United States Patent 11,332,783 (SAMPLE ANALYSIS, PRESENCE DETERMINATION OF A TARGET SEQUENCE) - sequence listing, part 8

SEQ ID NO: 145371 - DNA, 75 bp, Artificial Sequence
  Synthetic
atccatcccttccccccgagtgtcgcccaggaatggcgggaccccactcaactggggtccgcgttccatcctttc

SEQ ID NO: 145372 - DNA, 75 bp, Artificial Sequence
  Synthetic
cggtcctggtgaagggggactccgggacgccttgcatgctggggacgaagccgcccccgggcgctcccctcgatc

SEQ ID NO: 145373 - DNA, 75 bp, Artificial Sequence
  Synthetic
ccgcccccgggcgctcccctcgatccaccttcgagggggttcacacccccaaccggcgggccggctactcttctt

SEQ ID NO: 145374 - DNA, 75 bp, Artificial Sequence
  Synthetic
tcccttctctcgtcttcctcggccaacctcttaagttcctcttcttcttccctgctgaggttcttccctcccgcg

SEQ ID NO: 145375 - DNA, 75 bp, Artificial Sequence
  Synthetic
tctccatccttatccttctttccgagaattcctttgatgtttcccagccagggattttcgtcctcaagtctcttg

SEQ ID NO: 145376 - DNA, 75 bp, Artificial Sequence
  Synthetic
tatcccggggaactcggcgaatcgtccccatctagcagagcccggacccccttccaaaagagaccggagggggtg

SEQ ID NO: 145377 - DNA, 75 bp, Artificial Sequence
  Synthetic
actgagaacactcgggcccggtcgggtccatgggatgctcttcccgattccgtcaaacccttcccccgaggggtc

SEQ ID NO: 145378 - DNA, 75 bp, Artificial Sequence
  Synthetic
gtccatgggatgctcttcccgattccgtcaaacccttcccccgaggggtcccccagtggatgacgagaacccact

SEQ ID NO: 145379 - DNA, 75 bp, Artificial Sequence
  Synthetic
tcggtaatggcaaatgggacccaaaactctctttatcttccaaaagaaaagcaagaaaaaactggctctccctta

SEQ ID NO: 145380 - DNA, 75 bp, Artificial Sequence
  Synthetic
gggagaaaagggtggatcggatgggaagagtagatcccatgggaatccgctggttcccctgatgtccagtccctc

SEQ ID NO: 145381 - DNA, 75 bp, Artificial Sequence
  Synthetic
ttttcctttcctcgtcttccccggtcaacctcttaagttcctcttcttcttccttgctgaggctcttccctcccg

SEQ ID NO: 145382 - DNA, 75 bp, Artificial Sequence
  Synthetic
tccttgctgaggctcttccctcccgagctgagctgcttcttcttgttcttgagggccttccttcgtcggtgatcc

SEQ ID NO: 145383 - DNA, 75 bp, Artificial Sequence
  Synthetic
tgagtttcttctttgtcttccggaggtctctctcgagttcctctaacttctttcttccggccacccactgctcga

SEQ ID NO: 145384 - DNA, 75 bp, Artificial Sequence
  Synthetic
catgagccatctccgaacgaaggatcgcgccgggggcggatcaggacaccgagagggatcaataccaagagcggg

SEQ ID NO: 145385 - DNA, 75 bp, Artificial Sequence
  Synthetic
cgcgccgggggcggatcaggacaccgagagggatcaataccaagagcgggggatcgtcggagaaaagttccccaa

SEQ ID NO: 145386 - DNA, 75 bp, Artificial Sequence
  Synthetic
gagagggatcaataccaagagcgggggatcgtcggagaaaagttccccaagaaggacaaaagagccaagaagaga

SEQ ID NO: 145387 - DNA, 75 bp, Artificial Sequence
  Synthetic
gccttgcatgctggggacgaagccgcccccgggcgctcccctcggtccaccttcggaggggttcacccccaaccg

SEQ ID NO: 145388 - DNA, 75 bp, Artificial Sequence
  Synthetic
cgacgggccgtgctcttcttttttcctttcctcgtcttcccgggtcaacctcttaagttcctcttcttcctcctt

SEQ ID NO: 145389 - DNA, 75 bp, Artificial Sequence
  Synthetic
tgggccgcttccggcaagaggggccgaaagtgtgaagggagagaccgctccgagagttgggagaagaaagagagc

SEQ ID NO: 145390 - DNA, 75 bp, Artificial Sequence
  Synthetic
gcgaagaaaagaaggggagtccccgatcgaatgtccataggcagagaaacctctggagtcctctagaccgcaagg

SEQ ID NO: 145391 - DNA, 75 bp, Artificial Sequence
  Synthetic
catccagaggaccccttcagcgaacagaagaccctggtaccgggggggaataggccatagtacgaggggagatgc

SEQ ID NO: 145392 - DNA, 75 bp, Artificial Sequence
  Synthetic
ctcgagaatcggcaaatggggcccctcgctcgtatctccgagaggagacgagaaggaggtggatctccctttgcc

SEQ ID NO: 145393 - DNA, 75 bp, Artificial Sequence
  Synthetic
ccgcgggccggctactcttctttctctttcgtcgtcatccctggccagcctccggagttcctcttcttcctctcg

SEQ ID NO: 145394 - DNA, 75 bp, Artificial Sequence
  Synthetic
catcgggttggctcatcctgagaccggggagcttcgacgatctcttgtctctcctgaaggaggaaggagctctcg

SEQ ID NO: 145395 - DNA, 75 bp, Artificial Sequence
  Synthetic
accggggagcttcgacgatctcttgtctctcctgaaggaggaaggagctctcgaacgctctcccgaccgctcgga

SEQ ID NO: 145396 - DNA, 75 bp, Artificial Sequence
  Synthetic
atgggcccacttccgaacgaagattgcgcgaggagcaggatcagcgaccgagaggggtaggtggtaaagagcatt

SEQ ID NO: 145397 - DNA, 75 bp, Artificial Sequence
  Synthetic
gcgcgaggagcaggatcagcgaccgagaggggtaggtggtaaagagcattggaacgtcgggggaacactcccaag

SEQ ID NO: 145398 - DNA, 75 bp, Artificial Sequence
  Synthetic
ggaacgtcgggggaacactcccaagaaggaaaagagaaagcaagaatcggaagagttccccaagacgctgggaac

SEQ ID NO: 145399 - DNA, 75 bp, Artificial Sequence
  Synthetic
tgagagtacccagagggaggaatccactcggagaaaagccgacaaatcacctccagaggacccgttcagcgaaca

SEQ ID NO: 145400 - DNA, 75 bp, Artificial Sequence
  Synthetic
acatagcagtttccaggatccccttccaaaatggtccgaggggggtggcttagagcataggggaccagtggagcc

SEQ ID NO: 145401 - DNA, 75 bp, Artificial Sequence
  Synthetic
ccaaaatggtccgaggggggtggcttagagcataggggaccagtggagccatgggatgctcctcccgatgtccga

SEQ ID NO: 145402 - DNA, 75 bp, Artificial Sequence
  Synthetic
ttcactggggtcgacaactctggggagaaaagggaggatcggctgggaagagtatatccaatgggaatccctggt

SEQ ID NO: 145403 - DNA, 75 bp, Artificial Sequence
  Synthetic
ttcactggggtcgacaactctggggagaaaagggaggatcggctgggaagagtatatcctatgggaatccctggt

SEQ ID NO: 145404 - DNA, 75 bp, Artificial Sequence
  Synthetic
ttcactggggtcgacaactctggggagaaaagggaggatcggctgggaagagtatatcccatgggaatccctggt

SEQ ID NO: 145405 - DNA, 75 bp, Artificial Sequence
  Synthetic
ttcactggggtcgacaactctggggagaaaagggaggatcggctgggaagagtatatccgatgggaatccctggt

SEQ ID NO: 145406 - DNA, 75 bp, Artificial Sequence
  Synthetic
ttccccttatgtccagcccctccccggtcctggagaagggggactccggaacaccttgcatgttgggagcgaagc

SEQ ID NO: 145407 - DNA, 75 bp, Artificial Sequence
  Synthetic
ccccttaagttcctcttcttcctccctgctgagcttcttccctccggctgccagttgcttccttttgttctcgag

SEQ ID NO: 145408 - DNA, 75 bp, Artificial Sequence
  Synthetic
cctctcgagttcctctaacttctttcttccacacacccactgctcgagaagctcttctctgcttccgcgattttt

SEQ ID NO: 145409 - DNA, 75 bp, Artificial Sequence
  Synthetic
acaagaggcggggctccctagttctcttactcttttctgtaaagaggagatgtgggagtccccgcccaagttcga

SEQ ID NO: 145410 - DNA, 75 bp, Artificial Sequence
  Synthetic
atgggccgttgccggcgaacgagcccgaagtgcgagtgggggagaactcccgagagttgggagacagaaagagag

SEQ ID NO: 145411 - DNA, 75 bp, Artificial Sequence
  Synthetic
gacagaggagcccccatgacgctggtgaaccatcgcgagctgggagaggagtggcgaagctagcggcggagaccc

SEQ ID NO: 145412 - DNA, 75 bp, Artificial Sequence
  Synthetic
tgaaccatcgcgagctgggagaggagtggcgaagctagcggcggagaccccggtccgaatgcccgtcggcagcaa

SEQ ID NO: 145413 - DNA, 75 bp, Artificial Sequence
  Synthetic
cggtccgaatgcccgtcggcagcaaactcctctggagtccttcggatttaaaggagaaaactaccggcggagggt

SEQ ID NO: 145414 - DNA, 75 bp, Artificial Sequence
  Synthetic
gatccacccggagctgaacggacaagccacatccagaggaccccttcggcgaacagaaggccctggaccggggag

SEQ ID NO: 145415 - DNA, 75 bp, Artificial Sequence
  Synthetic
tcccttagcatcggaatcccgggccccctcccaggaatgggaacagggggagatcgaccgggtcccgcagaaccc

SEQ ID NO: 145416 - DNA, 75 bp, Artificial Sequence
  Synthetic
gatggagttccccaccatccctcaccggagaaaactggtcccgaatggggcacccacaataggatggcaggaggg

SEQ ID NO: 145417 - DNA, 75 bp, Artificial Sequence
  Synthetic
ccctcgctcgtatctccgagaggagacgagaaggaggtggatctccctttgccatccgagggaactacgttctcc

SEQ ID NO: 145418 - DNA, 75 bp, Artificial Sequence
  Synthetic
aactccctgcaggttgggcacgaagcccccaccgggcgctcccctcggcgggccgtccattgggttcacaccccc

SEQ ID NO: 145419 - DNA, 75 bp, Artificial Sequence
  Synthetic
gggccttccttcttctgtggtcccgcctctcctggtcggtgaaccccctggccttgggtttcctcccaggtccga

SEQ ID NO: 145420 - DNA, 75 bp, Artificial Sequence
  Synthetic
cctctcctggtcggtgaaccccctggccttgggtttcctcccaggtccgaaatcaacctccatggtttcctgcct

SEQ ID NO: 145421 - DNA, 75 bp, Artificial Sequence
  Synthetic
gggcctcttcgccgggggtcctccgtcttcgtccttcttccttctcaacagtccgacgatgtttcccagccaggg

SEQ ID NO: 145422 - DNA, 75 bp, Artificial Sequence
  Synthetic
tcttcgtccttcttccttctcaacagtccgacgatgtttcccagccaggggttttcatcctcaagtttcttgatc

SEQ ID NO: 145423 - DNA, 75 bp, Artificial Sequence
  Synthetic
gtccgacgatgtttcccagccaggggttttcatcctcaagtttcttgatcttcttgttggttcgccggagatcct

SEQ ID NO: 145424 - DNA, 75 bp, Artificial Sequence
  Synthetic
agatcggggagcctcgacgatctctttgatctcctgaaggaggaaggagctctcgagcgctctcccgctcctcgg

SEQ ID NO: 145425 - DNA, 75 bp, Artificial Sequence
  Synthetic
aaccgaagcgaggaggaaagcaaagaaagcaacggggctagcgagtggatgttcctccccccgagtggtcccgag

SEQ ID NO: 145426 - DNA, 75 bp, Artificial Sequence
  Synthetic
acccccgaaaggaggggggtgggccttggacctccgggagccatgggatccgtggagtacccgggccatcccctt

SEQ ID NO: 145427 - DNA, 75 bp, Artificial Sequence
  Synthetic
gtcctggctctcttcgccgggggagctccctccccgtccttgtcctttcttattattcctcggatgttccccagc

SEQ ID NO: 145428 - DNA, 75 bp, Artificial Sequence
  Synthetic
tctcggctgaggcgctttcctcctccggccagttgcttcttcttgttctccagggccttccttcttctgtggtcc

SEQ ID NO: 145429 - DNA, 75 bp, Artificial Sequence
  Synthetic
cggccagttgcttcttcttgttctccagggccttccttcttctgtggtcccgcctctcctggtcggtgaaccccc

SEQ ID NO: 145430 - DNA, 75 bp, Artificial Sequence
  Synthetic
atgggccgcttccggcgaacgagcccgaagagcgagtgggggagaactcccgagagttgggagacagaaagaggg

SEQ ID NO: 145431 - DNA, 75 bp, Artificial Sequence
  Synthetic
cgaagagcgagtgggggagaactcccgagagttgggagacagaaagagggcgagtgatctcggaaggaatccccc

SEQ ID NO: 145432 - DNA, 75 bp, Artificial Sequence
  Synthetic
cgagagttgggagacagaaagagggcgagtgatctcggaaggaatcccccaagctgccaacagaggaagaaacaa

SEQ ID NO: 145433 - DNA, 75 bp, Artificial Sequence
  Synthetic
aaggagaaaactaccggcggagggtgatccactcggagttggacgggaaaagcacatccagaggaccccttcgac

SEQ ID NO: 145434 - DNA, 75 bp, Artificial Sequence
  Synthetic
gatccactcggagttggacgggaaaagcacatccagaggaccccttcgacgaacagaaggatctggtaccgggga

SEQ ID NO: 145435 - DNA, 75 bp, Artificial Sequence
  Synthetic
ggaatagcccatagtacaaggggagatgctaggagtcaggggaagccagaacgactgagaaagaaaagagagcaa

SEQ ID NO: 145436 - DNA, 75 bp, Artificial Sequence
  Synthetic
ctcccttagcatcggagacccgggccccctcccaggaaagggaacagggggaaatcgaccgggtcccgcagaacc

SEQ ID NO: 145437 - DNA, 75 bp, Artificial Sequence
  Synthetic
cgatggagtcccccaccatcccttccggatgaaactggtcccgataggggcacccacaataggatggcaaaaggg

SEQ ID NO: 145438 - DNA, 75 bp, Artificial Sequence
  Synthetic
acgagaaagaggaggatctccctttgccatccgagggaactacgttctccttcggatgcccaggtcggaccgcga

SEQ ID NO: 145439 - DNA, 75 bp, Artificial Sequence
  Synthetic
ggaggtggagataccatgccgacccgaagaaggaaaggaggacacggacgacaaaccgtaggtactcttgccctt

SEQ ID NO: 145440 - DNA, 75 bp, Artificial Sequence
  Synthetic
tctctttcgtcgtcatccttggctagcctctggagttcctcttcttcctcttggctgaggcgctttcctcctccg

SEQ ID NO: 145441 - DNA, 75 bp, Artificial Sequence
  Synthetic
gttttcatcctcaagtttcttgatcttcttgttggatcgccggagatccttctcgagcagtcgccttttcttcct

SEQ ID NO: 145442 - DNA, 75 bp, Artificial Sequence
  Synthetic
catgagccaagtgccgaacgaggagaacgcgaaaggaaggatcagaggacgagaggggtgagatggtaaagaaac

SEQ ID NO: 145443 - DNA, 75 bp, Artificial Sequence
  Synthetic
ggggatcgccgaggagatgtctcccaagaaggccaaaagagaatacaagagtcggaagctttccccataacgctg

SEQ ID NO: 145444 - DNA, 75 bp, Artificial Sequence
  Synthetic
gtcggaagctttccccataacgctggagacatctcggaaggggaaagaggacagatggaagagaagggggggccc

SEQ ID NO: 145445 - DNA, 75 bp, Artificial Sequence
  Synthetic
agggttgagaacaccagagggaggaacacactcggagatagaacagagaaatcacctccagaaggaccccttcag

SEQ ID NO: 145446 - DNA, 75 bp, Artificial Sequence
  Synthetic
gaagcgaggaggaaagtaaagaaagcaacggggctagccgtcaggtgttccaccccccgagaggggacgagtgag

SEQ ID NO: 145447 - DNA, 75 bp, Artificial Sequence
  Synthetic
gcttatcccggggaactcggcgaatcgtccccacatagcagagcccaggacccccttccaaagtgaccgaggggg

SEQ ID NO: 145448 - DNA, 75 bp, Artificial Sequence
  Synthetic
gagccatgggatgcccttcccgattccgtccatccctcccccccaagggtcgcccaggaatggcgggaccccact

SEQ ID NO: 145449 - DNA, 75 bp, Artificial Sequence
  Synthetic
tcggtaatggcgaatgggacccagaaatctctctagattccgatagagaatcgagagaaaactggctctccctta

SEQ ID NO: 145450 - DNA, 75 bp, Artificial Sequence
  Synthetic
cgggccctcttcgccgggggagccccctctccgtccttatccttctttccgagaattcctttgatgtttcccagc

SEQ ID NO: 145451 - DNA, 75 bp, Artificial Sequence
  Synthetic
cagggattatcgtcctcaagtttcttgattttcttctttatcttccggaggtctctctccagatcctcggctctt

SEQ ID NO: 145452 - DNA, 75 bp, Artificial Sequence
  Synthetic
catgggccatctccatgcgaaaatggcgcgctggaaggatcagctcccgagaggggtaaaccggtaaagagcatt

SEQ ID NO: 145453 - DNA, 75 bp, Artificial Sequence
  Synthetic
gcgcgctggaaggatcagctcccgagaggggtaaaccggtaaagagcattggaacgccgagggtgagtctcccaa

SEQ ID NO: 145454 - DNA, 75 bp, Artificial Sequence
  Synthetic
gacatcctggaaggggaaagagggaaggtggaaaagaaggggcgggcctcccgatccgaggggcccaactaccaa

SEQ ID NO: 145455 - DNA, 75 bp, Artificial Sequence
  Synthetic
ccgatccgaggggcccaactaccaagtttggagagcactccggccgaagggtcgaggtacccagaaggaggaatc

SEQ ID NO: 145456 - DNA, 75 bp, Artificial Sequence
  Synthetic
cctgttcgccgggggagccggctctccatccttatgattctttccaaaaattccgataatgtttcccaaccaggg

SEQ ID NO: 145457 - DNA, 75 bp, Artificial Sequence
  Synthetic
ccatccttatgattctttccaaaaattccgataatgtttcccaaccagggatattcgtcctcaagtatcttgata

SEQ ID NO: 145458 - DNA, 75 bp, Artificial Sequence
  Synthetic
ttcttcttaatcttccggaggtccctctcaagttcctctaacattcttcttccgttcacccactgctcgaggatc

SEQ ID NO: 145459 - DNA, 75 bp, Artificial Sequence
  Synthetic
catgagccaattccgaacgaagagagcgcgaggggaaggatcagctcccgagagggagtcgtggtaaagaatggg

SEQ ID NO: 145460 - DNA, 75 bp, Artificial Sequence
  Synthetic
gcgcgaggggaaggatcagctcccgagagggagtcgtggtaaagaatgggggaaagttcggagggctctcccaag

SEQ ID NO: 145461 - DNA, 75 bp, Artificial Sequence
  Synthetic
agagggagtcgtggtaaagaatgggggaaagttcggagggctctcccaagaaggtcaagagaagcaaggaaacgg

SEQ ID NO: 145462 - DNA, 75 bp, Artificial Sequence
  Synthetic
aagcatttccccataacgctggaagacttcctggaatggggagaaagagggatggaaagaaaggagcgagccctc

SEQ ID NO: 145463 - DNA, 75 bp, Artificial Sequence
  Synthetic
acttcctggaatggggagaaagagggatggaaagaaaggagcgagccctccgatccgaggggcccaaccaccgaa

SEQ ID NO: 145464 - DNA, 75 bp, Artificial Sequence
  Synthetic
tttggagagcacttccggccgaatggtcgagtagcactcagagggagaaatccacacggagaaagcagacaaatc

SEQ ID NO: 145465 - DNA, 75 bp, Artificial Sequence
  Synthetic
gtcgagtagcactcagagggagaaatccacacggagaaagcagacaaatcacctccagaggaccccttcagcgaa

SEQ ID NO: 145466 - DNA, 75 bp, Artificial Sequence
  Synthetic
cagaagagctctcggagcgtagagcaagaccgtagcgatggggggagatgctaggagtagggcggagaccgaagc

SEQ ID NO: 145467 - DNA, 75 bp, Artificial Sequence
  Synthetic
aagaccgtagcgatggggggagatgctaggagtagggcggagaccgaagcgaggaggaaagcaaagaaagcaacg

SEQ ID NO: 145468 - DNA, 75 bp, Artificial Sequence
  Synthetic
gggctagccgtcagtgttccgccccccgagaggggacgagtgaggcttatcccggggaacgcgccgaatcgtccc

SEQ ID NO: 145469 - DNA, 75 bp, Artificial Sequence
  Synthetic
ccgagaggggacgagtgaggcttatcccggggaacgcgccgaatcgtccccatctagcagctcccggaccccctt

SEQ ID NO: 145470 - DNA, 75 bp, Artificial Sequence
  Synthetic
ccaaaatgaccaagagagggtggcttggagcgcggaggaccgtgggggtccgtgggatgctcctcccgattccgt

SEQ ID NO: 145471 - DNA, 75 bp, Artificial Sequence
  Synthetic
cgtgggatgctcctcccgattccgtccatcccctcccccagcgcgtccccccaggaatagcgggaccccacttca

SEQ ID NO: 145472 - DNA, 75 bp, Artificial Sequence
  Synthetic
gtctacctccatccggtctgttcgggccctcttcgccgggggagctccctccccatccttgtctttctttcccaa

SEQ ID NO: 145473 - DNA, 75 bp, Artificial Sequence
  Synthetic
aattcctttgatgtttcccagccagggattttcttcctctagtttcttgatcttcttcttggtcttccggaggtc

SEQ ID NO: 145474 - DNA, 75 bp, Artificial Sequence
  Synthetic
ggattttcttcctctagtttcttgatcttcttcttggtcttccggaggtccctctcgagttcctcctgctttctt

SEQ ID NO: 145475 - DNA, 75 bp, Artificial Sequence
  Synthetic
cttccagcgacccactgctcgagaacctcttctcttcccccgcggttcttcttcgattcggaccggctcatctcg

SEQ ID NO: 145476 - DNA, 75 bp, Artificial Sequence
  Synthetic
acgagggcgagcggtcctcagtgctcttactcttttctgtaaagaggagactgctggactcgctgcccgggtttc

SEQ ID NO: 145477 - DNA, 75 bp, Artificial Sequence
  Synthetic
catgagccaagtccgagcgaagagaacgcgttgggaaagatcagtgaccgagaggggtcaatggtaaagaggcga

SEQ ID NO: 145478 - DNA, 75 bp, Artificial Sequence
  Synthetic
acgcgttgggaaagatcagtgaccgagaggggtcaatggtaaagaggcgaagtatcccggagagatactctccta

SEQ ID NO: 145479 - DNA, 75 bp, Artificial Sequence
  Synthetic
agagggggaagagaatccaagagacggacgagctcccctacgacgctggaacatccctggaaggggaaagaggaa

SEQ ID NO: 145480 - DNA, 75 bp, Artificial Sequence
  Synthetic
tatcccggggaactcggcgaatcgtccccacatagcaagagcccggggccccttcaaaagtgaccgaggggggtg

SEQ ID NO: 145481 - DNA, 75 bp, Artificial Sequence
  Synthetic
ctaggaacatagggagccactggagccatgggatgctcctcccgattccgtccatcccttcccccagggggtcgc

SEQ ID NO: 145482 - DNA, 75 bp, Artificial Sequence
  Synthetic
ccatgggatgctcctcccgattccgtccatcccttcccccagggggtcgcccaggaatggcgggacctcactcga

SEQ ID NO: 145483 - DNA, 75 bp, Artificial Sequence
  Synthetic
ccttcgagggggttcacacctccagtcggcgggccggctgctcttctttcccttctctcgtcttcctcggtcaac

SEQ ID NO: 145484 - DNA, 75 bp, Artificial Sequence
  Synthetic
tttcttcttctccttccggaggtctctttcgagatcttctaacctttttcttccattcacccacttctcgaggac

SEQ ID NO: 145485 - DNA, 75 bp, Artificial Sequence
  Synthetic
ttccattcacccacttctcgaggacctcttctcttccctcgcgcttcttcttctgctcggcgcggctcatctcga

SEQ ID NO: 145486 - DNA, 75 bp, Artificial Sequence
  Synthetic
gatgggccgcagttcccgacgaggagcccgcaagtgggaggatcagccaccggaggggacacgatgccaaagagt

SEQ ID NO: 145487 - DNA, 75 bp, Artificial Sequence
  Synthetic
cggaggggacacgatgccaaagagtgggggaaatctcggagggtgatcccaagaaggccaaagaagattcaagcg

SEQ ID NO: 145488 - DNA, 75 bp, Artificial Sequence
  Synthetic
gaatcgggagaaaactggctctcccttagccatccgagtggacgttgtcctccttcggatgcccaggtcggaccg

SEQ ID NO: 145489 - DNA, 75 bp, Artificial Sequence
  Synthetic
catgggccacctccgagcgaagggagcgcgctggaaggatcagctcccgagaggggtaaaacggtaaagagcatt

SEQ ID NO: 145490 - DNA, 75 bp, Artificial Sequence
  Synthetic
ggaactctgaaggtaattcccccaagaagaaaaaaagagaaaacaagagacgggcgatctccctatgacgctgga

SEQ ID NO: 145491 - DNA, 75 bp, Artificial Sequence
  Synthetic
ccgatccgaggggcccaacggccaagtttggagagcactccggccgaaggatcgaggtacccagaaggaggaatc

SEQ ID NO: 145492 - DNA, 75 bp, Artificial Sequence
  Synthetic
caaagcgatcgaggggggtggcttggaacacaggggaccagtggagccatgggatgctcctcccgatgtccgtcc

SEQ ID NO: 145493 - DNA, 75 bp, Artificial Sequence
  Synthetic
tccgttcacccactgctcgaggatctcttctcttccgtcgcgtttcttcttcgactcggaacggctcatctcgac

SEQ ID NO: 145494 - DNA, 75 bp, Artificial Sequence
  Synthetic
atgagccaacttccgagcgaaggaacgcgggggaaggatcagcgcccgagagggagtggaaggtaaagagcattg

SEQ ID NO: 145495 - DNA, 75 bp, Artificial Sequence
  Synthetic
agggagtggaaggtaaagagcattggaacgccgaggggacacctcccaagaagtccaagagaaggcaagaatcgg

SEQ ID NO: 145496 - DNA, 75 bp, Artificial Sequence
  Synthetic
gaacgccgaggggacacctcccaagaagtccaagagaaggcaagaatcggacgctttccccatgacgctggaagt

SEQ ID NO: 145497 - DNA, 75 bp, Artificial Sequence
  Synthetic
cgtcctggaaggggaaagaggatgggtggaaaagaaggggcgggcctcccgatccgaggagcccggcctccagga

SEQ ID NO: 145498 - DNA, 75 bp, Artificial Sequence
  Synthetic
gtggaaaagaaggggcgggcctcccgatccgaggagcccggcctccaggatttggagggcactccgggccgaagg

SEQ ID NO: 145499 - DNA, 75 bp, Artificial Sequence
  Synthetic
acagaagagccttgcacgggataggagtaagaccatagcgatggggggagatgctaggagtaggaggagaccgaa

SEQ ID NO: 145500 - DNA, 75 bp, Artificial Sequence
  Synthetic
agtaagaccatagcgatggggggagatgctaggagtaggaggagaccgaagcgaggaggaaagtaaagagagcaa

SEQ ID NO: 145501 - DNA, 75 bp, Artificial Sequence
  Synthetic
atgctaggagtaggaggagaccgaagcgaggaggaaagtaaagagagcaacggggctagccgtcaggtgttccac

SEQ ID NO: 145502 - DNA, 75 bp, Artificial Sequence
  Synthetic
ccccacatagcagagcccaggacccccttccaaaaaggaaccgaggggggtggctaggaccgtgggggaccaacg

SEQ ID NO: 145503 - DNA, 75 bp, Artificial Sequence
  Synthetic
gagccatgggatgctcttcccgattccgtccaaccctcccccaggagggtcgcccaggaatggcgggaccccact

SEQ ID NO: 145504 - DNA, 75 bp, Artificial Sequence
  Synthetic
ctctccatccttatccttctttccgagaattcctttgacgtttcccagccagggattgtcgtcctcaagtttctt

SEQ ID NO: 145505 - DNA, 75 bp, Artificial Sequence
  Synthetic
tccctctcgagttcctctaactcctttcttcctttcacccactgctcgagaacctcttctcttcctccgcgcctc

SEQ ID NO: 145506 - DNA, 75 bp, Artificial Sequence
  Synthetic
catgagccaagagccgggcgaggagaacgcgggggaaggatcggcgaccgagaggggatgaactggtaagaggcg

SEQ ID NO: 145507 - DNA, 75 bp, Artificial Sequence
  Synthetic
aacgcgggggaaggatcggcgaccgagaggggatgaactggtaagaggcggggaacgccgaggggatatctccca

SEQ ID NO: 145508 - DNA, 75 bp, Artificial Sequence
  Synthetic
agaggggatgaactggtaagaggcggggaacgccgaggggatatctcccaagagggcaaggagaagacaagaatc

SEQ ID NO: 145509 - DNA, 75 bp, Artificial Sequence
  Synthetic
ggacgactccccctatgacgctaaagacatcctggaaggggaaagaggagggtggaaaagaaaggggcgggcctc

SEQ ID NO: 145510 - DNA, 75 bp, Artificial Sequence
  Synthetic
ccgctccgaggggcccggcggccaacctggaaagcactccggcccgaagggttgagtagcacccagagggaggaa

SEQ ID NO: 145511 - DNA, 75 bp, Artificial Sequence
  Synthetic
cctggaaagcactccggcccgaagggttgagtagcacccagagggaggaatccactcggagtgaacagagaaatc

SEQ ID NO: 145512 - DNA, 75 bp, Artificial Sequence
  Synthetic
gggctagccgtcaggtgttccgccccccgagaggggaagagtgaggcatatcccggggaactcgacttagcgtcc

SEQ ID NO: 145513 - DNA, 75 bp, Artificial Sequence
  Synthetic
acatctagcagttcccggggcccctctcgaaagggatcgaggggggagctaggaacgcggggtgggccgcggggc

SEQ ID NO: 145514 - DNA, 75 bp, Artificial Sequence
  Synthetic
aggaacgcggggtgggccgcggggccatgggatgctcctcccgattccgtccaacccccaccccaaaagggtcgc

SEQ ID NO: 145515 - DNA, 75 bp, Artificial Sequence
  Synthetic
ccaggaatggcgggaccccactctgtcggggtccgcgttccatcctttcttacctgatggccggcagggtcccag

SEQ ID NO: 145516 - DNA, 75 bp, Artificial Sequence
  Synthetic
tacctgatggccggcagggtcccagcctccccgctggcgccggctgggcaacattccaaggggacagtccctcgg

SEQ ID NO: 145517 - DNA, 75 bp, Artificial Sequence
  Synthetic
caatggcaaagggaacccaaaaatctctctaaattccaataaaaaatcaaaagaaaacgggttctcccttaccca

SEQ ID NO: 145518 - DNA, 75 bp, Artificial Sequence
  Synthetic
ttcactggggtcgacaactctggggagagaagggtggatcggatgggaagagtatatcctatgggaatccccggt

SEQ ID NO: 145519 - DNA, 75 bp, Artificial Sequence
  Synthetic
tcttcttccttgtcttccggaggtccctctcgagctcctctaacctttttcttccattcacccactgctcgagaa

SEQ ID NO: 145520 - DNA, 75 bp, Artificial Sequence
  Synthetic
gagaaatcacctccagaggaccccttcagcgaacagagaagccccttctcggcgggagtaagaccatagcgatgg

SEQ ID NO: 145521 - DNA, 75 bp, Artificial Sequence
  Synthetic
cccttccgaacgagggggacggtccttgaactcccaggggtcccatggatccgtgggaatcccagcactcccctc

SEQ ID NO: 145522 - DNA, 75 bp, Artificial Sequence
  Synthetic
ggagtggaaggcggggagaggggggctcgggaccaacctacgggaattcctgagttcccctggcgtccaggccgt

SEQ ID NO: 145523 - DNA, 75 bp, Artificial Sequence
  Synthetic
atgggccacagttccgagcgaagagacgcggggggaggatcagcgcccgagagggagtaatcggcaaagagcatt

SEQ ID NO: 145524 - DNA, 75 bp, Artificial Sequence
  Synthetic
acgcggggggaggatcagcgcccgagagggagtaatcggcaaagagcattggatcgtcgtcgggattctcccaag

SEQ ID NO: 145525 - DNA, 75 bp, Artificial Sequence
  Synthetic
gagggagtaatcggcaaagagcattggatcgtcgtcgggattctcccaagaaggaacaagagaggacaagaaacg

SEQ ID NO: 145526 - DNA, 75 bp, Artificial Sequence
  Synthetic
gaagaatttccccatgacgccggagaatctttggaaggggaaagaggccagatggaaaaaagagggggggcctcc

SEQ ID NO: 145527 - DNA, 75 bp, Artificial Sequence
  Synthetic
aatctttggaaggggaaagaggccagatggaaaaaagagggggggcctcccgatccgaggggcccaaccaccaag

SEQ ID NO: 145528 - DNA, 75 bp, Artificial Sequence
  Synthetic
acagaagagcgcttcgtgcggtaggagtaagaccatagcgataggaagggatgctaggagttaggggagaccgaa

SEQ ID NO: 145529 - DNA, 75 bp, Artificial Sequence
  Synthetic
cttccaaaaagactgaggggggtggcttgggacctggaggaccagtggagccatgggatgctccttccgatgctc

SEQ ID NO: 145530 - DNA, 75 bp, Artificial Sequence
  Synthetic
cttgggacctggaggaccagtggagccatgggatgctccttccgatgctcgatccctccctcccccccgggtgtc

SEQ ID NO: 145531 - DNA, 75 bp, Artificial Sequence
  Synthetic
gaattcctttgatgttccccagccagggattttcatcctctagtttcttgattttcttcttgaccttccggaggt

SEQ ID NO: 145532 - DNA, 75 bp, Artificial Sequence
  Synthetic
attttcttcttgaccttccggaggtccctctcgagatcctctaacttctttcttccgattatccactgctcgaga

SEQ ID NO: 145533 - DNA, 75 bp, Artificial Sequence
  Synthetic
ccctctcgagatcctctaacttctttcttccgattatccactgctcgagaacctcttctctccctccgcggtgct

SEQ ID NO: 145534 - DNA, 75 bp, Artificial Sequence
  Synthetic
tcttcgactcggaccggctcatctcgacaaggggcggcggtcctcagtactctcaatctttttcgataaagagga

SEQ ID NO: 145535 - DNA, 75 bp, Artificial Sequence
  Synthetic
gacaaggggcggcggtcctcagtactctcaatctttttcgataaagaggagactgctggacccgccgcccaagtt

SEQ ID NO: 145536 - DNA, 75 bp, Artificial Sequence
  Synthetic
tgaggagggatccccgagacgctggaggagcaccgggaaaaagaaaagaaggcaaggaattggtagaaaagagcg

SEQ ID NO: 145537 - DNA, 75 bp, Artificial Sequence
  Synthetic
cccccaaaaggaggggggtgggccttggacctccaggagccatgggatccgtggagtacccgggatatcccttct

SEQ ID NO: 145538 - DNA, 75 bp, Artificial Sequence
  Synthetic
ccagcctcctcgctggcgccggctgggcaacattccgaaggggaccgtccctcggtaatggcgaatgggacccag

SEQ ID NO: 145539 - DNA, 75 bp, Artificial Sequence
  Synthetic
ctggctctcttcgccgggggagctccctccccatccttgtcctttcttattattcctcggatgttccccagccag

SEQ ID NO: 145540 - DNA, 75 bp, Artificial Sequence
  Synthetic
agagggcggacggtcctgagaactcttatcttcctgcttagaagaggagtctcctggacgcttccgcccgctcgg

SEQ ID NO: 145541 - DNA, 75 bp, Artificial Sequence
  Synthetic
gatgagcctcagtgccgacgaggaatccgcaggtgggaggatcaaccggagagggcgcgatggtaagagtggagg

SEQ ID NO: 145542 - DNA, 75 bp, Artificial Sequence
  Synthetic
aaagttcggagggaaatcccaagagggtcactcgagattcaagaggtgaggagggatccccgagacgctgaggaa

SEQ ID NO: 145543 - DNA, 75 bp, Artificial Sequence
  Synthetic
ggtcactcgagattcaagaggtgaggagggatccccgagacgctgaggaagttccgggaaaaaaagaaaaaaagg

SEQ ID NO: 145544 - DNA, 75 bp, Artificial Sequence
  Synthetic
gtggaaggcggggagaggggcgcccagggtcaacctacggaaatccctgagttcctcggatgtccaggccgtccc

SEQ ID NO: 145545 - DNA, 75 bp, Artificial Sequence
  Synthetic
tctcgagttcctcctttcttcttcttccatcgatccacttcccgagtgtctcttctctccccctccgggctttcc

SEQ ID NO: 145546 - DNA, 75 bp, Artificial Sequence
  Synthetic
tcgcatcggactggctcattctcggagagggcggacggtcctgagaactcttatcttcctactcagaagaggagt

SEQ ID NO: 145547 - DNA, 75 bp, Artificial Sequence
  Synthetic
agagggcggacggtcctgagaactcttatcttcctactcagaagaggagtctcctggacatctccgcccactcgg

SEQ ID NO: 145548 - DNA, 75 bp, Artificial Sequence
  Synthetic
acagaagacctccagagcggcaggagtaagaccatagcgataggaggagatgctaggagtgaggggagtcccgag

SEQ ID NO: 145549 - DNA, 75 bp, Artificial Sequence
  Synthetic
ctaggaacagaggggtcgggtgggtccgtgggatgctcttcccgattccgccccaacccaccccccgagaggtcc

SEQ ID NO: 145550 - DNA, 75 bp, Artificial Sequence
  Synthetic
ctctctttagcttccaaaagagaagcaagagaaaactggctctcccttagccatccgaggtggacgttgtcctcc

SEQ ID NO: 145551 - DNA, 75 bp, Artificial Sequence
  Synthetic
ggttccccttatgtccagcccctccccggtccgagtgaagggggactccgggactccttgcatgctggggacgaa

SEQ ID NO: 145552 - DNA, 75 bp, Artificial Sequence
  Synthetic
tatggcccctataccgacgaggagtccgcaagattgaggatctgccaccggagagggacgcgatggtaagagtgg

SEQ ID NO: 145553 - DNA, 75 bp, Artificial Sequence
  Synthetic
ggagaacccacctccagaggaccccttcagcgaccagagaagctcctcccccgctggagtagacccgtaccgttg

SEQ ID NO: 145554 - DNA, 75 bp, Artificial Sequence
  Synthetic
gaagggattgttggaagttggggaagcccaaaccaagaaggaaaccaaagaaagcaccggggctagcaattggat

SEQ ID NO: 145555 - DNA, 75 bp, Artificial Sequence
  Synthetic
gctggctgtcttcgccgggggagctccctccccatccttgacctttcttattattcctcggatgttccatggcca

SEQ ID NO: 145556 - DNA, 75 bp, Artificial Sequence
  Synthetic
ccctccccatccttgacctttcttattattcctcggatgttccatggccagtgtttatcctcctgtagtctcttg

SEQ ID NO: 145557 - DNA, 75 bp, Artificial Sequence
  Synthetic
agattcttgttgatcttccggagcttcttttcgagtttctcctttcttcttcttccatcgatccattttccgagt

SEQ ID NO: 145558 - DNA, 75 bp, Artificial Sequence
  Synthetic
tcttttcgagtttctcctttcttcttcttccatcgatccattttccgagtgtcttttctctccccttcgggtgtc

SEQ ID NO: 145559 - DNA, 75 bp, Artificial Sequence
  Synthetic
tcctcgtatcggtctggctcatcctcaaaaagggcgcactgtcctgatttctcttatcttcctattcaaaagagg

SEQ ID NO: 145560 - DNA, 75 bp, Artificial Sequence
  Synthetic
caaaaagggcgcactgtcctgatttctcttatcttcctattcaaaagaggtgactcctgcacgcttccgccctct

SEQ ID NO: 145561 - DNA, 75 bp, Artificial Sequence
  Synthetic
tggaacgtcggagatacaactcccaagaaggaaaaaagagaaagcaagaagcggatgaatttccccataacgcca

SEQ ID NO: 145562 - DNA, 75 bp, Artificial Sequence
  Synthetic
ccaagtttggaggacactccggcccgaagggttgagagtaccccagagggaggaagccacacggagtagaacaga

SEQ ID NO: 145563 - DNA, 75 bp, Artificial Sequence
  Synthetic
aggaagccacacggagtagaacagagaaatcacctccagaggaccccttcagcgaacagagagcgcatcgcgaga

SEQ ID NO: 145564 - DNA, 75 bp, Artificial Sequence
  Synthetic
tgactttgaacattggggaccagtggagccatgggatgctcctcccgattccgcccaagctccttccccccaagg

SEQ ID NO: 145565 - DNA, 75 bp, Artificial Sequence
  Synthetic
ccccttatgtccagcccctccccggtcctggtgaagggggactccgggatgccttgcatgctggggacgaagccg

SEQ ID NO: 145566 - DNA, 75 bp, Artificial Sequence
  Synthetic
cctcttcgccgggggagccccctctccatccttatccttctttccgagaattcctttgatgtttcccagccaggg

SEQ ID NO: 145567 - DNA, 75 bp, Artificial Sequence
  Synthetic
ctgggccatctccgagcgaagggagcgcgctggaaggatcagctcccgagaggggaaaacggtaaagagcattgg

SEQ ID NO: 145568 - DNA, 75 bp, Artificial Sequence
  Synthetic
cgcgctggaaggatcagctcccgagaggggaaaacggtaaagagcattggatcgtcgaaggtgaggaccccaaga

SEQ ID NO: 145569 - DNA, 75 bp, Artificial Sequence
  Synthetic
aggaaaaaagagaaagcaagagacggacgatttccccacaacgctggagacatcctggaaggggaaaggagaagg

SEQ ID NO: 145570 - DNA, 75 bp, Artificial Sequence
  Synthetic
tggaaaagaaggggcgggcctcccgatccgaggggcccaactaccaagtttggagagcactccggccgaagggtc

SEQ ID NO: 145571 - DNA, 75 bp, Artificial Sequence
  Synthetic
agccgacggatgttccgcctcccgagaggggacgagtgaggcttatcccggggaactcggcagatcgcccccaca

SEQ ID NO: 145572 - DNA, 75 bp, Artificial Sequence
  Synthetic
cccctccccccgagtgtcgcccaggaatggcgggaccccactcaactggggtccgcgttccatcctttcttacct

SEQ ID NO: 145573 - DNA, 75 bp, Artificial Sequence
  Synthetic
gcccaggtcggaccgcggggaggtggagatgccatgccgacccgaagaggaaagaagaactcggacgcgaaccgt

SEQ ID NO: 145574 - DNA, 75 bp, Artificial Sequence
  Synthetic
ccggctactcttcttttcctttcctcgtcttcaacggtcaacctcctgagttcctcttcttcctccctgctgagg

SEQ ID NO: 145575 - DNA, 75 bp, Artificial Sequence
  Synthetic
ggattggctcatcctcggaacgaggcggaggtcctcagttctctctattctttcccttttgaaagaggagactgc

SEQ ID NO: 145576 - DNA, 75 bp, Artificial Sequence
  Synthetic
cggaggtcctcagttctctctattctttcccttttgaaagaggagactgctggaccaaacgcccgagccgggatg

SEQ ID NO: 145577 - DNA, 75 bp, Artificial Sequence
  Synthetic
ctgagccacttccgaacgaagattgcgcgggacaggatcagcggacgagaggggatatgtgctaaagaccattgg

SEQ ID NO: 145578 - DNA, 75 bp, Artificial Sequence
  Synthetic
cgcgggacaggatcagcggacgagaggggatatgtgctaaagaccattggaacgtcggaggaaatctcccaagaa

SEQ ID NO: 145579 - DNA, 75 bp, Artificial Sequence
  Synthetic
ggggatatgtgctaaagaccattggaacgtcggaggaaatctcccaagaaggaaagagggggagacaagagacgg

SEQ ID NO: 145580 - DNA, 75 bp, Artificial Sequence
  Synthetic
aagactctccccacaacgctggagacatcctggaaggggaaagaggacaggaggaaaagaaggagcgggcctccc

SEQ ID NO: 145581 - DNA, 75 bp, Artificial Sequence
  Synthetic
aagactctccccacaacgctggagacatcctggaaggggaaagaggacaggaggaaaagaaggtgcgggcctccc

SEQ ID NO: 145582 - DNA, 75 bp, Artificial Sequence
  Synthetic
aagactctccccacaacgctggagacatcctggaaggggaaagaggacaggaggaaaagaaggcgcgggcctccc

SEQ ID NO: 145583 - DNA, 75 bp, Artificial Sequence
  Synthetic
aagactctccccacaacgctggagacatcctggaaggggaaagaggacaggaggaaaagaaggggcgggcctccc

SEQ ID NO: 145584 - DNA, 75 bp, Artificial Sequence
  Synthetic
aagactctccccacaacgctggagacatcctggaaggggaaagaggactggaggaaaagaaggagcgggcctccc

SEQ ID NO: 145585 - DNA, 75 bp, Artificial Sequence
  Synthetic
aagactctccccacaacgctggagacatcctggaaggggaaagaggactggaggaaaagaaggtgcgggcctccc

SEQ ID NO: 145586 - DNA, 75 bp, Artificial Sequence
  Synthetic
aagactctccccacaacgctggagacatcctggaaggggaaagaggactggaggaaaagaaggcgcgggcctccc

SEQ ID NO: 145587 - DNA, 75 bp, Artificial Sequence
  Synthetic
aagactctccccacaacgctggagacatcctggaaggggaaagaggactggaggaaaagaaggggcgggcctccc

SEQ ID NO: 145588 - DNA, 75 bp, Artificial Sequence
  Synthetic
aagactctccccacaacgctggagacatcctggaaggggaaagaggaccggaggaaaagaaggagcgggcctccc

SEQ ID NO: 145589 - DNA, 75 bp, Artificial Sequence
  Synthetic
aagactctccccacaacgctggagacatcctggaaggggaaagaggaccggaggaaaagaaggtgcgggcctccc

SEQ ID NO: 145590 - DNA, 75 bp, Artificial Sequence
  Synthetic
aagactctccccacaacgctggagacatcctggaaggggaaagaggaccggaggaaaagaaggcgcgggcctccc

SEQ ID NO: 145591 - DNA, 75 bp, Artificial Sequence
  Synthetic
aagactctccccacaacgctggagacatcctggaaggggaaagaggaccggaggaaaagaaggggcgggcctccc

SEQ ID NO: 145592 - DNA, 75 bp, Artificial Sequence
  Synthetic
aagactctccccacaacgctggagacatcctggaaggggaaagaggacgggaggaaaagaaggagcgggcctccc

SEQ ID NO: 145593 - DNA, 75 bp, Artificial Sequence
  Synthetic
aagactctccccacaacgctggagacatcctggaaggggaaagaggacgggaggaaaagaaggtgcgggcctccc

SEQ ID NO: 145594 - DNA, 75 bp, Artificial Sequence
  Synthetic
aagactctccccacaacgctggagacatcctggaaggggaaagaggacgggaggaaaagaaggcgcgggcctccc

SEQ ID NO: 145595 - DNA, 75 bp, Artificial Sequence
  Synthetic
aagactctccccacaacgctggagacatcctggaaggggaaagaggacgggaggaaaagaaggggcgggcctccc

SEQ ID NO: 145596 - DNA, 75 bp, Artificial Sequence
  Synthetic
catcctggaaggggaaagaggacaggaggaaaagaaggagcgggcctcccgatccgagggtcccggtctccaaga

SEQ ID NO: 145597 - DNA, 75 bp, Artificial Sequence
  Synthetic
catcctggaaggggaaagaggacaggaggaaaagaaggagcgggcctcccgatccgagggtcccggtctccaagt

SEQ ID NO: 145598 - DNA, 75 bp, Artificial Sequence
  Synthetic
catcctggaaggggaaagaggacaggaggaaaagaaggagcgggcctcccgatccgagggtcccggtctccaagc

SEQ ID NO: 145599 - DNA, 75 bp, Artificial Sequence
  Synthetic
catcctggaaggggaaagaggacaggaggaaaagaaggagcgggcctcccgatccgagggtcccggtctccaagg

SEQ ID NO: 145600 - DNA, 75 bp, Artificial Sequence
  Synthetic
catcctggaaggggaaagaggacaggaggaaaagaaggtgcgggcctcccgatccgagggtcccggtctccaaga

SEQ ID NO: 145601 - DNA, 75 bp, Artificial Sequence
  Synthetic
catcctggaaggggaaagaggacaggaggaaaagaaggtgcgggcctcccgatccgagggtcccggtctccaagt

SEQ ID NO: 145602 - DNA, 75 bp, Artificial Sequence
  Synthetic
catcctggaaggggaaagaggacaggaggaaaagaaggtgcgggcctcccgatccgagggtcccggtctccaagc

SEQ ID NO: 145603 - DNA, 75 bp, Artificial Sequence
  Synthetic
catcctggaaggggaaagaggacaggaggaaaagaaggtgcgggcctcccgatccgagggtcccggtctccaagg

SEQ ID NO: 145604 - DNA, 75 bp, Artificial Sequence
  Synthetic
catcctggaaggggaaagaggacaggaggaaaagaaggcgcgggcctcccgatccgagggtcccggtctccaaga

SEQ ID NO: 145605 - DNA, 75 bp, Artificial Sequence
  Synthetic
catcctggaaggggaaagaggacaggaggaaaagaaggcgcgggcctcccgatccgagggtcccggtctccaagt

SEQ ID NO: 145606 - DNA, 75 bp, Artificial Sequence
  Synthetic
catcctggaaggggaaagaggacaggaggaaaagaaggcgcgggcctcccgatccgagggtcccggtctccaagc

SEQ ID NO: 145607 - DNA, 75 bp, Artificial Sequence
  Synthetic
catcctggaaggggaaagaggacaggaggaaaagaaggcgcgggcctcccgatccgagggtcccggtctccaagg

SEQ ID NO: 145608 - DNA, 75 bp, Artificial Sequence
  Synthetic
catcctggaaggggaaagaggacaggaggaaaagaaggggcgggcctcccgatccgagggtcccggtctccaaga

SEQ ID NO: 145609 - DNA, 75 bp, Artificial Sequence
  Synthetic
catcctggaaggggaaagaggacaggaggaaaagaaggggcgggcctcccgatccgagggtcccggtctccaagt

SEQ ID NO: 145610 - DNA, 75 bp, Artificial Sequence
  Synthetic
catcctggaaggggaaagaggacaggaggaaaagaaggggcgggcctcccgatccgagggtcccggtctccaagc

SEQ ID NO: 145611 - DNA, 75 bp, Artificial Sequence
  Synthetic
catcctggaaggggaaagaggacaggaggaaaagaaggggcgggcctcccgatccgagggtcccggtctccaagg

SEQ ID NO: 145612 - DNA, 75 bp, Artificial Sequence
  Synthetic
catcctggaaggggaaagaggactggaggaaaagaaggagcgggcctcccgatccgagggtcccggtctccaaga

SEQ ID NO: 145613 - DNA, 75 bp, Artificial Sequence
  Synthetic
catcctggaaggggaaagaggactggaggaaaagaaggagcgggcctcccgatccgagggtcccggtctccaagt

SEQ ID NO: 145614 - DNA, 75 bp, Artificial Sequence
  Synthetic
catcctggaaggggaaagaggactggaggaaaagaaggagcgggcctcccgatccgagggtcccggtctccaagc

SEQ ID NO: 145615 - DNA, 75 bp, Artificial Sequence
  Synthetic
catcctggaaggggaaagaggactggaggaaaagaaggagcgggcctcccgatccgagggtcccggtctccaagg

SEQ ID NO: 145616 - DNA, 75 bp, Artificial Sequence
  Synthetic
catcctggaaggggaaagaggactggaggaaaagaaggtgcgggcctcccgatccgagggtcccggtctccaaga

SEQ ID NO: 145617 - DNA, 75 bp, Artificial Sequence
  Synthetic
catcctggaaggggaaagaggactggaggaaaagaaggtgcgggcctcccgatccgagggtcccggtctccaagt

SEQ ID NO: 145618 - DNA, 75 bp, Artificial Sequence
  Synthetic
catcctggaaggggaaagaggactggaggaaaagaaggtgcgggcctcccgatccgagggtcccggtctccaagc

SEQ ID NO: 145619 - DNA, 75 bp, Artificial Sequence
  Synthetic
catcctggaaggggaaagaggactggaggaaaagaaggtgcgggcctcccgatccgagggtcccggtctccaagg

SEQ ID NO: 145620 - DNA, 75 bp, Artificial Sequence
  Synthetic
catcctggaaggggaaagaggactggaggaaaagaaggcgcgggcctcccgatccgagggtcccggtctccaaga

SEQ ID NO: 145621 - DNA, 75 bp, Artificial Sequence
  Synthetic
catcctggaaggggaaagaggactggaggaaaagaaggcgcgggcctcccgatccgagggtcccggtctccaagt

SEQ ID NO: 145622 - DNA, 75 bp, Artificial Sequence
  Synthetic
catcctggaaggggaaagaggactggaggaaaagaaggcgcgggcctcccgatccgagggtcccggtctccaagc

SEQ ID NO: 145623 - DNA, 75 bp, Artificial Sequence
  Synthetic
catcctggaaggggaaagaggactggaggaaaagaaggcgcgggcctcccgatccgagggtcccggtctccaagg

SEQ ID NO: 145624 - DNA, 75 bp, Artificial Sequence
  Synthetic
catcctggaaggggaaagaggactggaggaaaagaaggggcgggcctcccgatccgagggtcccggtctccaaga

SEQ ID NO: 145625 - DNA, 75 bp, Artificial Sequence
  Synthetic
catcctggaaggggaaagaggactggaggaaaagaaggggcgggcctcccgatccgagggtcccggtctccaagt

SEQ ID NO: 145626 - DNA, 75 bp, Artificial Sequence
  Synthetic
catcctggaaggggaaagaggactggaggaaaagaaggggcgggcctcccgatccgagggtcccggtctccaagc

SEQ ID NO: 145627 - DNA, 75 bp, Artificial Sequence
  Synthetic
catcctggaaggggaaagaggactggaggaaaagaaggggcgggcctcccgatccgagggtcccggtctccaagg

SEQ ID NO: 145628 - DNA, 75 bp, Artificial Sequence
  Synthetic
catcctggaaggggaaagaggaccggaggaaaagaaggagcgggcctcccgatccgagggtcccggtctccaaga

SEQ ID NO: 145629 - DNA, 75 bp, Artificial Sequence
  Synthetic
catcctggaaggggaaagaggaccggaggaaaagaaggagcgggcctcccgatccgagggtcccggtctccaagt

SEQ ID NO: 145630 - DNA, 75 bp, Artificial Sequence
  Synthetic
catcctggaaggggaaagaggaccggaggaaaagaaggagcgggcctcccgatccgagggtcccggtctccaagc

SEQ ID NO: 145631 - DNA, 75 bp, Artificial Sequence
  Synthetic
catcctggaaggggaaagaggaccggaggaaaagaaggagcgggcctcccgatccgagggtcccggtctccaagg

SEQ ID NO: 145632 - DNA, 75 bp, Artificial Sequence
  Synthetic
catcctggaaggggaaagaggaccggaggaaaagaaggtgcgggcctcccgatccgagggtcccggtctccaaga

SEQ ID NO: 145633 - DNA, 75 bp, Artificial Sequence
  Synthetic
catcctggaaggggaaagaggaccggaggaaaagaaggtgcgggcctcccgatccgagggtcccggtctccaagt

SEQ ID NO: 145634 - DNA, 75 bp, Artificial Sequence
  Synthetic
catcctggaaggggaaagaggaccggaggaaaagaaggtgcgggcctcccgatccgagggtcccggtctccaagc

SEQ ID NO: 145635 - DNA, 75 bp, Artificial Sequence
  Synthetic
catcctggaaggggaaagaggaccggaggaaaagaaggtgcgggcctcccgatccgagggtcccggtctccaagg

SEQ ID NO: 145636 - DNA, 75 bp, Artificial Sequence
  Synthetic
catcctggaaggggaaagaggaccggaggaaaagaaggcgcgggcctcccgatccgagggtcccggtctccaaga

SEQ ID NO: 145637 - DNA, 75 bp, Artificial Sequence
  Synthetic
catcctggaaggggaaagaggaccggaggaaaagaaggcgcgggcctcccgatccgagggtcccggtctccaagt

SEQ ID NO: 145638 - DNA, 75 bp, Artificial Sequence
  Synthetic
catcctggaaggggaaagaggaccggaggaaaagaaggcgcgggcctcccgatccgagggtcccggtctccaagc

SEQ ID NO: 145639 - DNA, 75 bp, Artificial Sequence
  Synthetic
catcctggaaggggaaagaggaccggaggaaaagaaggcgcgggcctcccgatccgagggtcccggtctccaagg

SEQ ID NO: 145640 - DNA, 75 bp, Artificial Sequence
  Synthetic
catcctggaaggggaaagaggaccggaggaaaagaaggggcgggcctcccgatccgagggtcccggtctccaaga

SEQ ID NO: 145641 - DNA, 75 bp, Artificial Sequence
  Synthetic
catcctggaaggggaaagaggaccggaggaaaagaaggggcgggcctcccgatccgagggtcccggtctccaagt

SEQ ID NO: 145642 - DNA, 75 bp, Artificial Sequence
  Synthetic
catcctggaaggggaaagaggaccggaggaaaagaaggggcgggcctcccgatccgagggtcccggtctccaagc

SEQ ID NO: 145643 - DNA, 75 bp, Artificial Sequence
  Synthetic
catcctggaaggggaaagaggaccggaggaaaagaaggggcgggcctcccgatccgagggtcccggtctccaagg

SEQ ID NO: 145644 - DNA, 75 bp, Artificial Sequence
  Synthetic
catcctggaaggggaaagaggacgggaggaaaagaaggagcgggcctcccgatccgagggtcccggtctccaaga

SEQ ID NO: 145645 - DNA, 75 bp, Artificial Sequence
  Synthetic
catcctggaaggggaaagaggacgggaggaaaagaaggagcgggcctcccgatccgagggtcccggtctccaagt

SEQ ID NO: 145646 - DNA, 75 bp, Artificial Sequence
  Synthetic
catcctggaaggggaaagaggacgggaggaaaagaaggagcgggcctcccgatccgagggtcccggtctccaagc

SEQ ID NO: 145647 - DNA, 75 bp, Artificial Sequence
  Synthetic
catcctggaaggggaaagaggacgggaggaaaagaaggagcgggcctcccgatccgagggtcccggtctccaagg

SEQ ID NO: 145648 - DNA, 75 bp, Artificial Sequence
  Synthetic
catcctggaaggggaaagaggacgggaggaaaagaaggtgcgggcctcccgatccgagggtcccggtctccaaga

SEQ ID NO: 145649 - DNA, 75 bp, Artificial Sequence
  Synthetic
catcctggaaggggaaagaggacgggaggaaaagaaggtgcgggcctcccgatccgagggtcccggtctccaagt

SEQ ID NO: 145650 - DNA, 75 bp, Artificial Sequence
  Synthetic
catcctggaaggggaaagaggacgggaggaaaagaaggtgcgggcctcccgatccgagggtcccggtctccaagc

SEQ ID NO: 145651 - DNA, 75 bp, Artificial Sequence
  Synthetic
catcctggaaggggaaagaggacgggaggaaaagaaggtgcgggcctcccgatccgagggtcccggtctccaagg

SEQ ID NO: 145652 - DNA, 75 bp, Artificial Sequence
  Synthetic
catcctggaaggggaaagaggacgggaggaaaagaaggcgcgggcctcccgatccgagggtcccggtctccaaga

SEQ ID NO: 145653 - DNA, 75 bp, Artificial Sequence
  Synthetic
catcctggaaggggaaagaggacgggaggaaaagaaggcgcgggcctcccgatccgagggtcccggtctccaagt

SEQ ID NO: 145654 - DNA, 75 bp, Artificial Sequence
  Synthetic
catcctggaaggggaaagaggacgggaggaaaagaaggcgcgggcctcccgatccgagggtcccggtctccaagc

SEQ ID NO: 145655 - DNA, 75 bp, Artificial Sequence
  Synthetic
catcctggaaggggaaagaggacgggaggaaaagaaggcgcgggcctcccgatccgagggtcccggtctccaagg

SEQ ID NO: 145656 - DNA, 75 bp, Artificial Sequence
  Synthetic
catcctggaaggggaaagaggacgggaggaaaagaaggggcgggcctcccgatccgagggtcccggtctccaaga

SEQ ID NO: 145657 - DNA, 75 bp, Artificial Sequence
  Synthetic
catcctggaaggggaaagaggacgggaggaaaagaaggggcgggcctcccgatccgagggtcccggtctccaagt

SEQ ID NO: 145658 - DNA, 75 bp, Artificial Sequence
  Synthetic
catcctggaaggggaaagaggacgggaggaaaagaaggggcgggcctcccgatccgagggtcccggtctccaagc

SEQ ID NO: 145659 - DNA, 75 bp, Artificial Sequence
  Synthetic
catcctggaaggggaaagaggacgggaggaaaagaaggggcgggcctcccgatccgagggtcccggtctccaagg

SEQ ID NO: 145660 - DNA, 75 bp, Artificial Sequence
  Synthetic
ttggagagcactccgggccgtatggttgagaacttacccagagggaggagatccactcggagaaagcagacaaat

SEQ ID NO: 145661 - DNA, 75 bp, Artificial Sequence
  Synthetic
ttggagagcactccgggccgtatggttgagaactttcccagagggaggagatccactcggagaaagcagacaaat

SEQ ID NO: 145662 - DNA, 75 bp, Artificial Sequence
  Synthetic
ttggagagcactccgggccgtatggttgagaacttccccagagggaggagatccactcggagaaagcagacaaat

SEQ ID NO: 145663 - DNA, 75 bp, Artificial Sequence
  Synthetic
ttggagagcactccgggccgtatggttgagaacttgcccagagggaggagatccactcggagaaagcagacaaat

SEQ ID NO: 145664 - DNA, 75 bp, Artificial Sequence
  Synthetic
cacctccagaggaccccttcagcgaacagagagcactgacacgcggggagtgagatcgtagcgataggaggagat

SEQ ID NO: 145665 - DNA, 75 bp, Artificial Sequence
  Synthetic
cttccaaaatgacagaggggggagcttaagacggcagggacccactggagccatgggatgcccctcccgatgctc

SEQ ID NO: 145666 - DNA, 75 bp, Artificial Sequence
  Synthetic
cttccaaaatgacagaggggggagctttagacggcagggacccactggagccatgggatgcccctcccgatgctc

SEQ ID NO: 145667 - DNA, 75 bp, Artificial Sequence
  Synthetic
cttccaaaatgacagaggggggagcttcagacggcagggacccactggagccatgggatgcccctcccgatgctc

SEQ ID NO: 145668 - DNA, 75 bp, Artificial Sequence
  Synthetic
cttccaaaatgacagaggggggagcttgagacggcagggacccactggagccatgggatgcccctcccgatgctc

SEQ ID NO: 145669 - DNA, 75 bp, Artificial Sequence
  Synthetic
cttccaaaatgactgaggggggagcttaagacggcagggacccactggagccatgggatgcccctcccgatgctc

SEQ ID NO: 145670 - DNA, 75 bp, Artificial Sequence
  Synthetic
cttccaaaatgactgaggggggagctttagacggcagggacccactggagccatgggatgcccctcccgatgctc

SEQ ID NO: 145671 - DNA, 75 bp, Artificial Sequence
  Synthetic
cttccaaaatgactgaggggggagcttcagacggcagggacccactggagccatgggatgcccctcccgatgctc

SEQ ID NO: 145672 - DNA, 75 bp, Artificial Sequence
  Synthetic
cttccaaaatgactgaggggggagcttgagacggcagggacccactggagccatgggatgcccctcccgatgctc

SEQ ID NO: 145673 - DNA, 75 bp, Artificial Sequence
  Synthetic
cttccaaaatgaccgaggggggagcttaagacggcagggacccactggagccatgggatgcccctcccgatgctc

SEQ ID NO: 145674 - DNA, 75 bp, Artificial Sequence
  Synthetic
cttccaaaatgaccgaggggggagctttagacggcagggacccactggagccatgggatgcccctcccgatgctc

SEQ ID NO: 145675 - DNA, 75 bp, Artificial Sequence
  Synthetic
cttccaaaatgaccgaggggggagcttcagacggcagggacccactggagccatgggatgcccctcccgatgctc

SEQ ID NO: 145676 - DNA, 75 bp, Artificial Sequence
  Synthetic
cttccaaaatgaccgaggggggagcttgagacggcagggacccactggagccatgggatgcccctcccgatgctc

SEQ ID NO: 145677 - DNA, 75 bp, Artificial Sequence
  Synthetic
cttccaaaatgacggaggggggagcttaagacggcagggacccactggagccatgggatgcccctcccgatgctc

SEQ ID NO: 145678 - DNA, 75 bp, Artificial Sequence
  Synthetic
cttccaaaatgacggaggggggagctttagacggcagggacccactggagccatgggatgcccctcccgatgctc

SEQ ID NO: 145679 - DNA, 75 bp, Artificial Sequence
  Synthetic
cttccaaaatgacggaggggggagcttcagacggcagggacccactggagccatgggatgcccctcccgatgctc

SEQ ID NO: 145680 - DNA, 75 bp, Artificial Sequence
  Synthetic
cttccaaaatgacggaggggggagcttgagacggcagggacccactggagccatgggatgcccctcccgatgctc

SEQ ID NO: 145681 - DNA, 75 bp, Artificial Sequence
  Synthetic
gattccctcccttcccccgagggtcgcccaggaatggcttgggacccactcgactggggtccgcgttccatcctt

SEQ ID NO: 145682 - DNA, 75 bp, Artificial Sequence
  Synthetic
ggagaaaagggaggatcggctgggaagagtatatccaatggaaatccgtgggttcccctgatgtccagcccctcc

SEQ ID NO: 145683 - DNA, 75 bp, Artificial Sequence
  Synthetic
ggagaaaagggaggatcggctgggaagagtatatccaatggtaatccgtgggttcccctgatgtccagcccctcc

SEQ ID NO: 145684 - DNA, 75 bp, Artificial Sequence
  Synthetic
ggagaaaagggaggatcggctgggaagagtatatccaatggcaatccgtgggttcccctgatgtccagcccctcc

SEQ ID NO: 145685 - DNA, 75 bp, Artificial Sequence
  Synthetic
ggagaaaagggaggatcggctgggaagagtatatccaatgggaatccgtgggttcccctgatgtccagcccctcc

SEQ ID NO: 145686 - DNA, 75 bp, Artificial Sequence
  Synthetic
ggagaaaagggaggatcggctgggaagagtatatcctatggaaatccgtgggttcccctgatgtccagcccctcc

SEQ ID NO: 145687 - DNA, 75 bp, Artificial Sequence
  Synthetic
ggagaaaagggaggatcggctgggaagagtatatcctatggtaatccgtgggttcccctgatgtccagcccctcc

SEQ ID NO: 145688 - DNA, 75 bp, Artificial Sequence
  Synthetic
ggagaaaagggaggatcggctgggaagagtatatcctatggcaatccgtgggttcccctgatgtccagcccctcc

SEQ ID NO: 145689 - DNA, 75 bp, Artificial Sequence
  Synthetic
ggagaaaagggaggatcggctgggaagagtatatcctatgggaatccgtgggttcccctgatgtccagcccctcc

SEQ ID NO: 145690 - DNA, 75 bp, Artificial Sequence
  Synthetic
ggagaaaagggaggatcggctgggaagagtatatcccatggaaatccgtgggttcccctgatgtccagcccctcc

SEQ ID NO: 145691 - DNA, 75 bp, Artificial Sequence
  Synthetic
ggagaaaagggaggatcggctgggaagagtatatcccatggtaatccgtgggttcccctgatgtccagcccctcc

SEQ ID NO: 145692 - DNA, 75 bp, Artificial Sequence
  Synthetic
ggagaaaagggaggatcggctgggaagagtatatcccatggcaatccgtgggttcccctgatgtccagcccctcc

SEQ ID NO: 145693 - DNA, 75 bp, Artificial Sequence
  Synthetic
ggagaaaagggaggatcggctgggaagagtatatcccatgggaatccgtgggttcccctgatgtccagcccctcc

SEQ ID NO: 145694 - DNA, 75 bp, Artificial Sequence
  Synthetic
ggagaaaagggaggatcggctgggaagagtatatccgatggaaatccgtgggttcccctgatgtccagcccctcc

SEQ ID NO: 145695 - DNA, 75 bp, Artificial Sequence
  Synthetic
ggagaaaagggaggatcggctgggaagagtatatccgatggtaatccgtgggttcccctgatgtccagcccctcc

SEQ ID NO: 145696 - DNA, 75 bp, Artificial Sequence
  Synthetic
ggagaaaagggaggatcggctgggaagagtatatccgatggcaatccgtgggttcccctgatgtccagcccctcc

SEQ ID NO: 145697 - DNA, 75 bp, Artificial Sequence
  Synthetic
ggagaaaagggaggatcggctgggaagagtatatccgatgggaatccgtgggttcccctgatgtccagcccctcc

SEQ ID NO: 145698 - DNA, 75 bp, Artificial Sequence
  Synthetic
tccctctcgagttcctctaacttctttcttgcacatacccactgctcgagaagctcttccctgtttccgcgattt

SEQ ID NO: 145699 - DNA, 75 bp, Artificial Sequence
  Synthetic
catgggccaattccgagcgaagaactccgcgggggaaggatcagcgcccgagaggggtcagtggtaaagagcatt

SEQ ID NO: 145700 - DNA, 75 bp, Artificial Sequence
  Synthetic
tccgcgggggaaggatcagcgcccgagaggggtcagtggtaaagagcattggaacgccgaggaggtgactcccaa

SEQ ID NO: 145701 - DNA, 75 bp, Artificial Sequence
  Synthetic
agaggggtcagtggtaaagagcattggaacgccgaggaggtgactcccaagaagaacaaagagaaaacaagaaac

SEQ ID NO: 145702 - DNA, 75 bp, Artificial Sequence
  Synthetic
ggaagattttccccaaaacgctggaagcatcctggaaggggaaagaggacggatggaagagaagggggggccccc

SEQ ID NO: 145703 - DNA, 75 bp, Artificial Sequence
  Synthetic
ccgatccgaatggcccaaccaccaagtttggaaagcactccgggccaaatggttgagtagcatccagagggagga

SEQ ID NO: 145704 - DNA, 75 bp, Artificial Sequence
  Synthetic
gtttggaaagcactccgggccaaatggttgagtagcatccagagggaggaaatccacacggagttgacagagaaa

SEQ ID NO: 145705 - DNA, 75 bp, Artificial Sequence
  Synthetic
aatccacacggagttgacagagaaatcacctccagaggaccccttcagcgaacagaagagcgtgagcgcgttggg

SEQ ID NO: 145706 - DNA, 75 bp, Artificial Sequence
  Synthetic
cccccgagaggggacgagtgaggcttatcccggggaattcgacttatcgtccccacatagcaggcctccggagcc

SEQ ID NO: 145707 - DNA, 75 bp, Artificial Sequence
  Synthetic
ccttcgaaagtgaccggagggggtgcttggagcgcagggtgaccactgggagccatgggatgcctctcccgattc

SEQ ID NO: 145708 - DNA, 75 bp, Artificial Sequence
  Synthetic
cttggagcgcagggtgaccactgggagccatgggatgcctctcccgattccgtccatcccccccccaggagggtc

SEQ ID NO: 145709 - DNA, 75 bp, Artificial Sequence
  Synthetic
tctctctcgagttcctctaacttctttcttccactcacccactgctcgagaacctcttctcttcctccgcggtgt

SEQ ID NO: 145710 - DNA, 75 bp, Artificial Sequence
  Synthetic
atgagccatagttccgagcgaagagacgcggggggaggatcagctcccgagaggggatgagacggcaaagagcat

SEQ ID NO: 145711 - DNA, 75 bp, Artificial Sequence
  Synthetic
acgcggggggaggatcagctcccgagaggggatgagacggcaaagagcattggaacgtcggagagatagctccca

SEQ ID NO: 145712 - DNA, 75 bp, Artificial Sequence
  Synthetic
gaggggatgagacggcaaagagcattggaacgtcggagagatagctcccaagaaggaaaaagggaattcaagaag

SEQ ID NO: 145713 - DNA, 75 bp, Artificial Sequence
  Synthetic
tggacgggatccccgagacgctggagaatctctggaaggggaaagaggaaggtggaaaagaaggggcgggcctcc

SEQ ID NO: 145714 - DNA, 75 bp, Artificial Sequence
  Synthetic
gaatctctggaaggggaaagaggaaggtggaaaagaaggggcgggcctcccgatccgaggggtccgtcggctcat

SEQ ID NO: 145715 - DNA, 75 bp, Artificial Sequence
  Synthetic
gccgacccgaagaggaaagaaggacgcgaaacgcaaacctgtgagtggaaatccactcggagagaacagacaaat

SEQ ID NO: 145716 - DNA, 75 bp, Artificial Sequence
  Synthetic
gcgaaacgcaaacctgtgagtggaaatccactcggagagaacagacaaatcacctccagaggaccccttcagcga

SEQ ID NO: 145717 - DNA, 75 bp, Artificial Sequence
  Synthetic
acagaagggcgtgtcgagcagtaggagtaagaccaaagcgataggaggagatgctaggagtgggaggagaccgaa

SEQ ID NO: 145718 - DNA, 75 bp, Artificial Sequence
  Synthetic
acagaagggcgtgtcgagcagtaggagtaagaccatagcgataggaggagatgctaggagtgggaggagaccgaa

SEQ ID NO: 145719 - DNA, 75 bp, Artificial Sequence
  Synthetic
acagaagggcgtgtcgagcagtaggagtaagaccacagcgataggaggagatgctaggagtgggaggagaccgaa

SEQ ID NO: 145720 - DNA, 75 bp, Artificial Sequence
  Synthetic
acagaagggcgtgtcgagcagtaggagtaagaccagagcgataggaggagatgctaggagtgggaggagaccgaa

SEQ ID NO: 145721 - DNA, 75 bp, Artificial Sequence
  Synthetic
agtaagaccaaagcgataggaggagatgctaggagtgggaggagaccgaagcgaggaggaaagcaagaaagcaac

SEQ ID NO: 145722 - DNA, 75 bp, Artificial Sequence
  Synthetic
agtaagaccatagcgataggaggagatgctaggagtgggaggagaccgaagcgaggaggaaagcaagaaagcaac

SEQ ID NO: 145723 - DNA, 75 bp, Artificial Sequence
  Synthetic
agtaagaccacagcgataggaggagatgctaggagtgggaggagaccgaagcgaggaggaaagcaagaaagcaac

SEQ ID NO: 145724 - DNA, 75 bp, Artificial Sequence
  Synthetic
agtaagaccagagcgataggaggagatgctaggagtgggaggagaccgaagcgaggaggaaagcaagaaagcaac

SEQ ID NO: 145725 - DNA, 75 bp, Artificial Sequence
  Synthetic
ttggaacatgggggaccagtggagccatgggatgcccttcccgatgctcgatccgactccctcccccccaagcgt

SEQ ID NO: 145726 - DNA, 75 bp, Artificial Sequence
  Synthetic
ccccggtccgagtgaagggggactccgggactccttgcatgctggggacgaagccgcccccgggcgctcccctcg

SEQ ID NO: 145727 - DNA, 75 bp, Artificial Sequence
  Synthetic
ctttcccttctctcgtcttctgcggtcaacctcccgagttcctcttcttcctccttgctgaggctcttgcctcct

SEQ ID NO: 145728 - DNA, 75 bp, Artificial Sequence
  Synthetic
cgagggccttccttcttcggtgatcctgcctctccttgtcggtgaatccccccctgagaggcctcttcctaggtc

SEQ ID NO: 145729 - DNA, 75 bp, Artificial Sequence
  Synthetic
ggtccctctcgagttcctctaacttctttcttccgctcacccactgctcgaggatctcttctctccctccgcggt

SEQ ID NO: 145730 - DNA, 75 bp, Artificial Sequence
  Synthetic
tcttcttcgactcggaccggctcatctcgacaagaggcggcggtcctcagtactcttactcttttctgtaaagag

SEQ ID NO: 145731 - DNA, 75 bp, Artificial Sequence
  Synthetic
cgaacccgccaccgggcgctcccctcggacctccgtcgagggggttcacatccccaacccgcgggccggctactc

SEQ ID NO: 145732 - DNA, 75 bp, Artificial Sequence
  Synthetic
tgagagtcttgttgaccttccggagatccctctcgagctcctcctttcttcttcttgcatcgatccactttccga

SEQ ID NO: 145733 - DNA, 75 bp, Artificial Sequence
  Synthetic
ctcgattgcgggcggcggtcctgagaactcttatcttcctgtttagaagaggagtctcctggacgccccgcccgg

SEQ ID NO: 145734 - DNA, 75 bp, Artificial Sequence
  Synthetic
cctggagagcactcctggccgaaaggtcgagtagcatccagagggaggaaaccactcggagaagaacagaaaaat

SEQ ID NO: 145735 - DNA, 75 bp, Artificial Sequence
  Synthetic
gtcgagtagcatccagagggaggaaaccactcggagaagaacagaaaaatcacctccagaggaccccttcagcga

SEQ ID NO: 145736 - DNA, 75 bp, Artificial Sequence
  Synthetic
accactcggagaagaacagaaaaatcacctccagaggaccccttcagcgaacaaaagagactcgtacggaatagg

SEQ ID NO: 145737 - DNA, 75 bp, Artificial Sequence
  Synthetic
ccttcaaaaatgaccggagggggagctaggagcgtgggggacccagtggagccatgggatgcttctcccgattcc

SEQ ID NO: 145738 - DNA, 75 bp, Artificial Sequence
  Synthetic
ctaggagcgtgggggacccagtggagccatgggatgcttctcccgattccctccaaccccactcccagaagggtc

SEQ ID NO: 145739 - DNA, 75 bp, Artificial Sequence
  Synthetic
agggccttccttcgtcggtgatcctgcctctccttgtcggtgaatcctcccctggaaggcctcttcctaggcccg

SEQ ID NO: 145740 - DNA, 75 bp, Artificial Sequence
  Synthetic
gattttcttcctgatcttccggaggtctctctcgagttcatcggctctttttcttccgctcacccactgctcgag

SEQ ID NO: 145741 - DNA, 75 bp, Artificial Sequence
  Synthetic
ttcttccgctcacccactgctcgaggacatcttctcttcctccgcgattcttcttcgactcggaccggctcatct

SEQ ID NO: 145742 - DNA, 75 bp, Artificial Sequence
  Synthetic
gggagcgcgggaggaaggatcagtacccgagagggagtgacggtaaagaggccggagaacgccgaagaaacactc

SEQ ID NO: 145743 - DNA, 75 bp, Artificial Sequence
  Synthetic
gccggagaacgccgaagaaacactcccaagaagagaggagaatcttcaggaagtggaagattttccccataacgc

SEQ ID NO: 145744 - DNA, 75 bp, Artificial Sequence
  Synthetic
tggagacatcctggaaggggaaagaggtaaggtggaaaaagaaggggcgggccccccgatccgaggggcccgaca

SEQ ID NO: 145745 - DNA, 75 bp, Artificial Sequence
  Synthetic
atgagccaagttccgaacaagggtccgcggggggagtgatcagttcccgagaggggtaagtcggtaaagagcatt

SEQ ID NO: 145746 - DNA, 75 bp, Artificial Sequence
  Synthetic
gaggggtaagtcggtaaagagcattggaacgtcggagatacaactcccaagaagaaaaaaagagaaagcaagaat

SEQ ID NO: 145747 - DNA, 75 bp, Artificial Sequence
  Synthetic
ggaacgtcggagatacaactcccaagaagaaaaaaagagaaagcaagaatcggacgactttccccataacgccag

SEQ ID NO: 145748 - DNA, 75 bp, Artificial Sequence
  Synthetic
tgaaactctaggaaggggaaagaggtatggtggaaaaagaggaggcgggcctcccgatccgaggggcccgatggc

SEQ ID NO: 145749 - DNA, 75 bp, Artificial Sequence
  Synthetic
ggtctctctcgagttcctctaacttctttcttccgctcacccactgctcgaggacctcttccctgcccccgcgat

SEQ ID NO: 145750 - DNA, 75 bp, Artificial Sequence
  Synthetic
cttgagccaattccgaacgaagagggcgcagagggaaggatcagacgacgagaggggatgaactggtaaagaggc

SEQ ID NO: 145751 - DNA, 75 bp, Artificial Sequence
  Synthetic
ggtttggagagcactccgggccgaagggttgagtagcatccagagggaggaatccacgcagagtagaacggagaa

SEQ ID NO: 145752 - DNA, 75 bp, Artificial Sequence
  Synthetic
atgggcctcgtgccgacgagaggccggagacggaggaatcggggatcccgaggagggaaccaaccaaagaagggg

SEQ ID NO: 145753 - DNA, 75 bp, Artificial Sequence
  Synthetic
ggagacggaggaatcggggatcccgaggagggaaccaaccaaagaaggggaatttcccggtagaagtatctccta

SEQ ID NO: 145754 - DNA, 75 bp, Artificial Sequence
  Synthetic
aggagggaaccaaccaaagaaggggaatttcccggtagaagtatctcctagaagaaccgagagcatctcagatga

SEQ ID NO: 145755 - DNA, 75 bp, Artificial Sequence
  Synthetic
aggagatctcccaaacgccggtggactccgggaacaaggaaacaggagaaggaacggtagaaaagagcgagcctc

SEQ ID NO: 145756 - DNA, 75 bp, Artificial Sequence
  Synthetic
ctccgggaacaaggaaacaggagaaggaacggtagaaaagagcgagcctcccagttcgagagtcccggacccctc

SEQ ID NO: 145757 - DNA, 75 bp, Artificial Sequence
  Synthetic
ggctctggagtccaccgacctgtgaggtcgaggctctccgtgcagggagacagccaccaggagaaggcagagaaa

SEQ ID NO: 145758 - DNA, 75 bp, Artificial Sequence
  Synthetic
ggctctggagtccaccgacctgtgaggtcgaggctctccgtgcagggagacagccacctggagaaggcagagaaa

SEQ ID NO: 145759 - DNA, 75 bp, Artificial Sequence
  Synthetic
ggctctggagtccaccgacctgtgaggtcgaggctctccgtgcagggagacagccacccggagaaggcagagaaa

SEQ ID NO: 145760 - DNA, 75 bp, Artificial Sequence
  Synthetic
ggctctggagtccaccgacctgtgaggtcgaggctctccgtgcagggagacagccaccgggagaaggcagagaaa

SEQ ID NO: 145761 - DNA, 75 bp, Artificial Sequence
  Synthetic
ggtcgaggctctccgtgcagggagacagccaccaggagaaggcagagaaatcacctccagaggaccccttcaacg

SEQ ID NO: 145762 - DNA, 75 bp, Artificial Sequence
  Synthetic
ggtcgaggctctccgtgcagggagacagccacctggagaaggcagagaaatcacctccagaggaccccttcaacg

SEQ ID NO: 145763 - DNA, 75 bp, Artificial Sequence
  Synthetic
ggtcgaggctctccgtgcagggagacagccacccggagaaggcagagaaatcacctccagaggaccccttcaacg

SEQ ID NO: 145764 - DNA, 75 bp, Artificial Sequence
  Synthetic
ggtcgaggctctccgtgcagggagacagccaccgggagaaggcagagaaatcacctccagaggaccccttcaacg

SEQ ID NO: 145765 - DNA, 75 bp, Artificial Sequence
  Synthetic
aacaaagaagcgctctgaggcgtcagggtgagaccatagcgataggagaggatgctgggagtcagcggcgaccaa

SEQ ID NO: 145766 - DNA, 75 bp, Artificial Sequence
  Synthetic
aacaaagaagcgctctgaggcgtcagggtgagaccttagcgataggagaggatgctgggagtcagcggcgaccaa

SEQ ID NO: 145767 - DNA, 75 bp, Artificial Sequence
  Synthetic
aacaaagaagcgctctgaggcgtcagggtgagaccctagcgataggagaggatgctgggagtcagcggcgaccaa

SEQ ID NO: 145768 - DNA, 75 bp, Artificial Sequence
  Synthetic
aacaaagaagcgctctgaggcgtcagggtgagaccgtagcgataggagaggatgctgggagtcagcggcgaccaa

SEQ ID NO: 145769 - DNA, 75 bp, Artificial Sequence
  Synthetic
gggtgagaccatagcgataggagaggatgctgggagtcagcggcgaccaaagcgaggatcgaaagtaaagagagc

SEQ ID NO: 145770 - DNA, 75 bp, Artificial Sequence
  Synthetic
gggtgagaccttagcgataggagaggatgctgggagtcagcggcgaccaaagcgaggatcgaaagtaaagagagc

SEQ ID NO: 145771 - DNA, 75 bp, Artificial Sequence
  Synthetic
gggtgagaccctagcgataggagaggatgctgggagtcagcggcgaccaaagcgaggatcgaaagtaaagagagc

SEQ ID NO: 145772 - DNA, 75 bp, Artificial Sequence
  Synthetic
gggtgagaccgtagcgataggagaggatgctgggagtcagcggcgaccaaagcgaggatcgaaagtaaagagagc

SEQ ID NO: 145773 - DNA, 75 bp, Artificial Sequence
  Synthetic
aacggggctagcgagtggatgttccgccaccctggagtcccgagtgaggcttatcccggggagattcggcctagt

SEQ ID NO: 145774 - DNA, 75 bp, Artificial Sequence
  Synthetic
cccgaaatgtctggttccgtcggctccacttccaaaaggaggagcgggtgggcttggagcacaggggaccagtca

SEQ ID NO: 145775 - DNA, 75 bp, Artificial Sequence
  Synthetic
ccacttccaaaaggaggagcgggtgggcttggagcacaggggaccagtcagtccgttggactaccccggacctcc

SEQ ID NO: 145776 - DNA, 75 bp, Artificial Sequence
  Synthetic
ccaccctttcttacctgtggccggcatggtcccagcctcctcgctggcgccggctgggcaacattccgaggggac

SEQ ID NO: 145777 - DNA, 75 bp, Artificial Sequence
  Synthetic
agagaaccgggagaaaactggctctcccttagccatccgagtggacgtttcgtcctccttcggatgcccaggtcg

SEQ ID NO: 145778 - DNA, 75 bp, Artificial Sequence
  Synthetic
cgtcctccttcggatgcccaggtcggaccgcggggaggtggagatgccatgccgacccgaagaggaaagaaggac

SEQ ID NO: 145779 - DNA, 75 bp, Artificial Sequence
  Synthetic
ctgctggttgcccctgatgtccagcccatctcccgtcctagagaagggagattcgggaacgttcagcatttgagg

SEQ ID NO: 145780 - DNA, 75 bp, Artificial Sequence
  Synthetic
ccatctcccgtcctagagaagggagattcgggaacgttcagcatttgagggacgaagccacccccgggcgctccc

SEQ ID NO: 145781 - DNA, 75 bp, Artificial Sequence
  Synthetic
ctcggagaggccccaggtgggttcacatccccaacccgcgggccggctgttcttctttccctttcctcgtcttct

SEQ ID NO: 145782 - DNA, 75 bp, Artificial Sequence
  Synthetic
tcttctttccctttcctcgtcttctctggtcaacctctggagttccccttcctcttccttgctgagtgtctttcc

SEQ ID NO: 145783 - DNA, 75 bp, Artificial Sequence
  Synthetic
ggtccggtatcgacctccatccgatccgtccgggccttcttcgacgggggagctccctccccgtccttccctttt

SEQ ID NO: 145784 - DNA, 75 bp, Artificial Sequence
  Synthetic
agctccctccccgtccttcccttttcttattattccgaagatgttccccagccagggattttcatcctcgagtct

SEQ ID NO: 145785 - DNA, 75 bp, Artificial Sequence
  Synthetic
agctccctccccgtccttcccttttcttattattccgatgatgttccccagccagggattttcatcctcgagtct

SEQ ID NO: 145786 - DNA, 75 bp, Artificial Sequence
  Synthetic
agctccctccccgtccttcccttttcttattattccgacgatgttccccagccagggattttcatcctcgagtct

SEQ ID NO: 145787 - DNA, 75 bp, Artificial Sequence
  Synthetic
agctccctccccgtccttcccttttcttattattccgaggatgttccccagccagggattttcatcctcgagtct

SEQ ID NO: 145788 - DNA, 75 bp, Artificial Sequence
  Synthetic
agccttctttcgagatcttccgcgtcttttcttgcttggacccatttctcgaggaattcctctcttcctcccctc

SEQ ID NO: 145789 - DNA, 75 bp, Artificial Sequence
  Synthetic
agccttctttcgagatcttccgcgtcttttcttgcttggacccatttctcgaggatttcctctcttcctcccctc

SEQ ID NO: 145790 - DNA, 75 bp, Artificial Sequence
  Synthetic
agccttctttcgagatcttccgcgtcttttcttgcttggacccatttctcgaggacttcctctcttcctcccctc

SEQ ID NO: 145791 - DNA, 75 bp, Artificial Sequence
  Synthetic
agccttctttcgagatcttccgcgtcttttcttgcttggacccatttctcgaggagttcctctcttcctcccctc

SEQ ID NO: 145792 - DNA, 75 bp, Artificial Sequence
  Synthetic
cttttcttgcttggacccatttctcgaggaattcctctcttcctcccctccgagatctcttctgttcggactggc

SEQ ID NO: 145793 - DNA, 75 bp, Artificial Sequence
  Synthetic
cttttcttgcttggacccatttctcgaggatttcctctcttcctcccctccgagatctcttctgttcggactggc

SEQ ID NO: 145794 - DNA, 75 bp, Artificial Sequence
  Synthetic
cttttcttgcttggacccatttctcgaggacttcctctcttcctcccctccgagatctcttctgttcggactggc

SEQ ID NO: 145795 - DNA, 75 bp, Artificial Sequence
  Synthetic
cttttcttgcttggacccatttctcgaggagttcctctcttcctcccctccgagatctcttctgttcggactggc

SEQ ID NO: 145796 - DNA, 75 bp, Artificial Sequence
  Synthetic
tcatcttcggaaaagggggcggcggcgcctgttctcttattttcctcttagaaaaggagacagttggccgctcgc

SEQ ID NO: 145797 - DNA, 75 bp, Artificial Sequence
  Synthetic
agggggcggcggcgcctgttctcttattttcctcttagaaaaggagacagttggccgctcgcccccaaccccgag

SEQ ID NO: 145798 - DNA, 75 bp, Artificial Sequence
  Synthetic
ccgggcttacctacgggaactgctggttgcccctgatgtccagcccatctcccgtcctagagaagggagattcgg

SEQ ID NO: 145799 - DNA, 75 bp, Artificial Sequence
  Synthetic
atgggccgcagccgggcgaggggggcgaagtggggagggggggatcccgaggaggatctccaactaaagagtgga

SEQ ID NO: 145800 - DNA, 75 bp, Artificial Sequence
  Synthetic
cgaagtggggagggggggatcccgaggaggatctccaactaaagagtggaggaaatttcggaaagcttctcccaa

SEQ ID NO: 145801 - DNA, 75 bp, Artificial Sequence
  Synthetic
ggaggatctccaactaaagagtggaggaaatttcggaaagcttctcccaagaagaactgggacgctctcaagaag

SEQ ID NO: 145802 - DNA, 75 bp, Artificial Sequence
  Synthetic
ggaaatttcggaaagcttctcccaagaagaactgggacgctctcaagaaggaggagatttcccgaacgctggaga

SEQ ID NO: 145803 - DNA, 75 bp, Artificial Sequence
  Synthetic
gaggagatttcccgaacgctggagactcccggaatttcattcaagaagaaggtaacggagaaaggagcgggcctc

SEQ ID NO: 145804 - DNA, 75 bp, Artificial Sequence
  Synthetic
ctcccggaatttcattcaagaagaaggtaacggagaaaggagcgggcctcccgatccgagtggtccgtggcgtat

SEQ ID NO: 145805 - DNA, 75 bp, Artificial Sequence
  Synthetic
atccaccaggagggtggaggagggttcacctccagaggaccccttcagcgaacggaagagcctcctccttcggag

SEQ ID NO: 145806 - DNA, 75 bp, Artificial Sequence
  Synthetic
cccccggcggggccgagtgaggcttatcccggggatcggcgaatcgtcccgggatggggactccaagggccccct

SEQ ID NO: 145807 - DNA, 75 bp, Artificial Sequence
  Synthetic
tctccttgtcggtgaacccgctcctgtgaggcctcttcccagtcccggagtcgacctccatccgatccgtccggg

SEQ ID NO: 145808 - DNA, 75 bp, Artificial Sequence
  Synthetic
gtgaggcctcttcccagtcccggagtcgacctccatccgatccgtccgggatctcttcgccgggggagccccctc

SEQ ID NO: 145809 - DNA, 75 bp, Artificial Sequence
  Synthetic
ctcccttgttccccttcgacctctcctcgactcggattggctcatccccaggtcgaggcgagggtcctcagttct

SEQ ID NO: 145810 - DNA, 75 bp, Artificial Sequence
  Synthetic
tttggagagcactccgggccgaagggttgagtagcatccagagcgaggaacccacacggagtagaacagagaaat

SEQ ID NO: 145811 - DNA, 75 bp, Artificial Sequence
  Synthetic
gttgagtagcatccagagcgaggaacccacacggagtagaacagagaaatcacctccagaggaccccttaagcga

SEQ ID NO: 145812 - DNA, 75 bp, Artificial Sequence
  Synthetic
cccacacggagtagaacagagaaatcacctccagaggaccccttaagcgaacaaaggagtctcctacggaatagg

SEQ ID NO: 145813 - DNA, 75 bp, Artificial Sequence
  Synthetic
agtaagaccatagcgatagggggagatgctaggagttagaggagaccgaagcgaggaggaaagcaaagaaagcaa

SEQ ID NO: 145814 - DNA, 75 bp, Artificial Sequence
  Synthetic
agagtatatcctatgggaatccctgcgtccctctcgtgtccagcccctccccgtgtctatggaagggggactccg

SEQ ID NO: 145815 - DNA, 75 bp, Artificial Sequence
  Synthetic
gattttcttcttaatcttccggaggtccttttcgagttcctcagctttctttcttccgttcacccactgctcgag

SEQ ID NO: 145816 - DNA, 75 bp, Artificial Sequence
  Synthetic
cgagcatgagccaattccgagcgaagggggcgcgggaggaaggaggattacccgacagggagtgacggtaaagat

SEQ ID NO: 145817 - DNA, 75 bp, Artificial Sequence
  Synthetic
gcggggaacgccgatgggaactctcccaagaagaaaagaagggaaaatcgggaagtggagggatccccacaacgc

SEQ ID NO: 145818 - DNA, 75 bp, Artificial Sequence
  Synthetic
tggagacatcctggaaggggaaagaagctaggtggaaaagaaggggtgggcctcccgatccgaggggcccgacca

SEQ ID NO: 145819 - DNA, 75 bp, Artificial Sequence
  Synthetic
agagggtcactcgagattcaagaggtggggagggatccccgagacgctgaggaagctccgggaagaaagaaaaga

SEQ ID NO: 145820 - DNA, 75 bp, Artificial Sequence
  Synthetic
aggcagggaatggtagaaaagagcgagcctcccgattacgagtttgccaggacctatcaagattggagtcatccg

SEQ ID NO: 145821 - DNA, 75 bp, Artificial Sequence
  Synthetic
tcggagagggcgggcggtcctgagaactcttatcttcctgcttagaagaggagtctcctggacgcccccgcccac

SEQ ID NO: 145822 - DNA, 75 bp, Artificial Sequence
  Synthetic
aaaaatcacctccagaggaccccttcagcgaacagaagagactcccctcgataggagcaagaccatagcgatggg

SEQ ID NO: 145823 - DNA, 75 bp, Artificial Sequence
  Synthetic
tccacactccttcccccctgcggggcccccccataagatggcgagatctccactcattgggtccttcgtccatct

SEQ ID NO: 145824 - DNA, 75 bp, Artificial Sequence
  Synthetic
gctgagggctaacctacggaaattcctgagctcccctgacgtccaggccgtcccctctccgagtgaagggagact

SEQ ID NO: 145825 - DNA, 75 bp, Artificial Sequence
  Synthetic
catgggccatctccgagcgaagggaacgcgctggagagatcatctcccgagaggggatgaacggtaaagagcatt

SEQ ID NO: 145826 - DNA, 75 bp, Artificial Sequence
  Synthetic
acgcgctggagagatcatctcccgagaggggatgaacggtaaagagcattggatcatcgaaggtaagtccccaag

SEQ ID NO: 145827 - DNA, 75 bp, Artificial Sequence
  Synthetic
ggatcatcgaaggtaagtccccaagaaggaaaaaagagaaagcaagagacggacgacctccctatggcgctagag

SEQ ID NO: 145828 - DNA, 75 bp, Artificial Sequence
  Synthetic
cgatccgaggggcccaactgccaagtttggagagcaccccggccgaagggtcgaggtaccccagaaggaggaatc

SEQ ID NO: 145829 - DNA, 75 bp, Artificial Sequence
  Synthetic
tctcggagaaaaggagacaaatcacctccagaggaccccttcagcgaacagagaactctgacgcgcgaggacgaa

SEQ ID NO: 145830 - DNA, 75 bp, Artificial Sequence
  Synthetic
gagaactctgacgcgcgaggacgaagcccatagcgatggaaagagatgctaggagttagaggagaccagaacgag

SEQ ID NO: 145831 - DNA, 75 bp, Artificial Sequence
  Synthetic
aaaatgaccgaggggggtggctaggaacgcgggggaccggtggagccatgggatgcccttcccgatgtccgtcca

SEQ ID NO: 145832 - DNA, 75 bp, Artificial Sequence
  Synthetic
ccttgcatgctggggacgaagccgcccccgggcgctcccctcgatccaccttcgagggggttcacacccccaacc

SEQ ID NO: 145833 - DNA, 75 bp, Artificial Sequence
  Synthetic
gacgggccggctactcttctttccctttcctcgtcttccttggtcaacctcttaagttcctcttcttcttccctg

SEQ ID NO: 145834 - DNA, 75 bp, Artificial Sequence
  Synthetic
aagaggcggcggtcctcagtactcttactcttttctgtaaagaggagactgctggactcgccgcccaagttcgag

SEQ ID NO: 145835 - DNA, 75 bp, Artificial Sequence
  Synthetic
cccgtccttccccttttctgattattccgaggatgttccccagccagggattttcctcctcaagtttcttgatgg

SEQ ID NO: 145836 - DNA, 75 bp, Artificial Sequence
  Synthetic
atgagccaattccgaacgaaggaccgcaggggggagagttcagcgaccgagaggggatgaacaacaaggagtgag

SEQ ID NO: 145837 - DNA, 75 bp, Artificial Sequence
  Synthetic
gcaggggggagagttcagcgaccgagaggggatgaacaacaaggagtgaggaacctccagaaaagctattcccag

SEQ ID NO: 145838 - DNA, 75 bp, Artificial Sequence
  Synthetic
gaggggatgaacaacaaggagtgaggaacctccagaaaagctattcccagaaggtaagaaaggaacaagagtcgg

SEQ ID NO: 145839 - DNA, 75 bp, Artificial Sequence
  Synthetic
gaggggatgaacaacaaggagtgaggaacctccagaaaagctattcccagaaggtaagaaaggatcaagagtcgg

SEQ ID NO: 145840 - DNA, 75 bp, Artificial Sequence
  Synthetic
gaggggatgaacaacaaggagtgaggaacctccagaaaagctattcccagaaggtaagaaaggaccaagagtcgg

SEQ ID NO: 145841 - DNA, 75 bp, Artificial Sequence
  Synthetic
gaggggatgaacaacaaggagtgaggaacctccagaaaagctattcccagaaggtaagaaaggagcaagagtcgg

SEQ ID NO: 145842 - DNA, 75 bp, Artificial Sequence
  Synthetic
aagttttcccgagaacgctggaagcactcttgaaatggaaagaaggaaggttgaaaaaaagggggcggccttccc

SEQ ID NO: 145843 - DNA, 75 bp, Artificial Sequence
  Synthetic
attccaagggccccaagcgacaacttttgaaggcaattccggccggaagggtgaaacctccgccagagggaggaa

SEQ ID NO: 145844 - DNA, 75 bp, Artificial Sequence
  Synthetic
acagaagagccttgctcgggataggagtaagcccatacgcgatggggggagatgctaggagaacgggctagccgt

SEQ ID NO: 145845 - DNA, 75 bp, Artificial Sequence
  Synthetic
gaggggaagagtgaggcttatcccggggaactcggcgaatcgtcaccacatagcagagcccggacccccttccaa

SEQ ID NO: 145846 - DNA, 75 bp, Artificial Sequence
  Synthetic
gaggggaagagtgaggcttatcccggggaactcggcgaatcgtctccacatagcagagcccggacccccttccaa

SEQ ID NO: 145847 - DNA, 75 bp, Artificial Sequence
  Synthetic
gaggggaagagtgaggcttatcccggggaactcggcgaatcgtccccacatagcagagcccggacccccttccaa

SEQ ID NO: 145848 - DNA, 75 bp, Artificial Sequence
  Synthetic
gaggggaagagtgaggcttatcccggggaactcggcgaatcgtcgccacatagcagagcccggacccccttccaa

SEQ ID NO: 145849 - DNA, 75 bp, Artificial Sequence
  Synthetic
gggaactcggcgaatcgtcaccacatagcagagcccggacccccttccaaaaggaccgggggtggagcttagagc

SEQ ID NO: 145850 - DNA, 75 bp, Artificial Sequence
  Synthetic
gggaactcggcgaatcgtctccacatagcagagcccggacccccttccaaaaggaccgggggtggagcttagagc

SEQ ID NO: 145851 - DNA, 75 bp, Artificial Sequence
  Synthetic
gggaactcggcgaatcgtccccacatagcagagcccggacccccttccaaaaggaccgggggtggagcttagagc

SEQ ID NO: 145852 - DNA, 75 bp, Artificial Sequence
  Synthetic
gggaactcggcgaatcgtcgccacatagcagagcccggacccccttccaaaaggaccgggggtggagcttagagc

SEQ ID NO: 145853 - DNA, 75 bp, Artificial Sequence
  Synthetic
gcgggggggacccgctggagccatgggatgcttctcccgattccgtccatccctcccccagggggtcgcccagga

SEQ ID NO: 145854 - DNA, 75 bp, Artificial Sequence
  Synthetic
ggatgcttctcccgattccgtccatccctcccccagggggtcgcccaggaatggcggaaactgcactcatcggag

SEQ ID NO: 145855 - DNA, 75 bp, Artificial Sequence
  Synthetic
ggatgcttctcccgattccgtccatccctcccccagggggtcgcccaggaatggcggaaactgcactcttcggag

SEQ ID NO: 145856 - DNA, 75 bp, Artificial Sequence
  Synthetic
ggatgcttctcccgattccgtccatccctcccccagggggtcgcccaggaatggcggaaactgcactcctcggag

SEQ ID NO: 145857 - DNA, 75 bp, Artificial Sequence
  Synthetic
ggatgcttctcccgattccgtccatccctcccccagggggtcgcccaggaatggcggaaactgcactcgtcggag

SEQ ID NO: 145858 - DNA, 75 bp, Artificial Sequence
  Synthetic
gctggcgccggctgggcaacattccgaggggaccgtcccctcggtaatggcgaatgggacccagaatccctcctc

SEQ ID NO: 145859 - DNA, 75 bp, Artificial Sequence
  Synthetic
atatcctatgggaatccgcggtcccccctcgtgtctagcccatccccgtgtctagagaagggggaatccggaact

SEQ ID NO: 145860 - DNA, 75 bp, Artificial Sequence
  Synthetic
atatcctatgggaatccgcggtcccccctcgtgtctagcccatccccgtgtctagagaagggggattccggaact

SEQ ID NO: 145861 - DNA, 75 bp, Artificial Sequence
  Synthetic
atatcctatgggaatccgcggtcccccctcgtgtctagcccatccccgtgtctagagaagggggactccggaact

SEQ ID NO: 145862 - DNA, 75 bp, Artificial Sequence
  Synthetic
atatcctatgggaatccgcggtcccccctcgtgtctagcccatccccgtgtctagagaagggggagtccggaact

SEQ ID NO: 145863 - DNA, 75 bp, Artificial Sequence
  Synthetic
tcttcttttccttccggagctctttctcgagttcctctgttctcttccttgcgttcacccacttctcgaggagct

SEQ ID NO: 145864 - DNA, 75 bp, Artificial Sequence
  Synthetic
ctcgagttcctctgttctcttccttgcgttcacccacttctcgaggagctcttccctccctccgcgttctttctt

SEQ ID NO: 145865 - DNA, 75 bp, Artificial Sequence
  Synthetic
agaggcggcggtcctcagtactctcaatcttttctgataaagaggagactgctggacccgccgcccatgttcgag

SEQ ID NO: 145866 - DNA, 75 bp, Artificial Sequence
  Synthetic
tgggcctcagttccgagcgaagagccgaaccgggaagaggaagcgcccgagagggagccaatgccaaagaggtgg

SEQ ID NO: 145867 - DNA, 75 bp, Artificial Sequence
  Synthetic
cgaaccgggaagaggaagcgcccgagagggagccaatgccaaagaggtggggatcgtcggaaggtatcgtcccaa

SEQ ID NO: 145868 - DNA, 75 bp, Artificial Sequence
  Synthetic
gagggagccaatgccaaagaggtggggatcgtcggaaggtatcgtcccaatgaccaagagaagggaagaaacgga

SEQ ID NO: 145869 - DNA, 75 bp, Artificial Sequence
  Synthetic
agcctttccccttgacgccggtgaaactctggaataggaagaaggaaggtggaaagaaaggagggaccctcccga

SEQ ID NO: 145870 - DNA, 75 bp, Artificial Sequence
  Synthetic
ggaaagaaaggagggaccctcccgatccgaggggcccaaccaccaagtttggagagcactccgggccgaatggtc

SEQ ID NO: 145871 - DNA, 75 bp, Artificial Sequence
  Synthetic
gagtagcactcagagggaggaatccacacggagtagagcagagaaatcacctccagaggaccccttcagcgaaca

SEQ ID NO: 145872 - DNA, 75 bp, Artificial Sequence
  Synthetic
ctccagaggaccccttcagcgaacagagagcgctgcgagcgaggagtaagaccatagcgatggaaagagatgcta

SEQ ID NO: 145873 - DNA, 75 bp, Artificial Sequence
  Synthetic
accatagcgatggaaagagatgctaggagtagggagagaccgaagcgaggaggaaagcaaagaaagcaacggggc

SEQ ID NO: 145874 - DNA, 75 bp, Artificial Sequence
  Synthetic
tagccggtgggtgttccgccccccgagaggggaagagtgaggcttatcccggggaactcgacttatcgtccccac

SEQ ID NO: 145875 - DNA, 75 bp, Artificial Sequence
  Synthetic
aaaaagactgaggggggtggctaggacgcaggggaccagtggagccgtgggatgctcttcccaatctgacctgac

SEQ ID NO: 145876 - DNA, 75 bp, Artificial Sequence
  Synthetic
gagatcatccactaactttcttgcattgacccactgctcgaggactccttctcttcccgctcgggatttcttcgt

SEQ ID NO: 145877 - DNA, 75 bp, Artificial Sequence
  Synthetic
ctcggaccggctcatcttcggcaaagggcggcggtcctcagtgctcttactcttttctgtaaagaggagactgct

SEQ ID NO: 145878 - DNA, 75 bp, Artificial Sequence
  Synthetic
aaagggcggcggtcctcagtgctcttactcttttctgtaaagaggagactgctggactctccgcccaagccgaga

SEQ ID NO: 145879 - DNA, 75 bp, Artificial Sequence
  Synthetic
catgagccaatttccgaacgggagggtcgcggcgggaaggatcagcttccgagaggggatgaatggcaaagagca

SEQ ID NO: 145880 - DNA, 75 bp, Artificial Sequence
  Synthetic
gtcgcggcgggaaggatcagcttccgagaggggatgaatggcaaagagcattggaacgccgaggggatatctccc

SEQ ID NO: 145881 - DNA, 75 bp, Artificial Sequence
  Synthetic
gagaggggatgaatggcaaagagcattggaacgccgaggggatatctcccaagaaggaaaaaaggaaaaagagtc

SEQ ID NO: 145882 - DNA, 75 bp, Artificial Sequence
  Synthetic
cgatccgaaaggcccgacgcccaagtttggagagcactccggccgaagggttgagaacaccagagggaggaacac

SEQ ID NO: 145883 - DNA, 75 bp, Artificial Sequence
  Synthetic
acacggagatcagcagagaaatcacctccagaggaccccttcagcgaacagaagagcactgcacgggtcaggagt

SEQ ID NO: 145884 - DNA, 75 bp, Artificial Sequence
  Synthetic
gaggcctcttcctaggcccggagtctatctccatctggtccgttcgggccctcttcgccgggggagccccctctc

SEQ ID NO: 145885 - DNA, 75 bp, Artificial Sequence
  Synthetic
ttttcttcctcaagtttcttgattttcttcttaaccttccggaggtccctctcgagttcctctaacttctttctt

SEQ ID NO: 145886 - DNA, 75 bp, Artificial Sequence
  Synthetic
ctcgagttcctctaacttctttcttccatttatccactgctcgagagtctcttctcttcccccgcggttcctcct

SEQ ID NO: 145887 - DNA, 75 bp, Artificial Sequence
  Synthetic
cgattcggaccggctcatctcgacaagaggcggcagtcctcagtactcttactcttttctgataaagaggagact

SEQ ID NO: 145888 - DNA, 75 bp, Artificial Sequence
  Synthetic
atgagccacgttccgagcgaagggaacgacggggagggggacagacccgaaagggactgaacgataaagatgaga

SEQ ID NO: 145889 - DNA, 75 bp, Artificial Sequence
  Synthetic
acgacggggagggggacagacccgaaagggactgaacgataaagatgagaggaacctcgggaggaatcctcccaa

SEQ ID NO: 145890 - DNA, 75 bp, Artificial Sequence
  Synthetic
aagggactgaacgataaagatgagaggaacctcgggaggaatcctcccaagaagccaaagagaactcaagaaaga

SEQ ID NO: 145891 - DNA, 75 bp, Artificial Sequence
  Synthetic
ggagatctccccacgacgctggtgaagctctaggaagcggaagaaggaaggtggaagaaaaggagtgagcctccc

SEQ ID NO: 145892 - DNA, 75 bp, Artificial Sequence
  Synthetic
agctctaggaagcggaagaaggaaggtggaagaaaaggagtgagcctcccgaaccgaacgccccgacgcccaagt

SEQ ID NO: 145893 - DNA, 75 bp, Artificial Sequence
  Synthetic
ttggaaagcactccggcccaaagggttgaattccacccagaggggggaagccacacggagaaaggagaaaaatca

SEQ ID NO: 145894 - DNA, 75 bp, Artificial Sequence
  Synthetic
ttgaattccacccagaggggggaagccacacggagaaaggagaaaaatcacctccagaggaccccttcagcgaac

SEQ ID NO: 145895 - DNA, 75 bp, Artificial Sequence
  Synthetic
agaaggctctctcacgcggtaggagaaagaccatagcgataggaggggatgctaggagtaggtggaggccaaggc

SEQ ID NO: 145896 - DNA, 75 bp, Artificial Sequence
  Synthetic
aaagaccatagcgataggaggggatgctaggagtaggtggaggccaaggcgaggaagaaagtaagagagcagcgg

SEQ ID NO: 145897 - DNA, 75 bp, Artificial Sequence
  Synthetic
ggctagtcgacgggtgttccacctcccgagaggggacgagtgaggcttatcccggggaactcggcaaatcgctcc

SEQ ID NO: 145898 - DNA, 75 bp, Artificial Sequence
  Synthetic
ccgagaggggacgagtgaggcttatcccggggaactcggcaaatcgctcccacatagcaggccccgggccccctc

SEQ ID NO: 145899 - DNA, 75 bp, Artificial Sequence
  Synthetic
caaaaatgaccggggagggcgcttagaacgcgggggagcagtagggtccgtgggatgctcctcccgattccgtcc

SEQ ID NO: 145900 - DNA, 75 bp, Artificial Sequence
  Synthetic
ttccgaggggaccgccccctcggtaatggcgaatgggacccagagttctctctagtttccaacagagaaacgaga

SEQ ID NO: 145901 - DNA, 75 bp, Artificial Sequence
  Synthetic
aaagggaggatcggatgggaagagtatatcctacgggaatcctccggttcccgtcacgtctagcccctccccgcg

SEQ ID NO: 145902 - DNA, 75 bp, Artificial Sequence
  Synthetic
ttcgagggggttcacacccccagccgacgggccggctattcttcttgatctttcctcgtcctccctggccaacct

SEQ ID NO: 145903 - DNA, 75 bp, Artificial Sequence
  Synthetic
tccttgtcggtgaatccccccctgagaggcttcttcctaggtccggagtctatctccatctggtccgtccggggc

SEQ ID NO: 145904 - DNA, 75 bp, Artificial Sequence
  Synthetic
tcctttgatgtttcccagccagggattttcctcctcaagtttcttgatcttcttctttgccttccggagttcctt

SEQ ID NO: 145905 - DNA, 75 bp, Artificial Sequence
  Synthetic
ctcgagctcctctgctttctttctttcgttcacccacttctcgagggtgtcctctcttccccctcgattcttctt

SEQ ID NO: 145906 - DNA, 75 bp, Artificial Sequence
  Synthetic
tccgcaggtgggaggatcagccaccggtgagggacgcgatggcaagagtggaggaaagttcggagggaaatccca

SEQ ID NO: 145907 - DNA, 75 bp, Artificial Sequence
  Synthetic
agaagatcactcgagattcaagcggtgaggggggacccccgagacgctggtgaacccccggaaaaaaagaaaaga

SEQ ID NO: 145908 - DNA, 75 bp, Artificial Sequence
  Synthetic
ttctccacactccttcccccctgcggggcccccccataagatggcgagaaatccactcatgggtccatcgtccat

SEQ ID NO: 145909 - DNA, 75 bp, Artificial Sequence
  Synthetic
ctccggaatgccttccatggagggcacgaagccgccgccgggcgctcccctcggaggtccctcgagggggttcac

SEQ ID NO: 145910 - DNA, 75 bp, Artificial Sequence
  Synthetic
cttcgacgagaggcggggcgtcccgagaactcttatcttcctgcttagaagaggagtctcctggacgccctccgc

SEQ ID NO: 145911 - DNA, 75 bp, Artificial Sequence
  Synthetic
atgagccaagtcggaacgaagagatcgcgggggcgggatcagccgacgagaggggatgaataccaaagagcattg

SEQ ID NO: 145912 - DNA, 75 bp, Artificial Sequence
  Synthetic
cgcgggggcgggatcagccgacgagaggggatgaataccaaagagcattggatcgtcggaggtagtcccccaaga

SEQ ID NO: 145913 - DNA, 75 bp, Artificial Sequence
  Synthetic
aggggatgaataccaaagagcattggatcgtcggaggtagtcccccaagaaggacaaagagaatgcaagaaacgg

SEQ ID NO: 145914 - DNA, 75 bp, Artificial Sequence
  Synthetic
aagcctttccccacaacgctggagacatcttggaagggggaagaggcaggtggaaaaagaaggggcgggcctccc

SEQ ID NO: 145915 - DNA, 75 bp, Artificial Sequence
  Synthetic
catcttggaagggggaagaggcaggtggaaaaagaaggggcgggcctcccgatccgaggggcccgacgtccagaa

SEQ ID NO: 145916 - DNA, 75 bp, Artificial Sequence
  Synthetic
attggaaggcactccgggccgaagggttcagagtacccagagcgaggaatacactcggagaaaagcagacaaatc

SEQ ID NO: 145917 - DNA, 75 bp, Artificial Sequence
  Synthetic
acactcggagaaaagcagacaaatcacgtccagcggaccccttcagcgaacagagagcatctgacgcgcgaggag

SEQ ID NO: 145918 - DNA, 75 bp, Artificial Sequence
  Synthetic
cccgagaggggacgagtgaggcttatcccggggaactcggcgaattcgtccccacatagcagcgcccggagcccc

SEQ ID NO: 145919 - DNA, 75 bp, Artificial Sequence
  Synthetic
ttctaaaagggaccgagggggtggctaggagcatgggggaccagtggagccatgggatgcccttccccgatgtcc

SEQ ID NO: 145920 - DNA, 75 bp, Artificial Sequence
  Synthetic
catgggatgcccttccccgatgtccgtccatccctcccccccgagggtcgcccaggaatggcgggacctcaccca

SEQ ID NO: 145921 - DNA, 75 bp, Artificial Sequence
  Synthetic
gagaaaactggctctcccttagccatccgagtggacgttcgtcctccttcggatgcccaggtcggaccgcgagga

SEQ ID NO: 145922 - DNA, 75 bp, Artificial Sequence
  Synthetic
ctctcgagatcctctaacttctttcttgtattcacccactgctcgagagtctcttccctgcctccgcggctcttc

SEQ ID NO: 145923 - DNA, 75 bp, Artificial Sequence
  Synthetic
ttgtattcacccactgctcgagagtctcttccctgcctccgcggctcttcttcgattccgagcggctcatctcgg

SEQ ID NO: 145924 - DNA, 75 bp, Artificial Sequence
  Synthetic
caagaggcggcgatcctcagtactcttactcttttcttttgaaagaggagactgctggacccgccgcccaagccc

SEQ ID NO: 145925 - DNA, 75 bp, Artificial Sequence
  Synthetic
ccccaggtcgaggcgagggtcctcagttctttcctctgtaaagaggagactgctgggccaaacgcccgagccggg

SEQ ID NO: 145926 - DNA, 75 bp, Artificial Sequence
  Synthetic
atgagccaacttccgaacgaggagagcgcgggggaggaatcggcgcccgagagggagtagaaggtaaagagcatt

SEQ ID NO: 145927 - DNA, 75 bp, Artificial Sequence
  Synthetic
ggaacgccgaggggaaacctcccaagaagtccaagagaaggcaagaatcggacgattatccccaagacgctggaa

SEQ ID NO: 145928 - DNA, 75 bp, Artificial Sequence
  Synthetic
ggaacgccgaggggaaacctcccaagaagtccaagagaaggcaagaatcggacgattttccccaagacgctggaa

SEQ ID NO: 145929 - DNA, 75 bp, Artificial Sequence
  Synthetic
ggaacgccgaggggaaacctcccaagaagtccaagagaaggcaagaatcggacgattctccccaagacgctggaa

SEQ ID NO: 145930 - DNA, 75 bp, Artificial Sequence
  Synthetic
ggaacgccgaggggaaacctcccaagaagtccaagagaaggcaagaatcggacgattgtccccaagacgctggaa

SEQ ID NO: 145931 - DNA, 75 bp, Artificial Sequence
  Synthetic
ggaacgccgaggggatacctcccaagaagtccaagagaaggcaagaatcggacgattatccccaagacgctggaa

SEQ ID NO: 145932 - DNA, 75 bp, Artificial Sequence
  Synthetic
ggaacgccgaggggatacctcccaagaagtccaagagaaggcaagaatcggacgattttccccaagacgctggaa

SEQ ID NO: 145933 - DNA, 75 bp, Artificial Sequence
  Synthetic
ggaacgccgaggggatacctcccaagaagtccaagagaaggcaagaatcggacgattctccccaagacgctggaa

SEQ ID NO: 145934 - DNA, 75 bp, Artificial Sequence
  Synthetic
ggaacgccgaggggatacctcccaagaagtccaagagaaggcaagaatcggacgattgtccccaagacgctggaa

SEQ ID NO: 145935 - DNA, 75 bp, Artificial Sequence
  Synthetic
ggaacgccgaggggacacctcccaagaagtccaagagaaggcaagaatcggacgattatccccaagacgctggaa

SEQ ID NO: 145936 - DNA, 75 bp, Artificial Sequence
  Synthetic
ggaacgccgaggggacacctcccaagaagtccaagagaaggcaagaatcggacgattttccccaagacgctggaa

SEQ ID NO: 145937 - DNA, 75 bp, Artificial Sequence
  Synthetic
ggaacgccgaggggacacctcccaagaagtccaagagaaggcaagaatcggacgattctccccaagacgctggaa

SEQ ID NO: 145938 - DNA, 75 bp, Artificial Sequence
  Synthetic
ggaacgccgaggggacacctcccaagaagtccaagagaaggcaagaatcggacgattgtccccaagacgctggaa

SEQ ID NO: 145939 - DNA, 75 bp, Artificial Sequence
  Synthetic
ggaacgccgaggggagacctcccaagaagtccaagagaaggcaagaatcggacgattatccccaagacgctggaa

SEQ ID NO: 145940 - DNA, 75 bp, Artificial Sequence
  Synthetic
ggaacgccgaggggagacctcccaagaagtccaagagaaggcaagaatcggacgattttccccaagacgctggaa

SEQ ID NO: 145941 - DNA, 75 bp, Artificial Sequence
  Synthetic
ggaacgccgaggggagacctcccaagaagtccaagagaaggcaagaatcggacgattctccccaagacgctggaa

SEQ ID NO: 145942 - DNA, 75 bp, Artificial Sequence
  Synthetic
ggaacgccgaggggagacctcccaagaagtccaagagaaggcaagaatcggacgattgtccccaagacgctggaa

SEQ ID NO: 145943 - DNA, 75 bp, Artificial Sequence
  Synthetic
gtcgtcctgggaggggaaagaggatgggtggaaaagaaggggcgggcctcccgatccgaggggcccgacctccaa

SEQ ID NO: 145944 - DNA, 75 bp, Artificial Sequence
  Synthetic
ggttgagtagcatccagagggagagaaccacacggagaaaagcagacaaatcacctccagaggaccccttcagcg

SEQ ID NO: 145945 - DNA, 75 bp, Artificial Sequence
  Synthetic
ttttcttcttgaccttccggagatccctctcgagttcctctaacttctttcttccttcaaaccactgctcgagag

SEQ ID NO: 145946 - DNA, 75 bp, Artificial Sequence
  Synthetic
ttttcttcttgaccttccggagatccctctcgagttcctctaacttctttcttccttcaatccactgctcgagag

SEQ ID NO: 145947 - DNA, 75 bp, Artificial Sequence
  Synthetic
ttttcttcttgaccttccggagatccctctcgagttcctctaacttctttcttccttcaacccactgctcgagag

SEQ ID NO: 145948 - DNA, 75 bp, Artificial Sequence
  Synthetic
ttttcttcttgaccttccggagatccctctcgagttcctctaacttctttcttccttcaagccactgctcgagag

SEQ ID NO: 145949 - DNA, 75 bp, Artificial Sequence
  Synthetic
ttttcttcttgaccttccggagatccctctcgagttcctctaacttctttcttccttctaaccactgctcgagag

SEQ ID NO: 145950 - DNA, 75 bp, Artificial Sequence
  Synthetic
ttttcttcttgaccttccggagatccctctcgagttcctctaacttctttcttccttctatccactgctcgagag

SEQ ID NO: 145951 - DNA, 75 bp, Artificial Sequence
  Synthetic
ttttcttcttgaccttccggagatccctctcgagttcctctaacttctttcttccttctacccactgctcgagag

SEQ ID NO: 145952 - DNA, 75 bp, Artificial Sequence
  Synthetic
ttttcttcttgaccttccggagatccctctcgagttcctctaacttctttcttccttctagccactgctcgagag

SEQ ID NO: 145953 - DNA, 75 bp, Artificial Sequence
  Synthetic
ttttcttcttgaccttccggagatccctctcgagttcctctaacttctttcttccttccaaccactgctcgagag

SEQ ID NO: 145954 - DNA, 75 bp, Artificial Sequence
  Synthetic
ttttcttcttgaccttccggagatccctctcgagttcctctaacttctttcttccttccatccactgctcgagag

SEQ ID NO: 145955 - DNA, 75 bp, Artificial Sequence
  Synthetic
ttttcttcttgaccttccggagatccctctcgagttcctctaacttctttcttccttccacccactgctcgagag

SEQ ID NO: 145956 - DNA, 75 bp, Artificial Sequence
  Synthetic
ttttcttcttgaccttccggagatccctctcgagttcctctaacttctttcttccttccagccactgctcgagag

SEQ ID NO: 145957 - DNA, 75 bp, Artificial Sequence
  Synthetic
ttttcttcttgaccttccggagatccctctcgagttcctctaacttctttcttccttcgaaccactgctcgagag

SEQ ID NO: 145958 - DNA, 75 bp, Artificial Sequence
  Synthetic
ttttcttcttgaccttccggagatccctctcgagttcctctaacttctttcttccttcgatccactgctcgagag

SEQ ID NO: 145959 - DNA, 75 bp, Artificial Sequence
  Synthetic
ttttcttcttgaccttccggagatccctctcgagttcctctaacttctttcttccttcgacccactgctcgagag

SEQ ID NO: 145960 - DNA, 75 bp, Artificial Sequence
  Synthetic
ttttcttcttgaccttccggagatccctctcgagttcctctaacttctttcttccttcgagccactgctcgagag

SEQ ID NO: 145961 - DNA, 75 bp, Artificial Sequence
  Synthetic
ttttcttcttgaccttccggagttccctctcgagttcctctaacttctttcttccttcaaaccactgctcgagag

SEQ ID NO: 145962 - DNA, 75 bp, Artificial Sequence
  Synthetic
ttttcttcttgaccttccggagttccctctcgagttcctctaacttctttcttccttcaatccactgctcgagag

SEQ ID NO: 145963 - DNA, 75 bp, Artificial Sequence
  Synthetic
ttttcttcttgaccttccggagttccctctcgagttcctctaacttctttcttccttcaacccactgctcgagag

SEQ ID NO: 145964 - DNA, 75 bp, Artificial Sequence
  Synthetic
ttttcttcttgaccttccggagttccctctcgagttcctctaacttctttcttccttcaagccactgctcgagag

SEQ ID NO: 145965 - DNA, 75 bp, Artificial Sequence
  Synthetic
ttttcttcttgaccttccggagttccctctcgagttcctctaacttctttcttccttctaaccactgctcgagag

SEQ ID NO: 145966 - DNA, 75 bp, Artificial Sequence
  Synthetic
ttttcttcttgaccttccggagttccctctcgagttcctctaacttctttcttccttctatccactgctcgagag

SEQ ID NO: 145967 - DNA, 75 bp, Artificial Sequence
  Synthetic
ttttcttcttgaccttccggagttccctctcgagttcctctaacttctttcttccttctacccactgctcgagag

SEQ ID NO: 145968 - DNA, 75 bp, Artificial Sequence
  Synthetic
ttttcttcttgaccttccggagttccctctcgagttcctctaacttctttcttccttctagccactgctcgagag

SEQ ID NO: 145969 - DNA, 75 bp, Artificial Sequence
  Synthetic
ttttcttcttgaccttccggagttccctctcgagttcctctaacttctttcttccttccaaccactgctcgagag

SEQ ID NO: 145970 - DNA, 75 bp, Artificial Sequence
  Synthetic
ttttcttcttgaccttccggagttccctctcgagttcctctaacttctttcttccttccatccactgctcgagag

SEQ ID NO: 145971 - DNA, 75 bp, Artificial Sequence
  Synthetic
ttttcttcttgaccttccggagttccctctcgagttcctctaacttctttcttccttccacccactgctcgagag

SEQ ID NO: 145972 - DNA, 75 bp, Artificial Sequence
  Synthetic
ttttcttcttgaccttccggagttccctctcgagttcctctaacttctttcttccttccagccactgctcgagag

SEQ ID NO: 145973 - DNA, 75 bp, Artificial Sequence
  Synthetic
ttttcttcttgaccttccggagttccctctcgagttcctctaacttctttcttccttcgaaccactgctcgagag

SEQ ID NO: 145974 - DNA, 75 bp, Artificial Sequence
  Synthetic
ttttcttcttgaccttccggagttccctctcgagttcctctaacttctttcttccttcgatccactgctcgagag

SEQ ID NO: 145975 - DNA, 75 bp, Artificial Sequence
  Synthetic
ttttcttcttgaccttccggagttccctctcgagttcctctaacttctttcttccttcgacccactgctcgagag

SEQ ID NO: 145976 - DNA, 75 bp, Artificial Sequence
  Synthetic
ttttcttcttgaccttccggagttccctctcgagttcctctaacttctttcttccttcgagccactgctcgagag

SEQ ID NO: 145977 - DNA, 75 bp, Artificial Sequence
  Synthetic
ttttcttcttgaccttccggagctccctctcgagttcctctaacttctttcttccttcaaaccactgctcgagag

SEQ ID NO: 145978 - DNA, 75 bp, Artificial Sequence
  Synthetic
ttttcttcttgaccttccggagctccctctcgagttcctctaacttctttcttccttcaatccactgctcgagag

SEQ ID NO: 145979 - DNA, 75 bp, Artificial Sequence
  Synthetic
ttttcttcttgaccttccggagctccctctcgagttcctctaacttctttcttccttcaacccactgctcgagag

SEQ ID NO: 145980 - DNA, 75 bp, Artificial Sequence
  Synthetic
ttttcttcttgaccttccggagctccctctcgagttcctctaacttctttcttccttcaagccactgctcgagag

SEQ ID NO: 145981 - DNA, 75 bp, Artificial Sequence
  Synthetic
ttttcttcttgaccttccggagctccctctcgagttcctctaacttctttcttccttctaaccactgctcgagag

SEQ ID NO: 145982 - DNA, 75 bp, Artificial Sequence
  Synthetic
ttttcttcttgaccttccggagctccctctcgagttcctctaacttctttcttccttctatccactgctcgagag

SEQ ID NO: 145983 - DNA, 75 bp, Artificial Sequence
  Synthetic
ttttcttcttgaccttccggagctccctctcgagttcctctaacttctttcttccttctacccactgctcgagag

SEQ ID NO: 145984 - DNA, 75 bp, Artificial Sequence
  Synthetic
ttttcttcttgaccttccggagctccctctcgagttcctctaacttctttcttccttctagccactgctcgagag

SEQ ID NO: 145985 - DNA, 75 bp, Artificial Sequence
  Synthetic
ttttcttcttgaccttccggagctccctctcgagttcctctaacttctttcttccttccaaccactgctcgagag

SEQ ID NO: 145986 - DNA, 75 bp, Artificial Sequence
  Synthetic
ttttcttcttgaccttccggagctccctctcgagttcctctaacttctttcttccttccatccactgctcgagag

SEQ ID NO: 145987 - DNA, 75 bp, Artificial Sequence
  Synthetic
ttttcttcttgaccttccggagctccctctcgagttcctctaacttctttcttccttccacccactgctcgagag

SEQ ID NO: 145988 - DNA, 75 bp, Artificial Sequence
  Synthetic
ttttcttcttgaccttccggagctccctctcgagttcctctaacttctttcttccttccagccactgctcgagag

SEQ ID NO: 145989 - DNA, 75 bp, Artificial Sequence
  Synthetic
ttttcttcttgaccttccggagctccctctcgagttcctctaacttctttcttccttcgaaccactgctcgagag

SEQ ID NO: 145990 - DNA, 75 bp, Artificial Sequence
  Synthetic
ttttcttcttgaccttccggagctccctctcgagttcctctaacttctttcttccttcgatccactgctcgagag

SEQ ID NO: 145991 - DNA, 75 bp, Artificial Sequence
  Synthetic
ttttcttcttgaccttccggagctccctctcgagttcctctaacttctttcttccttcgacccactgctcgagag

SEQ ID NO: 145992 - DNA, 75 bp, Artificial Sequence
  Synthetic
ttttcttcttgaccttccggagctccctctcgagttcctctaacttctttcttccttcgagccactgctcgagag

SEQ ID NO: 145993 - DNA, 75 bp, Artificial Sequence
  Synthetic
ttttcttcttgaccttccggaggtccctctcgagttcctctaacttctttcttccttcaaaccactgctcgagag

SEQ ID NO: 145994 - DNA, 75 bp, Artificial Sequence
  Synthetic
ttttcttcttgaccttccggaggtccctctcgagttcctctaacttctttcttccttcaatccactgctcgagag

SEQ ID NO: 145995 - DNA, 75 bp, Artificial Sequence
  Synthetic
ttttcttcttgaccttccggaggtccctctcgagttcctctaacttctttcttccttcaacccactgctcgagag

SEQ ID NO: 145996 - DNA, 75 bp, Artificial Sequence
  Synthetic
ttttcttcttgaccttccggaggtccctctcgagttcctctaacttctttcttccttcaagccactgctcgagag

SEQ ID NO: 145997 - DNA, 75 bp, Artificial Sequence
  Synthetic
ttttcttcttgaccttccggaggtccctctcgagttcctctaacttctttcttccttctaaccactgctcgagag

SEQ ID NO: 145998 - DNA, 75 bp, Artificial Sequence
  Synthetic
ttttcttcttgaccttccggaggtccctctcgagttcctctaacttctttcttccttctatccactgctcgagag

SEQ ID NO: 145999 - DNA, 75 bp, Artificial Sequence
  Synthetic
ttttcttcttgaccttccggaggtccctctcgagttcctctaacttctttcttccttctacccactgctcgagag

SEQ ID NO: 146000 - DNA, 75 bp, Artificial Sequence
  Synthetic
ttttcttcttgaccttccggaggtccctctcgagttcctctaacttctttcttccttctagccactgctcgagag

SEQ ID NO: 146001 - DNA, 75 bp, Artificial Sequence
  Synthetic
ttttcttcttgaccttccggaggtccctctcgagttcctctaacttctttcttccttccaaccactgctcgagag

SEQ ID NO: 146002 - DNA, 75 bp, Artificial Sequence
  Synthetic
ttttcttcttgaccttccggaggtccctctcgagttcctctaacttctttcttccttccatccactgctcgagag

SEQ ID NO: 146003 - DNA, 75 bp, Artificial Sequence
  Synthetic
ttttcttcttgaccttccggaggtccctctcgagttcctctaacttctttcttccttccacccactgctcgagag

SEQ ID NO: 146004 - DNA, 75 bp, Artificial Sequence
  Synthetic
ttttcttcttgaccttccggaggtccctctcgagttcctctaacttctttcttccttccagccactgctcgagag

SEQ ID NO: 146005 - DNA, 75 bp, Artificial Sequence
  Synthetic
ttttcttcttgaccttccggaggtccctctcgagttcctctaacttctttcttccttcgaaccactgctcgagag

SEQ ID NO: 146006 - DNA, 75 bp, Artificial Sequence
  Synthetic
ttttcttcttgaccttccggaggtccctctcgagttcctctaacttctttcttccttcgatccactgctcgagag

SEQ ID NO: 146007 - DNA, 75 bp, Artificial Sequence
  Synthetic
ttttcttcttgaccttccggaggtccctctcgagttcctctaacttctttcttccttcgacccactgctcgagag

SEQ ID NO: 146008 - DNA, 75 bp, Artificial Sequence
  Synthetic
ttttcttcttgaccttccggaggtccctctcgagttcctctaacttctttcttccttcgagccactgctcgagag

SEQ ID NO: 146009 - DNA, 75 bp, Artificial Sequence
  Synthetic
tgtcttctcttcctccgcgcctcttcctcgattcggagcggctcatctcggctagaggcgggggtcctcagtact

SEQ ID NO: 146010 - DNA, 75 bp, Artificial Sequence
  Synthetic
tgtcttctcttcctccgcgcctcttcctcgattcggagcggctcatctcggctagaggcgggggtcctcagttct

SEQ ID NO: 146011 - DNA, 75 bp, Artificial Sequence
  Synthetic
tgtcttctcttcctccgcgcctcttcctcgattcggagcggctcatctcggctagaggcgggggtcctcagtcct

SEQ ID NO: 146012 - DNA, 75 bp, Artificial Sequence
  Synthetic
tgtcttctcttcctccgcgcctcttcctcgattcggagcggctcatctcggctagaggcgggggtcctcagtgct

SEQ ID NO: 146013 - DNA, 75 bp, Artificial Sequence
  Synthetic
gctagaggcgggggtcctcagtactcttactcttttctgtaaagaggagactgctggacgcaccgcccaagtccg

SEQ ID NO: 146014 - DNA, 75 bp, Artificial Sequence
  Synthetic
gctagaggcgggggtcctcagtactcttactcttttctgtaaagaggagactgctggacgctccgcccaagtccg

SEQ ID NO: 146015 - DNA, 75 bp, Artificial Sequence
  Synthetic
gctagaggcgggggtcctcagtactcttactcttttctgtaaagaggagactgctggacgccccgcccaagtccg

SEQ ID NO: 146016 - DNA, 75 bp, Artificial Sequence
  Synthetic
gctagaggcgggggtcctcagtactcttactcttttctgtaaagaggagactgctggacgcgccgcccaagtccg

SEQ ID NO: 146017 - DNA, 75 bp, Artificial Sequence
  Synthetic
gctagaggcgggggtcctcagttctcttactcttttctgtaaagaggagactgctggacgcaccgcccaagtccg

SEQ ID NO: 146018 - DNA, 75 bp, Artificial Sequence
  Synthetic
gctagaggcgggggtcctcagttctcttactcttttctgtaaagaggagactgctggacgctccgcccaagtccg

SEQ ID NO: 146019 - DNA, 75 bp, Artificial Sequence
  Synthetic
gctagaggcgggggtcctcagttctcttactcttttctgtaaagaggagactgctggacgccccgcccaagtccg

SEQ ID NO: 146020 - DNA, 75 bp, Artificial Sequence
  Synthetic
gctagaggcgggggtcctcagttctcttactcttttctgtaaagaggagactgctggacgcgccgcccaagtccg

SEQ ID NO: 146021 - DNA, 75 bp, Artificial Sequence
  Synthetic
gctagaggcgggggtcctcagtcctcttactcttttctgtaaagaggagactgctggacgcaccgcccaagtccg

SEQ ID NO: 146022 - DNA, 75 bp, Artificial Sequence
  Synthetic
gctagaggcgggggtcctcagtcctcttactcttttctgtaaagaggagactgctggacgctccgcccaagtccg

SEQ ID NO: 146023 - DNA, 75 bp, Artificial Sequence
  Synthetic
gctagaggcgggggtcctcagtcctcttactcttttctgtaaagaggagactgctggacgccccgcccaagtccg

SEQ ID NO: 146024 - DNA, 75 bp, Artificial Sequence
  Synthetic
gctagaggcgggggtcctcagtcctcttactcttttctgtaaagaggagactgctggacgcgccgcccaagtccg

SEQ ID NO: 146025 - DNA, 75 bp, Artificial Sequence
  Synthetic
gctagaggcgggggtcctcagtgctcttactcttttctgtaaagaggagactgctggacgcaccgcccaagtccg

SEQ ID NO: 146026 - DNA, 75 bp, Artificial Sequence
  Synthetic
gctagaggcgggggtcctcagtgctcttactcttttctgtaaagaggagactgctggacgctccgcccaagtccg

SEQ ID NO: 146027 - DNA, 75 bp, Artificial Sequence
  Synthetic
gctagaggcgggggtcctcagtgctcttactcttttctgtaaagaggagactgctggacgccccgcccaagtccg

SEQ ID NO: 146028 - DNA, 75 bp, Artificial Sequence
  Synthetic
gctagaggcgggggtcctcagtgctcttactcttttctgtaaagaggagactgctggacgcgccgcccaagtccg

SEQ ID NO: 146029 - DNA, 75 bp, Artificial Sequence
  Synthetic
tgggaggggaaagaggatgggtggaaaagaaggggcgggcctcccgatccgaggggcccgacctccaagtttgga

SEQ ID NO: 146030 - DNA, 75 bp, Artificial Sequence
  Synthetic
ccgatccgaggggcccaacctccagatctggagagcactccggcccgaagggttgagtagcactcagagggagga

SEQ ID NO: 146031 - DNA, 75 bp, Artificial Sequence
  Synthetic
aagaggaaagaaggacgcgagacgcaaacctgtgagtggaaacccgctttattcactggggtcgacaactctggg

SEQ ID NO: 146032 - DNA, 75 bp, Artificial Sequence
  Synthetic
atgggccaagagccgacgaagaggtcgaaggaggagaaggagtgagtccccaaggggttcgaagccaaagagtgg

SEQ ID NO: 146033 - DNA, 75 bp, Artificial Sequence
  Synthetic
cgaaggaggagaaggagtgagtccccaaggggttcgaagccaaagagtggaaacactcgaggaagagggagtccc

SEQ ID NO: 146034 - DNA, 75 bp, Artificial Sequence
  Synthetic
caaggggttcgaagccaaagagtggaaacactcgaggaagagggagtcccaagagggcgaggggagctttcagga

SEQ ID NO: 146035 - DNA, 75 bp, Artificial Sequence
  Synthetic
gggagggtgaatccccgagacgctggagactcccggaatgaggaaagtggggataggctaggtagaaaagagcga

SEQ ID NO: 146036 - DNA, 75 bp, Artificial Sequence
  Synthetic
gggagggtgaatccccgagtcgctggagactcccggaatgaggaaagtggggataggctaggtagaaaagagcga

SEQ ID NO: 146037 - DNA, 75 bp, Artificial Sequence
  Synthetic
gggagggtgaatccccgagccgctggagactcccggaatgaggaaagtggggataggctaggtagaaaagagcga

SEQ ID NO: 146038 - DNA, 75 bp, Artificial Sequence
  Synthetic
gggagggtgaatccccgaggcgctggagactcccggaatgaggaaagtggggataggctaggtagaaaagagcga

SEQ ID NO: 146039 - DNA, 75 bp, Artificial Sequence
  Synthetic
gcctcccaaatcgagattgccctgaacctatcaagtttggagtcatccgagcttagggttgaatgtagcgcagag

SEQ ID NO: 146040 - DNA, 75 bp, Artificial Sequence
  Synthetic
gcctcccaaatcgagattgccctgaacctatctagtttggagtcatccgagcttagggttgaatgtagcgcagag

SEQ ID NO: 146041 - DNA, 75 bp, Artificial Sequence
  Synthetic
gcctcccaaatcgagattgccctgaacctatccagtttggagtcatccgagcttagggttgaatgtagcgcagag

SEQ ID NO: 146042 - DNA, 75 bp, Artificial Sequence
  Synthetic
gcctcccaaatcgagattgccctgaacctatcgagtttggagtcatccgagcttagggttgaatgtagcgcagag

SEQ ID NO: 146043 - DNA, 75 bp, Artificial Sequence
  Synthetic
ggaggaagccaccaggagccggagacaagacacctccagaggaccccttcagcgaacagaagagtctgtccccag

SEQ ID NO: 146044 - DNA, 75 bp, Artificial Sequence
  Synthetic
agcgaacagaagagtctgtccccagatgagaagagcgtagctagagggggagatgctgggagtagggggagatcg

SEQ ID NO: 146045 - DNA, 75 bp, Artificial Sequence
  Synthetic
aagcgaggaggaaagtaaagatggcaacggggctagcaggagggtgttccgccccccggcggggccgagtgaggc

SEQ ID NO: 146046 - DNA, 75 bp, Artificial Sequence
  Synthetic
ccggactgccggctccaggggcccactccaaaggaccgagggcaggacttggagcaccgggaattccgagcaact

SEQ ID NO: 146047 - DNA, 75 bp, Artificial Sequence
  Synthetic
ccatggtagactccgtcccccttctccacactccttccccccgcgggcccccccgtaaagtggagaaccccactc

SEQ ID NO: 146048 - DNA, 75 bp, Artificial Sequence
  Synthetic
ccacactccttccccccgcgggcccccccgtaaagtggagaaccccactccgcagggtccgcgccctcctccctt

SEQ ID NO: 146049 - DNA, 75 bp, Artificial Sequence
  Synthetic
tcttacctgtggccggcatggtcccagcctcctcgcggcgccggccgggcaacattccgaggggaccgtcccccg

SEQ ID NO: 146050 - DNA, 75 bp, Artificial Sequence
  Synthetic
aacattccgaggggaccgtcccccggtaatggcagatgggacccaggcttcccccggattccctcatggggatcg

SEQ ID NO: 146051 - DNA, 75 bp, Artificial Sequence
  Synthetic
ggaggtggagatgccatgccgacccgaagaggaaagaaggagaccggacgcaaacctgtgagtggaactctcatc

SEQ ID NO: 146052 - DNA, 75 bp, Artificial Sequence
  Synthetic
ggaggtggagatgccatgccgacccgaagaggaaagaaggagaccggacgcaaacctgtgagtggaactctcttc

SEQ ID NO: 146053 - DNA, 75 bp, Artificial Sequence
  Synthetic
ggaggtggagatgccatgccgacccgaagaggaaagaaggagaccggacgcaaacctgtgagtggaactctcctc

SEQ ID NO: 146054 - DNA, 75 bp, Artificial Sequence
  Synthetic
ggaggtggagatgccatgccgacccgaagaggaaagaaggagaccggacgcaaacctgtgagtggaactctcgtc

SEQ ID NO: 146055 - DNA, 75 bp, Artificial Sequence
  Synthetic
ctttattggggggtacactcgaggagtggaaggcggggaggggggggcggtctttgtccctatggaaattgctgg

SEQ ID NO: 146056 - DNA, 75 bp, Artificial Sequence
  Synthetic
gtggaaggcggggaggggggggcggtctttgtccctatggaaattgctggtctcccctgatgtccagtccatccc

SEQ ID NO: 146057 - DNA, 75 bp, Artificial Sequence
  Synthetic
cgtgtctggtgaatggagactccggaacacctagcatcctagggacaaatccgcccccgggcgctcccctcggac

SEQ ID NO: 146058 - DNA, 75 bp, Artificial Sequence
  Synthetic
aacacctagcatcctagggacaaatccgcccccgggcgctcccctcggacttcctccgggagggttcacaccccc

SEQ ID NO: 146059 - DNA, 75 bp, Artificial Sequence
  Synthetic
atcctgcgggccggccgctcttctttctcttttctcgtcttcaacgatcaacctcctgagttccccttcttcctc

SEQ ID NO: 146060 - DNA, 75 bp, Artificial Sequence
  Synthetic
acctcctgagttccccttcttcctcctcgctgagcttcttccctccggaggacagttgcttcttcttgttctcga

SEQ ID NO: 146061 - DNA, 75 bp, Artificial Sequence
  Synthetic
gggccttccttcttcggtgatccctcctctcctcgtcggtgaatcctcccttgcgactcttcttccccggaccgg

SEQ ID NO: 146062 - DNA, 75 bp, Artificial Sequence
  Synthetic
ggctctcttcgctgggggagctccctcccctgccttcccctttcttattattccgaggatgttccccagccaggg

SEQ ID NO: 146063 - DNA, 75 bp, Artificial Sequence
  Synthetic
ttccgaggatgttccccagccagggattttcatcctcgagtctcttgatgttcctcctcgtcttccggatcctct

SEQ ID NO: 146064 - DNA, 75 bp, Artificial Sequence
  Synthetic
tttcgaggtcttccagatcttttcttgcttcgacccactttgagaggacatcctcccgtcctccccttcgttctc

SEQ ID NO: 146065 - DNA, 75 bp, Artificial Sequence
  Synthetic
tcctcccgtcctccccttcgttctctcttcgcatcggactggctcatctcggcgagggcggcgatcctcagtgct

SEQ ID NO: 146066 - DNA, 75 bp, Artificial Sequence
  Synthetic
ggcgagggcggcgatcctcagtgctcttactctttacagtagaaagaggagactgctggatgccccgcccgggca

SEQ ID NO: 146067 - DNA, 75 bp, Artificial Sequence
  Synthetic
ggcgagggcggcgatcctcagtgctcttactctttacagtagaaagaggagactgctggatgccccgcccgggct

SEQ ID NO: 146068 - DNA, 75 bp, Artificial Sequence
  Synthetic
ggcgagggcggcgatcctcagtgctcttactctttacagtagaaagaggagactgctggatgccccgcccgggcc

SEQ ID NO: 146069 - DNA, 75 bp, Artificial Sequence
  Synthetic
ggcgagggcggcgatcctcagtgctcttactctttacagtagaaagaggagactgctggatgccccgcccgggcg

SEQ ID NO: 146070 - DNA, 75 bp, Artificial Sequence
  Synthetic
atgagccaagttccgaacaaggatccgcggggaggatagatcagcgcccgagaggggtaagtcggtaaagagcat

SEQ ID NO: 146071 - DNA, 75 bp, Artificial Sequence
  Synthetic
tggaacgtcggagatacaactcccaagagggaaaaaagagaaagcaagaagcggacgaatttccccataacgccg

SEQ ID NO: 146072 - DNA, 75 bp, Artificial Sequence
  Synthetic
ccaagtttggagagcactccggcccgaagggttgagagtaccccagagggaggaagccacacggagtagaacaga

SEQ ID NO: 146073 - DNA, 75 bp, Artificial Sequence
  Synthetic
gttcccacatagcagaatcccggaccccctttcaaagtgaccgaggggggtgactttgaacattgggggccggtg

SEQ ID NO: 146074 - DNA, 75 bp, Artificial Sequence
  Synthetic
ctgcctctccttgtcggtgaatcctcccctggaaggcctcttcctaggtccggagtctacctccatctggtccgt

SEQ ID NO: 146075 - DNA, 75 bp, Artificial Sequence
  Synthetic
tcgggccctcttcgccgggggtgccccctctccatccttatccctctttccgagaattcctttgatgtttcccag

SEQ ID NO: 146076 - DNA, 75 bp, Artificial Sequence
  Synthetic
cgagaattcctttgatgtttcccagccagggattttcgtcctcaagtttcttgattttcttcttaaccttccgga

SEQ ID NO: 146077 - DNA, 75 bp, Artificial Sequence
  Synthetic
catgggccacagttccgagcgaagatcccgcggagggaggattggcatccgagaggggatgaatggcaaagagtg

SEQ ID NO: 146078 - DNA, 75 bp, Artificial Sequence
  Synthetic
tcccgcggagggaggattggcatccgagaggggatgaatggcaaagagtggaggaacgtcgaggagaaccctccc

SEQ ID NO: 146079 - DNA, 75 bp, Artificial Sequence
  Synthetic
gagaggggatgaatggcaaagagtggaggaacgtcgaggagaaccctcccaagaaggacaagagagattcgggaa

SEQ ID NO: 146080 - DNA, 75 bp, Artificial Sequence
  Synthetic
gcggacgactttccccaaaacgctggagacatcttggaaggggaaagaggagggatggaagagaagaagcggact

SEQ ID NO: 146081 - DNA, 75 bp, Artificial Sequence
  Synthetic
gagacatcttggaaggggaaagaggagggatggaagagaagaagcggactccccgatccgagggtcccggccacc

SEQ ID NO: 146082 - DNA, 75 bp, Artificial Sequence
  Synthetic
aagtttggaaagcactccgggccaaatggttgagtagcactcagagggaggaatccacacggaggtaagcagaca

SEQ ID NO: 146083 - DNA, 75 bp, Artificial Sequence
  Synthetic
ccttccaaaaagactgaggggggtggctaggacgcaggggaccagtggagccgtgggatgctcttcccgatctga

SEQ ID NO: 146084 - DNA, 75 bp, Artificial Sequence
  Synthetic
ccaggaatggcgggaccccacttcagcagggtccgcgttccatcctttcttacctgatggccggcatggtcccag

SEQ ID NO: 146085 - DNA, 75 bp, Artificial Sequence
  Synthetic
agagaagggaggatcagctgggaagagtatatcctacgggaatccctggtttccccttgtgtccagcccctcccc

SEQ ID NO: 146086 - DNA, 75 bp, Artificial Sequence
  Synthetic
tgagaggcctcttcctaggcccggaatctatctccatctggtctgcgcggggcctcttcgccggggagggccctt

SEQ ID NO: 146087 - DNA, 75 bp, Artificial Sequence
  Synthetic
tcttcttcttgaccttccggagatctctctcgagctcatccatctttcttcttccattcacccactgctcgagaa

SEQ ID NO: 146088 - DNA, 75 bp, Artificial Sequence
  Synthetic
tctctcgagctcatccatctttcttcttccattcacccactgctcgagaatgtcttctctccccccgcggctttt

SEQ ID NO: 146089 - DNA, 75 bp, Artificial Sequence
  Synthetic
ccgcaggtgggaggatcagccaccggcgagggacgcgatggcaagagtggaggaaagttcggaaggaaatcccaa

SEQ ID NO: 146090 - DNA, 75 bp, Artificial Sequence
  Synthetic
cgtccccccactggaggtctccaggacccccgaaaaaagaagggggtgggccttggacctccagggagccatggg

SEQ ID NO: 146091 - DNA, 75 bp, Artificial Sequence
  Synthetic
agagaagcaagagaaaactggctctcccttagccatccgagtggacgtccgtcctccttcggatgcccaggtcgg

SEQ ID NO: 146092 - DNA, 75 bp, Artificial Sequence
  Synthetic
atgagccaacttccgaacgaagggaacgcagggggaaggatcagcgcccgagaggggtaaacggtaaagaggcag

SEQ ID NO: 146093 - DNA, 75 bp, Artificial Sequence
  Synthetic
acgcagggggaaggatcagcgcccgagaggggtaaacggtaaagaggcagagaaacgtcgatggcacactcccaa

SEQ ID NO: 146094 - DNA, 75 bp, Artificial Sequence
  Synthetic
acgcagggggaaggatcagcgcccgagaggggtaaacggtaaagaggcagagaaacgtcgatggcactctcccaa

SEQ ID NO: 146095 - DNA, 75 bp, Artificial Sequence
  Synthetic
acgcagggggaaggatcagcgcccgagaggggtaaacggtaaagaggcagagaaacgtcgatggcaccctcccaa

SEQ ID NO: 146096 - DNA, 75 bp, Artificial Sequence
  Synthetic
acgcagggggaaggatcagcgcccgagaggggtaaacggtaaagaggcagagaaacgtcgatggcacgctcccaa

SEQ ID NO: 146097 - DNA, 75 bp, Artificial Sequence
  Synthetic
agaggggtaaacggtaaagaggcagagaaacgtcgatggcacactcccaagaagaaaagagatgattcaagaggt

SEQ ID NO: 146098 - DNA, 75 bp, Artificial Sequence
  Synthetic
agaggggtaaacggtaaagaggcagagaaacgtcgatggcactctcccaagaagaaaagagatgattcaagaggt

SEQ ID NO: 146099 - DNA, 75 bp, Artificial Sequence
  Synthetic
agaggggtaaacggtaaagaggcagagaaacgtcgatggcaccctcccaagaagaaaagagatgattcaagaggt

SEQ ID NO: 146100 - DNA, 75 bp, Artificial Sequence
  Synthetic
agaggggtaaacggtaaagaggcagagaaacgtcgatggcacgctcccaagaagaaaagagatgattcaagaggt

SEQ ID NO: 146101 - DNA, 75 bp, Artificial Sequence
  Synthetic
gggcgactctccccataacgctggagacatctcggaaggggaaaggaagctagatggaaagagaagggggggccc

SEQ ID NO: 146102 - DNA, 75 bp, Artificial Sequence
  Synthetic
tagatggaaagagaagggggggccccccgatccgaaaggcccaaccaccaagtttggaggacactccaggcccaa

SEQ ID NO: 146103 - DNA, 75 bp, Artificial Sequence
  Synthetic
tagatggaaagagaagggggggccccccgatccgaaaggcccaaccaccaagtttggaggacactcctggcccaa

SEQ ID NO: 146104 - DNA, 75 bp, Artificial Sequence
  Synthetic
tagatggaaagagaagggggggccccccgatccgaaaggcccaaccaccaagtttggaggacactcccggcccaa

SEQ ID NO: 146105 - DNA, 75 bp, Artificial Sequence
  Synthetic
tagatggaaagagaagggggggccccccgatccgaaaggcccaaccaccaagtttggaggacactccgggcccaa

SEQ ID NO: 146106 - DNA, 75 bp, Artificial Sequence
  Synthetic
agtaagaccatagcgatggggggagatgctaggagttagaggagaccgaagcgaggaggaaagcaaagaaagcaa

SEQ ID NO: 146107 - DNA, 75 bp, Artificial Sequence
  Synthetic
ctaggagcgcggggggacccagtggagccatgggatgctcctcccgattccgtccaaccccacccccaggagggt

SEQ ID NO: 146108 - DNA, 75 bp, Artificial Sequence
  Synthetic
tcggtaatggcgaatgggacccagaactctctctagcttcccagagagaagcgagagaaaactggctctccctta

SEQ ID NO: 146109 - DNA, 75 bp, Artificial Sequence
  Synthetic
gcgagagaaaactggctctcccttagccatccgagtggacgtgcgtcctccttcggatgcccaggtcggaccgcg

SEQ ID NO: 146110 - DNA, 75 bp, Artificial Sequence
  Synthetic
tgattttcttcttaatcttccggaggtccctctcgagcttctcggcttcccttcttccgttcacccactgctcga

SEQ ID NO: 146111 - DNA, 75 bp, Artificial Sequence
  Synthetic
cttcttccgttcacccactgctcgagaacctcttctcttcctccgcgactcttcttcgattcggatcggctcatc

SEQ ID NO: 146112 - DNA, 75 bp, Artificial Sequence
  Synthetic
atgggccacgaagccgacaaggagccggaggaggaggggttggaggtcccgaggaggactcaaagcaaagaaggg

SEQ ID NO: 146113 - DNA, 75 bp, Artificial Sequence
  Synthetic
atgggccacgaagccgacaaggagccggaggaggaggggttggaggtcccgaggaggactctaagcaaagaaggg

SEQ ID NO: 146114 - DNA, 75 bp, Artificial Sequence
  Synthetic
atgggccacgaagccgacaaggagccggaggaggaggggttggaggtcccgaggaggactccaagcaaagaaggg

SEQ ID NO: 146115 - DNA, 75 bp, Artificial Sequence
  Synthetic
atgggccacgaagccgacaaggagccggaggaggaggggttggaggtcccgaggaggactcgaagcaaagaaggg

SEQ ID NO: 146116 - DNA, 75 bp, Artificial Sequence
  Synthetic
atgggccacgtagccgacaaggagccggaggaggaggggttggaggtcccgaggaggactcaaagcaaagaaggg

SEQ ID NO: 146117 - DNA, 75 bp, Artificial Sequence
  Synthetic
atgggccacgtagccgacaaggagccggaggaggaggggttggaggtcccgaggaggactctaagcaaagaaggg

SEQ ID NO: 146118 - DNA, 75 bp, Artificial Sequence
  Synthetic
atgggccacgtagccgacaaggagccggaggaggaggggttggaggtcccgaggaggactccaagcaaagaaggg

SEQ ID NO: 146119 - DNA, 75 bp, Artificial Sequence
  Synthetic
atgggccacgtagccgacaaggagccggaggaggaggggttggaggtcccgaggaggactcgaagcaaagaaggg

SEQ ID NO: 146120 - DNA, 75 bp, Artificial Sequence
  Synthetic
atgggccacgcagccgacaaggagccggaggaggaggggttggaggtcccgaggaggactcaaagcaaagaaggg

SEQ ID NO: 146121 - DNA, 75 bp, Artificial Sequence
  Synthetic
atgggccacgcagccgacaaggagccggaggaggaggggttggaggtcccgaggaggactctaagcaaagaaggg

SEQ ID NO: 146122 - DNA, 75 bp, Artificial Sequence
  Synthetic
atgggccacgcagccgacaaggagccggaggaggaggggttggaggtcccgaggaggactccaagcaaagaaggg

SEQ ID NO: 146123 - DNA, 75 bp, Artificial Sequence
  Synthetic
atgggccacgcagccgacaaggagccggaggaggaggggttggaggtcccgaggaggactcgaagcaaagaaggg

SEQ ID NO: 146124 - DNA, 75 bp, Artificial Sequence
  Synthetic
atgggccacggagccgacaaggagccggaggaggaggggttggaggtcccgaggaggactcaaagcaaagaaggg

SEQ ID NO: 146125 - DNA, 75 bp, Artificial Sequence
  Synthetic
atgggccacggagccgacaaggagccggaggaggaggggttggaggtcccgaggaggactctaagcaaagaaggg

SEQ ID NO: 146126 - DNA, 75 bp, Artificial Sequence
  Synthetic
atgggccacggagccgacaaggagccggaggaggaggggttggaggtcccgaggaggactccaagcaaagaaggg

SEQ ID NO: 146127 - DNA, 75 bp, Artificial Sequence
  Synthetic
atgggccacggagccgacaaggagccggaggaggaggggttggaggtcccgaggaggactcgaagcaaagaaggg

SEQ ID NO: 146128 - DNA, 75 bp, Artificial Sequence
  Synthetic
cggaggaggaggggttggaggtcccgaggaggactcaaagcaaagaaggggaggaatctcgaaaaagaactccca

SEQ ID NO: 146129 - DNA, 75 bp, Artificial Sequence
  Synthetic
cggaggaggaggggttggaggtcccgaggaggactctaagcaaagaaggggaggaatctcgaaaaagaactccca

SEQ ID NO: 146130 - DNA, 75 bp, Artificial Sequence
  Synthetic
cggaggaggaggggttggaggtcccgaggaggactccaagcaaagaaggggaggaatctcgaaaaagaactccca

SEQ ID NO: 146131 - DNA, 75 bp, Artificial Sequence
  Synthetic
cggaggaggaggggttggaggtcccgaggaggactcgaagcaaagaaggggaggaatctcgaaaaagaactccca

SEQ ID NO: 146132 - DNA, 75 bp, Artificial Sequence
  Synthetic
gaggaggactcaaagcaaagaaggggaggaatctcgaaaaagaactcccaagaagaaccgagaacaaccacaaga

SEQ ID NO: 146133 - DNA, 75 bp, Artificial Sequence
  Synthetic
gaggaggactcaaagcaaagaaggggaggaatctcgaaaaagaactcccaagaagaaccgagaacaacctcaaga

SEQ ID NO: 146134 - DNA, 75 bp, Artificial Sequence
  Synthetic
gaggaggactcaaagcaaagaaggggaggaatctcgaaaaagaactcccaagaagaaccgagaacaaccccaaga

SEQ ID NO: 146135 - DNA, 75 bp, Artificial Sequence
  Synthetic
gaggaggactcaaagcaaagaaggggaggaatctcgaaaaagaactcccaagaagaaccgagaacaaccgcaaga

SEQ ID NO: 146136 - DNA, 75 bp, Artificial Sequence
  Synthetic
gaggaggactctaagcaaagaaggggaggaatctcgaaaaagaactcccaagaagaaccgagaacaaccacaaga

SEQ ID NO: 146137 - DNA, 75 bp, Artificial Sequence
  Synthetic
gaggaggactctaagcaaagaaggggaggaatctcgaaaaagaactcccaagaagaaccgagaacaacctcaaga

SEQ ID NO: 146138 - DNA, 75 bp, Artificial Sequence
  Synthetic
gaggaggactctaagcaaagaaggggaggaatctcgaaaaagaactcccaagaagaaccgagaacaaccccaaga

SEQ ID NO: 146139 - DNA, 75 bp, Artificial Sequence
  Synthetic
gaggaggactctaagcaaagaaggggaggaatctcgaaaaagaactcccaagaagaaccgagaacaaccgcaaga

SEQ ID NO: 146140 - DNA, 75 bp, Artificial Sequence
  Synthetic
gaggaggactccaagcaaagaaggggaggaatctcgaaaaagaactcccaagaagaaccgagaacaaccacaaga

SEQ ID NO: 146141 - DNA, 75 bp, Artificial Sequence
  Synthetic
gaggaggactccaagcaaagaaggggaggaatctcgaaaaagaactcccaagaagaaccgagaacaacctcaaga

SEQ ID NO: 146142 - DNA, 75 bp, Artificial Sequence
  Synthetic
gaggaggactccaagcaaagaaggggaggaatctcgaaaaagaactcccaagaagaaccgagaacaaccccaaga

SEQ ID NO: 146143 - DNA, 75 bp, Artificial Sequence
  Synthetic
gaggaggactccaagcaaagaaggggaggaatctcgaaaaagaactcccaagaagaaccgagaacaaccgcaaga

SEQ ID NO: 146144 - DNA, 75 bp, Artificial Sequence
  Synthetic
gaggaggactcgaagcaaagaaggggaggaatctcgaaaaagaactcccaagaagaaccgagaacaaccacaaga

SEQ ID NO: 146145 - DNA, 75 bp, Artificial Sequence
  Synthetic
gaggaggactcgaagcaaagaaggggaggaatctcgaaaaagaactcccaagaagaaccgagaacaacctcaaga

SEQ ID NO: 146146 - DNA, 75 bp, Artificial Sequence
  Synthetic
gaggaggactcgaagcaaagaaggggaggaatctcgaaaaagaactcccaagaagaaccgagaacaaccccaaga

SEQ ID NO: 146147 - DNA, 75 bp, Artificial Sequence
  Synthetic
gaggaggactcgaagcaaagaaggggaggaatctcgaaaaagaactcccaagaagaaccgagaacaaccgcaaga

SEQ ID NO: 146148 - DNA, 75 bp, Artificial Sequence
  Synthetic
agaggaggtttcccaaacgcaggtggagcacccgggaacaaggaaacaggagaaggatcggtagaaaagagcgag

SEQ ID NO: 146149 - DNA, 75 bp, Artificial Sequence
  Synthetic
agaggaggtttcccaaacgctggtggagcacccgggaacaaggaaacaggagaaggatcggtagaaaagagcgag

SEQ ID NO: 146150 - DNA, 75 bp, Artificial Sequence
  Synthetic
agaggaggtttcccaaacgccggtggagcacccgggaacaaggaaacaggagaaggatcggtagaaaagagcgag

SEQ ID NO: 146151 - DNA, 75 bp, Artificial Sequence
  Synthetic
agaggaggtttcccaaacgcgggtggagcacccgggaacaaggaaacaggagaaggatcggtagaaaagagcgag

SEQ ID NO: 146152 - DNA, 75 bp, Artificial Sequence
  Synthetic
gagcacccgggaacaaggaaacaggagaaggatcggtagaaaagagcgagcctcccgatccgaggggccctggac

SEQ ID NO: 146153 - DNA, 75 bp, Artificial Sequence
  Synthetic
acctcagctctggagtcctccgacccgtgaggttgaggttctccgcgcagggaaggcagccaccgggagaaaacg

SEQ ID NO: 146154 - DNA, 75 bp, Artificial Sequence
  Synthetic
acctcagctctggagtcctccgacccgtgaggttgaggttctccgcgcagggtaggcagccaccgggagaaaacg

SEQ ID NO: 146155 - DNA, 75 bp, Artificial Sequence
  Synthetic
acctcagctctggagtcctccgacccgtgaggttgaggttctccgcgcagggcaggcagccaccgggagaaaacg

SEQ ID NO: 146156 - DNA, 75 bp, Artificial Sequence
  Synthetic
acctcagctctggagtcctccgacccgtgaggttgaggttctccgcgcaggggaggcagccaccgggagaaaacg

SEQ ID NO: 146157 - DNA, 75 bp, Artificial Sequence
  Synthetic
cgtgaggttgaggttctccgcgcagggaaggcagccaccgggagaaaacggagaaaccacctccagaggacccct

SEQ ID NO: 146158 - DNA, 75 bp, Artificial Sequence
  Synthetic
cgtgaggttgaggttctccgcgcagggtaggcagccaccgggagaaaacggagaaaccacctccagaggacccct

SEQ ID NO: 146159 - DNA, 75 bp, Artificial Sequence
  Synthetic
cgtgaggttgaggttctccgcgcagggcaggcagccaccgggagaaaacggagaaaccacctccagaggacccct

SEQ ID NO: 146160 - DNA, 75 bp, Artificial Sequence
  Synthetic
cgtgaggttgaggttctccgcgcaggggaggcagccaccgggagaaaacggagaaaccacctccagaggacccct

SEQ ID NO: 146161 - DNA, 75 bp, Artificial Sequence
  Synthetic
tcagcgaacagagaagcgcactgggacgtcaggatgagtccatagcgataggaggggatgctaggagtcggcagc

SEQ ID NO: 146162 - DNA, 75 bp, Artificial Sequence
  Synthetic
acgtcaggatgagtccatagcgataggaggggatgctaggagtcggcagcgaccgaagcgaggaaagaaagtaaa

SEQ ID NO: 146163 - DNA, 75 bp, Artificial Sequence
  Synthetic
tgttccgcctccccggagtcccgagtgaggcttatcccggggaacccggccaagcccccaaaatgtctggttccc

SEQ ID NO: 146164 - DNA, 75 bp, Artificial Sequence
  Synthetic
acgggctccacttccaaaaggaggagcgggggaacttggaacgtgaggggaccagttcagtccgtgggaattacc

SEQ ID NO: 146165 - DNA, 75 bp, Artificial Sequence
  Synthetic
acgggctccacttccaaaaggaggagcgggggaacttggaacgtgaggggaccagttcagtccgtgggaatttcc

SEQ ID NO: 146166 - DNA, 75 bp, Artificial Sequence
  Synthetic
acgggctccacttccaaaaggaggagcgggggaacttggaacgtgaggggaccagttcagtccgtgggaattccc

SEQ ID NO: 146167 - DNA, 75 bp, Artificial Sequence
  Synthetic
acgggctccacttccaaaaggaggagcgggggaacttggaacgtgaggggaccagttcagtccgtgggaattgcc

SEQ ID NO: 146168 - DNA, 75 bp, Artificial Sequence
  Synthetic
acgggctccacttccaaaaggaggagcgggggaacttggaacgtgaggggaccagttcagtccgtgggatttacc

SEQ ID NO: 146169 - DNA, 75 bp, Artificial Sequence
  Synthetic
acgggctccacttccaaaaggaggagcgggggaacttggaacgtgaggggaccagttcagtccgtgggattttcc

SEQ ID NO: 146170 - DNA, 75 bp, Artificial Sequence
  Synthetic
acgggctccacttccaaaaggaggagcgggggaacttggaacgtgaggggaccagttcagtccgtgggatttccc

SEQ ID NO: 146171 - DNA, 75 bp, Artificial Sequence
  Synthetic
acgggctccacttccaaaaggaggagcgggggaacttggaacgtgaggggaccagttcagtccgtgggatttgcc

SEQ ID NO: 146172 - DNA, 75 bp, Artificial Sequence
  Synthetic
acgggctccacttccaaaaggaggagcgggggaacttggaacgtgaggggaccagttcagtccgtgggacttacc

SEQ ID NO: 146173 - DNA, 75 bp, Artificial Sequence
  Synthetic
acgggctccacttccaaaaggaggagcgggggaacttggaacgtgaggggaccagttcagtccgtgggactttcc

SEQ ID NO: 146174 - DNA, 75 bp, Artificial Sequence
  Synthetic
acgggctccacttccaaaaggaggagcgggggaacttggaacgtgaggggaccagttcagtccgtgggacttccc

SEQ ID NO: 146175 - DNA, 75 bp, Artificial Sequence
  Synthetic
acgggctccacttccaaaaggaggagcgggggaacttggaacgtgaggggaccagttcagtccgtgggacttgcc

SEQ ID NO: 146176 - DNA, 75 bp, Artificial Sequence
  Synthetic
acgggctccacttccaaaaggaggagcgggggaacttggaacgtgaggggaccagttcagtccgtgggagttacc

SEQ ID NO: 146177 - DNA, 75 bp, Artificial Sequence
  Synthetic
acgggctccacttccaaaaggaggagcgggggaacttggaacgtgaggggaccagttcagtccgtgggagtttcc

SEQ ID NO: 146178 - DNA, 75 bp, Artificial Sequence
  Synthetic
acgggctccacttccaaaaggaggagcgggggaacttggaacgtgaggggaccagttcagtccgtgggagttccc

SEQ ID NO: 146179 - DNA, 75 bp, Artificial Sequence
  Synthetic
acgggctccacttccaaaaggaggagcgggggaacttggaacgtgaggggaccagttcagtccgtgggagttgcc

SEQ ID NO: 146180 - DNA, 75 bp, Artificial Sequence
  Synthetic
acgggctccacttccaaaaggaggagcgggggtacttggaacgtgaggggaccagttcagtccgtgggaattacc

SEQ ID NO: 146181 - DNA, 75 bp, Artificial Sequence
  Synthetic
acgggctccacttccaaaaggaggagcgggggtacttggaacgtgaggggaccagttcagtccgtgggaatttcc

SEQ ID NO: 146182 - DNA, 75 bp, Artificial Sequence
  Synthetic
acgggctccacttccaaaaggaggagcgggggtacttggaacgtgaggggaccagttcagtccgtgggaattccc

SEQ ID NO: 146183 - DNA, 75 bp, Artificial Sequence
  Synthetic
acgggctccacttccaaaaggaggagcgggggtacttggaacgtgaggggaccagttcagtccgtgggaattgcc

SEQ ID NO: 146184 - DNA, 75 bp, Artificial Sequence
  Synthetic
acgggctccacttccaaaaggaggagcgggggtacttggaacgtgaggggaccagttcagtccgtgggatttacc

SEQ ID NO: 146185 - DNA, 75 bp, Artificial Sequence
  Synthetic
acgggctccacttccaaaaggaggagcgggggtacttggaacgtgaggggaccagttcagtccgtgggattttcc

SEQ ID NO: 146186 - DNA, 75 bp, Artificial Sequence
  Synthetic
acgggctccacttccaaaaggaggagcgggggtacttggaacgtgaggggaccagttcagtccgtgggatttccc

SEQ ID NO: 146187 - DNA, 75 bp, Artificial Sequence
  Synthetic
acgggctccacttccaaaaggaggagcgggggtacttggaacgtgaggggaccagttcagtccgtgggatttgcc

SEQ ID NO: 146188 - DNA, 75 bp, Artificial Sequence
  Synthetic
acgggctccacttccaaaaggaggagcgggggtacttggaacgtgaggggaccagttcagtccgtgggacttacc

SEQ ID NO: 146189 - DNA, 75 bp, Artificial Sequence
  Synthetic
acgggctccacttccaaaaggaggagcgggggtacttggaacgtgaggggaccagttcagtccgtgggactttcc

SEQ ID NO: 146190 - DNA, 75 bp, Artificial Sequence
  Synthetic
acgggctccacttccaaaaggaggagcgggggtacttggaacgtgaggggaccagttcagtccgtgggacttccc

SEQ ID NO: 146191 - DNA, 75 bp, Artificial Sequence
  Synthetic
acgggctccacttccaaaaggaggagcgggggtacttggaacgtgaggggaccagttcagtccgtgggacttgcc

SEQ ID NO: 146192 - DNA, 75 bp, Artificial Sequence
  Synthetic
acgggctccacttccaaaaggaggagcgggggtacttggaacgtgaggggaccagttcagtccgtgggagttacc

SEQ ID NO: 146193 - DNA, 75 bp, Artificial Sequence
  Synthetic
acgggctccacttccaaaaggaggagcgggggtacttggaacgtgaggggaccagttcagtccgtgggagtttcc

SEQ ID NO: 146194 - DNA, 75 bp, Artificial Sequence
  Synthetic
acgggctccacttccaaaaggaggagcgggggtacttggaacgtgaggggaccagttcagtccgtgggagttccc

SEQ ID NO: 146195 - DNA, 75 bp, Artificial Sequence
  Synthetic
acgggctccacttccaaaaggaggagcgggggtacttggaacgtgaggggaccagttcagtccgtgggagttgcc

SEQ ID NO: 146196 - DNA, 75 bp, Artificial Sequence
  Synthetic
acgggctccacttccaaaaggaggagcgggggcacttggaacgtgaggggaccagttcagtccgtgggaattacc

SEQ ID NO: 146197 - DNA, 75 bp, Artificial Sequence
  Synthetic
acgggctccacttccaaaaggaggagcgggggcacttggaacgtgaggggaccagttcagtccgtgggaatttcc

SEQ ID NO: 146198 - DNA, 75 bp, Artificial Sequence
  Synthetic
acgggctccacttccaaaaggaggagcgggggcacttggaacgtgaggggaccagttcagtccgtgggaattccc

SEQ ID NO: 146199 - DNA, 75 bp, Artificial Sequence
  Synthetic
acgggctccacttccaaaaggaggagcgggggcacttggaacgtgaggggaccagttcagtccgtgggaattgcc

SEQ ID NO: 146200 - DNA, 75 bp, Artificial Sequence
  Synthetic
acgggctccacttccaaaaggaggagcgggggcacttggaacgtgaggggaccagttcagtccgtgggatttacc

SEQ ID NO: 146201 - DNA, 75 bp, Artificial Sequence
  Synthetic
acgggctccacttccaaaaggaggagcgggggcacttggaacgtgaggggaccagttcagtccgtgggattttcc

SEQ ID NO: 146202 - DNA, 75 bp, Artificial Sequence
  Synthetic
acgggctccacttccaaaaggaggagcgggggcacttggaacgtgaggggaccagttcagtccgtgggatttccc

SEQ ID NO: 146203 - DNA, 75 bp, Artificial Sequence
  Synthetic
acgggctccacttccaaaaggaggagcgggggcacttggaacgtgaggggaccagttcagtccgtgggatttgcc

SEQ ID NO: 146204 - DNA, 75 bp, Artificial Sequence
  Synthetic
acgggctccacttccaaaaggaggagcgggggcacttggaacgtgaggggaccagttcagtccgtgggacttacc

SEQ ID NO: 146205 - DNA, 75 bp, Artificial Sequence
  Synthetic
acgggctccacttccaaaaggaggagcgggggcacttggaacgtgaggggaccagttcagtccgtgggactttcc

SEQ ID NO: 146206 - DNA, 75 bp, Artificial Sequence
  Synthetic
acgggctccacttccaaaaggaggagcgggggcacttggaacgtgaggggaccagttcagtccgtgggacttccc

SEQ ID NO: 146207 - DNA, 75 bp, Artificial Sequence
  Synthetic
acgggctccacttccaaaaggaggagcgggggcacttggaacgtgaggggaccagttcagtccgtgggacttgcc

SEQ ID NO: 146208 - DNA, 75 bp, Artificial Sequence
  Synthetic
acgggctccacttccaaaaggaggagcgggggcacttggaacgtgaggggaccagttcagtccgtgggagttacc

SEQ ID NO: 146209 - DNA, 75 bp, Artificial Sequence
  Synthetic
acgggctccacttccaaaaggaggagcgggggcacttggaacgtgaggggaccagttcagtccgtgggagtttcc

SEQ ID NO: 146210 - DNA, 75 bp, Artificial Sequence
  Synthetic
acgggctccacttccaaaaggaggagcgggggcacttggaacgtgaggggaccagttcagtccgtgggagttccc

SEQ ID NO: 146211 - DNA, 75 bp, Artificial Sequence
  Synthetic
acgggctccacttccaaaaggaggagcgggggcacttggaacgtgaggggaccagttcagtccgtgggagttgcc

SEQ ID NO: 146212 - DNA, 75 bp, Artificial Sequence
  Synthetic
acgggctccacttccaaaaggaggagcggggggacttggaacgtgaggggaccagttcagtccgtgggaattacc

SEQ ID NO: 146213 - DNA, 75 bp, Artificial Sequence
  Synthetic
acgggctccacttccaaaaggaggagcggggggacttggaacgtgaggggaccagttcagtccgtgggaatttcc

SEQ ID NO: 146214 - DNA, 75 bp, Artificial Sequence
  Synthetic
acgggctccacttccaaaaggaggagcggggggacttggaacgtgaggggaccagttcagtccgtgggaattccc

SEQ ID NO: 146215 - DNA, 75 bp, Artificial Sequence
  Synthetic
acgggctccacttccaaaaggaggagcggggggacttggaacgtgaggggaccagttcagtccgtgggaattgcc

SEQ ID NO: 146216 - DNA, 75 bp, Artificial Sequence
  Synthetic
acgggctccacttccaaaaggaggagcggggggacttggaacgtgaggggaccagttcagtccgtgggatttacc

SEQ ID NO: 146217 - DNA, 75 bp, Artificial Sequence
  Synthetic
acgggctccacttccaaaaggaggagcggggggacttggaacgtgaggggaccagttcagtccgtgggattttcc

SEQ ID NO: 146218 - DNA, 75 bp, Artificial Sequence
  Synthetic
acgggctccacttccaaaaggaggagcggggggacttggaacgtgaggggaccagttcagtccgtgggatttccc

SEQ ID NO: 146219 - DNA, 75 bp, Artificial Sequence
  Synthetic
acgggctccacttccaaaaggaggagcggggggacttggaacgtgaggggaccagttcagtccgtgggatttgcc

SEQ ID NO: 146220 - DNA, 75 bp, Artificial Sequence
  Synthetic
acgggctccacttccaaaaggaggagcggggggacttggaacgtgaggggaccagttcagtccgtgggacttacc

SEQ ID NO: 146221 - DNA, 75 bp, Artificial Sequence
  Synthetic
acgggctccacttccaaaaggaggagcggggggacttggaacgtgaggggaccagttcagtccgtgggactttcc

SEQ ID NO: 146222 - DNA, 75 bp, Artificial Sequence
  Synthetic
acgggctccacttccaaaaggaggagcggggggacttggaacgtgaggggaccagttcagtccgtgggacttccc

SEQ ID NO: 146223 - DNA, 75 bp, Artificial Sequence
  Synthetic
acgggctccacttccaaaaggaggagcggggggacttggaacgtgaggggaccagttcagtccgtgggacttgcc

SEQ ID NO: 146224 - DNA, 75 bp, Artificial Sequence
  Synthetic
acgggctccacttccaaaaggaggagcggggggacttggaacgtgaggggaccagttcagtccgtgggagttacc

SEQ ID NO: 146225 - DNA, 75 bp, Artificial Sequence
  Synthetic
acgggctccacttccaaaaggaggagcggggggacttggaacgtgaggggaccagttcagtccgtgggagtttcc

SEQ ID NO: 146226 - DNA, 75 bp, Artificial Sequence
  Synthetic
acgggctccacttccaaaaggaggagcggggggacttggaacgtgaggggaccagttcagtccgtgggagttccc

SEQ ID NO: 146227 - DNA, 75 bp, Artificial Sequence
  Synthetic
acgggctccacttccaaaaggaggagcggggggacttggaacgtgaggggaccagttcagtccgtgggagttgcc

SEQ ID NO: 146228 - DNA, 75 bp, Artificial Sequence
  Synthetic
ccggacctccggttctccacactccttcccccctgcgggcttcccagtaaacggtaagaacccaccctcggggtc

SEQ ID NO: 146229 - DNA, 75 bp, Artificial Sequence
  Synthetic
gttcccagagagaaccgagagaaaactggctctcccttagccatccgagtggacgttctgtcctccttcggatgc

SEQ ID NO: 146230 - DNA, 75 bp, Artificial Sequence
  Synthetic
cacgggtactgctggttccccctcacgtccagtccctcccccgtcctggagaagggagactcaggaacacctagc

SEQ ID NO: 146231 - DNA, 75 bp, Artificial Sequence
  Synthetic
cacgggtactgctggttccccctcacgtccagtccctcccccgtcctggagaagggagactctggaacacctagc

SEQ ID NO: 146232 - DNA, 75 bp, Artificial Sequence
  Synthetic
cacgggtactgctggttccccctcacgtccagtccctcccccgtcctggagaagggagactccggaacacctagc

SEQ ID NO: 146233 - DNA, 75 bp, Artificial Sequence
  Synthetic
cacgggtactgctggttccccctcacgtccagtccctcccccgtcctggagaagggagactcgggaacacctagc

SEQ ID NO: 146234 - DNA, 75 bp, Artificial Sequence
  Synthetic
gaagggagactcaggaacacctagcatttgagggacaaagccgcccccgggcgctcccctcggagatgttccggg

SEQ ID NO: 146235 - DNA, 75 bp, Artificial Sequence
  Synthetic
gaagggagactctggaacacctagcatttgagggacaaagccgcccccgggcgctcccctcggagatgttccggg

SEQ ID NO: 146236 - DNA, 75 bp, Artificial Sequence
  Synthetic
gaagggagactccggaacacctagcatttgagggacaaagccgcccccgggcgctcccctcggagatgttccggg

SEQ ID NO: 146237 - DNA, 75 bp, Artificial Sequence
  Synthetic
gaagggagactcgggaacacctagcatttgagggacaaagccgcccccgggcgctcccctcggagatgttccggg

SEQ ID NO: 146238 - DNA, 75 bp, Artificial Sequence
  Synthetic
ttcctcttcctcctccttgctaagtgactttcctcccgcgctcagttgtttcttcttgttctcgagggccttcct

SEQ ID NO: 146239 - DNA, 75 bp, Artificial Sequence
  Synthetic
ttcctcttcctcctccttgcttagtgactttcctcccgcgctcagttgtttcttcttgttctcgagggccttcct

SEQ ID NO: 146240 - DNA, 75 bp, Artificial Sequence
  Synthetic
ttcctcttcctcctccttgctcagtgactttcctcccgcgctcagttgtttcttcttgttctcgagggccttcct

SEQ ID NO: 146241 - DNA, 75 bp, Artificial Sequence
  Synthetic
ttcctcttcctcctccttgctgagtgactttcctcccgcgctcagttgtttcttcttgttctcgagggccttcct

SEQ ID NO: 146242 - DNA, 75 bp, Artificial Sequence
  Synthetic
tcttcttgttctcgagggccttccttcttcggtggtcccgtctctccttgtcggtgaagtctcccgcgcgagtcc

SEQ ID NO: 146243 - DNA, 75 bp, Artificial Sequence
  Synthetic
catcagatccgtccgggccctcttcgccgggggagctccctccccgtccttcccttttcttattattccgaggat

SEQ ID NO: 146244 - DNA, 75 bp, Artificial Sequence
  Synthetic
catctgatccgtccgggccctcttcgccgggggagctccctccccgtccttcccttttcttattattccgaggat

SEQ ID NO: 146245 - DNA, 75 bp, Artificial Sequence
  Synthetic
catccgatccgtccgggccctcttcgccgggggagctccctccccgtccttcccttttcttattattccgaggat

SEQ ID NO: 146246 - DNA, 75 bp, Artificial Sequence
  Synthetic
catcggatccgtccgggccctcttcgccgggggagctccctccccgtccttcccttttcttattattccgaggat

SEQ ID NO: 146247 - DNA, 75 bp, Artificial Sequence
  Synthetic
tcgagtatcttggcggttctcttggccttccggagccttttctcgaggtcctccgcgtcttttcttgcttggatc

SEQ ID NO: 146248 - DNA, 75 bp, Artificial Sequence
  Synthetic
tcgagtttcttggcggttctcttggccttccggagccttttctcgaggtcctccgcgtcttttcttgcttggatc

SEQ ID NO: 146249 - DNA, 75 bp, Artificial Sequence
  Synthetic
tcgagtctcttggcggttctcttggccttccggagccttttctcgaggtcctccgcgtcttttcttgcttggatc

SEQ ID NO: 146250 - DNA, 75 bp, Artificial Sequence
  Synthetic
tcgagtgtcttggcggttctcttggccttccggagccttttctcgaggtcctccgcgtcttttcttgcttggatc

SEQ ID NO: 146251 - DNA, 75 bp, Artificial Sequence
  Synthetic
ccttccggagccttttctcgaggtcctccgcgtcttttcttgcttggatccatttctcgaggacatcctcccttc

SEQ ID NO: 146252 - DNA, 75 bp, Artificial Sequence
  Synthetic
ctcccctccggggtttcctctgttcggactggctcatcctcggagagggggcgacggcgtctgttctctattctt

SEQ ID NO: 146253 - DNA, 75 bp, Artificial Sequence
  Synthetic
ggggcgacggcgtctgttctctattcttttttctctaaaagaggagacagcttgccgcccgcccccagccccggg

SEQ ID NO: 146254 - DNA, 75 bp, Artificial Sequence
  Synthetic
ctcgtgagtggaaacttattcctttactggggagtacactcgaggagtggaaggcggggaggccggggtcccggg

SEQ ID NO: 146255 - DNA, 75 bp, Artificial Sequence
  Synthetic
gcgcgctggaagggtcggctcccgagagggataaaacggtaaagagcgttggatctctgagggtagaacccccaa

SEQ ID NO: 146256 - DNA, 75 bp, Artificial Sequence
  Synthetic
cggacgatttccccatgactctggagacatcctggaaggggaaagaaggaaggtggaaaagaaggagctgggcct

SEQ ID NO: 146257 - DNA, 75 bp, Artificial Sequence
  Synthetic
cccgatccgaggggcccaactgccaagtttggagagcactccggccgaaaggtcgaggtacccagaaggaggaat

SEQ ID NO: 146258 - DNA, 75 bp, Artificial Sequence
  Synthetic
gaaaagggaggatcggctgggaagagtatatcctatgggaatccctggtttcccctcacgtccagcccctccccg

SEQ ID NO: 146259 - DNA, 75 bp, Artificial Sequence
  Synthetic
cagctgctttctcttgttctcgagggccttccttcgtcggtgatcctgcctctccttgtcggagaaccctcccct

SEQ ID NO: 146260 - DNA, 75 bp, Artificial Sequence
  Synthetic
tttcttcttaatcttccggaggtccctctcgagatcctctaacttctttcttccgtttacccactgctcgaggat

SEQ ID NO: 146261 - DNA, 75 bp, Artificial Sequence
  Synthetic
agaatgtcattcgagattcaagcggtgaggggggatccccgagacgctggtggaaccccgggaagaaagaaaaag

SEQ ID NO: 146262 - DNA, 75 bp, Artificial Sequence
  Synthetic
gggcccccccataagatggcgagaaatccactcatgggtccatcgtccatctctttcttaccttttggccggcat

SEQ ID NO: 146263 - DNA, 75 bp, Artificial Sequence
  Synthetic
cttcgacgagaggcggagcggtcctgagaactcttatcttccttcttagaagaggagtctcctggacgccctccg

SEQ ID NO: 146264 - DNA, 75 bp, Artificial Sequence
  Synthetic
cgcggggaggacagatcagcgcccgagaggggtaagtcggtaaagagcattggaacgtcggagatacaactccca

SEQ ID NO: 146265 - DNA, 75 bp, Artificial Sequence
  Synthetic
tggaacgtcggagatacaactcccaagaaggaaaaaagagaaagcaagagacggaagaatttccccacgacgccg

SEQ ID NO: 146266 - DNA, 75 bp, Artificial Sequence
  Synthetic
tggaacgtcggagatacaactcccaagaaggaaaaaagagaaagcaagagacggatgaatttccccacgacgccg

SEQ ID NO: 146267 - DNA, 75 bp, Artificial Sequence
  Synthetic
tggaacgtcggagatacaactcccaagaaggaaaaaagagaaagcaagagacggacgaatttccccacgacgccg

SEQ ID NO: 146268 - DNA, 75 bp, Artificial Sequence
  Synthetic
tggaacgtcggagatacaactcccaagaaggaaaaaagagaaagcaagagacggaggaatttccccacgacgccg

SEQ ID NO: 146269 - DNA, 75 bp, Artificial Sequence
  Synthetic
gaggaaagttcggaaggaaatcccaagaggatcactcgagattcaagaggtgagaagggatccccgagacgctgg

SEQ ID NO: 146270 - DNA, 75 bp, Artificial Sequence
  Synthetic
agaggatcactcgagattcaagaggtgagaagggatccccgagacgctggaggagctccgggaaaaaagaaaaaa

SEQ ID NO: 146271 - DNA, 75 bp, Artificial Sequence
  Synthetic
aggcaagagattggtagaaaagagcgagcctcccgatacgagtttgccaggacctatcaaagattggagtcatcc

SEQ ID NO: 146272 - DNA, 75 bp, Artificial Sequence
  Synthetic
tgggaggggatgctaggagttgggggagaccgaagcgaggaggaaagcaaagaaagcaacggggctagcgagtgg

SEQ ID NO: 146273 - DNA, 75 bp, Artificial Sequence
  Synthetic
gagaccgaagcgaggaggaaagcaaagaaagcaacggggctagcgagtggatgttcctccccccgagggtcccga

SEQ ID NO: 146274 - DNA, 75 bp, Artificial Sequence
  Synthetic
gtgaggcttatcccggggatcggcctccgctcctccatggtggactccaggacccccgaaaggaggggggtgggc

SEQ ID NO: 146275 - DNA, 75 bp, Artificial Sequence
  Synthetic
ggtcccagcctcctcgtcggcgccggccgggcaacattccgaaggggaccgtccctcggtaatggcgaatgggac

SEQ ID NO: 146276 - DNA, 75 bp, Artificial Sequence
  Synthetic
tcttcttccatcgatccacttcccgagtgtctcttctctccccttccggggtctcctcgcatcggactggctcat

SEQ ID NO: 146277 - DNA, 75 bp, Artificial Sequence
  Synthetic
atgggccaagttccgaacaaggaatcgcggggaggacagatcagctcccgagaggggtaggtcggtaaagagcat

SEQ ID NO: 146278 - DNA, 75 bp, Artificial Sequence
  Synthetic
atgggccaagttccgaacaaggattcgcggggaggacagatcagctcccgagaggggtaggtcggtaaagagcat

SEQ ID NO: 146279 - DNA, 75 bp, Artificial Sequence
  Synthetic
atgggccaagttccgaacaaggactcgcggggaggacagatcagctcccgagaggggtaggtcggtaaagagcat

SEQ ID NO: 146280 - DNA, 75 bp, Artificial Sequence
  Synthetic
atgggccaagttccgaacaaggagtcgcggggaggacagatcagctcccgagaggggtaggtcggtaaagagcat

SEQ ID NO: 146281 - DNA, 75 bp, Artificial Sequence
  Synthetic
tcggacgaatttccccataacgccggtgaaactctaggaaggggaaagaggaaaggtggaagagaaggaggcggg

SEQ ID NO: 146282 - DNA, 75 bp, Artificial Sequence
  Synthetic
tcggacgaatttccccataacgccggtgaaactctaggaaggggaaagaggaatggtggaagagaaggaggcggg

SEQ ID NO: 146283 - DNA, 75 bp, Artificial Sequence
  Synthetic
tcggacgaatttccccataacgccggtgaaactctaggaaggggaaagaggaacggtggaagagaaggaggcggg

SEQ ID NO: 146284 - DNA, 75 bp, Artificial Sequence
  Synthetic
tcggacgaatttccccataacgccggtgaaactctaggaaggggaaagaggaagggtggaagagaaggaggcggg

SEQ ID NO: 146285 - DNA, 75 bp, Artificial Sequence
  Synthetic
tcggacgaatttccccataacgccggtgaaactctaggaaggggaaagaggtaaggtggaagagaaggaggcggg

SEQ ID NO: 146286 - DNA, 75 bp, Artificial Sequence
  Synthetic
tcggacgaatttccccataacgccggtgaaactctaggaaggggaaagaggtatggtggaagagaaggaggcggg

SEQ ID NO: 146287 - DNA, 75 bp, Artificial Sequence
  Synthetic
tcggacgaatttccccataacgccggtgaaactctaggaaggggaaagaggtacggtggaagagaaggaggcggg

SEQ ID NO: 146288 - DNA, 75 bp, Artificial Sequence
  Synthetic
tcggacgaatttccccataacgccggtgaaactctaggaaggggaaagaggtagggtggaagagaaggaggcggg

SEQ ID NO: 146289 - DNA, 75 bp, Artificial Sequence
  Synthetic
tcggacgaatttccccataacgccggtgaaactctaggaaggggaaagaggcaaggtggaagagaaggaggcggg

SEQ ID NO: 146290 - DNA, 75 bp, Artificial Sequence
  Synthetic
tcggacgaatttccccataacgccggtgaaactctaggaaggggaaagaggcatggtggaagagaaggaggcggg

SEQ ID NO: 146291 - DNA, 75 bp, Artificial Sequence
  Synthetic
tcggacgaatttccccataacgccggtgaaactctaggaaggggaaagaggcacggtggaagagaaggaggcggg

SEQ ID NO: 146292 - DNA, 75 bp, Artificial Sequence
  Synthetic
tcggacgaatttccccataacgccggtgaaactctaggaaggggaaagaggcagggtggaagagaaggaggcggg

SEQ ID NO: 146293 - DNA, 75 bp, Artificial Sequence
  Synthetic
tcggacgaatttccccataacgccggtgaaactctaggaaggggaaagagggaaggtggaagagaaggaggcggg

SEQ ID NO: 146294 - DNA, 75 bp, Artificial Sequence
  Synthetic
tcggacgaatttccccataacgccggtgaaactctaggaaggggaaagagggatggtggaagagaaggaggcggg

SEQ ID NO: 146295 - DNA, 75 bp, Artificial Sequence
  Synthetic
tcggacgaatttccccataacgccggtgaaactctaggaaggggaaagagggacggtggaagagaaggaggcggg

SEQ ID NO: 146296 - DNA, 75 bp, Artificial Sequence
  Synthetic
tcggacgaatttccccataacgccggtgaaactctaggaaggggaaagagggagggtggaagagaaggaggcggg

SEQ ID NO: 146297 - DNA, 75 bp, Artificial Sequence
  Synthetic
tcggacgaatttccccattacgccggtgaaactctaggaaggggaaagaggaaaggtggaagagaaggaggcggg

SEQ ID NO: 146298 - DNA, 75 bp, Artificial Sequence
  Synthetic
tcggacgaatttccccattacgccggtgaaactctaggaaggggaaagaggaatggtggaagagaaggaggcggg

SEQ ID NO: 146299 - DNA, 75 bp, Artificial Sequence
  Synthetic
tcggacgaatttccccattacgccggtgaaactctaggaaggggaaagaggaacggtggaagagaaggaggcggg

SEQ ID NO: 146300 - DNA, 75 bp, Artificial Sequence
  Synthetic
tcggacgaatttccccattacgccggtgaaactctaggaaggggaaagaggaagggtggaagagaaggaggcggg

SEQ ID NO: 146301 - DNA, 75 bp, Artificial Sequence
  Synthetic
tcggacgaatttccccattacgccggtgaaactctaggaaggggaaagaggtaaggtggaagagaaggaggcggg

SEQ ID NO: 146302 - DNA, 75 bp, Artificial Sequence
  Synthetic
tcggacgaatttccccattacgccggtgaaactctaggaaggggaaagaggtatggtggaagagaaggaggcggg

SEQ ID NO: 146303 - DNA, 75 bp, Artificial Sequence
  Synthetic
tcggacgaatttccccattacgccggtgaaactctaggaaggggaaagaggtacggtggaagagaaggaggcggg

SEQ ID NO: 146304 - DNA, 75 bp, Artificial Sequence
  Synthetic
tcggacgaatttccccattacgccggtgaaactctaggaaggggaaagaggtagggtggaagagaaggaggcggg

SEQ ID NO: 146305 - DNA, 75 bp, Artificial Sequence
  Synthetic
tcggacgaatttccccattacgccggtgaaactctaggaaggggaaagaggcaaggtggaagagaaggaggcggg

SEQ ID NO: 146306 - DNA, 75 bp, Artificial Sequence
  Synthetic
tcggacgaatttccccattacgccggtgaaactctaggaaggggaaagaggcatggtggaagagaaggaggcggg

SEQ ID NO: 146307 - DNA, 75 bp, Artificial Sequence
  Synthetic
tcggacgaatttccccattacgccggtgaaactctaggaaggggaaagaggcacggtggaagagaaggaggcggg

SEQ ID NO: 146308 - DNA, 75 bp, Artificial Sequence
  Synthetic
tcggacgaatttccccattacgccggtgaaactctaggaaggggaaagaggcagggtggaagagaaggaggcggg

SEQ ID NO: 146309 - DNA, 75 bp, Artificial Sequence
  Synthetic
tcggacgaatttccccattacgccggtgaaactctaggaaggggaaagagggaaggtggaagagaaggaggcggg

SEQ ID NO: 146310 - DNA, 75 bp, Artificial Sequence
  Synthetic
tcggacgaatttccccattacgccggtgaaactctaggaaggggaaagagggatggtggaagagaaggaggcggg

SEQ ID NO: 146311 - DNA, 75 bp, Artificial Sequence
  Synthetic
tcggacgaatttccccattacgccggtgaaactctaggaaggggaaagagggacggtggaagagaaggaggcggg

SEQ ID NO: 146312 - DNA, 75 bp, Artificial Sequence
  Synthetic
tcggacgaatttccccattacgccggtgaaactctaggaaggggaaagagggagggtggaagagaaggaggcggg

SEQ ID NO: 146313 - DNA, 75 bp, Artificial Sequence
  Synthetic
tcggacgaatttccccatcacgccggtgaaactctaggaaggggaaagaggaaaggtggaagagaaggaggcggg

SEQ ID NO: 146314 - DNA, 75 bp, Artificial Sequence
  Synthetic
tcggacgaatttccccatcacgccggtgaaactctaggaaggggaaagaggaatggtggaagagaaggaggcggg

SEQ ID NO: 146315 - DNA, 75 bp, Artificial Sequence
  Synthetic
tcggacgaatttccccatcacgccggtgaaactctaggaaggggaaagaggaacggtggaagagaaggaggcggg

SEQ ID NO: 146316 - DNA, 75 bp, Artificial Sequence
  Synthetic
tcggacgaatttccccatcacgccggtgaaactctaggaaggggaaagaggaagggtggaagagaaggaggcggg

SEQ ID NO: 146317 - DNA, 75 bp, Artificial Sequence
  Synthetic
tcggacgaatttccccatcacgccggtgaaactctaggaaggggaaagaggtaaggtggaagagaaggaggcggg

SEQ ID NO: 146318 - DNA, 75 bp, Artificial Sequence
  Synthetic
tcggacgaatttccccatcacgccggtgaaactctaggaaggggaaagaggtatggtggaagagaaggaggcggg

SEQ ID NO: 146319 - DNA, 75 bp, Artificial Sequence
  Synthetic
tcggacgaatttccccatcacgccggtgaaactctaggaaggggaaagaggtacggtggaagagaaggaggcggg

SEQ ID NO: 146320 - DNA, 75 bp, Artificial Sequence
  Synthetic
tcggacgaatttccccatcacgccggtgaaactctaggaaggggaaagaggtagggtggaagagaaggaggcggg

SEQ ID NO: 146321 - DNA, 75 bp, Artificial Sequence
  Synthetic
tcggacgaatttccccatcacgccggtgaaactctaggaaggggaaagaggcaaggtggaagagaaggaggcggg

SEQ ID NO: 146322 - DNA, 75 bp, Artificial Sequence
  Synthetic
tcggacgaatttccccatcacgccggtgaaactctaggaaggggaaagaggcatggtggaagagaaggaggcggg

SEQ ID NO: 146323 - DNA, 75 bp, Artificial Sequence
  Synthetic
tcggacgaatttccccatcacgccggtgaaactctaggaaggggaaagaggcacggtggaagagaaggaggcggg

SEQ ID NO: 146324 - DNA, 75 bp, Artificial Sequence
  Synthetic
tcggacgaatttccccatcacgccggtgaaactctaggaaggggaaagaggcagggtggaagagaaggaggcggg

SEQ ID NO: 146325 - DNA, 75 bp, Artificial Sequence
  Synthetic
tcggacgaatttccccatcacgccggtgaaactctaggaaggggaaagagggaaggtggaagagaaggaggcggg

SEQ ID NO: 146326 - DNA, 75 bp, Artificial Sequence
  Synthetic
tcggacgaatttccccatcacgccggtgaaactctaggaaggggaaagagggatggtggaagagaaggaggcggg

SEQ ID NO: 146327 - DNA, 75 bp, Artificial Sequence
  Synthetic
tcggacgaatttccccatcacgccggtgaaactctaggaaggggaaagagggacggtggaagagaaggaggcggg

SEQ ID NO: 146328 - DNA, 75 bp, Artificial Sequence
  Synthetic
tcggacgaatttccccatcacgccggtgaaactctaggaaggggaaagagggagggtggaagagaaggaggcggg

SEQ ID NO: 146329 - DNA, 75 bp, Artificial Sequence
  Synthetic
tcggacgaatttccccatgacgccggtgaaactctaggaaggggaaagaggaaaggtggaagagaaggaggcggg

SEQ ID NO: 146330 - DNA, 75 bp, Artificial Sequence
  Synthetic
tcggacgaatttccccatgacgccggtgaaactctaggaaggggaaagaggaatggtggaagagaaggaggcggg

SEQ ID NO: 146331 - DNA, 75 bp, Artificial Sequence
  Synthetic
tcggacgaatttccccatgacgccggtgaaactctaggaaggggaaagaggaacggtggaagagaaggaggcggg

SEQ ID NO: 146332 - DNA, 75 bp, Artificial Sequence
  Synthetic
tcggacgaatttccccatgacgccggtgaaactctaggaaggggaaagaggaagggtggaagagaaggaggcggg

SEQ ID NO: 146333 - DNA, 75 bp, Artificial Sequence
  Synthetic
tcggacgaatttccccatgacgccggtgaaactctaggaaggggaaagaggtaaggtggaagagaaggaggcggg

SEQ ID NO: 146334 - DNA, 75 bp, Artificial Sequence
  Synthetic
tcggacgaatttccccatgacgccggtgaaactctaggaaggggaaagaggtatggtggaagagaaggaggcggg

SEQ ID NO: 146335 - DNA, 75 bp, Artificial Sequence
  Synthetic
tcggacgaatttccccatgacgccggtgaaactctaggaaggggaaagaggtacggtggaagagaaggaggcggg

SEQ ID NO: 146336 - DNA, 75 bp, Artificial Sequence
  Synthetic
tcggacgaatttccccatgacgccggtgaaactctaggaaggggaaagaggtagggtggaagagaaggaggcggg

SEQ ID NO: 146337 - DNA, 75 bp, Artificial Sequence
  Synthetic
tcggacgaatttccccatgacgccggtgaaactctaggaaggggaaagaggcaaggtggaagagaaggaggcggg

SEQ ID NO: 146338 - DNA, 75 bp, Artificial Sequence
  Synthetic
tcggacgaatttccccatgacgccggtgaaactctaggaaggggaaagaggcatggtggaagagaaggaggcggg

SEQ ID NO: 146339 - DNA, 75 bp, Artificial Sequence
  Synthetic
tcggacgaatttccccatgacgccggtgaaactctaggaaggggaaagaggcacggtggaagagaaggaggcggg

SEQ ID NO: 146340 - DNA, 75 bp, Artificial Sequence
  Synthetic
tcggacgaatttccccatgacgccggtgaaactctaggaaggggaaagaggcagggtggaagagaaggaggcggg

SEQ ID NO: 146341 - DNA, 75 bp, Artificial Sequence
  Synthetic
tcggacgaatttccccatgacgccggtgaaactctaggaaggggaaagagggaaggtggaagagaaggaggcggg

SEQ ID NO: 146342 - DNA, 75 bp, Artificial Sequence
  Synthetic
tcggacgaatttccccatgacgccggtgaaactctaggaaggggaaagagggatggtggaagagaaggaggcggg

SEQ ID NO: 146343 - DNA, 75 bp, Artificial Sequence
  Synthetic
tcggacgaatttccccatgacgccggtgaaactctaggaaggggaaagagggacggtggaagagaaggaggcggg

SEQ ID NO: 146344 - DNA, 75 bp, Artificial Sequence
  Synthetic
tcggacgaatttccccatgacgccggtgaaactctaggaaggggaaagagggagggtggaagagaaggaggcggg

SEQ ID NO: 146345 - DNA, 75 bp, Artificial Sequence
  Synthetic
gtgaaacactaggaaggggaaagaggaaaggtggaagagaaggaggcgggctccccgatccgagggccccggcgg

SEQ ID NO: 146346 - DNA, 75 bp, Artificial Sequence
  Synthetic
gtgaaacactaggaaggggaaagaggaatggtggaagagaaggaggcgggctccccgatccgagggccccggcgg

SEQ ID NO: 146347 - DNA, 75 bp, Artificial Sequence
  Synthetic
gtgaaacactaggaaggggaaagaggaacggtggaagagaaggaggcgggctccccgatccgagggccccggcgg

SEQ ID NO: 146348 - DNA, 75 bp, Artificial Sequence
  Synthetic
gtgaaacactaggaaggggaaagaggaagggtggaagagaaggaggcgggctccccgatccgagggccccggcgg

SEQ ID NO: 146349 - DNA, 75 bp, Artificial Sequence
  Synthetic
gtgaaacactaggaaggggaaagaggtaaggtggaagagaaggaggcgggctccccgatccgagggccccggcgg

SEQ ID NO: 146350 - DNA, 75 bp, Artificial Sequence
  Synthetic
gtgaaacactaggaaggggaaagaggtatggtggaagagaaggaggcgggctccccgatccgagggccccggcgg

SEQ ID NO: 146351 - DNA, 75 bp, Artificial Sequence
  Synthetic
gtgaaacactaggaaggggaaagaggtacggtggaagagaaggaggcgggctccccgatccgagggccccggcgg

SEQ ID NO: 146352 - DNA, 75 bp, Artificial Sequence
  Synthetic
gtgaaacactaggaaggggaaagaggtagggtggaagagaaggaggcgggctccccgatccgagggccccggcgg

SEQ ID NO: 146353 - DNA, 75 bp, Artificial Sequence
  Synthetic
gtgaaacactaggaaggggaaagaggcaaggtggaagagaaggaggcgggctccccgatccgagggccccggcgg

SEQ ID NO: 146354 - DNA, 75 bp, Artificial Sequence
  Synthetic
gtgaaacactaggaaggggaaagaggcatggtggaagagaaggaggcgggctccccgatccgagggccccggcgg

SEQ ID NO: 146355 - DNA, 75 bp, Artificial Sequence
  Synthetic
gtgaaacactaggaaggggaaagaggcacggtggaagagaaggaggcgggctccccgatccgagggccccggcgg

SEQ ID NO: 146356 - DNA, 75 bp, Artificial Sequence
  Synthetic
gtgaaacactaggaaggggaaagaggcagggtggaagagaaggaggcgggctccccgatccgagggccccggcgg

SEQ ID NO: 146357 - DNA, 75 bp, Artificial Sequence
  Synthetic
gtgaaacactaggaaggggaaagagggaaggtggaagagaaggaggcgggctccccgatccgagggccccggcgg

SEQ ID NO: 146358 - DNA, 75 bp, Artificial Sequence
  Synthetic
gtgaaacactaggaaggggaaagagggatggtggaagagaaggaggcgggctccccgatccgagggccccggcgg

SEQ ID NO: 146359 - DNA, 75 bp, Artificial Sequence
  Synthetic
gtgaaacactaggaaggggaaagagggacggtggaagagaaggaggcgggctccccgatccgagggccccggcgg

SEQ ID NO: 146360 - DNA, 75 bp, Artificial Sequence
  Synthetic
gtgaaacactaggaaggggaaagagggagggtggaagagaaggaggcgggctccccgatccgagggccccggcgg

SEQ ID NO: 146361 - DNA, 75 bp, Artificial Sequence
  Synthetic
gtgaaactctaggaaggggaaagaggaaaggtggaagagaaggaggcgggctccccgatccgagggccccggcgg

SEQ ID NO: 146362 - DNA, 75 bp, Artificial Sequence
  Synthetic
gtgaaactctaggaaggggaaagaggaatggtggaagagaaggaggcgggctccccgatccgagggccccggcgg

SEQ ID NO: 146363 - DNA, 75 bp, Artificial Sequence
  Synthetic
gtgaaactctaggaaggggaaagaggaacggtggaagagaaggaggcgggctccccgatccgagggccccggcgg

SEQ ID NO: 146364 - DNA, 75 bp, Artificial Sequence
  Synthetic
gtgaaactctaggaaggggaaagaggaagggtggaagagaaggaggcgggctccccgatccgagggccccggcgg

SEQ ID NO: 146365 - DNA, 75 bp, Artificial Sequence
  Synthetic
gtgaaactctaggaaggggaaagaggtaaggtggaagagaaggaggcgggctccccgatccgagggccccggcgg

SEQ ID NO: 146366 - DNA, 75 bp, Artificial Sequence
  Synthetic
gtgaaactctaggaaggggaaagaggtatggtggaagagaaggaggcgggctccccgatccgagggccccggcgg

SEQ ID NO: 146367 - DNA, 75 bp, Artificial Sequence
  Synthetic
gtgaaactctaggaaggggaaagaggtacggtggaagagaaggaggcgggctccccgatccgagggccccggcgg

SEQ ID NO: 146368 - DNA, 75 bp, Artificial Sequence
  Synthetic
gtgaaactctaggaaggggaaagaggtagggtggaagagaaggaggcgggctccccgatccgagggccccggcgg

SEQ ID NO: 146369 - DNA, 75 bp, Artificial Sequence
  Synthetic
gtgaaactctaggaaggggaaagaggcaaggtggaagagaaggaggcgggctccccgatccgagggccccggcgg

SEQ ID NO: 146370 - DNA, 75 bp, Artificial Sequence
  Synthetic
gtgaaactctaggaaggggaaagaggcatggtggaagagaaggaggcgggctccccgatccgagggccccggcgg

SEQ ID NO: 146371 - DNA, 75 bp, Artificial Sequence
  Synthetic
gtgaaactctaggaaggggaaagaggcacggtggaagagaaggaggcgggctccccgatccgagggccccggcgg

SEQ ID NO: 146372 - DNA, 75 bp, Artificial Sequence
  Synthetic
gtgaaactctaggaaggggaaagaggcagggtggaagagaaggaggcgggctccccgatccgagggccccggcgg

SEQ ID NO: 146373 - DNA, 75 bp, Artificial Sequence
  Synthetic
gtgaaactctaggaaggggaaagagggaaggtggaagagaaggaggcgggctccccgatccgagggccccggcgg

SEQ ID NO: 146374 - DNA, 75 bp, Artificial Sequence
  Synthetic
gtgaaactctaggaaggggaaagagggatggtggaagagaaggaggcgggctccccgatccgagggccccggcgg

SEQ ID NO: 146375 - DNA, 75 bp, Artificial Sequence
  Synthetic
gtgaaactctaggaaggggaaagagggacggtggaagagaaggaggcgggctccccgatccgagggccccggcgg

SEQ ID NO: 146376 - DNA, 75 bp, Artificial Sequence
  Synthetic
gtgaaactctaggaaggggaaagagggagggtggaagagaaggaggcgggctccccgatccgagggccccggcgg

SEQ ID NO: 146377 - DNA, 75 bp, Artificial Sequence
  Synthetic
gtgaaaccctaggaaggggaaagaggaaaggtggaagagaaggaggcgggctccccgatccgagggccccggcgg

SEQ ID NO: 146378 - DNA, 75 bp, Artificial Sequence
  Synthetic
gtgaaaccctaggaaggggaaagaggaatggtggaagagaaggaggcgggctccccgatccgagggccccggcgg

SEQ ID NO: 146379 - DNA, 75 bp, Artificial Sequence
  Synthetic
gtgaaaccctaggaaggggaaagaggaacggtggaagagaaggaggcgggctccccgatccgagggccccggcgg

SEQ ID NO: 146380 - DNA, 75 bp, Artificial Sequence
  Synthetic
gtgaaaccctaggaaggggaaagaggaagggtggaagagaaggaggcgggctccccgatccgagggccccggcgg

SEQ ID NO: 146381 - DNA, 75 bp, Artificial Sequence
  Synthetic
gtgaaaccctaggaaggggaaagaggtaaggtggaagagaaggaggcgggctccccgatccgagggccccggcgg

SEQ ID NO: 146382 - DNA, 75 bp, Artificial Sequence
  Synthetic
gtgaaaccctaggaaggggaaagaggtatggtggaagagaaggaggcgggctccccgatccgagggccccggcgg

SEQ ID NO: 146383 - DNA, 75 bp, Artificial Sequence
  Synthetic
gtgaaaccctaggaaggggaaagaggtacggtggaagagaaggaggcgggctccccgatccgagggccccggcgg

SEQ ID NO: 146384 - DNA, 75 bp, Artificial Sequence
  Synthetic
gtgaaaccctaggaaggggaaagaggtagggtggaagagaaggaggcgggctccccgatccgagggccccggcgg

SEQ ID NO: 146385 - DNA, 75 bp, Artificial Sequence
  Synthetic
gtgaaaccctaggaaggggaaagaggcaaggtggaagagaaggaggcgggctccccgatccgagggccccggcgg

SEQ ID NO: 146386 - DNA, 75 bp, Artificial Sequence
  Synthetic
gtgaaaccctaggaaggggaaagaggcatggtggaagagaaggaggcgggctccccgatccgagggccccggcgg

SEQ ID NO: 146387 - DNA, 75 bp, Artificial Sequence
  Synthetic
gtgaaaccctaggaaggggaaagaggcacggtggaagagaaggaggcgggctccccgatccgagggccccggcgg

SEQ ID NO: 146388 - DNA, 75 bp, Artificial Sequence
  Synthetic
gtgaaaccctaggaaggggaaagaggcagggtggaagagaaggaggcgggctccccgatccgagggccccggcgg

SEQ ID NO: 146389 - DNA, 75 bp, Artificial Sequence
  Synthetic
gtgaaaccctaggaaggggaaagagggaaggtggaagagaaggaggcgggctccccgatccgagggccccggcgg

SEQ ID NO: 146390 - DNA, 75 bp, Artificial Sequence
  Synthetic
gtgaaaccctaggaaggggaaagagggatggtggaagagaaggaggcgggctccccgatccgagggccccggcgg

SEQ ID NO: 146391 - DNA, 75 bp, Artificial Sequence
  Synthetic
gtgaaaccctaggaaggggaaagagggacggtggaagagaaggaggcgggctccccgatccgagggccccggcgg

SEQ ID NO: 146392 - DNA, 75 bp, Artificial Sequence
  Synthetic
gtgaaaccctaggaaggggaaagagggagggtggaagagaaggaggcgggctccccgatccgagggccccggcgg

SEQ ID NO: 146393 - DNA, 75 bp, Artificial Sequence
  Synthetic
gtgaaacgctaggaaggggaaagaggaaaggtggaagagaaggaggcgggctccccgatccgagggccccggcgg

SEQ ID NO: 146394 - DNA, 75 bp, Artificial Sequence
  Synthetic
gtgaaacgctaggaaggggaaagaggaatggtggaagagaaggaggcgggctccccgatccgagggccccggcgg

SEQ ID NO: 146395 - DNA, 75 bp, Artificial Sequence
  Synthetic
gtgaaacgctaggaaggggaaagaggaacggtggaagagaaggaggcgggctccccgatccgagggccccggcgg

SEQ ID NO: 146396 - DNA, 75 bp, Artificial Sequence
  Synthetic
gtgaaacgctaggaaggggaaagaggaagggtggaagagaaggaggcgggctccccgatccgagggccccggcgg

SEQ ID NO: 146397 - DNA, 75 bp, Artificial Sequence
  Synthetic
gtgaaacgctaggaaggggaaagaggtaaggtggaagagaaggaggcgggctccccgatccgagggccccggcgg

SEQ ID NO: 146398 - DNA, 75 bp, Artificial Sequence
  Synthetic
gtgaaacgctaggaaggggaaagaggtatggtggaagagaaggaggcgggctccccgatccgagggccccggcgg

SEQ ID NO: 146399 - DNA, 75 bp, Artificial Sequence
  Synthetic
gtgaaacgctaggaaggggaaagaggtacggtggaagagaaggaggcgggctccccgatccgagggccccggcgg

SEQ ID NO: 146400 - DNA, 75 bp, Artificial Sequence
  Synthetic
gtgaaacgctaggaaggggaaagaggtagggtggaagagaaggaggcgggctccccgatccgagggccccggcgg

SEQ ID NO: 146401 - DNA, 75 bp, Artificial Sequence
  Synthetic
gtgaaacgctaggaaggggaaagaggcaaggtggaagagaaggaggcgggctccccgatccgagggccccggcgg

SEQ ID NO: 146402 - DNA, 75 bp, Artificial Sequence
  Synthetic
gtgaaacgctaggaaggggaaagaggcatggtggaagagaaggaggcgggctccccgatccgagggccccggcgg

SEQ ID NO: 146403 - DNA, 75 bp, Artificial Sequence
  Synthetic
gtgaaacgctaggaaggggaaagaggcacggtggaagagaaggaggcgggctccccgatccgagggccccggcgg

SEQ ID NO: 146404 - DNA, 75 bp, Artificial Sequence
  Synthetic
gtgaaacgctaggaaggggaaagaggcagggtggaagagaaggaggcgggctccccgatccgagggccccggcgg

SEQ ID NO: 146405 - DNA, 75 bp, Artificial Sequence
  Synthetic
gtgaaacgctaggaaggggaaagagggaaggtggaagagaaggaggcgggctccccgatccgagggccccggcgg

SEQ ID NO: 146406 - DNA, 75 bp, Artificial Sequence
  Synthetic
gtgaaacgctaggaaggggaaagagggatggtggaagagaaggaggcgggctccccgatccgagggccccggcgg

SEQ ID NO: 146407 - DNA, 75 bp, Artificial Sequence
  Synthetic
gtgaaacgctaggaaggggaaagagggacggtggaagagaaggaggcgggctccccgatccgagggccccggcgg

SEQ ID NO: 146408 - DNA, 75 bp, Artificial Sequence
  Synthetic
gtgaaacgctaggaaggggaaagagggagggtggaagagaaggaggcgggctccccgatccgagggccccggcgg

SEQ ID NO: 146409 - DNA, 75 bp, Artificial Sequence
  Synthetic
gcttatcccggggaactcgacttatcgtccccacatagcagagccccggaccccctttcaaagtgaccgaggggg

SEQ ID NO: 146410 - DNA, 75 bp, Artificial Sequence
  Synthetic
cgtccccacatagcagagccccggaccccctttcaaagtgaccgaggggggtgacttagaaccaggggggccagt

SEQ ID NO: 146411 - DNA, 75 bp, Artificial Sequence
  Synthetic
cgtccccacatagcagagccccggaccccctttcaaagtgaccgaggggggtgacttagaacctggggggccagt

SEQ ID NO: 146412 - DNA, 75 bp, Artificial Sequence
  Synthetic
cgtccccacatagcagagccccggaccccctttcaaagtgaccgaggggggtgacttagaacccggggggccagt

SEQ ID NO: 146413 - DNA, 75 bp, Artificial Sequence
  Synthetic
cgtccccacatagcagagccccggaccccctttcaaagtgaccgaggggggtgacttagaaccgggggggccagt

SEQ ID NO: 146414 - DNA, 75 bp, Artificial Sequence
  Synthetic
cgtccccacatagcagagccccggaccccctttcaaagtgaccgaggggggtgactttgaaccaggggggccagt

SEQ ID NO: 146415 - DNA, 75 bp, Artificial Sequence
  Synthetic
cgtccccacatagcagagccccggaccccctttcaaagtgaccgaggggggtgactttgaacctggggggccagt

SEQ ID NO: 146416 - DNA, 75 bp, Artificial Sequence
  Synthetic
cgtccccacatagcagagccccggaccccctttcaaagtgaccgaggggggtgactttgaacccggggggccagt

SEQ ID NO: 146417 - DNA, 75 bp, Artificial Sequence
  Synthetic
cgtccccacatagcagagccccggaccccctttcaaagtgaccgaggggggtgactttgaaccgggggggccagt

SEQ ID NO: 146418 - DNA, 75 bp, Artificial Sequence
  Synthetic
cgtccccacatagcagagccccggaccccctttcaaagtgaccgaggggggtgacttcgaaccaggggggccagt

SEQ ID NO: 146419 - DNA, 75 bp, Artificial Sequence
  Synthetic
cgtccccacatagcagagccccggaccccctttcaaagtgaccgaggggggtgacttcgaacctggggggccagt

SEQ ID NO: 146420 - DNA, 75 bp, Artificial Sequence
  Synthetic
cgtccccacatagcagagccccggaccccctttcaaagtgaccgaggggggtgacttcgaacccggggggccagt

SEQ ID NO: 146421 - DNA, 75 bp, Artificial Sequence
  Synthetic
cgtccccacatagcagagccccggaccccctttcaaagtgaccgaggggggtgacttcgaaccgggggggccagt

SEQ ID NO: 146422 - DNA, 75 bp, Artificial Sequence
  Synthetic
cgtccccacatagcagagccccggaccccctttcaaagtgaccgaggggggtgacttggaaccaggggggccagt

SEQ ID NO: 146423 - DNA, 75 bp, Artificial Sequence
  Synthetic
cgtccccacatagcagagccccggaccccctttcaaagtgaccgaggggggtgacttggaacctggggggccagt

SEQ ID NO: 146424 - DNA, 75 bp, Artificial Sequence
  Synthetic
cgtccccacatagcagagccccggaccccctttcaaagtgaccgaggggggtgacttggaacccggggggccagt

SEQ ID NO: 146425 - DNA, 75 bp, Artificial Sequence
  Synthetic
cgtccccacatagcagagccccggaccccctttcaaagtgaccgaggggggtgacttggaaccgggggggccagt

SEQ ID NO: 146426 - DNA, 75 bp, Artificial Sequence
  Synthetic
ggtcgcccaggaatggcgggaccccactctgcagggtccgcgttccatcctttcttacctgatggccggcatggt

SEQ ID NO: 146427 - DNA, 75 bp, Artificial Sequence
  Synthetic
gccagggattttcgtcctcaagtttcatgattttcttcttaaacttccggagatctctctcgagttcctctaact

SEQ ID NO: 146428 - DNA, 75 bp, Artificial Sequence
  Synthetic
gccagggattttcgtcctcaagtttcatgattttcttcttaaacttccggagttctctctcgagttcctctaact

SEQ ID NO: 146429 - DNA, 75 bp, Artificial Sequence
  Synthetic
gccagggattttcgtcctcaagtttcatgattttcttcttaaacttccggagctctctctcgagttcctctaact

SEQ ID NO: 146430 - DNA, 75 bp, Artificial Sequence
  Synthetic
gccagggattttcgtcctcaagtttcatgattttcttcttaaacttccggaggtctctctcgagttcctctaact

SEQ ID NO: 146431 - DNA, 75 bp, Artificial Sequence
  Synthetic
gccagggattttcgtcctcaagtttcatgattttcttcttaatcttccggagatctctctcgagttcctctaact

SEQ ID NO: 146432 - DNA, 75 bp, Artificial Sequence
  Synthetic
gccagggattttcgtcctcaagtttcatgattttcttcttaatcttccggagttctctctcgagttcctctaact

SEQ ID NO: 146433 - DNA, 75 bp, Artificial Sequence
  Synthetic
gccagggattttcgtcctcaagtttcatgattttcttcttaatcttccggagctctctctcgagttcctctaact

SEQ ID NO: 146434 - DNA, 75 bp, Artificial Sequence
  Synthetic
gccagggattttcgtcctcaagtttcatgattttcttcttaatcttccggaggtctctctcgagttcctctaact

SEQ ID NO: 146435 - DNA, 75 bp, Artificial Sequence
  Synthetic
gccagggattttcgtcctcaagtttcatgattttcttcttaaccttccggagatctctctcgagttcctctaact

SEQ ID NO: 146436 - DNA, 75 bp, Artificial Sequence
  Synthetic
gccagggattttcgtcctcaagtttcatgattttcttcttaaccttccggagttctctctcgagttcctctaact

SEQ ID NO: 146437 - DNA, 75 bp, Artificial Sequence
  Synthetic
gccagggattttcgtcctcaagtttcatgattttcttcttaaccttccggagctctctctcgagttcctctaact

SEQ ID NO: 146438 - DNA, 75 bp, Artificial Sequence
  Synthetic
gccagggattttcgtcctcaagtttcatgattttcttcttaaccttccggaggtctctctcgagttcctctaact

SEQ ID NO: 146439 - DNA, 75 bp, Artificial Sequence
  Synthetic
gccagggattttcgtcctcaagtttcatgattttcttcttaagcttccggagatctctctcgagttcctctaact

SEQ ID NO: 146440 - DNA, 75 bp, Artificial Sequence
  Synthetic
gccagggattttcgtcctcaagtttcatgattttcttcttaagcttccggagttctctctcgagttcctctaact

SEQ ID NO: 146441 - DNA, 75 bp, Artificial Sequence
  Synthetic
gccagggattttcgtcctcaagtttcatgattttcttcttaagcttccggagctctctctcgagttcctctaact

SEQ ID NO: 146442 - DNA, 75 bp, Artificial Sequence
  Synthetic
gccagggattttcgtcctcaagtttcatgattttcttcttaagcttccggaggtctctctcgagttcctctaact

SEQ ID NO: 146443 - DNA, 75 bp, Artificial Sequence
  Synthetic
gccagggattttcgtcctcaagtttcttgattttcttcttaaacttccggagatctctctcgagttcctctaact

SEQ ID NO: 146444 - DNA, 75 bp, Artificial Sequence
  Synthetic
gccagggattttcgtcctcaagtttcttgattttcttcttaaacttccggagttctctctcgagttcctctaact

SEQ ID NO: 146445 - DNA, 75 bp, Artificial Sequence
  Synthetic
gccagggattttcgtcctcaagtttcttgattttcttcttaaacttccggagctctctctcgagttcctctaact

SEQ ID NO: 146446 - DNA, 75 bp, Artificial Sequence
  Synthetic
gccagggattttcgtcctcaagtttcttgattttcttcttaaacttccggaggtctctctcgagttcctctaact

SEQ ID NO: 146447 - DNA, 75 bp, Artificial Sequence
  Synthetic
gccagggattttcgtcctcaagtttcttgattttcttcttaatcttccggagatctctctcgagttcctctaact

SEQ ID NO: 146448 - DNA, 75 bp, Artificial Sequence
  Synthetic
gccagggattttcgtcctcaagtttcttgattttcttcttaatcttccggagttctctctcgagttcctctaact

SEQ ID NO: 146449 - DNA, 75 bp, Artificial Sequence
  Synthetic
gccagggattttcgtcctcaagtttcttgattttcttcttaatcttccggagctctctctcgagttcctctaact

SEQ ID NO: 146450 - DNA, 75 bp, Artificial Sequence
  Synthetic
gccagggattttcgtcctcaagtttcttgattttcttcttaatcttccggaggtctctctcgagttcctctaact

SEQ ID NO: 146451 - DNA, 75 bp, Artificial Sequence
  Synthetic
gccagggattttcgtcctcaagtttcttgattttcttcttaaccttccggagatctctctcgagttcctctaact

SEQ ID NO: 146452 - DNA, 75 bp, Artificial Sequence
  Synthetic
gccagggattttcgtcctcaagtttcttgattttcttcttaaccttccggagttctctctcgagttcctctaact

SEQ ID NO: 146453 - DNA, 75 bp, Artificial Sequence
  Synthetic
gccagggattttcgtcctcaagtttcttgattttcttcttaaccttccggagctctctctcgagttcctctaact

SEQ ID NO: 146454 - DNA, 75 bp, Artificial Sequence
  Synthetic
gccagggattttcgtcctcaagtttcttgattttcttcttaaccttccggaggtctctctcgagttcctctaact

SEQ ID NO: 146455 - DNA, 75 bp, Artificial Sequence
  Synthetic
gccagggattttcgtcctcaagtttcttgattttcttcttaagcttccggagatctctctcgagttcctctaact

SEQ ID NO: 146456 - DNA, 75 bp, Artificial Sequence
  Synthetic
gccagggattttcgtcctcaagtttcttgattttcttcttaagcttccggagttctctctcgagttcctctaact

SEQ ID NO: 146457 - DNA, 75 bp, Artificial Sequence
  Synthetic
gccagggattttcgtcctcaagtttcttgattttcttcttaagcttccggagctctctctcgagttcctctaact

SEQ ID NO: 146458 - DNA, 75 bp, Artificial Sequence
  Synthetic
gccagggattttcgtcctcaagtttcttgattttcttcttaagcttccggaggtctctctcgagttcctctaact

SEQ ID NO: 146459 - DNA, 75 bp, Artificial Sequence
  Synthetic
gccagggattttcgtcctcaagtttcctgattttcttcttaaacttccggagatctctctcgagttcctctaact

SEQ ID NO: 146460 - DNA, 75 bp, Artificial Sequence
  Synthetic
gccagggattttcgtcctcaagtttcctgattttcttcttaaacttccggagttctctctcgagttcctctaact

SEQ ID NO: 146461 - DNA, 75 bp, Artificial Sequence
  Synthetic
gccagggattttcgtcctcaagtttcctgattttcttcttaaacttccggagctctctctcgagttcctctaact

SEQ ID NO: 146462 - DNA, 75 bp, Artificial Sequence
  Synthetic
gccagggattttcgtcctcaagtttcctgattttcttcttaaacttccggaggtctctctcgagttcctctaact

SEQ ID NO: 146463 - DNA, 75 bp, Artificial Sequence
  Synthetic
gccagggattttcgtcctcaagtttcctgattttcttcttaatcttccggagatctctctcgagttcctctaact

SEQ ID NO: 146464 - DNA, 75 bp, Artificial Sequence
  Synthetic
gccagggattttcgtcctcaagtttcctgattttcttcttaatcttccggagttctctctcgagttcctctaact

SEQ ID NO: 146465 - DNA, 75 bp, Artificial Sequence
  Synthetic
gccagggattttcgtcctcaagtttcctgattttcttcttaatcttccggagctctctctcgagttcctctaact

SEQ ID NO: 146466 - DNA, 75 bp, Artificial Sequence
  Synthetic
gccagggattttcgtcctcaagtttcctgattttcttcttaatcttccggaggtctctctcgagttcctctaact

SEQ ID NO: 146467 - DNA, 75 bp, Artificial Sequence
  Synthetic
gccagggattttcgtcctcaagtttcctgattttcttcttaaccttccggagatctctctcgagttcctctaact

SEQ ID NO: 146468 - DNA, 75 bp, Artificial Sequence
  Synthetic
gccagggattttcgtcctcaagtttcctgattttcttcttaaccttccggagttctctctcgagttcctctaact

SEQ ID NO: 146469 - DNA, 75 bp, Artificial Sequence
  Synthetic
gccagggattttcgtcctcaagtttcctgattttcttcttaaccttccggagctctctctcgagttcctctaact

SEQ ID NO: 146470 - DNA, 75 bp, Artificial Sequence
  Synthetic
gccagggattttcgtcctcaagtttcctgattttcttcttaaccttccggaggtctctctcgagttcctctaact

SEQ ID NO: 146471 - DNA, 75 bp, Artificial Sequence
  Synthetic
gccagggattttcgtcctcaagtttcctgattttcttcttaagcttccggagatctctctcgagttcctctaact

SEQ ID NO: 146472 - DNA, 75 bp, Artificial Sequence
  Synthetic
gccagggattttcgtcctcaagtttcctgattttcttcttaagcttccggagttctctctcgagttcctctaact

SEQ ID NO: 146473 - DNA, 75 bp, Artificial Sequence
  Synthetic
gccagggattttcgtcctcaagtttcctgattttcttcttaagcttccggagctctctctcgagttcctctaact

SEQ ID NO: 146474 - DNA, 75 bp, Artificial Sequence
  Synthetic
gccagggattttcgtcctcaagtttcctgattttcttcttaagcttccggaggtctctctcgagttcctctaact

SEQ ID NO: 146475 - DNA, 75 bp, Artificial Sequence
  Synthetic
gccagggattttcgtcctcaagtttcgtgattttcttcttaaacttccggagatctctctcgagttcctctaact

SEQ ID NO: 146476 - DNA, 75 bp, Artificial Sequence
  Synthetic
gccagggattttcgtcctcaagtttcgtgattttcttcttaaacttccggagttctctctcgagttcctctaact

SEQ ID NO: 146477 - DNA, 75 bp, Artificial Sequence
  Synthetic
gccagggattttcgtcctcaagtttcgtgattttcttcttaaacttccggagctctctctcgagttcctctaact

SEQ ID NO: 146478 - DNA, 75 bp, Artificial Sequence
  Synthetic
gccagggattttcgtcctcaagtttcgtgattttcttcttaaacttccggaggtctctctcgagttcctctaact

SEQ ID NO: 146479 - DNA, 75 bp, Artificial Sequence
  Synthetic
gccagggattttcgtcctcaagtttcgtgattttcttcttaatcttccggagatctctctcgagttcctctaact

SEQ ID NO: 146480 - DNA, 75 bp, Artificial Sequence
  Synthetic
gccagggattttcgtcctcaagtttcgtgattttcttcttaatcttccggagttctctctcgagttcctctaact

SEQ ID NO: 146481 - DNA, 75 bp, Artificial Sequence
  Synthetic
gccagggattttcgtcctcaagtttcgtgattttcttcttaatcttccggagctctctctcgagttcctctaact

SEQ ID NO: 146482 - DNA, 75 bp, Artificial Sequence
  Synthetic
gccagggattttcgtcctcaagtttcgtgattttcttcttaatcttccggaggtctctctcgagttcctctaact

SEQ ID NO: 146483 - DNA, 75 bp, Artificial Sequence
  Synthetic
gccagggattttcgtcctcaagtttcgtgattttcttcttaaccttccggagatctctctcgagttcctctaact

SEQ ID NO: 146484 - DNA, 75 bp, Artificial Sequence
  Synthetic
gccagggattttcgtcctcaagtttcgtgattttcttcttaaccttccggagttctctctcgagttcctctaact

SEQ ID NO: 146485 - DNA, 75 bp, Artificial Sequence
  Synthetic
gccagggattttcgtcctcaagtttcgtgattttcttcttaaccttccggagctctctctcgagttcctctaact

SEQ ID NO: 146486 - DNA, 75 bp, Artificial Sequence
  Synthetic
gccagggattttcgtcctcaagtttcgtgattttcttcttaaccttccggaggtctctctcgagttcctctaact

SEQ ID NO: 146487 - DNA, 75 bp, Artificial Sequence
  Synthetic
gccagggattttcgtcctcaagtttcgtgattttcttcttaagcttccggagatctctctcgagttcctctaact

SEQ ID NO: 146488 - DNA, 75 bp, Artificial Sequence
  Synthetic
gccagggattttcgtcctcaagtttcgtgattttcttcttaagcttccggagttctctctcgagttcctctaact

SEQ ID NO: 146489 - DNA, 75 bp, Artificial Sequence
  Synthetic
gccagggattttcgtcctcaagtttcgtgattttcttcttaagcttccggagctctctctcgagttcctctaact

SEQ ID NO: 146490 - DNA, 75 bp, Artificial Sequence
  Synthetic
gccagggattttcgtcctcaagtttcgtgattttcttcttaagcttccggaggtctctctcgagttcctctaact

SEQ ID NO: 146491 - DNA, 75 bp, Artificial Sequence
  Synthetic
gatgggccgcaaccgggcgaggggggcgaagtggggaaggggatatcccgaggaggatcctcaactaaagagtgg

SEQ ID NO: 146492 - DNA, 75 bp, Artificial Sequence
  Synthetic
ttaacttccagaggaccccttcagcgaacggaagagcttcctccttcggagagaaagaccatagcgatgggggag

SEQ ID NO: 146493 - DNA, 75 bp, Artificial Sequence
  Synthetic
atgctaggagtaggcggcgaccgaagcgagggggaaagtaaagaaagcaacggggctagcgagtggatgttccgc

SEQ ID NO: 146494 - DNA, 75 bp, Artificial Sequence
  Synthetic
cgccaccgggcgctcccctcggacctcctccggagaggttcacatccccaacccgcgggccggctactcttcttt

SEQ ID NO: 146495 - DNA, 75 bp, Artificial Sequence
  Synthetic
ctcgagctcctccgcctttcttcttgttgtgatccatttctcgagggtatcctcccttgttccccttcgactcct

SEQ ID NO: 146496 - DNA, 75 bp, Artificial Sequence
  Synthetic
cttcgactcggattggctcatccccaggtcgaggcgaaggtcctcagttctcatatattctttctaagaaagagg

SEQ ID NO: 146497 - DNA, 75 bp, Artificial Sequence
  Synthetic
aggtcgaggcgaaggtcctcagttctcatatattctttctaagaaagaggagactgttggaccaaacgcccgagc

SEQ ID NO: 146498 - DNA, 75 bp, Artificial Sequence
  Synthetic
tcgagatcctctaacttctttcttccgttcacccactgctcgaggatctcttctcttccatcgcgtttcttcttc

SEQ ID NO: 146499 - DNA, 75 bp, Artificial Sequence
  Synthetic
atgagccaagtccgacgaagagtccggagatgggagaggagagagacccccgaggaggcaaagtcgagagggcgg

SEQ ID NO: 146500 - DNA, 75 bp, Artificial Sequence
  Synthetic
ggagatgggagaggagagagacccccgaggaggcaaagtcgagagggcggagacactctgaggagaggactccca

SEQ ID NO: 146501 - DNA, 75 bp, Artificial Sequence
  Synthetic
cgaggaggcaaagtcgagagggcggagacactctgaggagaggactcccaagaggacaagaaggactcaagatcc

SEQ ID NO: 146502 - DNA, 75 bp, Artificial Sequence
  Synthetic
gggaacgaatccccaaaacgccggtaaagctcttggaatgaggaaaacgggcgggatggtagaaaagagcgagcc

SEQ ID NO: 146503 - DNA, 75 bp, Artificial Sequence
  Synthetic
aaagctcttggaatgaggaaaacgggcgggatggtagaaaagagcgagcctcccgattacgagattcccctgaac

SEQ ID NO: 146504 - DNA, 75 bp, Artificial Sequence
  Synthetic
ttattggatctggagactccgaccttaaggggtcaaaggtaggacagggaggcaatccaccaggagatttcggac

SEQ ID NO: 146505 - DNA, 75 bp, Artificial Sequence
  Synthetic
taaggggtcaaaggtaggacagggaggcaatccaccaggagatttcggacaactcacctccagaggaccccttca

SEQ ID NO: 146506 - DNA, 75 bp, Artificial Sequence
  Synthetic
gaattgtcccgtagcgataggaggagatgctaggagtagggagagaccggtgcgagagaggcaagacaagagagc

SEQ ID NO: 146507 - DNA, 75 bp, Artificial Sequence
  Synthetic
agcggggctagcgagtggatgttccgccccccgttggctccgagtgaggcttatcccggggaatttggctaactt

SEQ ID NO: 146508 - DNA, 75 bp, Artificial Sequence
  Synthetic
agcggggctagcgagtggatgttccgccccccgttggctccgagtgaggcttatcccggggaatttggctatctt

SEQ ID NO: 146509 - DNA, 75 bp, Artificial Sequence
  Synthetic
agcggggctagcgagtggatgttccgccccccgttggctccgagtgaggcttatcccggggaatttggctacctt

SEQ ID NO: 146510 - DNA, 75 bp, Artificial Sequence
  Synthetic
agcggggctagcgagtggatgttccgccccccgttggctccgagtgaggcttatcccggggaatttggctagctt

SEQ ID NO: 146511 - DNA, 75 bp, Artificial Sequence
  Synthetic
gccccccgttggctccgagtgaggcttatcccggggaatttggctaacttccccaactagccggtcccggatccc

SEQ ID NO: 146512 - DNA, 75 bp, Artificial Sequence
  Synthetic
gccccccgttggctccgagtgaggcttatcccggggaatttggctatcttccccaactagccggtcccggatccc

SEQ ID NO: 146513 - DNA, 75 bp, Artificial Sequence
  Synthetic
gccccccgttggctccgagtgaggcttatcccggggaatttggctaccttccccaactagccggtcccggatccc

SEQ ID NO: 146514 - DNA, 75 bp, Artificial Sequence
  Synthetic
gccccccgttggctccgagtgaggcttatcccggggaatttggctagcttccccaactagccggtcccggatccc

SEQ ID NO: 146515 - DNA, 75 bp, Artificial Sequence
  Synthetic
cttccaaatgaacggggggactccggcctctcggggaatcggcggctccatggtgaacccccgcagccccccact

SEQ ID NO: 146516 - DNA, 75 bp, Artificial Sequence
  Synthetic
cttccatatgaacggggggactccggcctctcggggaatcggcggctccatggtgaacccccgcagccccccact

SEQ ID NO: 146517 - DNA, 75 bp, Artificial Sequence
  Synthetic
cttccacatgaacggggggactccggcctctcggggaatcggcggctccatggtgaacccccgcagccccccact

SEQ ID NO: 146518 - DNA, 75 bp, Artificial Sequence
  Synthetic
cttccagatgaacggggggactccggcctctcggggaatcggcggctccatggtgaacccccgcagccccccact

SEQ ID NO: 146519 - DNA, 75 bp, Artificial Sequence
  Synthetic
ccacactccttccccccgcggggccccccatccaaagatggaactccacccctcagggttcgcaatcctaccctt

SEQ ID NO: 146520 - DNA, 75 bp, Artificial Sequence
  Synthetic
ccacactccttccccccgcggggccccccatccaaagatggaactccacccctcagggttcgctatcctaccctt

SEQ ID NO: 146521 - DNA, 75 bp, Artificial Sequence
  Synthetic
ccacactccttccccccgcggggccccccatccaaagatggaactccacccctcagggttcgccatcctaccctt

SEQ ID NO: 146522 - DNA, 75 bp, Artificial Sequence
  Synthetic
ccacactccttccccccgcggggccccccatccaaagatggaactccacccctcagggttcgcgatcctaccctt

SEQ ID NO: 146523 - DNA, 75 bp, Artificial Sequence
  Synthetic
gcaacattccgaggggaccgtccctcggcaatggcgaatgggacccaagacctccaagattcccagagagaatct

SEQ ID NO: 146524 - DNA, 75 bp, Artificial Sequence
  Synthetic
gaggtggagatgccatgccgacccgaagaggaaagaaggattcggacgcaaacctgtgagtggaagttcgctctt

SEQ ID NO: 146525 - DNA, 75 bp, Artificial Sequence
  Synthetic
tattggggggtacactcgaggagtggaaggcggggagggggggtcggactaggtccctatggaaactgtcggtct

SEQ ID NO: 146526 - DNA, 75 bp, Artificial Sequence
  Synthetic
gaaggcggggagggggggtcggactaggtccctatggaaactgtcggtctcctcggatgtcgagtccctctcccg

SEQ ID NO: 146527 - DNA, 75 bp, Artificial Sequence
  Synthetic
cctcgggagggttcacatccccaacccgcgggccggctattcttcttgctctttgctcgtcatcggcggtcaact

SEQ ID NO: 146528 - DNA, 75 bp, Artificial Sequence
  Synthetic
ccttccttcgtcggtgagcccgtctctcctcgtcggtgaagcctcccttgttactctttttccctggtccggagt

SEQ ID NO: 146529 - DNA, 75 bp, Artificial Sequence
  Synthetic
cgacctccatccgatctgttcggggtctcttcgccgggggagctccctccccagtcccgacctttccaattattc

SEQ ID NO: 146530 - DNA, 75 bp, Artificial Sequence
  Synthetic
tctcttcgccgggggagctccctccccagtcccgacctttccaattattcctttgatgtttcccagccagggatt

SEQ ID NO: 146531 - DNA, 75 bp, Artificial Sequence
  Synthetic
gtcgtcctcaagtttcttgatggtcttctttgtcttccggagcctcctctcgagttcttccgcgtcttcccttgc

SEQ ID NO: 146532 - DNA, 75 bp, Artificial Sequence
  Synthetic
ttctttgtcttccggagcctcctctcgagttcttccgcgtcttcccttgctttgacccacttcgaaagggtctcc

SEQ ID NO: 146533 - DNA, 75 bp, Artificial Sequence
  Synthetic
ttctttgtcttccggagcctcctctcgagttcttccgcgtcttcccttgctttgtcccacttcgaaagggtctcc

SEQ ID NO: 146534 - DNA, 75 bp, Artificial Sequence
  Synthetic
ttctttgtcttccggagcctcctctcgagttcttccgcgtcttcccttgctttgccccacttcgaaagggtctcc

SEQ ID NO: 146535 - DNA, 75 bp, Artificial Sequence
  Synthetic
ttctttgtcttccggagcctcctctcgagttcttccgcgtcttcccttgctttggcccacttcgaaagggtctcc

SEQ ID NO: 146536 - DNA, 75 bp, Artificial Sequence
  Synthetic
tcccttcccttccgggatctcttcgtatcggcgtggctcatctcggcagaggcgggcgatcctcagttctcttac

SEQ ID NO: 146537 - DNA, 75 bp, Artificial Sequence
  Synthetic
agaggcgggcgatcctcagttctcttactcttttcttgaaagaggagactgctggacgctccgccgtgtccgagc

SEQ ID NO: 146538 - DNA, 75 bp, Artificial Sequence
  Synthetic
atgagccaagttccgaacaaggattccgcgggaggatagatcagcgcccgagaggggtaattcggtaaagagcat

SEQ ID NO: 146539 - DNA, 75 bp, Artificial Sequence
  Synthetic
atgtgccaagttccgaacaaggattccgcgggaggatagatcagcgcccgagaggggtaattcggtaaagagcat

SEQ ID NO: 146540 - DNA, 75 bp, Artificial Sequence
  Synthetic
atgcgccaagttccgaacaaggattccgcgggaggatagatcagcgcccgagaggggtaattcggtaaagagcat

SEQ ID NO: 146541 - DNA, 75 bp, Artificial Sequence
  Synthetic
atgggccaagttccgaacaaggattccgcgggaggatagatcagcgcccgagaggggtaattcggtaaagagcat

SEQ ID NO: 146542 - DNA, 75 bp, Artificial Sequence
  Synthetic
tggaacgtcggagatgaaactcccaagaaggaaaaaagagaaagcaagaatcggatgattttccccaaaaccctg

SEQ ID NO: 146543 - DNA, 75 bp, Artificial Sequence
  Synthetic
gtgaagctctaggaaggggaaagagggaaggtggaagagaaggaggcgggcctcccgatccgagggacccgatgg

SEQ ID NO: 146544 - DNA, 75 bp, Artificial Sequence
  Synthetic
gtgaagctctaggaaggggaaagagggaaggtggaagagaaggaggcgggcctcccgatccgagggtcccgatgg

SEQ ID NO: 146545 - DNA, 75 bp, Artificial Sequence
  Synthetic
gtgaagctctaggaaggggaaagagggaaggtggaagagaaggaggcgggcctcccgatccgagggccccgatgg

SEQ ID NO: 146546 - DNA, 75 bp, Artificial Sequence
  Synthetic
gtgaagctctaggaaggggaaagagggaaggtggaagagaaggaggcgggcctcccgatccgaggggcccgatgg

SEQ ID NO: 146547 - DNA, 75 bp, Artificial Sequence
  Synthetic
ggaaggtggaagagaaggaggcgggcctcccgatccgagggacccgatggccaagtttgggaggcactccggccc

SEQ ID NO: 146548 - DNA, 75 bp, Artificial Sequence
  Synthetic
ggaaggtggaagagaaggaggcgggcctcccgatccgagggtcccgatggccaagtttgggaggcactccggccc

SEQ ID NO: 146549 - DNA, 75 bp, Artificial Sequence
  Synthetic
ggaaggtggaagagaaggaggcgggcctcccgatccgagggccccgatggccaagtttgggaggcactccggccc

SEQ ID NO: 146550 - DNA, 75 bp, Artificial Sequence
  Synthetic
ggaaggtggaagagaaggaggcgggcctcccgatccgaggggcccgatggccaagtttgggaggcactccggccc

SEQ ID NO: 146551 - DNA, 75 bp, Artificial Sequence
  Synthetic
tgactttgaacaatggggaccagtggagccatgggatgctattcccgattccgcccactccttccccccagcggt

SEQ ID NO: 146552 - DNA, 75 bp, Artificial Sequence
  Synthetic
tgactttgaacaatggggaccagtggagccatgggatgcttttcccgattccgcccactccttccccccagcggt

SEQ ID NO: 146553 - DNA, 75 bp, Artificial Sequence
  Synthetic
tgactttgaacaatggggaccagtggagccatgggatgctcttcccgattccgcccactccttccccccagcggt

SEQ ID NO: 146554 - DNA, 75 bp, Artificial Sequence
  Synthetic
tgactttgaacaatggggaccagtggagccatgggatgctgttcccgattccgcccactccttccccccagcggt

SEQ ID NO: 146555 - DNA, 75 bp, Artificial Sequence
  Synthetic
tgactttgaacattggggaccagtggagccatgggatgctattcccgattccgcccactccttccccccagcggt

SEQ ID NO: 146556 - DNA, 75 bp, Artificial Sequence
  Synthetic
tgactttgaacattggggaccagtggagccatgggatgcttttcccgattccgcccactccttccccccagcggt

SEQ ID NO: 146557 - DNA, 75 bp, Artificial Sequence
  Synthetic
tgactttgaacattggggaccagtggagccatgggatgctcttcccgattccgcccactccttccccccagcggt

SEQ ID NO: 146558 - DNA, 75 bp, Artificial Sequence
  Synthetic
tgactttgaacattggggaccagtggagccatgggatgctgttcccgattccgcccactccttccccccagcggt

SEQ ID NO: 146559 - DNA, 75 bp, Artificial Sequence
  Synthetic
tgactttgaacactggggaccagtggagccatgggatgctattcccgattccgcccactccttccccccagcggt

SEQ ID NO: 146560 - DNA, 75 bp, Artificial Sequence
  Synthetic
tgactttgaacactggggaccagtggagccatgggatgcttttcccgattccgcccactccttccccccagcggt

SEQ ID NO: 146561 - DNA, 75 bp, Artificial Sequence
  Synthetic
tgactttgaacactggggaccagtggagccatgggatgctcttcccgattccgcccactccttccccccagcggt

SEQ ID NO: 146562 - DNA, 75 bp, Artificial Sequence
  Synthetic
tgactttgaacactggggaccagtggagccatgggatgctgttcccgattccgcccactccttccccccagcggt

SEQ ID NO: 146563 - DNA, 75 bp, Artificial Sequence
  Synthetic
tgactttgaacagtggggaccagtggagccatgggatgctattcccgattccgcccactccttccccccagcggt

SEQ ID NO: 146564 - DNA, 75 bp, Artificial Sequence
  Synthetic
tgactttgaacagtggggaccagtggagccatgggatgcttttcccgattccgcccactccttccccccagcggt

SEQ ID NO: 146565 - DNA, 75 bp, Artificial Sequence
  Synthetic
tgactttgaacagtggggaccagtggagccatgggatgctcttcccgattccgcccactccttccccccagcggt

SEQ ID NO: 146566 - DNA, 75 bp, Artificial Sequence
  Synthetic
tgactttgaacagtggggaccagtggagccatgggatgctgttcccgattccgcccactccttccccccagcggt

SEQ ID NO: 146567 - DNA, 75 bp, Artificial Sequence
  Synthetic
tcgactagaggcggcggtcctcagttctcttaatctttttcgataaagaggagactgctggccctgccgcccgag

SEQ ID NO: 146568 - DNA, 75 bp, Artificial Sequence
  Synthetic
tgtccagtccctccccggtccgagtaaagggggactccgggactccttgcatgttggggacgaagccgcccccgg

SEQ ID NO: 146569 - DNA, 75 bp, Artificial Sequence
  Synthetic
tgtccagtccctccccggtccgagttaagggggactccgggactccttgcatgttggggacgaagccgcccccgg

SEQ ID NO: 146570 - DNA, 75 bp, Artificial Sequence
  Synthetic
tgtccagtccctccccggtccgagtcaagggggactccgggactccttgcatgttggggacgaagccgcccccgg

SEQ ID NO: 146571 - DNA, 75 bp, Artificial Sequence
  Synthetic
tgtccagtccctccccggtccgagtgaagggggactccgggactccttgcatgttggggacgaagccgcccccgg

SEQ ID NO: 146572 - DNA, 75 bp, Artificial Sequence
  Synthetic
atgagccacagttccgagcgaagagacgcgaggggaggatcagctcccgagaggggatgaacggcaaagagaatt

SEQ ID NO: 146573 - DNA, 75 bp, Artificial Sequence
  Synthetic
atgagccacagttccgagcgaagagacgcgaggggaggatcagctcccgagaggggatgaacggcaaagagtatt

SEQ ID NO: 146574 - DNA, 75 bp, Artificial Sequence
  Synthetic
atgagccacagttccgagcgaagagacgcgaggggaggatcagctcccgagaggggatgaacggcaaagagcatt

SEQ ID NO: 146575 - DNA, 75 bp, Artificial Sequence
  Synthetic
atgagccacagttccgagcgaagagacgcgaggggaggatcagctcccgagaggggatgaacggcaaagaggatt

SEQ ID NO: 146576 - DNA, 75 bp, Artificial Sequence
  Synthetic
acgcgaggggaggatcagctcccgagaggggatgaacggcaaagagaattggaacgtcggcgggaacactcccaa

SEQ ID NO: 146577 - DNA, 75 bp, Artificial Sequence
  Synthetic
acgcgaggggaggatcagctcccgagaggggatgaacggcaaagagtattggaacgtcggcgggaacactcccaa

SEQ ID NO: 146578 - DNA, 75 bp, Artificial Sequence
  Synthetic
acgcgaggggaggatcagctcccgagaggggatgaacggcaaagagcattggaacgtcggcgggaacactcccaa

SEQ ID NO: 146579 - DNA, 75 bp, Artificial Sequence
  Synthetic
acgcgaggggaggatcagctcccgagaggggatgaacggcaaagaggattggaacgtcggcgggaacactcccaa

SEQ ID NO: 146580 - DNA, 75 bp, Artificial Sequence
  Synthetic
gaaggaacaagagaagacaagaaccggaaggttttccccaaaacgctggagaatctttggaaggggaaagaggat

SEQ ID NO: 146581 - DNA, 75 bp, Artificial Sequence
  Synthetic
gaaggaacaagagaagacaagaaccggaaggttttccccataacgctggagaatctttggaaggggaaagaggat

SEQ ID NO: 146582 - DNA, 75 bp, Artificial Sequence
  Synthetic
gaaggaacaagagaagacaagaaccggaaggttttccccacaacgctggagaatctttggaaggggaaagaggat

SEQ ID NO: 146583 - DNA, 75 bp, Artificial Sequence
  Synthetic
gaaggaacaagagaagacaagaaccggaaggttttccccagaacgctggagaatctttggaaggggaaagaggat

SEQ ID NO: 146584 - DNA, 75 bp, Artificial Sequence
  Synthetic
gcttaggacccggaggaccggtggagccatgggatgctccttccgatgctcgatccgattccctccccccaaagg

SEQ ID NO: 146585 - DNA, 75 bp, Artificial Sequence
  Synthetic
ggggagaaaagggaggatcggctggaaagagtatatcctatgggaatccccggtctcctctcaggtccagcccct

SEQ ID NO: 146586 - DNA, 75 bp, Artificial Sequence
  Synthetic
ggtccctctcgagttcctctaacttctttcttccgtttacccactgctcgaggaactcttctctccctccgcgat

SEQ ID NO: 146587 - DNA, 75 bp, Artificial Sequence
  Synthetic
ggtccctctcgagttcctctaacttctttcttccgtttacccactgctcgaggatctcttctctccctccgcgat

SEQ ID NO: 146588 - DNA, 75 bp, Artificial Sequence
  Synthetic
ggtccctctcgagttcctctaacttctttcttccgtttacccactgctcgaggacctcttctctccctccgcgat

SEQ ID NO: 146589 - DNA, 75 bp, Artificial Sequence
  Synthetic
ggtccctctcgagttcctctaacttctttcttccgtttacccactgctcgaggagctcttctctccctccgcgat

SEQ ID NO: 146590 - DNA, 75 bp, Artificial Sequence
  Synthetic
ctttcttccgtttacccactgctcgaggaactcttctctccctccgcgatccttcttcttctcggaccggctcat

SEQ ID NO: 146591 - DNA, 75 bp, Artificial Sequence
  Synthetic
ctttcttccgtttacccactgctcgaggatctcttctctccctccgcgatccttcttcttctcggaccggctcat

SEQ ID NO: 146592 - DNA, 75 bp, Artificial Sequence
  Synthetic
ctttcttccgtttacccactgctcgaggacctcttctctccctccgcgatccttcttcttctcggaccggctcat

SEQ ID NO: 146593 - DNA, 75 bp, Artificial Sequence
  Synthetic
ctttcttccgtttacccactgctcgaggagctcttctctccctccgcgatccttcttcttctcggaccggctcat

SEQ ID NO: 146594 - DNA, 75 bp, Artificial Sequence
  Synthetic
ctcgacaaagggcggcggtcctcagtactcttaatctttttcgataaagaggagactgctggaccagccgcccga

SEQ ID NO: 146595 - DNA, 75 bp, Artificial Sequence
  Synthetic
ctcgacaaagggcggcggtcctcagtactcttaatctttttcgataaagaggagactgctggacctgccgcccga

SEQ ID NO: 146596 - DNA, 75 bp, Artificial Sequence
  Synthetic
ctcgacaaagggcggcggtcctcagtactcttaatctttttcgataaagaggagactgctggacccgccgcccga

SEQ ID NO: 146597 - DNA, 75 bp, Artificial Sequence
  Synthetic
ctcgacaaagggcggcggtcctcagtactcttaatctttttcgataaagaggagactgctggaccggccgcccga

SEQ ID NO: 146598 - DNA, 75 bp, Artificial Sequence
  Synthetic
ctcgacaaagggcggcggtcctcagttctcttaatctttttcgataaagaggagactgctggaccagccgcccga

SEQ ID NO: 146599 - DNA, 75 bp, Artificial Sequence
  Synthetic
ctcgacaaagggcggcggtcctcagttctcttaatctttttcgataaagaggagactgctggacctgccgcccga

SEQ ID NO: 146600 - DNA, 75 bp, Artificial Sequence
  Synthetic
ctcgacaaagggcggcggtcctcagttctcttaatctttttcgataaagaggagactgctggacccgccgcccga

SEQ ID NO: 146601 - DNA, 75 bp, Artificial Sequence
  Synthetic
ctcgacaaagggcggcggtcctcagttctcttaatctttttcgataaagaggagactgctggaccggccgcccga

SEQ ID NO: 146602 - DNA, 75 bp, Artificial Sequence
  Synthetic
ctcgacaaagggcggcggtcctcagtcctcttaatctttttcgataaagaggagactgctggaccagccgcccga

SEQ ID NO: 146603 - DNA, 75 bp, Artificial Sequence
  Synthetic
ctcgacaaagggcggcggtcctcagtcctcttaatctttttcgataaagaggagactgctggacctgccgcccga

SEQ ID NO: 146604 - DNA, 75 bp, Artificial Sequence
  Synthetic
ctcgacaaagggcggcggtcctcagtcctcttaatctttttcgataaagaggagactgctggacccgccgcccga

SEQ ID NO: 146605 - DNA, 75 bp, Artificial Sequence
  Synthetic
ctcgacaaagggcggcggtcctcagtcctcttaatctttttcgataaagaggagactgctggaccggccgcccga

SEQ ID NO: 146606 - DNA, 75 bp, Artificial Sequence
  Synthetic
ctcgacaaagggcggcggtcctcagtgctcttaatctttttcgataaagaggagactgctggaccagccgcccga

SEQ ID NO: 146607 - DNA, 75 bp, Artificial Sequence
  Synthetic
ctcgacaaagggcggcggtcctcagtgctcttaatctttttcgataaagaggagactgctggacctgccgcccga

SEQ ID NO: 146608 - DNA, 75 bp, Artificial Sequence
  Synthetic
ctcgacaaagggcggcggtcctcagtgctcttaatctttttcgataaagaggagactgctggacccgccgcccga

SEQ ID NO: 146609 - DNA, 75 bp, Artificial Sequence
  Synthetic
ctcgacaaagggcggcggtcctcagtgctcttaatctttttcgataaagaggagactgctggaccggccgcccga

SEQ ID NO: 146610 - DNA, 75 bp, Artificial Sequence
  Synthetic
catgagccacgttccgaacgaagagacgcgaggggaaggggatagtgctcgagagggagtgacggtaaagagcat

SEQ ID NO: 146611 - DNA, 75 bp, Artificial Sequence
  Synthetic
acgcgaggggaaggggatagtgctcgagagggagtgacggtaaagagcattggaacgccgaggggatgtctccca

SEQ ID NO: 146612 - DNA, 75 bp, Artificial Sequence
  Synthetic
gagagggagtgacggtaaagagcattggaacgccgaggggatgtctcccaagaagaaaaagagaggattcaagaa

SEQ ID NO: 146613 - DNA, 75 bp, Artificial Sequence
  Synthetic
gtgggagacttccccataacgctggagacatcctggaaggggaaagaggatgggtggaaagaaaaggggcggggc

SEQ ID NO: 146614 - DNA, 75 bp, Artificial Sequence
  Synthetic
tgggtggaaagaaaaggggcggggccccccgatccgaggggcccaacgccaggatttgggaggcattccggcccg

SEQ ID NO: 146615 - DNA, 75 bp, Artificial Sequence
  Synthetic
aaatcacctccagaggaccccttcagcgaacagaggcgcttcgagcggtaggagtaaggccatagcgataggagg

SEQ ID NO: 146616 - DNA, 75 bp, Artificial Sequence
  Synthetic
aagcgaggaggaaagcaaagaaagcaacggggctagccggtaggtgttccgccccccgagaggggacgagtgagg

SEQ ID NO: 146617 - DNA, 75 bp, Artificial Sequence
  Synthetic
cgctaggatcgcgggggaaccggtggatccgtgggatgctcttcccgattctgtccactcccccctccagggggt

SEQ ID NO: 146618 - DNA, 75 bp, Artificial Sequence
  Synthetic
gcaacattccgaggggaccgtccctcggtaatggcgaatgggacccagaaatctctctagattcccagagagaat

SEQ ID NO: 146619 - DNA, 75 bp, Artificial Sequence
  Synthetic
agagtagatcctacgggaatccccgatctcccctcgtgtccagcccctccccggtccggtggaagggggactccg

SEQ ID NO: 146620 - DNA, 75 bp, Artificial Sequence
  Synthetic
agggattgtcatcctctagtttcttgatcttcttcttagtcttccggaggtccctctcgagttcctccaacttct

SEQ ID NO: 146621 - DNA, 75 bp, Artificial Sequence
  Synthetic
ttcttccactcacccactgctcgagaatctcttctcttccatcgcgcttcttcttcgattcggaccggctcatct

SEQ ID NO: 146622 - DNA, 75 bp, Artificial Sequence
  Synthetic
catgagccaaatgccgaacgaagagaacgcgagtggaggatcagaggacgagaggggatgagatggtaaagaaga

SEQ ID NO: 146623 - DNA, 75 bp, Artificial Sequence
  Synthetic
aacgcgagtggaggatcagaggacgagaggggatgagatggtaaagaagagaggatcgccgaggggacacctccc

SEQ ID NO: 146624 - DNA, 75 bp, Artificial Sequence
  Synthetic
aagagggcaaagagaaggcaagaatcggaggctctccctatgacgctggagacatcctggaaggggaaagaggaa

SEQ ID NO: 146625 - DNA, 75 bp, Artificial Sequence
  Synthetic
cggaggctctccctatgacgctggagacatcctggaaggggaaagaggaaggtggaagaaaaaggggcgggcccc

SEQ ID NO: 146626 - DNA, 75 bp, Artificial Sequence
  Synthetic
ccgatccgaggggtccgacggccaagtttgggaggcactccgggccgcagggttgagaagtcccagagggaggaa

SEQ ID NO: 146627 - DNA, 75 bp, Artificial Sequence
  Synthetic
gtttgggaggcactccgggccgcagggttgagaagtcccagagggaggaatccacgcggagataagcggagaaac

SEQ ID NO: 146628 - DNA, 75 bp, Artificial Sequence
  Synthetic
tcccggagcattcgacttatcgtccccacatagcagagccccggaccccctcagaaagtgaccgagggaggcgct

SEQ ID NO: 146629 - DNA, 75 bp, Artificial Sequence
  Synthetic
aggatcgcgggggcaccggtggagccatgggatgctccttccgattccgtccatccctcctcccagggggtcgcc

SEQ ID NO: 146630 - DNA, 75 bp, Artificial Sequence
  Synthetic
ttcactggggtcgacaactctgaggagaaaagggaggatcggatggaaagagtagatcctatgggaatccccggt

SEQ ID NO: 146631 - DNA, 75 bp, Artificial Sequence
  Synthetic
tacccctcgtgtccagcccgtccccggtccggctgaagggggactccgggaccccttgcatgttggggacgaagc

SEQ ID NO: 146632 - DNA, 75 bp, Artificial Sequence
  Synthetic
ctccatccttatccttctttccgagaattcctttgatgtttcccagccagggattttcgtcctcaagtttcttga

SEQ ID NO: 146633 - DNA, 75 bp, Artificial Sequence
  Synthetic
gcgcggcggaaggatcagctcccgagaggggtaaaacggtaaagagcattggaacgtcggaggcagccccctaag

SEQ ID NO: 146634 - DNA, 75 bp, Artificial Sequence
  Synthetic
aaggaaaaaagagaaaacaagagacggacgacttccccatgacgctggagacatcttggaaggggaaagaggtaa

SEQ ID NO: 146635 - DNA, 75 bp, Artificial Sequence
  Synthetic
ggacgacttccccatgacgctggagacatcttggaaggggaaagaggtaaggtggaaaaagaaggggtcggcctc

SEQ ID NO: 146636 - DNA, 75 bp, Artificial Sequence
  Synthetic
gaggaaagcaaagaaagcaacggggctagccggtgggtgttccgcctcccgagaggggacgagtgaggcttatcc

SEQ ID NO: 146637 - DNA, 75 bp, Artificial Sequence
  Synthetic
gagaggggacgagtgaggcttatcccggggaactcggcgaatcgtccccacatagcagactcccggggccccttc

SEQ ID NO: 146638 - DNA, 75 bp, Artificial Sequence
  Synthetic
caaaatgaccgaggggggtggctaggaacgcgggggaccagtggagccatgggatgctcctcccgatgtccgtcc

SEQ ID NO: 146639 - DNA, 75 bp, Artificial Sequence
  Synthetic
cgagaggcgggagttcctcagtactcttactcttttctgtaaagaggagactgctggactccccgcccaagttcg

SEQ ID NO: 146640 - DNA, 75 bp, Artificial Sequence
  Synthetic
cgagaggcgggtgttcctcagtactcttactcttttctgtaaagaggagactgctggactccccgcccaagttcg

SEQ ID NO: 146641 - DNA, 75 bp, Artificial Sequence
  Synthetic
cgagaggcgggcgttcctcagtactcttactcttttctgtaaagaggagactgctggactccccgcccaagttcg

SEQ ID NO: 146642 - DNA, 75 bp, Artificial Sequence
  Synthetic
cgagaggcgggggttcctcagtactcttactcttttctgtaaagaggagactgctggactccccgcccaagttcg

SEQ ID NO: 146643 - DNA, 75 bp, Artificial Sequence
  Synthetic
gatgggcctcagtgccgacgaggatccgcaagtgggaggatcagccaccggtgagggacgcgatgccaagagtgg

SEQ ID NO: 146644 - DNA, 75 bp, Artificial Sequence
  Synthetic
aggaaagttcggagggagatcccaagaatgtcactcgagattcaagcggtgaggggggatccccgagacgctggc

SEQ ID NO: 146645 - DNA, 75 bp, Artificial Sequence
  Synthetic
gaatgtcactcgagattcaagcggtgaggggggatccccgagacgctggcggaaccccgggaaaaaagaaaaaaa

SEQ ID NO: 146646 - DNA, 75 bp, Artificial Sequence
  Synthetic
ggagaacccacctccagaggaccccttcagcgaacagaagagctcctcctctgcgggagaggatccgtagcgatg

SEQ ID NO: 146647 - DNA, 75 bp, Artificial Sequence
  Synthetic
cgtttcccccatggaggcctccaggacccccgaaaagaggggggtgggccttggacccccagggagccatgggat

SEQ ID NO: 146648 - DNA, 75 bp, Artificial Sequence
  Synthetic
ttcgacgagaggcggggcggtcccgagaactcttatcttcctacttagaagaggagtctcctggacgccccccgc

SEQ ID NO: 146649 - DNA, 75 bp, Artificial Sequence
  Synthetic
cccccgatccgaaagtcccgatcccgatttccaaagtttgggagcactccggcccaaaggttgagagtacccaga

SEQ ID NO: 146650 - DNA, 75 bp, Artificial Sequence
  Synthetic
gggaggagatccactcggagaaagccctccagagggaggacccccttcagcgaacagaagagcgtcagacgcgtc

SEQ ID NO: 146651 - DNA, 75 bp, Artificial Sequence
  Synthetic
cctccagagggaggacccccttcagcgaacagaagagcgtcagacgcgtcaggagtaagagatagggggagatgc

SEQ ID NO: 146652 - DNA, 75 bp, Artificial Sequence
  Synthetic
cgagaggggacgagtgaggcttatcccggggaactcggctaatcgtccccacatagcagctccaggacccccttc

SEQ ID NO: 146653 - DNA, 75 bp, Artificial Sequence
  Synthetic
caaaaagactgaggggggagcttggagcgtgggggacccagtggaaccatgggatgcccttcccgattccgaacc

SEQ ID NO: 146654 - DNA, 75 bp, Artificial Sequence
  Synthetic
tatatcctatgggaatccccgggatcccctcacgtccagcccctccccagttctggtgaagggggactccgggat

SEQ ID NO: 146655 - DNA, 75 bp, Artificial Sequence
  Synthetic
ttctggtgaagggggactccgggatgccttgcatgctggggacgaagccgcccccgggcgctcccctcggtccac

SEQ ID NO: 146656 - DNA, 75 bp, Artificial Sequence
  Synthetic
atgggccaagttccgaacaaggatccgcggggaggacggatcacctcccgagaggggtaagtcggtaaagagcat

SEQ ID NO: 146657 - DNA, 75 bp, Artificial Sequence
  Synthetic
tggaacgtcggagatacaactcccaagaaggaaaaaagagaaagcaagaagcggaagaattccccataacgctag

SEQ ID NO: 146658 - DNA, 75 bp, Artificial Sequence
  Synthetic
tgaaactctaggaagggaaaagaggtgcgatggaaaaagaggaggtgggcctcccgatccgagggtcccggtggc

SEQ ID NO: 146659 - DNA, 75 bp, Artificial Sequence
  Synthetic
ccgggactccttgcatgctggggacgaagccgcccccgggcgctcccctcgatccaccttcgagggggttcacac

SEQ ID NO: 146660 - DNA, 75 bp, Artificial Sequence
  Synthetic
cccctctccatccttatccttctttccgattattcctttgatgtttcccagccagggattgtcttcctctagttt

SEQ ID NO: 146661 - DNA, 75 bp, Artificial Sequence
  Synthetic
tctttccttctttcggaccggctcatcttcgactagaggcgacggtcctcagtactcttactcttttctgtaaag

SEQ ID NO: 146662 - DNA, 75 bp, Artificial Sequence
  Synthetic
tcttcgactagaggcgacggtcctcagtactcttactcttttctgtaaagaggagactgctggccctgtcgccca

SEQ ID NO: 146663 - DNA, 75 bp, Artificial Sequence
  Synthetic
taggagccacgtgccgagagaagagatgcggtagggagaaggacctcccgaggggggttacctggttaagaagcg

SEQ ID NO: 146664 - DNA, 75 bp, Artificial Sequence
  Synthetic
atgcggtagggagaaggacctcccgaggggggttacctggttaagaagcgaggaaagtcgggagggttcccccaa

SEQ ID NO: 146665 - DNA, 75 bp, Artificial Sequence
  Synthetic
aggggggttacctggttaagaagcgaggaaagtcgggagggttcccccaagagggccaggagaactcaagaatcg

SEQ ID NO: 146666 - DNA, 75 bp, Artificial Sequence
  Synthetic
gatgagtctccctttgacgctggaagcgcatcttggaatgggaaccaaggaaggtggaaaaaggagggagcctcc

SEQ ID NO: 146667 - DNA, 75 bp, Artificial Sequence
  Synthetic
gcgcatcttggaatgggaaccaaggaaggtggaaaaaggagggagcctcccgatccgaatggtccggcgtccaga

SEQ ID NO: 146668 - DNA, 75 bp, Artificial Sequence
  Synthetic
atttggaaaacctccggaccgtaaggtagagttttccccagagggagagcatcacacggagttggacagagaaat

SEQ ID NO: 146669 - DNA, 75 bp, Artificial Sequence
  Synthetic
gtagagttttccccagagggagagcatcacacggagttggacagagaaatcacctccagaggaaaccccttcagc

SEQ ID NO: 146670 - DNA, 75 bp, Artificial Sequence
  Synthetic
tatcccggggaactcggcgaatcgtccccatctagcagagccccggacccccttccaaagagaccggagggggtg

SEQ ID NO: 146671 - DNA, 75 bp, Artificial Sequence
  Synthetic
ccccatctagcagagccccggacccccttccaaagagaccggagggggtgactaggaacaccggggacaggtcgg

SEQ ID NO: 146672 - DNA, 75 bp, Artificial Sequence
  Synthetic
gtccgtgggatgcttttcccgattccgtcccaacccttcccccgagaggtcaccccagcggatggcaggacccca

SEQ ID NO: 146673 - DNA, 75 bp, Artificial Sequence
  Synthetic
ctggggagaaaagggaggatcggatgggaagagtaaatcctacgggaatccgcctgttcccctgatgtccagtcc

SEQ ID NO: 146674 - DNA, 75 bp, Artificial Sequence
  Synthetic
ctccccagtccgagcgaagggggactccgggacaccttgcagactggggacgaagccgcccccgggcgctcccct

SEQ ID NO: 146675 - DNA, 75 bp, Artificial Sequence
  Synthetic
tccgattattcccttgatgtttcccagccagggattttcatcctcaagtttcttgatcttcttcctgaccttccg

SEQ ID NO: 146676 - DNA, 75 bp, Artificial Sequence
  Synthetic
gaggtccctctcgagctcctctgctctctttcttccagacacccactgctcgaggacctcttctctccctccgcg

SEQ ID NO: 146677 - DNA, 75 bp, Artificial Sequence
  Synthetic
ctctttcttccagacacccactgctcgaggacctcttctctccctccgcgttccttcttcttctcggaccggctc

SEQ ID NO: 146678 - DNA, 75 bp, Artificial Sequence
  Synthetic
atttcgacaaagggcgacggtcctcagtgctcttactcttttctgataaagaggagactggtggactcgtcgccc

SEQ ID NO: 146679 - DNA, 75 bp, Artificial Sequence
  Synthetic
catgggccaattgccgaacggagagagcgcgagaggaaggaagccgaccgagaggggatgaattggtaaagatga

SEQ ID NO: 146680 - DNA, 75 bp, Artificial Sequence
  Synthetic
agcgcgagaggaaggaagccgaccgagaggggatgaattggtaaagatgaggggaacgccgaggggacacctccc

SEQ ID NO: 146681 - DNA, 75 bp, Artificial Sequence
  Synthetic
gacatcctggaaggggaaagagacaggcggaagaaaaaggagcgggcctcccggtccgaggggcccgactgccaa

SEQ ID NO: 146682 - DNA, 75 bp, Artificial Sequence
  Synthetic
ccttccaaaaggaaccgaggggggagctaggagcgcgggggacccggtggagccatgggatgcccttcccgattc

SEQ ID NO: 146683 - DNA, 75 bp, Artificial Sequence
  Synthetic
tccctctcgagttcctctactttctttcttccattcacccactgctcgagggcgtcttctcttcccccgcgcctc

SEQ ID NO: 146684 - DNA, 75 bp, Artificial Sequence
  Synthetic
cggaggggacgcgatgccaaagagtgggggaaatctcgcgagggaaatcccaagaaggtcgagaatctcaagaga

SEQ ID NO: 146685 - DNA, 75 bp, Artificial Sequence
  Synthetic
ctatcaagtttggagtcatccgggccccagggtggaatataacaccggggggtgatccaccaggagatgaaacgg

SEQ ID NO: 146686 - DNA, 75 bp, Artificial Sequence
  Synthetic
ggcttatcccggggatcgggcgtcgcccccacatagcagaccccaggaccccttccgaacgagggggacggtcct

SEQ ID NO: 146687 - DNA, 75 bp, Artificial Sequence
  Synthetic
tcccctctccgagtgaagggagactccgggattccttgcatgctggggacgaacccgcctccgggcgctcccctc

SEQ ID NO: 146688 - DNA, 75 bp, Artificial Sequence
  Synthetic
tgggcgtacctacgggaatccctggtttcctctgatgtccagtccctcccccatccgagagaagggggactccgg

SEQ ID NO: 146689 - DNA, 75 bp, Artificial Sequence
  Synthetic
ccatccgagagaagggggactccggaacaccttccatccgagggacgaagccgccaccgggcgctcccctcggac

SEQ ID NO: 146690 - DNA, 75 bp, Artificial Sequence
  Synthetic
caggtcgaggcgagggtcctcagttctctctattctttccttcttgaaagaggagactgctggaccaaacgcccg

SEQ ID NO: 146691 - DNA, 75 bp, Artificial Sequence
  Synthetic
ggggagaatagaacaccggggggtgatccaccaggagaagtagcggagaacccacctccagaggaccccttcagc

SEQ ID NO: 146692 - DNA, 75 bp, Artificial Sequence
  Synthetic
gagtagagccgtagcgatggggggagatgctaggagttggaggagaccgaagcgaggaggaaagcaaagaaagca

SEQ ID NO: 146693 - DNA, 75 bp, Artificial Sequence
  Synthetic
ccccccgagggtcccgagtgaggcttatcccggggatcggcctccgcctcccccactggaggactccaggacccc

SEQ ID NO: 146694 - DNA, 75 bp, Artificial Sequence
  Synthetic
cctctcgagttcctcctttcttcttcttccatcgatccacttcccgagtgtctcttctctccccttccgggtttt

SEQ ID NO: 146695 - DNA, 75 bp, Artificial Sequence
  Synthetic
catgagccaattccgaacgggagggtcgcggcgggaaggatcagcttccgagaggggatgaatggcaaagagtat

SEQ ID NO: 146696 - DNA, 75 bp, Artificial Sequence
  Synthetic
agaggggatgaatggcaaagagtattggaacgccgaggggatgtctcccaagaaggaaaaaggagaagacaagaa

SEQ ID NO: 146697 - DNA, 75 bp, Artificial Sequence
  Synthetic
tcggaagctttccccataacgctggtaacgtcttggaaggggaaagggggaaggtggaaaagaaggggtgggcct

SEQ ID NO: 146698 - DNA, 75 bp, Artificial Sequence
  Synthetic
cccgatccgaggggcccagcgcccaggtttggaggcactccgggccgaagggttgagaatccccagagggaggaa

SEQ ID NO: 146699 - DNA, 75 bp, Artificial Sequence
  Synthetic
cttggatcgtgggggaccagtggagccatgggatgctcctcccgattccgtccatccccaccccccgagggtcgc

SEQ ID NO: 146700 - DNA, 75 bp, Artificial Sequence
  Synthetic
cccttctctcgtcttcctcggtcaacctcctgagttcctcttcttcctccttgctgaggttcttccctcccgccg

SEQ ID NO: 146701 - DNA, 75 bp, Artificial Sequence
  Synthetic
cccccggcggggccgagtgaggcttatcccggggatcggtgaatcgtcccgggatggggtctccgaggacccctt

SEQ ID NO: 146702 - DNA, 75 bp, Artificial Sequence
  Synthetic
cctctccttgtcggtgaacccgctcttgtgaggcctcttcccagtcccggagtcgatctccatctgatccgtccg

SEQ ID NO: 146703 - DNA, 75 bp, Artificial Sequence
  Synthetic
gtcttcctggccttccggaggtctttctcgagctcctccgcctttcttcttgttgtgatccatttctcgaggatg

SEQ ID NO: 146704 - DNA, 75 bp, Artificial Sequence
  Synthetic
catgagccatctccgagcgaagggaacgcgctggaaggatcagctcccgagaggggtaaacggtaaagagcattg

SEQ ID NO: 146705 - DNA, 75 bp, Artificial Sequence
  Synthetic
acgcgctggaaggatcagctcccgagaggggtaaacggtaaagagcattggaacgccgagagtgattctcccaag

SEQ ID NO: 146706 - DNA, 75 bp, Artificial Sequence
  Synthetic
gaggggtaaacggtaaagagcattggaacgccgagagtgattctcccaagaagagaaagagaaggcaagagacgg

SEQ ID NO: 146707 - DNA, 75 bp, Artificial Sequence
  Synthetic
agccggtgggtgttccaccccccgagaggggacgagtgaggcttatcccggggaactcggcgaatcgtccccaca

SEQ ID NO: 146708 - DNA, 75 bp, Artificial Sequence
  Synthetic
tagcagcccccggagccccttccaaaatgaccgaggggggtggctaggaacgcgggggaccagtggagccatggg

SEQ ID NO: 146709 - DNA, 75 bp, Artificial Sequence
  Synthetic
atgccatggaggcccaccagtttattaaggctcctggcattactactgccattgagcaggctgctctggctgcgg

SEQ ID NO: 146710 - DNA, 75 bp, Artificial Sequence
  Synthetic
taaggctcctggcattactactgccattgagcaggctgctctggctgcggctaactccgccttggcgaatgctgt

SEQ ID NO: 146711 - DNA, 75 bp, Artificial Sequence
  Synthetic
ctgtgaccttggaccaccgtcgggaaccccctcgtccgctggcgacgtctggatactcccaccgccctccgaggg

SEQ ID NO: 146712 - DNA, 75 bp, Artificial Sequence
  Synthetic
ggttaatgcatctaatccgggccaccgccctggtggcggtctctgtcatgccttctaccagcggttcccagagtc

SEQ ID NO: 146713 - DNA, 75 bp, Artificial Sequence
  Synthetic
tgtcgttcgatgcctcccgccagtctatgggggccgggtcccatagcctcacttacgagcttacacccgccggct

SEQ ID NO: 146714 - DNA, 75 bp, Artificial Sequence
  Synthetic
tgatgcaaccacggcaactggttttccgccctgaggtactttggaatcatcccattcagagagtcatacataatg

SEQ ID NO: 146715 - DNA, 75 bp, Artificial Sequence
  Synthetic
tttatacataccctgatggggccaaggtgtatgcaggctctctgtttgagtcagattgtgactggctggttaatg

SEQ ID NO: 146716 - DNA, 75 bp, Artificial Sequence
  Synthetic
cgggggaggtggcggctttttgcagcgccctctacaggtataacagattcacccagcggcattcgctgaccggcg

SEQ ID NO: 146717 - DNA, 75 bp, Artificial Sequence
  Synthetic
atcctaatgttctgcatcggtgttttcttagaccggttggcagggatgtccagcgctggtactctgccccaaccc

SEQ ID NO: 146718 - DNA, 75 bp, Artificial Sequence
  Synthetic
tcttagaccggttggcagggatgtccagcgctggtactctgccccaacccgtggccctgcggctaactgccgccg

SEQ ID NO: 146719 - DNA, 75 bp, Artificial Sequence
  Synthetic
cataaccctaagcggcttgaggccgcctatcgggagacatgttctcgccgggggacgactgcttaccccttactc

SEQ ID NO: 146720 - DNA, 75 bp, Artificial Sequence
  Synthetic
ggtgtatgcaggctctctgtttgagtcagattgtgactggctggttaatgcatctaatcctggccaccgccccgg

SEQ ID NO: 146721 - DNA, 75 bp, Artificial Sequence
  Synthetic
cctgggcacatttgggagtctgccaaccccttctgcggtgagggtaccttgtatactcgcacctggtctacatct

SEQ ID NO: 146722 - DNA, 75 bp, Artificial Sequence
  Synthetic
ctatatctgactgagccagccatagcttggtttgaggctaatcggcccactctccctgccctgactataaccgag

SEQ ID NO: 146723 - DNA, 75 bp, Artificial Sequence
  Synthetic
accccttctgcggtgagggtaccttgtatactcgcacctggtctacatctggtttttctagtgacttttcccctc

SEQ ID NO: 146724 - DNA, 75 bp, Artificial Sequence
  Synthetic
tctccctgccctgactataaccgaggatacggcccgtacagcgaatctagcgctcgagctggacgcagccacgga

SEQ ID NO: 146725 - DNA, 75 bp, Artificial Sequence
  Synthetic
ctgcatgacctctggccggccgatgttgcagaggctatggcccgccacgggatgacgcgtctatatgctgcactt

SEQ ID NO: 146726 - DNA, 75 bp, Artificial Sequence
  Synthetic
tttcgtgacctgagggtggcagcgttcaaaggggatgattcagtggtcctctgcagtgactaccgtcagagtcgt

SEQ ID NO: 146727 - DNA, 75 bp, Artificial Sequence
  Synthetic
gatttaccaggtccctgtaggcttaagcttcgacgcctgggagcgtaaccatcgcccaggcgatgagctttacct

SEQ ID NO: 146728 - DNA, 75 bp, Artificial Sequence
  Synthetic
tgttaccaccgctttcagaggagccccaggtgggtgcgccgcctgcacctcccacccccgagcctgctcggctgc

SEQ ID NO: 146729 - DNA, 75 bp, Artificial Sequence
  Synthetic
ccaggtgggtgcgccgcctgcacctcccacccccgagcctgctcggctgccctgccccactaaacctaacacccc

SEQ ID NO: 146730 - DNA, 75 bp, Artificial Sequence
  Synthetic
cagggggatgtagacgtgatagtggtgccaacccgtgagctgcgtaattcatggcgtcgccgcgggtttgcggcc

SEQ ID NO: 146731 - DNA, 75 bp, Artificial Sequence
  Synthetic
gatgacgcgtctatatgctgcacttcacctcccccctgaggtgctgttaccacctggtacctaccacacaacctc

SEQ ID NO: 146732 - DNA, 75 bp, Artificial Sequence
  Synthetic
catctgcttttgctgcatatgcagcgggcctcatcagttcacctcctcggtgaccccaatcaaatccctgccatt

SEQ ID NO: 146733 - DNA, 75 bp, Artificial Sequence
  Synthetic
cgcctatgccttatgttccttaccctcgttcgacggaagtgtatgtccgatctatatttggccctggcggttccc

SEQ ID NO: 146734 - DNA, 75 bp, Artificial Sequence
  Synthetic
tcgttcgacggaagtgtatgtccgatctatatttggccctggcggttccccatccttgtttccatcagcctgctc

SEQ ID NO: 146735 - DNA, 75 bp, Artificial Sequence
  Synthetic
ctgaatttattatgcgtgagggtcttgcagcatacaccttgaccccgcgccctattatccatgcagtggcccccg

SEQ ID NO: 146736 - DNA, 75 bp, Artificial Sequence
  Synthetic
cgttttcccgaggcgttctatccaactgaatttattatgcgtgagggtcttgcagcatacaccttgaccccgcgc

SEQ ID NO: 146737 - DNA, 75 bp, Artificial Sequence
  Synthetic
tacaaagtggtggcatcttacccatagatgcccggcggatgtttgtgagttaatccgcggcgcatacccgaagat

SEQ ID NO: 146738 - DNA, 75 bp, Artificial Sequence
  Synthetic
ccaggcgttctgttgctcgcggctcatgacatacctccgcggtattagctataaggtcaccgttggtgcgcttgt

SEQ ID NO: 146739 - DNA, 75 bp, Artificial Sequence
  Synthetic
tctttgttttggggggaaccccctgtgggtcagaagctggtatttactcaggcggcgaaggctgcaaaccctggt

SEQ ID NO: 146740 - DNA, 75 bp, Artificial Sequence
  Synthetic
tgggtcagaagctggtatttactcaggcggcgaaggctgcaaaccctggtgcgattaccgtccatgaagcccagg

SEQ ID NO: 146741 - DNA, 75 bp, Artificial Sequence
  Synthetic
gccctggcgatgagctttacctgactgaacccgctgcagcctggtttgaagctaataagccaacgcagccagcac

SEQ ID NO: 146742 - DNA, 75 bp, Artificial Sequence
  Synthetic
ggtggcatgtcacccaccgctgtcccgccgatgtttgtgagctcatacgcggggcttacccaaagattcagacga

SEQ ID NO: 146743 - DNA, 75 bp, Artificial Sequence
  Synthetic
cgccgatgtttgtgagctcatacgcggggcttacccaaagattcagacgaccagccgtgtgttgcgatctctatt

SEQ ID NO: 146744 - DNA, 75 bp, Artificial Sequence
  Synthetic
cgattgtggccctaacccgccacacggagaagtgcgtggtagtcgatgcgccgggactcctccgtgaggtgggca

SEQ ID NO: 146745 - DNA, 75 bp, Artificial Sequence
  Synthetic
cttgtgccggctgcactattagccccgggattgtgcattatcagttcactgccggggtcccaggctcaggcaaat

SEQ ID NO: 146746 - DNA, 75 bp, Artificial Sequence
  Synthetic
tgttcatgaggcccagggcgccacatttacggagaccaccatcatagccacagccgatgccagaggccttatcca

SEQ ID NO: 146747 - DNA, 75 bp, Artificial Sequence
  Synthetic
gtgatactattgaaaacaatgttgacacacttgatgccttcccgccctcttgtcagtttagtgcttatcatcagt

SEQ ID NO: 146748 - DNA, 75 bp, Artificial Sequence
  Synthetic
ccggctacccttataattataatactaccgccagtgaccagattttaattgagaatgcagctggtcaccgtgtat

SEQ ID NO: 146749 - DNA, 75 bp, Artificial Sequence
  Synthetic
actgcgtgaggtcggtatttctgacataattgttaacaactttttcctggctggtggtgaattgggccaccaccg

SEQ ID NO: 146750 - DNA, 75 bp, Artificial Sequence
  Synthetic
tactctatatgcctcaggaactgacaacatcggatagcgtgctcacttttgagctcacggacatagtgcactgtc

SEQ ID NO: 146751 - DNA, 75 bp, Artificial Sequence
  Synthetic
gctctcacactctttaatcttgctgacacgcttctcggtggtttgccgacagaattaatttcgtcggctggggga

SEQ ID NO: 146752 - DNA, 75 bp, Artificial Sequence
  Synthetic
gatgtgtcggggacctatgctgtccatgggcgccagcttgaggccctctatagggcactcaatataccgcatgat

SEQ ID NO: 146753 - DNA, 75 bp, Artificial Sequence
  Synthetic
aacatcggatagcgtgctcacttttgagctcacggacatagtgcactgtcgcatggcagcgcccagccagcgcaa

SEQ ID NO: 146754 - DNA, 75 bp, Artificial Sequence
  Synthetic
gagctcacggacatagtgcactgtcgcatggcagcgcccagccagcgcaaagcggtcctgtcaactctcgttggc

SEQ ID NO: 146755 - DNA, 75 bp, Artificial Sequence
  Synthetic
tagtgcctaccaccagctggctgaggagctgggccaccggccggccccagtggccgccgtcctgcccccctgccc

SEQ ID NO: 146756 - DNA, 75 bp, Artificial Sequence
  Synthetic
gtaaaacccgggagtactgatttattctacttgtaccttccttctgttctgttcttttatttttcttttctgcgt

SEQ ID NO: 146757 - DNA, 75 bp, Artificial Sequence
  Synthetic
tcccacatgatatagatctgggtgactcccgtgtggtcgtccaagactatgacaaccagcatgagcaggatcgac

SEQ ID NO: 146758 - DNA, 75 bp, Artificial Sequence
  Synthetic
cgacggtggttgatggcgcgcatcttgaagcgaacggccctgagcagtatgttctgtcgtttgacgcttcccagc

SEQ ID NO: 146759 - DNA, 75 bp, Artificial Sequence
  Synthetic
gaatgagccggctattggccagaagttggtcttcacgcaggccgctaaagctgccaaccctggtgcaattacggt

SEQ ID NO: 146760 - DNA, 75 bp, Artificial Sequence
  Synthetic
ggttctgcggttttggagcttgatttgtgtagccgtgatgtgtcccggataacattcttccagaaggattgtaat

SEQ ID NO: 146761 - DNA, 75 bp, Artificial Sequence
  Synthetic
tctgccttggcgaatgctgtggttattcggccgtttttgtcccgaacacagacagacatccttattaaccttatg

SEQ ID NO: 146762 - DNA, 75 bp, Artificial Sequence
  Synthetic
ccgccgagtacgaccagactacatatgggtcgtccaccaacccgatgtatgtctcggatactgtcacatttgtca

SEQ ID NO: 146763 - DNA, 75 bp, Artificial Sequence
  Synthetic
atggcttagattgtaccgccgtatttccccctggcggtgcccctagcgcagcgccgggggaggtagcggcttttt

SEQ ID NO: 146764 - DNA, 75 bp, Artificial Sequence
  Synthetic
tccccctggcggtgcccctagcgcagcgccgggggaggtagcggctttttgcagcgccctttacaggtacaacag

SEQ ID NO: 146765 - DNA, 75 bp, Artificial Sequence
  Synthetic
cagccccggcaactggtttttcgcccagaggtcttttggaatcatcctatccaacgtgttatacataatgagcta

SEQ ID NO: 146766 - DNA, 75 bp, Artificial Sequence
  Synthetic
ctactatccagcagtactccaaaacattttatgttctcccgcttcgcgggaagttatccttttgggaggccggga

SEQ ID NO: 146767 - DNA, 75 bp, Artificial Sequence
  Synthetic
cgtgctcgagcttgatctctgtagccgtgatgtctcgcgcattacattcttccagaaggactgtaataaattcac

SEQ ID NO: 146768 - DNA, 75 bp, Artificial Sequence
  Synthetic
ttctcctgggcacatttgggaatctgccaacccattttgtggagaaggaactttgtacactcgcacctggtccac

SEQ ID NO: 146769 - DNA, 75 bp, Artificial Sequence
  Synthetic
ctgcaaggtttttgagaatgatttttctgagtttgatagcacccaaaataatttttcgctcgggttagagtgtat

SEQ ID NO: 146770 - DNA, 75 bp, Artificial Sequence
  Synthetic
gaccggaaccttgacaccctacaggccttcccgccatcctgccaaattagtgcttaccatcagttggctgaggag

SEQ ID NO: 146771 - DNA, 75 bp, Artificial Sequence
  Synthetic
gccaacccattttgtggagaaggaactttgtacactcgcacctggtccacgtctggtttttccagtgacttttcc

SEQ ID NO: 146772 - DNA, 75 bp, Artificial Sequence
  Synthetic
aaggtgggccaaggcatatcggcttggagtaaaactttctgtgctttattcggcccgtggttccgtgccatagag

SEQ ID NO: 146773 - DNA, 75 bp, Artificial Sequence
  Synthetic
ggcctgttggtagagacgtccagcggtggtattccgcccccacccgtggccctgctgctaattgtcgccgctctg

SEQ ID NO: 146774 - DNA, 75 bp, Artificial Sequence
  Synthetic
ccacaggagcttacagtgtccgatagtgtgttggtttttgagctcactgacatagtccattgccgcatggctgcc

SEQ ID NO: 146775 - DNA, 75 bp, Artificial Sequence
  Synthetic
tgggtgttaccaccgccctcagaagagtctcaggttgatgcggctcctgcacctcctgcccccgagcccgttggg

SEQ ID NO: 146776 - DNA, 75 bp, Artificial Sequence
  Synthetic
atcgtgtagctatttccacgtacaccaccagcttgggcgcaggccctgtgtctgtttctgcagtcggtgttttag

SEQ ID NO: 146777 - DNA, 75 bp, Artificial Sequence
  Synthetic
cacgcctgtatgctgtactgcacctccctcctgaggttctgctgccacctggcacttaccacaccacctcctatc

SEQ ID NO: 146778 - DNA, 75 bp, Artificial Sequence
  Synthetic
cccccgtgcgtaagccaccggcatcgccgccttctcgcacccgccgtcttctttacacttaccctgacggcgcca

SEQ ID NO: 146779 - DNA, 75 bp, Artificial Sequence
  Synthetic
tgttgtgctttgtagtgattatcggcagagccgtgatgcagctgccttgattgctggttgtgggttgaagcttaa

SEQ ID NO: 146780 - DNA, 75 bp, Artificial Sequence
  Synthetic
attgctgagcttcagcgtcttaaaatgaagttaggtaaaacccgggagttttaatcaatttcctttgtgccccct

SEQ ID NO: 146781 - DNA, 75 bp, Artificial Sequence
  Synthetic
aagtgtattcggggtcactgtttgagtcggattgtgattggttagttaatgcctctaacccaggccaccgtcccg

SEQ ID NO: 146782 - DNA, 75 bp, Artificial Sequence
  Synthetic
ttgctggttgtgggttgaagcttaaggcggactttaggcctattgggttgtatgctggtgtggttgtggccccgg

SEQ ID NO: 146783 - DNA, 75 bp, Artificial Sequence
  Synthetic
gcctctaacccaggccaccgtcccgggggtggcctctgtcacgccttttaccaacgtttccctgaggcattttac

SEQ ID NO: 146784 - DNA, 75 bp, Artificial Sequence
  Synthetic
ggcacttaccacaccacctcctatcttttgattcatgacggtagtcgcgccgttgtaacttatgaaggtgacact

SEQ ID NO: 146785 - DNA, 75 bp, Artificial Sequence
  Synthetic
tgttatgagtttcgcgacctcaaagtcgcagcatttaagggggatgactctgttgtgctttgtagtgattatcgg

SEQ ID NO: 146786 - DNA, 75 bp, Artificial Sequence
  Synthetic
tgaagttaggtaaaacccgggagttttaatcaatttcctttgtgcccccttcatagctttgctttattttttctt

SEQ ID NO: 146787 - DNA, 75 bp, Artificial Sequence
  Synthetic
tggcgatcatagcacactgctatgaatttcgtgacctgagagtggcagcgttcaaaggggatgattcagtggtcc

SEQ ID NO: 146788 - DNA, 75 bp, Artificial Sequence
  Synthetic
gcgccctattattcatgcagtggctcccgattatagggttgagcagaacccaaagaggcttgaggcggcgtatcg

SEQ ID NO: 146789 - DNA, 75 bp, Artificial Sequence
  Synthetic
aatgtggctcaggtttgtgtggatgttgtttcgcaggtctatggtgttagccctggtttggtacataacctgatt

SEQ ID NO: 146790 - DNA, 75 bp, Artificial Sequence
  Synthetic
ttgtgattttctgcgaaagttaacgaatgtggctcaggtttgtgtggatgttgtttcgcaggtctatggtgttag

SEQ ID NO: 146791 - DNA, 75 bp, Artificial Sequence
  Synthetic
cccgattatagggttgagcagaacccaaagaggcttgaggcggcgtatcgggagacttgctcccgtcgcggcacc

SEQ ID NO: 146792 - DNA, 75 bp, Artificial Sequence
  Synthetic
gggatgcttcagactattgccgatggcaaggcacactttactgagacaattaagcctgttctcgacctcactagc

SEQ ID NO: 146793 - DNA, 75 bp, Artificial Sequence
  Synthetic
ggctcgcagcatacactttgaccccgcgccctattattcatgcagtggctcccgattatagggttgagcagaacc

SEQ ID NO: 146794 - DNA, 75 bp, Artificial Sequence
  Synthetic
tgctctcactgcagtaatcaccgcggcgtatctcaccatttgccatcagcgttacctccgcacccaggcgatctc

SEQ ID NO: 146795 - DNA, 75 bp, Artificial Sequence
  Synthetic
gttacctccgcacccaggcgatctctaaaggtatgcgccggcttgaggtcgagcacgcccagaagtttgttacca

SEQ ID NO: 146796 - DNA, 75 bp, Artificial Sequence
  Synthetic
aacctgggattgtgcactaccagtttactgccggggttccgggttcgggcaagtcaaggtccatacagcaggggg

SEQ ID NO: 146797 - DNA, 75 bp, Artificial Sequence
  Synthetic
acagaggttggaatgaataacatgttctgtgcatcgcccatgggatcgccatgcgccctagggctgttctgttgc

SEQ ID NO: 146798 - DNA, 75 bp, Artificial Sequence
  Synthetic
gtagtgattaccgacagagtcgtaacgcggcagccttaatcgcaggttgtgggctcaagttgaaggttgactatc

SEQ ID NO: 146799 - DNA, 75 bp, Artificial Sequence
  Synthetic
attgctactggcactaatcttgtgctatatgctgccccacttagccccctgctaccgcttcaggatggcactaac

SEQ ID NO: 146800 - DNA, 75 bp, Artificial Sequence
  Synthetic
gctgctgctcaccgcagcccctgagccgtcacctatgccttatgtcccctaccctcgttcaactgaggtgtatgt

SEQ ID NO: 146801 - DNA, 75 bp, Artificial Sequence
  Synthetic
tggtggcatgtcacacaccgttgcccggccgatgtctgtgaactcatacgcggggcttaccctaaaatccagacc

SEQ ID NO: 146802 - DNA, 75 bp, Artificial Sequence
  Synthetic
cggttgttggtagatctatataaagcactcaacgttccgcaagagatagcagcccgggccgtccgtttgtcggct

SEQ ID NO: 146803 - DNA, 75 bp, Artificial Sequence
  Synthetic
cggggcttaccctaaaatccagaccacgagtcgtgtgctacggtctctgttctggaatgagcctgctactggcca

SEQ ID NO: 146804 - DNA, 75 bp, Artificial Sequence
  Synthetic
ttggtgccgaacgctgtcggcgggtacgctatatctatctccttctggccccagacaacgactaccccaacgtcc

SEQ ID NO: 146805 - DNA, 75 bp, Artificial Sequence
  Synthetic
ccagacaacgactaccccaacgtccgttgatatgaattccattacttccactgatgttcgcattcttgtccagcc

SEQ ID NO: 146806 - DNA, 75 bp, Artificial Sequence
  Synthetic
acggctgatgccagaggccttatccagtcatcccgagcccatgctatagttgcacttacccgccacacagagaag

SEQ ID NO: 146807 - DNA, 75 bp, Artificial Sequence
  Synthetic
cgcttaatcccctcctgcctctccaagatggcaccaatactcacattatggcgactgaggcttccaattacgccc

SEQ ID NO: 146808 - DNA, 75 bp, Artificial Sequence
  Synthetic
caaatggtcctgagcagtatgttctttcatttgatgaagtccgccaatgtatgggtgccgggccgcatagtcttg

SEQ ID NO: 146809 - DNA, 75 bp, Artificial Sequence
  Synthetic
gcggtgccggcggtggtttctggggtgacagggttgattctcagcccttcgccctcccctatattcatccaacca

SEQ ID NO: 146810 - DNA, 75 bp, Artificial Sequence
  Synthetic
ccggaaaggccccgggtgttgaggctgcagaggttactgccttctgcagcgccttgtacagatataacagaacca

SEQ ID NO: 146811 - DNA, 75 bp, Artificial Sequence
  Synthetic
gtccctctgtgatcccccgtggtaaccctgatcagaacctcgagactctacacgccttcccgccgtcctgtcaga

SEQ ID NO: 146812 - DNA, 75 bp, Artificial Sequence
  Synthetic
cttggcttacttgactttgcactcgagctcgagttccgcaatctgacacctggtaacactaacacgcgtgtttct

SEQ ID NO: 146813 - DNA, 75 bp, Artificial Sequence
  Synthetic
atttgagaaatctggccgtgattatattcccggccgccagcttcagttctatgcacaatgccggcggtggctatc

SEQ ID NO: 146814 - DNA, 75 bp, Artificial Sequence
  Synthetic
tgcagaggttactgccttctgcagcgccttgtacagatataacagaaccattcaacggcactcggttgttggcgg

SEQ ID NO: 146815 - DNA, 75 bp, Artificial Sequence
  Synthetic
agtataatctgtccacgtccccgcttacgtcatctgtcgcctcgggtactaatttggttctctatgccgccccat

SEQ ID NO: 146816 - DNA, 75 bp, Artificial Sequence
  Synthetic
cccgttttgcggtgaaggaaccctctacaccagaacctggtctgagtccggcttctccagtgattttctaccacc

SEQ ID NO: 146817 - DNA, 75 bp, Artificial Sequence
  Synthetic
ctgttaattcctataccaacacgccctataccggggcattggggcttcttgattttgcactcgagcttgaattta

SEQ ID NO: 146818 - DNA, 75 bp, Artificial Sequence
  Synthetic
accgaggcatctaattatgcccagtaccgggtggttcgagctacaatccgttatcgcccgttggtaccaaatgct

SEQ ID NO: 146819 - DNA, 75 bp, Artificial Sequence
  Synthetic
cccgttatcccctcatgtggttcccggggctgttggtccacccgctggcacccccgggtcctctgttcataagcc

SEQ ID NO: 146820 - DNA, 75 bp, Artificial Sequence
  Synthetic
gtccatgggcaccagcttgaggccctttatagagcacttaatgtcccacatgatattgccgctcgagcctcccgg

SEQ ID NO: 146821 - DNA, 75 bp, Artificial Sequence
  Synthetic
gacccgtccaggccaccacatgtgagctatatgaattggttgaggctatggtagagaagggccaggacggctctg

SEQ ID NO: 146822 - DNA, 75 bp, Artificial Sequence
  Synthetic
ggttattcaggattatgacaaccagcatgagcaggatcgtcctaccccctcccctgctccctctcgtcctttctc

SEQ ID NO: 146823 - DNA, 75 bp, Artificial Sequence
  Synthetic
tatagccctaacgctatttaatcttgctgatacacttctcggcgggctgccgacagaattgatttcgtcggctgg

SEQ ID NO: 146824 - DNA, 75 bp, Artificial Sequence
  Synthetic
cattatcgtaatcaaggctggcgctctgtcgagaccacgggtgtcgccgaggaggaggctacctctggcctggta

SEQ ID NO: 146825 - DNA, 75 bp, Artificial Sequence
  Synthetic
cgacagaattgatttcgtcggctggaggtcaactgttctactcccgcccggttgtctcagccaatggcgagccga

SEQ ID NO: 146826 - DNA, 75 bp, Artificial Sequence
  Synthetic
tactaatcctatgtatgtttctgatactgtaacatttgttaacgtggcgactggtgcccagggggtttcgcgctc

SEQ ID NO: 146827 - DNA, 75 bp, Artificial Sequence
  Synthetic
ctggtgcccagggggtttcgcgctctctggactggtccaaggtcactcttgatggtcgcccgctcactaccatcc

SEQ ID NO: 146828 - DNA, 75 bp, Artificial Sequence
  Synthetic
aaaggaaatactggccctgctcccccctaacatcttttatggtgatgcctatgaggagtcagtgtttgctgccgc

SEQ ID NO: 146829 - DNA, 75 bp, Artificial Sequence
  Synthetic
tctggactggtccaaggtcactcttgatggtcgcccgctcactaccatccagcagtattctaagactttttatgt

SEQ ID NO: 146830 - DNA, 75 bp, Artificial Sequence
  Synthetic
gcccgccaccggctgcgccgtggtgccgacgggaccgctgagcttaccactacggcggccacgcgttttatgaag

SEQ ID NO: 146831 - DNA, 75 bp, Artificial Sequence
  Synthetic
cactgctagtgaccagaccctgattgagaatgcagctggccaccgggtttgcatctctacttacactactaatct

SEQ ID NO: 146832 - DNA, 75 bp, Artificial Sequence
  Synthetic
gggctctgggcccgtgtctatttctgctgttggtgtccttgctcctcactctgcgctggcagctttggaggatac

SEQ ID NO: 146833 - DNA, 75 bp, Artificial Sequence
  Synthetic
cgtagcaggtgctggcctctcaccgggggccgaaaccggcccggtactgcccgccctaaccataacagaggacat

SEQ ID NO: 146834 - DNA, 75 bp, Artificial Sequence
  Synthetic
ccgccctaaccataacagaggacatagcccggacggctaaccttgcattggaaattgattctaggaccgagctcg

SEQ ID NO: 146835 - DNA, 75 bp, Artificial Sequence
  Synthetic
attctcgtgtggtcatccaggactatgataaccagcacgagcaggaccgacctaccccctcacccgccccctctc

SEQ ID NO: 146836 - DNA, 75 bp, Artificial Sequence
  Synthetic
ataattataataccactgctagtgaccaaatcttgatcgagaatgcagccggtcatcgtgttgccatatctacct

SEQ ID NO: 146837 - DNA, 75 bp, Artificial Sequence
  Synthetic
tctgtttgtgcctcccttctgctatgtttccttttatttttcttttctgcgttccgcgctccctggaagaaaaaa

SEQ ID NO: 146838 - DNA, 75 bp, Artificial Sequence
  Synthetic
cccggttgtatgcggctctccacctccctcctgaggtgctgctcccccctggtacttatcataccacctcgtacc

SEQ ID NO: 146839 - DNA, 75 bp, Artificial Sequence
  Synthetic
cgcaggtctgtgttgatgttgtgtcccgtgtttatggagtcagccccgggttggtacataaccttattggcatgc

SEQ ID NO: 146840 - DNA, 75 bp, Artificial Sequence
  Synthetic
ttggtacataaccttattggcatgctgcagactattgccgatggcaaggcccactttacagagactattaaacct

SEQ ID NO: 146841 - DNA, 75 bp, Artificial Sequence
  Synthetic
aaagttgtctttttgggaggctggcacgaccaaggctggttatccttataattataatacaactgctagtgatca

SEQ ID NO: 146842 - DNA, 75 bp, Artificial Sequence
  Synthetic
agtcttaattaattcccctttgtgcccccttctaaacttttctctgttgtttctttcttctgcgtttcgcgctcc

SEQ ID NO: 146843 - DNA, 75 bp, Artificial Sequence
  Synthetic
tacagcgggtggaatgaataacatgtcttgtgcatcgcccatgggatcaccatgcgccctagggctgttctgttg

SEQ ID NO: 146844 - DNA, 75 bp, Artificial Sequence
  Synthetic
ctaccagcctgggcgccggccccacttctatctctgcggtcggtgtgttagccccgcactcagcccttgctgttc

SEQ ID NO: 146845 - DNA, 75 bp, Artificial Sequence
  Synthetic
cactgttcatgaggcccagggagctactttcactgagaccactattatcgcgacggctgatgctagaggcctcat

SEQ ID NO: 146846 - DNA, 75 bp, Artificial Sequence
  Synthetic
tgcagggctgcgctttccagtctactattgctgagcttcagcgccttaaaatgaaggtaggtaaaacccgggagt

SEQ ID NO: 146847 - DNA, 75 bp, Artificial Sequence
  Synthetic
ttggtactctgcccctacccgtggccctgctgcaaattgccgccgttctgcactacgtggtctttcccctgtcga

SEQ ID NO: 146848 - DNA, 75 bp, Artificial Sequence
  Synthetic
ttggtactctgcccctacccgtggccctgctgctaattgccgccgttctgcactacgtggtctttcccctgtcga

SEQ ID NO: 146849 - DNA, 75 bp, Artificial Sequence
  Synthetic
ttggtactctgcccctacccgtggccctgctgccaattgccgccgttctgcactacgtggtctttcccctgtcga

SEQ ID NO: 146850 - DNA, 75 bp, Artificial Sequence
  Synthetic
ttggtactctgcccctacccgtggccctgctgcgaattgccgccgttctgcactacgtggtctttcccctgtcga

SEQ ID NO: 146851 - DNA, 75 bp, Artificial Sequence
  Synthetic
ttaattcgtcctgtacccccttcgtagttttcttttgctttatttctcttttctgctttccgcgctccctggaaa

SEQ ID NO: 146852 - DNA, 75 bp, Artificial Sequence
  Synthetic
gattagcgccttccaccagctggccgaggagcttggtcatcggcccgcgcccgtggcagctgtcctaccaccctg

SEQ ID NO: 146853 - DNA, 75 bp, Artificial Sequence
  Synthetic
cgcttacgtcatccgttgcctcgggtactaatctggttctttatgctgccccgttgaatcctcttttaccacttc

SEQ ID NO: 146854 - DNA, 75 bp, Artificial Sequence
  Synthetic
tactaatctggttctttatgctgccccgttgaatcctcttttaccacttcaggatggtaccaacactcatattat

SEQ ID NO: 146855 - DNA, 75 bp, Artificial Sequence
  Synthetic
tgttgtgacttacgagggtgatactagtgcaggctataaccatgacgtctcaatactccgtgcgtggatccgcac

SEQ ID NO: 146856 - DNA, 75 bp, Artificial Sequence
  Synthetic
cgctgttggtggttatgctatttctatctctttctggccccaaacaaccaccacccctacttctgttgatatgaa

SEQ ID NO: 146857 - DNA, 75 bp, Artificial Sequence
  Synthetic
cgggcgccggacgaagttatatgaggctgcccactcggacgtgcgcgaatcactcacaaggttcatccccatcat

SEQ ID NO: 146858 - DNA, 75 bp, Artificial Sequence
  Synthetic
tcctctccacgctcgttgggcgctacgggcgccggacgaagttatatgaggctgcccactcggacgtgcgcgaat

SEQ ID NO: 146859 - DNA, 75 bp, Artificial Sequence
  Synthetic
cgacggaggtgtatgttcgatccatatttggcccaggcggctccccgtctttgttcccatcagcttgctccacta

SEQ ID NO: 146860 - DNA, 75 bp, Artificial Sequence
  Synthetic
gagctttatgagctggtcgaggcgatggtggagaaaggtcaggatgggtcagctgtgctcgagcttgatctctgt

SEQ ID NO: 146861 - DNA, 75 bp, Artificial Sequence
  Synthetic
gctgctaatcctggtgcgatcacggttcatgaagctcagggtgccaccttcacggagaccacaattatagccacg

SEQ ID NO: 146862 - DNA, 75 bp, Artificial Sequence
  Synthetic
cgagacaggcatcgccctctactcccttcacgatatgtcaccatccgacgttgccgaggccatgttccgccatgg

SEQ ID NO: 146863 - DNA, 75 bp, Artificial Sequence
  Synthetic
ggtgatgctttgcattcatggctctcctgttaattcttatactaatacaccttacactggtgcacttgggcttct

SEQ ID NO: 146864 - DNA, 75 bp, Artificial Sequence
  Synthetic
cacaactggggagacgattgcccacggcaaagtcggtcagggaatatcagcctggagcaaaaccttttgtgcttt

SEQ ID NO: 146865 - DNA, 75 bp, Artificial Sequence
  Synthetic
ggcaaagtcggtcagggaatatcagcctggagcaaaaccttttgtgctttatttggcccctggttccgggccata

SEQ ID NO: 146866 - DNA, 75 bp, Artificial Sequence
  Synthetic
tgcgcgaggtcggtatttcggatgtgattgttaacaactttttccttgctggtggagaggtcggccaccaccgcc

SEQ ID NO: 146867 - DNA, 75 bp, Artificial Sequence
  Synthetic
tacagcccgccaccggctgcgtcgtggcgctgatgggacagctgagcttaccaccacggctgccacacgtttcat

SEQ ID NO: 146868 - DNA, 75 bp, Artificial Sequence
  Synthetic
gctacctccgcacccaggcgatatccaagggtatgcgccggctggaggttgagcatgcccagaaatttatcacaa

SEQ ID NO: 146869 - DNA, 75 bp, Artificial Sequence
  Synthetic
caagggtatgcgccggctggaggttgagcatgcccagaaatttatcacaagactttacagctggttgtttgagaa

SEQ ID NO: 146870 - DNA, 75 bp, Artificial Sequence
  Synthetic
ctgtgattttctgcgaaagttaacgaatgtggctcaggtctgtgtggatgttgtttcgcaggtttatggtgtcag

SEQ ID NO: 146871 - DNA, 75 bp, Artificial Sequence
  Synthetic
atttgatagcacccagaataacttctcacttggccttgaatgtgtgattatggaagaatgtggcatgccccaatg

SEQ ID NO: 146872 - DNA, 75 bp, Artificial Sequence
  Synthetic
cacctatgccttatgtcccttacccccggtctaccgaggtctacgtccgatcgattttcggcccgggtggtactc

SEQ ID NO: 146873 - DNA, 75 bp, Artificial Sequence
  Synthetic
tcacttggccttgaatgtgtgattatggaagaatgtggcatgccccaatggctagttagattgtatcacctggtg

SEQ ID NO: 146874 - DNA, 75 bp, Artificial Sequence
  Synthetic
gtaggactttcctaaagaaggtcgcgggcaaattctgttgctttatgcggtggttgggacaggagtgcacctgct

SEQ ID NO: 146875 - DNA, 75 bp, Artificial Sequence
  Synthetic
tctcgtcctttttcagtccttcgtgctaatgatgttttgtggctctctcttactgctgccgagtatgatcagact

SEQ ID NO: 146876 - DNA, 75 bp, Artificial Sequence
  Synthetic
aggccgaacctgcacatctagacgtgtcggggacctatgcggtccatgggcgccagctcgaagccctttataggg

SEQ ID NO: 146877 - DNA, 75 bp, Artificial Sequence
  Synthetic
gtcggggacctatgcggtccatgggcgccagctcgaagccctttatagggcactcaacatcccgcacgatattgc

SEQ ID NO: 146878 - DNA, 75 bp, Artificial Sequence
  Synthetic
ggcagacccctaatggagacacatcagtatgtctcagccacaggggtcaacacagcccgtgaggcccaagccacg

SEQ ID NO: 146879 - DNA, 75 bp, Artificial Sequence
  Synthetic
cacagcccgtgaggcccaagccacggcggcagcggctaccgcctttgctaatgctcaggtcgtacgcccattcgt

SEQ ID NO: 146880 - DNA, 75 bp, Artificial Sequence
  Synthetic
cgggaataagactttccggacgacgatagttgatggtgcccaccttgaggtgaatggccctgagcaatgcgtttt

SEQ ID NO: 146881 - DNA, 75 bp, Artificial Sequence
  Synthetic
gcggcagcggctaccgcctttgctaatgctcaggtcgtacgcccattcgtgtcgcattctcaggcctcgcttctt

SEQ ID NO: 146882 - DNA, 75 bp, Artificial Sequence
  Synthetic
gtggtaagctgtccttctgggaggctggcacgaccaaggctggctatccttacaattacaatacaactgctagtg

SEQ ID NO: 146883 - DNA, 75 bp, Artificial Sequence
  Synthetic
atgggggccgggtcgcatagcctcacttatgaactcacgcccgctggtttgcaggttaggatttcatctaatggc

SEQ ID NO: 146884 - DNA, 75 bp, Artificial Sequence
  Synthetic
atcaaatcttaattgagaacgcagctggtcaccgtgttgctatttctacctacaccaccagccttggtgctggtc

SEQ ID NO: 146885 - DNA, 75 bp, Artificial Sequence
  Synthetic
catgattttctggagacgtacgtccgccggaaggctggcgtttgcctggaggttggtgcgcatcctagatctatt

SEQ ID NO: 146886 - DNA, 75 bp, Artificial Sequence
  Synthetic
gccggaaggctggcgtttgcctggaggttggtgcgcatcctagatctattaatgataaccccggagtctcacacc

SEQ ID NO: 146887 - DNA, 75 bp, Artificial Sequence
  Synthetic
cccagcggcattcgttgaccggcggtttgtggctacatcctgaggggttgctgggcattttcccccctttctccc

SEQ ID NO: 146888 - DNA, 75 bp, Artificial Sequence
  Synthetic
ttaggttgtaccatctggttcggtcagcctggattttgcaggcgccgaaggagtcccttaagggtttttggaaga

SEQ ID NO: 146889 - DNA, 75 bp, Artificial Sequence
  Synthetic
ctgggcattttcccccctttctcccctgggcacatttgggagtccgctaaccccttctgtggggaaggcaccttg

SEQ ID NO: 146890 - DNA, 75 bp, Artificial Sequence
  Synthetic
tcaggcgttgcattctcacagggcgcccggcttctgatttgtccttttgtacgaggggattcacacggtgtcgcc

SEQ ID NO: 146891 - DNA, 75 bp, Artificial Sequence
  Synthetic
cccggcttctgatttgtccttttgtacgaggggattcacacggtgtcgccaccatgcgccggtggggattgccct

SEQ ID NO: 146892 - DNA, 75 bp, Artificial Sequence
  Synthetic
taaaatgaaggtaggtaaaacccgggagtcttaattaattcttcctgtacccccttcgtggttttctttgcttta

SEQ ID NO: 146893 - DNA, 75 bp, Artificial Sequence
  Synthetic
ctgggcacatttgggagtccgctaaccccttctgtggggaaggcaccttgtacactcgcacctggtccacatccg

SEQ ID NO: 146894 - DNA, 75 bp, Artificial Sequence
  Synthetic
ccccaccagtcagtgatatttgggtgtcaccaccgccctcagaagagtcccagattgatgcggcgctcgcacctc

SEQ ID NO: 146895 - DNA, 75 bp, Artificial Sequence
  Synthetic
tgtgatgcacttacctgctgaggcgctgttacccgacggggtttacaccacgaaggcctatgtcgcacgcaactt

SEQ ID NO: 146896 - DNA, 75 bp, Artificial Sequence
  Synthetic
ctgttacccgacggggtttacaccacgaaggcctatgtcgcacgcaacttacagggccgcctcattgtcacctac

SEQ ID NO: 146897 - DNA, 75 bp, Artificial Sequence
  Synthetic
ccgcccccgagcctgttgggttgcccagccctactgaacctcccccccccgtgcgtaagccaccggcattgccac

SEQ ID NO: 146898 - DNA, 75 bp, Artificial Sequence
  Synthetic
cgtcgatctaccccagctggggctgcgccgctgactgccgtttcacccgcacctgatacggcgcctgtccctgat

SEQ ID NO: 146899 - DNA, 75 bp, Artificial Sequence
  Synthetic
ggctgttgttctttagtggtggagagggttcggagcgtgggttgccattttgttttaaggttgaccactgttgcc

SEQ ID NO: 146900 - DNA, 75 bp, Artificial Sequence
  Synthetic
ggtactaatcttgttttgtatgctgcgccgcttaaccccctcctgcccctccaggatggcactaatactcatatc

SEQ ID NO: 146901 - DNA, 75 bp, Artificial Sequence
  Synthetic
gggttcggagcgtgggttgccattttgttttaaggttgaccactgttgccaccccttgcccgatgccctacacac

SEQ ID NO: 146902 - DNA, 75 bp, Artificial Sequence
  Synthetic
tgtttcttgaaacctgtcggccgcgatgttcagcggtggtacaccgcccccactcgtggccccgcagcaaactgc

SEQ ID NO: 146903 - DNA, 75 bp, Artificial Sequence
  Synthetic
cgccgcttaaccccctcctgcccctccaggatggcactaatactcatatcatggccactgaggcatccaactacg

SEQ ID NO: 146904 - DNA, 75 bp, Artificial Sequence
  Synthetic
cggcctgatttaggttttatgtctgagccttctatacctagtagggccgccacacctatccccgcggcccctcta

SEQ ID NO: 146905 - DNA, 75 bp, Artificial Sequence
  Synthetic
cattgtcctgcaagtctcgatccacatttcatagtgtcccttcagacatctgggacaggttgatgttatttggtg

SEQ ID NO: 146906 - DNA, 75 bp, Artificial Sequence
  Synthetic
ctatttctttttggccccagactactactacccctacctctgtcgatatgaactcaatcacttcaactgatgtta

SEQ ID NO: 146907 - DNA, 75 bp, Artificial Sequence
  Synthetic
atttcatagtgtcccttcagacatctgggacaggttgatgttatttggtgccacgcttgatgatgatgcattctg

SEQ ID NO: 146908 - DNA, 75 bp, Artificial Sequence
  Synthetic
tactacccctacctctgtcgatatgaactcaatcacttcaactgatgttaggattcttgtccagcccggcctagc

SEQ ID NO: 146909 - DNA, 75 bp, Artificial Sequence
  Synthetic
cctgctcccgccgtggtactgccgcctatccacttcttggctcaggtatatatcaggtccccgctggccttagtt

SEQ ID NO: 146910 - DNA, 75 bp, Artificial Sequence
  Synthetic
ggggccccggccataacccaccagacggcccggcaccgccgcctgctctttacctacccggatggctctaaggta

SEQ ID NO: 146911 - DNA, 75 bp, Artificial Sequence
  Synthetic
ctggacaacagatgaatatgcattgactgccaccgtggtagcatcctatctgacgatctgtcaccagcgttggat

SEQ ID NO: 146912 - DNA, 75 bp, Artificial Sequence
  Synthetic
ggctgaggaggaggccacttccgggcttgtcatgctttgtatccacggttcccccgttaactcatacactaatac

SEQ ID NO: 146913 - DNA, 75 bp, Artificial Sequence
  Synthetic
gctcccccctggcacctatcataccacttcgtaccttctcatccatgatggggaccgtgcagtgattacatatga

SEQ ID NO: 146914 - DNA, 75 bp, Artificial Sequence
  Synthetic
cacaacccggggctggagctcgccctcgacagccgccccgcccccttggctccgcttggcgtgaccagtcccagc

SEQ ID NO: 146915 - DNA, 75 bp, Artificial Sequence
  Synthetic
cccccgttaactcatacactaataccccctatactggggctttgggccttcttgattttgcgcttgagattgaat

SEQ ID NO: 146916 - DNA, 75 bp, Artificial Sequence
  Synthetic
actgccaccgtggtagcatcctatctgacgatctgtcaccagcgttggattcgaacacaaggtatttctatgggc

SEQ ID NO: 146917 - DNA, 75 bp, Artificial Sequence
  Synthetic
cgaccacccgctggtaattgagcgggtccgggcggtgggctgtcactttgtgcttcttctcacagctgcacctga

SEQ ID NO: 146918 - DNA, 75 bp, Artificial Sequence
  Synthetic
ggcagtaaggagagctttatccccggacgacagctgcagttttataaacagtgtcagaactgggtttcggcaggt

SEQ ID NO: 146919 - DNA, 75 bp, Artificial Sequence
  Synthetic
gccgcgtacacattaaccccccggccaataattcatgctgtcgcccctgattataggttggaacataacccaaag

SEQ ID NO: 146920 - DNA, 75 bp, Artificial Sequence
  Synthetic
ctcttttgtgatgcgcgacggcgcggccgcgtacacattaaccccccggccaataattcatgctgtcgcccctga

SEQ ID NO: 146921 - DNA, 75 bp, Artificial Sequence
  Synthetic
gacgacagctgcagttttataaacagtgtcagaactgggtttcggcaggtttttacttagatgtgagagagatgt

SEQ ID NO: 146922 - DNA, 75 bp, Artificial Sequence
  Synthetic
ggaagtttggtcagacttgcgggtgtttcatgggtgatgttgtcgccgggatcgaagattcagttgaggatttga

SEQ ID NO: 146923 - DNA, 75 bp, Artificial Sequence
  Synthetic
tttcatgggtgatgttgtcgccgggatcgaagattcagttgaggatttgacggccgacctgtgcccgactgatgc

SEQ ID NO: 146924 - DNA, 75 bp, Artificial Sequence
  Synthetic
cactgaggcatctaattatgcccagtatcgggttgttcgagctacgatccgttatcgcccgttggtgccgaacgc

SEQ ID NO: 146925 - DNA, 75 bp, Artificial Sequence
  Synthetic
tagttacaaagtcacagttggcgctcttgtcgccaacgagggctggaatgcctccgaagacgcattaactgctgt

SEQ ID NO: 146926 - DNA, 75 bp, Artificial Sequence
  Synthetic
gctggcctggtccccgcaatccgccctgagcttgcaccaacgagttggtggcatgttacacatcgctgtccggcc

SEQ ID NO: 146927 - DNA, 75 bp, Artificial Sequence
  Synthetic
cctagctagacagcgcggcagtaggctggccaactacccaaggattgacctcgctttcttactatgccctatagg

SEQ ID NO: 146928 - DNA, 75 bp, Artificial Sequence
  Synthetic
cattacttccactgatgttaggattttggttcagcccggtattgcctccgagttagtcatccctagtgagcgcct

SEQ ID NO: 146929 - DNA, 75 bp, Artificial Sequence
  Synthetic
ctggccaactacccaaggattgacctcgctttcttactatgccctataggctgttttttctctggccgtccgtca

SEQ ID NO: 146930 - DNA, 75 bp, Artificial Sequence
  Synthetic
attggagcttgagcatgcacagaagtttataacacgtctttatagctggttgtttgaaaaatctggccgtgatta

SEQ ID NO: 146931 - DNA, 75 bp, Artificial Sequence
  Synthetic
tcgtgtgctacggtctctgttctggaatgagccggctatcggtcagaggttggtcttcacgcaggctgctaaagc

SEQ ID NO: 146932 - DNA, 75 bp, Artificial Sequence
  Synthetic
agcccatcggtcgaggaggaagtctgtgtcgagccccagctttatcgtggtcataaaccgggctcgccagggttt

SEQ ID NO: 146933 - DNA, 75 bp, Artificial Sequence
  Synthetic
gtgtcgagccccagctttatcgtggtcataaaccgggctcgccagggttttggcgagactatacgcctagcatca

SEQ ID NO: 146934 - DNA, 75 bp, Artificial Sequence
  Synthetic
tgtgctcgtttttgatgaagcggccccttgccgctgtcgtagcttgcttcgcaaagctgcccataaattttgctg

SEQ ID NO: 146935 - DNA, 75 bp, Artificial Sequence
  Synthetic
gccgggttgtcattgatgaggctccgtccctccctcctcacctgctgctgctccacatgcagcgggccgccaccg

SEQ ID NO: 146936 - DNA, 75 bp, Artificial Sequence
  Synthetic
ggctaaagtaactctggatgggcggccgctcactaccatccagcagcattccaaattattttatgtcctccccct

SEQ ID NO: 146937 - DNA, 75 bp, Artificial Sequence
  Synthetic
ccgctcactaccatccagcagcattccaaattattttatgtcctccccctccgtggtaagctttccttttgggag

SEQ ID NO: 146938 - DNA, 75 bp, Artificial Sequence
  Synthetic
agcccgtcaccggctgcgacgcggtgctgatgggactgctgagctcaccaccacagcagccacacgttttatgaa

SEQ ID NO: 146939 - DNA, 75 bp, Artificial Sequence
  Synthetic
ccaggaatcctccccagcctccgaggcagcggctgttgttagagcttttgccggatgggtcagcggtttatgaag

SEQ ID NO: 146940 - DNA, 75 bp, Artificial Sequence
  Synthetic
tgataatgaggcatttgaggggtcggacgtcgaccctgctgaagaggccactgtgagtatctctggctcgtacat

SEQ ID NO: 146941 - DNA, 75 bp, Artificial Sequence
  Synthetic
gacgtcgaccctgctgaagaggccactgtgagtatctctggctcgtacattgtcaccggcagccagttgcagcct

SEQ ID NO: 146942 - DNA, 75 bp, Artificial Sequence
  Synthetic
gctgaccaccgtgttgctgtctcaacttatactacaagcttaggtgctggtcctgtgtctatctctgcagttggt

SEQ ID NO: 146943 - DNA, 75 bp, Artificial Sequence
  Synthetic
ttgtcaacaacttttttcttgctggcggagaggtgggccatcaccgcccctctgtgatacctcgtggcaaccctg

SEQ ID NO: 146944 - DNA, 75 bp, Artificial Sequence
  Synthetic
gggacctgttttcatctgattgtttctggctagttaatgccgccaatagtaaccatctgcccggagggggcattt

SEQ ID NO: 146945 - DNA, 75 bp, Artificial Sequence
  Synthetic
tgatacgcttctcggtggtttaccgacagaattgatttcgtcggccgggggtcagctgttttactcccgccctgt

SEQ ID NO: 146946 - DNA, 75 bp, Artificial Sequence
  Synthetic
tagtgttcacccaggcggctaaggccgccaaccccggctcagtgacagtccacgaggcacagggcgctacctaca

SEQ ID NO: 146947 - DNA, 75 bp, Artificial Sequence
  Synthetic
gacaccgacggccgtctcacttgtaagaccactatgggcaataagaccttcacaacagtttttaccgacggtgcc

SEQ ID NO: 146948 - DNA, 75 bp, Artificial Sequence
  Synthetic
cttacactcagcacccccgacctatcattcatgctgtggccccagattacaggcagggggctaacttggcccgtc

SEQ ID NO: 146949 - DNA, 75 bp, Artificial Sequence
  Synthetic
cgctgtcttgcccccctgccctgagcttgagcagggcttgttgttcatgccgcaagaactcacagtgtccgacag

SEQ ID NO: 146950 - DNA, 75 bp, Artificial Sequence
  Synthetic
cgcaagaactcacagtgtccgacagcgtgctggtctttgaactcacagatatagtccattgccgcatggctgctc

SEQ ID NO: 146951 - DNA, 75 bp, Artificial Sequence
  Synthetic
cattcatgctgtggccccagattacaggcagggggctaacttggcccgtctgcaggcttcttataaagaatgttt

SEQ ID NO: 146952 - DNA, 75 bp, Artificial Sequence
  Synthetic
ggcatggctggatcaccacctgcctggcgatgagttgtacctgttaccagacttaactaattggtttagggcttg

SEQ ID NO: 146953 - DNA, 75 bp, Artificial Sequence
  Synthetic
ggcgatgagttgtacctgttaccagacttaactaattggtttagggcttggcggcaggcattcccggatggctcg

SEQ ID NO: 146954 - DNA, 75 bp, Artificial Sequence
  Synthetic
cttctgctcggctttatacaggtttaaccgctgtgtccagcggcactctctcattggtggcttgtggtattatcc

SEQ ID NO: 146955 - DNA, 75 bp, Artificial Sequence
  Synthetic
aaccgctgtgtccagcggcactctctcattggtggcttgtggtattatcctgaggggctaattggtttgtttcca

SEQ ID NO: 146956 - DNA, 75 bp, Artificial Sequence
  Synthetic
gctaatacagctaatttggcactgcaacaggaagctgaaggggcctttggcaagtacgttggtaatgctcatatc

SEQ ID NO: 146957 - DNA, 75 bp, Artificial Sequence
  Synthetic
aacaggaagctgaaggggcctttggcaagtacgttggtaatgctcatatcgcccccgggcctgtgaggtaccggt

SEQ ID NO: 146958 - DNA, 75 bp, Artificial Sequence
  Synthetic
tcggtgtcgggcttttctagctgtttttctccattcgagccccccgctctggactcactaccccccgccgaggct

SEQ ID NO: 146959 - DNA, 75 bp, Artificial Sequence
  Synthetic
gcttccttagaccggttggccgagatgtccagcgctggtactctgcccccacccgtggccctgcggccaattgtc

SEQ ID NO: 146960 - DNA, 75 bp, Artificial Sequence
  Synthetic
cacccccagctaccttgacattaccacaacctccggctcctaaacgggcagtacccccgcaagatcttgccgatg

SEQ ID NO: 146961 - DNA, 75 bp, Artificial Sequence
  Synthetic
cgcagcagttaaagaaccagtggaaacagcgcggttttaatgtaatgacacagcatgttggcctaagccacgccg

SEQ ID NO: 146962 - DNA, 75 bp, Artificial Sequence
  Synthetic
acagcgcggttttaatgtaatgacacagcatgttggcctaagccacgccgccggccagaggttggttgtggacga

SEQ ID NO: 146963 - DNA, 75 bp, Artificial Sequence
  Synthetic
gcgatgtcgctcgggcttctccgggtgtctctgctgcaccccctgtgccggcgcaatccgtgactgatccacccg

SEQ ID NO: 146964 - DNA, 75 bp, Artificial Sequence
  Synthetic
ctgcagagaccggtgtggccctctactctttacatgacctttggccagctgatgttgcggaggctatggcccgcc

SEQ ID NO: 146965 - DNA, 75 bp, Artificial Sequence
  Synthetic
ttatcctgatgggtcaaaagtgtacgctggctcccttttcgagtccgagtgtacttggttggtcaatgcgtccaa

SEQ ID NO: 146966 - DNA, 75 bp, Artificial Sequence
  Synthetic
caaccaaataccggccattgatttcgaccataaggggctagtgcctgccatgaacttgaggttagagcccacaga

SEQ ID NO: 146967 - DNA, 75 bp, Artificial Sequence
  Synthetic
actgcaccttcttcccgaggtgctgctaccacccggcacctaccacacaacttcgtacctcctgattcacgacgg

SEQ ID NO: 146968 - DNA, 75 bp, Artificial Sequence
  Synthetic
gaccataaggggctagtgcctgccatgaacttgaggttagagcccacagagtggcgcacgttgacccatcggtgc

SEQ ID NO: 146969 - DNA, 75 bp, Artificial Sequence
  Synthetic
gttcgtcatgtccgatgggtttgcagcctataccttgacgccccgacctattatccatgctgttgctcccgacta

SEQ ID NO: 146970 - DNA, 75 bp, Artificial Sequence
  Synthetic
tccttctcggggaccgttgccggccaaaagcttgttttcacgcaggccgctaaatcgatgcacccgggagcgata

SEQ ID NO: 146971 - DNA, 75 bp, Artificial Sequence
  Synthetic
ggctcaagctgaaagttgattaccgccctatcgggttgtatgccggcgtggtagtggcccctggcttggggacac

SEQ ID NO: 146972 - DNA, 75 bp, Artificial Sequence
  Synthetic
ttatccatgctgttgctcccgactatcgggtagaacataaccccaagaggctcgaggctgcttatcgagagacgt

SEQ ID NO: 146973 - DNA, 75 bp, Artificial Sequence
  Synthetic
taaatcgatgcacccgggagcgataactgtccacgaggcccagggcagcacgtttaacaccgttactctgattgc

SEQ ID NO: 146974 - DNA, 75 bp, Artificial Sequence
  Synthetic
accctcgttcaacggaggtgtatgttcgatccatatttggccctggcggctccccatccttgtttccgtcagcct

SEQ ID NO: 146975 - DNA, 75 bp, Artificial Sequence
  Synthetic
atgcctgggagcgcaaccatcggcccggggatgagttgtatcttactgagccggctatagcttggttcgaggcta

SEQ ID NO: 146976 - DNA, 75 bp, Artificial Sequence
  Synthetic
atgtcacatcgtggatgcacctgggttgctgcgtgagctgggcgtgtctgatgctgttttgcacaatttctatct

SEQ ID NO: 146977 - DNA, 75 bp, Artificial Sequence
  Synthetic
ttgctgcgtgagctgggcgtgtctgatgctgttttgcacaatttctatctcaccaatccagttgatgtgcaagcc

SEQ ID NO: 146978 - DNA, 75 bp, Artificial Sequence
  Synthetic
tatcactgaggacacggcacgaacagcaaatctggcgttggagctagattcggccactgaggtcggtcgggcgtg

SEQ ID NO: 146979 - DNA, 75 bp, Artificial Sequence
  Synthetic
tgctggttgccgtgttgagccaggcgtcgttcattaccagttcacggcgggcgtccctggttccggcaagtcacg

SEQ ID NO: 146980 - DNA, 75 bp, Artificial Sequence
  Synthetic
gtcgttcattaccagttcacggcgggcgtccctggttccggcaagtcacggtcaattcagcagggcgaggtggat

SEQ ID NO: 146981 - DNA, 75 bp, Artificial Sequence
  Synthetic
gatgtggcccttcaccagatgtcagaggcttttggtcatcgcccgttagaagtccgagccgttatccctgcagca

SEQ ID NO: 146982 - DNA, 75 bp, Artificial Sequence
  Synthetic
aggcttttggtcatcgcccgttagaagtccgagccgttatccctgcagcaccaagtcttgagcaggggaaacttt

SEQ ID NO: 146983 - DNA, 75 bp, Artificial Sequence
  Synthetic
cccggttgtatgcagccccccaccttcccccagaagtgctgctcccccccggaacttatcacaccacctcatacc

SEQ ID NO: 146984 - DNA, 75 bp, Artificial Sequence
  Synthetic
gcggcccgtgttacccgtggccgtagggttgtcattgatgaggccccgtcacttccaccacatctgctcctgctg

SEQ ID NO: 146985 - DNA, 75 bp, Artificial Sequence
  Synthetic
ctgcccccgcacacaggcttgccgtcctgtctactttggtgggcaggtatggaaaagaaactaagctttggcacg

SEQ ID NO: 146986 - DNA, 75 bp, Artificial Sequence
  Synthetic
acttccaccacatctgctcctgctgcacatgcagcgggcctcgtcggtccaccttcttggcgaccccaaccaaat

SEQ ID NO: 146987 - DNA, 75 bp, Artificial Sequence
  Synthetic
cctacgggcgctggttccatcgttgtcgggggtgcaggtgacatcttgtgagctggctgagcttgtggaggcgat

SEQ ID NO: 146988 - DNA, 75 bp, Artificial Sequence
  Synthetic
cacagctgcacctgagccgtcgccaatgccttatgtcccataccctcgttctaccgaggtctatgtccggtccat

SEQ ID NO: 146989 - DNA, 75 bp, Artificial Sequence
  Synthetic
tgttacccacaggtgtccggcagatgtttgtgagctaattcgcggcgcgtaccctaagatccagacagcgagccg

SEQ ID NO: 146990 - DNA, 75 bp, Artificial Sequence
  Synthetic
gtttgtgagctaattcgcggcgcgtaccctaagatccagacagcgagccgtgtttttcgctccctgttttggggg

SEQ ID NO: 146991 - DNA, 75 bp, Artificial Sequence
  Synthetic
gacaacgaggcctatgagggttctgaggtcgacccggctgaacctgctcatcttgatgtttctgggacctatgcc

SEQ ID NO: 146992 - DNA, 75 bp, Artificial Sequence
  Synthetic
tttccagaaagactgcaacaagtttacaaccgatgagcccatcgcacacggtaaagttggtcagggcatatcagc

SEQ ID NO: 146993 - DNA, 75 bp, Artificial Sequence
  Synthetic
acaaccgatgagcccatcgcacacggtaaagttggtcagggcatatcagcctggtccaaaaccttagtcgcccta

SEQ ID NO: 146994 - DNA, 75 bp, Artificial Sequence
  Synthetic
gcacatatgggacaggcttatgctcttcggtgcgaccctcgacgatcaggccttctgctgttcgaggctaatgac

SEQ ID NO: 146995 - DNA, 75 bp, Artificial Sequence
  Synthetic
gaggcccagggcgctacattcactgagactactattattgctacggcggatgctcgcgggctgattcagtcatct

SEQ ID NO: 146996 - DNA, 75 bp, Artificial Sequence
  Synthetic
agggctcacgctattgtggccctaacccgtcatacggagaaatgtgtggtcgttgatgccccgggactccttcgt

SEQ ID NO: 146997 - DNA, 75 bp, Artificial Sequence
  Synthetic
tatgctatgccgcggtttgaagccgcagtttcaggtgctcgaggctgtcgtgtttttgagaatgatttttctgaa

SEQ ID NO: 146998 - DNA, 75 bp, Artificial Sequence
  Synthetic
cagtttcaggtgctcgaggctgtcgtgtttttgagaatgatttttctgaatttgatagcacgcagaataactttt

SEQ ID NO: 146999 - DNA, 75 bp, Artificial Sequence
  Synthetic
gaggaggccacctccggcctggtaatgctctgcattcacggctctcctgtcaattcttatactaatacaccttac

SEQ ID NO: 147000 - DNA, 75 bp, Artificial Sequence
  Synthetic
gtcataccgcgtggcactatcgacaacaatgttgatacgcttgatgcattcccaccctcttgccagttcagcgcc

SEQ ID NO: 147001 - DNA, 75 bp, Artificial Sequence
  Synthetic
ggagtgcttgggttttgcaggccccgcaggagtctcttaggggccggtggaagaagcattcaggtgagcctggta

SEQ ID NO: 147002 - DNA, 75 bp, Artificial Sequence
  Synthetic
gcaggagtctcttaggggccggtggaagaagcattcaggtgagcctggtaccctgctctggaacactgtgtggaa

SEQ ID NO: 147003 - DNA, 75 bp, Artificial Sequence
  Synthetic
cgtcctgcccccctgccctgaacttgaacagggtctactttacatgcctcaggaattgaccacgtctgatagtgt

SEQ ID NO: 147004 - DNA, 75 bp, Artificial Sequence
  Synthetic
cgacgggaccgctgagcttaccactacggcggccacgcgtttcatgaaggacctgcatttcactggcacgaatgg

SEQ ID NO: 147005 - DNA, 75 bp, Artificial Sequence
  Synthetic
gacggcaccaatactcatataatggccacggaggcttctaattatgcccagtaccgggttgcccgtgccacaatc

SEQ ID NO: 147006 - DNA, 75 bp, Artificial Sequence
  Synthetic
ttgttgccgtatgtatgaccagctcccccgtgcaaatgcgttaataaccggctgtggtcttaagttgaaggtggc

SEQ ID NO: 147007 - DNA, 75 bp, Artificial Sequence
  Synthetic
ccccgtgcaaatgcgttaataaccggctgtggtcttaagttgaaggtggcgttccacgatgttggcagttacgcc

SEQ ID NO: 147008 - DNA, 75 bp, Artificial Sequence
  Synthetic
tggggtcccggtcaagagcgccgtgcagaattgcagcaggcagtgaaagattttctggcgaagattacaaatact

SEQ ID NO: 147009 - DNA, 75 bp, Artificial Sequence
  Synthetic
aggccaggatggttctgcggttctggagctcgacttatgcaaccgtgatgtgtctcgtataacattcttccagaa

SEQ ID NO: 147010 - DNA, 75 bp, Artificial Sequence
  Synthetic
gagctcgacttatgcaaccgtgatgtgtctcgtataacattcttccagaaggattgtaataagtttacaacgggc

SEQ ID NO: 147011 - DNA, 75 bp, Artificial Sequence
  Synthetic
ttttctggcgaagattacaaatactaccgccctatcttgtcttttggcaacaaggttttacaaattagagcctgg

SEQ ID NO: 147012 - DNA, 75 bp, Artificial Sequence
  Synthetic
tggacctaaaggagtacacctggccggtgttgcagttgggtagtagggaataacactcattatggagcatgtgta

SEQ ID NO: 147013 - DNA, 75 bp, Artificial Sequence
  Synthetic
ggtgttgcagttgggtagtagggaataacactcattatggagcatgtgtacaagatgcgttttgttctcttgctc

SEQ ID NO: 147014 - DNA, 75 bp, Artificial Sequence
  Synthetic
ctgccgagtatgaccagactacgtatgggtcatccaccaaccctatgtatgtctcggatacagtcacatttgtca

SEQ ID NO: 147015 - DNA, 75 bp, Artificial Sequence
  Synthetic
tgaggtgcgtgttgtttccgccggactcgactgcaaggctgttttcccatctggtgtagcgaccccctccacccc

SEQ ID NO: 147016 - DNA, 75 bp, Artificial Sequence
  Synthetic
attctatggtgatgcatacgaagatacagttctggccgccgcagtcgccggagcccctggttgcaaggtttttga

SEQ ID NO: 147017 - DNA, 75 bp, Artificial Sequence
  Synthetic
tgcccgctcccttgactggtctaaggtcacgctggatggccgccccctcactaccatccagcagtactccaagac

SEQ ID NO: 147018 - DNA, 75 bp, Artificial Sequence
  Synthetic
cgacgtggcacccgcactgacaccgtcggcaccggcactagcggcttgccccccccaatcaccagggctgatgct

SEQ ID NO: 147019 - DNA, 75 bp, Artificial Sequence
  Synthetic
tccagcggcattcccttatcgggggcctgtggtactaccccgaggggctaattggcttgtttccgccgttctctc

SEQ ID NO: 147020 - DNA, 75 bp, Artificial Sequence
  Synthetic
tggagtgtataatcatggaggagtgcggtatgccgcagtggatgatccggctttatcaccttgttcgctctgctt

SEQ ID NO: 147021 - DNA, 75 bp, Artificial Sequence
  Synthetic
atagcccttacccttttcaaccttgctgacactctgcttggtggcctgccgacagaattgatttcgtcggctggt

SEQ ID NO: 147022 - DNA, 75 bp, Artificial Sequence
  Synthetic
tcggcaccggcactagcggcttgccccccccaatcaccagggctgatgctaggcccaattggatgtcttccacaa

SEQ ID NO: 147023 - DNA, 75 bp, Artificial Sequence
  Synthetic
gacagaattgatttcgtcggctggtggccagctgttttactctcgccccgttgtctcagccaatggcgagccgac

SEQ ID NO: 147024 - DNA, 75 bp, Artificial Sequence
  Synthetic
tcctttttgtggggagagcaccctctacacccggacctggtcagtgtcagggttctctagctgcttctccccgct

SEQ ID NO: 147025 - DNA, 75 bp, Artificial Sequence
  Synthetic
aaccccgaaattcccgtgttcccgatgccgggcaatcgccgttgaccgcggtagcgcccgccccgaacacggccc

SEQ ID NO: 147026 - DNA, 75 bp, Artificial Sequence
  Synthetic
ggaatactgtctggaacatggcggtcatagcccactgttatgagttccgcgacttaaaagtcgccgcatttaaag

SEQ ID NO: 147027 - DNA, 75 bp, Artificial Sequence
  Synthetic
tgccgggcaatcgccgttgaccgcggtagcgcccgccccgaacacggcccctgtgcccgattaccattctcgagg

SEQ ID NO: 147028 - DNA, 75 bp, Artificial Sequence
  Synthetic
tatctctgcactgcctcagcccccagcctccgaacgggcggccccttcactagacctagttgatagcggtgctgt

SEQ ID NO: 147029 - DNA, 75 bp, Artificial Sequence
  Synthetic
tttgtttgcggcttctctgaacccccttctgccgctgcaagacgggtctaacacacacattatggcgactgaggc

SEQ ID NO: 147030 - DNA, 75 bp, Artificial Sequence
  Synthetic
cttctgccgctgcaagacgggtctaacacacacattatggcgactgaggcttccaattatgctcaatatcgcata

SEQ ID NO: 147031 - DNA, 75 bp, Artificial Sequence
  Synthetic
tgaaggtaggtaaaacccgggagtcttaattaattctttttgtacccccttcatagctttcttttgttttatttc

SEQ ID NO: 147032 - DNA, 75 bp, Artificial Sequence
  Synthetic
ggctcaaaggtgtatgccggctccctttttgagtctgagtgtacttggctggttaatgcgtccaaccctggccac

SEQ ID NO: 147033 - DNA, 75 bp, Artificial Sequence
  Synthetic
atgtggtggtcgtgcccacccgggagctccgtaatagttggcgtcgccggggttttgcggctttcacacctcaca

SEQ ID NO: 147034 - DNA, 75 bp, Artificial Sequence
  Synthetic
aaagttaacgaatgtggctcaagtctgtgtggacgttgtttcgcaggtttatggtgttagccccggcttggtaca

SEQ ID NO: 147035 - DNA, 75 bp, Artificial Sequence
  Synthetic
ccgcgttgtgattgatgaggctccatctctccctccacacctgttgctgttacacatgcagcgggcctcctcggt

SEQ ID NO: 147036 - DNA, 75 bp, Artificial Sequence
  Synthetic
ccacagtcaaccacggttcctacctcggttgacatgaattctatcacttccactgatgttagggttgtctcacag

SEQ ID NO: 147037 - DNA, 75 bp, Artificial Sequence
  Synthetic
ccgacctgaagttctctggaaccatccgatccagcgagtcatacataatgagctggagcaatactgccgagcccg

SEQ ID NO: 147038 - DNA, 75 bp, Artificial Sequence
  Synthetic
ccgatccagcgagtcatacataatgagctggagcaatactgccgagcccgcgctggtcgctgtcttgaggtgggc

SEQ ID NO: 147039 - DNA, 75 bp, Artificial Sequence
  Synthetic
cggttgacatgaattctatcacttccactgatgttagggttgtctcacagccgggcctctctgccgaactagtca

SEQ ID NO: 147040 - DNA, 75 bp, Artificial Sequence
  Synthetic
cataaccctaaaaggcttgaggccgcttatcgggagacgtgctctcgccgtgggacggctgcttaccccctgctc

SEQ ID NO: 147041 - DNA, 75 bp, Artificial Sequence
  Synthetic
cgacatccggcatgattatggtttgtatccacggggcccctatcaattcttttactaattctccttatactggtg

SEQ ID NO: 147042 - DNA, 75 bp, Artificial Sequence
  Synthetic
cctcaccaattctattatacatcgggtggaatgaataacatgttcttttgctctgtgcatggagatgccaccatg

SEQ ID NO: 147043 - DNA, 75 bp, Artificial Sequence
  Synthetic
gtttccatttctgcggttgctgttttagccccccactctgcactagcattgcttgaggataccttggactaccct

SEQ ID NO: 147044 - DNA, 75 bp, Artificial Sequence
  Synthetic
tatccacggggcccctatcaattcttttactaattctccttatactggtgcgttggggctgcttgatctcgctct

SEQ ID NO: 147045 - DNA, 75 bp, Artificial Sequence
  Synthetic
cgcgccaccggccggtcagccgtctggccgccgccgcgggcggcgcagcggcggtgccggcggtggtttctgggg

SEQ ID NO: 147046 - DNA, 75 bp, Artificial Sequence
  Synthetic
cttggtttgaggctaaccggcctgctctccccgcccttactattactgaggacacggcacgcacagcgaatttgg

SEQ ID NO: 147047 - DNA, 75 bp, Artificial Sequence
  Synthetic
tctccccgcccttactattactgaggacacggcacgcacagcgaatttggcgctggagctggactcagctaccga

SEQ ID NO: 147048 - DNA, 75 bp, Artificial Sequence
  Synthetic
ggttctcccgctgcgccttcgccgctgagaccgggatcgctttatactcactgcatgacctttggccctcggacg

SEQ ID NO: 147049 - DNA, 75 bp, Artificial Sequence
  Synthetic
caagattcgccgcttacctgatggtacagctcaggtctcatctgcggcagccatgcgctttatgcaggatgttca

SEQ ID NO: 147050 - DNA, 75 bp, Artificial Sequence
  Synthetic
gatgccaggggccttatccagtcatcccgggctcacgctatagtcgcactcacccgccacactgagaagtgtgtt

SEQ ID NO: 147051 - DNA, 75 bp, Artificial Sequence
  Synthetic
tgagaccgggatcgctttatactcactgcatgacctttggccctcggacgttgcggaggctatggcccgccacgg

SEQ ID NO: 147052 - DNA, 75 bp, Artificial Sequence
  Synthetic
gacgtgggcagaggcatcgtgcaagtgcttctcaacatcgcagacaccctgcttggtggcctgcccaccgatctt

SEQ ID NO: 147053 - DNA, 75 bp, Artificial Sequence
  Synthetic
ctccggtaagtcccgttcagttcagcagggtgaggtagatgtggtggtggtgccaactcgtgagttgcgtaattc

SEQ ID NO: 147054 - DNA, 75 bp, Artificial Sequence
  Synthetic
gtgtcgaacgccgggggacagatgttttatggtcgccctcaagtttcagctaatggtgagccatcggtcaagtta

SEQ ID NO: 147055 - DNA, 75 bp, Artificial Sequence
  Synthetic
tttatggtcgccctcaagtttcagctaatggtgagccatcggtcaagttatatacttctgttgaggctgcccagc

SEQ ID NO: 147056 - DNA, 75 bp, Artificial Sequence
  Synthetic
tccgccttggcgaatgctgtggtggttcggccgtttttatctcgtgtacaaaccgagattcttattaatttgatg

SEQ ID NO: 147057 - DNA, 75 bp, Artificial Sequence
  Synthetic
ctgtgataccccgcggtaaccctgatcagaacctcgggactctacaggccttcccgccgtcctgccagattagtg

SEQ ID NO: 147058 - DNA, 75 bp, Artificial Sequence
  Synthetic
cgctggagctggactcagctaccgaggtcggccgggcatgtgctggctgtcgtgttgagcctggcgtcgttcact

SEQ ID NO: 147059 - DNA, 75 bp, Artificial Sequence
  Synthetic
ctgaggtgctttggaaccatcccatccagcgggtcatacataatgaattggagcagtactgccgggcccgggctg

SEQ ID NO: 147060 - DNA, 75 bp, Artificial Sequence
  Synthetic
aaccttgttctatatgctgctccgctgagccctttgcttccgctccaagatggaactaacactcacattatggcc

SEQ ID NO: 147061 - DNA, 75 bp, Artificial Sequence
  Synthetic
aacacatacaggaccggccgacgccttcgcctgcccccgttaggccgataacgaattggaggacgggcgatgtgg

SEQ ID NO: 147062 - DNA, 75 bp, Artificial Sequence
  Synthetic
ctccttactgcagcccccgagccatccccaatgccttatgtcccctaccctcgttcaacagaggtgtatgttaga

SEQ ID NO: 147063 - DNA, 75 bp, Artificial Sequence
  Synthetic
ttgagcagggcctgctctatatgccacaagagcttactgtgtctgatagtgtgttggtttttgagctcacggata

SEQ ID NO: 147064 - DNA, 75 bp, Artificial Sequence
  Synthetic
ttcgcctgcccccgttaggccgataacgaattggaggacgggcgatgtggtgtgggtcacgttgccggcggccca

SEQ ID NO: 147065 - DNA, 75 bp, Artificial Sequence
  Synthetic
gtaccgtccgcttgtaccgaacgctgtcggcggatacgctatatctatctctttctggcctcagacaactactac

SEQ ID NO: 147066 - DNA, 75 bp, Artificial Sequence
  Synthetic
gtaccgtccgcttgttccgaacgctgtcggcggatacgctatatctatctctttctggcctcagacaactactac

SEQ ID NO: 147067 - DNA, 75 bp, Artificial Sequence
  Synthetic
gtaccgtccgcttgtcccgaacgctgtcggcggatacgctatatctatctctttctggcctcagacaactactac

SEQ ID NO: 147068 - DNA, 75 bp, Artificial Sequence
  Synthetic
gtaccgtccgcttgtgccgaacgctgtcggcggatacgctatatctatctctttctggcctcagacaactactac

SEQ ID NO: 147069 - DNA, 75 bp, Artificial Sequence
  Synthetic
gaccggttggccgagatgttcagcgctggtattctgcccctacccgtggccctgcggccaattgtcgccgctccg

SEQ ID NO: 147070 - DNA, 75 bp, Artificial Sequence
  Synthetic
cacaggccaacgtgctgcagtgtcatctatcaagtgggaccaggttacgcttaatggccgccctctgcaccatga

SEQ ID NO: 147071 - DNA, 75 bp, Artificial Sequence
  Synthetic
tctatcaagtgggaccaggttacgcttaatggccgccctctgcaccatgaagcccattctgagttgatctattac

SEQ ID NO: 147072 - DNA, 75 bp, Artificial Sequence
  Synthetic
ggcggcaaaggccgccaaccctggtgcaattacagtccatgaggcccagggtgctacatttactgagaccacaat

SEQ ID NO: 147073 - DNA, 75 bp, Artificial Sequence
  Synthetic
cattatcgtaaccaaggctggcgctctgttgagacctctggtgttgcggaggaggaggcgacctccggccttgtc

SEQ ID NO: 147074 - DNA, 75 bp, Artificial Sequence
  Synthetic
ataaagtgaccgttggcgcactcgtcgccaacgagggctggaatgcctcggaggatgcgctaactgccgtgatta

SEQ ID NO: 147075 - DNA, 75 bp, Artificial Sequence
  Synthetic
ataaagtgaccgttggcgcactcgtcgccaacgagggctggaatgcctcggaggatgcgcttactgccgtgatta

SEQ ID NO: 147076 - DNA, 75 bp, Artificial Sequence
  Synthetic
ataaagtgaccgttggcgcactcgtcgccaacgagggctggaatgcctcggaggatgcgctcactgccgtgatta

SEQ ID NO: 147077 - DNA, 75 bp, Artificial Sequence
  Synthetic
ataaagtgaccgttggcgcactcgtcgccaacgagggctggaatgcctcggaggatgcgctgactgccgtgatta

SEQ ID NO: 147078 - DNA, 75 bp, Artificial Sequence
  Synthetic
cgccaacgagggctggaatgcctcggaggatgcgctaactgccgtgattactgcagcgtatttaaccatctgcca

SEQ ID NO: 147079 - DNA, 75 bp, Artificial Sequence
  Synthetic
cgccaacgagggctggaatgcctcggaggatgcgcttactgccgtgattactgcagcgtatttaaccatctgcca

SEQ ID NO: 147080 - DNA, 75 bp, Artificial Sequence
  Synthetic
cgccaacgagggctggaatgcctcggaggatgcgctcactgccgtgattactgcagcgtatttaaccatctgcca

SEQ ID NO: 147081 - DNA, 75 bp, Artificial Sequence
  Synthetic
cgccaacgagggctggaatgcctcggaggatgcgctgactgccgtgattactgcagcgtatttaaccatctgcca

SEQ ID NO: 147082 - DNA, 75 bp, Artificial Sequence
  Synthetic
acagttgactctgataatatctgggtttggtgggatagtggttctaaggcttatctttatgtttctacctacact

SEQ ID NO: 147083 - DNA, 75 bp, Artificial Sequence
  Synthetic
tttggtgggatagtggttctaaggcttatctttatgtttctacctacactactatgctcggtgcggggccggtcg

SEQ ID NO: 147084 - DNA, 75 bp, Artificial Sequence
  Synthetic
tcttgatccacgacggcaaccgcgctgttgtaacttacgagggcgacactagtgcgggctataatcatgatgtct

SEQ ID NO: 147085 - DNA, 75 bp, Artificial Sequence
  Synthetic
ttcgcactcgagctcgagttccgcaatttgacacctggtaacacgaacacacgtgtttcccgctactcgagtagt

SEQ ID NO: 147086 - DNA, 75 bp, Artificial Sequence
  Synthetic
cacaaggttatatagctggctgtttgaaaaatcaggccgtgactacatccccggtcgccagctccagttttatgc

SEQ ID NO: 147087 - DNA, 75 bp, Artificial Sequence
  Synthetic
acgtgtttcccgctactcgagtagtgcgcgccacaagctacgccgagggcctgatggcactgctgagttaactac

SEQ ID NO: 147088 - DNA, 75 bp, Artificial Sequence
  Synthetic
gaaaaatcaggccgtgactacatccccggtcgccagctccagttttatgcacagtgccgccgttggctctcggct

SEQ ID NO: 147089 - DNA, 75 bp, Artificial Sequence
  Synthetic
aggacggatgcccagcctgtgcttccgccgggctttcaagttgcctcgttgctgaagctattgcgcgagtcaagc

SEQ ID NO: 147090 - DNA, 75 bp, Artificial Sequence
  Synthetic
ttttgtccgtttctgaggatgtctagttattcttttctttggtttctttactttttccttttccttccttctttt

SEQ ID NO: 147091 - DNA, 75 bp, Artificial Sequence
  Synthetic
ctggttggtgactgtggccatgataacgaggcctacgaagggtccgaggtggaccccgccgagcctgcccacctt

SEQ ID NO: 147092 - DNA, 75 bp, Artificial Sequence
  Synthetic
gatctacctttcatgctgtcccggttcacatctgggatcggctcatgctctttggtgccaccctggacgatcagg

SEQ ID NO: 147093 - DNA, 75 bp, Artificial Sequence
  Synthetic
ggttgtatcatctggttcggtcagcctggattttgcaggcgccgaaggagtctcttaagggtttctggaagaagc

SEQ ID NO: 147094 - DNA, 75 bp, Artificial Sequence
  Synthetic
ctggattttgcaggcgccgaaggagtctcttaagggtttctggaagaagcattctggtgagcctggtacccttct

SEQ ID NO: 147095 - DNA, 75 bp, Artificial Sequence
  Synthetic
gcaaccccggcagttggttttccgccctgaggtgctttggaatcaccccatccagcgagttatacacaatgaatt

SEQ ID NO: 147096 - DNA, 75 bp, Artificial Sequence
  Synthetic
attgcagctcgtgcgtcacgtctgacggctaccgtggaactcgccgccagcccaggccgactcgagtgccgtact

SEQ ID NO: 147097 - DNA, 75 bp, Artificial Sequence
  Synthetic
atgaggggtggaacgcctctgaagacgctcttactgcagtgatcactgcggcctatctgactatctgccatcagc

SEQ ID NO: 147098 - DNA, 75 bp, Artificial Sequence
  Synthetic
cccaccccttctcctgctccctctcggcctttttctgtccttcgtgctaatgatgtgctatggctttcacttaca

SEQ ID NO: 147099 - DNA, 75 bp, Artificial Sequence
  Synthetic
ggcctttttctgtccttcgtgctaatgatgtgctatggctttcacttacagcagctgagtatgatcagactacct

SEQ ID NO: 147100 - DNA, 75 bp, Artificial Sequence
  Synthetic
taatgttctgcaccgatgcttcctcaaaccggttggtagggacgttcagcgctggtattctgcccccacccgcgg

SEQ ID NO: 147101 - DNA, 75 bp, Artificial Sequence
  Synthetic
gtgactttcgtgttgccgccttcaagggtgatgattcagtggtcctttgtagtgactaccgacagagccgtaatg

SEQ ID NO: 147102 - DNA, 75 bp, Artificial Sequence
  Synthetic
aaaccggttggtagggacgttcagcgctggtattctgcccccacccgcggccctgcggccaactgtcgtcgctcc

SEQ ID NO: 147103 - DNA, 75 bp, Artificial Sequence
  Synthetic
aggcaatgggggctgggcctcacagcctcacgtatgaacttgttcctgccggtctgcaggttaaaatatcttcta

SEQ ID NO: 147104 - DNA, 75 bp, Artificial Sequence
  Synthetic
aaatttacaacaggtgagacgatagcacacggcaaagttgggcaggggatatccgcgtggagcaagaccttctgt

SEQ ID NO: 147105 - DNA, 75 bp, Artificial Sequence
  Synthetic
agaacaatactgccgggcccgggctggtcgttgcttggaggttggagcccacccgaggtccattaatgacaaccc

SEQ ID NO: 147106 - DNA, 75 bp, Artificial Sequence
  Synthetic
actggcgtagccctctactctttgcacgacctttggccagccgatgttgcggaagctatggcccgccatgggatg

SEQ ID NO: 147107 - DNA, 75 bp, Artificial Sequence
  Synthetic
tttgatgagtcagtgccatgccgttgcaggacgttcttgaagaaggtcgcgggtaaattctgctgttttatgcgg

SEQ ID NO: 147108 - DNA, 75 bp, Artificial Sequence
  Synthetic
gacgcatatgaagatacagtcttggctgccgctgtggctggggctcctggctgcaaggtctttgagaacgacttc

SEQ ID NO: 147109 - DNA, 75 bp, Artificial Sequence
  Synthetic
acacgcttatacgccgcgctacacctcccccctgaggtgctgttaccacccggcacctaccacacgacctcctat

SEQ ID NO: 147110 - DNA, 75 bp, Artificial Sequence
  Synthetic
gattttaattgagaatgcagctggtcaccgtgtatgcatctcaacctacactactaatcttggatctggccctgt

SEQ ID NO: 147111 - DNA, 75 bp, Artificial Sequence
  Synthetic
gcaaatcccttttgcggtgagagcacactttatacacgaacttggtctacatctggtttttctagcgacttctcc

SEQ ID NO: 147112 - DNA, 75 bp, Artificial Sequence
  Synthetic
ttctatttctgctgtcggtgtcctcgcacctcactctgcgctggccgctttagaggacactgttgactatcctgc

SEQ ID NO: 147113 - DNA, 75 bp, Artificial Sequence
  Synthetic
cagcccctgacatggggctgccctcgagcgccccctcgtcagctggtgatgtctgggcatttccaccgccctccg

SEQ ID NO: 147114 - DNA, 75 bp, Artificial Sequence
  Synthetic
atcggatgtcattttgtgttactgcttaccgcagcccctgaaccgtcacctatgccttatgtcccctacccccgc

SEQ ID NO: 147115 - DNA, 75 bp, Artificial Sequence
  Synthetic
ttctacttgtaccctccttctgttttgctcttttatttttcttttctgcgttccgcgctccctggaaaaaaaaaa

SEQ ID NO: 147116 - DNA, 75 bp, Artificial Sequence
  Synthetic
gtcatttgacgcctcccgtcagtctatgggggccgggtcacacagcctcacctatgagctcacccctgccggttt

SEQ ID NO: 147117 - DNA, 75 bp, Artificial Sequence
  Synthetic
ttcacatctgggaccggctcatgctctttggtgccaccttggacgatcaggcgttctgctgctcgcggctcatga

SEQ ID NO: 147118 - DNA, 75 bp, Artificial Sequence
  Synthetic
ctggattgtactgccacattcccccctggtggcgcccctagcgccgcaccgggggaagtggcagccttttgcagt

SEQ ID NO: 147119 - DNA, 75 bp, Artificial Sequence
  Synthetic
ttcggccgtttttgtctcgtgtgcaaaccgagattcttatcaacctgatgcaaccccggcagttggttttccgtc

SEQ ID NO: 147120 - DNA, 75 bp, Artificial Sequence
  Synthetic
acgcccttactgcagtaatcactgcagcttatttgactatctgccaccagcgctacctccgcacccaggcgatat

SEQ ID NO: 147121 - DNA, 75 bp, Artificial Sequence
  Synthetic
aaggtctcgccgcatacactttgagcccgcgtccgatcattcacgctgtggctcctgactacagggttgagcaga

SEQ ID NO: 147122 - DNA, 75 bp, Artificial Sequence
  Synthetic
agcttatttgactatctgccaccagcgctacctccgcacccaggcgatatctaagggtatgcgtcggttggaggt

SEQ ID NO: 147123 - DNA, 75 bp, Artificial Sequence
  Synthetic
ctgggtatcttccccccattctcccctgggcatatttgggagtctgctaaccccttttgcggtgagggaactttg

SEQ ID NO: 147124 - DNA, 75 bp, Artificial Sequence
  Synthetic
ctgggcatatttgggagtctgctaaccccttttgcggtgagggaactttgtatacccgaacctggtcaacttctg

SEQ ID NO: 147125 - DNA, 75 bp, Artificial Sequence
  Synthetic
acagctgcttacccgttactggggtcggggatttaccaggtccctgtgggcttaagcttcgacgcctgggagcgt

SEQ ID NO: 147126 - DNA, 75 bp, Artificial Sequence
  Synthetic
ccgtcagcttcaattttatgcgcagtgccgacggtggttatctgcaggttttcacctagatcccagagtgcttgt

SEQ ID NO: 147127 - DNA, 75 bp, Artificial Sequence
  Synthetic
tgccgacggtggttatctgcaggttttcacctagatcccagagtgcttgtttttgacgaatcagtgccctgtcgc

SEQ ID NO: 147128 - DNA, 75 bp, Artificial Sequence
  Synthetic
ctccacctgttagcgatatccgggtgttaccaccgccctcagaggaatctcatgttgatgtggcatctgtaccct

SEQ ID NO: 147129 - DNA, 75 bp, Artificial Sequence
  Synthetic
gttcgaggctaataagccaacccagccggccctaacaattactgaggacactgctcgtacagctaaccttgcgct

SEQ ID NO: 147130 - DNA, 75 bp, Artificial Sequence
  Synthetic
catgttgatgtggcatctgtaccctctgttcctgagcctgctggattacccagccccattgtgcttacccccccc

SEQ ID NO: 147131 - DNA, 75 bp, Artificial Sequence
  Synthetic
ccggcgtggccctctactctttgcatgacctctggccagccgatgttgctgaagctatggcccgtcacgggatga

SEQ ID NO: 147132 - DNA, 75 bp, Artificial Sequence
  Synthetic
gttcagcccggtattgcctccgagttagtcatccctagtgagcgccttcattaccgcaatcaaggctggcgctct

SEQ ID NO: 147133 - DNA, 75 bp, Artificial Sequence
  Synthetic
ttcttggagccagctgagggtttagttggcgaccaaggccacgacaatgaggcctacgaggattctgaggttgac

SEQ ID NO: 147134 - DNA, 75 bp, Artificial Sequence
  Synthetic
ttggcgaccaaggccacgacaatgaggcctacgaggattctgaggttgacagggccgagcccgcatatctcgatg

SEQ ID NO: 147135 - DNA, 75 bp, Artificial Sequence
  Synthetic
gttcaccgccggggttcctggctccggaaagtctaggtctatacagcagggggatgttgatgttgtggtcgtgcc

SEQ ID NO: 147136 - DNA, 75 bp, Artificial Sequence
  Synthetic
gacggcgctaaggtgtatgcggggtcactgtttgaatcaggctgtgactggctagttaatgcctcaaacccgggc

SEQ ID NO: 147137 - DNA, 75 bp, Artificial Sequence
  Synthetic
ggaaagtctaggtctatacagcagggggatgttgatgttgtggtcgtgccaactcgtgagctccgcaacagttgg

SEQ ID NO: 147138 - DNA, 75 bp, Artificial Sequence
  Synthetic
ttgcccgtgcatctcgcctaacggccactgttgaactcgttgcaagcccagatcgcttggagtgccgtactgtgc

SEQ ID NO: 147139 - DNA, 75 bp, Artificial Sequence
  Synthetic
cactgttgaactcgttgcaagcccagatcgcttggagtgccgtactgtgctcgggaataaggtcttccggacgac

SEQ ID NO: 147140 - DNA, 75 bp, Artificial Sequence
  Synthetic
ttggttatagaacgtgtacgggccattggatgccattttgtgctgctgctcactgcggcccccgagccgtcgcct

SEQ ID NO: 147141 - DNA, 75 bp, Artificial Sequence
  Synthetic
tatgggggctgggtcacatagcctcacttacgagctcacctctgccggcttgcaggttagaatttcatctaatgg

SEQ ID NO: 147142 - DNA, 75 bp, Artificial Sequence
  Synthetic
acttacgagctcacctctgccggcttgcaggttagaatttcatctaatggcctagattgcactgctacattctcc

SEQ ID NO: 147143 - DNA, 75 bp, Artificial Sequence
  Synthetic
ttgggttcgggtatataccaggtccctgttagcctcagttttgacgcctgggagcgtaatcaccgccccggcgat

SEQ ID NO: 147144 - DNA, 75 bp, Artificial Sequence
  Synthetic
acccagcggcactcgttaaccggtggcttgtggctacaccctgaggggctgctgggcattttcccccctttttcc

SEQ ID NO: 147145 - DNA, 75 bp, Artificial Sequence
  Synthetic
gccaaggcggccaaccccggtgcaattaccgttcatgaggcccagggcgccacatttacggagactactatcata

SEQ ID NO: 147146 - DNA, 75 bp, Artificial Sequence
  Synthetic
gaggacacggcccgtacggccaacctggcattagagatcgatgccgctacagaggttggccgcgcttgtgccggc

SEQ ID NO: 147147 - DNA, 75 bp, Artificial Sequence
  Synthetic
gcttgtggctacaccctgaggggctgctgggcattttcccccctttttcccctgggcatatttgggagtctgcta

SEQ ID NO: 147148 - DNA, 75 bp, Artificial Sequence
  Synthetic
ataccttcgtggcattagctacaaggtcactgtcggtgcgcttgttgccaatgagggttggaacgcttctgaaga

SEQ ID NO: 147149 - DNA, 75 bp, Artificial Sequence
  Synthetic
ctgaagcggccgctctcccggctgccgctccggggccgctcccccccaccccacctgtcagtgacatctgggtgg

SEQ ID NO: 147150 - DNA, 75 bp, Artificial Sequence
  Synthetic
gcctactgcgtgaggtcggcatttctgatataattgttaataactttttcctggctggtggtgaagtaggccatc

SEQ ID NO: 147151 - DNA, 75 bp, Artificial Sequence
  Synthetic
ttgtgcccacccgggagctccgtaacagctggcgtcgccggggttttgcggcctttacacctcacacggcggccc

SEQ ID NO: 147152 - DNA, 75 bp, Artificial Sequence
  Synthetic
tcacctagaccctagagtgcttgtgtttgatgagtcagtgccctgccgctgtaggactttcctaaagaaggttgc

SEQ ID NO: 147153 - DNA, 75 bp, Artificial Sequence
  Synthetic
gccccactgtatccaccctcccctccccgcctccgccccccgtgcgtaagccaccagcaccaccgcttcctcgta

SEQ ID NO: 147154 - DNA, 75 bp, Artificial Sequence
  Synthetic
tttgatgagtcagtgccctgccgctgtaggactttcctaaagaaggttgcaggtaaaatttgctgcttcatgcgg

SEQ ID NO: 147155 - DNA, 75 bp, Artificial Sequence
  Synthetic
agcgggcctcctcggtccatctccttggtgacccaaaccagatccctgctattgattttgagcatgccggcctgg

SEQ ID NO: 147156 - DNA, 75 bp, Artificial Sequence
  Synthetic
ttatccttataattataacactactgctagtgaccagattttgattgagaatgcagctggtcaccgtgttgccat

SEQ ID NO: 147157 - DNA, 75 bp, Artificial Sequence
  Synthetic
tggcgaccatggccatgataatgaggcttatgagggttccgaggtcgaccaggccgaacctgcacaccttgatgt

SEQ ID NO: 147158 - DNA, 75 bp, Artificial Sequence
  Synthetic
ggttggtcaatgcttctaacccgggccatcgccctgggggtggcctctgccacgctttttaccaacgcttcccgg

SEQ ID NO: 147159 - DNA, 75 bp, Artificial Sequence
  Synthetic
agctcatacgtggagcttaccctaaaatccagaccacgagccgtgtgctacggtccctgttttggaatgaaccgg

SEQ ID NO: 147160 - DNA, 75 bp, Artificial Sequence
  Synthetic
gtcggggacctatgctgtccacgggcgccagctcgaggccctctacagggcacttaacatcccgcatgatattgc

SEQ ID NO: 147161 - DNA, 75 bp, Artificial Sequence
  Synthetic
gtcctttcgacgctcgtcggtaggtatggccgccgaacgaagctgtatgaagcggcccattctgatgttcgcgag

SEQ ID NO: 147162 - DNA, 75 bp, Artificial Sequence
  Synthetic
atggccgccgaacgaagctgtatgaagcggcccattctgatgttcgcgagtctttagggaggtttatccctacta

SEQ ID NO: 147163 - DNA, 75 bp, Artificial Sequence
  Synthetic
atgcagtggcccctgactatagggttgagcagaacccaaagaggcttgaggcagcataccgggaaacctgctccc

SEQ ID NO: 147164 - DNA, 75 bp, Artificial Sequence
  Synthetic
tgagcagaacccaaagaggcttgaggcagcataccgggaaacctgctcccgtcgcggcaccgcagcctatccgct

SEQ ID NO: 147165 - DNA, 75 bp, Artificial Sequence
  Synthetic
cagggttgtgcattccagtctactattgctgagcttcagcgtcttaaaatgaaggtaggtaaaacccgggagtct

SEQ ID NO: 147166 - DNA, 75 bp, Artificial Sequence
  Synthetic
tgtcatccaggactatgataaccaacacgagcaggaccgccccaccccctctccggccccttctcgccccttctc

SEQ ID NO: 147167 - DNA, 75 bp, Artificial Sequence
  Synthetic
ttgctgagcttcagcgtcttaaaatgaaggtaggtaaaacccgggagtcttaattaattccttttgtgccccctt

SEQ ID NO: 147168 - DNA, 75 bp, Artificial Sequence
  Synthetic
cttacgagctcacgcctgctggtttgcaggttaggatttcatctaatggcctggactgcactgccgtattccccc

SEQ ID NO: 147169 - DNA, 75 bp, Artificial Sequence
  Synthetic
tgagctctacttgactgagcccgccgcagcttggttcgaggctaacaaaccgatgcagccggcgcttacgataac

SEQ ID NO: 147170 - DNA, 75 bp, Artificial Sequence
  Synthetic
gcttggagtaagaccttctgtgctttattcggcccgtggttccgtgccattgagaaggagattctggctctgctc

SEQ ID NO: 147171 - DNA, 75 bp, Artificial Sequence
  Synthetic
tattcggcccgtggttccgtgccattgagaaggagattctggctctgctcccacctaacgttttttatggcgatg

SEQ ID NO: 147172 - DNA, 75 bp, Artificial Sequence
  Synthetic
cttttttcttgccggtggggaggttggccaccaccgcccttctgtgatacctcgcggtaaccctgatcagaacct

SEQ ID NO: 147173 - DNA, 75 bp, Artificial Sequence
  Synthetic
gccctctacaggtataacagattcacccagcggcattcgctgaccggcggtttgtggctacaccctgaggggttg

SEQ ID NO: 147174 - DNA, 75 bp, Artificial Sequence
  Synthetic
gcagcttggttcgaggctaacaaaccgatgcagccggcgcttacgataacggaggacacggcccgcacagctaac

SEQ ID NO: 147175 - DNA, 75 bp, Artificial Sequence
  Synthetic
cactatcaatttactgccggggttcccggctctggcaagtcaaggtccatacagcagggagatgtcgatgtggtg

SEQ ID NO: 147176 - DNA, 75 bp, Artificial Sequence
  Synthetic
cctccttgccctgagcttgagcagggcctgctctacatgccacaagagcttactgtgtctgacagtgtgcttgtt

SEQ ID NO: 147177 - DNA, 75 bp, Artificial Sequence
  Synthetic
agtttgacagtacccaaaacaatttctctcttggccttgagtgtgttattatggaggagtgtggcatgccccagt

SEQ ID NO: 147178 - DNA, 75 bp, Artificial Sequence
  Synthetic
ttctgggaggctggcaccaccaaggctggctacccttataattataatactactgctagtgaccagattttaatt

SEQ ID NO: 147179 - DNA, 75 bp, Artificial Sequence
  Synthetic
tgacaattccaatgttatgcatcggtgctttctcagaccggttggtagggacgtccagcgctggtactctgcccc

SEQ ID NO: 147180 - DNA, 75 bp, Artificial Sequence
  Synthetic
gcttttctagtgacttctccccccctgaggcggccgcccctgcaccggctgctgccccaaggccgtcctacccca

SEQ ID NO: 147181 - DNA, 75 bp, Artificial Sequence
  Synthetic
tttgagcttacagatatagtccactgccgcatggccgccccaagccagcgaaaggctgttctctcaacgcttgtg

SEQ ID NO: 147182 - DNA, 75 bp, Artificial Sequence
  Synthetic
acagcagggagatgtcgatgtggtggtcgtccccactcgggagctccgaaatagttggcgtcgccgaggttttgc

SEQ ID NO: 147183 - DNA, 75 bp, Artificial Sequence
  Synthetic
accgcacctgttgctgctacatatgcagcgggcctcttcggtccatctcctcggagacccaaatcagattcctgc

SEQ ID NO: 147184 - DNA, 75 bp, Artificial Sequence
  Synthetic
ctgcgctggccgctttggaggataccgttgactatcccgctcgtgctcatacttttgatgatttctgccctgagt

SEQ ID NO: 147185 - DNA, 75 bp, Artificial Sequence
  Synthetic
cccaccatcgggcctgtccgagccaccacatgtgagctgtacgagctggttgaagccatggtagagaagggtcag

SEQ ID NO: 147186 - DNA, 75 bp, Artificial Sequence
  Synthetic
ccgcccccgggcccgtcgggctgcccagccttcctgagcctccaccccccgtgcgtaagccaccggtgttgtcac

SEQ ID NO: 147187 - DNA, 75 bp, Artificial Sequence
  Synthetic
acgtccagcgctggtactctgcccccacccgcggccctgcagccaactgccgccgctccgcgctgcgtggcctcc

SEQ ID NO: 147188 - DNA, 75 bp, Artificial Sequence
  Synthetic
cagcgggcctcttcggtccatctcctcggagacccaaatcagattcctgccattgattttgaacatgctggtctg

SEQ ID NO: 147189 - DNA, 75 bp, Artificial Sequence
  Synthetic
gagctcatacgtggggcttatcctaagatccagaccacaagccgtgtgcgacggtccctgttctggaatgaaccg

SEQ ID NO: 147190 - DNA, 75 bp, Artificial Sequence
  Synthetic
catcacatttttccaaaaggactgcaataagtttacaactggtgaaactatcgcgcatggcaaggttggccaggg

SEQ ID NO: 147191 - DNA, 75 bp, Artificial Sequence
  Synthetic
attgtgactggctggtgaatgcttctaacccgggccatcgccctgggggtggcctctgccatgctttttaccaac

SEQ ID NO: 147192 - DNA, 75 bp, Artificial Sequence
  Synthetic
agatccagaccacaagccgtgtgcgacggtccctgttctggaatgaaccggcctctggccagaagttggttttta

SEQ ID NO: 147193 - DNA, 75 bp, Artificial Sequence
  Synthetic
caaccccggcagttggttttccgccctgaggtgctctggaatcaccctatccagcgggttatacataatgaattg

SEQ ID NO: 147194 - DNA, 75 bp, Artificial Sequence
  Synthetic
catgatgtttctatactccgtgcgtggattcgtacgactaaaatagttggtgaccatccgctggttatagagcgt

SEQ ID NO: 147195 - DNA, 75 bp, Artificial Sequence
  Synthetic
ccagcgggttatacataatgaattggaacagtactgccgggcccgggccggccgttgcctggaggttggggctca

SEQ ID NO: 147196 - DNA, 75 bp, Artificial Sequence
  Synthetic
caattatagctacggctgatgccaggggccttatccagtcatcccgggcgcatgctatagtcgcgcttacccggc

SEQ ID NO: 147197 - DNA, 75 bp, Artificial Sequence
  Synthetic
gggccttatccagtcatcccgggcgcatgctatagtcgcgcttacccggcacacagagaagtgtattattctaga

SEQ ID NO: 147198 - DNA, 75 bp, Artificial Sequence
  Synthetic
gcagcatacaccctgaccccgcgccctattattcatgcagtggcccccgactatagggttgagcagaacccgaag

SEQ ID NO: 147199 - DNA, 75 bp, Artificial Sequence
  Synthetic
tatccccgctcgacagaagtgtatgtccgatctatattcggccctggcggctctccgtctttgttcccgtcagcc

SEQ ID NO: 147200 - DNA, 75 bp, Artificial Sequence
  Synthetic
ctatccactccttggctcaggtatataccaggtccccgttggtctcagttttgatgcctgggagcgtaaccaccg

SEQ ID NO: 147201 - DNA, 75 bp, Artificial Sequence
  Synthetic
taccaggtccccgttggtctcagttttgatgcctgggagcgtaaccaccgccccggcgatgagctttacctgact

SEQ ID NO: 147202 - DNA, 75 bp, Artificial Sequence
  Synthetic
tggccaccaccgcccctccgtcatccctcgtggtaaccctgatcagaatttagggaccctacaagcctttccgcc

SEQ ID NO: 147203 - DNA, 75 bp, Artificial Sequence
  Synthetic
ccgcacttattgctttgatggattctcccgctgtgcttttgctgcagagaccggcgtggccctttactctctgca

SEQ ID NO: 147204 - DNA, 75 bp, Artificial Sequence
  Synthetic
cctcgtggtaaccctgatcagaatttagggaccctacaagcctttccgccgtcttgtcagatcagtgcctactat

SEQ ID NO: 147205 - DNA, 75 bp, Artificial Sequence
  Synthetic
ccggcgtggccctttactctctgcatgacctttggccagctgatgtcgcagaggctatggcccgccacgggatga

SEQ ID NO: 147206 - DNA, 75 bp, Artificial Sequence
  Synthetic
ctaacaagccgacgcagccggcactcacaataacggaagatacagcccgcacggccaacctagcattagagatcg

SEQ ID NO: 147207 - DNA, 75 bp, Artificial Sequence
  Synthetic
ggcctgctgtacatgccacaagagctcactgtgtccgatagtgtgctggtttttgagctcacgaatatggttcat

SEQ ID NO: 147208 - DNA, 75 bp, Artificial Sequence
  Synthetic
ggcacttaccacacaacctcgtatctcctgatccacgacggcgaccgtgccgtcgtaacttatgagggcgatact

SEQ ID NO: 147209 - DNA, 75 bp, Artificial Sequence
  Synthetic
tgccatcagcgctacctccgcacccaggcgatatctaagggtatgcgccggttggaggttgagcatgcccagaaa

SEQ ID NO: 147210 - DNA, 75 bp, Artificial Sequence
  Synthetic
aaggtccatacagcaaggggatgttgatgttgtggttgtccccacccgggagctccgcaatagttggcgccgccg

SEQ ID NO: 147211 - DNA, 75 bp, Artificial Sequence
  Synthetic
tcactgtgtccgatagtgtgctggtttttgagctcacgaatatggttcattgtcgcatgcccgccccaagccagc

SEQ ID NO: 147212 - DNA, 75 bp, Artificial Sequence
  Synthetic
tccgtgagtccttagccaggttcatccccactattggacctgtccaggccaccacatgtgagttatatgagttgg

SEQ ID NO: 147213 - DNA, 75 bp, Artificial Sequence
  Synthetic
agcgtgctgagcagctgcgtcttgctgtttgtgatttccttcgagggttgacgaatgttgcgcaggtttgtgttg

SEQ ID NO: 147214 - DNA, 75 bp, Artificial Sequence
  Synthetic
atttggccctggtggctccccatctttgttcccgtcagcctgctctactaaatctacttttcatgctgtcccggt

SEQ ID NO: 147215 - DNA, 75 bp, Artificial Sequence
  Synthetic
acgaatgttgcgcaggtttgtgttgatgttgtgtcccgtgtttatggagttagccccgggctggtacataacctt

SEQ ID NO: 147216 - DNA, 75 bp, Artificial Sequence
  Synthetic
tcgaagctatggtggagaagggccaggacggatctgccgtcttggagcttgacctttgcaatcgcgacgtctcgc

SEQ ID NO: 147217 - DNA, 75 bp, Artificial Sequence
  Synthetic
agaaggttgcgggtaaattctgctgcttcatgcggtggttaggacaggagtgcacctgtttcttggagccagccg

SEQ ID NO: 147218 - DNA, 75 bp, Artificial Sequence
  Synthetic
gctggcctggtccccgcaattcgccctgaacttgcaccaacgagttggtggcatgttacacatcgctgcccggcc

SEQ ID NO: 147219 - DNA, 75 bp, Artificial Sequence
  Synthetic
cgttttgttgttcacggctcatgacttacctccgtggtattagctacaaggtcactgtcggtgcgcttgttgcta

SEQ ID NO: 147220 - DNA, 75 bp, Artificial Sequence
  Synthetic
ccatctctttctggccccagactacaactacccctacttctgttgatatgaattctattacttctaccgatgtta

SEQ ID NO: 147221 - DNA, 75 bp, Artificial Sequence
  Synthetic
atcttgacgtctcggggacctatgctgtccatggccatcagcttgaggccctctatagggcactcaatattccgc

SEQ ID NO: 147222 - DNA, 75 bp, Artificial Sequence
  Synthetic
caagggtatgcgccggttggaggttgagcatgcccagaaattcatcacaaggctctacagctggctatttgagaa

SEQ ID NO: 147223 - DNA, 75 bp, Artificial Sequence
  Synthetic
gttcctgcatggtatttgaaaatgatttctcggagtttgacagcacccagaataatttctctcttggccttgagt

SEQ ID NO: 147224 - DNA, 75 bp, Artificial Sequence
  Synthetic
ggctctacagctggctatttgagaaatctggtcgtgattatatccccggccgccagcttcagttctatgcacaat

SEQ ID NO: 147225 - DNA, 75 bp, Artificial Sequence
  Synthetic
gaattccattacctccactgatgttaggattttagtccagcctggcatagcctctgagctggtcatcccgagtga

SEQ ID NO: 147226 - DNA, 75 bp, Artificial Sequence
  Synthetic
tcccgagctcatgctatagttgcactcacccgccacacagagaagtgcgttattttagatgcccctggtttgctg

SEQ ID NO: 147227 - DNA, 75 bp, Artificial Sequence
  Synthetic
ccgaacgacggtggttgatggcgctcatcttgaagcgaacggccctgagcaatatgttttatcgtttgatgcttc

SEQ ID NO: 147228 - DNA, 75 bp, Artificial Sequence
  Synthetic
tggagaccaaggccatgataatgaggcctatgagggttctgaggtcgacccggctgaacctgcacatcttgatgt

SEQ ID NO: 147229 - DNA, 75 bp, Artificial Sequence
  Synthetic
ttgtcaacaacttcttccttgctggcggagaggtgggccaccaccgcccctctgtgataccccgtggtaaccctg

SEQ ID NO: 147230 - DNA, 75 bp, Artificial Sequence
  Synthetic
atctaatggcctagactgcactgccgtgttcccccccggcggtgcccctagcgctgcgccaggggaggtagcggc

SEQ ID NO: 147231 - DNA, 75 bp, Artificial Sequence
  Synthetic
tacctgatgttgactcacgtggtgctattctgcgccggcagtataatttgtccacgtccccgcttacgtcatctg

SEQ ID NO: 147232 - DNA, 75 bp, Artificial Sequence
  Synthetic
cttcccgccatcctgtcaaattagcgcttaccaccagctggctgaggagctaggccatcgtccggctcctgttgc

SEQ ID NO: 147233 - DNA, 75 bp, Artificial Sequence
  Synthetic
accgcttagagtgccgtactgtgcttggtaataagacctttcggacaacggtggttgatggtgcccatcttgaag

SEQ ID NO: 147234 - DNA, 75 bp, Artificial Sequence
  Synthetic
cttttgcagtgctctctacaggtataacaggtttacccagcggcactcgttgaccggtggcctgtggctacatcc

SEQ ID NO: 147235 - DNA, 75 bp, Artificial Sequence
  Synthetic
cgtgttgccgcttttaagggtgatgattcggtggtcctctgcagtgactaccgacagagccgtaatgcggcagcc

SEQ ID NO: 147236 - DNA, 75 bp, Artificial Sequence
  Synthetic
ctcgagcagggcttgttgtacatgccacaagagcttacagtgtccgatagtgtgttggtctttgaactcacggat

SEQ ID NO: 147237 - DNA, 75 bp, Artificial Sequence
  Synthetic
cgagctacgatccgttaccgcccgctggtgccgaatgccgttggtggttatgctatttccatttctttctggcct

SEQ ID NO: 147238 - DNA, 75 bp, Artificial Sequence
  Synthetic
atagtccactgccgtatggccgccccaaaccagcggaaggccgtcctctcaacacttgtggggaggtatggccgt

SEQ ID NO: 147239 - DNA, 75 bp, Artificial Sequence
  Synthetic
tgaaaagaattggggccctggcccagagcgcgctgaacagctgcgccttgctgtttgtgacttccttcgaaggtt

SEQ ID NO: 147240 - DNA, 75 bp, Artificial Sequence
  Synthetic
acatttgggtgttaccaccgcccttggaagagtcccaggccgacgcggcccctgtatcacctgcccctgaacccg

SEQ ID NO: 147241 - DNA, 75 bp, Artificial Sequence
  Synthetic
gtccaggccactacatgtgagttatatgaattggttgaggccatggtggagaagggccaggacggctctgccgtc

SEQ ID NO: 147242 - DNA, 75 bp, Artificial Sequence
  Synthetic
gaagggccaggacggctctgccgtcttggagcttgacttatgtaaccgtgatgtttcgcgcatcacatttttcca

SEQ ID NO: 147243 - DNA, 75 bp, Artificial Sequence
  Synthetic
ggaccggcctaccccgtcgccggccccgtcccgccccttttcagtccttcgagccaatgatgtcctgtggctctc

SEQ ID NO: 147244 - DNA, 75 bp, Artificial Sequence
  Synthetic
ccccacctgttagtgacatttgggtgctgccaccaccctcagaggagtcccagatcgatgcggcacctgtgcccc

SEQ ID NO: 147245 - DNA, 75 bp, Artificial Sequence
  Synthetic
gctgccaccaccctcagaggagtcccagatcgatgcggcacctgtgccccctgtccctaagactgttggattgcc

SEQ ID NO: 147246 - DNA, 75 bp, Artificial Sequence
  Synthetic
aagactatgacaaccaacatgaacaggaccggcctaccccgtcgccggccccgtcccgccccttttcagtccttc

SEQ ID NO: 147247 - DNA, 75 bp, Artificial Sequence
  Synthetic
actacttacggctcgtcgaccaatcctatgtatgtttcagacactgtcacatttgttaatgtggcgacaggtgcc

SEQ ID NO: 147248 - DNA, 75 bp, Artificial Sequence
  Synthetic
tcaatgcttctaatccgggccatcgccccgggggtggcctctgtcatgctttctaccaacgcttccctgaggcgt

SEQ ID NO: 147249 - DNA, 75 bp, Artificial Sequence
  Synthetic
aaatactggccctgctcccgcctaatatcttttacggcgacgcttatgaggagtcggtgtttgctgcggccgtat

SEQ ID NO: 147250 - DNA, 75 bp, Artificial Sequence
  Synthetic
agaggcgttttacccaactgaattcattatgcgtgagggccttgcagcatataccctgaccccgcgccctatcat

SEQ ID NO: 147251 - DNA, 75 bp, Artificial Sequence
  Synthetic
tggcccccgactatagggttgagcagaatccaaagaggcttgaggcagcgtaccgagaaacctgctcccgtcgtg

SEQ ID NO: 147252 - DNA, 75 bp, Artificial Sequence
  Synthetic
gaatccaaagaggcttgaggcagcgtaccgagaaacctgctcccgtcgtggtactgctgcctacccacttcttgg

SEQ ID NO: 147253 - DNA, 75 bp, Artificial Sequence
  Synthetic
gtctcccgtcgtcgatctgccccagctggggctgcgccgctgactgctacatcaccagcccccgatacagcacct

SEQ ID NO: 147254 - DNA, 75 bp, Artificial Sequence
  Synthetic
gtgaccagattttgattgagaatgcagccggtcatcgtgttgccatatctacatatactactagtcttggtgccg

SEQ ID NO: 147255 - DNA, 75 bp, Artificial Sequence
  Synthetic
gtgcggtatgccccagtggttaatcaggttgtatcatctggtccggtcagcctggattctgcaggcgccgaagga

SEQ ID NO: 147256 - DNA, 75 bp, Artificial Sequence
  Synthetic
gtcgcctcgggtactaatctagtcctctatgctgccccgctgaaccctctcttacctcttcaggatggcaccaac

SEQ ID NO: 147257 - DNA, 75 bp, Artificial Sequence
  Synthetic
ttacctgaccgaacccgctgcagcttggtttgaagctaacaaaccaatgcagccagcacttacgataacggagga

SEQ ID NO: 147258 - DNA, 75 bp, Artificial Sequence
  Synthetic
agccagcacttacgataacggaggatacggcccgtacggccaacctagcgctagagatcgacgccgccacagagg

SEQ ID NO: 147259 - DNA, 75 bp, Artificial Sequence
  Synthetic
gcccgccccctcccgccctttctcagtgcttcgtgccaatgatgttctgtggctttccctcactgccgctgagta

SEQ ID NO: 147260 - DNA, 75 bp, Artificial Sequence
  Synthetic
tcgagctacgatccgttaccgcccgctggtgcccaatgctgtcggcggttacgccatctctatttccttctggcc

SEQ ID NO: 147261 - DNA, 75 bp, Artificial Sequence
  Synthetic
gtgcttcgtgccaatgatgttctgtggctttccctcactgccgctgagtacgatcagactacgtatgggtcgtcc

SEQ ID NO: 147262 - DNA, 75 bp, Artificial Sequence
  Synthetic
ggctcaaattgaaggttgattaccgccctattgggctgtatgctggtgtggtagtggctcccggcctggggacac

SEQ ID NO: 147263 - DNA, 75 bp, Artificial Sequence
  Synthetic
cgggagtcttaattaatttcccccctttgtgcccccttctaaattttgctctgttatttctttttttttctgcgt

SEQ ID NO: 147264 - DNA, 75 bp, Artificial Sequence
  Synthetic
cccacccgggaacttcgcaacagctggcgtcgccgaggctttgcggccttcacaccccatacggcggcccgcgtt

SEQ ID NO: 147265 - DNA, 75 bp, Artificial Sequence
  Synthetic
ttcatggctcccctgttaattcttacactaatacaccttatactggtgcattggggcttcttgattttgcgttgg

SEQ ID NO: 147266 - DNA, 75 bp, Artificial Sequence
  Synthetic
gcctcttcggtccatctcctcggtgacccaaatcagatccctgctattgactttgaacatgcaggtttggtcccc

SEQ ID NO: 147267 - DNA, 75 bp, Artificial Sequence
  Synthetic
cggctacccgtacaattataatactaccgctagtgaccaaattctgattgagaacgcggccggccaccgtgtcgc

SEQ ID NO: 147268 - DNA, 75 bp, Artificial Sequence
  Synthetic
ctgcccggccgacgtatgtgagcttatacgtggggcttatcctaaaatccagaccacgagtcgtgtgctacggtc

SEQ ID NO: 147269 - DNA, 75 bp, Artificial Sequence
  Synthetic
tgctctcgccgttcttgaggatactattgactaccctgcccgtgctcatacttttgatgatttttgcccggagtg

SEQ ID NO: 147270 - DNA, 75 bp, Artificial Sequence
  Synthetic
gccctagggctgttctgttgctgttcttcgtgcttctgcctatgctgcccgcgccaccggccggccagccgtctg

SEQ ID NO: 147271 - DNA, 75 bp, Artificial Sequence
  Synthetic
ttacccccttgcccggagcttgagcagggcctgctctacatgccacaagagcttactgtgtccgatagtgtgttg

SEQ ID NO: 147272 - DNA, 75 bp, Artificial Sequence
  Synthetic
ggccagaagttggtctttacgcaggcggctaaagctgctaaccctggtgcgattacggtccatgaagcccagggt

SEQ ID NO: 147273 - DNA, 75 bp, Artificial Sequence
  Synthetic
attgccgtatggccgctccaagccagcgaaaggctgttctctcaacacttgtcgggaggtatggccgtagaacga

SEQ ID NO: 147274 - DNA, 75 bp, Artificial Sequence
  Synthetic
tcggcgggctgccgacagaattaatttcgtcggccgggggtcaactgttctactcccgccctgttgtctcagcca

SEQ ID NO: 147275 - DNA, 75 bp, Artificial Sequence
  Synthetic
caaaacccgggagtcttaattaattccttttgtgcccccttcgtagtttcctctgctttatttcttatttctgcc

SEQ ID NO: 147276 - DNA, 75 bp, Artificial Sequence
  Synthetic
ttcgtcggccgggggtcaactgttctactcccgccctgttgtctcagccaatggcgagccaaccgtaaagttata

SEQ ID NO: 147277 - DNA, 75 bp, Artificial Sequence
  Synthetic
gattacggtccatgaagcccagggtgccacctttacagagaccacaatcatagccacggctgacgctaggggcct

SEQ ID NO: 147278 - DNA, 75 bp, Artificial Sequence
  Synthetic
ccaccacatgtgagttgtatgagttggttgaggccatggtggagaagggtcaggacggctctgccgtcctagagc

SEQ ID NO: 147279 - DNA, 75 bp, Artificial Sequence
  Synthetic
cggtctgctgcgtgaagttggcatatcggatgtgattgtcaacaatttcttccttgctggtggggaggtgggcca

SEQ ID NO: 147280 - DNA, 75 bp, Artificial Sequence
  Synthetic
ggttatccaggactacgataaccaacatgagcaagatcgacctactccgtcacctgctccctcccgccccttctc

SEQ ID NO: 147281 - DNA, 75 bp, Artificial Sequence
  Synthetic
tcggatgtgattgtcaacaatttcttccttgctggtggggaggtgggccatcaccgcccttctgtgataccccgt

SEQ ID NO: 147282 - DNA, 75 bp, Artificial Sequence
  Synthetic
gccgaggagctaggccatcgcccggcccctgttgctgccgtcttgcccccctgccctgagcttgagcagggtctg

SEQ ID NO: 147283 - DNA, 75 bp, Artificial Sequence
  Synthetic
caccaaccctatgtatgtctccgatacagtcacatttgtcaatgtggccaccggtgctcaggctgttgcccgttc

SEQ ID NO: 147284 - DNA, 75 bp, Artificial Sequence
  Synthetic
acagtcacatttgtcaatgtggccaccggtgctcaggctgttgcccgttcccttgactggtctaaagttacttta

SEQ ID NO: 147285 - DNA, 75 bp, Artificial Sequence
  Synthetic
acttgatgcagccccggcagcttgttttccggcctgaggttttgtggaatcacccaattcagcgtgtgatccaca

SEQ ID NO: 147286 - DNA, 75 bp, Artificial Sequence
  Synthetic
tttccggcctgaggttttgtggaatcacccaattcagcgtgtgatccacaacgagcttgagcagtattgccgagc

SEQ ID NO: 147287 - DNA, 75 bp, Artificial Sequence
  Synthetic
ttgtacatgccacaagagcttacagtatccgacagtgtcttggttttcgaactcacggatatagtccactgccgt

SEQ ID NO: 147288 - DNA, 75 bp, Artificial Sequence
  Synthetic
cacccaattcagcgtgtgatccacaacgagcttgagcagtattgccgagcccgggccgggcgctgtcttgaggtg

SEQ ID NO: 147289 - DNA, 75 bp, Artificial Sequence
  Synthetic
ttctgggaggctggcacgaccaaggctggctacccttataattacaatacaactgctagtgaccaaattctaatt

SEQ ID NO: 147290 - DNA, 75 bp, Artificial Sequence
  Synthetic
cacttcggcagtaccccaaccttcagtccctgaacaggccgcgccattgccggattcggttgacggcggtgctgc

SEQ ID NO: 147291 - DNA, 75 bp, Artificial Sequence
  Synthetic
gttcagcggtggtataccgctcctacccgtggccctgcagcaaattgccggcggtccgctctccgcgggcttcca

SEQ ID NO: 147292 - DNA, 75 bp, Artificial Sequence
  Synthetic
ctggtcatccccagtgagcgtcttcattatcgcaatcaaggttggcgctctgtcgagaccactggtgtcgccgag

SEQ ID NO: 147293 - DNA, 75 bp, Artificial Sequence
  Synthetic
gggtgctggtcccacgtcaatttctgcggtcggtgtgttagccccacactcggcccttgctgtacttgaggacac

SEQ ID NO: 147294 - DNA, 75 bp, Artificial Sequence
  Synthetic
ccatggtggagaagggtcaagacggctctgccgtcctggagcttgatctctgtaaccgtgatgtctcgcgcatta

SEQ ID NO: 147295 - DNA, 75 bp, Artificial Sequence
  Synthetic
cccgtggccctgcagcaaattgccggcggtccgctctccgcgggcttccacctgtcgatcggacttattgtttcg

SEQ ID NO: 147296 - DNA, 75 bp, Artificial Sequence
  Synthetic
cgtgaccagtcccagcgcccctccgctgccccccgccgtcgatctgccccagctggggctgcgccgttgaccgct

SEQ ID NO: 147297 - DNA, 75 bp, Artificial Sequence
  Synthetic
gtaaaacccgggagtcttaattaattctttctgtgcccccttcgtagatctcttctgctatatttcttttttctg

SEQ ID NO: 147298 - DNA, 75 bp, Artificial Sequence
  Synthetic
cgacgggactgctgagcttactactacagcggccacgcgttttatgaaggacttgcatttcaccggtacgaatgg

SEQ ID NO: 147299 - DNA, 75 bp, Artificial Sequence
  Synthetic
ctgtgcctgatgttgattcacgcggtgctatcctgcgccggcagtacaatctgtccacgtccccgctcacgtcat

SEQ ID NO: 147300 - DNA, 75 bp, Artificial Sequence
  Synthetic
gccgctgtgtctggggcgggctcttgcatggtgtttgaaaatgatttctcggaatttgatagtactcagaataat

SEQ ID NO: 147301 - DNA, 75 bp, Artificial Sequence
  Synthetic
gttcgagctacgatccgttatcgcccgttggtgccgaatgcagttggcggttatgctatttctatttctttttgg

SEQ ID NO: 147302 - DNA, 75 bp, Artificial Sequence
  Synthetic
ccgggctgtgggatgtcacttcgtgctcctcctcacagctgcacctgagccgtcaccgatgccctatgttccata

SEQ ID NO: 147303 - DNA, 75 bp, Artificial Sequence
  Synthetic
atacgcttctcggcggcctgccgacagaattgatttcgtcggctgggggtcagctgttttactcccgccctgttg

SEQ ID NO: 147304 - DNA, 75 bp, Artificial Sequence
  Synthetic
ggcaccctcctctggaataccgtctggaacatggcgatcatagcacattgctatgattttcgtgatttccgggtt

SEQ ID NO: 147305 - DNA, 75 bp, Artificial Sequence
  Synthetic
ccctttttcagttcttcgtgctaacgacgttttgtggctatctcttactgcagccgagtacgaccagactacgta

SEQ ID NO: 147306 - DNA, 75 bp, Artificial Sequence
  Synthetic
gcaggctgcgggctcaaactgaaggttgattatcgccctattgggctgtatgctggtgtagtggtggcccctggt

SEQ ID NO: 147307 - DNA, 75 bp, Artificial Sequence
  Synthetic
tgtcgccaacgagggctggaatgcttctgaagatgcattgactgctgtaatcactgctgcctatttaactatttg

SEQ ID NO: 147308 - DNA, 75 bp, Artificial Sequence
  Synthetic
tctgaagatgcattgactgctgtaatcactgctgcctatttaactatttgtcaccagaggtacctccgcacgcaa

SEQ ID NO: 147309 - DNA, 75 bp, Artificial Sequence
  Synthetic
cgacctttggcctgccgatgttgcggaggcaatggcccgccatggcatgactcggttgtatgcagccctccatct

SEQ ID NO: 147310 - DNA, 75 bp, Artificial Sequence
  Synthetic
ctcggttgtatgcagccctccatcttcccccggaggtattactcccccctggcacttaccataccacctcatacc

SEQ ID NO: 147311 - DNA, 75 bp, Artificial Sequence
  Synthetic
tcccccggaggtattactcccccctggcacttaccataccacctcatacctcctaattcatgatggggaccgtgc

SEQ ID NO: 147312 - DNA, 75 bp, Artificial Sequence
  Synthetic
tccctggtcgccagttggagttttatgcccagtgtcgccggtggctatctgctggcttccatctcgatccccggg

SEQ ID NO: 147313 - DNA, 75 bp, Artificial Sequence
  Synthetic
ctacgatacaactgctagtgatcaaattttaatcgaaaatgcagccggccatcgtgttgctatctctacctatac

SEQ ID NO: 147314 - DNA, 75 bp, Artificial Sequence
  Synthetic
tgtggctctccctcaccgccgctgagtatgaccagactacgtatgggtcgtccaccaaccctatgtatgtctccg

SEQ ID NO: 147315 - DNA, 75 bp, Artificial Sequence
  Synthetic
attttaatcgaaaatgcagccggccatcgtgttgctatctctacctataccactagcctgggtgccggccccacc

SEQ ID NO: 147316 - DNA, 75 bp, Artificial Sequence
  Synthetic
tatcatacagcgggtggaatgaataacatgtcttgtgcatcgcccatgggatcaccatgcgccctagggctgttc

SEQ ID NO: 147317 - DNA, 75 bp, Artificial Sequence
  Synthetic
tcatgcggtggcttggccaggactgcacttgttttctccagcccattgaggggagggttggtgaacagggctatg

SEQ ID NO: 147318 - DNA, 75 bp, Artificial Sequence
  Synthetic
gccactctggacgaccaagccttttgctgctcgcggcttatgacctatctccgtgggattagttacaaggtgacc

SEQ ID NO: 147319 - DNA, 75 bp, Artificial Sequence
  Synthetic
ctttttccatctgcctgctcgactaagtcaacatttcatgccgtccctgtgcatatatgggacaggcttatgctt

SEQ ID NO: 147320 - DNA, 75 bp, Artificial Sequence
  Synthetic
agtcaacatttcatgccgtccctgtgcatatatgggacaggcttatgctttttggagcgacccttgatgaccagg

SEQ ID NO: 147321 - DNA, 75 bp, Artificial Sequence
  Synthetic
tttctggggtgacagggttgattctcagcccttcgccctcccctatattcatccaaccaaccccttcgccgccga

SEQ ID NO: 147322 - DNA, 75 bp, Artificial Sequence
  Synthetic
ttgagaacgcggccggccaccgtgtcgctatttctacctatactactagcttgggtgccggccctacctcgatct

SEQ ID NO: 147323 - DNA, 75 bp, Artificial Sequence
  Synthetic
ttaattaattcttcctgtacccccttcgcggtttctttttgctttatttcttttttctgcttttcgcgctccctg

SEQ ID NO: 147324 - DNA, 75 bp, Artificial Sequence
  Synthetic
ttactggtagccagttacagcccctctaccaagcactcggcataccctccgatctcgccgctcgtgcaagccggc

SEQ ID NO: 147325 - DNA, 75 bp, Artificial Sequence
  Synthetic
ctaccaagcactcggcataccctccgatctcgccgctcgtgcaagccggcttactgctactgttgaggtctctga

SEQ ID NO: 147326 - DNA, 75 bp, Artificial Sequence
  Synthetic
gctggaggccaatgggccagagcaatatgtcttgtcatttgatccggcgaaacaaactatggcagcaggcccgca

SEQ ID NO: 147327 - DNA, 75 bp, Artificial Sequence
  Synthetic
tatgtcttgtcatttgatccggcgaaacaaactatggcagcaggcccgcatagtcttagctacaccttgacacct

SEQ ID NO: 147328 - DNA, 75 bp, Artificial Sequence
  Synthetic
tctgctgccggggaggtgtctgccttctgctcggccctatataggttcaaccgctgtgttcaacggcattccctt

SEQ ID NO: 147329 - DNA, 75 bp, Artificial Sequence
  Synthetic
gccgccggtggttatctgccggcttccatcttgatcctcgggtacttgtatttgatgaggcggccccctgtcgtt

SEQ ID NO: 147330 - DNA, 75 bp, Artificial Sequence
  Synthetic
acccacgttcgatcaacgacaaccccaacgtcttgcatcgctgttttttaaaaccagttggccgcgatgtccagc

SEQ ID NO: 147331 - DNA, 75 bp, Artificial Sequence
  Synthetic
attatggctaccgaggcatctaattatgcccagtatcgggtggtccgagccacaatccgttatcgcccgctggtg

SEQ ID NO: 147332 - DNA, 75 bp, Artificial Sequence
  Synthetic
tctgctcggccctatataggttcaaccgctgtgttcaacggcattcccttatcggaggcctgtggtaccaccctg

SEQ ID NO: 147333 - DNA, 75 bp, Artificial Sequence
  Synthetic
gcccttcgtggcctcccgcctgttgaccggacatattgctttgacggtttttccggttgcacatttgccgccgag

SEQ ID NO: 147334 - DNA, 75 bp, Artificial Sequence
  Synthetic
gcaccctctacactcggacctggtcggtctcgggcttttctagttgtttctcaccgctcgagcactgcaccccga

SEQ ID NO: 147335 - DNA, 75 bp, Artificial Sequence
  Synthetic
ggtctcgggcttttctagttgtttctcaccgctcgagcactgcaccccgagcgtgttgccccccgttgaggctag

SEQ ID NO: 147336 - DNA, 75 bp, Artificial Sequence
  Synthetic
cgctcgtgcaagccgactcactgctaccgttgaggtttctgatgctgatggccgtcttacctgtaagactactat

SEQ ID NO: 147337 - DNA, 75 bp, Artificial Sequence
  Synthetic
acctctatccgacccagttgataatagtattagccctaccccacctagtgctcccattgcgcctccggcgccggt

SEQ ID NO: 147338 - DNA, 75 bp, Artificial Sequence
  Synthetic
agtattagccctaccccacctagtgctcccattgcgcctccggcgccggtgctgtctgtaacccacctatccgga

SEQ ID NO: 147339 - DNA, 75 bp, Artificial Sequence
  Synthetic
tccctcctgaggtgctgctcccccctggtacctatcataccacctcgtacctactcatccatgatggggaccgtg

SEQ ID NO: 147340 - DNA, 75 bp, Artificial Sequence
  Synthetic
gtcatttgatccggcgaaacaaactatggcagcaggtccacatagtcttagttacactctgacatctgctggcct

SEQ ID NO: 147341 - DNA, 75 bp, Artificial Sequence
  Synthetic
acctggctggttaatgcatctaaccccggtcaccgccctggtggtggcctttgccatgctttctatcaacggttc

SEQ ID NO: 147342 - DNA, 75 bp, Artificial Sequence
  Synthetic
tttatgaaagacctgcatttcactggtacgaatggggttggtgaggtgggccgaggcattgctttgaccttgttt

SEQ ID NO: 147343 - DNA, 75 bp, Artificial Sequence
  Synthetic
attcatgctgtcgctcctgactatcgggtcgaacataaccccaaacggctcgaggccgcctatcgggagacctgc

SEQ ID NO: 147344 - DNA, 75 bp, Artificial Sequence
  Synthetic
cctatggtatcaccctgaggggcttgttggcctgttcccaccgttctcccccggccatagttgggagtctgctaa

SEQ ID NO: 147345 - DNA, 75 bp, Artificial Sequence
  Synthetic
agccgactgtaaagctatatacatctgttgagaatgcgcagcaggacaagggcattaccatcccgcacgacatag

SEQ ID NO: 147346 - DNA, 75 bp, Artificial Sequence
  Synthetic
cgaaccttgtgtcccgagtatgccacctcccgcggaggttaatacacctgtggtcttagatgccctaccttcaga

SEQ ID NO: 147347 - DNA, 75 bp, Artificial Sequence
  Synthetic
cctcccgcggaggttaatacacctgtggtcttagatgccctaccttcagagattatggagccggcccaacctcca

SEQ ID NO: 147348 - DNA, 75 bp, Artificial Sequence
  Synthetic
tggcaccaacacccatattatggctaccgaggcatctaattatgcccagtaccgggtggttcgagctacaatccg

SEQ ID NO: 147349 - DNA, 75 bp, Artificial Sequence
  Synthetic
ctccctctcgccctttctcagttcttcgtgccaatgatgtcctgtggctatccctcactgttgctgagtacgatc

SEQ ID NO: 147350 - DNA, 75 bp, Artificial Sequence
  Synthetic
gaatctggcgcttgagctggacgcggccactgaggtgggccgtgcgtgtgctggctgtcgtgtggaacccggtgt

SEQ ID NO: 147351 - DNA, 75 bp, Artificial Sequence
  Synthetic
tgagcacgcacagaagttcataacacgtctttacagctggttgtttgaaaaatctggccgtgattacattcccgg

SEQ ID NO: 147352 - DNA, 75 bp, Artificial Sequence
  Synthetic
agactacgtatgggtcgtccaccaaccctatgtatgtctcggatacagctacatttgtcaacgtggctactggtg

SEQ ID NO: 147353 - DNA, 75 bp, Artificial Sequence
  Synthetic
gcacctccggcaccggcgctgcctgtaacccacctatctgggccccgccggcggttgcttcatacttaccctgac

SEQ ID NO: 147354 - DNA, 75 bp, Artificial Sequence
  Synthetic
gatagtggtgccaactcgtgagttgcgcaattcgtggcgccgccgcgggttcgcagcttacacacctcacacggc

SEQ ID NO: 147355 - DNA, 75 bp, Artificial Sequence
  Synthetic
ctttgatgaagcggccccttgtcgctgccgtagtttccttcgtaaagctgctcatagattttgttgttttatgcg

SEQ ID NO: 147356 - DNA, 75 bp, Artificial Sequence
  Synthetic
attctaagacattctatgtcctcccgctccgcggtaagctgtctttctgggaggctggcacgaccaaggctggct

SEQ ID NO: 147357 - DNA, 75 bp, Artificial Sequence
  Synthetic
tgccgtagtttccttcgtaaagctgctcatagattttgttgttttatgcggtggctgggccaggattgtacctgt

SEQ ID NO: 147358 - DNA, 75 bp, Artificial Sequence
  Synthetic
ggttaatgcatccaaccccggtcaccgccccggtggcggtctctgtcatgccttctaccagcggttcccagaatc

SEQ ID NO: 147359 - DNA, 75 bp, Artificial Sequence
  Synthetic
cgcaattcgtggcgccgccgcgggttcgcagcttacacacctcacacggcagctcgtgtgacccgtggccgcagg

SEQ ID NO: 147360 - DNA, 75 bp, Artificial Sequence
  Synthetic
cttcttggtgaccctaatcaaatccctgctattgattttgaacatgccggccttgtaccagcaatccagcctgag

SEQ ID NO: 147361 - DNA, 75 bp, Artificial Sequence
  Synthetic
cccgctgaggaggccactgtgaacatctctggatcatatattgtcaccggtagccagctacagcctctctaccag

SEQ ID NO: 147362 - DNA, 75 bp, Artificial Sequence
  Synthetic
cagccctacctctatctctgcggtcggtgtgttggccccgcactcggcccttgctgttctcgaggatactgttga

SEQ ID NO: 147363 - DNA, 75 bp, Artificial Sequence
  Synthetic
tagccagctacagcctctctaccaggcgcttggcatcccttctgatcttgccgcccgagcgggtcggcttactgc

SEQ ID NO: 147364 - DNA, 75 bp, Artificial Sequence
  Synthetic
tctctggatcatatattgtcaccggtagccagctacagcctctctaccaggcgcttggcatcccttctgatcttg

SEQ ID NO: 147365 - DNA, 75 bp, Artificial Sequence
  Synthetic
ttgggttgagcttcgatgcttgggagcgtaaccatcgacctggggatgaactatatctgactgagccagccatag

SEQ ID NO: 147366 - DNA, 75 bp, Artificial Sequence
  Synthetic
ctgctattgattttgaacatgccggccttgtaccagcaatccagcctgagctagtccctacaaagtggtggcacc

SEQ ID NO: 147367 - DNA, 75 bp, Artificial Sequence
  Synthetic
tccttcgctccctgttctggggggaaccccctgtgggtcagaagctggtattcacccaggcggcaaaggctgcga

SEQ ID NO: 147368 - DNA, 75 bp, Artificial Sequence
  Synthetic
ttggcaataagacctttacaacagtttttactgatggtgctcagctagaggctaacgggccggagcagtgtgtgc

SEQ ID NO: 147369 - DNA, 75 bp, Artificial Sequence
  Synthetic
cccgggagtcttaattaattctttctgtacccccttcgtagttcccttttgctttatttttcttttctgccttcc

SEQ ID NO: 147370 - DNA, 75 bp, Artificial Sequence
  Synthetic
gatacggcccgtacagcgaatctggcgcttgagctggatgcggccacagaggtgggccgtgcgtgtgttggctgt

SEQ ID NO: 147371 - DNA, 75 bp, Artificial Sequence
  Synthetic
agctcagggtgcaacattcaccgagacaacgattattgccacggctgatgcccgtgggctgatccaatcatctag

SEQ ID NO: 147372 - DNA, 75 bp, Artificial Sequence
  Synthetic
tatggccgccggcccgcacagtcttagctatgctttgacatctgcgggccttgaggtgcgcgttgtctctgccgg

SEQ ID NO: 147373 - DNA, 75 bp, Artificial Sequence
  Synthetic
gctaacgggccggagcagtgtgtgctgtcgtttgacccggccaagcaaactatggccgccggcccgcacagtctt

SEQ ID NO: 147374 - DNA, 75 bp, Artificial Sequence
  Synthetic
gattgagattctcattaacctaatgcaacctcgccagcttgttttccgccccgaggttttctggaatcatcccat

SEQ ID NO: 147375 - DNA, 75 bp, Artificial Sequence
  Synthetic
agatcggccaacatcgtccgtcggttataccgcgcggcattattaatgacaatgttaatacacttgatgctttcc

SEQ ID NO: 147376 - DNA, 75 bp, Artificial Sequence
  Synthetic
tgatgaggccccttcactcccaccacatctgcttctgttgcacatgcagcgggcctcatcagtccatctccttgg

SEQ ID NO: 147377 - DNA, 75 bp, Artificial Sequence
  Synthetic
ctggtatactgctcccactcgcggaccggctgctaattgccggcgttctgcactgcgtgggctccctgctgccga

SEQ ID NO: 147378 - DNA, 75 bp, Artificial Sequence
  Synthetic
agatgcccggcggatgtctgtgagctaatccgcggtgcatacccgaagatccagactgcaagccgcgtcctccgc

SEQ ID NO: 147379 - DNA, 75 bp, Artificial Sequence
  Synthetic
tcacttttgagctcacggacatagtgcactgccgtatggcagcgcccagccagcgcaaggcggtcctgtcaactc

SEQ ID NO: 147380 - DNA, 75 bp, Artificial Sequence
  Synthetic
ttgtcggcaggtacggccgacgtactaaattgtacgaggccgcacacgcagatgtccgcggatctctgaatcatt

SEQ ID NO: 147381 - DNA, 75 bp, Artificial Sequence
  Synthetic
cgacatgtcgccgtctgatgtcgccgaggccatgttccgtcatggcatgacgcggctttatgctgccctccatct

SEQ ID NO: 147382 - DNA, 75 bp, Artificial Sequence
  Synthetic
gaggccatgttccgtcatggcatgacgcggctttatgctgccctccatctcccgcccgaggttctactgcctccc

SEQ ID NO: 147383 - DNA, 75 bp, Artificial Sequence
  Synthetic
gcaatcactgttcatgaagcccagggtgcgacattcactgagactacgattattgccacggcagacgctcgtggg

SEQ ID NO: 147384 - DNA, 75 bp, Artificial Sequence
  Synthetic
taaattgtacgaggccgcacacgcagatgtccgcggatctctgaatcatttcattcctgagctcggccctattag

SEQ ID NO: 147385 - DNA, 75 bp, Artificial Sequence
  Synthetic
gcttgatctatgcagccgtgatgtgtcccggataacattcttccagaaggattgtaataaatttacaacgggtga

SEQ ID NO: 147386 - DNA, 75 bp, Artificial Sequence
  Synthetic
agtgctggttataatcatgatgtttctaatctacgttcctggattaggaccactaaggtcaccggggaccatcct

SEQ ID NO: 147387 - DNA, 75 bp, Artificial Sequence
  Synthetic
ctaatctacgttcctggattaggaccactaaggtcaccggggaccatcctctcgttatcgagcgggttagggcca

SEQ ID NO: 147388 - DNA, 75 bp, Artificial Sequence
  Synthetic
ttgacaccccgacccattatccatgctgttgcccctgattatcgggtggaacataaccctaagaggctcgaggct

SEQ ID NO: 147389 - DNA, 75 bp, Artificial Sequence
  Synthetic
gtggcactattgataacaatgttgacacacttgatgccttcccgccctcttgccagtttagtgcttaccaccagt

SEQ ID NO: 147390 - DNA, 75 bp, Artificial Sequence
  Synthetic
ctggcagtgcttgcacctaatgtgttttatggtgatgcatatgaggacacagtcttggccgctgctgttgccggt

SEQ ID NO: 147391 - DNA, 75 bp, Artificial Sequence
  Synthetic
ccaccgaggtctatgtccgatcaatctttggcccgggtggaaccccctcattgtttccaacctcgtgctccacta

SEQ ID NO: 147392 - DNA, 75 bp, Artificial Sequence
  Synthetic
ttgtttccaacctcgtgctccactaagtcaaccttccatgctgtccctgtccatatctgggaccgtcttatgttg

SEQ ID NO: 147393 - DNA, 75 bp, Artificial Sequence
  Synthetic
gagtgtataatcatggaagagtgtggcatgccgcagtggatgatccggctctatcacctcgttcgctctgcttgg

SEQ ID NO: 147394 - DNA, 75 bp, Artificial Sequence
  Synthetic
ctctccccgcgcttactattactgaggacacagcacgaacagcgaacctggctcttgagttagattcagccactg

SEQ ID NO: 147395 - DNA, 75 bp, Artificial Sequence
  Synthetic
gttactgtcggcacccttgtggccaatgagggctggaacgcctccgaggacgccctcacagctgtcattactgcc

SEQ ID NO: 147396 - DNA, 75 bp, Artificial Sequence
  Synthetic
tgcgaggcttctggaagaaacactctggtgagcctggcaccctattatggaataccgtttggaacatggctgtca

SEQ ID NO: 147397 - DNA, 75 bp, Artificial Sequence
  Synthetic
aggtcggcagggcgtgtgccggctgtcgtgtcgagccgggtgttgtccattaccagttcacagcaggtgtccctg

SEQ ID NO: 147398 - DNA, 75 bp, Artificial Sequence
  Synthetic
tgggtccctgaatcactttattcctgagcttggccccattaatgttaccacctgtgagctttatgagcttgtgga

SEQ ID NO: 147399 - DNA, 75 bp, Artificial Sequence
  Synthetic
tcgtgtcgagccgggtgttgtccattaccagttcacagcaggtgtccctggctccggcaagtcacggtcaattca

SEQ ID NO: 147400 - DNA, 75 bp, Artificial Sequence
  Synthetic
tgctttgattgctggttgtgggttgaagcttaaggtagattttaggcctattgggttgtacgctggtgtggttgt

SEQ ID NO: 147401 - DNA, 75 bp, Artificial Sequence
  Synthetic
ttatacaccacacaccgcggcccgtgttacctgtggccgtagggttgttattgacgaggccccgtcgcttccacc

SEQ ID NO: 147402 - DNA, 75 bp, Artificial Sequence
  Synthetic
ttgacgaggccccgtcgcttccaccacatttacttttgctgcatatgcagcgagcctcgtcggttcatctccttg

SEQ ID NO: 147403 - DNA, 75 bp, Artificial Sequence
  Synthetic
ccatcttgacccacgggtgttggtttttgacgagtcggtcccctgccactgtaggaccacgatccgcagggttgc

SEQ ID NO: 147404 - DNA, 75 bp, Artificial Sequence
  Synthetic
tttgacgagtcggtcccctgccactgtaggaccacgatccgcagggttgcttcaaagttctgttgcttcatgaag

SEQ ID NO: 147405 - DNA, 75 bp, Artificial Sequence
  Synthetic
gctttgtttggcccctggttccgcgctattgagaaagaaattctggcagcgcttgcacctaatgttttctacggt

SEQ ID NO: 147406 - DNA, 75 bp, Artificial Sequence
  Synthetic
caacaaagtggtggcaccttactcataggtgtcctgcggatgtttgtgagctaatccgcggcgcgtacccaaaga

SEQ ID NO: 147407 - DNA, 75 bp, Artificial Sequence
  Synthetic
taggtgtcctgcggatgtttgtgagctaatccgcggcgcgtacccaaagatccagacggcaagccgagttctccg

SEQ ID NO: 147408 - DNA, 75 bp, Artificial Sequence
  Synthetic
gcttatgagggctctgatgttgaccctgccgaatctgccacctgtgacatatctgggtcctacgtggtgcctggt

SEQ ID NO: 147409 - DNA, 75 bp, Artificial Sequence
  Synthetic
ctgccgaatctgccacctgtgacatatctgggtcctacgtggtgcctggtgctgccctccagccgctctaccagg

SEQ ID NO: 147410 - DNA, 75 bp, Artificial Sequence
  Synthetic
aatcatggaggagtgtggcatgccgcagtggatgattcggctctatcatctcgtccgctccgcctggattttgca

SEQ ID NO: 147411 - DNA, 75 bp, Artificial Sequence
  Synthetic
tgcaattacagtccacgaggcccagggtgctacatttactgagactactattattgcaacggctgatgcccgcgg

SEQ ID NO: 147412 - DNA, 75 bp, Artificial Sequence
  Synthetic
ggcggattgactgcgagacctatcttggtaataaaactttccgcacgtcgttcgtcgacggagcggttttagaga

SEQ ID NO: 147413 - DNA, 75 bp, Artificial Sequence
  Synthetic
tggtaataaaactttccgcacgtcgttcgtcgacggagcggttttagagactaatggcccagagcgcctcaatct

SEQ ID NO: 147414 - DNA, 75 bp, Artificial Sequence
  Synthetic
cagagaaatgtgtggtcgttgacgccccggggcttcttcgtgaggttggcatttcagatgccattgttaataact

SEQ ID NO: 147415 - DNA, 75 bp, Artificial Sequence
  Synthetic
tgttgtgctttgtagtgactaccggcagagtcgtgatgcagctgttttgatcgcaggttgtggcttgaagcttaa

SEQ ID NO: 147416 - DNA, 75 bp, Artificial Sequence
  Synthetic
tgttgtgctttgtagtgactaccggcagagtcgtgatgcagctgttttgatcgctggttgtggcttgaagcttaa

SEQ ID NO: 147417 - DNA, 75 bp, Artificial Sequence
  Synthetic
tgttgtgctttgtagtgactaccggcagagtcgtgatgcagctgttttgatcgccggttgtggcttgaagcttaa

SEQ ID NO: 147418 - DNA, 75 bp, Artificial Sequence
  Synthetic
tgttgtgctttgtagtgactaccggcagagtcgtgatgcagctgttttgatcgcgggttgtggcttgaagcttaa

SEQ ID NO: 147419 - DNA, 75 bp, Artificial Sequence
  Synthetic
ggaggtgcattatgtcgctgccgggcttgaccatcgggcggtttttgccccgggtgtctcaccccggtcggcccc

SEQ ID NO: 147420 - DNA, 75 bp, Artificial Sequence
  Synthetic
tcagcaccgcccatcagtcatacctcgtggcactgttgatagcaatgttgccacgcttgatgcatttccaccttc

SEQ ID NO: 147421 - DNA, 75 bp, Artificial Sequence
  Synthetic
cgggtgtctcaccccggtcggcccctggcgaggttaccgccttctgctccgccctatataggttcaaccgtgagg

SEQ ID NO: 147422 - DNA, 75 bp, Artificial Sequence
  Synthetic
ccgccgcttccacccgtcgtcgacctgccccagctggggcttcgccgttgacggctgtggctccggctcctgaca

SEQ ID NO: 147423 - DNA, 75 bp, Artificial Sequence
  Synthetic
cttgcagaggagcttggtcatcggccggccccgattgccgccgttctgcccccttgtccggagctcgagcaaggc

SEQ ID NO: 147424 - DNA, 75 bp, Artificial Sequence
  Synthetic
ccgggcatgtttgggagtcggctaacccgttttgtggtgagagcacactctacacccgtacctggtcggaagttg

SEQ ID NO: 147425 - DNA, 75 bp, Artificial Sequence
  Synthetic
ccgtggcgctatcttgcgccgccagtataatttgtctacgtccccgctcacatctactattgctactggcacaaa

SEQ ID NO: 147426 - DNA, 75 bp, Artificial Sequence
  Synthetic
cccgttttgtggtgagagcacactctacacccgtacctggtcggaagttgatgccgcttctaacccggcccagcc

SEQ ID NO: 147427 - DNA, 75 bp, Artificial Sequence
  Synthetic
cattgtaccgggccccaccccccccccctccgccctggtgcctagtgagccggcctctggtgccagcgccggggc

SEQ ID NO: 147428 - DNA, 75 bp, Artificial Sequence
  Synthetic
ccctccgccctggtgcctagtgagccggcctctggtgccagcgccggggctctggccataacccaccagacggtc

SEQ ID NO: 147429 - DNA, 75 bp, Artificial Sequence
  Synthetic
acctgcgagctttatgagcttgttgaggctatggtggagaagggtcaggatggctctgcagtcttggaacttgat

SEQ ID NO: 147430 - DNA, 75 bp, Artificial Sequence
  Synthetic
tggtgggtatgctatatctatctctttctggcctcagacaacaaccaccccgacgtctgttgatatgaattcaat

SEQ ID NO: 147431 - DNA, 75 bp, Artificial Sequence
  Synthetic
ctatcgaaatcagggatggcgttcagttgagacctctggcgtcgctgaggaagaggctacctccggccttgttat

SEQ ID NO: 147432 - DNA, 75 bp, Artificial Sequence
  Synthetic
ttgaccaccgccctggtggcgggctctgccatgcattctaccaaaggtatcccgcttcctttgacgctgcctctt

SEQ ID NO: 147433 - DNA, 75 bp, Artificial Sequence
  Synthetic
cgcttgcccctaatgtattttatggtgatgcatatgaagatacagttttggctgccgctgtcgccggggccccag

SEQ ID NO: 147434 - DNA, 75 bp, Artificial Sequence
  Synthetic
ccggtgccctcggcctactcgacttcgcacttgagctcgagttccgtaatttgacacctggtaacactaacacgc

SEQ ID NO: 147435 - DNA, 75 bp, Artificial Sequence
  Synthetic
ggttggaacataacccaaagaggctcgaggccgcttaccgggagacctgctctcgccttggtaccgctgcatacc

SEQ ID NO: 147436 - DNA, 75 bp, Artificial Sequence
  Synthetic
cgaggccgcttaccgggagacctgctctcgccttggtaccgctgcatacccgctcctcgggactggcatatatca

SEQ ID NO: 147437 - DNA, 75 bp, Artificial Sequence
  Synthetic
gatgctgattcccgtggcgctattctacgccgccagtacaatttgtccacatccccgctcacgtccactattgca

SEQ ID NO: 147438 - DNA, 75 bp, Artificial Sequence
  Synthetic
ctgctgccacacgttttatgaaagacctccactttacggggactaatggtgttggtgaggtcggtcgtggtatag

SEQ ID NO: 147439 - DNA, 75 bp, Artificial Sequence
  Synthetic
tgccgccaaatggttcgaggccaataagcctacccgcccgactcttactataactgaggatgtcgcacggacggc

SEQ ID NO: 147440 - DNA, 75 bp, Artificial Sequence
  Synthetic
aagcctacccgcccgactcttactataactgaggatgtcgcacggacggcaaacttggccatcgaacttgactcg

SEQ ID NO: 147441 - DNA, 75 bp, Artificial Sequence
  Synthetic
tctggaacatggcggttattgcgcattgttatgaattccgtgacctaaaggtcgcggcatttaaaggagatgact

SEQ ID NO: 147442 - DNA, 75 bp, Artificial Sequence
  Synthetic
ctcagccaatggcgagccgacagtgaaactttacacctcagtcgagaatgctcagcaggacaagggtatagctat

SEQ ID NO: 147443 - DNA, 75 bp, Artificial Sequence
  Synthetic
tatctatctccttttggcctcagacaacgaccaccccaacgtctgttgatatgaattcaattacctccactgatg

SEQ ID NO: 147444 - DNA, 75 bp, Artificial Sequence
  Synthetic
gtgcccgggtctggaaagtcccgttctgttatccagactgacgtggacgttgttgtggttccgactcgggagctg

SEQ ID NO: 147445 - DNA, 75 bp, Artificial Sequence
  Synthetic
tgttgtggttccgactcgggagctgcgtaacgcctggcgccgccgcggttttgctgcttttaccccgcatactgc

SEQ ID NO: 147446 - DNA, 75 bp, Artificial Sequence
  Synthetic
gatggcgttcggttgagacctctggtgtcgctgaggaagaagcgacctctggccttgttatgctttgcattcatg

SEQ ID NO: 147447 - DNA, 75 bp, Artificial Sequence
  Synthetic
caccccctctcctgctccctctcgccctttttccgtccttcgtgctaatgatgtgctctggctctcgcttaccgc

SEQ ID NO: 147448 - DNA, 75 bp, Artificial Sequence
  Synthetic
ttacttgactttgcactcgagctcgagtttcgcaatttgacacctggtaacaccaatacgcgcgtttctcgttat

SEQ ID NO: 147449 - DNA, 75 bp, Artificial Sequence
  Synthetic
tgtggcgactggtgcccagggggtttcgcgctctttggactggtctaaggtcactcttgatggccgcccgctcac

SEQ ID NO: 147450 - DNA, 75 bp, Artificial Sequence
  Synthetic
gttgtttcgcaggtttatggtgtcagccccggtttagtacataacctgattggaatgctccagaccattgctgat

SEQ ID NO: 147451 - DNA, 75 bp, Artificial Sequence
  Synthetic
ttagcccctacttcctggtggcatgtcactcaccgctgtcccgcggatgtgtgtgagctgattcgcggtgcatat

SEQ ID NO: 147452 - DNA, 75 bp, Artificial Sequence
  Synthetic
tcgcgctctttggactggtctaaggtcactcttgatggccgcccgctcactactattcagcagtattctaagacc

SEQ ID NO: 147453 - DNA, 75 bp, Artificial Sequence
  Synthetic
tacaataccactgctagcgatcagattttgatcgagaatgcggctggccatcgcgtgtgtatttccacctatacc

SEQ ID NO: 147454 - DNA, 75 bp, Artificial Sequence
  Synthetic
tcgcgtgtgtatttccacctataccactaacttgggctctgggcccgtgtctatttctgctgttggtgtccttgc

SEQ ID NO: 147455 - DNA, 75 bp, Artificial Sequence
  Synthetic
accccggctcagtgacggtccacgaggcacagggcgctacctacacagagaccaccattattgcaacggcagacg

SEQ ID NO: 147456 - DNA, 75 bp, Artificial Sequence
  Synthetic
gcggtggtttctggggtgaccgggttgattctcagcccttcgccctcccctatattcatccaaccaaccccttcg

SEQ ID NO: 147457 - DNA, 75 bp, Artificial Sequence
  Synthetic
ttgacgcaccaggcttgcttcgtgaggtgggcatctctgacgcaattgtcaataatttcttcctcgctggcggtg

SEQ ID NO: 147458 - DNA, 75 bp, Artificial Sequence
  Synthetic
cagggttgtgcttttcaatctactgttgctgagctgcagcgtcttaaaatgaaggtgggtaaaacccgggagtat

SEQ ID NO: 147459 - DNA, 75 bp, Artificial Sequence
  Synthetic
ctccctctcgtccattttctgttcttcgtgctaatgatgtgctttggctttcacttactgctgctgagtatgatc

SEQ ID NO: 147460 - DNA, 75 bp, Artificial Sequence
  Synthetic
tcgtgctaatgatgtgctttggctttcacttactgctgctgagtatgatcaaacgacttatggctcctctaccaa

SEQ ID NO: 147461 - DNA, 75 bp, Artificial Sequence
  Synthetic
tcccgcccgccgtcgatctgccccagctggggcttcgccgctgactgctgtggccccggcccctgataccgcccc

SEQ ID NO: 147462 - DNA, 75 bp, Artificial Sequence
  Synthetic
tatccctcgcggcaaccccgacgccaatgtcgacaccctggctgcctttccaccgtcatgccagattagtgcttt

SEQ ID NO: 147463 - DNA, 75 bp, Artificial Sequence
  Synthetic
cccggcgaggttaccgccttctgctctgccctatacaggttcaaccgtgaggcccagcgccattcgctgaccggt

SEQ ID NO: 147464 - DNA, 75 bp, Artificial Sequence
  Synthetic
tgatttattttgcttgtgcccttccttctgttactttcctttttatttgctttttctgcgttccgcgctccctgg

SEQ ID NO: 147465 - DNA, 75 bp, Artificial Sequence
  Synthetic
tcacttactgctgctgagtatgatcaaacgacttatggctcctctaccaaccctatgtatgtttctgacactgtt

SEQ ID NO: 147466 - DNA, 75 bp, Artificial Sequence
  Synthetic
catcgctactggcaccaatcttgttttatatgctgctcccctgagccctctgcttccgcttcaagatgggactaa

SEQ ID NO: 147467 - DNA, 75 bp, Artificial Sequence
  Synthetic
ttatatgctgctcccctgagccctctgcttccgcttcaagatgggactaacactcatattatggccactgaagca

SEQ ID NO: 147468 - DNA, 75 bp, Artificial Sequence
  Synthetic
ttgcaggaccgcgatccgtaaggctctctcaaagttctgctgctttatgaagtggcttggtcaggagtgtacttg

SEQ ID NO: 147469 - DNA, 75 bp, Artificial Sequence
  Synthetic
acagggccttctctacctgccccaggagctcaccacctgtgatagtgttgtaacatttgagttgacagatattgt

SEQ ID NO: 147470 - DNA, 75 bp, Artificial Sequence
  Synthetic
cgtccactcaccaccatccagcagtattctaagactttctatgtcttgccccttcgtggtaagctttccttttgg

SEQ ID NO: 147471 - DNA, 75 bp, Artificial Sequence
  Synthetic
gaggccggcaccactaaagccggctacccttataattataacactactgctagtgaccagatcctgattgagaat

SEQ ID NO: 147472 - DNA, 75 bp, Artificial Sequence
  Synthetic
ctccctctgccccggcgcttgatgagccggcttctggcgctaccgccggggccccggccataacccaccagacgg

SEQ ID NO: 147473 - DNA, 75 bp, Artificial Sequence
  Synthetic
tacgctatatctatttctttctggccccagactacaactaccccaacatctgtcgatatgaattctattacctct

SEQ ID NO: 147474 - DNA, 75 bp, Artificial Sequence
  Synthetic
gccccggccataacccaccagacggcccggcaccgccgcctgctcttcacctacccggatggctctaaggtattc

SEQ ID NO: 147475 - DNA, 75 bp, Artificial Sequence
  Synthetic
ggttacaacttgtgagctgtacgagttagtggaagccatggttgagaagggccaggatggctccgccgtccttga

SEQ ID NO: 147476 - DNA, 75 bp, Artificial Sequence
  Synthetic
gccggcttctggcgctaccgccggggccccggccataacccaccagacggcccggcaccgccgcctgctcttcac

SEQ ID NO: 147477 - DNA, 75 bp, Artificial Sequence
  Synthetic
gacccgttggtagagacgtccagcgttggtactctgcccctacccgtggccctgctgccaattgccgccgttctg

SEQ ID NO: 147478 - DNA, 75 bp, Artificial Sequence
  Synthetic
ggtgtcctcgcccctcactctgcgctggctgctttggaggataccgctgactaccctgctcgcgcccatactttt

SEQ ID NO: 147479 - DNA, 75 bp, Artificial Sequence
  Synthetic
cccagactacaactaccccaacatctgtcgatatgaattctattacctctactgatgttcggattcttgttcagc

SEQ ID NO: 147480 - DNA, 75 bp, Artificial Sequence
  Synthetic
tctcgctgtgcctttgccgcagagaccggcgtggccctttactctttgcacgatctctggccagccgatgttgcg

SEQ ID NO: 147481 - DNA, 75 bp, Artificial Sequence
  Synthetic
cagggcatctcggcttggagtaagactttctgtgccctcttcggcccctggttccgtgctattgagaaggccatc

SEQ ID NO: 147482 - DNA, 75 bp, Artificial Sequence
  Synthetic
cgtcttaaaatgaaggtgggtaaaacccgggagtattgatttatttgcttgtgccccccttctgccatgttttct

SEQ ID NO: 147483 - DNA, 75 bp, Artificial Sequence
  Synthetic
ccggtaacacgaatacgcgcgtttcccgttattcgagtagcgcgcgccacaagctacgtcgtgggcccgacggta

SEQ ID NO: 147484 - DNA, 75 bp, Artificial Sequence
  Synthetic
gcgaaggcttccatggtgtttgagaatgacttctctgagtttgactctactcagaataatttctccttgggactt

SEQ ID NO: 147485 - DNA, 75 bp, Artificial Sequence
  Synthetic
ctgctgagctaaccaccactgctgctacacggtttatgaaagatcttcacttcacagggaccaatggtgttggtg

SEQ ID NO: 147486 - DNA, 75 bp, Artificial Sequence
  Synthetic
gaacagtactgccgggcccgggccggccgttgcctggagattggggctcatccaaggtctattaatgataacccc

SEQ ID NO: 147487 - DNA, 75 bp, Artificial Sequence
  Synthetic
cctgctgccaattgccgccgctccgcgctacgtggtctcccccctgccgaccgcacttactgttttgatggattt

SEQ ID NO: 147488 - DNA, 75 bp, Artificial Sequence
  Synthetic
ttgtcatccaggattacgataaccagcacgagcaggaccgtcccaccccgtctccagccccttcccgcccttttt

SEQ ID NO: 147489 - DNA, 75 bp, Artificial Sequence
  Synthetic
cgttttgctgttcacggctcatgacatacctccgtggcattagctacaaggtcactgtcggtgcgcttgttgcca

SEQ ID NO: 147490 - DNA, 75 bp, Artificial Sequence
  Synthetic
agtaccgtcagagtccaggagccgcagtcctaattgctggctgcggcctgaagttgaaggtggatttccgcccga

SEQ ID NO: 147491 - DNA, 75 bp, Artificial Sequence
  Synthetic
tctcgttgcgcctttgccgcagagaccggcgtggccctttactctttgcatgacctctggccagccgatgttgca

SEQ ID NO: 147492 - DNA, 75 bp, Artificial Sequence
  Synthetic
agtcctaattgctggctgcggcctgaagttgaaggtggatttccgcccgattggcttatatgcaggtgttgtggt

SEQ ID NO: 147493 - DNA, 75 bp, Artificial Sequence
  Synthetic
ccctgagcgagcggagcagctccgcctcgctgtgtgtgatttccttcgcaagctcacgaatgtggctcagatgtg

SEQ ID NO: 147494 - DNA, 75 bp, Artificial Sequence
  Synthetic
tgtggatgttgcttctcgtgtttatggggtctccccagggctagttcataacctgattggtatgctacaggctgt

SEQ ID NO: 147495 - DNA, 75 bp, Artificial Sequence
  Synthetic
cagcagtactctaagaccttctttgttctgcccctccgtggcaagctctctttctgggaggctggcaccactaag

SEQ ID NO: 147496 - DNA, 75 bp, Artificial Sequence
  Synthetic
cactgcggcccctgagccgtcgcctatgccttacgttccttaccctcgctcgactgaggtgtatgttcgctctat

SEQ ID NO: 147497 - DNA, 75 bp, Artificial Sequence
  Synthetic
ccacctagaccccagagtgctcgtgtttgatgagtcagtgccctgccgctgtaggactttcctaaagagggttgc

SEQ ID NO: 147498 - DNA, 75 bp, Artificial Sequence
  Synthetic
atgccttacgttccttaccctcgctcgactgaggtgtatgttcgctctatatttggccctggcggctccccttcc

SEQ ID NO: 147499 - DNA, 75 bp, Artificial Sequence
  Synthetic
tttgatgagtcagtgccctgccgctgtaggactttcctaaagagggttgcgggaaaattttgctgtttcatgcgg

SEQ ID NO: 147500 - DNA, 75 bp, Artificial Sequence
  Synthetic
tttggcgccaccctggatgaccaggcgttttgctgctcacggctcatgacataccttcgtggcattagctacaag

SEQ ID NO: 147501 - DNA, 75 bp, Artificial Sequence
  Synthetic
aggctgaacctgcacatctcgatgtgtcggggacctatgctgtccacgggcgccagcttgaagccctctataggg

SEQ ID NO: 147502 - DNA, 75 bp, Artificial Sequence
  Synthetic
tgccgtacgctcggccttcagggctgtgcttttcaatcaactgttgctgagctgcagcgtcttaaaatgaaggtg

SEQ ID NO: 147503 - DNA, 75 bp, Artificial Sequence
  Synthetic
gtgcttttcaatcaactgttgctgagctgcagcgtcttaaaatgaaggtgggtaaaacccgggagtattgattta

SEQ ID NO: 147504 - DNA, 75 bp, Artificial Sequence
  Synthetic
cgttttgctgctcacggctcatgacataccttcgtggcattagctacaaggttaccgtcggtgcgcttgttgcca

SEQ ID NO: 147505 - DNA, 75 bp, Artificial Sequence
  Synthetic
gctacctccgtacccaggcaatatctaagggtatgcgccggttggaggttgagcatgcccagaaatttattacaa

SEQ ID NO: 147506 - DNA, 75 bp, Artificial Sequence
  Synthetic
tgtcacccaccgctgccctgcggatgtatgtgagctgatccgtggtgcataccccatgatccagaccactagccg

SEQ ID NO: 147507 - DNA, 75 bp, Artificial Sequence
  Synthetic
gagcatgcccagaaatttattacaagactttatagctggctgttcgagaagtctggccgtgactacatccccggc

SEQ ID NO: 147508 - DNA, 75 bp, Artificial Sequence
  Synthetic
accacagctggggccgcgccgctgactgcggttgctccggcccatgataccccgcctgtgcccgatgttgattct

SEQ ID NO: 147509 - DNA, 75 bp, Artificial Sequence
  Synthetic
atgggggccgggccgcacagtcttacttacgagctcacacccgctggtttgcaggttaggatttcatctaacggc

SEQ ID NO: 147510 - DNA, 75 bp, Artificial Sequence
  Synthetic
cgaacagtactgtcgagctcgagccggccgctgccttgaagtgggtgcccacccacgatccatcaatgacaaccc

SEQ ID NO: 147511 - DNA, 75 bp, Artificial Sequence
  Synthetic
gccctctacaggtataatagattcacccagcggcattcgctgaccggtggcctgtggttacatcctgaggggttg

SEQ ID NO: 147512 - DNA, 75 bp, Artificial Sequence
  Synthetic
tggctagggcaagagtgtacctgctttttggaaccagctgaaggcctggttggcgaccagggccatgataacgag

SEQ ID NO: 147513 - DNA, 75 bp, Artificial Sequence
  Synthetic
ggtggctatgctatctctatatcgttctggccgcagaccactaccaccccgacgtccgtcgacatgaattctata

SEQ ID NO: 147514 - DNA, 75 bp, Artificial Sequence
  Synthetic
ctgggcatatttgggagtctgcaaaccccttctgtggggaaggcaccttgtatactcgtacctggtccacatccg

SEQ ID NO: 147515 - DNA, 75 bp, Artificial Sequence
  Synthetic
acaaagctttacaatgcctcccactctgatgttcgcgactctctcgcccgttttatccccgccattggccccgta

SEQ ID NO: 147516 - DNA, 75 bp, Artificial Sequence
  Synthetic
ccccaccagtcagtgatatttgggtgttaccaccgccctcagaagggtctcaggttgatgtggctctcacacccc

SEQ ID NO: 147517 - DNA, 75 bp, Artificial Sequence
  Synthetic
ttgaaacctccggggtggcggaggaggaggccacctctggccttgtcatgctttgtatacatggctcacctgtga

SEQ ID NO: 147518 - DNA, 75 bp, Artificial Sequence
  Synthetic
caggttgatgtggctctcacaccccccgcccccgagcccgttgggttgcccggccctactgaacctcctcccccc

SEQ ID NO: 147519 - DNA, 75 bp, Artificial Sequence
  Synthetic
tcacccctggtaacaccaatacacgggtttcccgctactctagcaccgcccgccaccgtcttcgccgtggcgcag

SEQ ID NO: 147520 - DNA, 75 bp, Artificial Sequence
  Synthetic
gcaggttaggatttcatctaatggtctagactgcactgccgtattcccccccggtggcgcccctagtgcagcgcc

SEQ ID NO: 147521 - DNA, 75 bp, Artificial Sequence
  Synthetic
ctgtaatcacatatgagggggattccagtgccgggtataatcatgatgtgtctattctccgtgcctggatccgta

SEQ ID NO: 147522 - DNA, 75 bp, Artificial Sequence
  Synthetic
attgtgactggctggtgaatgcctctaacccgggccatcgccctgggggtggcctctgtcatgccttttaccaac

SEQ ID NO: 147523 - DNA, 75 bp, Artificial Sequence
  Synthetic
tctattctccgtgcctggatccgtactactaaggtcaccggagatcacccgctagtgattgagcgggtccgggca

SEQ ID NO: 147524 - DNA, 75 bp, Artificial Sequence
  Synthetic
ggtttcccgctactctagcaccgcccgccaccgtcttcgccgtggcgcagacgggactgccgagctcaccaccac

SEQ ID NO: 147525 - DNA, 75 bp, Artificial Sequence
  Synthetic
ttacagccgcacctgagccgtcgtcaatgacttatgttccataccctcgttctaccgaggtctatgtccggccta

SEQ ID NO: 147526 - DNA, 75 bp, Artificial Sequence
  Synthetic
attgtggctacatcctgaggggttgctgggcattttcccccctttctcccctgggcacatctgggagtctgctaa

SEQ ID NO: 147527 - DNA, 75 bp, Artificial Sequence
  Synthetic
aggcttgaggcagcgtaccgagaaacctgctcccgccgtggtactgccgcctatccactcctaggctcaggtata

SEQ ID NO: 147528 - DNA, 75 bp, Artificial Sequence
  Synthetic
cctgctcccgccgtggtactgccgcctatccactcctaggctcaggtatatatcaggtccctgttggccttagct

SEQ ID NO: 147529 - DNA, 75 bp, Artificial Sequence
  Synthetic
tgaggcggccgttcctgcaccggccgttgccctagggtcacctagccctaccccaccagttagtgatatttgggt

SEQ ID NO: 147530 - DNA, 75 bp, Artificial Sequence
  Synthetic
gttaccaccgccttcagaagagtttcaggttgatgcaaagcccgccccccctgtccccgaggtcgttaggtcgcc

SEQ ID NO: 147531 - DNA, 75 bp, Artificial Sequence
  Synthetic
ctaacaagccgacgcagccggcacttacgataacggaggacacggctcgcacggccaacctagcattagagattg

SEQ ID NO: 147532 - DNA, 75 bp, Artificial Sequence
  Synthetic
ctttttctgttctccgggccaatgatgtgctttggctctctctcactgctgctgagtatgatcagtccacctatg

SEQ ID NO: 147533 - DNA, 75 bp, Artificial Sequence
  Synthetic
tgagcatgcgcaaaagttcataacacgcctttatagctggctgtttgaaaagtctggccgtgattacatccctgg

SEQ ID NO: 147534 - DNA, 75 bp, Artificial Sequence
  Synthetic
gttgcgaccggcgcgcaggccgttgctcggtcgcttgactggactaaggtcacacttgatggccgccctctttct

SEQ ID NO: 147535 - DNA, 75 bp, Artificial Sequence
  Synthetic
cgcctttatagctggctgtttgaaaagtctggccgtgattacatccctggtcgtcagttgcagttttatgctcaa

SEQ ID NO: 147536 - DNA, 75 bp, Artificial Sequence
  Synthetic
tgtcgccggtggttatccgccggcttccaccttgaccctcgtgtgctcgtttttgatgaggcggccccttgccgc

SEQ ID NO: 147537 - DNA, 75 bp, Artificial Sequence
  Synthetic
gggctttgcggcctttacaccccatacggcggcccgtgtcactataggccgccgtgttgtgattgacgaggcccc

SEQ ID NO: 147538 - DNA, 75 bp, Artificial Sequence
  Synthetic
ataatactactgctagtgaccaactgctcgttgagaatgccgccgggcaccgggtggctatttccacctacacca

SEQ ID NO: 147539 - DNA, 75 bp, Artificial Sequence
  Synthetic
gccgtgttgtgattgacgaggccccgtccctcccaccgcacttgttgctgttgcatatgcaacgggcctcttcag

SEQ ID NO: 147540 - DNA, 75 bp, Artificial Sequence
  Synthetic
gtggctcgggcaggactgtacctgctttctccagcctgttgaggggagggtcggcgagcaaggttatgataatga

SEQ ID NO: 147541 - DNA, 75 bp, Artificial Sequence
  Synthetic
ctccgccttggcgaatgctgtggtggttcggcctttcctatcccggctacagacagagatactcattaacctgat

SEQ ID NO: 147542 - DNA, 75 bp, Artificial Sequence
  Synthetic
ttgatgcctgggagcgtaaccaccgccccggcgatgagctttacctgactgaacccgctgcagcctggtttgaag

SEQ ID NO: 147543 - DNA, 75 bp, Artificial Sequence
  Synthetic
ctgagcttgcaccaacgagttggtggcatgtcacacatcgttgcccggctgatgtatgtgagcttatacgcgggg

SEQ ID NO: 147544 - DNA, 75 bp, Artificial Sequence
  Synthetic
cttaccctaaaatccagaccactagtcgtgtgctacgatctctgttctggaatgagccggccgttggccagaagt

SEQ ID NO: 147545 - DNA, 75 bp, Artificial Sequence
  Synthetic
tacgataacggaagatacagcccgcacggccaacctagcattagagatcgatgctgctacagaggtgggccgtgc

SEQ ID NO: 147546 - DNA, 75 bp, Artificial Sequence
  Synthetic
ggtcgccttatctgtgaaactacaataggcaataagacttttaaaacagtttttactgatggtgcccagttagag

SEQ ID NO: 147547 - DNA, 75 bp, Artificial Sequence
  Synthetic
ttgtgccggctgcactgtcagccccgggattgtgcattatcagtttactgccggggtcccgggctcaggtaagtc

SEQ ID NO: 147548 - DNA, 75 bp, Artificial Sequence
  Synthetic
gctaacgggccagagcaatatgtgctgtcgtttgatccggccaagcagaccatggctgccggcccacatagtctt

SEQ ID NO: 147549 - DNA, 75 bp, Artificial Sequence
  Synthetic
tgatgccaggggtcttatccagtcatcccgagctcatgctatagttgcacttacccgccacacagagaagtgcgt

SEQ ID NO: 147550 - DNA, 75 bp, Artificial Sequence
  Synthetic
cagagaccacaattatagctacggctgatgccaggggtcttatccagtcatcccgagctcatgctatagttgcac

SEQ ID NO: 147551 - DNA, 75 bp, Artificial Sequence
  Synthetic
catggctgccggcccacatagtcttagttatgccttgacatctactggccttgaggtgcgtgttgtttccgccgg

SEQ ID NO: 147552 - DNA, 75 bp, Artificial Sequence
  Synthetic
ttgtcaacaacttttttcttgctggtggggaggtgggtcatcaccgcccctctgtgataccccgcggcaaccctg

SEQ ID NO: 147553 - DNA, 75 bp, Artificial Sequence
  Synthetic
atcccttccaccacacctgctgctgttgcacatgcagcgggcctcttcagtccatctccttggtgacccaaatca

SEQ ID NO: 147554 - DNA, 75 bp, Artificial Sequence
  Synthetic
tctgtgataccccgcggcaaccctgaccggaacctcgagactctacaggcctttccaccatcttgtcagattagt

SEQ ID NO: 147555 - DNA, 75 bp, Artificial Sequence
  Synthetic
tgaggctatggcccgccatggtatgacccggctgtatgcagccctccaccttcccccagaagtgctgcttccccc

SEQ ID NO: 147556 - DNA, 75 bp, Artificial Sequence
  Synthetic
aattggcctttttccgccgttttctcccggccacgcttgggagtccgccaatcctttctgtggggagagtaccct

SEQ ID NO: 147557 - DNA, 75 bp, Artificial Sequence
  Synthetic
cagtgctgggtataatcatgatgtgtctattctccgtgcctggatccgcactactaaggtcaccggtgatcaccc

SEQ ID NO: 147558 - DNA, 75 bp, Artificial Sequence
  Synthetic
accgcctgctgagactgatatgcctgttgctattaatgtcccatccccaactatctctgcactgcctcagccctc

SEQ ID NO: 147559 - DNA, 75 bp, Artificial Sequence
  Synthetic
atagtccattgccgtatggccgccccgagccagcggaaagctgttctctcaacgcttgtggggaggtatggccgt

SEQ ID NO: 147560 - DNA, 75 bp, Artificial Sequence
  Synthetic
tgccaaccctggtgcgattacggtccatgaagcccagggcgccactttcacagagaccacaatcatagctacggc

SEQ ID NO: 147561 - DNA, 75 bp, Artificial Sequence
  Synthetic
agtctacatttcatgccgtccctgtgcatatctgggacaggcttatgctttttggtgcgacccttgatgaccagg

SEQ ID NO: 147562 - DNA, 75 bp, Artificial Sequence
  Synthetic
cattcttgacgcccctggtttgttgcgcgaggttggcatatcagatgtgattgttaacaacttcttcctcgctgg

SEQ ID NO: 147563 - DNA, 75 bp, Artificial Sequence
  Synthetic
agtcacggtcggcgctcttgtcgccaacgagggttggaatgcttccgaagatgcactgactgctgtgattactgc

SEQ ID NO: 147564 - DNA, 75 bp, Artificial Sequence
  Synthetic
tctgtgatacctcgtggcaaccctgatcggaaccttgagatcctacaggccttcccgccatcttgccagattagc

SEQ ID NO: 147565 - DNA, 75 bp, Artificial Sequence
  Synthetic
gcttatcgggagacgtgctctcgccgcgggacggctgcttaccccttgctcggcgccggtatatacaaagtgcct

SEQ ID NO: 147566 - DNA, 75 bp, Artificial Sequence
  Synthetic
cggcgccggtatatacaaagtgcctgttgggctgagttttgatgcctgggaacgtaaccatcgacctggggatga

SEQ ID NO: 147567 - DNA, 75 bp, Artificial Sequence
  Synthetic
tgccgtagcttcctccgcaaagctgctcataaattttgttgcttcatgcggtggctcgggcaggagtgtacctgc

SEQ ID NO: 147568 - DNA, 75 bp, Artificial Sequence
  Synthetic
actcagatgttcgtgaatctctagctaggtttatccctactatcggacccgtccaggccaccacgtgtgagctgt

SEQ ID NO: 147569 - DNA, 75 bp, Artificial Sequence
  Synthetic
gtctcttaaaggtttctggaagaagcactctggtgagcctggcacccttctttggaataccgtttggaacatggc

SEQ ID NO: 147570 - DNA, 75 bp, Artificial Sequence
  Synthetic
gatcatagcacactgctatgagtttcgcgatttccgggttgccgcttttaagggtgatgattcggtggtcctctg

SEQ ID NO: 147571 - DNA, 75 bp, Artificial Sequence
  Synthetic
cgcgatttccgggttgccgcttttaagggtgatgattcggtggtcctctgtagtgattaccgacagagccgtaat

SEQ ID NO: 147572 - DNA, 75 bp, Artificial Sequence
  Synthetic
ttggccagggtatatcggcctggagtaagaccttttgtgccctgtttggcccgtggtttcgtgccattgaaaaag

SEQ ID NO: 147573 - DNA, 75 bp, Artificial Sequence
  Synthetic
atgatatgtcaccatctgatgtcgccgaggccatgttccgccatggtatgacgcggctttatgccgccctccatc

SEQ ID NO: 147574 - DNA, 75 bp, Artificial Sequence
  Synthetic
gtggtggcccctggtctggggacactgcctgatgtggtgcgatttgctggccggctgtctgaaaagaactggggc

SEQ ID NO: 147575 - DNA, 75 bp, Artificial Sequence
  Synthetic
ccgtggtttcgtgccattgaaaaagaaatattggccctgctcccgcctaatatcttttacggcgacgcttacgag

SEQ ID NO: 147576 - DNA, 75 bp, Artificial Sequence
  Synthetic
ttgtggtgacgtacgagggtgacactagtgctggttataaccatgatgtttccaacctgcgctcctggattagaa

SEQ ID NO: 147577 - DNA, 75 bp, Artificial Sequence
  Synthetic
agccttgtacaggttcaatcgctgtgtccagcggcattcccttatcgggggcctgtggtactaccctgaggggct

SEQ ID NO: 147578 - DNA, 75 bp, Artificial Sequence
  Synthetic
cagatgtcctgccgatgtctgcgagctgattcgcggcgcatacccaaaaatccagaccgcaagccgtgtcctccg

SEQ ID NO: 147579 - DNA, 75 bp, Artificial Sequence
  Synthetic
ctgccccagctggggctgcgccgctgactgctatatcaccagcccctgacacagcccctgtacctgatgttgatt

SEQ ID NO: 147580 - DNA, 75 bp, Artificial Sequence
  Synthetic
ccctattgggctgtatgccggtgtggtagtggcccctggcctggggacactgcctgatgtggtgcgatttgctgg

SEQ ID NO: 147581 - DNA, 75 bp, Artificial Sequence
  Synthetic
atttccgatgctatcgtcaataattttttcctctctggtggccagattggtcaacaccgcccgtcagttatccca

SEQ ID NO: 147582 - DNA, 75 bp, Artificial Sequence
  Synthetic
acgtcatctgttgcctcgggcactaatttggttctttatgctgccccactgaaccctctcttaccccttcaggat

SEQ ID NO: 147583 - DNA, 75 bp, Artificial Sequence
  Synthetic
gcattctaccaacgtttcccagagtcatttgaccccgccgagttcgtcatgtctgacggccttgcggcttatacc

SEQ ID NO: 147584 - DNA, 75 bp, Artificial Sequence
  Synthetic
cttctttatatgccccaggaattggctacgtctgatagtgtgcttacgtttgaactgacagacatagtgcactgc

SEQ ID NO: 147585 - DNA, 75 bp, Artificial Sequence
  Synthetic
taccgcccgctggtgccaaatgctgtcggcggctacgccatttctatttccttctggccccagacaaccactacc

SEQ ID NO: 147586 - DNA, 75 bp, Artificial Sequence
  Synthetic
tgaactgacagacatagtgcactgccgtatggcggcacctagtcagcgtaaagctgtcctgtccacccttgttgg

SEQ ID NO: 147587 - DNA, 75 bp, Artificial Sequence
  Synthetic
ttttgatgagtcggccccctgccactgcaggaccgcgattcgtaaggcggtctcaaagttttgctgctttatgaa

SEQ ID NO: 147588 - DNA, 75 bp, Artificial Sequence
  Synthetic
ttggtcatccccagcgagcgtctccattatcgtaatcaaggctggcgctccgtcgagactacgggtgtcgctgag

SEQ ID NO: 147589 - DNA, 75 bp, Artificial Sequence
  Synthetic
taaattcacaacaggtgaaacgatagcacacggcaaggtcgggcaggggatatccgcgtggagtaagaccttctg

SEQ ID NO: 147590 - DNA, 75 bp, Artificial Sequence
  Synthetic
acagcccctgtacctgatgttgactcacgcggcgccattttgcgccggcagtataatttgtctacatccccgctt

SEQ ID NO: 147591 - DNA, 75 bp, Artificial Sequence
  Synthetic
ctgaggcatctaattatgcccagtaccgggtggttcgagctacaatccgctaccgcccgttggtaccaaatgccg

SEQ ID NO: 147592 - DNA, 75 bp, Artificial Sequence
  Synthetic
gcttgaccaccgggcggttttcgcccccggcgtttcaccccggtcggcccctggcgaggtcaccgccttttgctc

SEQ ID NO: 147593 - DNA, 75 bp, Artificial Sequence
  Synthetic
taatcatggaggagtgtggcatgccgcaatggatgatccgactttatcatcttgtccgctctgcctgggtgctgc

SEQ ID NO: 147594 - DNA, 75 bp, Artificial Sequence
  Synthetic
tcacttctactgatgtcaggattctggtccagcccggtattgcctccgaattggtcattcccagtgaacgtctcc

SEQ ID NO: 147595 - DNA, 75 bp, Artificial Sequence
  Synthetic
tcccacatgacatagacctcggtgactctcgtgtggttattcaagattatgataaccagcacgagcaggatcggc

SEQ ID NO: 147596 - DNA, 75 bp, Artificial Sequence
  Synthetic
gttttggaagaagcactcaggtgagcctggtaccttgttgtggaacactgtttggaacatggcggttattgcaca

SEQ ID NO: 147597 - DNA, 75 bp, Artificial Sequence
  Synthetic
cagatgtcctgccgatgtctgcgagctgattcgtggtgcataccccaaaattcagaccgcaagccgtgtcctccg

SEQ ID NO: 147598 - DNA, 75 bp, Artificial Sequence
  Synthetic
cactggtgctctcggcctgcttgattttgcgcttgagcttgagtttcgtaatttgacacctggtaacacgaatac

SEQ ID NO: 147599 - DNA, 75 bp, Artificial Sequence
  Synthetic
cccgtcatcggctgcgccgtggtgccgacgggactgctgagcttaccactacggcggccacgcggtttatgaagg

SEQ ID NO: 147600 - DNA, 75 bp, Artificial Sequence
  Synthetic
gatacgcttctcggcgggctcccgacagaattgatttcgtcggctggcggccagctgttttattcacgccccgtc

SEQ ID NO: 147601 - DNA, 75 bp, Artificial Sequence
  Synthetic
ctataatacaactgctagtgatcaaattctaattgagaacgcagccggccaccgtgttgctatttccacctacac

SEQ ID NO: 147602 - DNA, 75 bp, Artificial Sequence
  Synthetic
gaatgtggctcaggtttgtgtggatgttgtttcgcaggtctatggtgttagccccggcttagtacataacctgat

SEQ ID NO: 147603 - DNA, 75 bp, Artificial Sequence
  Synthetic
atacgcttctcggtggtttgccgacagaattgatttcgtcggctgggggtcagttgttctactcccgccctgtcg

SEQ ID NO: 147604 - DNA, 75 bp, Artificial Sequence
  Synthetic
cagttgttctactcccgccctgtcgtctcagccaatggcgagccgactgtaaagctatatacatctgttgagaat

SEQ ID NO: 147605 - DNA, 75 bp, Artificial Sequence
  Synthetic
ccagaggttttctggaatcatcctatccaacgtgtaatacataatgagctagagcagtattgtcggtcccgcgcg

SEQ ID NO: 147606 - DNA, 75 bp, Artificial Sequence
  Synthetic
ttcccgtgtggttatccaggactatgataaccagcacgagcaggatcggcctactccttcacccgccccctcccg

SEQ ID NO: 147607 - DNA, 75 bp, Artificial Sequence
  Synthetic
ttttgcctatgctgcccgcgccaccggccggtcagccgtctggccgtcgccgcgggcggcgcagcggcggtgccg

SEQ ID NO: 147608 - DNA, 75 bp, Artificial Sequence
  Synthetic
ttattaaggctcctggcattactactgccattgagcaggctgctctggctgcggccaactccgccttggcgaatg

SEQ ID NO: 147609 - DNA, 75 bp, Artificial Sequence
  Synthetic
cccacgttcaattaatgacaatcctaatgttttgcatcgttgttttcttaaaccagttggccgtgatgttcagcg

SEQ ID NO: 147610 - DNA, 75 bp, Artificial Sequence
  Synthetic
gccatattacgtcgccagtgtaatctatcaacatctccgcttacgtccactattgctactggtactaatcttgtc

SEQ ID NO: 147611 - DNA, 75 bp, Artificial Sequence
  Synthetic
attttaattgagaatgcagccggccaccgtgttgctatctctacctacaccactagcctgggtgccggccctacc

SEQ ID NO: 147612 - DNA, 75 bp, Artificial Sequence
  Synthetic
cctgcggcaaattgtcgccggtctgctcttcgtgggcttccacctgttgaccgtacatactgctttgacggcttt

SEQ ID NO: 147613 - DNA, 75 bp, Artificial Sequence
  Synthetic
ctgtatgccgctccgctgagccccttgctcccgcttcaggatggaactaatactcatattatggccactgaggct

SEQ ID NO: 147614 - DNA, 75 bp, Artificial Sequence
  Synthetic
tgctcccgcttcaggatggaactaatactcatattatggccactgaggcttcaaattatgcccagtaccgcgttg

SEQ ID NO: 147615 - DNA, 75 bp, Artificial Sequence
  Synthetic
cactagcctgggtgccggccctacctctatctccgcggttggtgtattagccccgcactcggcccttgccgttct

SEQ ID NO: 147616 - DNA, 75 bp, Artificial Sequence
  Synthetic
gaggcgatggcccgccatggaatgactcggctttatgcagccctccatctcccccctgaggtattattaccccct

SEQ ID NO: 147617 - DNA, 75 bp, Artificial Sequence
  Synthetic
ccctatgatccagaccactagccgggtcctccgttcgttgttctggggtgagcctgccgttgggcagaaactagt

SEQ ID NO: 147618 - DNA, 75 bp, Artificial Sequence
  Synthetic
actgatgttcgaattcttgtccaacccggtatcgcctctgaactcgtgatccctagtgagcgcctgcactatcgt

SEQ ID NO: 147619 - DNA, 75 bp, Artificial Sequence
  Synthetic
ttttaatccatgatggggaccgtgcagtgatcacatacgagggggactccagtgcgggatataaccatgatgtgt

SEQ ID NO: 147620 - DNA, 75 bp, Artificial Sequence
  Synthetic
aatcagggttggcgttcggttgagacctctggtgtcgcggaggaggaggctacctctggccttgttatgctttgc

SEQ ID NO: 147621 - DNA, 75 bp, Artificial Sequence
  Synthetic
gagctcgagttttgtaatctaacgcctggcaacacgaatacgcgtgtctcccgttattcgagcagtgcgcgccac

SEQ ID NO: 147622 - DNA, 75 bp, Artificial Sequence
  Synthetic
gtacctccgtggcattagctataaggttacggtaggtgctctcgttgccaacgagggctggaatgcttctgagga

SEQ ID NO: 147623 - DNA, 75 bp, Artificial Sequence
  Synthetic
ggtacctccgtacgcaggccatttcgaaggggatgaaaaggctggagcttgagcacgcgcagaagttcataacac

SEQ ID NO: 147624 - DNA, 75 bp, Artificial Sequence
  Synthetic
gcctttacagctggttatttgaaaagtccgggcgtgactatatccccggccgccaactgcagttttatgctcagt

SEQ ID NO: 147625 - DNA, 75 bp, Artificial Sequence
  Synthetic
ccaccttgatcctcgtgtgctcgtttttgatgaacccgccccctgccgttgccggagtttcctgcgcaaagccgc

SEQ ID NO: 147626 - DNA, 75 bp, Artificial Sequence
  Synthetic
cactgtgacatttgttaatgtagctactggtgcccagggagtttcccgctctcttgactggtctaaggtcactct

SEQ ID NO: 147627 - DNA, 75 bp, Artificial Sequence
  Synthetic
cctgccgctgtaggactttcttaaagaaggttgcgggtaaattctgctgcttcatgcggtggttagggcaggagt

SEQ ID NO: 147628 - DNA, 75 bp, Artificial Sequence
  Synthetic
tggcgaacaaggttatgataatgaggcatttgaggggtcggatgttgaccctgctgaggaggccaccgtgagcat

SEQ ID NO: 147629 - DNA, 75 bp, Artificial Sequence
  Synthetic
tgcacgtgccggtcggcttgccgctaccgttgaagtttcagatgcagagggccgtcttacctgtaagaccatttt

SEQ ID NO: 147630 - DNA, 75 bp, Artificial Sequence
  Synthetic
ctaccaatcctatgtatgtttctgacactgtgacatttgttaatgtagctactggtgcccagggagtttcccgct

SEQ ID NO: 147631 - DNA, 75 bp, Artificial Sequence
  Synthetic
gccctctacaggtataacagattcacccagcggcattcgctgaccggcggcctttggctgcaccctgaggggctg

SEQ ID NO: 147632 - DNA, 75 bp, Artificial Sequence
  Synthetic
atcatttgacctgactaaacaaaccatggctgctggcccgcatagtcttagttacaccctaacaccagaaggcct

SEQ ID NO: 147633 - DNA, 75 bp, Artificial Sequence
  Synthetic
tacttttgatgatttctgccctgagtgccgtacactcggccttcagggctgtgcatttcagtcaactgttgctga

SEQ ID NO: 147634 - DNA, 75 bp, Artificial Sequence
  Synthetic
atggctgctggcccgcatagtcttagttacaccctaacaccagaaggccttgaggtgcatatcatttctgctggg

SEQ ID NO: 147635 - DNA, 75 bp, Artificial Sequence
  Synthetic
ggtaaaactcgggagtattgatttattttgcttgtgcctcccttcttttctgtttcttttatttctcttttctgc

SEQ ID NO: 147636 - DNA, 75 bp, Artificial Sequence
  Synthetic
ctactgctagtgaccagattctaattgagaatgcgtctggtcaccgtgtctgcatttcaacttatactactaatc

SEQ ID NO: 147637 - DNA, 75 bp, Artificial Sequence
  Synthetic
atggaggcccatcagtttattaaggctcctggcatcacaaccgccatcgagcaagctgctctggctgcggccaat

SEQ ID NO: 147638 - DNA, 75 bp, Artificial Sequence
  Synthetic
ctcctggcatcacaaccgccatcgagcaagctgctctggctgcggccaattctgccctggcgaatgctgtggtta

SEQ ID NO: 147639 - DNA, 75 bp, Artificial Sequence
  Synthetic
tcctttttgcggtgagagcactctttatactcgcacatggtccgtgtcgggtttttctagctgtttctctccctt

SEQ ID NO: 147640 - DNA, 75 bp, Artificial Sequence
  Synthetic
tgacgttgtgcgcttcgccggccggctcactgagaagaattggggccctggccccgagcgggcggagcagctccg

SEQ ID NO: 147641 - DNA, 75 bp, Artificial Sequence
  Synthetic
ttcggccgtttttgtcccggacacagactgagattctcattaaccttatgcagccccggcagctggttttccgcc

SEQ ID NO: 147642 - DNA, 75 bp, Artificial Sequence
  Synthetic
gactgagattctcattaaccttatgcagccccggcagctggttttccgcccggaggttttttggaaccaccccat

SEQ ID NO: 147643 - DNA, 75 bp, Artificial Sequence
  Synthetic
tagatgctgataccccgccattggttccccttgcacagactcagcccccaacccccagtcatgtggcgcccccac

SEQ ID NO: 147644 - DNA, 75 bp, Artificial Sequence
  Synthetic
cccaagatctattaatgataacccaaatgttcttcaccggtgcttcctcaggcccgttgggagggacgtccagcg

SEQ ID NO: 147645 - DNA, 75 bp, Artificial Sequence
  Synthetic
ttgcgccccccgccctcgagcctgttggaccgcccagccctattaaacttgcctcccccgtgcgtaagccaccga

SEQ ID NO: 147646 - DNA, 75 bp, Artificial Sequence
  Synthetic
taacccagcccgggccccgtcgacgactgcttcacacttatcccgacggctcgaaggtgtatgccggatctctct

SEQ ID NO: 147647 - DNA, 75 bp, Artificial Sequence
  Synthetic
tcgtacttattgctttgacgggttctccggctgcacctttgcggctgaaaccggtattgctctctactctttaca

SEQ ID NO: 147648 - DNA, 75 bp, Artificial Sequence
  Synthetic
tccggctgcacctttgcggctgaaaccggtattgctctctactctttacatgacttgtggcccgctgatgttgcg

SEQ ID NO: 147649 - DNA, 75 bp, Artificial Sequence
  Synthetic
tttaccagcggttcccagaatccttcgaccccgctgagttcatcatgtccgacgggcttgcagcctataccctga

SEQ ID NO: 147650 - DNA, 75 bp, Artificial Sequence
  Synthetic
ttgagtcagattgcgactggctggtgaatgcctctaacccgggccaccgccctgggggtggcctctgtcatgcct

SEQ ID NO: 147651 - DNA, 75 bp, Artificial Sequence
  Synthetic
ggccgttgtcttgaggtgggtgcccacccaagatccatcaatgacaacccaaatgtcctgcaccggtgcttcctc

SEQ ID NO: 147652 - DNA, 75 bp, Artificial Sequence
  Synthetic
cgctcctgactatcgggttgaacataaccctaagcgacttgaggccgcttaccgggagacgtgttctcgccgcgg

SEQ ID NO: 147653 - DNA, 75 bp, Artificial Sequence
  Synthetic
gctggtatatacaaggtccctgtcgggctgagctttgacgcctgggaacgtaaccatcgacctggggacgagttg

SEQ ID NO: 147654 - DNA, 75 bp, Artificial Sequence
  Synthetic
gactaaagttatcggcgaccatccgctggtgatagagcgtgttcgcgctattggctgccactttgtgttactgct

SEQ ID NO: 147655 - DNA, 75 bp, Artificial Sequence
  Synthetic
ggtttgaagccaaccggcctaccctccccgctctgactatcactgaggacacggcgcgcacggcgaacctggcat

SEQ ID NO: 147656 - DNA, 75 bp, Artificial Sequence
  Synthetic
ggtttgaagctaacaagccggcgcagccagcacttacgataacagaagatacggcccgcacggccaacctagcac

SEQ ID NO: 147657 - DNA, 75 bp, Artificial Sequence
  Synthetic
attcggcccgggcggctcgccctctctttttccatcagcttgctccacaaaatctacttttcacgccgtccctgt

SEQ ID NO: 147658 - DNA, 75 bp, Artificial Sequence
  Synthetic
ccgtcgtgacttatgagggggataccagtgcgggctataaccacgatgtgtctatacttcgtgcatggatccgca

SEQ ID NO: 147659 - DNA, 75 bp, Artificial Sequence
  Synthetic
tctatacttcgtgcatggatccgcaccactaagatagttggtgatcacccactggtaatagagagggtccgcgcc

SEQ ID NO: 147660 - DNA, 75 bp, Artificial Sequence
  Synthetic
tttggtgctacgctggatgaccaggccttttgttgctcgcggctcatgacctaccttcgcggtattagttacaaa

SEQ ID NO: 147661 - DNA, 75 bp, Artificial Sequence
  Synthetic
tagagctggatgcggccaccgaggtcggccgggcgtgcgctggctgccgtgttgaacctggtgtagttcattatc

SEQ ID NO: 147662 - DNA, 75 bp, Artificial Sequence
  Synthetic
caacccgtgagttacgtaactcgtggcgccgccgcgggtttgcagcctatacgccccataccgcagctcgtgtta

SEQ ID NO: 147663 - DNA, 75 bp, Artificial Sequence
  Synthetic
gtcactgttggtgctcttgtagccaatgagggttggaatgcttctgaggatgctctcactgcagtgattaccgcg

SEQ ID NO: 147664 - DNA, 75 bp, Artificial Sequence
  Synthetic
aatgccttatgtcccgtaccctcgctcaacagaggtgtatgttagatctatatttggccctggtgggtcgccttc

SEQ ID NO: 147665 - DNA, 75 bp, Artificial Sequence
  Synthetic
gcgtcgccggggctttgcggcctttacaccccacacggcggcccgtgtcactataggccgccgtgttgtgattga

SEQ ID NO: 147666 - DNA, 75 bp, Artificial Sequence
  Synthetic
gctacctccgcacccaggcgatttctaaaggtatgcgtcgactggagcttgagcacgcccagaagtttatcacca

SEQ ID NO: 147667 - DNA, 75 bp, Artificial Sequence
  Synthetic
ttacttctgctgcacatgcagcgggcctcgtcagtccatcttcttggtgatcctaatcaaatccccgccattgac

SEQ ID NO: 147668 - DNA, 75 bp, Artificial Sequence
  Synthetic
gctttctgctgctcgcggcttatgacctatctccgcgggattagctataaagtaaccgttggcgcacttgtcgcc

SEQ ID NO: 147669 - DNA, 75 bp, Artificial Sequence
  Synthetic
cccaaaccagatccccgccattgattttgagcacgctggtctggtccccgcaatccgccctgagcttgcaccaac

SEQ ID NO: 147670 - DNA, 75 bp, Artificial Sequence
  Synthetic
ctcactcccggcaacaccaatactcgggtctctcgttactccagcactgctcgccaccgtcttcgccgcggtgca

SEQ ID NO: 147671 - DNA, 75 bp, Artificial Sequence
  Synthetic
tcatttggaccctagagtgcttgtttttgatgagtctgtgcactgccgctgtaggagctttgtaaagaatgtggc

SEQ ID NO: 147672 - DNA, 75 bp, Artificial Sequence
  Synthetic
tgccgccgttggctctcagctggcttccatttggaccccagagttcttgtctttgacgaggcggtcccctgccgc

SEQ ID NO: 147673 - DNA, 75 bp, Artificial Sequence
  Synthetic
gggctcctccgtgaggtgggtatctccgatgctattgtcaataatttcttcctcgctagcggcgagattggtcag

SEQ ID NO: 147674 - DNA, 75 bp, Artificial Sequence
  Synthetic
actgttgagctcaccgccggcccagggcggcttgagtgtcgcactattttaggtaacaagaccttccgcactacg

SEQ ID NO: 147675 - DNA, 75 bp, Artificial Sequence
  Synthetic
cgaatggccctgagcagtatgtcctttcatttgatgaagcccgccagtgcatgggtgccggcccgcatagcctcg

SEQ ID NO: 147676 - DNA, 75 bp, Artificial Sequence
  Synthetic
cgaatggccctgagctgtatgtcctttcatttgatgaagcccgccagtgcatgggtgccggcccgcatagcctcg

SEQ ID NO: 147677 - DNA, 75 bp, Artificial Sequence
  Synthetic
cgaatggccctgagccgtatgtcctttcatttgatgaagcccgccagtgcatgggtgccggcccgcatagcctcg

SEQ ID NO: 147678 - DNA, 75 bp, Artificial Sequence
  Synthetic
cgaatggccctgagcggtatgtcctttcatttgatgaagcccgccagtgcatgggtgccggcccgcatagcctcg

SEQ ID NO: 147679 - DNA, 75 bp, Artificial Sequence
  Synthetic
ggcctatgaagggtctgaggtggaccccgctgagcctgctcatcttgatgtttctgggacctatgcggtccatgg

SEQ ID NO: 147680 - DNA, 75 bp, Artificial Sequence
  Synthetic
ttcatttgatgaagcccgccagtgcatgggtgccggcccgcatagcctcgtgtatgatctcacccccagcgggct

SEQ ID NO: 147681 - DNA, 75 bp, Artificial Sequence
  Synthetic
cagtacccagaataacttttcccttggccttgagtgtgtcattatggaggagtgtggcatgccccaatggctaat

SEQ ID NO: 147682 - DNA, 75 bp, Artificial Sequence
  Synthetic
gtatttgaaaatgatttctcggaatttgacagtactcagaacaatttctcccttggccttgagtgtgtggttatg

SEQ ID NO: 147683 - DNA, 75 bp, Artificial Sequence
  Synthetic
cgcagaggttacggccttctgtagtgccctttatagatataatagaaccatccagcgacactcgattgttggcgg

SEQ ID NO: 147684 - DNA, 75 bp, Artificial Sequence
  Synthetic
ttgacggacattgtgcattgccgtatggcagcacccagtcagcgtaaggcagtcctgtcgactcttgtcggcagg

SEQ ID NO: 147685 - DNA, 75 bp, Artificial Sequence
  Synthetic
aggctgcccatgcagatgttcgcgggtccttgaaccattttattcctgagctcagccctattaatgtcaccacct

SEQ ID NO: 147686 - DNA, 75 bp, Artificial Sequence
  Synthetic
caggtcatttctgggagtctaataacccgttttgtggtgaggagactctttataccaggacttggtccatgtctg

SEQ ID NO: 147687 - DNA, 75 bp, Artificial Sequence
  Synthetic
cctggcggggcaccaagcgctgcaccaggtgaagtggcggctttttgcagcgccctatataggtataataggttc

SEQ ID NO: 147688 - DNA, 75 bp, Artificial Sequence
  Synthetic
gcagctgcgtcttgctgtctgtgattttcttcgagggttaacgaatgttgcgcaggtctgtgttgatgttgtgtc

SEQ ID NO: 147689 - DNA, 75 bp, Artificial Sequence
  Synthetic
cccgatgatatgccttgtacaccggctccctccgagattgccgttcgaaccctgccgcccccccccgtggacctg

SEQ ID NO: 147690 - DNA, 75 bp, Artificial Sequence
  Synthetic
cccgatgatttgccttgtacaccggctccctccgagattgccgttcgaaccctgccgcccccccccgtggacctg

SEQ ID NO: 147691 - DNA, 75 bp, Artificial Sequence
  Synthetic
cccgatgatctgccttgtacaccggctccctccgagattgccgttcgaaccctgccgcccccccccgtggacctg

SEQ ID NO: 147692 - DNA, 75 bp, Artificial Sequence
  Synthetic
cccgatgatgtgccttgtacaccggctccctccgagattgccgttcgaaccctgccgcccccccccgtggacctg

SEQ ID NO: 147693 - DNA, 75 bp, Artificial Sequence
  Synthetic
cccgttgatatgccttgtacaccggctccctccgagattgccgttcgaaccctgccgcccccccccgtggacctg

SEQ ID NO: 147694 - DNA, 75 bp, Artificial Sequence
  Synthetic
cccgttgatttgccttgtacaccggctccctccgagattgccgttcgaaccctgccgcccccccccgtggacctg

SEQ ID NO: 147695 - DNA, 75 bp, Artificial Sequence
  Synthetic
cccgttgatctgccttgtacaccggctccctccgagattgccgttcgaaccctgccgcccccccccgtggacctg

SEQ ID NO: 147696 - DNA, 75 bp, Artificial Sequence
  Synthetic
cccgttgatgtgccttgtacaccggctccctccgagattgccgttcgaaccctgccgcccccccccgtggacctg

SEQ ID NO: 147697 - DNA, 75 bp, Artificial Sequence
  Synthetic
cccgctgatatgccttgtacaccggctccctccgagattgccgttcgaaccctgccgcccccccccgtggacctg

SEQ ID NO: 147698 - DNA, 75 bp, Artificial Sequence
  Synthetic
cccgctgatttgccttgtacaccggctccctccgagattgccgttcgaaccctgccgcccccccccgtggacctg

SEQ ID NO: 147699 - DNA, 75 bp, Artificial Sequence
  Synthetic
cccgctgatctgccttgtacaccggctccctccgagattgccgttcgaaccctgccgcccccccccgtggacctg

SEQ ID NO: 147700 - DNA, 75 bp, Artificial Sequence
  Synthetic
cccgctgatgtgccttgtacaccggctccctccgagattgccgttcgaaccctgccgcccccccccgtggacctg

SEQ ID NO: 147701 - DNA, 75 bp, Artificial Sequence
  Synthetic
cccggtgatatgccttgtacaccggctccctccgagattgccgttcgaaccctgccgcccccccccgtggacctg

SEQ ID NO: 147702 - DNA, 75 bp, Artificial Sequence
  Synthetic
cccggtgatttgccttgtacaccggctccctccgagattgccgttcgaaccctgccgcccccccccgtggacctg

SEQ ID NO: 147703 - DNA, 75 bp, Artificial Sequence
  Synthetic
cccggtgatctgccttgtacaccggctccctccgagattgccgttcgaaccctgccgcccccccccgtggacctg

SEQ ID NO: 147704 - DNA, 75 bp, Artificial Sequence
  Synthetic
cccggtgatgtgccttgtacaccggctccctccgagattgccgttcgaaccctgccgcccccccccgtggacctg

SEQ ID NO: 147705 - DNA, 75 bp, Artificial Sequence
  Synthetic
ttatttggtccgtggttccgcgctattgaaaaggagattctggcagcgcttgcacccaatatcttttatggcgat

SEQ ID NO: 147706 - DNA, 75 bp, Artificial Sequence
  Synthetic
ccggggcatctttgggagtctgcaaatcccttctgtggtgagagcacactttatacacggacttggtctacatct

SEQ ID NO: 147707 - DNA, 75 bp, Artificial Sequence
  Synthetic
ttgaaaaggagattctggcagcgcttgcacccaatatcttttatggcgatgcttttgaagacacagttttggccg

SEQ ID NO: 147708 - DNA, 75 bp, Artificial Sequence
  Synthetic
atggtgctaaagtttattcagggtccttgtttgagtctgattgtgactggctggttaacgcgtctaatcccgggc

SEQ ID NO: 147709 - DNA, 75 bp, Artificial Sequence
  Synthetic
atacctccgtggcattagctacaaagtcacggtcggcgctcttgtcgccaacgagggttggaatgcttccgagga

SEQ ID NO: 147710 - DNA, 75 bp, Artificial Sequence
  Synthetic
atcccttctgtggtgagagcacactttatacacggacttggtctacatctggtttctccagtgatttctccccgc

SEQ ID NO: 147711 - DNA, 75 bp, Artificial Sequence
  Synthetic
cggccgtgtccggggcagggtcttgcatggtattcgagaatgacttttctgaatttgacagtactcagaacaatt

SEQ ID NO: 147712 - DNA, 75 bp, Artificial Sequence
  Synthetic
gggtgtttccaccaccctccgaggggtcggcgatcgtcccgccgcccgagaccctggttagtaagccagctaatc

SEQ ID NO: 147713 - DNA, 75 bp, Artificial Sequence
  Synthetic
tgcgggacgggttggctgcttacaccctatcgcctcgcccgatcattcatgcagttgcccctgactatagagttg

SEQ ID NO: 147714 - DNA, 75 bp, Artificial Sequence
  Synthetic
agcgcccccccgctgccccccgccgtcgatctgccccagctggggctgcgccgttaactgctacttcaccagccc

SEQ ID NO: 147715 - DNA, 75 bp, Artificial Sequence
  Synthetic
gtcggcgatcgtcccgccgcccgagaccctggttagtaagccagctaatccgcctagccttactacacctagacc

SEQ ID NO: 147716 - DNA, 75 bp, Artificial Sequence
  Synthetic
gcaccctactgtggaataccgtctggaacatggcggttatagcacactgttatgagttccgtgaccttaaagctg

SEQ ID NO: 147717 - DNA, 75 bp, Artificial Sequence
  Synthetic
tcagattgtgattggctggtcaatgcatctaaccctggccaccgccctggcggtggtctttgccatgcattttac

SEQ ID NO: 147718 - DNA, 75 bp, Artificial Sequence
  Synthetic
gaatatggcgatcatagcacattgctatgagtttcgcgatttccgggttgccgcctttaagggtgatgattcggt

SEQ ID NO: 147719 - DNA, 75 bp, Artificial Sequence
  Synthetic
gagcgaaaccaccggcccggtgatgaactttacctcacggagccagcgatcgcttggttagaggccaataagcct

SEQ ID NO: 147720 - DNA, 75 bp, Artificial Sequence
  Synthetic
gagcgaaaccaccggcccggtgatgaactttacctcacggagccagcgatcgcttggtttgaggccaataagcct

SEQ ID NO: 147721 - DNA, 75 bp, Artificial Sequence
  Synthetic
gagcgaaaccaccggcccggtgatgaactttacctcacggagccagcgatcgcttggttcgaggccaataagcct

SEQ ID NO: 147722 - DNA, 75 bp, Artificial Sequence
  Synthetic
gagcgaaaccaccggcccggtgatgaactttacctcacggagccagcgatcgcttggttggaggccaataagcct

SEQ ID NO: 147723 - DNA, 75 bp, Artificial Sequence
  Synthetic
ctgggtgtggattgaagcttaaggtagattttaggcctattgggctgtatgctggtgtcgttgtggccccgggtc

SEQ ID NO: 147724 - DNA, 75 bp, Artificial Sequence
  Synthetic
gaagctgataccggcccagcactgccagctctgacaataacggaagatgcagctcgaacggctaaccttgcctta

SEQ ID NO: 147725 - DNA, 75 bp, Artificial Sequence
  Synthetic
cagctctgacaataacggaagatgcagctcgaacggctaaccttgccttagagatcgactccaggactgagctag

SEQ ID NO: 147726 - DNA, 75 bp, Artificial Sequence
  Synthetic
gtttgctgggcggctctcagagaagaactgggggccaggcccggagaggatggagcagcttcggctagccgtttg

SEQ ID NO: 147727 - DNA, 75 bp, Artificial Sequence
  Synthetic
gtaaatcgaggtccatacagcagggtgatgttgatgtggtggttgtgcccacccgcgagcttcgtaatagctggc

SEQ ID NO: 147728 - DNA, 75 bp, Artificial Sequence
  Synthetic
tactgagccagctgccgcctggtttgaggctaataagccgactcagccagccctaacaattactgaggacaccgc

SEQ ID NO: 147729 - DNA, 75 bp, Artificial Sequence
  Synthetic
tcgtacagccaaccttgcgcttgagattgactccgccactgaggtgggtcgtgcctgcgccggctgtactgttag

SEQ ID NO: 147730 - DNA, 75 bp, Artificial Sequence
  Synthetic
ccgacagaattgatttcgtcggccgggggtcagttgttctactcccgccctgtcgtctcggccaatggcgagccg

SEQ ID NO: 147731 - DNA, 75 bp, Artificial Sequence
  Synthetic
agtggccggcgtgttgtaatcgatgaagcgccatccctcccgccccacctgctcttactgcatatgcagcgtgct

SEQ ID NO: 147732 - DNA, 75 bp, Artificial Sequence
  Synthetic
gctcttactgcatatgcagcgtgcttcatcggtgcatcttctcggtgacccgaaccagattcccgcaattgattt

SEQ ID NO: 147733 - DNA, 75 bp, Artificial Sequence
  Synthetic
tcatcggtgcatcttctcggtgacccgaaccagattcccgcaattgatttcgagcatgcaggtcttgttcctgca

SEQ ID NO: 147734 - DNA, 75 bp, Artificial Sequence
  Synthetic
tctcgtcctttttcagtccttcgtgctaatgatgttttgtggctttctctcactgctgccgagtatgatcagact

SEQ ID NO: 147735 - DNA, 75 bp, Artificial Sequence
  Synthetic
cgaggggcgtaccctaagattcaaaccaccagccgtgtgctaaggtccctgttctggggagacccccccgttggt

SEQ ID NO: 147736 - DNA, 75 bp, Artificial Sequence
  Synthetic
gctgcttcacatgcagcgagcctcatcggtccatcttcttggcgaccccaaccagatccctgctattgactttga

SEQ ID NO: 147737 - DNA, 75 bp, Artificial Sequence
  Synthetic
ccaccagccgtgtgctaaggtccctgttctggggagacccccccgttggtcagaagttggttttcacgcaagctg

SEQ ID NO: 147738 - DNA, 75 bp, Artificial Sequence
  Synthetic
gcccgtcgtcgacctaccccagctggggcttcgccgttgacggctgtggctccggcccctgacactgctccggtc

SEQ ID NO: 147739 - DNA, 75 bp, Artificial Sequence
  Synthetic
accagatccctgctattgactttgagcatgccggtttggtcccagcgatccgccctgagctcgcccccactagtt

SEQ ID NO: 147740 - DNA, 75 bp, Artificial Sequence
  Synthetic
tcccagcgcccccccgctgccccccgtcgtcgatctgccccagctggggctgcgccgctgactgctatatcacca

SEQ ID NO: 147741 - DNA, 75 bp, Artificial Sequence
  Synthetic
gtggtataccgccccaacccgcggccctgcagcgaattgccgccggtctgcccttcgtgggcttccacctgctga

SEQ ID NO: 147742 - DNA, 75 bp, Artificial Sequence
  Synthetic
cgacggcagatgcgagaggcctcatccagtcatctcgggcgcatgcaattgtcgcgttaacccggcatacagaga

SEQ ID NO: 147743 - DNA, 75 bp, Artificial Sequence
  Synthetic
gccactgggactaatcttgtgctatatgctgccccgcttagccctctactcccactccaggatggcaccaacact

SEQ ID NO: 147744 - DNA, 75 bp, Artificial Sequence
  Synthetic
gtcgcgttaacccggcatacagagaagtgtgttattctagacgccccggggcttcttcgcgaggtgggcatatca

SEQ ID NO: 147745 - DNA, 75 bp, Artificial Sequence
  Synthetic
gtgccgaatgctgttggtgggtatgctatatctatttccttttggccccaaacaactaccaccccgacgtccgtg

SEQ ID NO: 147746 - DNA, 75 bp, Artificial Sequence
  Synthetic
aatcctgaccgaaaccttgacatccttcaggctttccccccttcatgccagattagtgcttaccaccagctggct

SEQ ID NO: 147747 - DNA, 75 bp, Artificial Sequence
  Synthetic
ttcaggctttccccccttcatgccagattagtgcttaccaccagctggctgaagagctcggtcaccggcccgcgc

SEQ ID NO: 147748 - DNA, 75 bp, Artificial Sequence
  Synthetic
gcacttactcgccatacagaaaaatgcgtcattcttgacgcccctggcctactgcgtgaggtcggcatttctgac

SEQ ID NO: 147749 - DNA, 75 bp, Artificial Sequence
  Synthetic
caaatgctgttggtggctatgctatctctatttctttttggccccagacaaccactacccctacttctgttgata

SEQ ID NO: 147750 - DNA, 75 bp, Artificial Sequence
  Synthetic
actgcgtgaggtcggcatttctgacataattgttaataacttcttcttggctggtggtgaagtgggtcaccatcg

SEQ ID NO: 147751 - DNA, 75 bp, Artificial Sequence
  Synthetic
gagcagtactgtcgagcccgtgctggtcgctgccttgaggtgggagcccatccgcgttccattaatgataacccc

SEQ ID NO: 147752 - DNA, 75 bp, Artificial Sequence
  Synthetic
ctgacagtgtattagtttttgagttgactgatatagtccactgccgtatggctgcccccagccagcggaaagccg

SEQ ID NO: 147753 - DNA, 75 bp, Artificial Sequence
  Synthetic
aatgttctgcatcgctgctttttgaaaccccgtggtcgtgatgttcagcggtggtataccgcccccacccgcggc

SEQ ID NO: 147754 - DNA, 75 bp, Artificial Sequence
  Synthetic
aaccccgtggtcgtgatgttcagcggtggtataccgcccccacccgcggccctgcagcgaactgccgccgatcgg

SEQ ID NO: 147755 - DNA, 75 bp, Artificial Sequence
  Synthetic
tgggcgccgaacaaggttatatgaggctgctcactctgatgtccgtgagtcactctcgaggtttattcccgccat

SEQ ID NO: 147756 - DNA, 75 bp, Artificial Sequence
  Synthetic
gagctgggccatcggccggccccagtggctgccgtcttgcccccctgccctgagcttgagcaggggctactctac

SEQ ID NO: 147757 - DNA, 75 bp, Artificial Sequence
  Synthetic
cggccctgtgcaggcaacaacttgcgagctctatgagctggttgaggcgatggtagagaaaggtcaggacgggtc

SEQ ID NO: 147758 - DNA, 75 bp, Artificial Sequence
  Synthetic
tggtagagaaaggtcaggacgggtcagctgtcctcgagcttgatctttgcagccgtgatgtgtctcgaataacct

SEQ ID NO: 147759 - DNA, 75 bp, Artificial Sequence
  Synthetic
gcccccagtcagcgcaaggcagtcctttcgacgctcgtcggtaggtacggccgccgaactaagctgtatgaagcg

SEQ ID NO: 147760 - DNA, 75 bp, Artificial Sequence
  Synthetic
tagggaggttcatccccaccatcggaccggtccgggccaccacgtgcgaactatacgagctggttgaggctatgg

SEQ ID NO: 147761 - DNA, 75 bp, Artificial Sequence
  Synthetic
ttttaattcatgatggcgatcgtgctgtgatcacatatgagggtgactcgagcgcagggtacaatcatgatgtgt

SEQ ID NO: 147762 - DNA, 75 bp, Artificial Sequence
  Synthetic
taaagggatgaagaggttggagcttgaacatgcacagaagtttataacacgcctttatagctggctgtttgagaa

SEQ ID NO: 147763 - DNA, 75 bp, Artificial Sequence
  Synthetic
atcttgctgacacgcttctcggtggtttgccgacagaattgatttcgtcggctgggggccagttgttctactccc

SEQ ID NO: 147764 - DNA, 75 bp, Artificial Sequence
  Synthetic
gagaaacagatactaaccctgctcccgcctaacattttctatggtgatgcttatgaggactctgtgttctctgcg

SEQ ID NO: 147765 - DNA, 75 bp, Artificial Sequence
  Synthetic
ttggtcattgagcgggtccgggcggtagggtgccattttgtgcttttgctcacagctgcgcctgaaccatcgccg

SEQ ID NO: 147766 - DNA, 75 bp, Artificial Sequence
  Synthetic
tccagaaggattgtaataaatttacaacaggtgagaccattgcccatggcaaggtgggccagggcatttcggctt

SEQ ID NO: 147767 - DNA, 75 bp, Artificial Sequence
  Synthetic
aacaggtgagaccattgcccatggcaaggtgggccagggcatttcggcttggagtaagaccttctgtgctttatt

SEQ ID NO: 147768 - DNA, 75 bp, Artificial Sequence
  Synthetic
tcacttggccttgagtgtgtgattatggaggaatgtggcatgccccagtggctagtcagactgtaccatctggtg

SEQ ID NO: 147769 - DNA, 75 bp, Artificial Sequence
  Synthetic
gccctgtcgtctcagccaatggcgagccgactgtaaagctatatacatctgttgagaatgcgcagcaggataagg

SEQ ID NO: 147770 - DNA, 75 bp, Artificial Sequence
  Synthetic
tggaggaatgtggcatgccccagtggctagtcagactgtaccatctggtgcggtctgcctggattttacaggccc

SEQ ID NO: 147771 - DNA, 75 bp, Artificial Sequence
  Synthetic
atcagactacctatggctcttctactaaccctatgtatgtttctgatactgtgacgttcgtcaatgtggctaccg

SEQ ID NO: 147772 - DNA, 75 bp, Artificial Sequence
  Synthetic
ttttcgagaacgatttttctgagtttgatagcacccaaaacaacttttctcttggccttgagtgcgttattatgg

SEQ ID NO: 147773 - DNA, 75 bp, Artificial Sequence
  Synthetic
atatggcggtcatagctcattgttatgagttccgcgatttcaaggttgctgcgtttaaaggggacgattcagtcg

SEQ ID NO: 147774 - DNA, 75 bp, Artificial Sequence
  Synthetic
acgaaggctggaacgcctccgaggatgcgctgactgctgtaattactgcagcttaccttactatttgtcatcaga

SEQ ID NO: 147775 - DNA, 75 bp, Artificial Sequence
  Synthetic
ggctgcgggctcaagctcaaagttgactaccgtcctgtcgggctctatgccggagttgtggttgcccctggcctt

SEQ ID NO: 147776 - DNA, 75 bp, Artificial Sequence
  Synthetic
cggagttgtggttgcccctggccttggcacgttgcccgacgtcgtccggttcgctggccggctgtcagaaaagaa

SEQ ID NO: 147777 - DNA, 75 bp, Artificial Sequence
  Synthetic
tggcgatcatagcacactgctatgaattccgtgacttgagagtggcagcgtttaagggggatgattcagtggttc

SEQ ID NO: 147778 - DNA, 75 bp, Artificial Sequence
  Synthetic
ctctgggcctgtttctatttccgctgtcggtgtcctcgcacctcattctgcattggctgttttagaggacactgc

SEQ ID NO: 147779 - DNA, 75 bp, Artificial Sequence
  Synthetic
gtcgccggtggttgtctgccggctttcatctcgacccacgcgtactcgtatttgatgaagcagccccctgccgct

SEQ ID NO: 147780 - DNA, 75 bp, Artificial Sequence
  Synthetic
tcatctcgacccacgcgtactcgtatttgatgaagcagccccctgccgctgccgtaactttcttcggaaagctgc

SEQ ID NO: 147781 - DNA, 75 bp, Artificial Sequence
  Synthetic
ctcgactgcaaggccgtctttccatctggtgtcgctacgccctcagcccctggagaggtgtctgcattctgctcg

SEQ ID NO: 147782 - DNA, 75 bp, Artificial Sequence
  Synthetic
ctggtgtcgctacgccctcagcccctggagaggtgtctgcattctgctcggccttgtataggttcaaccgctgcg

SEQ ID NO: 147783 - DNA, 75 bp, Artificial Sequence
  Synthetic
tctcgtgtttatggggtgagccctgggcttgtacataaccttattggcatgttacagacaattgctgacggtaag

SEQ ID NO: 147784 - DNA, 75 bp, Artificial Sequence
  Synthetic
aaacccgggagtattgatttattttgcctgtgccttcctttctgcctctttccttttacttcttttttctgcgtt

SEQ ID NO: 147785 - DNA, 75 bp, Artificial Sequence
  Synthetic
tgtttttctttgcatcgcccatgggttcaccatgcgccctggggctattttgctgctgctcgtcgtgtgtttgcc

SEQ ID NO: 147786 - DNA, 75 bp, Artificial Sequence
  Synthetic
ctctgggtcatatattgtaactggtagccagctacagcctctatatcaggcacttggtatcccctctgatcttgc

SEQ ID NO: 147787 - DNA, 75 bp, Artificial Sequence
  Synthetic
agccagctacagcctctatatcaggcacttggtatcccctctgatcttgctgctcgtgccggccggcttactgcc

SEQ ID NO: 147788 - DNA, 75 bp, Artificial Sequence
  Synthetic
ccccttttgtggtgagagcacactttatactcgcacctggtcggtatcaggtttttcgagctgtttctccccact

SEQ ID NO: 147789 - DNA, 75 bp, Artificial Sequence
  Synthetic
cagcccttcgccctcccctattttcatccaaccaaccccttcgccgctgacgttgacccacatcccgggtctgga

SEQ ID NO: 147790 - DNA, 75 bp, Artificial Sequence
  Synthetic
ttcgccgatggtgcccagctagaggccaatgggccggagcagtatatgctgtcatttgacccggctaagcagact

SEQ ID NO: 147791 - DNA, 75 bp, Artificial Sequence
  Synthetic
tacacagacccagccaccggtctctgagcaagtggcatcccccttggatttacctgaccgtggtgctagccccac

SEQ ID NO: 147792 - DNA, 75 bp, Artificial Sequence
  Synthetic
ccaatgggccggagcagtatatgctgtcatttgacccggctaagcagactatggccgctggcccgcatagcctca

SEQ ID NO: 147793 - DNA, 75 bp, Artificial Sequence
  Synthetic
gtcccagcgcccccccgctgcctcgcgtcgtcgatctaccccagctggggctgcgccgttgaccgctgtttcacc

SEQ ID NO: 147794 - DNA, 75 bp, Artificial Sequence
  Synthetic
acttcacacttacccagatggctcaaaagtgtatgccggttccctttttgagtctgaatgcacctggctggtcaa

SEQ ID NO: 147795 - DNA, 75 bp, Artificial Sequence
  Synthetic
ccggcgtcgcaacgccctcagcccctggggaggtgtctgcattttgctcggctttatacaggttcaaccgctgtg

SEQ ID NO: 147796 - DNA, 75 bp, Artificial Sequence
  Synthetic
tggggaggtgtctgcattttgctcggctttatacaggttcaaccgctgtgtccagcggcactctcttatcggggg

SEQ ID NO: 147797 - DNA, 75 bp, Artificial Sequence
  Synthetic
ttcacctttaacttcgactgttgcctcaggcactaaccttgttctatatgctgcaccgcttaaccccctcctgcc

SEQ ID NO: 147798 - DNA, 75 bp, Artificial Sequence
  Synthetic
gagacgggtattgccctctattcactgcatgacctatggcctgctgatgttgccgaggcgatggcccgtcacggt

SEQ ID NO: 147799 - DNA, 75 bp, Artificial Sequence
  Synthetic
gctcctcttggcgtgaccagtcccagcgcccccccgctgccctccgtcgtcgacctaccccaactggggctgcgc

SEQ ID NO: 147800 - DNA, 75 bp, Artificial Sequence
  Synthetic
ccccttttgtggtgagagcacactctacacccgcacctggtcagtatcaggtttttcaagctgtttctccccact

SEQ ID NO: 147801 - DNA, 75 bp, Artificial Sequence
  Synthetic
tacacccgcacctggtcagtatcaggtttttcaagctgtttctccccactcgagccctgtgccccggatctgccg

SEQ ID NO: 147802 - DNA, 75 bp, Artificial Sequence
  Synthetic
gccagtataatttgtccacctcccctttaacttcatctgttgcttctgggactaatcttgttttgtatgccgccc

SEQ ID NO: 147803 - DNA, 75 bp, Artificial Sequence
  Synthetic
cccaatgcagtcggtggctatgcaatttctatctctttttggccccagaccactacaacccctacctccgttgat

SEQ ID NO: 147804 - DNA, 75 bp, Artificial Sequence
  Synthetic
gagcgggtggcaccccccccggatttgcctgaccgtggtaccggccccatgaccggtgcccctgcggcgtcccct

SEQ ID NO: 147805 - DNA, 75 bp, Artificial Sequence
  Synthetic
agtatcgggtagtccgggctacaattcgctatcgccctttggtgccgaatgctgtcggtggttatgcaatttcta

SEQ ID NO: 147806 - DNA, 75 bp, Artificial Sequence
  Synthetic
gagcgtctccactatcgtaaccaagggtggcgttctgtcgagacctccggtgtggctgaggaggaggccacttcc

SEQ ID NO: 147807 - DNA, 75 bp, Artificial Sequence
  Synthetic
ttgaccgagccggctatagcttggtttgaggctaaccggcccacccttcctgccttgaccattactgaggacgca

SEQ ID NO: 147808 - DNA, 75 bp, Artificial Sequence
  Synthetic
tgcctgaccgtggtaccggccccatgaccggtgcccctgcggcgtcccctacgccgccgcagtccataacccatt

SEQ ID NO: 147809 - DNA, 75 bp, Artificial Sequence
  Synthetic
tcgctatcgccctttggtgccgaatgctgtcggtggttatgcaatttctatttccttctggcctcagaccacaac

SEQ ID NO: 147810 - DNA, 75 bp, Artificial Sequence
  Synthetic
ctgaatgcacctggctggtaaatgcttccaaccctggccaccgtcctggtggcggcctctgccatgcgttctacc

SEQ ID NO: 147811 - DNA, 75 bp, Artificial Sequence
  Synthetic
tgagctggtcatcccgagtgagcgccttcattatcgcaatcagggttggcgttctgttgagacatcgggtgtggc

SEQ ID NO: 147812 - DNA, 75 bp, Artificial Sequence
  Synthetic
cttcattatcgcaatcagggttggcgttctgttgagacatcgggtgtggcagaggaggaggcaacatcaggcttg

SEQ ID NO: 147813 - DNA, 75 bp, Artificial Sequence
  Synthetic
aacggttcccagagtcattcgatcccgctgagttcgttatgtcggatgggtttgcagcctacaccctgtcccccc

SEQ ID NO: 147814 - DNA, 75 bp, Artificial Sequence
  Synthetic
cctcacactgcagcccgtgtaactcgcggccgtagggttgttattgatgaggccccctcgctcccaccgcacctg

SEQ ID NO: 147815 - DNA, 75 bp, Artificial Sequence
  Synthetic
aggacgcgctgaccgccgtaatcactgcggcttatctcactatctgtcatcagaggtacctccgcacgcaggcca

SEQ ID NO: 147816 - DNA, 75 bp, Artificial Sequence
  Synthetic
ctcttgctacatatgcagcgggcctcatcagtccacctcctcggtgaccctaaccaaatccccgccattgatttt

SEQ ID NO: 147817 - DNA, 75 bp, Artificial Sequence
  Synthetic
ggccgggggtcaggtattctactcccgccccgtcgtctcagccaatggcgagccgactgtcaagttgtatacatc

SEQ ID NO: 147818 - DNA, 75 bp, Artificial Sequence
  Synthetic
tagatgcccggcggatgtctgtgagctaatccgcggtgcatacccgaagatccagactttaagtcgcgttctacg

SEQ ID NO: 147819 - DNA, 75 bp, Artificial Sequence
  Synthetic
actgagccagccgtagcttggtttgaggcaaaccggcccaccctcccagctcttactattactgaggataccgca

SEQ ID NO: 147820 - DNA, 75 bp, Artificial Sequence
  Synthetic
gggatcgcgatacctcatgacattgatcttggcgactcccgcgttgttattcaggactatgacaatcaacatgag

SEQ ID NO: 147821 - DNA, 75 bp, Artificial Sequence
  Synthetic
tcttactattactgaggataccgcacgtacggcgaacctggcattggagctagactccgccactgaagtcggccg

SEQ ID NO: 147822 - DNA, 75 bp, Artificial Sequence
  Synthetic
cgtacggcgaacctggcattggagctagactccgccactgaagtcggccgggcgtgtgctggctgccgcgtcgag

SEQ ID NO: 147823 - DNA, 75 bp, Artificial Sequence
  Synthetic
gttttcacctcgatcctcgtgtgctcgtttttgatgaagctgccccctgccgctgccggagttttctgcgtgaag

SEQ ID NO: 147824 - DNA, 75 bp, Artificial Sequence
  Synthetic
ctattaagttatacacctcagtcgagaatgcacagcaggataaaggcattgccataccacacgatatagatttag

SEQ ID NO: 147825 - DNA, 75 bp, Artificial Sequence
  Synthetic
catttaccgagaccacaattatcgccactgcagacgcccgtgggctgatccagtcctctagggcccatgcgattg

SEQ ID NO: 147826 - DNA, 75 bp, Artificial Sequence
  Synthetic
gcatctctgggtcatatattgttaccggccgtcagctgcagcctctttatcaagcgcttggcataccatctgatc

SEQ ID NO: 147827 - DNA, 75 bp, Artificial Sequence
  Synthetic
cccgtcccttttcagtccttcgagccaatgacgtcctgtggctctctctgactgcggctgaatatgatcagacta

SEQ ID NO: 147828 - DNA, 75 bp, Artificial Sequence
  Synthetic
actctaaaatgttttatgttctccccttgcgcggtaagctctccttctgggaggccggtactaccaaggcaggtt

SEQ ID NO: 147829 - DNA, 75 bp, Artificial Sequence
  Synthetic
cttgcgcggtaagctctccttctgggaggccggtactaccaaggcaggttacccctataattacaacactaccgc

SEQ ID NO: 147830 - DNA, 75 bp, Artificial Sequence
  Synthetic
gaggccggtactaccaaggcaggttacccctataattacaacactaccgccagcgaccagatcttgattgagaat

SEQ ID NO: 147831 - DNA, 75 bp, Artificial Sequence
  Synthetic
gaccggagttggtcccgacaaaatggtggcacgtcactcatagatgtccagccgatgtctgtgagttaatccgtg

SEQ ID NO: 147832 - DNA, 75 bp, Artificial Sequence
  Synthetic
gaggccaacgggccggaacagtatgttctatcatttgatctgactaaacaaactatggctgctggcccgcatagt

SEQ ID NO: 147833 - DNA, 75 bp, Artificial Sequence
  Synthetic
gtggcacgtcactcatagatgtccagccgatgtctgtgagttaatccgtggtgcgtacccaaaaatccagactgc

SEQ ID NO: 147834 - DNA, 75 bp, Artificial Sequence
  Synthetic
aactatggctgctggcccgcatagtcttagttataccttaacatctgaaggccttgaagtacatattatttccgc

SEQ ID NO: 147835 - DNA, 75 bp, Artificial Sequence
  Synthetic
ctgtcgcccgctcccttgactggtctaaggtcaccttagatggccggcctctcaccaccattcagcagtactcta

SEQ ID NO: 147836 - DNA, 75 bp, Artificial Sequence
  Synthetic
gccgatgtctgtgagttaatccgtggtgcgtacccaaaaatccagactgcaagccgcgttctccgctccctgttc

SEQ ID NO: 147837 - DNA, 75 bp, Artificial Sequence
  Synthetic
acggacatagtgcactgccgtatggcggcgccaagtcagcgtaaggcagtcctatcgactttagtcggtaggtat

SEQ ID NO: 147838 - DNA, 75 bp, Artificial Sequence
  Synthetic
taaggtcaccttagatggccggcctctcaccaccattcagcagtactctaagacattttatgtgctgccgcttcg

SEQ ID NO: 147839 - DNA, 75 bp, Artificial Sequence
  Synthetic
gtccatgaagcccagggcgcaactttcactgagactacaattattgccactgcagacgcccgcgggctgattcag

SEQ ID NO: 147840 - DNA, 75 bp, Artificial Sequence
  Synthetic
tcagtctactgttgctgagcttcaacgccttaagatgaaggtgggtaaaacccgggagtcttaattaattcttgc

SEQ ID NO: 147841 - DNA, 75 bp, Artificial Sequence
  Synthetic
tcactgagactacaattattgccactgcagacgcccgcgggctgattcagtcctctagggcccatgcgattgtgg

SEQ ID NO: 147842 - DNA, 75 bp, Artificial Sequence
  Synthetic
cccgggagtcttaattaattcttgctgtgccttccttctttgctgattgctttatttcttatttctgcgcttcgc

SEQ ID NO: 147843 - DNA, 75 bp, Artificial Sequence
  Synthetic
ggccccattaacgtcaccacttgtgagctctacgagctcgtagaggctatggtagagaagggtcaggatggctcc

SEQ ID NO: 147844 - DNA, 75 bp, Artificial Sequence
  Synthetic
tgctcgtgcccatacttttgatgatttctgccctgagtgccgcaatctcggcctacagggctgtgcttttcagtc

SEQ ID NO: 147845 - DNA, 75 bp, Artificial Sequence
  Synthetic
aggcagaccacatatgtggtcgatgccatggaggcccatcagtttatcaaggctcctggcatcactactgctatt

SEQ ID NO: 147846 - DNA, 75 bp, Artificial Sequence
  Synthetic
ccatggaggcccatcagtttatcaaggctcctggcatcactactgctattgagcaggctgctctagcagcggcca

SEQ ID NO: 147847 - DNA, 75 bp, Artificial Sequence
  Synthetic
cttccagaaggactgtaataaattcactacaggtgaaacgatagcgcacggtaaggtcgggcaggggatatctgc

SEQ ID NO: 147848 - DNA, 75 bp, Artificial Sequence
  Synthetic
ctctcgagcctcgtgccccggagctgccacctctaggtgacattgacatgtctgtagttattgataccccgccat

SEQ ID NO: 147849 - DNA, 75 bp, Artificial Sequence
  Synthetic
ctatagtcaataactctttcctttccggtggtcaggtcggccagcaccgcccgtctgtcataccacgtggcacca

SEQ ID NO: 147850 - DNA, 75 bp, Artificial Sequence
  Synthetic
agtcttaattaattcccccttgtgcccccttctaagctttgctctgttattcttttttttctgcgtttcgcgctc

SEQ ID NO: 147851 - DNA, 75 bp, Artificial Sequence
  Synthetic
gccacctctaggtgacattgacatgtctgtagttattgataccccgccattggtttcccctgtgcagactcagcc

SEQ ID NO: 147852 - DNA, 75 bp, Artificial Sequence
  Synthetic
tgcaacctcgccagcttgttttccgccccgaggttttctggaatcaccccatccagcgtgtcatccataatgagc

SEQ ID NO: 147853 - DNA, 75 bp, Artificial Sequence
  Synthetic
cccgcctgaggtcttactgccgccaggcacctaccacaccaccacctaccttctcattcacgacggcgctcgtgc

SEQ ID NO: 147854 - DNA, 75 bp, Artificial Sequence
  Synthetic
atccagcgtgtcatccataatgagctggagctttactgccgcgcccgctccggccgctgccttgaaattggcgcc

SEQ ID NO: 147855 - DNA, 75 bp, Artificial Sequence
  Synthetic
cggtggtcaggtcggccagcaccgcccgtctgtcataccacgtggcaccattgacagtaatgttgatacacttga

SEQ ID NO: 147856 - DNA, 75 bp, Artificial Sequence
  Synthetic
ggctcctggcatcactactgctattgagcaggctgctctagcagcggccaactctgtcctggcggatgctgtggt

SEQ ID NO: 147857 - DNA, 75 bp, Artificial Sequence
  Synthetic
ctaatgtggtccaccgctgcttcctccgccctgttgggcgtgatgttcagcgctggtatactgcacccactcgcg

SEQ ID NO: 147858 - DNA, 75 bp, Artificial Sequence
  Synthetic
gttctgcttgggtcctgcaggccccgaaggagtccctacggggcttttggaagaaacattctggtgagcctggca

SEQ ID NO: 147859 - DNA, 75 bp, Artificial Sequence
  Synthetic
ccgccctggtggtggcctttgccatgcattttaccaacggttcccagagtcttttgaccccgctgagtttatcat

SEQ ID NO: 147860 - DNA, 75 bp, Artificial Sequence
  Synthetic
cacgatatgtcaccatctgacgtcgccgaggccatgtctcgtcatggtatgacgcggctttatgccgccctccat

SEQ ID NO: 147861 - DNA, 75 bp, Artificial Sequence
  Synthetic
acataaccccaagcgacttgaggccgcctaccgggagacgtgctctcgccgtgggacagcagcttaccccttgct

SEQ ID NO: 147862 - DNA, 75 bp, Artificial Sequence
  Synthetic
ctacccacttcttggctcgggtatataccaggtccctgttggtctcagttttgatgcctgggagcgtaatcatcg

SEQ ID NO: 147863 - DNA, 75 bp, Artificial Sequence
  Synthetic
gttgggttgagctttgatgcttgggaacgtaaccatcggcctggagacgagctgtatttgaccgagccagccata

SEQ ID NO: 147864 - DNA, 75 bp, Artificial Sequence
  Synthetic
gcacccttcccgatgtcgtcaggttcgccgggcggctttcggaaaagaactgggggccgggcccggagagagcag

SEQ ID NO: 147865 - DNA, 75 bp, Artificial Sequence
  Synthetic
ctagtgctggttataaccacgatgtctccaacctgcgctcctggattagaaccaccaaggttactggagaccatc

SEQ ID NO: 147866 - DNA, 75 bp, Artificial Sequence
  Synthetic
aagttgggcaggggatatctgcatggagtaaaaccttctgtgccctgtttggtccctggttccgtgctattgaga

SEQ ID NO: 147867 - DNA, 75 bp, Artificial Sequence
  Synthetic
ttttgagaatgatttttcagagtttgatagtactcagaataatttctcgcttgggctggagtgtataattatgga

SEQ ID NO: 147868 - DNA, 75 bp, Artificial Sequence
  Synthetic
gcaaggggaagtagacgtcatagtagtgccaacccgtgagttgcgtaactcatggcgccgccgcgggtttgcagc

SEQ ID NO: 147869 - DNA, 75 bp, Artificial Sequence
  Synthetic
ccgcctgggtcctccagaccccgaaggagtccctgcggggtttttggaagaagcattctggtgagcctggcacct

SEQ ID NO: 147870 - DNA, 75 bp, Artificial Sequence
  Synthetic
acacttgctcctgctgcatatgcagcgggcctcgtcagttcaccttcttggtgatcctaaccaaattcccgccat

SEQ ID NO: 147871 - DNA, 75 bp, Artificial Sequence
  Synthetic
tcaagggggatgattctgttgtgctctgtagcgattaccggcagagccgcaatgcggctgcgttgatcgctggtt

SEQ ID NO: 147872 - DNA, 75 bp, Artificial Sequence
  Synthetic
aggttactgtgggtacccttgtggccaacgaaggctggaacgcctctgaggacgccctcacagctgtcatcaccg

SEQ ID NO: 147873 - DNA, 75 bp, Artificial Sequence
  Synthetic
tccggccgtttttatctcgtgtgcaaaccgagattcttattaatttgatgcaaccccggcagttggtcttccgtc

SEQ ID NO: 147874 - DNA, 75 bp, Artificial Sequence
  Synthetic
taggcctattgggttatatgctggtgttgttgttgccccgggccttggcacccttcccgatgtcgtcaggtttgc

SEQ ID NO: 147875 - DNA, 75 bp, Artificial Sequence
  Synthetic
gatgttgactcacgtggtgctattctgcgccgtcaatataatctgtccacatccccgcttacgtctactattgca

SEQ ID NO: 147876 - DNA, 75 bp, Artificial Sequence
  Synthetic
gtgtaggcgctggctttcggccggcttccatcttgacccacgggtgttggtttttgacgagtcggccccctgcca

SEQ ID NO: 147877 - DNA, 75 bp, Artificial Sequence
  Synthetic
gaccggttggccgagatgtccagcgctggtactctgcccccacccgtggccctgcggccaattgccgccgctccg

SEQ ID NO: 147878 - DNA, 75 bp, Artificial Sequence
  Synthetic
aggccgccaaggctgctaaccctggtgcaattacagttcatgaagcccagggcgctacattcactgagactacaa

SEQ ID NO: 147879 - DNA, 75 bp, Artificial Sequence
  Synthetic
ctctcaaagttctgctgctttatgaagtggcttggtcaggagtgtacttgtttccttcagcctgcagaaggcgtc

SEQ ID NO: 147880 - DNA, 75 bp, Artificial Sequence
  Synthetic
agcctctgagctggtgattcctagtgaacgcctgcactaccgtaatcagggttggcgctcggttgagacttcagg

SEQ ID NO: 147881 - DNA, 75 bp, Artificial Sequence
  Synthetic
agtgcgggctataatcacgatgtttccatactccgtgcgtggatccgcactactaaaatagttggtgaccacccg

SEQ ID NO: 147882 - DNA, 75 bp, Artificial Sequence
  Synthetic
tgggcggatcgattgtgagacccttcttggtaacaaaaccttccgcacgtcattcgttgacggggcggtcttaga

SEQ ID NO: 147883 - DNA, 75 bp, Artificial Sequence
  Synthetic
tacaccttacaccggcgccctcggcctgcttgactttgcactcgagctcgagttccgcaatctgacacctggtaa

SEQ ID NO: 147884 - DNA, 75 bp, Artificial Sequence
  Synthetic
tcggctccgcttggcgcgaccaatcccagcgccccgccgctcccgcccgtcgtcgacctgccccagctggggctt

SEQ ID NO: 147885 - DNA, 75 bp, Artificial Sequence
  Synthetic
ccagcgccccgccgctcccgcccgtcgtcgacctgccccagctggggcttcgccgctaacagctgtagccccagc

SEQ ID NO: 147886 - DNA, 75 bp, Artificial Sequence
  Synthetic
cctggcgaggtcaccgccttttgctccgccctatacaggttcaatcgtgaggcccagcgccattcgctgaccggt

SEQ ID NO: 147887 - DNA, 75 bp, Artificial Sequence
  Synthetic
attcagatgtccgtgagtccctagctaggttcatccccactatcggacctgtccaggccaccacgtgtgagttat

SEQ ID NO: 147888 - DNA, 75 bp, Artificial Sequence
  Synthetic
tttggtgccaccctggatgatcaggcgttctgttgttcacggctcatgacttaccttcgtggtattagctacaag

SEQ ID NO: 147889 - DNA, 75 bp, Artificial Sequence
  Synthetic
accgcttacatccaccattgctactggcactaatcttgtactatatgctgccccactgagccctttgcttcccct

SEQ ID NO: 147890 - DNA, 75 bp, Artificial Sequence
  Synthetic
ccaggatgggactaatactcatatcatggccactgaggcctctgactatgctcagtatcgtgttgtccgtgccac

SEQ ID NO: 147891 - DNA, 75 bp, Artificial Sequence
  Synthetic
aatccattctgtggcgagagcacactatatactcgtacctggtcggaggttgacgccgtctctagtccggcccgg

SEQ ID NO: 147892 - DNA, 75 bp, Artificial Sequence
  Synthetic
cccgacttaggttttatgtctgagccttctatacctagtagggccaccacacccatccccgcggcccctctacct

SEQ ID NO: 147893 - DNA, 75 bp, Artificial Sequence
  Synthetic
cgctctatttggcccgtggttccgcgctattgagaaggagattctggcagcactcgcacctaatatcttctatgg

SEQ ID NO: 147894 - DNA, 75 bp, Artificial Sequence
  Synthetic
ggcgctcggttgagacttctggtgttgcggaggaggaggctacctctggccttgttatgctttgtatccatggat

SEQ ID NO: 147895 - DNA, 75 bp, Artificial Sequence
  Synthetic
tgcggaggaggaggctacctctggccttgttatgctttgtatccatggatcacctgtaaattcttatactactac

SEQ ID NO: 147896 - DNA, 75 bp, Artificial Sequence
  Synthetic
cccagggggttgcacgctctctggactggtccaaggttacccttgatgggcgcccacttaccactattcagcagt

SEQ ID NO: 147897 - DNA, 75 bp, Artificial Sequence
  Synthetic
aggttgtatcacctggttcggtcagcctggattctgcaggcgccgaaggagtctcttaaaggtttttggaagaag

SEQ ID NO: 147898 - DNA, 75 bp, Artificial Sequence
  Synthetic
gaacacgcgcgtctcccgttattcgagtagcgcacgtcacaagttgcgccgaggacctgacggtacagcggagct

SEQ ID NO: 147899 - DNA, 75 bp, Artificial Sequence
  Synthetic
gaggacctgacggtacagcggagctaactactactgctgctacacgtcttatgaaagatctccattttactggga

SEQ ID NO: 147900 - DNA, 75 bp, Artificial Sequence
  Synthetic
atccatataattataatactactgccagtgaccagattttgattgagaatgcggcgggtcaccgtgtttgcattt

SEQ ID NO: 147901 - DNA, 75 bp, Artificial Sequence
  Synthetic
cagtgaccagattttgattgagaatgcggcgggtcaccgtgtttgcatttctacttacactactaatttaggtgc

SEQ ID NO: 147902 - DNA, 75 bp, Artificial Sequence
  Synthetic
accgcttagagtgccgcactgtgcttggtaataagacctttcggacgacggtggttgatggcgcccatcttgaag

SEQ ID NO: 147903 - DNA, 75 bp, Artificial Sequence
  Synthetic
tggtaataagacctttcggacgacggtggttgatggcgcccatcttgaagcaaatggccctgagcagtatgttct

SEQ ID NO: 147904 - DNA, 75 bp, Artificial Sequence
  Synthetic
ttatccagcccgcgctcatacttttgacgacttttgccctgagtgccgtgcgttaggcctccagggctgtgcctt

SEQ ID NO: 147905 - DNA, 75 bp, Artificial Sequence
  Synthetic
caaatggccctgagcagtatgttctatcatttgacgcctcccgtcagtctatgggggccggatcgcacagcctca

SEQ ID NO: 147906 - DNA, 75 bp, Artificial Sequence
  Synthetic
cttgctgccagatggtttgaggccaatcggccgacccgcccaactctcactataaccgaggatgttgcacggaca

SEQ ID NO: 147907 - DNA, 75 bp, Artificial Sequence
  Synthetic
cgtcttaaaatgaaggtgggtaaaacccgggaggattgatttattcttcttgtacctccttttgtactgtttttt

SEQ ID NO: 147908 - DNA, 75 bp, Artificial Sequence
  Synthetic
ccggcggcgcccctagcgccgcaccgggggaggtggcagccttttgcagtgccctttatagatataacaggttca

SEQ ID NO: 147909 - DNA, 75 bp, Artificial Sequence
  Synthetic
gttgttcagtaccagtttactgctggtgtgcctggatccggcaagtcccgctctatcactcaagccgatgtggac

SEQ ID NO: 147910 - DNA, 75 bp, Artificial Sequence
  Synthetic
gccctttatagatataacaggttcacccaacggcactcgctgaccggtggattatggctacaccctgaggggttg

SEQ ID NO: 147911 - DNA, 75 bp, Artificial Sequence
  Synthetic
agggggtttctcgttccctggactggtctaaagtcaccctcgatggtcggccgcttacgactattcagcagtatt

SEQ ID NO: 147912 - DNA, 75 bp, Artificial Sequence
  Synthetic
ccagcgagtcatacataatgagctggagcagtattgccgtgctcgagctggtcgctgcctggaggtaggggctca

SEQ ID NO: 147913 - DNA, 75 bp, Artificial Sequence
  Synthetic
gagcagtattgccgtgctcgagctggtcgctgcctggaggtaggggctcatccaagatctattaatgacaacccc

SEQ ID NO: 147914 - DNA, 75 bp, Artificial Sequence
  Synthetic
gctgccaccaccctcagaggagtcccagatcgatgcggcacctgtacctcctgtctctaagactgctggactacc

SEQ ID NO: 147915 - DNA, 75 bp, Artificial Sequence
  Synthetic
ccggcggctaactgccgccgctccgcgctacgtggcttaccccctgtcgaccgtacttactgcttcgacgggttc

SEQ ID NO: 147916 - DNA, 75 bp, Artificial Sequence
  Synthetic
tcccgctgtacctttgctgctgagactggaattgccttatactcattacatgacctctggcctgcggatgtcgca

SEQ ID NO: 147917 - DNA, 75 bp, Artificial Sequence
  Synthetic
tcccgctgtacctttgctgctgagactggaattgccttatactcatttcatgacctctggcctgcggatgtcgca

SEQ ID NO: 147918 - DNA, 75 bp, Artificial Sequence
  Synthetic
tcccgctgtacctttgctgctgagactggaattgccttatactcattccatgacctctggcctgcggatgtcgca

SEQ ID NO: 147919 - DNA, 75 bp, Artificial Sequence
  Synthetic
tcccgctgtacctttgctgctgagactggaattgccttatactcattgcatgacctctggcctgcggatgtcgca

SEQ ID NO: 147920 - DNA, 75 bp, Artificial Sequence
  Synthetic
cacgcttatacgcagcccttcatctaccccctgaggttttgttaccacctggtacctatcataccacctcttatt

SEQ ID NO: 147921 - DNA, 75 bp, Artificial Sequence
  Synthetic
accccctgaggttttgttaccacctggtacctatcataccacctcttatttgctgattcacgacggtgatcgtgc

SEQ ID NO: 147922 - DNA, 75 bp, Artificial Sequence
  Synthetic
tattgctaccgggactaatcttgtgctatatgctgccccgcttagccctctacttccacttcaggacggcaccaa

SEQ ID NO: 147923 - DNA, 75 bp, Artificial Sequence
  Synthetic
cgggctcacgccatcgttgctctgacgcgtcacactgagaagtgcgtcatcattgatgcaccgggcctgcttcgc

SEQ ID NO: 147924 - DNA, 75 bp, Artificial Sequence
  Synthetic
tttaaaatgaaggtaggtaaaactcgggagtattgatttattttccttgtgcctcccttcagttttgtttcttta

SEQ ID NO: 147925 - DNA, 75 bp, Artificial Sequence
  Synthetic
aactaagatagttggtgaccacccgctggtcatagagagggttcgtgctatcggctgccattttgtgctgctcct

SEQ ID NO: 147926 - DNA, 75 bp, Artificial Sequence
  Synthetic
ctggtcatagagagggttcgtgctatcggctgccattttgtgctgctcctcaccgcagcccctgagccatccccc

SEQ ID NO: 147927 - DNA, 75 bp, Artificial Sequence
  Synthetic
gttattccccgtggcaatcctgatgccaatgttgacaccctggctgcctttccgccgtcctgccagattagtgcc

SEQ ID NO: 147928 - DNA, 75 bp, Artificial Sequence
  Synthetic
ctgggaacgcaatcaccgccccggcgacgagctttacttgactgagcccgctgcagcctggtttgaggctaataa

SEQ ID NO: 147929 - DNA, 75 bp, Artificial Sequence
  Synthetic
ccccagtgagcgcctgcactatcgtaatcagggttggcgctcagttgagacctctggcgttgctgaggaggaggc

SEQ ID NO: 147930 - DNA, 75 bp, Artificial Sequence
  Synthetic
gtgcactgccgcatggccgctccgagccagcgcaaggctgtgctgtccacactcgtgggccgctacggccgtcgc

SEQ ID NO: 147931 - DNA, 75 bp, Artificial Sequence
  Synthetic
gctacctccgaactcaggccatatctaaaggcatgcgccgactagaagtcgagcacgcccagaagtttatcacta

SEQ ID NO: 147932 - DNA, 75 bp, Artificial Sequence
  Synthetic
agctagtggaggccatggtcgagaagggccaggatggctccgccgtccttgagctcgacctttgcaaccgtgacg

SEQ ID NO: 147933 - DNA, 75 bp, Artificial Sequence
  Synthetic
gagcacgcccagaagtttatcactagactttatagttggctgtttgagaaatctggtcgtgactacatccccggc

SEQ ID NO: 147934 - DNA, 75 bp, Artificial Sequence
  Synthetic
tttacagggactaatggcgttggtgaggttggccgtgggatagcgcttaccttgtttaaccttgctgacacactt

SEQ ID NO: 147935 - DNA, 75 bp, Artificial Sequence
  Synthetic
gactttatagttggctgtttgagaaatctggtcgtgactacatccccggccgccaacttcagttttatgcgcagt

SEQ ID NO: 147936 - DNA, 75 bp, Artificial Sequence
  Synthetic
gagaccattgcccatggtaaagtgggccagggcatctcggcctggagcaagaccttttgcgccctctttggccct

SEQ ID NO: 147937 - DNA, 75 bp, Artificial Sequence
  Synthetic
gaaggagctttttaaagaaggtcgctggcaagttttgctgctttatgaagtggctcgggcaggagtgcacttgct

SEQ ID NO: 147938 - DNA, 75 bp, Artificial Sequence
  Synthetic
gtaggagctttttaaagaaggtcgctggcaagttttgctgctttatgaagtggctcgggcaggagtgcacttgct

SEQ ID NO: 147939 - DNA, 75 bp, Artificial Sequence
  Synthetic
gcaggagctttttaaagaaggtcgctggcaagttttgctgctttatgaagtggctcgggcaggagtgcacttgct

SEQ ID NO: 147940 - DNA, 75 bp, Artificial Sequence
  Synthetic
ggaggagctttttaaagaaggtcgctggcaagttttgctgctttatgaagtggctcgggcaggagtgcacttgct

SEQ ID NO: 147941 - DNA, 75 bp, Artificial Sequence
  Synthetic
cagcaaaggcatccatggtgtttgagaatgacttttctgagtttgactccacccagaataatttctctctaggcc

SEQ ID NO: 147942 - DNA, 75 bp, Artificial Sequence
  Synthetic
ctcagggtgccaccttcacggagaccacaattatagccacggcggatgccaggggccttattcagtcatcccggg

SEQ ID NO: 147943 - DNA, 75 bp, Artificial Sequence
  Synthetic
ggatcctgcaggccccgaaggagtccctgcgggggttctggaagaaacactccggtgagcccggcactctcctat

SEQ ID NO: 147944 - DNA, 75 bp, Artificial Sequence
  Synthetic
gtcgccttgaatgccgtacggtgcttggaaataagaccttccgcacatcaataactgatggcgcccacctcgagg

SEQ ID NO: 147945 - DNA, 75 bp, Artificial Sequence
  Synthetic
gatgcccccggcctgctgcgtgaggtcggcatttcggatgtgattgtcaataactttttccttgctggtggagag

SEQ ID NO: 147946 - DNA, 75 bp, Artificial Sequence
  Synthetic
atgaaggctggaacgcctctgaggacgctcttacagctgtcatcactgccgcctaccttaccatctgccaccagc

SEQ ID NO: 147947 - DNA, 75 bp, Artificial Sequence
  Synthetic
atgggggctggcccccatagcctcacatatgagctcactcctgccggtttgcaggttaagatatcttctaatggc

SEQ ID NO: 147948 - DNA, 75 bp, Artificial Sequence
  Synthetic
tctcgggactctacaggctttcccgccgtcctgccagattagtgcttaccaccagttggctgaggaattaggcca

SEQ ID NO: 147949 - DNA, 75 bp, Artificial Sequence
  Synthetic
tattgcctcttcgcggcaagctttctttttgggaggcgggtactactaaagctggttatccttacaactacaata

SEQ ID NO: 147950 - DNA, 75 bp, Artificial Sequence
  Synthetic
gccttatacagatacaacagattcactcagcgccactcgctaaccggcgggttgtggttgcaccctgaggggctc

SEQ ID NO: 147951 - DNA, 75 bp, Artificial Sequence
  Synthetic
ctcagcgccactcgctaaccggcgggttgtggttgcaccctgaggggctcttaggattgttccctcctttctccc

SEQ ID NO: 147952 - DNA, 75 bp, Artificial Sequence
  Synthetic
tgtgtggatgttgtttcccgtgtttatggggtttcccctgggctcgttcataacctgattggcatgctacaggct

SEQ ID NO: 147953 - DNA, 75 bp, Artificial Sequence
  Synthetic
gtttctctagtgacttttcccctcctgaggcggccttcgctgccccaacttttgatgggaggttgcccccgggta

SEQ ID NO: 147954 - DNA, 75 bp, Artificial Sequence
  Synthetic
gcctatgaggggtctgatgttgaccctgctgaatccgctattagtgacatatctgggtcctacgtagtccctggc

SEQ ID NO: 147955 - DNA, 75 bp, Artificial Sequence
  Synthetic
tttattttccttttctgcgtttcgcgctccctggaaaaaaaaaaaaaaaaaaaaaaaaaaaaaaaaaaaaaaaaa

SEQ ID NO: 147956 - DNA, 75 bp, Artificial Sequence
  Synthetic
ccccctcttctcttagtggcgtctgggcgttcccaccgccctccgagggttcagtggctaccccggtgttagcgg

SEQ ID NO: 147957 - DNA, 75 bp, Artificial Sequence
  Synthetic
tgcaataagtttacaactggtgagactatcgcccatggcaaggttggccagggtatatcggcctggagtaagacc

SEQ ID NO: 147958 - DNA, 75 bp, Artificial Sequence
  Synthetic
caccaacccgtacccgtcggcttctctacacttatccggatggagctaaggtttatgcaggctccttgttcgagt

SEQ ID NO: 147959 - DNA, 75 bp, Artificial Sequence
  Synthetic
tatggcgacgcttatgaggagtcagtgtttgctgccgctgtgtctggggcggggtcatgcatggtatttgaaaat

SEQ ID NO: 147960 - DNA, 75 bp, Artificial Sequence
  Synthetic
cctgaagtgctttggaatcaccccatccaacgtgttattcacaatgaactggagcagtactgccgggcccgggcc

SEQ ID NO: 147961 - DNA, 75 bp, Artificial Sequence
  Synthetic
cagattgtgattggctggttaacgcgtccaaccctggccaccgtcccggtggtggcctctgtcatgctttttacc

SEQ ID NO: 147962 - DNA, 75 bp, Artificial Sequence
  Synthetic
tccaacgtgttattcacaatgaactggagcagtactgccgggcccgggccggccgttgtttagaggtcggggccc

SEQ ID NO: 147963 - DNA, 75 bp, Artificial Sequence
  Synthetic
cttcgcccccgatgtcaccgctgcggccggggctggacctcgtgttcgccaacccgcccgaccactcggttccgc

SEQ ID NO: 147964 - DNA, 75 bp, Artificial Sequence
  Synthetic
gtccgattattcatgctgtggctcctgactatagggttgagcagaaccctaagaggctggaggcggcgtaccgtg

SEQ ID NO: 147965 - DNA, 75 bp, Artificial Sequence
  Synthetic
gctggtactctgcccccacccgcggccctgcagctaactgccgccgatcagcgttacgtggtctcccccctgctg

SEQ ID NO: 147966 - DNA, 75 bp, Artificial Sequence
  Synthetic
ccctgcagctaactgccgccgatcagcgttacgtggtctcccccctgctgaccgcacctactgttttgacgggtt

SEQ ID NO: 147967 - DNA, 75 bp, Artificial Sequence
  Synthetic
gtgagcctggtacccttctctggaacaccgtctggaacatggcgattatagcacactgttatgagttccgtgact

SEQ ID NO: 147968 - DNA, 75 bp, Artificial Sequence
  Synthetic
ccgccagtgcctgatgtcgactcccgcggcgccatcttgcgccgtcagtataacctatcaacatctcccctcacc

SEQ ID NO: 147969 - DNA, 75 bp, Artificial Sequence
  Synthetic
agaggccatggcccgacatgggatgacacgcttgtatgccgcgctacacctcccccccgaggtactattaccacc

SEQ ID NO: 147970 - DNA, 75 bp, Artificial Sequence
  Synthetic
aggccaataagccaacccaaccagctttaacaattactgaagatactgctcgcacggctaacctcgcgcttgaga

SEQ ID NO: 147971 - DNA, 75 bp, Artificial Sequence
  Synthetic
aggcttctaattatgctcagtaccgggttgcccgtgccacaatccgttaccgcccgctggtcccaaatgctgtcg

SEQ ID NO: 147972 - DNA, 75 bp, Artificial Sequence
  Synthetic
acacgcttgtatgccgcgctacacctcccccccgaggtactattaccacctggcacttatcataccacctcgtat

SEQ ID NO: 147973 - DNA, 75 bp, Artificial Sequence
  Synthetic
ggcttgaccaccgggcggtttttgcccccggagtttcaccccggtcagcccctggcgaggtcaccgccttttgct

SEQ ID NO: 147974 - DNA, 75 bp, Artificial Sequence
  Synthetic
tccatactccgtgcatggatccgcacgactaagattgttggtgaccatccgttggtgatagagcgcgtgcgggcc

SEQ ID NO: 147975 - DNA, 75 bp, Artificial Sequence
  Synthetic
cgactaagattgttggtgaccatccgttggtgatagagcgcgtgcgggccattggctgtcactttgtgctgctgc

SEQ ID NO: 147976 - DNA, 75 bp, Artificial Sequence
  Synthetic
cgagacctccggggtggctgaggaggaagctacctctggtctcgttatgctttgcatacacggttcacccgtaaa

SEQ ID NO: 147977 - DNA, 75 bp, Artificial Sequence
  Synthetic
ccgcggttttgctgcttttacaccccatacggcagctcgcgtcactgccggccggcgtgtcgtgattgatgaggc

SEQ ID NO: 147978 - DNA, 75 bp, Artificial Sequence
  Synthetic
catacggcagctcgcgtcactgccggccggcgtgtcgtgattgatgaggcgccttctctcccgccacatttacta

SEQ ID NO: 147979 - DNA, 75 bp, Artificial Sequence
  Synthetic
tattcggccctggcggatctccgtctttgttcccatcagcctgctctaccaaatctacattccacgctgtcccgg

SEQ ID NO: 147980 - DNA, 75 bp, Artificial Sequence
  Synthetic
gtctcccgttattccagcactgctcgccaccgccttcgtcgcggtgcggacgggactgccgagcttaccaccacg

SEQ ID NO: 147981 - DNA, 75 bp, Artificial Sequence
  Synthetic
catgcaggtttggtaccggcgattcgccctgagctcgccccaaccgcttggtggcacgttacacaccgttgtcct

SEQ ID NO: 147982 - DNA, 75 bp, Artificial Sequence
  Synthetic
gccctgagctcgccccaaccgcttggtggcacgttacacaccgttgtcctgccgacgtgtgtgagctcatacgcg

SEQ ID NO: 147983 - DNA, 75 bp, Artificial Sequence
  Synthetic
cctatctccgtggtattagctacaaggttaccgttggcgctctcgttgccaatgagggctggaatgcctcggagg

SEQ ID NO: 147984 - DNA, 75 bp, Artificial Sequence
  Synthetic
ggttaccgttggcgctctcgttgccaatgagggctggaatgcctcggaggacgcccttaccgctgtcatcactgc

SEQ ID NO: 147985 - DNA, 75 bp, Artificial Sequence
  Synthetic
ttgtcccggcaattcggcctgagcttgttccaacaaagtggtggcaccttactcatagatgtccggcagacgtct

SEQ ID NO: 147986 - DNA, 75 bp, Artificial Sequence
  Synthetic
agactttacagctggctatttgagaagtcaggccgtgattacatccccggccgccaactccagttttatgcgcag

SEQ ID NO: 147987 - DNA, 75 bp, Artificial Sequence
  Synthetic
cacttacccgccacacagagaaatgtgtcatattggatgcccccggtctactacgtgaggttggtatctctgaca

SEQ ID NO: 147988 - DNA, 75 bp, Artificial Sequence
  Synthetic
cacttacccgccacacagagaaatgtgtcatattggatgcccccggtctacttcgtgaggttggtatctctgaca

SEQ ID NO: 147989 - DNA, 75 bp, Artificial Sequence
  Synthetic
cacttacccgccacacagagaaatgtgtcatattggatgcccccggtctactccgtgaggttggtatctctgaca

SEQ ID NO: 147990 - DNA, 75 bp, Artificial Sequence
  Synthetic
cacttacccgccacacagagaaatgtgtcatattggatgcccccggtctactgcgtgaggttggtatctctgaca

SEQ ID NO: 147991 - DNA, 75 bp, Artificial Sequence
  Synthetic
tgcaggacgttccttaagaaagtagcaggcaaattctgctgcttcatgaagtggctggggcaggagtgtacctgc

SEQ ID NO: 147992 - DNA, 75 bp, Artificial Sequence
  Synthetic
gtgctttggctctctctcaccgctgccgagtatgaccagtccacttatggctcttcgactggcccagtttatgtt

SEQ ID NO: 147993 - DNA, 75 bp, Artificial Sequence
  Synthetic
caggcaaattctgctgcttcatgaagtggctggggcaggagtgtacctgctttctggaaccagcggatggcctgg

SEQ ID NO: 147994 - DNA, 75 bp, Artificial Sequence
  Synthetic
cagaccagaacttagatactttgcaggcatttcctccatcttgtcaaataagtgcctaccaccagctagctgagg

SEQ ID NO: 147995 - DNA, 75 bp, Artificial Sequence
  Synthetic
tctttatgctgccccgcttaatcctctcctgcctcttcaggatggcaccaacactcatattatggccactgaggc

SEQ ID NO: 147996 - DNA, 75 bp, Artificial Sequence
  Synthetic
acacttgatggtcgccccctttccaccatccagcagtactcgaagaccttctttgtcctgccgctccgcggtaag

SEQ ID NO: 147997 - DNA, 75 bp, Artificial Sequence
  Synthetic
tctcggggacctatgccgtttacggacgtcagcttgaggctctgtatagggcacttaatattccacaggatattg

SEQ ID NO: 147998 - DNA, 75 bp, Artificial Sequence
  Synthetic
tgccacaagaactcacagtgtccgacagtgtcctggtttttgagctcacggacatagtccattgccgaatggcgg

SEQ ID NO: 147999 - DNA, 75 bp, Artificial Sequence
  Synthetic
acgtcagcttgaggctctgtatagggcacttaatattccacaggatattgccgctcgggcgtcccgtctaacagc

SEQ ID NO: 148000 - DNA, 75 bp, Artificial Sequence
  Synthetic
cgccgaacgaagctgtatgaggcagctcattctgacgtccgtgagtctttagggaagtttatccctagcatcgga

SEQ ID NO: 148001 - DNA, 75 bp, Artificial Sequence
  Synthetic
ggtggttgacggtgcccatcttgaggtgaatggccccgagcagtatgtcctttcatttgatgcctcccaccagtc

SEQ ID NO: 148002 - DNA, 75 bp, Artificial Sequence
  Synthetic
atttccgcggttgctgttttagccccccactctgcgctagcactgcttgaggataccttggactaccctgctcgc

SEQ ID NO: 148003 - DNA, 75 bp, Artificial Sequence
  Synthetic
gtgaatggccccgagcagtatgtcctttcatttgatgcctcccaccagtctatgggggctgggccgcatagcctt

SEQ ID NO: 148004 - DNA, 75 bp, Artificial Sequence
  Synthetic
cttatactacaagcttaggtgctggtcctgtgtctatctctgcagttggtgtgcttgctccgcactctgttctgg

SEQ ID NO: 148005 - DNA, 75 bp, Artificial Sequence
  Synthetic
gtgttagagcttgatctctgtagccgtgatgtttcacgtattacattctttcagaaggactgtaataaattcaca

SEQ ID NO: 148006 - DNA, 75 bp, Artificial Sequence
  Synthetic
ccgggcggcgcccctagtgccgcaccgggcgaggtggcggccttctgcagcgccctttataggtataatcggttt

SEQ ID NO: 148007 - DNA, 75 bp, Artificial Sequence
  Synthetic
ccggctgcgccgcggtgctgatgggaccgctgagcttaccaccacagcagccacacgtttcatgaaggatttgca

SEQ ID NO: 148008 - DNA, 75 bp, Artificial Sequence
  Synthetic
cccggtataccagcacagcccgtcaccggctgcgccgcggtgctgatgggaccgctgagcttaccaccacagcag

SEQ ID NO: 148009 - DNA, 75 bp, Artificial Sequence
  Synthetic
cgggcgaggtggcggccttctgcagcgccctttataggtataatcggtttacccagcggcactcgctggcaggtg

SEQ ID NO: 148010 - DNA, 75 bp, Artificial Sequence
  Synthetic
aagagatcttagccctgctcccacctaacatcttctatggtgatgcttttgaagagtcagtgttctctgcggccg

SEQ ID NO: 148011 - DNA, 75 bp, Artificial Sequence
  Synthetic
atcccttctgcggggagggaactttgtacacccgaacttggtctacatcaggtttttctagtgacttttccccgc

SEQ ID NO: 148012 - DNA, 75 bp, Artificial Sequence
  Synthetic
gtacacccgaacttggtctacatcaggtttttctagtgacttttccccgcccgaggctgctgcccctctgccggt

SEQ ID NO: 148013 - DNA, 75 bp, Artificial Sequence
  Synthetic
aggctcctggcatcactaccgccatcgagcaagctgctctggctgcggccaactctgccctggcgaatgctgtgg

SEQ ID NO: 148014 - DNA, 75 bp, Artificial Sequence
  Synthetic
tcggccttgagtgtgtcatcatggaggagtgtggcatgccccagtggcttattcggttgtaccatttagtcaggt

SEQ ID NO: 148015 - DNA, 75 bp, Artificial Sequence
  Synthetic
gccctgaggttttgtggaaccacccaatccagcgtgttatccataatgagctagaacaatactgccgggcccgtg

SEQ ID NO: 148016 - DNA, 75 bp, Artificial Sequence
  Synthetic
tcaggttactgtagtgcctgaccctcctgtacccgaacatattcaaccacctagccttgtcaagcctaagacctt

SEQ ID NO: 148017 - DNA, 75 bp, Artificial Sequence
  Synthetic
aatccagcgtgttatccataatgagctagaacaatactgccgggcccgtgccgggcgttgcttggaggtgggagc

SEQ ID NO: 148018 - DNA, 75 bp, Artificial Sequence
  Synthetic
ggagtgtggcatgccccagtggcttattcggttgtaccatttagtcaggtcagcctggaccctgcaggccccgaa

SEQ ID NO: 148019 - DNA, 75 bp, Artificial Sequence
  Synthetic
tacattcactgagaccactattatcgcgacggctgatgcaagaggcctcattcagtcgtcccgggcgcatgccat

SEQ ID NO: 148020 - DNA, 75 bp, Artificial Sequence
  Synthetic
ttctttggaacactgtctggaatatggcaatcatagcgcactgctatgaatttcgtgacctgaagatggcagcgt

SEQ ID NO: 148021 - DNA, 75 bp, Artificial Sequence
  Synthetic
ttctttggaacactgtctggaatatggcaatcatagcgcactgctatgaatttcgtgacctgaagatggctgcgt

SEQ ID NO: 148022 - DNA, 75 bp, Artificial Sequence
  Synthetic
ttctttggaacactgtctggaatatggcaatcatagcgcactgctatgaatttcgtgacctgaagatggccgcgt

SEQ ID NO: 148023 - DNA, 75 bp, Artificial Sequence
  Synthetic
ttctttggaacactgtctggaatatggcaatcatagcgcactgctatgaatttcgtgacctgaagatggcggcgt

SEQ ID NO: 148024 - DNA, 75 bp, Artificial Sequence
  Synthetic
ggcaatcatagcgcactgctatgaatttcgtgacctgaagatggcagcgttcaaaggagatgattcagtggtcct

SEQ ID NO: 148025 - DNA, 75 bp, Artificial Sequence
  Synthetic
ggcaatcatagcgcactgctatgaatttcgtgacctgaagatggctgcgttcaaaggagatgattcagtggtcct

SEQ ID NO: 148026 - DNA, 75 bp, Artificial Sequence
  Synthetic
ggcaatcatagcgcactgctatgaatttcgtgacctgaagatggccgcgttcaaaggagatgattcagtggtcct

SEQ ID NO: 148027 - DNA, 75 bp, Artificial Sequence
  Synthetic
ggcaatcatagcgcactgctatgaatttcgtgacctgaagatggcggcgttcaaaggagatgattcagtggtcct

SEQ ID NO: 148028 - DNA, 75 bp, Artificial Sequence
  Synthetic
gcgctggtattctgcccccacccgcggtccggcggctaactgccgccgttccgcactgcgtggtttgcctcccgt

SEQ ID NO: 148029 - DNA, 75 bp, Artificial Sequence
  Synthetic
gtatgcagggtcattgtttgagtcggattgcgattggctggttaatgcatcaaaccctggccatcgccccggggg

SEQ ID NO: 148030 - DNA, 75 bp, Artificial Sequence
  Synthetic
tctcttgattggtctaaagttaccttggatggccgcccccttactaccattcagcagtattctaagacattttat

SEQ ID NO: 148031 - DNA, 75 bp, Artificial Sequence
  Synthetic
ggtccggcggctaactgccgccgttccgcactgcgtggtttgcctcccgttgatcggacctattgtttcgacggg

SEQ ID NO: 148032 - DNA, 75 bp, Artificial Sequence
  Synthetic
gattgcgattggctggttaatgcatcaaaccctggccatcgccccgggggtgggctttgccacgccttttaccaa

SEQ ID NO: 148033 - DNA, 75 bp, Artificial Sequence
  Synthetic
ccgccccatagggttgtacgccggtgttgtagtggcccccggtcttggggcactccctgacatcgtccggttcgc

SEQ ID NO: 148034 - DNA, 75 bp, Artificial Sequence
  Synthetic
tgtggctctctctcaccgccgctgagtatgaccagactacgtatgggtcgtccaccaaccctatgtatgtctccg

SEQ ID NO: 148035 - DNA, 75 bp, Artificial Sequence
  Synthetic
ggccggctatccgtataattataatactactgctagtgatcaaattttgattgagaacgcggccggccaccgtgt

SEQ ID NO: 148036 - DNA, 75 bp, Artificial Sequence
  Synthetic
gcggaggctatggcccgccatgggatgacgcgcttgtatgccgcactccacttgccccctgaggtcctgttacca

SEQ ID NO: 148037 - DNA, 75 bp, Artificial Sequence
  Synthetic
tgacgcgcttgtatgccgcactccacttgccccctgaggtcctgttaccacctggcacctaccatacgacctcat

SEQ ID NO: 148038 - DNA, 75 bp, Artificial Sequence
  Synthetic
gtggaatgaataacatgtcttttgctgcgcccatgggttcgcgaccatgcgccctcggcctattttgctgctgct

SEQ ID NO: 148039 - DNA, 75 bp, Artificial Sequence
  Synthetic
attacagggttgagcagaacccaaagaggcttgaggcggcgtatcgggagacctgctctcgccgcggcaccgctg

SEQ ID NO: 148040 - DNA, 75 bp, Artificial Sequence
  Synthetic
tgtctatactccgcgcatggatccgcacaactaagatagttggtgaccatccgctggtgatagagcgggtccgcg

SEQ ID NO: 148041 - DNA, 75 bp, Artificial Sequence
  Synthetic
gccctggggatgagctctacttaaccgaccccgctgttgcctggttcgaggccaacaagccaacgcagccggctc

SEQ ID NO: 148042 - DNA, 75 bp, Artificial Sequence
  Synthetic
cacaactaagatagttggtgaccatccgctggtgatagagcgggtccgcgccattggctgccactttgttttgct

SEQ ID NO: 148043 - DNA, 75 bp, Artificial Sequence
  Synthetic
tgcgcattccagtctactattgctgagcttcagcgccttaaaatgaaggtaggtaaaacccgggagtcttaatta

SEQ ID NO: 148044 - DNA, 75 bp, Artificial Sequence
  Synthetic
cgaccccgctgttgcctggttcgaggccaacaagccaacgcagccggctcttacgataactgaagacacagcccg

SEQ ID NO: 148045 - DNA, 75 bp, Artificial Sequence
  Synthetic
aggtaaaacccgggagtcttaattaattccttttgtgcccccttcgtagcttcctctggctttatttcttatttc

SEQ ID NO: 148046 - DNA, 75 bp, Artificial Sequence
  Synthetic
gacgccccggggctcctccgtgaagtcggcatttctgatgctattgtaaataacttctttctttctggtggtcaa

SEQ ID NO: 148047 - DNA, 75 bp, Artificial Sequence
  Synthetic
gatattcggccctgggggctcgccatccctcttcccatcagcttgctccacaaagtcaacctttcatgccgtccc

SEQ ID NO: 148048 - DNA, 75 bp, Artificial Sequence
  Synthetic
cggggttgtacattaccagttcactgctggcgtccctggctcggggaagtcacgatccatacagcagggggatgt

SEQ ID NO: 148049 - DNA, 75 bp, Artificial Sequence
  Synthetic
tccctcttcccatcagcttgctccacaaagtcaacctttcatgccgtcccggtgcacatctgggaccggcttatg

SEQ ID NO: 148050 - DNA, 75 bp, Artificial Sequence
  Synthetic
gctggcgtccctggctcggggaagtcacgatccatacagcagggggatgtggatgtggtggtagtccctacccgg

SEQ ID NO: 148051 - DNA, 75 bp, Artificial Sequence
  Synthetic
aaggtcactgttggtgcacttgttgctaatgagggttggaacgcctcggaggatgcgcttacagctgttattact

SEQ ID NO: 148052 - DNA, 75 bp, Artificial Sequence
  Synthetic
cgccgtgttgtcattgatgaagccccctccctcccgccacatctgctgttgttacatatgcagcgggcttcatcg

SEQ ID NO: 148053 - DNA, 75 bp, Artificial Sequence
  Synthetic
gtcgttgtttggaagttggtgctcacccgaggtctattaatgacaaccccaacgtcctgcaccggtgttttctta

SEQ ID NO: 148054 - DNA, 75 bp, Artificial Sequence
  Synthetic
gacacggctccagtccctgatgttgattcccgcggagctattttgcgccgccagtataatttgtctacttctcct

SEQ ID NO: 148055 - DNA, 75 bp, Artificial Sequence
  Synthetic
ctaatgagggttggaacgcctcggaggatgcgcttacagctgttattactgcggcgtatttgaccatttgtcatc

SEQ ID NO: 148056 - DNA, 75 bp, Artificial Sequence
  Synthetic
cctccctcccgccacatctgctgttgttacatatgcagcgggcttcatcggtccaccttcttggtgatccaaatc

SEQ ID NO: 148057 - DNA, 75 bp, Artificial Sequence
  Synthetic
cccgaggtctattaatgacaaccccaacgtcctgcaccggtgttttcttaggccggtcggtcgagatgtccaacg

SEQ ID NO: 148058 - DNA, 75 bp, Artificial Sequence
  Synthetic
caaggctgtatagctggctgtttgagaaatccggccgtgattatatccccggccgtcagctccaattttatgcac

SEQ ID NO: 148059 - DNA, 75 bp, Artificial Sequence
  Synthetic
ggcatgtcacacatcgctgccctgctgatgtgtgtgaactcatacgcggagcttacccaaagatccaaaccacga

SEQ ID NO: 148060 - DNA, 75 bp, Artificial Sequence
  Synthetic
ccgcacttactgctttgatggattttctcgctgtgcttttgctgctgagaccggtgtggccctttactctttgca

SEQ ID NO: 148061 - DNA, 75 bp, Artificial Sequence
  Synthetic
cgactgaggcgtctaattatgcccagtatcgggttgttcgggccacaatccgttaccgccccttggtgccaaatg

SEQ ID NO: 148062 - DNA, 75 bp, Artificial Sequence
  Synthetic
gaaatccggccgtgattatatccccggccgtcagctccaattttatgcacagtgtcgacgctggctttcggccgg

SEQ ID NO: 148063 - DNA, 75 bp, Artificial Sequence
  Synthetic
gaaatccggccgtgattatatccccggccgtcagctccaattttatgcacagtgtcgtcgctggctttcggccgg

SEQ ID NO: 148064 - DNA, 75 bp, Artificial Sequence
  Synthetic
gaaatccggccgtgattatatccccggccgtcagctccaattttatgcacagtgtcgccgctggctttcggccgg

SEQ ID NO: 148065 - DNA, 75 bp, Artificial Sequence
  Synthetic
gaaatccggccgtgattatatccccggccgtcagctccaattttatgcacagtgtcggcgctggctttcggccgg

SEQ ID NO: 148066 - DNA, 75 bp, Artificial Sequence
  Synthetic
tgatgtgtgtgaactcatacgcggagcttacccaaagatccaaaccacgagccgtgtgttgcggtccctattttg

SEQ ID NO: 148067 - DNA, 75 bp, Artificial Sequence
  Synthetic
tctcgctgtgcttttgctgctgagaccggtgtggccctttactctttgcatgatctttggccggctgacgttgca

SEQ ID NO: 148068 - DNA, 75 bp, Artificial Sequence
  Synthetic
tgccggtaagatctgctgttttatgaagtggttgggccaggagtgcacctgtttcctagaaccggctgaaggtct

SEQ ID NO: 148069 - DNA, 75 bp, Artificial Sequence
  Synthetic
tcacgaggctcagggcgccacctttacggagactaccattatagctacggctgatgccaggggccttatacaatc

SEQ ID NO: 148070 - DNA, 75 bp, Artificial Sequence
  Synthetic
ggcacttatcacacaacctcgtatctcctgatccacgacggtaaccgcgcagttgtgacttacgagggtgacacc

SEQ ID NO: 148071 - DNA, 75 bp, Artificial Sequence
  Synthetic
aagtggttgggccaggagtgcacctgtttcctagaaccggctgaaggtctggttggtgactgtggccacgataac

SEQ ID NO: 148072 - DNA, 75 bp, Artificial Sequence
  Synthetic
acggagactaccattatagctacggctgatgccaggggccttatacaatcgtccagggctcacgctatagtagca

SEQ ID NO: 148073 - DNA, 75 bp, Artificial Sequence
  Synthetic
tttggtccagcctggtatagcctctgagttggtcatcccgagtgagcgcctccactatcgtaatcaaggttggcg

SEQ ID NO: 148074 - DNA, 75 bp, Artificial Sequence
  Synthetic
gggcgccaacttgaggccctttacagagcacttaacatcccgcaagacatcgcagctcgcgcatctcgtctgacg

SEQ ID NO: 148075 - DNA, 75 bp, Artificial Sequence
  Synthetic
attgttaataacttcttccttgctggcggtgaggtgggccaccaccgcccttctgtaatacctcgtggtaacccc

SEQ ID NO: 148076 - DNA, 75 bp, Artificial Sequence
  Synthetic
cgtcaactcctataccaatacgccctatactggggcattgggacttcttgactttgcacttgagcttgaatttag

SEQ ID NO: 148077 - DNA, 75 bp, Artificial Sequence
  Synthetic
gagcacttaacatcccgcaagacatcgcagctcgcgcatctcgtctgacggccactgtggagcttgctgccagcc

SEQ ID NO: 148078 - DNA, 75 bp, Artificial Sequence
  Synthetic
gcggtgaggtgggccaccaccgcccttctgtaatacctcgtggtaaccccgaccagaatcttgcaacgttgcaag

SEQ ID NO: 148079 - DNA, 75 bp, Artificial Sequence
  Synthetic
actttgcacttgagcttgaatttaggaatttgacccctgggaacactaacacccgtgtgtcccggtatactagca

SEQ ID NO: 148080 - DNA, 75 bp, Artificial Sequence
  Synthetic
aagccaacggcccggagcagtatgtcttaacatttgatgattctagtcagtccatgggtgctgggccccatagtc

SEQ ID NO: 148081 - DNA, 75 bp, Artificial Sequence
  Synthetic
aagccaacggcccggagcagtatgtcttaacatttgatgattcttgtcagtccatgggtgctgggccccatagtc

SEQ ID NO: 148082 - DNA, 75 bp, Artificial Sequence
  Synthetic
aagccaacggcccggagcagtatgtcttaacatttgatgattctcgtcagtccatgggtgctgggccccatagtc

SEQ ID NO: 148083 - DNA, 75 bp, Artificial Sequence
  Synthetic
aagccaacggcccggagcagtatgtcttaacatttgatgattctggtcagtccatgggtgctgggccccatagtc

SEQ ID NO: 148084 - DNA, 75 bp, Artificial Sequence
  Synthetic
ccgctgtcctgcctccctgccctgagcttgagcagggcctgctgtacatgccgcaggagcttacggtgtctgata

SEQ ID NO: 148085 - DNA, 75 bp, Artificial Sequence
  Synthetic
cttaacatttgatgattctagtcagtccatgggtgctgggccccatagtcttacttacgagctcacccccgccgg

SEQ ID NO: 148086 - DNA, 75 bp, Artificial Sequence
  Synthetic
cttaacatttgatgattcttgtcagtccatgggtgctgggccccatagtcttacttacgagctcacccccgccgg

SEQ ID NO: 148087 - DNA, 75 bp, Artificial Sequence
  Synthetic
cttaacatttgatgattctcgtcagtccatgggtgctgggccccatagtcttacttacgagctcacccccgccgg

SEQ ID NO: 148088 - DNA, 75 bp, Artificial Sequence
  Synthetic
cttaacatttgatgattctggtcagtccatgggtgctgggccccatagtcttacttacgagctcacccccgccgg

SEQ ID NO: 148089 - DNA, 75 bp, Artificial Sequence
  Synthetic
gcttgagcagggcctgctgtacatgccgcaggagcttacggtgtctgatagtgtgttggtcttcgaactcacgga

SEQ ID NO: 148090 - DNA, 75 bp, Artificial Sequence
  Synthetic
atagccctaactttattcaaccttgctgatacacttctcggcggtttgccgacagaattgatttcgtcggctgga

SEQ ID NO: 148091 - DNA, 75 bp, Artificial Sequence
  Synthetic
gtcactgttggagcgcttgtcgctaatgaggggtggaatgcctcggaggatgctctcactgcagtgattactgcg

SEQ ID NO: 148092 - DNA, 75 bp, Artificial Sequence
  Synthetic
gccgggggaggtggcggctttttgcagtgctctatataggtacaacaggttcacccagcgccattcgctaactgg

SEQ ID NO: 148093 - DNA, 75 bp, Artificial Sequence
  Synthetic
taggacgaagctgtatgaggccgctcattctgatgttcgcgagtctttagccaggttcattcccaccatcgggcc

SEQ ID NO: 148094 - DNA, 75 bp, Artificial Sequence
  Synthetic
agtgctctatataggtacaacaggttcacccagcgccattcgctaactggtgggctgtggttgcaccccgagggg

SEQ ID NO: 148095 - DNA, 75 bp, Artificial Sequence
  Synthetic
cattctgatgttcgcgagtctttagccaggttcattcccaccatcgggcccgtccaggccaccacatgcgagttg

SEQ ID NO: 148096 - DNA, 75 bp, Artificial Sequence
  Synthetic
ggattctcgcgtggttatccaggactacgataaccagcatgaacaggataggcctaccccctcgccagccccgtc

SEQ ID NO: 148097 - DNA, 75 bp, Artificial Sequence
  Synthetic
tatcgcaaccaaggttggcgctctgttgagacctccggggtggcggaggaggaggccacctctggtcttgtcatg

SEQ ID NO: 148098 - DNA, 75 bp, Artificial Sequence
  Synthetic
ttatatactcgaacctggtctacatctggcttttctagtgacttttcccccccggaagcggccgctaacggtgaa

SEQ ID NO: 148099 - DNA, 75 bp, Artificial Sequence
  Synthetic
gatgtttcgcgtatcacattctttcaaaaagactgcaataagtttaccaccggtgagaccattgcccacggtaaa

SEQ ID NO: 148100 - DNA, 75 bp, Artificial Sequence
  Synthetic
cgtcagctccagttctatgcgcagtgccgacggtggctgtctgctggcttccatctagaccccagggtgcttgtc

SEQ ID NO: 148101 - DNA, 75 bp, Artificial Sequence
  Synthetic
tacgataaccagcatgaacaggataggcctaccccctcgccagccccgtcccgccccttttcggtcctccgtgct

SEQ ID NO: 148102 - DNA, 75 bp, Artificial Sequence
  Synthetic
ctggcttttctagtgacttttcccccccggaagcggccgctaacggtgaaccgcccccgggtgccccctccacca

SEQ ID NO: 148103 - DNA, 75 bp, Artificial Sequence
  Synthetic
tatgtttcagacactgtcacttttgtcaatgtggctacaggggcccaggctgttgcccgctctcttgactggtct

SEQ ID NO: 148104 - DNA, 75 bp, Artificial Sequence
  Synthetic
tcgatctgccggtctccatccctcccgaggcccccgcccgtaagccgcccgcccccccgccggctcgtactcgcc

SEQ ID NO: 148105 - DNA, 75 bp, Artificial Sequence
  Synthetic
acatcttttacggcgacgcctttgaggagtctgtgttcgccgccgctgtgtccggagcgggatcatgtatggtct

SEQ ID NO: 148106 - DNA, 75 bp, Artificial Sequence
  Synthetic
cgaggcccccgcccgtaagccgcccgcccccccgccggctcgtactcgccggcttctctacacttacccggacgg

SEQ ID NO: 148107 - DNA, 75 bp, Artificial Sequence
  Synthetic
ttaccaccattcagcagtattctaagacattctatgtgctcccacttcgcgggaagctatctttttgggaggctg

SEQ ID NO: 148108 - DNA, 75 bp, Artificial Sequence
  Synthetic
ggagtctgtgttcgccgccgctgtgtccggagcgggatcatgtatggtctttgagaatgacttttcagagtttga

SEQ ID NO: 148109 - DNA, 75 bp, Artificial Sequence
  Synthetic
cgccagctcgaggccctctacagggcacttaatgtcccacaagatatcgccgccagagcatcccagctgacggct

SEQ ID NO: 148110 - DNA, 75 bp, Artificial Sequence
  Synthetic
tcccggcggcggcctctgtcatgctttctaccagcggttcccggaatcgttctacccggccgatttcatcatgcg

SEQ ID NO: 148111 - DNA, 75 bp, Artificial Sequence
  Synthetic
ccggctatatcacctggttcgatcggcctgggttctacaggcgccgaaggagtcccttaaaggcttttggaagaa

SEQ ID NO: 148112 - DNA, 75 bp, Artificial Sequence
  Synthetic
gccatcgcgttgctatctctacctacaccactagccttggtgctggtccagtgtctgtttctgcagttggtgttc

SEQ ID NO: 148113 - DNA, 75 bp, Artificial Sequence
  Synthetic
gccatcgcgttgctatctctacctacaccactagccttggtgctggtcctgtgtctgtttctgcagttggtgttc

SEQ ID NO: 148114 - DNA, 75 bp, Artificial Sequence
  Synthetic
gccatcgcgttgctatctctacctacaccactagccttggtgctggtcccgtgtctgtttctgcagttggtgttc

SEQ ID NO: 148115 - DNA, 75 bp, Artificial Sequence
  Synthetic
gccatcgcgttgctatctctacctacaccactagccttggtgctggtccggtgtctgtttctgcagttggtgttc

SEQ ID NO: 148116 - DNA, 75 bp, Artificial Sequence
  Synthetic
ttctaccagcggttcccggaatcgttctacccggccgatttcatcatgcgcgatggcctcgctgcgtacaccctg

SEQ ID NO: 148117 - DNA, 75 bp, Artificial Sequence
  Synthetic
gtgtctgtttctgcagttggtgttcttgcccctcactctgctttggccctgcttgaagatactattgattacccc

SEQ ID NO: 148118 - DNA, 75 bp, Artificial Sequence
  Synthetic
gcctgggttctacaggcgccgaaggagtcccttaaaggcttttggaagaagcactctggtgagcccggcaccctt

SEQ ID NO: 148119 - DNA, 75 bp, Artificial Sequence
  Synthetic
caaatggccctgagcagtatgttctatcatttgatgcctcccgtcagactatgggggctgggtcgcacagtctta

SEQ ID NO: 148120 - DNA, 75 bp, Artificial Sequence
  Synthetic
taccgtgagacttgctcccggcgtggcactgctgcttacccattgttaggttcggggatctatcaagtccctgtg

SEQ ID NO: 148121 - DNA, 75 bp, Artificial Sequence
  Synthetic
aagggtgatgattcagtggtcctttgtagtgattatcgccagagccgcaatgcggcagctttgattgctggctgt

SEQ ID NO: 148122 - DNA, 75 bp, Artificial Sequence
  Synthetic
acaccttccccagccccatcgcgtcctttttctgtcctccgagctaatgatgtgctttggctttctctcaccgct

SEQ ID NO: 148123 - DNA, 75 bp, Artificial Sequence
  Synthetic
atgggggctgggtcgcacagtcttacttacgagctcacccctgccggtttgcaggtcaggatttcatctaatggt

SEQ ID NO: 148124 - DNA, 75 bp, Artificial Sequence
  Synthetic
gcactgctgcttacccattgttaggttcggggatctatcaagtccctgtgggtttgagctttgatgcttgggagc

SEQ ID NO: 148125 - DNA, 75 bp, Artificial Sequence
  Synthetic
gtcttaattaatttcatcttgtgcccccttctacgtcctgctttatttctttcttctgcgttccgcgctccctgg

SEQ ID NO: 148126 - DNA, 75 bp, Artificial Sequence
  Synthetic
gtagtgattatcgccagagccgcaatgcggcagctttgattgctggctgtgggcttaaactgaaggttgattacc

SEQ ID NO: 148127 - DNA, 75 bp, Artificial Sequence
  Synthetic
agccggccctcacgataactgaggacatcgcccgcacggctaatctcgcgcttgagatcgactccgccaccgagg

SEQ ID NO: 148128 - DNA, 75 bp, Artificial Sequence
  Synthetic
gccggctatctgagaagaactggggcccaggcccggaacgggccgagcagttgcgccttgcagtctgtgatttcc

SEQ ID NO: 148129 - DNA, 75 bp, Artificial Sequence
  Synthetic
catcgcccgcacggctaatctcgcgcttgagatcgactccgccaccgaggtgggtcgggcctgtgccggctgcac

SEQ ID NO: 148130 - DNA, 75 bp, Artificial Sequence
  Synthetic
tatacccgaacttggtcaacatctggtttttctagtgatttctccccccctgaggcggccgcccctgtcccgacc

SEQ ID NO: 148131 - DNA, 75 bp, Artificial Sequence
  Synthetic
gggggatgttgatgttgtggtcgtgcctacccgtgaactccgtaacagctggaggcgccgtggttttgcagcctt

SEQ ID NO: 148132 - DNA, 75 bp, Artificial Sequence
  Synthetic
cctacccgtgaactccgtaacagctggaggcgccgtggttttgcagccttcacgccgcatacggcagcccgtgtc

SEQ ID NO: 148133 - DNA, 75 bp, Artificial Sequence
  Synthetic
caggccgacgtagcacctgcaccccctgcccctgagtctgttggaccgtctagtcccattgtgtttacccccccc

SEQ ID NO: 148134 - DNA, 75 bp, Artificial Sequence
  Synthetic
ctgcccctgagtctgttggaccgtctagtcccattgtgtttacccccccccccccccctcccgtgcgtaagccgc

SEQ ID NO: 148135 - DNA, 75 bp, Artificial Sequence
  Synthetic
gcctcatcggttcatcttcttggcgacccgaatcagatccctgcgattgactttgaacacgctggcctagtcccc

SEQ ID NO: 148136 - DNA, 75 bp, Artificial Sequence
  Synthetic
acccgaatcagatccctgcgattgactttgaacacgctggcctagtccccgcaatccgtcccgagcttgccccca

SEQ ID NO: 148137 - DNA, 75 bp, Artificial Sequence
  Synthetic
tgtttgagtcagattgcgattggctggtcaacgcctcaaatccgggtcaccgccctggaggtggcctctgccacg

SEQ ID NO: 148138 - DNA, 75 bp, Artificial Sequence
  Synthetic
aaaccactagccgtgtgctgcggtccttattttggaatgagcctgcaatagggcaaaagttggtctttacgcagg

SEQ ID NO: 148139 - DNA, 75 bp, Artificial Sequence
  Synthetic
cttattttggaatgagcctgcaatagggcaaaagttggtctttacgcaggcggctaaggccgccaaccctggtgc

SEQ ID NO: 148140 - DNA, 75 bp, Artificial Sequence
  Synthetic
cccccccgccaccccccgccgtcgatctgccccagctggggctgcgccgctgaccgctgtttcaccggctcccga

SEQ ID NO: 148141 - DNA, 75 bp, Artificial Sequence
  Synthetic
tctgccccagctggggctgcgccgctgaccgctgtttcaccggctcccgacacggcccccgtgcctgatgtcgat

SEQ ID NO: 148142 - DNA, 75 bp, Artificial Sequence
  Synthetic
caggatggctcggcggttctggagcttgacctgtgtagccgtgatgtgtctcggataacattcttccaaaaggac

SEQ ID NO: 148143 - DNA, 75 bp, Artificial Sequence
  Synthetic
catccagtcctcccgagcccacgctatagttgcattgacccgccacacagagaaatgtgttatcctggacgcccc

SEQ ID NO: 148144 - DNA, 75 bp, Artificial Sequence
  Synthetic
gcctctacagctggctgtttgagaagtctgggcgtgattatatccctggccgtcaactgcagttttacgcccagt

SEQ ID NO: 148145 - DNA, 75 bp, Artificial Sequence
  Synthetic
gcaggccccgaaagagtctttgaaaggtttctggaagaagcattccggcgagcctggcaccctcctttggaacac

SEQ ID NO: 148146 - DNA, 75 bp, Artificial Sequence
  Synthetic
ggtttctggaagaagcattccggcgagcctggcaccctcctttggaacaccgtctggaacatggcgatcatagca

SEQ ID NO: 148147 - DNA, 75 bp, Artificial Sequence
  Synthetic
aatttggttctttatgctgctccgttaaatcctctcctgcccctccaggatggcaccaacacacatattatggcc

SEQ ID NO: 148148 - DNA, 75 bp, Artificial Sequence
  Synthetic
atagttgcattgacccgccacacagagaaatgtgttatcctggacgcccctggtctgctgcgtgaggtcggaatt

SEQ ID NO: 148149 - DNA, 75 bp, Artificial Sequence
  Synthetic
atagttgcattgacccgccacacagagaaatgtgttatcctggacgcccctggtctgctgcgtgaggtcggtatt

SEQ ID NO: 148150 - DNA, 75 bp, Artificial Sequence
  Synthetic
atagttgcattgacccgccacacagagaaatgtgttatcctggacgcccctggtctgctgcgtgaggtcggcatt

SEQ ID NO: 148151 - DNA, 75 bp, Artificial Sequence
  Synthetic
atagttgcattgacccgccacacagagaaatgtgttatcctggacgcccctggtctgctgcgtgaggtcgggatt

SEQ ID NO: 148152 - DNA, 75 bp, Artificial Sequence
  Synthetic
taaatcctctcctgcccctccaggatggcaccaacacacatattatggccactgaggcatccaactatgctcagt

SEQ ID NO: 148153 - DNA, 75 bp, Artificial Sequence
  Synthetic
ggtaacccggaccggaacttggacaccttgcaggctttccctccatcttgtcaaattagcgcttaccatcagttg

SEQ ID NO: 148154 - DNA, 75 bp, Artificial Sequence
  Synthetic
ccttgcaggctttccctccatcttgtcaaattagcgcttaccatcagttggctgaagagttgggccaccggccag

SEQ ID NO: 148155 - DNA, 75 bp, Artificial Sequence
  Synthetic
cattctggcctcagactaccaccacccctacatctgtggatatgaattccatcacttccactgatgttaggatcc

SEQ ID NO: 148156 - DNA, 75 bp, Artificial Sequence
  Synthetic
ccctacatctgtggatatgaattccatcacttccactgatgttaggatcctggtccaacctgggatagcctccga

SEQ ID NO: 148157 - DNA, 75 bp, Artificial Sequence
  Synthetic
tctatatttggccctggcggttccccgtccttgtttccatcagcctgctctacaaaatctacttttcacgctgtc

SEQ ID NO: 148158 - DNA, 75 bp, Artificial Sequence
  Synthetic
ctcgggcaagtcgaggtccatacagcaaggagatgtcgatgtggtggttgtgcctacccgggagctccgtaatag

SEQ ID NO: 148159 - DNA, 75 bp, Artificial Sequence
  Synthetic
tatccgacagtgtcctagtgtttgagctcacggatatagttcattgccggatggctgccccaagccaacggaaag

SEQ ID NO: 148160 - DNA, 75 bp, Artificial Sequence
  Synthetic
gctcacggatatagttcattgccggatggctgccccaagccaacggaaagccgtcctctcgacattggtgggcag

SEQ ID NO: 148161 - DNA, 75 bp, Artificial Sequence
  Synthetic
agaggaggctacttccggtttggtgatgctctgcattcatggctcccctgttaattcttatactaacacccctta

SEQ ID NO: 148162 - DNA, 75 bp, Artificial Sequence
  Synthetic
aggttgagcatgcccagaaattcatcacaagactttacagctggctatttgagaagtctggccgtgactacatcc

SEQ ID NO: 148163 - DNA, 75 bp, Artificial Sequence
  Synthetic
tattggcccagtccaggccaccacatgtgagctatgtgagctggtcgaggctatggtggagaagggccaggatgg

SEQ ID NO: 148164 - DNA, 75 bp, Artificial Sequence
  Synthetic
ccgtgtgtcccgttatacgagcacagcccgccaccggctgcgccgcggtgctgatggtactgctgaacttaccac

SEQ ID NO: 148165 - DNA, 75 bp, Artificial Sequence
  Synthetic
tgtgagctatgtgagctggtcgaggctatggtggagaagggccaggatggttctgccgtcctggagcttgacctc

SEQ ID NO: 148166 - DNA, 75 bp, Artificial Sequence
  Synthetic
tcgttgtaggacttttctaaagaaggttgcgggtaaattctgctgctttatgcggtggttagggcaggagtgcac

SEQ ID NO: 148167 - DNA, 75 bp, Artificial Sequence
  Synthetic
cacggtaaggtgggccagggaatctcggcttggagcaagaccttttgtgccctattcggaccttggttccgtgct

SEQ ID NO: 148168 - DNA, 75 bp, Artificial Sequence
  Synthetic
cggcttggagcaagaccttttgtgccctattcggaccttggttccgtgctattgaaaaagagatcttagccctgc

SEQ ID NO: 148169 - DNA, 75 bp, Artificial Sequence
  Synthetic
gatacgcttctcggtggtttgccgacagaattaatttcgtcggctgggggccaattgttttactcccgccccgtc

SEQ ID NO: 148170 - DNA, 75 bp, Artificial Sequence
  Synthetic
gcgattacggtccacgaggcccagggtgctaccttcacagagaccacaattatagccacagctgatgccaggggc

SEQ ID NO: 148171 - DNA, 75 bp, Artificial Sequence
  Synthetic
gtatggtctttgagaatgacttttctgaatttgatagcactcagaataatttctcccttggtctcgagtgtgtta

SEQ ID NO: 148172 - DNA, 75 bp, Artificial Sequence
  Synthetic
atcccacatgatatagacctgggcgactctcgtgtggttattcaggattatgataatcaacatgagcaggatcgg

SEQ ID NO: 148173 - DNA, 75 bp, Artificial Sequence
  Synthetic
tgaatttgatagcactcagaataatttctcccttggtctcgagtgtgttattatggaggagtgtggcatgccgca

SEQ ID NO: 148174 - DNA, 75 bp, Artificial Sequence
  Synthetic
actctcgtgtggttattcaggattatgataatcaacatgagcaggatcggcccaccccttcacccgccccgtctc

SEQ ID NO: 148175 - DNA, 75 bp, Artificial Sequence
  Synthetic
ctggaagaagcactccggcgagcctggcacgcttctctggaatactgtctggaacatggcaattatagctcattg

SEQ ID NO: 148176 - DNA, 75 bp, Artificial Sequence
  Synthetic
atgggtcttccaccaacccaatgtatgtctcagatactgttacacttgttaatgtggccacaggggctcaggctg

SEQ ID NO: 148177 - DNA, 75 bp, Artificial Sequence
  Synthetic
ggcacgcttctctggaatactgtctggaacatggcaattatagctcattgctatgagttccgcgactttaaggtc

SEQ ID NO: 148178 - DNA, 75 bp, Artificial Sequence
  Synthetic
tgtctcagatactgttacacttgttaatgtggccacaggggctcaggctgttgctcgttctcttgattggtctaa

SEQ ID NO: 148179 - DNA, 75 bp, Artificial Sequence
  Synthetic
ccttgccctgaacttgagcagggcctgctctacatgccacaggagcttactgtgtccgatagtgtgttggttttt

SEQ ID NO: 148180 - DNA, 75 bp, Artificial Sequence
  Synthetic
gctggctgtgggttgaagttgaaagttgattaccgccctattgggctgtatgctggcgtggtgattgccccaggt

SEQ ID NO: 148181 - DNA, 75 bp, Artificial Sequence
  Synthetic
aaagttatccttttgggaagctggcacgaccaaggctggctacccttataattataatacaactgctagtgatca

SEQ ID NO: 148182 - DNA, 75 bp, Artificial Sequence
  Synthetic
ttgattaccgccctattgggctgtatgctggcgtggtgattgccccaggtttgggagctctacctgatgtggtta

SEQ ID NO: 148183 - DNA, 75 bp, Artificial Sequence
  Synthetic
ctactagcctaggtgctgggcctgtatcagtctctgcggttggcgtgctagcccctcactcggctctcgctatcc

SEQ ID NO: 148184 - DNA, 75 bp, Artificial Sequence
  Synthetic
ccacctcgacccccgtgtgcttgtctttgatgaggcagccccttgccgctgccggaacttcctccgcaaggcagc

SEQ ID NO: 148185 - DNA, 75 bp, Artificial Sequence
  Synthetic
gtgactttcttcgagggttaacgaatgttgcgcaggtttgtgttgatgtggtgtcccgtgtttatgaggtcagcc

SEQ ID NO: 148186 - DNA, 75 bp, Artificial Sequence
  Synthetic
aaggcccactttactgagactgttaaaccggtactggatcttacgaactccattatacagaggctagaatgaata

SEQ ID NO: 148187 - DNA, 75 bp, Artificial Sequence
  Synthetic
atgaaggtaggtaaaacccgggagtcttaattaattcttcttgtgcccccttcatagttttgctttatttcttat

SEQ ID NO: 148188 - DNA, 75 bp, Artificial Sequence
  Synthetic
cccatggcaaagttggtcaaggcatatcggcctggagtaagaccttctgtgccctgttcggcccgtggttccgcg

SEQ ID NO: 148189 - DNA, 75 bp, Artificial Sequence
  Synthetic
tgttgttacacatgcagcgggcctcttcggtccacctccttggtgacccaaatcagatccctgccattgattttg

SEQ ID NO: 148190 - DNA, 75 bp, Artificial Sequence
  Synthetic
ccattgaaaaagagatactggctttactcccgcctaatatcttttatggtgatgcctatgaggagtcagtgttcg

SEQ ID NO: 148191 - DNA, 75 bp, Artificial Sequence
  Synthetic
ccctgcggatgtctgcgaacttatacgtggggcgtaccccaagattcagactaccagccgcgtgctgagatccct

SEQ ID NO: 148192 - DNA, 75 bp, Artificial Sequence
  Synthetic
cgaggtttccattgtctccgctgggctcgattgtaaggccgtctttccaccccgtgtcgctacgccctcagcccc

SEQ ID NO: 148193 - DNA, 75 bp, Artificial Sequence
  Synthetic
gtcccagcgcccctccgctgccccccgtcgtcgatctaccccagctggggctgcgccgttgactgctgtgtcacc

SEQ ID NO: 148194 - DNA, 75 bp, Artificial Sequence
  Synthetic
ctggtactctgcccccacccgtggtcctgcggccaactgccgccgctccgcgttgcgtggtctccctcccgctga

SEQ ID NO: 148195 - DNA, 75 bp, Artificial Sequence
  Synthetic
gatagtgtgttggtttttgaactcacggatatagtccactgccgtatggctgccccaagccagcgaaaggccgtt

SEQ ID NO: 148196 - DNA, 75 bp, Artificial Sequence
  Synthetic
ctcccctttaacatcctctgtggcttcaggtacaaatcttgttctgtatgccgctccactcaatccccttctacc

SEQ ID NO: 148197 - DNA, 75 bp, Artificial Sequence
  Synthetic
ctcccctttaacttcctctgtggcttcaggtacaaatcttgttctgtatgccgctccactcaatccccttctacc

SEQ ID NO: 148198 - DNA, 75 bp, Artificial Sequence
  Synthetic
ctcccctttaacctcctctgtggcttcaggtacaaatcttgttctgtatgccgctccactcaatccccttctacc

SEQ ID NO: 148199 - DNA, 75 bp, Artificial Sequence
  Synthetic
ctcccctttaacgtcctctgtggcttcaggtacaaatcttgttctgtatgccgctccactcaatccccttctacc

SEQ ID NO: 148200 - DNA, 75 bp, Artificial Sequence
  Synthetic
ttgccgccttcaagggtgatgattcggtggtcctctgcagcgactaccgacagagccgcaatgcagctgccttaa

SEQ ID NO: 148201 - DNA, 75 bp, Artificial Sequence
  Synthetic
tgacctctggccagctgatgtcgcagaggctatggcccgccatgggatgacacgcctatatgctgcactacacct

SEQ ID NO: 148202 - DNA, 75 bp, Artificial Sequence
  Synthetic
tcaggtacaaatcttgttctgtatgccgctccactcaatccccttctacccctccaggacggcactaacacccat

SEQ ID NO: 148203 - DNA, 75 bp, Artificial Sequence
  Synthetic
tgtacagacccaaccaccggcccctgagcaggtggcaccccccttggatttacccgaccgtggcgctagtcccac

SEQ ID NO: 148204 - DNA, 75 bp, Artificial Sequence
  Synthetic
ccgaatgctgttggtggttatgcaatttccatctcattttggcctcagaccacaaccaccccgacctctgtggat

SEQ ID NO: 148205 - DNA, 75 bp, Artificial Sequence
  Synthetic
ccgaatgctgttggtggttatgcaatttccatctctttttggcctcagaccacaaccaccccgacctctgtggat

SEQ ID NO: 148206 - DNA, 75 bp, Artificial Sequence
  Synthetic
ccgaatgctgttggtggttatgcaatttccatctccttttggcctcagaccacaaccaccccgacctctgtggat

SEQ ID NO: 148207 - DNA, 75 bp, Artificial Sequence
  Synthetic
ccgaatgctgttggtggttatgcaatttccatctcgttttggcctcagaccacaaccaccccgacctctgtggat

SEQ ID NO: 148208 - DNA, 75 bp, Artificial Sequence
  Synthetic
tttccatctcattttggcctcagaccacaaccaccccgacctctgtggatatgaattctatcacctctactgatg

SEQ ID NO: 148209 - DNA, 75 bp, Artificial Sequence
  Synthetic
tttccatctctttttggcctcagaccacaaccaccccgacctctgtggatatgaattctatcacctctactgatg

SEQ ID NO: 148210 - DNA, 75 bp, Artificial Sequence
  Synthetic
tttccatctccttttggcctcagaccacaaccaccccgacctctgtggatatgaattctatcacctctactgatg

SEQ ID NO: 148211 - DNA, 75 bp, Artificial Sequence
  Synthetic
tttccatctcgttttggcctcagaccacaaccaccccgacctctgtggatatgaattctatcacctctactgatg

SEQ ID NO: 148212 - DNA, 75 bp, Artificial Sequence
  Synthetic
ttggttatagagcgtgtgcgggctattggatgtcattttgtgctgctgctcaccgcagcccctgagccgtcacct

SEQ ID NO: 148213 - DNA, 75 bp, Artificial Sequence
  Synthetic
gctggcgctctgtggagacctcgggtgtggccgaagaggaggctacttccggtctggttatgctttgcattcatg

SEQ ID NO: 148214 - DNA, 75 bp, Artificial Sequence
  Synthetic
tgtggccgaagaggaggctacttccggtctggttatgctttgcattcatggctctcctgttaactcctatactaa

SEQ ID NO: 148215 - DNA, 75 bp, Artificial Sequence
  Synthetic
cactaacacccgtgtgtcccgctatactagtacagctcgccaccgcctacgccgaggtgcggacgggactgctga

SEQ ID NO: 148216 - DNA, 75 bp, Artificial Sequence
  Synthetic
gccgaggtgcggacgggactgctgagcttacaactactgctgccacacgtttcatgaaggacctgcattttactg

SEQ ID NO: 148217 - DNA, 75 bp, Artificial Sequence
  Synthetic
taccgccccattgggctgtatgctggtgtggtggtggcccctggcttggggacactgcctgatgtggtgcggttt

SEQ ID NO: 148218 - DNA, 75 bp, Artificial Sequence
  Synthetic
cgcaggtctgtgttgatgttgtgtcccgtgtttatggagtcagccccgggctggtacataaccttattggcatgc

SEQ ID NO: 148219 - DNA, 75 bp, Artificial Sequence
  Synthetic
ttacctgcgtggtattagctacaaggtcactgtcggtgcgcttgttgctaatgagggatggaatgcctctgagga

SEQ ID NO: 148220 - DNA, 75 bp, Artificial Sequence
  Synthetic
ccagcccctgacacagcccctgtgcctgatgttgattcacgcggtgctattttgcgccggcagtacaatctgtct

SEQ ID NO: 148221 - DNA, 75 bp, Artificial Sequence
  Synthetic
ctgatgttgattcacgcggtgctattttgcgccggcagtacaatctgtctacgtccccgctcacgtcatctgttg

SEQ ID NO: 148222 - DNA, 75 bp, Artificial Sequence
  Synthetic
ccaggactatgacaatcaacatgagcaggatagacccactccatcacctgccccgtctcgccctttttcggttct

SEQ ID NO: 148223 - DNA, 75 bp, Artificial Sequence
  Synthetic
caggatagacccactccatcacctgccccgtctcgccctttttcggttctccgtgctaatgatgttttgtggctt

SEQ ID NO: 148224 - DNA, 75 bp, Artificial Sequence
  Synthetic
acatcatggctactgaggcttctaattatgcccagtatcgggtcgttcgagctacgatccgttaccgccctttgg

SEQ ID NO: 148225 - DNA, 75 bp, Artificial Sequence
  Synthetic
cctcacactgcagcccgtgtaactcgtggccgtagggttgttatcgatgaggccccctcgctcccaccgcaccta

SEQ ID NO: 148226 - DNA, 75 bp, Artificial Sequence
  Synthetic
acttttgtcaatgtggccacgggtgctcaggccgtggcccgctcactggactggtctaaggtcaccttggacggc

SEQ ID NO: 148227 - DNA, 75 bp, Artificial Sequence
  Synthetic
actactactaccccaacttctgttgacatgaattctattacttctactgatgttaggattttggttcagcccggt

SEQ ID NO: 148228 - DNA, 75 bp, Artificial Sequence
  Synthetic
ctcaggccgtggcccgctcactggactggtctaaggtcaccttggacggccggccccttactactatccagcaat

SEQ ID NO: 148229 - DNA, 75 bp, Artificial Sequence
  Synthetic
ttgtaaggtttttgagaatgatttttctgagtttgatagcactcaaaataatttttcattggggttggagtgtat

SEQ ID NO: 148230 - DNA, 75 bp, Artificial Sequence
  Synthetic
ggtgtggctgaggaggaggctacctccggtttggtgatgctttgtattcatggctcccctgttaattcttatact

SEQ ID NO: 148231 - DNA, 75 bp, Artificial Sequence
  Synthetic
acccctataactataacaccactgctagtgatcagatcctgattgaaaatgcggcgggtcaccgtgttgcaattt

SEQ ID NO: 148232 - DNA, 75 bp, Artificial Sequence
  Synthetic
tggctcccctgttaattcttatactaatacaccttacaccggtgcattggggctccttgattttgcattagagct

SEQ ID NO: 148233 - DNA, 75 bp, Artificial Sequence
  Synthetic
aaaggccgccaatccgggggcaattacagtccatgaagcccagggcgcaacatttactgagaccacaattattgc

SEQ ID NO: 148234 - DNA, 75 bp, Artificial Sequence
  Synthetic
ctacttacaccactagtcttggtgctgggcctgtgtctgtgtccgcggttggtgtgcttgctccacactctgctc

SEQ ID NO: 148235 - DNA, 75 bp, Artificial Sequence
  Synthetic
cccgggagtcttaattagtttccttctgtgcccccttcctttgttttgtttaattactaattactttttacgggg

SEQ ID NO: 148236 - DNA, 75 bp, Artificial Sequence
  Synthetic
cccgggagtcttaattagtttccttctgtgcccccttcctttgttttgtttaattactaattacttttttcgggg

SEQ ID NO: 148237 - DNA, 75 bp, Artificial Sequence
  Synthetic
cccgggagtcttaattagtttccttctgtgcccccttcctttgttttgtttaattactaattactttttccgggg

SEQ ID NO: 148238 - DNA, 75 bp, Artificial Sequence
  Synthetic
cccgggagtcttaattagtttccttctgtgcccccttcctttgttttgtttaattactaattactttttgcgggg

SEQ ID NO: 148239 - DNA, 75 bp, Artificial Sequence
  Synthetic
cccgggagtcttaattagtttccttctgtgcccccttcctttgttttgtttaattactaatttctttttacgggg

SEQ ID NO: 148240 - DNA, 75 bp, Artificial Sequence
  Synthetic
cccgggagtcttaattagtttccttctgtgcccccttcctttgttttgtttaattactaatttcttttttcgggg

SEQ ID NO: 148241 - DNA, 75 bp, Artificial Sequence
  Synthetic
cccgggagtcttaattagtttccttctgtgcccccttcctttgttttgtttaattactaatttctttttccgggg

SEQ ID NO: 148242 - DNA, 75 bp, Artificial Sequence
  Synthetic
cccgggagtcttaattagtttccttctgtgcccccttcctttgttttgtttaattactaatttctttttgcgggg

SEQ ID NO: 148243 - DNA, 75 bp, Artificial Sequence
  Synthetic
cccgggagtcttaattagtttccttctgtgcccccttcctttgttttgtttaattactaattcctttttacgggg

SEQ ID NO: 148244 - DNA, 75 bp, Artificial Sequence
  Synthetic
cccgggagtcttaattagtttccttctgtgcccccttcctttgttttgtttaattactaattccttttttcgggg

SEQ ID NO: 148245 - DNA, 75 bp, Artificial Sequence
  Synthetic
cccgggagtcttaattagtttccttctgtgcccccttcctttgttttgtttaattactaattcctttttccgggg

SEQ ID NO: 148246 - DNA, 75 bp, Artificial Sequence
  Synthetic
cccgggagtcttaattagtttccttctgtgcccccttcctttgttttgtttaattactaattcctttttgcgggg

SEQ ID NO: 148247 - DNA, 75 bp, Artificial Sequence
  Synthetic
cccgggagtcttaattagtttccttctgtgcccccttcctttgttttgtttaattactaattgctttttacgggg

SEQ ID NO: 148248 - DNA, 75 bp, Artificial Sequence
  Synthetic
cccgggagtcttaattagtttccttctgtgcccccttcctttgttttgtttaattactaattgcttttttcgggg

SEQ ID NO: 148249 - DNA, 75 bp, Artificial Sequence
  Synthetic
cccgggagtcttaattagtttccttctgtgcccccttcctttgttttgtttaattactaattgctttttccgggg

SEQ ID NO: 148250 - DNA, 75 bp, Artificial Sequence
  Synthetic
cccgggagtcttaattagtttccttctgtgcccccttcctttgttttgtttaattactaattgctttttgcgggg

SEQ ID NO: 148251 - DNA, 75 bp, Artificial Sequence
  Synthetic
cccgggagtcttaattagtttccttctgtgcccccttcctttgttttgtttaatttctaattactttttacgggg

SEQ ID NO: 148252 - DNA, 75 bp, Artificial Sequence
  Synthetic
cccgggagtcttaattagtttccttctgtgcccccttcctttgttttgtttaatttctaattacttttttcgggg

SEQ ID NO: 148253 - DNA, 75 bp, Artificial Sequence
  Synthetic
cccgggagtcttaattagtttccttctgtgcccccttcctttgttttgtttaatttctaattactttttccgggg

SEQ ID NO: 148254 - DNA, 75 bp, Artificial Sequence
  Synthetic
cccgggagtcttaattagtttccttctgtgcccccttcctttgttttgtttaatttctaattactttttgcgggg

SEQ ID NO: 148255 - DNA, 75 bp, Artificial Sequence
  Synthetic
cccgggagtcttaattagtttccttctgtgcccccttcctttgttttgtttaatttctaatttctttttacgggg

SEQ ID NO: 148256 - DNA, 75 bp, Artificial Sequence
  Synthetic
cccgggagtcttaattagtttccttctgtgcccccttcctttgttttgtttaatttctaatttcttttttcgggg

SEQ ID NO: 148257 - DNA, 75 bp, Artificial Sequence
  Synthetic
cccgggagtcttaattagtttccttctgtgcccccttcctttgttttgtttaatttctaatttctttttccgggg

SEQ ID NO: 148258 - DNA, 75 bp, Artificial Sequence
  Synthetic
cccgggagtcttaattagtttccttctgtgcccccttcctttgttttgtttaatttctaatttctttttgcgggg

SEQ ID NO: 148259 - DNA, 75 bp, Artificial Sequence
  Synthetic
cccgggagtcttaattagtttccttctgtgcccccttcctttgttttgtttaatttctaattcctttttacgggg

SEQ ID NO: 148260 - DNA, 75 bp, Artificial Sequence
  Synthetic
cccgggagtcttaattagtttccttctgtgcccccttcctttgttttgtttaatttctaattccttttttcgggg

SEQ ID NO: 148261 - DNA, 75 bp, Artificial Sequence
  Synthetic
cccgggagtcttaattagtttccttctgtgcccccttcctttgttttgtttaatttctaattcctttttccgggg

SEQ ID NO: 148262 - DNA, 75 bp, Artificial Sequence
  Synthetic
cccgggagtcttaattagtttccttctgtgcccccttcctttgttttgtttaatttctaattcctttttgcgggg

SEQ ID NO: 148263 - DNA, 75 bp, Artificial Sequence
  Synthetic
cccgggagtcttaattagtttccttctgtgcccccttcctttgttttgtttaatttctaattgctttttacgggg

SEQ ID NO: 148264 - DNA, 75 bp, Artificial Sequence
  Synthetic
cccgggagtcttaattagtttccttctgtgcccccttcctttgttttgtttaatttctaattgcttttttcgggg

SEQ ID NO: 148265 - DNA, 75 bp, Artificial Sequence
  Synthetic
cccgggagtcttaattagtttccttctgtgcccccttcctttgttttgtttaatttctaattgctttttccgggg

SEQ ID NO: 148266 - DNA, 75 bp, Artificial Sequence
  Synthetic
cccgggagtcttaattagtttccttctgtgcccccttcctttgttttgtttaatttctaattgctttttgcgggg

SEQ ID NO: 148267 - DNA, 75 bp, Artificial Sequence
  Synthetic
cccgggagtcttaattagtttccttctgtgcccccttcctttgttttgtttaattcctaattactttttacgggg

SEQ ID NO: 148268 - DNA, 75 bp, Artificial Sequence
  Synthetic
cccgggagtcttaattagtttccttctgtgcccccttcctttgttttgtttaattcctaattacttttttcgggg

SEQ ID NO: 148269 - DNA, 75 bp, Artificial Sequence
  Synthetic
cccgggagtcttaattagtttccttctgtgcccccttcctttgttttgtttaattcctaattactttttccgggg

SEQ ID NO: 148270 - DNA, 75 bp, Artificial Sequence
  Synthetic
cccgggagtcttaattagtttccttctgtgcccccttcctttgttttgtttaattcctaattactttttgcgggg

SEQ ID NO: 148271 - DNA, 75 bp, Artificial Sequence
  Synthetic
cccgggagtcttaattagtttccttctgtgcccccttcctttgttttgtttaattcctaatttctttttacgggg

SEQ ID NO: 148272 - DNA, 75 bp, Artificial Sequence
  Synthetic
cccgggagtcttaattagtttccttctgtgcccccttcctttgttttgtttaattcctaatttcttttttcgggg

SEQ ID NO: 148273 - DNA, 75 bp, Artificial Sequence
  Synthetic
cccgggagtcttaattagtttccttctgtgcccccttcctttgttttgtttaattcctaatttctttttccgggg

SEQ ID NO: 148274 - DNA, 75 bp, Artificial Sequence
  Synthetic
cccgggagtcttaattagtttccttctgtgcccccttcctttgttttgtttaattcctaatttctttttgcgggg

SEQ ID NO: 148275 - DNA, 75 bp, Artificial Sequence
  Synthetic
cccgggagtcttaattagtttccttctgtgcccccttcctttgttttgtttaattcctaattcctttttacgggg

SEQ ID NO: 148276 - DNA, 75 bp, Artificial Sequence
  Synthetic
cccgggagtcttaattagtttccttctgtgcccccttcctttgttttgtttaattcctaattccttttttcgggg

SEQ ID NO: 148277 - DNA, 75 bp, Artificial Sequence
  Synthetic
cccgggagtcttaattagtttccttctgtgcccccttcctttgttttgtttaattcctaattcctttttccgggg

SEQ ID NO: 148278 - DNA, 75 bp, Artificial Sequence
  Synthetic
cccgggagtcttaattagtttccttctgtgcccccttcctttgttttgtttaattcctaattcctttttgcgggg

SEQ ID NO: 148279 - DNA, 75 bp, Artificial Sequence
  Synthetic
cccgggagtcttaattagtttccttctgtgcccccttcctttgttttgtttaattcctaattgctttttacgggg

SEQ ID NO: 148280 - DNA, 75 bp, Artificial Sequence
  Synthetic
cccgggagtcttaattagtttccttctgtgcccccttcctttgttttgtttaattcctaattgcttttttcgggg

SEQ ID NO: 148281 - DNA, 75 bp, Artificial Sequence
  Synthetic
cccgggagtcttaattagtttccttctgtgcccccttcctttgttttgtttaattcctaattgctttttccgggg

SEQ ID NO: 148282 - DNA, 75 bp, Artificial Sequence
  Synthetic
cccgggagtcttaattagtttccttctgtgcccccttcctttgttttgtttaattcctaattgctttttgcgggg

SEQ ID NO: 148283 - DNA, 75 bp, Artificial Sequence
  Synthetic
cccgggagtcttaattagtttccttctgtgcccccttcctttgttttgtttaattgctaattactttttacgggg

SEQ ID NO: 148284 - DNA, 75 bp, Artificial Sequence
  Synthetic
cccgggagtcttaattagtttccttctgtgcccccttcctttgttttgtttaattgctaattacttttttcgggg

SEQ ID NO: 148285 - DNA, 75 bp, Artificial Sequence
  Synthetic
cccgggagtcttaattagtttccttctgtgcccccttcctttgttttgtttaattgctaattactttttccgggg

SEQ ID NO: 148286 - DNA, 75 bp, Artificial Sequence
  Synthetic
cccgggagtcttaattagtttccttctgtgcccccttcctttgttttgtttaattgctaattactttttgcgggg

SEQ ID NO: 148287 - DNA, 75 bp, Artificial Sequence
  Synthetic
cccgggagtcttaattagtttccttctgtgcccccttcctttgttttgtttaattgctaatttctttttacgggg

SEQ ID NO: 148288 - DNA, 75 bp, Artificial Sequence
  Synthetic
cccgggagtcttaattagtttccttctgtgcccccttcctttgttttgtttaattgctaatttcttttttcgggg

SEQ ID NO: 148289 - DNA, 75 bp, Artificial Sequence
  Synthetic
cccgggagtcttaattagtttccttctgtgcccccttcctttgttttgtttaattgctaatttctttttccgggg

SEQ ID NO: 148290 - DNA, 75 bp, Artificial Sequence
  Synthetic
cccgggagtcttaattagtttccttctgtgcccccttcctttgttttgtttaattgctaatttctttttgcgggg

SEQ ID NO: 148291 - DNA, 75 bp, Artificial Sequence
  Synthetic
cccgggagtcttaattagtttccttctgtgcccccttcctttgttttgtttaattgctaattcctttttacgggg

SEQ ID NO: 148292 - DNA, 75 bp, Artificial Sequence
  Synthetic
cccgggagtcttaattagtttccttctgtgcccccttcctttgttttgtttaattgctaattccttttttcgggg

SEQ ID NO: 148293 - DNA, 75 bp, Artificial Sequence
  Synthetic
cccgggagtcttaattagtttccttctgtgcccccttcctttgttttgtttaattgctaattcctttttccgggg

SEQ ID NO: 148294 - DNA, 75 bp, Artificial Sequence
  Synthetic
cccgggagtcttaattagtttccttctgtgcccccttcctttgttttgtttaattgctaattcctttttgcgggg

SEQ ID NO: 148295 - DNA, 75 bp, Artificial Sequence
  Synthetic
cccgggagtcttaattagtttccttctgtgcccccttcctttgttttgtttaattgctaattgctttttacgggg

SEQ ID NO: 148296 - DNA, 75 bp, Artificial Sequence
  Synthetic
cccgggagtcttaattagtttccttctgtgcccccttcctttgttttgtttaattgctaattgcttttttcgggg

SEQ ID NO: 148297 - DNA, 75 bp, Artificial Sequence
  Synthetic
cccgggagtcttaattagtttccttctgtgcccccttcctttgttttgtttaattgctaattgctttttccgggg

SEQ ID NO: 148298 - DNA, 75 bp, Artificial Sequence
  Synthetic
cccgggagtcttaattagtttccttctgtgcccccttcctttgttttgtttaattgctaattgctttttgcgggg

SEQ ID NO: 148299 - DNA, 75 bp, Artificial Sequence
  Synthetic
cccattttgtggggaggggaccttgtatacccgaacctggtcaacatctggcttctctagtgacttctccccccc

SEQ ID NO: 148300 - DNA, 75 bp, Artificial Sequence
  Synthetic
atggaggcccatcagttcataaaggctcctggcgtcactactgctattgagcaggcagctctagcagcggccaac

SEQ ID NO: 148301 - DNA, 75 bp, Artificial Sequence
  Synthetic
tgatgcattcccgccctcctgccagtttagtgcttatcaccagctggctgaggagcttggccaccgaccggcccc

SEQ ID NO: 148302 - DNA, 75 bp, Artificial Sequence
  Synthetic
gcagaccacgtatgtggtcgacgccatggaggcccatcagttcataaaggctcctggcgtcactactgctattga

SEQ ID NO: 148303 - DNA, 75 bp, Artificial Sequence
  Synthetic
atatgccccaggagttaactacatcggatagtgtactcacttttgaactcacggacatagtgcattgccgtatgg

SEQ ID NO: 148304 - DNA, 75 bp, Artificial Sequence
  Synthetic
gctgccaccaccctcagaggagtcccagaccgacgcggcacctgtgccccctgtccctaagacagttggattgcc

SEQ ID NO: 148305 - DNA, 75 bp, Artificial Sequence
  Synthetic
cactcgtcgtctcctctacacctatcctgacggcgctagggtatatgcggggtcgttgtttgaatcagactgtga

SEQ ID NO: 148306 - DNA, 75 bp, Artificial Sequence
  Synthetic
aatgttttgcatcgttgttttctcaaaccggtcggccgtgatgttcagcggtggtataccgcccccacccgtggt

SEQ ID NO: 148307 - DNA, 75 bp, Artificial Sequence
  Synthetic
tcacgcttgtcaatgtggccactggcgcccaggctgttgcccgctcccttgattggtctaaagtcactctggatg

SEQ ID NO: 148308 - DNA, 75 bp, Artificial Sequence
  Synthetic
tgaccagtcccagcgccccgccgcttccgcccgtcgtcgatctgccccagctggggcttcgccgctgacggctgt

SEQ ID NO: 148309 - DNA, 75 bp, Artificial Sequence
  Synthetic
ctacccgtataattataacactactgctagtgatcaaattctgattgagaacgcggccggtcaccgtgtcgctat

SEQ ID NO: 148310 - DNA, 75 bp, Artificial Sequence
  Synthetic
tgacctatggcctgctgatgtcgccgaggcgatggcccgccatggtatgactcggctctatgcagccctccatct

SEQ ID NO: 148311 - DNA, 75 bp, Artificial Sequence
  Synthetic
atgacatacctccgcggtattagctacaaggtcaccgttggtgcgcttgttgctaatgaggggtggaacgcctct

SEQ ID NO: 148312 - DNA, 75 bp, Artificial Sequence
  Synthetic
acaaggtcaccgttggtgcgcttgttgctaatgaggggtggaacgcctctgaggatgccctcaccgcagtaatta

SEQ ID NO: 148313 - DNA, 75 bp, Artificial Sequence
  Synthetic
aacccgggagtcttaattaattccctttcgtgcccccttcgtagtttccttttgctttatttcttatttctgctt

SEQ ID NO: 148314 - DNA, 75 bp, Artificial Sequence
  Synthetic
tgctaatgaggggtggaacgcctctgaggatgccctcaccgcagtaattactgcagcctatttgaccatctgtca

SEQ ID NO: 148315 - DNA, 75 bp, Artificial Sequence
  Synthetic
atgccttatgttccatacccacgttcaaccgaggtctatgttcggtccattttcggccctggcggctcgccgtcc

SEQ ID NO: 148316 - DNA, 75 bp, Artificial Sequence
  Synthetic
aacttgagcagtactgccgggcccgggccggccgctgtcttgaaattggtgcacacccacggtccattaatgaca

SEQ ID NO: 148317 - DNA, 75 bp, Artificial Sequence
  Synthetic
ccgccgcacttgctgctgctacacatgcaacgggcctcctcggtccatctcctcggcgacccaaatcagattcct

SEQ ID NO: 148318 - DNA, 75 bp, Artificial Sequence
  Synthetic
tgcaacgggcctcctcggtccatctcctcggcgacccaaatcagattcctgctattgattttgaacatgccggcc

SEQ ID NO: 148319 - DNA, 75 bp, Artificial Sequence
  Synthetic
ggccggccgctgtcttgaaattggtgcacacccacggtccattaatgacaaccccaatgttctgcatcgctgctt

SEQ ID NO: 148320 - DNA, 75 bp, Artificial Sequence
  Synthetic
tggtaatacgaacacgcgtgtttctcgctactcgagcagcgcgcgtcataagttgcgccgagggcctgacggtac

SEQ ID NO: 148321 - DNA, 75 bp, Artificial Sequence
  Synthetic
ggtaccttcgtacgcaggccatctcgaaggggatgaaaaggtaggagctcgagcacgcgcagaaatttataacac

SEQ ID NO: 148322 - DNA, 75 bp, Artificial Sequence
  Synthetic
ggtaccttcgtacgcaggccatctcgaaggggatgaaaaggttggagctcgagcacgcgcagaaatttataacac

SEQ ID NO: 148323 - DNA, 75 bp, Artificial Sequence
  Synthetic
ggtaccttcgtacgcaggccatctcgaaggggatgaaaaggtcggagctcgagcacgcgcagaaatttataacac

SEQ ID NO: 148324 - DNA, 75 bp, Artificial Sequence
  Synthetic
ggtaccttcgtacgcaggccatctcgaaggggatgaaaaggtgggagctcgagcacgcgcagaaatttataacac

SEQ ID NO: 148325 - DNA, 75 bp, Artificial Sequence
  Synthetic
tgttcttgaccttaccagttctattatataccggatggaatgaataacatgttcttttgctctgtgcatggagat

SEQ ID NO: 148326 - DNA, 75 bp, Artificial Sequence
  Synthetic
ttcagctcttcgcgggctcccaccggtcgaccgcacttactgttttgctggcttttctggttgtacgtttgccgc

SEQ ID NO: 148327 - DNA, 75 bp, Artificial Sequence
  Synthetic
gtgagcttatacgtggggcctaccctaagatccagaccacgagtcgtgtgctacggtctctgttttggaacgaac

SEQ ID NO: 148328 - DNA, 75 bp, Artificial Sequence
  Synthetic
gtgctcgggaataagaccttccgaacgacggtggttgatggcgcgcatcttgaagcgaacggccctgagcagtat

SEQ ID NO: 148329 - DNA, 75 bp, Artificial Sequence
  Synthetic
gtcgaccgcacttactgttttgctggcttttctggttgtacgtttgccgccgagacggggattgctctctactca

SEQ ID NO: 148330 - DNA, 75 bp, Artificial Sequence
  Synthetic
gccgccggtggttatctgctggttttcaccttgatcctcgtgtgctcgtttttgacgaagctgccccctgccgct

SEQ ID NO: 148331 - DNA, 75 bp, Artificial Sequence
  Synthetic
tcaccttgatcctcgtgtgctcgtttttgacgaagctgccccctgccgctgtcggagcttcctgcgtaaagccgc

SEQ ID NO: 148332 - DNA, 75 bp, Artificial Sequence
  Synthetic
catctccccccggaggtgctgctccctcctggcacttaccataccacctcatatctcctaatccatgatggagat

SEQ ID NO: 148333 - DNA, 75 bp, Artificial Sequence
  Synthetic
ctcctggcacttaccataccacctcatatctcctaatccatgatggagatcgtgctgtgattacatacgaggggg

SEQ ID NO: 148334 - DNA, 75 bp, Artificial Sequence
  Synthetic
ctcacgctatagtcgcacttacccgccacactgagaagtgtgttattttagatgcccccggcctactgcgcgagg

SEQ ID NO: 148335 - DNA, 75 bp, Artificial Sequence
  Synthetic
acccgttggtgattgagcgggtccgggcagtggggtgccattttgtacttcttttaacagctgcacctgagccgt

SEQ ID NO: 148336 - DNA, 75 bp, Artificial Sequence
  Synthetic
ggcagtggggtgccattttgtacttcttttaacagctgcacctgagccgtcgccgatgccctatgttccatatcc

SEQ ID NO: 148337 - DNA, 75 bp, Artificial Sequence
  Synthetic
taccccgcggtaaccccgatcagaatctcgggactctacaggcattcccgccgtcttgccagattagtgcctacc

SEQ ID NO: 148338 - DNA, 75 bp, Artificial Sequence
  Synthetic
agggcctgctctacatgccacaagagcttactgtgtccgatagtgtgttggtatttgaactcacagatatagtcc

SEQ ID NO: 148339 - DNA, 75 bp, Artificial Sequence
  Synthetic
gttataccttaacatctgaaggcctcgaagtacatattatttccgctgggcttgattgcagggctgtcttcccgc

SEQ ID NO: 148340 - DNA, 75 bp, Artificial Sequence
  Synthetic
gaggacgcgctgacagctgtgattactgcggcatatcttacaatctgccatcagaggtacctccgcacgcaagct

SEQ ID NO: 148341 - DNA, 75 bp, Artificial Sequence
  Synthetic
ctgcggcatatcttacaatctgccatcagaggtacctccgcacgcaagctatctctaagggaatgaagaggttag

SEQ ID NO: 148342 - DNA, 75 bp, Artificial Sequence
  Synthetic
caccgcccaggcgatgagctctacctgactgagcccgctgcagcctggtttgaagctaacaagccgacacagccg

SEQ ID NO: 148343 - DNA, 75 bp, Artificial Sequence
  Synthetic
ccgtggtatagcattgaccctgtttaatcttgctgatacgcttctcggcgggctcccgacagaattaatttcgtc

SEQ ID NO: 148344 - DNA, 75 bp, Artificial Sequence
  Synthetic
ctggccgtcagctgcagttttatgctcagtgtcgtcggtggctgtctgccggtttccatcttgaccctcgtgtgc

SEQ ID NO: 148345 - DNA, 75 bp, Artificial Sequence
  Synthetic
tatacccgcacttggtctgtgtcgggcttttccagctgtttctctcctctcgagcctcgtgccccggagttgcca

SEQ ID NO: 148346 - DNA, 75 bp, Artificial Sequence
  Synthetic
tcagtgtcgtcggtggctgtctgccggtttccatcttgaccctcgtgtgctagtgtttgatgaagcggccccctg

SEQ ID NO: 148347 - DNA, 75 bp, Artificial Sequence
  Synthetic
ctgcttcctccagcctattgaggggagggtcggtgagcagggttatgacaatgaggcatttgaggggtcggatgt

SEQ ID NO: 148348 - DNA, 75 bp, Artificial Sequence
  Synthetic
acccccggccctgtcgcgtccccgtcagacctggctgatggtggtgctggcccaggcttgactagcgcccctgcg

SEQ ID NO: 148349 - DNA, 75 bp, Artificial Sequence
  Synthetic
tcgtgctaatgatgtgctttggctttcacttacagctgctgaatatgatcagactacctatggctcttctactaa

SEQ ID NO: 148350 - DNA, 75 bp, Artificial Sequence
  Synthetic
cccaggcttgactagcgcccctgcggagcccccggcgcccgtgcagcttgtaacccagcccggacctcgtcgacg

SEQ ID NO: 148351 - DNA, 75 bp, Artificial Sequence
  Synthetic
agaataacttctctctcggccttgagtgtgtggtcatggaggagtgcggcatgccccagtggttgattaggttgt

SEQ ID NO: 148352 - DNA, 75 bp, Artificial Sequence
  Synthetic
ccggctacagacagagatacttattaacctgatgcagccccggcagcttgttttccggcctgaagtcttgtggaa

SEQ ID NO: 148353 - DNA, 75 bp, Artificial Sequence
  Synthetic
agggtcggtgagcagggttatgacaatgaggcatttgaggggtcggatgttgacccagctgaggaggctgttgta

SEQ ID NO: 148354 - DNA, 75 bp, Artificial Sequence
  Synthetic
attgctgctcgcgccagccgcctcactgccaccgttgaggtctcggatgcgaatggccgtctcacctgcaaaacc

SEQ ID NO: 148355 - DNA, 75 bp, Artificial Sequence
  Synthetic
ctgccaccgttgaggtctcggatgcgaatggccgtctcacctgcaaaaccaccttgggtaataagactttttcaa

SEQ ID NO: 148356 - DNA, 75 bp, Artificial Sequence
  Synthetic
cctggtggtggcctctgccatgcattttaccagcggttcccagagtccttcgatcccgctgagtttatcatgtcc

SEQ ID NO: 148357 - DNA, 75 bp, Artificial Sequence
  Synthetic
aagggtttttggaagaagcactctggtgagcctggtacccttctctggaacaccgtctggaacatggcgattata

SEQ ID NO: 148358 - DNA, 75 bp, Artificial Sequence
  Synthetic
caccgtctggaacatggcgattatagcgcactgttacgagttccgtgactttcgcgttgccgccttcaagggtga

SEQ ID NO: 148359 - DNA, 75 bp, Artificial Sequence
  Synthetic
tttaccagcggttcccagagtccttcgatcccgctgagtttatcatgtccgacgggtttgcagcctacaccctga

SEQ ID NO: 148360 - DNA, 75 bp, Artificial Sequence
  Synthetic
aggctatggctgccggcccgcataatcttagttatgccctaacagctgcaggtcttgaggtacatatcgtttctg

SEQ ID NO: 148361 - DNA, 75 bp, Artificial Sequence
  Synthetic
tcttagttatgccctaacagctgcaggtcttgaggtacatatcgtttctgcggggctcgactgtaaggcagtctt

SEQ ID NO: 148362 - DNA, 75 bp, Artificial Sequence
  Synthetic
tggacctgtctctatttctgctgttggtgttttagcaccccactctgccttggccgctttggaggacacggtcga

SEQ ID NO: 148363 - DNA, 75 bp, Artificial Sequence
  Synthetic
ctgctgagacagggatagccctttactcactgcacgacctctggcctgccgatgttgccgaggcaatggctcgcc

SEQ ID NO: 148364 - DNA, 75 bp, Artificial Sequence
  Synthetic
ggttgagctttgatgcttgggaacgtaaccaccgacctggagatgagctgtacctgaccgagccagccatagcct

SEQ ID NO: 148365 - DNA, 75 bp, Artificial Sequence
  Synthetic
ctgtgtccagcggcactccctcattgggggcctgtggtactatcctgaggggttaattggtttgttcccaccatt

SEQ ID NO: 148366 - DNA, 75 bp, Artificial Sequence
  Synthetic
ggtttgaggccaaccgacctacccttcctgctctgactattactgaggacacggcgcgcactgcgaacctggcat

SEQ ID NO: 148367 - DNA, 75 bp, Artificial Sequence
  Synthetic
gggggcctgtggtactatcctgaggggttaattggtttgttcccaccattcgctcccggtcatagctgggagtcc

SEQ ID NO: 148368 - DNA, 75 bp, Artificial Sequence
  Synthetic
ctgtgggctcaaattgaaggttgattaccgccccattggactgtatgctggtgtggtggtggcccctggtttggg

SEQ ID NO: 148369 - DNA, 75 bp, Artificial Sequence
  Synthetic
tcctgctctgactattactgaggacacggcgcgcactgcgaacctggcattggagctggatgcagccactgaggt

SEQ ID NO: 148370 - DNA, 75 bp, Artificial Sequence
  Synthetic
tgtgccttcctttgtactgttttttttattttttttttttgcgttccgcgctccctggaaaaaaaaaaaaaaaaa

SEQ ID NO: 148371 - DNA, 75 bp, Artificial Sequence
  Synthetic
ccgatggcaaggcccacttcacagagaccattaaacctgtgcttgaccttacgaattccatcatacagcgggaag

SEQ ID NO: 148372 - DNA, 75 bp, Artificial Sequence
  Synthetic
ccacttgagccctgtgccccggatttaccacctcctgctgatactgatatgcctgcgatcgttaataccacaccg

SEQ ID NO: 148373 - DNA, 75 bp, Artificial Sequence
  Synthetic
ggggatgtagacgtaattgtggtaccaacccgcgagctacgtaattcgtggcgccgtcgcgggttcgcagcctat

SEQ ID NO: 148374 - DNA, 75 bp, Artificial Sequence
  Synthetic
taccacctcctgctgatactgatatgcctgcgatcgttaataccacaccgtcagtcactttagtgcagccttact

SEQ ID NO: 148375 - DNA, 75 bp, Artificial Sequence
  Synthetic
ggagcaatactgccgagcccgcgctggtcgttgtcttgaggtgggcgctcacccaagatccattaatgataaccc

SEQ ID NO: 148376 - DNA, 75 bp, Artificial Sequence
  Synthetic
tcaccatccctgtttccaactgcctgctctactaagtcaacatttcatgccgtccctgtgcatatatgggacagg

SEQ ID NO: 148377 - DNA, 75 bp, Artificial Sequence
  Synthetic
tggcacccccggcaccagttcggcctgtaacccatccgtctgggcctcgccgacggctactccatacttatcctg

SEQ ID NO: 148378 - DNA, 75 bp, Artificial Sequence
  Synthetic
caatgttctgcaccggtgctttctccgcccggttgggagagacgtccagcgctggtattctgcccccactcgtgg

SEQ ID NO: 148379 - DNA, 75 bp, Artificial Sequence
  Synthetic
tgtaacccatccgtctgggcctcgccgacggctactccatacttatcctgatggctcaaaggtttatgctggctc

SEQ ID NO: 148380 - DNA, 75 bp, Artificial Sequence
  Synthetic
caatccggcctgagttggttccaactaagtggtggcaccttacccataggtgccctgcagatgtctgtgagctga

SEQ ID NO: 148381 - DNA, 75 bp, Artificial Sequence
  Synthetic
tgccctgcagatgtctgtgagctgattcgtggtgcatacccaaagatccaaactgcaagccgtgtcctccgctct

SEQ ID NO: 148382 - DNA, 75 bp, Artificial Sequence
  Synthetic
tgcattctaccagcggttcccggagtcatttgaccccgccgggttcattatgtctgatgggtttgcggcctacac

SEQ ID NO: 148383 - DNA, 75 bp, Artificial Sequence
  Synthetic
tcatttgaccccgccgggttcattatgtctgatgggtttgcggcctacactctaaccccccggcccattattcat

SEQ ID NO: 148384 - DNA, 75 bp, Artificial Sequence
  Synthetic
gccagaagctagtatttacccaagcggccaaggctgctaaccctggtgcgattacagtccatgaggcccagggtg

SEQ ID NO: 148385 - DNA, 75 bp, Artificial Sequence
  Synthetic
gcctgaagctagtatttacccaagcggccaaggctgctaaccctggtgcgattacagtccatgaggcccagggtg

SEQ ID NO: 148386 - DNA, 75 bp, Artificial Sequence
  Synthetic
gcccgaagctagtatttacccaagcggccaaggctgctaaccctggtgcgattacagtccatgaggcccagggtg

SEQ ID NO: 148387 - DNA, 75 bp, Artificial Sequence
  Synthetic
gccggaagctagtatttacccaagcggccaaggctgctaaccctggtgcgattacagtccatgaggcccagggtg

SEQ ID NO: 148388 - DNA, 75 bp, Artificial Sequence
  Synthetic
cgtgggacggctgcttaccccttactcggtgctggtatatatagagtgcctgtcgggctcagctttgatgcctgg

SEQ ID NO: 148389 - DNA, 75 bp, Artificial Sequence
  Synthetic
tcggtgctggtatatatagagtgcctgtcgggctcagctttgatgcctgggagcgtaaccatcggcctggggatg

SEQ ID NO: 148390 - DNA, 75 bp, Artificial Sequence
  Synthetic
cttctgattcacgacggcaatcgtgccgtcgtgacatatgagggggatactagtgcgggctataaccatgatgtg

SEQ ID NO: 148391 - DNA, 75 bp, Artificial Sequence
  Synthetic
attcaatcctctagggctcatgccattgtggccctgactcgtcacacggagaagtgcgtggtggttgatgccccg

SEQ ID NO: 148392 - DNA, 75 bp, Artificial Sequence
  Synthetic
gggcttcttcgagaggtgggtatctctgacgctattgttaacaacttcttcctctctggcggcgagattggtcag

SEQ ID NO: 148393 - DNA, 75 bp, Artificial Sequence
  Synthetic
gtattgctctgacattgtttaatcttgctgatacgcttctcggtggcctgccgacagaattgatttcgtcggccg

SEQ ID NO: 148394 - DNA, 75 bp, Artificial Sequence
  Synthetic
aggacacggcgcgcacggcgaacttggcgctggagctggattccgccactgaggttggccgggcttgtgccggtt

SEQ ID NO: 148395 - DNA, 75 bp, Artificial Sequence
  Synthetic
ggcgctggagctggattccgccactgaggttggccgggcttgtgccggttgccgtgttgagcccggtgttgttta

SEQ ID NO: 148396 - DNA, 75 bp, Artificial Sequence
  Synthetic
cagtttagcgcgtaccatcagctggccgaagagcttggccaccggcccgcgccgattgctgctgtcctgcccccc

SEQ ID NO: 148397 - DNA, 75 bp, Artificial Sequence
  Synthetic
tccctagtgagcgcctccactaccgcaatcaaggctggcgctctgttgagaccacgggtgtggccgaggaggagg

SEQ ID NO: 148398 - DNA, 75 bp, Artificial Sequence
  Synthetic
ggtaccaacccgtgaactgcgtaattcgtggcggcgccgcgggtttgcagcttacacaccccacactgcggcccg

SEQ ID NO: 148399 - DNA, 75 bp, Artificial Sequence
  Synthetic
tcgtggcggcgccgcgggtttgcagcttacacaccccacactgcggcccgcgttacccgcggccgcagagttgtt

SEQ ID NO: 148400 - DNA, 75 bp, Artificial Sequence
  Synthetic
ggtgaccctaaccagatccccgccattgacttcgagcatgccggtctcgtcccggcgatccggcctgaacttgtc

SEQ ID NO: 148401 - DNA, 75 bp, Artificial Sequence
  Synthetic
ttgacttcgagcatgccggtctcgtcccggcgatccggcctgaacttgtcccaacaaagtggtggcatcttactc

SEQ ID NO: 148402 - DNA, 75 bp, Artificial Sequence
  Synthetic
catggtagagaaaggccaggatggctctgcagtcctggagctcgacctatgtaaccgtgatgtgtcccgaataac

SEQ ID NO: 148403 - DNA, 75 bp, Artificial Sequence
  Synthetic
tgagcacgcccaaaagtttatcacaaggttatatagctggctgtttgagaaatcaggtcgtgactacattcccgg

SEQ ID NO: 148404 - DNA, 75 bp, Artificial Sequence
  Synthetic
gctctctgttttggggggagcctcctgtcggccagaagcttgtgttcactcaggcggcgaaagccgctaatcctg

SEQ ID NO: 148405 - DNA, 75 bp, Artificial Sequence
  Synthetic
tctcggtggtttaccgacagaattgatttcgtcggccgggggccaactgttttactcccgccctgttgtctcggc

SEQ ID NO: 148406 - DNA, 75 bp, Artificial Sequence
  Synthetic
caggcggcgaaagccgctaatcctggcgcgattacagttcacgaggctcaaggtgccacattcactgaaaccacc

SEQ ID NO: 148407 - DNA, 75 bp, Artificial Sequence
  Synthetic
tgcgtggagtaaaaccttctgcgctttatttggcccgtggttccgcgctattgaaaaggagattctggcagcgct

SEQ ID NO: 148408 - DNA, 75 bp, Artificial Sequence
  Synthetic
ttatttggcccgtggttccgcgctattgaaaaggagattctggcagcgcttgcacctaacatcttttatggtgat

SEQ ID NO: 148409 - DNA, 75 bp, Artificial Sequence
  Synthetic
acagagaagtgtgtggttgtcgacgccccggggctcctccgtgaggtcggcatttctgatgctattgttaacaac

SEQ ID NO: 148410 - DNA, 75 bp, Artificial Sequence
  Synthetic
ccccggggctcctccgtgaggtcggcatttctgatgctattgttaacaacttttttctttctggcggtcaaattg

SEQ ID NO: 148411 - DNA, 75 bp, Artificial Sequence
  Synthetic
tttcacttgggcttgagtgtataattatggaggagtgtggcatgccacaatggatggtgcgactttaccatcttg

SEQ ID NO: 148412 - DNA, 75 bp, Artificial Sequence
  Synthetic
tttgctgattcatgacggcaggcgcgttgtggtgacgtatgagggtgatactagtgctggttataaccacgatgt

SEQ ID NO: 148413 - DNA, 75 bp, Artificial Sequence
  Synthetic
tatggaggagtgtggcatgccacaatggatggtgcgactttaccatcttgttcgctccgcctgggtcttgcaggg

SEQ ID NO: 148414 - DNA, 75 bp, Artificial Sequence
  Synthetic
cggctcgtgcgtcacgtctgacggctactgtggaactcgctgccagcccaggccgactcgagtgccgcaccgtgc

SEQ ID NO: 148415 - DNA, 75 bp, Artificial Sequence
  Synthetic
cctgccaatttagcgcttttcatcagctggcggaggagcttggtcatagaccagccccaattgccgccgtcttgc

SEQ ID NO: 148416 - DNA, 75 bp, Artificial Sequence
  Synthetic
gctggcggaggagcttggtcatagaccagccccaattgccgccgtcttgccgccctgtccggagctcgaacaagg

SEQ ID NO: 148417 - DNA, 75 bp, Artificial Sequence
  Synthetic
tggatggccgcccccttactaccattcagcagtattctaagacattctatgtccttccgcttcgcgggaagctgt

SEQ ID NO: 148418 - DNA, 75 bp, Artificial Sequence
  Synthetic
tatgagttccgtgacctcaaggttgcggcatttaaaggggatgactctgttgtgctctgcagcgattatcggcag

SEQ ID NO: 148419 - DNA, 75 bp, Artificial Sequence
  Synthetic
tgacatttgatgactctcgccaggcaatgggggctgggcctcacagccttacgtatgaacttgttcctgccggtc

SEQ ID NO: 148420 - DNA, 75 bp, Artificial Sequence
  Synthetic
attttcggcccgggtggtactccttccttattcccaacctcatgctccactaagtccaccttccacgctgtccct

SEQ ID NO: 148421 - DNA, 75 bp, Artificial Sequence
  Synthetic
ccgtatggcggcacccagccagcgcaaggcagttctgtcgactcttgtcggcaggtacggccgccgaacgaagct

SEQ ID NO: 148422 - DNA, 75 bp, Artificial Sequence
  Synthetic
ctggccccagacaacgactaccccaacgtctgttgatatgaattccatcacttctaccgatgttcggattcttgt

SEQ ID NO: 148423 - DNA, 75 bp, Artificial Sequence
  Synthetic
acctatcttcgcggcattagctacaaggttactgtgggtacccttgtggctaacgaaggctggaacgcctctgag

SEQ ID NO: 148424 - DNA, 75 bp, Artificial Sequence
  Synthetic
acccagcgccattcgctgaccggtgggctgtggctgcaccctgaggggctccttggcctgttcccccctttctcc

SEQ ID NO: 148425 - DNA, 75 bp, Artificial Sequence
  Synthetic
tacctgcgagctttatgagctcgtggaggccatggtagagaagggccaagacggttcggcggttttggagcttga

SEQ ID NO: 148426 - DNA, 75 bp, Artificial Sequence
  Synthetic
ctcggccctcgccgttctagaggacaccgttgattaccccgcccgcgctcacacttttgatgatttctgcccgga

SEQ ID NO: 148427 - DNA, 75 bp, Artificial Sequence
  Synthetic
ccttggcctgttcccccctttctccccagggcatctttgggagtctgcaaatcctttttgcggtgagagcacact

SEQ ID NO: 148428 - DNA, 75 bp, Artificial Sequence
  Synthetic
ccttgacatgaggctaccctcgggccccccttcgtctgctggcgatgtttgggtattcccaccaccctctgaggg

SEQ ID NO: 148429 - DNA, 75 bp, Artificial Sequence
  Synthetic
atatctgggtcctatgtcgtccctggcacagccctccaacctctttaccaggccctcgatctccccgctgagatt

SEQ ID NO: 148430 - DNA, 75 bp, Artificial Sequence
  Synthetic
agccgctgctgtcgcgggagctcctagctgtaaggtttttgaaaatgatttttctgagttcgatagtacccaaaa

SEQ ID NO: 148431 - DNA, 75 bp, Artificial Sequence
  Synthetic
agctgtaaggtttttgaaaatgatttttctgagttcgatagtacccaaaataacttctcgctcggtctggagtgt

SEQ ID NO: 148432 - DNA, 75 bp, Artificial Sequence
  Synthetic
ccctgtccgtaagccgcctacaccaccaccgacccgcactcgccggctcctttatacataccctgatggggccaa

SEQ ID NO: 148433 - DNA, 75 bp, Artificial Sequence
  Synthetic
cattcgttgacggggcggtcttagagaccaatggcccagagcgccacaatctttcctttgatgccagtcagagca

SEQ ID NO: 148434 - DNA, 75 bp, Artificial Sequence
  Synthetic
catctggttcggtcagcctggattttgcaggcgccgaaggagtctcttaagggtttctggaagaagcattctggt

SEQ ID NO: 148435 - DNA, 75 bp, Artificial Sequence
  Synthetic
caggccccgaaagagtccctgcgggggttttggaagaagcattctggtgagcccggtaccctgctgtggaatact

SEQ ID NO: 148436 - DNA, 75 bp, Artificial Sequence
  Synthetic
cgcagccggggctggagctcgccctcggcagccagcccgcccactcggctccgcttggcgtgaccaatcccagcg

SEQ ID NO: 148437 - DNA, 75 bp, Artificial Sequence
  Synthetic
tctcgctgcatacactttgagcccgcgtccgatcattcatgctgtggcccctgattacagggtcgagcagaatcc

SEQ ID NO: 148438 - DNA, 75 bp, Artificial Sequence
  Synthetic
actgctatgagttccgcgacctgagagttgcggcgtttaaaggggatgactctgttgtactttgcagtgattacc

SEQ ID NO: 148439 - DNA, 75 bp, Artificial Sequence
  Synthetic
tccgcgttccattaatgacaaccccaacgttctgcaccgttgtttcttgaaacctcgtggccgcgatgttcagcg

SEQ ID NO: 148440 - DNA, 75 bp, Artificial Sequence
  Synthetic
gggtttctggaagaagcattctggtgagcctggtacccttctctggaacaccgtctggaacatggcgattatagc

SEQ ID NO: 148441 - DNA, 75 bp, Artificial Sequence
  Synthetic
cacgtccccactcacatccaccatcgccaccgggaccaaccttgtgctatatgctgccccgcttagccctctact

SEQ ID NO: 148442 - DNA, 75 bp, Artificial Sequence
  Synthetic
ggcacctatcataccacttcatatcttttaatccatgatggcgaccgtgctgtgattacatatgagggcgattct

SEQ ID NO: 148443 - DNA, 75 bp, Artificial Sequence
  Synthetic
ctacccggatggctctaaggtatttgccggctcgctgttcgagtcgacatgtacgtggctcgtcaacgcgtctaa

SEQ ID NO: 148444 - DNA, 75 bp, Artificial Sequence
  Synthetic
agtgagcgcttgcactatcgaaatcagggttggcgctcggttgagacctctggcgttgctgaggaggaggctact

SEQ ID NO: 148445 - DNA, 75 bp, Artificial Sequence
  Synthetic
agggttggcgctcggttgagacctctggcgttgctgaggaggaggctacttccggtcttgttatgctctgtattc

SEQ ID NO: 148446 - DNA, 75 bp, Artificial Sequence
  Synthetic
gccgcggctttgctgctttcacaccccacacagcagctcgtgtcactgccggccgacgtgtggtgatagatgagg

SEQ ID NO: 148447 - DNA, 75 bp, Artificial Sequence
  Synthetic
atggatcacctgtgaactcctataccaatacaccttatactggtgctctcggcctgctcgattttgcacttgagc

SEQ ID NO: 148448 - DNA, 75 bp, Artificial Sequence
  Synthetic
tagggtgtcattttgtgcttttgctcacagctgcgcctgagccatcgccgatgccttatgtcccataccctcgct

SEQ ID NO: 148449 - DNA, 75 bp, Artificial Sequence
  Synthetic
ggcctgctcgattttgcacttgagcttgagtttcgtaatttgacacctggtaatacaaacgcgcgcgtttctcgt

SEQ ID NO: 148450 - DNA, 75 bp, Artificial Sequence
  Synthetic
cgccttcgttaccaccgcacttgctgttgctccatatgcaacgagcttcatccgtccatctccttggtgacccaa

SEQ ID NO: 148451 - DNA, 75 bp, Artificial Sequence
  Synthetic
tattcgagcagtgcgcgccacaaactgcgtcgaggggccgacggcactgctgagctaactactactgctgctaca

SEQ ID NO: 148452 - DNA, 75 bp, Artificial Sequence
  Synthetic
agctggggcttcgccgttaacggctgtggctccggcccctgatactgccccggtccctgacgttgattcccgcgg

SEQ ID NO: 148453 - DNA, 75 bp, Artificial Sequence
  Synthetic
cgttcatgaggcccagggcgccacatttacggagactaccatcatagccacggccgatgctaggggtcttattca

SEQ ID NO: 148454 - DNA, 75 bp, Artificial Sequence
  Synthetic
ctcagtcgagaatgctcagcaggacaaagggattgctatcccacatgatattgatcttggtgagtcccgagttgt

SEQ ID NO: 148455 - DNA, 75 bp, Artificial Sequence
  Synthetic
aaaaggaatgaagaggctggagcttgaacacgcgcagaagtttataacgcgcctttatagctggctgttcgagaa

SEQ ID NO: 148456 - DNA, 75 bp, Artificial Sequence
  Synthetic
gctgtatgctgccccgctaagccctttgcttccgcttcaagacgggactaacacacacattatggctactgaggc

SEQ ID NO: 148457 - DNA, 75 bp, Artificial Sequence
  Synthetic
ttgcttccgcttcaagacgggactaacacacacattatggctactgaggcatctaattatgctcagtatcgtgtt

SEQ ID NO: 148458 - DNA, 75 bp, Artificial Sequence
  Synthetic
gcttcgtgctaatgatgtactttggctttcacttacggccgctgagtatgatcagactacctacggctcttctac

SEQ ID NO: 148459 - DNA, 75 bp, Artificial Sequence
  Synthetic
ccccagacaacaactaccccaacgtctgttgatatgaactctattacctccaccgatgttcgaattcttgttcag

SEQ ID NO: 148460 - DNA, 75 bp, Artificial Sequence
  Synthetic
caaccctatgtatgtttctgatactgtgacgttcgtcaatgtggctaccggtgcccagggggtttcgcgttccct

SEQ ID NO: 148461 - DNA, 75 bp, Artificial Sequence
  Synthetic
tttgatgaggcagccccctgccgttgtcgtaattttctccggaaagctgctcacaagttttgttgcttcatgcgg

SEQ ID NO: 148462 - DNA, 75 bp, Artificial Sequence
  Synthetic
ctgttgatatgaactctattacctccaccgatgttcgaattcttgttcagcccggtatagcctctgaacttgtga

SEQ ID NO: 148463 - DNA, 75 bp, Artificial Sequence
  Synthetic
ctcaaaataatttttcacttgggctggagtgtataatcatggaggagtgcggcatgccgcagtggatgatccggc

SEQ ID NO: 148464 - DNA, 75 bp, Artificial Sequence
  Synthetic
gagctgggccaccggccggccccagtagccgccgtcctgcccccctgccctgaactcgagcaggggctactctac

SEQ ID NO: 148465 - DNA, 75 bp, Artificial Sequence
  Synthetic
caacttccggtcttgttatgctttgtattcatggttcacctgtgaattcttacactaacacaccttacactggcg

SEQ ID NO: 148466 - DNA, 75 bp, Artificial Sequence
  Synthetic
tattcatggttcacctgtgaattcttacactaacacaccttacactggcgcccttggcctgctcgatttcgcgct

SEQ ID NO: 148467 - DNA, 75 bp, Artificial Sequence
  Synthetic
gcccccagtcaacgtaaggcggtcctttcgacgcttgttggcaggtatggccgccgaacgaagctgtatgaagcg

SEQ ID NO: 148468 - DNA, 75 bp, Artificial Sequence
  Synthetic
cacttggtataccctccgatcttgctgctcgtgctggccggcttactgccactgttgaggtctctgatgcagacg

SEQ ID NO: 148469 - DNA, 75 bp, Artificial Sequence
  Synthetic
ctctgggcctgtttctatttctgctgttggtgtcctcgcacctcattctgcattggctgttctagaggacactgt

SEQ ID NO: 148470 - DNA, 75 bp, Artificial Sequence
  Synthetic
taagttacgccgtgggcccgatggcaccgctgaattgactacgactgctgctacacgtttcatgaaggatcttca

SEQ ID NO: 148471 - DNA, 75 bp, Artificial Sequence
  Synthetic
gggcaataaaaccttctcgacagtcttcactgatggcgcccagctggaggccaacgggccggagcagtatgtgct

SEQ ID NO: 148472 - DNA, 75 bp, Artificial Sequence
  Synthetic
atggccgccggcccgcacaatcttagttataccttgacatctgcaggccttgaaatacatgtcgtctctgccggg

SEQ ID NO: 148473 - DNA, 75 bp, Artificial Sequence
  Synthetic
aaacccgggagtattgatttattttgcttgtgccttccttctgtccttttccttttatttccctcttctgcgttt

SEQ ID NO: 148474 - DNA, 75 bp, Artificial Sequence
  Synthetic
tttactctcgccccgtcgtctcagccaatggcgagccgacagtgaaactttacacctcagtcgagaatgcccagc

SEQ ID NO: 148475 - DNA, 75 bp, Artificial Sequence
  Synthetic
ggatcctgcaggccccgaaggagtctctgcgagggttttggaagaaacactccggtgagcccggcactcttctat

SEQ ID NO: 148476 - DNA, 75 bp, Artificial Sequence
  Synthetic
tacacctcagtcgagaatgcccagcaggataaggggatagctataccacatgatattgatctcggtgagtcccgg

SEQ ID NO: 148477 - DNA, 75 bp, Artificial Sequence
  Synthetic
ccccttttgcggggagagtactctttatacccgtacctgttcggtatcgggcttttccagctgcttttccccact

SEQ ID NO: 148478 - DNA, 75 bp, Artificial Sequence
  Synthetic
tctgttctccgtgctaatgatgtgctttggctctctcttacagctgctgagtatgatcagactacttatggctcc

SEQ ID NO: 148479 - DNA, 75 bp, Artificial Sequence
  Synthetic
gtatgatcagactacttatggctcctctactaatcctatgtatgtttctgacactgttacatttgttaatgtcgc

SEQ ID NO: 148480 - DNA, 75 bp, Artificial Sequence
  Synthetic
tgtctcagtaccccctgagcaaatagcacctctaccagacccagtagataaggcagccggcctgactccatctag

SEQ ID NO: 148481 - DNA, 75 bp, Artificial Sequence
  Synthetic
gcacctctaccagacccagtagataaggcagccggcctgactccatctagcacccccgttgtgtcaccagcaccg

SEQ ID NO: 148482 - DNA, 75 bp, Artificial Sequence
  Synthetic
ccgccctgtcgggcgcgatgttcagcgctggtatactgcccccactcgcgggccagctgctaattgccggcgttc

SEQ ID NO: 148483 - DNA, 75 bp, Artificial Sequence
  Synthetic
gccggctccctttttgagtctgattgcacttggctggttaacgcatctaaccctggccaccgccctggcggtggt

SEQ ID NO: 148484 - DNA, 75 bp, Artificial Sequence
  Synthetic
ttgagaatgcagccggccaccgtgtttgtatctcgacttatactaccaatctaggttctggccccgtttctatct

SEQ ID NO: 148485 - DNA, 75 bp, Artificial Sequence
  Synthetic
gcacttggctggttaacgcatctaaccctggccaccgccctggcggtggtctctgtcatgcattctaccagcggt

SEQ ID NO: 148486 - DNA, 75 bp, Artificial Sequence
  Synthetic
atacttttgatgatttctgcccagagtgccgtgcgctcggccttcagggttgtgcctttcaatcaactgttgctg

SEQ ID NO: 148487 - DNA, 75 bp, Artificial Sequence
  Synthetic
tcattcatgctgttgcccccgactatcgggttgaacataatcctaagaggcttgaggccgcctatcgggagactt

SEQ ID NO: 148488 - DNA, 75 bp, Artificial Sequence
  Synthetic
gggtaaaacccgggagtactgatttattttccttgtgcctcccttcagttctgcttctttatttctcttttctgc

SEQ ID NO: 148489 - DNA, 75 bp, Artificial Sequence
  Synthetic
tcctttacttggcgctggtatatataaggtgcctgttgggttgagcttcgatgcctgggaacgtaaccatcggcc

SEQ ID NO: 148490 - DNA, 75 bp, Artificial Sequence
  Synthetic
cttgtgatccctagtgagcgcctgcattatcgtaaccaaggctggcgctcggttgagacctctggtgttgcggag

SEQ ID NO: 148491 - DNA, 75 bp, Artificial Sequence
  Synthetic
caaccccggcagcttgttttccggcctgaagttctctggaatcacccgatccagcgggttatccataatgagctg

SEQ ID NO: 148492 - DNA, 75 bp, Artificial Sequence
  Synthetic
tgttcggggccaccctggacgaccaagccttttgctgctcccgtctaatgacctaccttcgcggcattagctaca

SEQ ID NO: 148493 - DNA, 75 bp, Artificial Sequence
  Synthetic
gctccccccacacttgcttttgttgcatatgcagcgggcctcttcagttcatctcttgggtgaccccaatcaaat

SEQ ID NO: 148494 - DNA, 75 bp, Artificial Sequence
  Synthetic
tcgtacatattgcttcgacgggttttcccgctgcgcctttgccgctgagaccggaattgctttatattcactgca

SEQ ID NO: 148495 - DNA, 75 bp, Artificial Sequence
  Synthetic
aagtccggccgtgattatatccccggccgtcagttggagttctacgcccagtgtaggcgctggctctcggccggc

SEQ ID NO: 148496 - DNA, 75 bp, Artificial Sequence
  Synthetic
tctcagccaatggcgagccgacagtgaagctttatacttcagtcgagaacgctcagcaggataagggtatagcta

SEQ ID NO: 148497 - DNA, 75 bp, Artificial Sequence
  Synthetic
aaaaagactgcaataagtttaccaccggtgagaccattgcccacggtaaagtcggccagggcatttcagcttgga

SEQ ID NO: 148498 - DNA, 75 bp, Artificial Sequence
  Synthetic
cgtacttcgctctctgttctggggagaaccccctgtgggtcagaagttagtgttcacccaggcggcgaaggccgc

SEQ ID NO: 148499 - DNA, 75 bp, Artificial Sequence
  Synthetic
cgtcgtgacttacgagggtgatactagtgcgggctataatcacgatgtgtctatacttcgtgcatggatccgcac

SEQ ID NO: 148500 - DNA, 75 bp, Artificial Sequence
  Synthetic
aagctctctttctgggaggcaggtacaactaaggccgggtacccctataattataacaccactgctagcgaccaa

SEQ ID NO: 148501 - DNA, 75 bp, Artificial Sequence
  Synthetic
ccacagtaaaggtctcccaggtcgacgggcggatcgattgtgagacccttcttggtaataaaacctttcgcacgt

SEQ ID NO: 148502 - DNA, 75 bp, Artificial Sequence
  Synthetic
cacccgtgtatcccgttacaccagcacagcccgacaccgcctgcgccgtggtgctgacgggacagccgagctcac

SEQ ID NO: 148503 - DNA, 75 bp, Artificial Sequence
  Synthetic
gccatcgaccggccccaattgctgctgtcttacctccctgcccggagcttgaacagggcttgctttacatgccgc

SEQ ID NO: 148504 - DNA, 75 bp, Artificial Sequence
  Synthetic
agaggacactgttgactatcctgcccgtgctcatacttttgatgatttttgccctgagtgccgtgcactcggcct

SEQ ID NO: 148505 - DNA, 75 bp, Artificial Sequence
  Synthetic
ctatgacaaccaacatgaacaggaccggccaaccccgtcgcctgccccgtcccgccccttctcggtccttcgagc

SEQ ID NO: 148506 - DNA, 75 bp, Artificial Sequence
  Synthetic
gttgtcttgaagtgggcgcccacccaagatctattaatgataaccccaacgttctgcaccggtgcttcctccgcc

SEQ ID NO: 148507 - DNA, 75 bp, Artificial Sequence
  Synthetic
gagcttgacttgtgcagccgcgatgtgtcgcggataacctttttccagaaagattgtaataagttcacaacaggc

SEQ ID NO: 148508 - DNA, 75 bp, Artificial Sequence
  Synthetic
acctaccccggcggctcttcaacccccctctgcaccggaccctttcccccccccctctgctccggcgcttgggga

SEQ ID NO: 148509 - DNA, 75 bp, Artificial Sequence
  Synthetic
gcaggctgctctggctgcggctaactccgccttggcgaatgctgtggtggtccggccgttcttgtcccgtaccca

SEQ ID NO: 148510 - DNA, 75 bp, Artificial Sequence
  Synthetic
tggttccgcgctattgagaaagaaattctggctgtgcttgcgcctaatgtattttatggtgatgcatatgaggac

SEQ ID NO: 148511 - DNA, 75 bp, Artificial Sequence
  Synthetic
ggatcgctttatactcactgcatgacctttggccttcggatgtcgcggaggctatggctcgccacgggatgacgc

SEQ ID NO: 148512 - DNA, 75 bp, Artificial Sequence
  Synthetic
ctacccggatggctctaaggtatttgccggctcgctgtttgagtcgacatgtacgtggcttgttaacgcgtctaa

SEQ ID NO: 148513 - DNA, 75 bp, Artificial Sequence
  Synthetic
ttctggctgtgcttgcgcctaatgtattttatggtgatgcatatgaggacacagttttggccgctgccgtcgcag

SEQ ID NO: 148514 - DNA, 75 bp, Artificial Sequence
  Synthetic
gtacgtggcttgttaacgcgtctaatgttgaccatcgccctggcggcgggctctgccatgcattttaccaaaggt

SEQ ID NO: 148515 - DNA, 75 bp, Artificial Sequence
  Synthetic
ataccactagtctcagtgccggccctgtgtcaatttctgcggtcggtgttctcgcgccgcattctgctttagctg

SEQ ID NO: 148516 - DNA, 75 bp, Artificial Sequence
  Synthetic
gctggagctcgccctcgacagccgccccgcccccttggctccgcttggcgtgaccagtcccagcgcccctccact

SEQ ID NO: 148517 - DNA, 75 bp, Artificial Sequence
  Synthetic
tttgctctgtgcatgggttagagtgtataatcatggaggagtgcggtatgccgcagtggatgattcgactctacc

SEQ ID NO: 148518 - DNA, 75 bp, Artificial Sequence
  Synthetic
tataatcatggaggagtgcggtatgccgcagtggatgattcgactctaccaccttgttcgctccgcctgggtcct

SEQ ID NO: 148519 - DNA, 75 bp, Artificial Sequence
  Synthetic
ccaggacggcactaatacccacatcatggcgactgaggcatccaactacgcccagtaccgggttgtccgagctac

SEQ ID NO: 148520 - DNA, 75 bp, Artificial Sequence
  Synthetic
taatccatgccgtcgcccctgattataggttggaacataacccaaagaggcttgaggccgcctaccgggagactt

SEQ ID NO: 148521 - DNA, 75 bp, Artificial Sequence
  Synthetic
atgggggctgggccacacagcctcacgtatgaacttgtccctgccggcttgcaagtcaaaatatcctctaatggc

SEQ ID NO: 148522 - DNA, 75 bp, Artificial Sequence
  Synthetic
ccgtacctactgtttcgacgggttttcccgctgcgccttcgccgccgagactgggatcgctttatactcattaca

SEQ ID NO: 148523 - DNA, 75 bp, Artificial Sequence
  Synthetic
tatctgggaccggcttatgctttttggtgccaccttagatgaccaggccttttgctgctcgcggcttatgaccta

SEQ ID NO: 148524 - DNA, 75 bp, Artificial Sequence
  Synthetic
gtttttccagcgacttctccccacccgaggcggcctatgcctccccagcgcccgacatggggttaccctcgggca

SEQ ID NO: 148525 - DNA, 75 bp, Artificial Sequence
  Synthetic
cgaggcggcctatgcctccccagcgcccgacatggggttaccctcgggcacctcctcatccgctagtggtatctg

SEQ ID NO: 148526 - DNA, 75 bp, Artificial Sequence
  Synthetic
aacgttttgcatcgatgttttcttagaccggtcggccgagatgtccagcgctggtactccgcccccacccgcggc

SEQ ID NO: 148527 - DNA, 75 bp, Artificial Sequence
  Synthetic
gttgtcgtggtcccgacccgggagttgcgtaatgcctggcgccgtcgcggcttcgctgctttcaccccgcacact

SEQ ID NO: 148528 - DNA, 75 bp, Artificial Sequence
  Synthetic
accaagtcttgccacacctaggtcccccgtttgtgagccgcctacaccaccaccggccctcaccccggtcagtaa

SEQ ID NO: 148529 - DNA, 75 bp, Artificial Sequence
  Synthetic
cagctccaattttatgcccagtgccgccgctggctctcggctggcttccaccttgaccctagagttcttgtcttt

SEQ ID NO: 148530 - DNA, 75 bp, Artificial Sequence
  Synthetic
ccatatctgggaccggcttatgcttttcggtgccactctggacgaccaagccttttgttgctcgcggcttatgac

SEQ ID NO: 148531 - DNA, 75 bp, Artificial Sequence
  Synthetic
tgacctctggccagctgatgtcgcagaggctatggcccgccacggaatgacacgcctgtatgccgcactacacct

SEQ ID NO: 148532 - DNA, 75 bp, Artificial Sequence
  Synthetic
ttggggcaggagtgcacttgttttttggaaccggcggaaggcctggttggtgactgtggccatgataacgaggcc

SEQ ID NO: 148533 - DNA, 75 bp, Artificial Sequence
  Synthetic
gcttgttaatgcatctaatcctggccatcgtcctggcggcggtctctgtcatgcattttaccaacgcttcccgga

SEQ ID NO: 148534 - DNA, 75 bp, Artificial Sequence
  Synthetic
cgttgtgacttacgagggcgatactagtgcgggctacaatcatgatgtctccatacttcgtgcgtggatccgaac

SEQ ID NO: 148535 - DNA, 75 bp, Artificial Sequence
  Synthetic
tgttcacccaggcggctaaggctgccaaccccggttcagtgacggtccatgaggcacagggcgctacctatacag

SEQ ID NO: 148536 - DNA, 75 bp, Artificial Sequence
  Synthetic
tactaaaatagttggcgaccatccgttagttatagagcgtgtgcgggccatcgggtgtcattttgtgttgctgct

SEQ ID NO: 148537 - DNA, 75 bp, Artificial Sequence
  Synthetic
tcgtgcgtcacgtctaacggctactgtggagcttgccgccagtccaggcagactcgaatgccgtacggtgcttgg

SEQ ID NO: 148538 - DNA, 75 bp, Artificial Sequence
  Synthetic
tgcccgaggcctcattcagtcgtctcgggctcatgccattgttgccctgacgcgccacactgagaagtgcgtcat

SEQ ID NO: 148539 - DNA, 75 bp, Artificial Sequence
  Synthetic
gtggagcttgccgccagtccaggcagactcgaatgccgtacggtgcttgggaataagattttccgtacatcaata

SEQ ID NO: 148540 - DNA, 75 bp, Artificial Sequence
  Synthetic
atttggccctggcggctccccatccttgttcccgtcagcctgctctactaaatctacctttcatgctgtcccggt

SEQ ID NO: 148541 - DNA, 75 bp, Artificial Sequence
  Synthetic
ctgtgagtttaagtttcgacgcctgggagcgtaaccaccgcccaggtgatgaactgtaccttactgagccagctg

SEQ ID NO: 148542 - DNA, 75 bp, Artificial Sequence
  Synthetic
aatctacctttcatgctgtcccggttcatatctgggatcggctcatgctctttggtgccaccctggacgatcagg

SEQ ID NO: 148543 - DNA, 75 bp, Artificial Sequence
  Synthetic
ttgtccacgtcaccactcacgtctgctattgctactggcactaatcttgtcttgtatgctgccccgctgagccct

SEQ ID NO: 148544 - DNA, 75 bp, Artificial Sequence
  Synthetic
ctacctccgtggcattagttacaaggtcactgtcggcgcgcttgtcgctaatgaggggtggaatgcttccgaaga

SEQ ID NO: 148545 - DNA, 75 bp, Artificial Sequence
  Synthetic
ttccatcagttggctgaggagcttggccacagacctgcccctgttgcagctgttctaccgccctgccctgagctc

SEQ ID NO: 148546 - DNA, 75 bp, Artificial Sequence
  Synthetic
ggcatctttgggagtctgcaaaccccttttgcggtgagagcacactttatacacgaacttggtccacatctggtt

SEQ ID NO: 148547 - DNA, 75 bp, Artificial Sequence
  Synthetic
ataactgatggtgctcaccttgaggtcaatggccctgagcagtatgttctgacatttgacgactcccgccaagcg

SEQ ID NO: 148548 - DNA, 75 bp, Artificial Sequence
  Synthetic
gcttttacaccccacacagcagctcgtgttactgccggccggcgtgtggtgatagacgaggcaccttcgcttcca

SEQ ID NO: 148549 - DNA, 75 bp, Artificial Sequence
  Synthetic
cctggtatagcctctgaacttgtgatacctagagagcgcctgcattatcgtaaccagggttggcgctcggttgag

SEQ ID NO: 148550 - DNA, 75 bp, Artificial Sequence
  Synthetic
gtgcattgtcgcatggccgccccgagtcagcgcaaggccgtgctgtccacgctcgtgggccgttacggccgtcgc

SEQ ID NO: 148551 - DNA, 75 bp, Artificial Sequence
  Synthetic
ccacctagaccccagggtacttgtttttgatgaatcagtgccatgccgttgtaggacgtttttgaagaaagtcac

SEQ ID NO: 148552 - DNA, 75 bp, Artificial Sequence
  Synthetic
cattcatgggtcccctgtgaattcctatactaatacaccctacgctggtgctctcggtttgctcgattttgcgct

SEQ ID NO: 148553 - DNA, 75 bp, Artificial Sequence
  Synthetic
gtttccaccgccctctgaggggtcggcgatcatttcgccacccataaccccggtcggtaagccaactaatccgcc

SEQ ID NO: 148554 - DNA, 75 bp, Artificial Sequence
  Synthetic
tcccggcgattcgtcccgagttagctcctactagttggtggcatgttacccaccgctgccccgccgatgtatgtg

SEQ ID NO: 148555 - DNA, 75 bp, Artificial Sequence
  Synthetic
tggctggggcaggagtgtacctgcttcttggagccagccgagggtctagttggtgaccatggccatgacaacgag

SEQ ID NO: 148556 - DNA, 75 bp, Artificial Sequence
  Synthetic
tgtccaggatcaccttcttccagaaagattgtaataagtttaccacgggagagaccatcgcccatggtaaagtgg

SEQ ID NO: 148557 - DNA, 75 bp, Artificial Sequence
  Synthetic
gcccgtgagccgtccacaccatcaccggccctaaccccggctagtaagccagctaatccgcctagccttaccgca

SEQ ID NO: 148558 - DNA, 75 bp, Artificial Sequence
  Synthetic
ttttacagggactaatggtgttggtgaggttggccgtggtattgcgctaactctgtttaatcttgctgatacgct

SEQ ID NO: 148559 - DNA, 75 bp, Artificial Sequence
  Synthetic
ggggccaaggtgtatgcaggctctctgtttgagtcagattgttactggctggttaatgcatctaaccctggccac

SEQ ID NO: 148560 - DNA, 75 bp, Artificial Sequence
  Synthetic
cgcccgagcttcccgactaacggcaactgttgagctcgttgcaagcccagaccgcttagagtgccgcaccgtgct

SEQ ID NO: 148561 - DNA, 75 bp, Artificial Sequence
  Synthetic
ccagatgggggcctgcccctgggcaccccttcctctgccagtgacgtctgggtgcttccgtcgccctctgagggg

SEQ ID NO: 148562 - DNA, 75 bp, Artificial Sequence
  Synthetic
ggttaatgcatctaaccctggccaccgtcctggtggtggtctctgtcatgcattttaccagcgctttccagagtc

SEQ ID NO: 148563 - DNA, 75 bp, Artificial Sequence
  Synthetic
atcatttgacgcctcccgccagtctatgggggccgggccgcatagcctcacttatgagctcacccctgccggttt

SEQ ID NO: 148564 - DNA, 75 bp, Artificial Sequence
  Synthetic
ttttttcttggccggtggcgaagtaggccaccaccgcccttcaattataccgcgcggcaacccagaccgaaactt

SEQ ID NO: 148565 - DNA, 75 bp, Artificial Sequence
  Synthetic
tgtggcccccgactatagggttgagcagaaccccaagaggctggaggcggcatatcgtgagacctgctcccgcct

SEQ ID NO: 148566 - DNA, 75 bp, Artificial Sequence
  Synthetic
tgatatcgatcttggtgagtcccgagttgtcatccaggattatgataatcaacacgagcaagaccgtcccacccc

SEQ ID NO: 148567 - DNA, 75 bp, Artificial Sequence
  Synthetic
atgggggccgggccgcatagcctcacttatgagctcacccctgccggtttgcaggttaggatctcatctaatggc

SEQ ID NO: 148568 - DNA, 75 bp, Artificial Sequence
  Synthetic
gccctctatagatataacaggttcacccagcggcactcgctgaccggtggattatggttacaccctgaggggctg

SEQ ID NO: 148569 - DNA, 75 bp, Artificial Sequence
  Synthetic
cccagcggcactcgctgaccggtggattatggttacaccctgaggggctgttgggtatttttccccctttctccc

SEQ ID NO: 148570 - DNA, 75 bp, Artificial Sequence
  Synthetic
ccagccagccctaacaattactgaggacaccgcccgcacagccaaccttgcgcttgagatcgactccgctactga

SEQ ID NO: 148571 - DNA, 75 bp, Artificial Sequence
  Synthetic
tattggtctgtatgcaggtgttgtggtggcccccggccttggcgcgcttcctgacgtcgtgcgcttcgccggccg

SEQ ID NO: 148572 - DNA, 75 bp, Artificial Sequence
  Synthetic
gtttttctagcgatttctcccctcctgaagcggccgctcctgctctggccgcagccccggagctgcctcgcccta

SEQ ID NO: 148573 - DNA, 75 bp, Artificial Sequence
  Synthetic
ccttctgggaggctggcactaccaaagctggctacccttataattataatactaccgccagtgatcagatcctaa

SEQ ID NO: 148574 - DNA, 75 bp, Artificial Sequence
  Synthetic
gccttgctgtaagtgatttcctccgcaagcttacgaatgtagctcagatgtgtgtggatgttgtttctcgtgttt

SEQ ID NO: 148575 - DNA, 75 bp, Artificial Sequence
  Synthetic
gcagccccggagctgcctcgccctactccacccgctagtgatatctgggtgttaccaccgccctcagaggagtct

SEQ ID NO: 148576 - DNA, 75 bp, Artificial Sequence
  Synthetic
ctccgggaagtctaggtccatacagcagggggatgttgatgttgtggtcgtgccaacccgcgagcttcgcaacag

SEQ ID NO: 148577 - DNA, 75 bp, Artificial Sequence
  Synthetic
ctgccgttggtgtcctcgcacctcattctgtgctggccgctctggaggacaccgttgactatcctgctcgagctc

SEQ ID NO: 148578 - DNA, 75 bp, Artificial Sequence
  Synthetic
ttctgtgctggccgctctggaggacaccgttgactatcctgctcgagctcatacttttgatgatttttgccctga

SEQ ID NO: 148579 - DNA, 75 bp, Artificial Sequence
  Synthetic
gactttgagcacgccggtttggtccctgcgattcgccctgagctagcccctactagttggtggcatgtcacccac

SEQ ID NO: 148580 - DNA, 75 bp, Artificial Sequence
  Synthetic
ccattatcagtttactgccggggtacctggttccgggaagtctaggtctatacaacaaggggacgtcgatgttgt

SEQ ID NO: 148581 - DNA, 75 bp, Artificial Sequence
  Synthetic
gggtaaaacccgggagtattgatttattcttcttgtacctccccttcggttctgtttctttttatttctcctttc

SEQ ID NO: 148582 - DNA, 75 bp, Artificial Sequence
  Synthetic
cgttgccccgccgatgtatgtgagctcatacgcggggcctacccaaaaattcagacaaccagccgtgtgttgaga

SEQ ID NO: 148583 - DNA, 75 bp, Artificial Sequence
  Synthetic
atcatgcgtgagggtcttgcagcatataccttgaccccgcgccctattattcatgcagtggctcctgactatagg

SEQ ID NO: 148584 - DNA, 75 bp, Artificial Sequence
  Synthetic
tcatacgcggggcctacccaaaaattcagacaaccagccgtgtgttgagatctctattttggaatgagcctgcga

SEQ ID NO: 148585 - DNA, 75 bp, Artificial Sequence
  Synthetic
tctgtttctttttatttctcctttctgcgttccgcgctcactactatccagcaggatccatgttgaaaaaaaaaa

SEQ ID NO: 148586 - DNA, 75 bp, Artificial Sequence
  Synthetic
gagcaggctgctctagcagcggccaactctgccctggcgaatgctgtggtagttaggccttttctctctcaccag

SEQ ID NO: 148587 - DNA, 75 bp, Artificial Sequence
  Synthetic
ctccagtatggtttttgagaatgatttctctgagtttgatagcacccaaaacaatttttctcttggccttgagtg

SEQ ID NO: 148588 - DNA, 75 bp, Artificial Sequence
  Synthetic
ccgccgtggcaccgctgcctacccgcttttaggctcgggtatataccaggtccccgttagcctcagttttgatgc

SEQ ID NO: 148589 - DNA, 75 bp, Artificial Sequence
  Synthetic
ctaccacagctggggccgcgccgctaaccgcggtcgctccggctcatgacaccccgccagtgcctgatgtcgact

SEQ ID NO: 148590 - DNA, 75 bp, Artificial Sequence
  Synthetic
ccgccctgttgggcgtgatgttcagcgctggtatactgctcccactcgcgggccggctgctaattgccggcgttc

SEQ ID NO: 148591 - DNA, 75 bp, Artificial Sequence
  Synthetic
atttggtcctttatgccgcccctcttagcccgcttttaccccttcaggacggcaccaatactcatataatggcta

SEQ ID NO: 148592 - DNA, 75 bp, Artificial Sequence
  Synthetic
tgagctcatacgcggggcttaccctaagatccaaactactagccgtgtgatgcgatctttgttttggaatgagcc

SEQ ID NO: 148593 - DNA, 75 bp, Artificial Sequence
  Synthetic
tttccttgctggtggtgaagtgggccaccatcgcccttctaccatcccccgcggcaacccagaccagaacttaga

SEQ ID NO: 148594 - DNA, 75 bp, Artificial Sequence
  Synthetic
ggcaccaatactcatataatggctacagaagcctctaactatgcccagtaccgggttgcccgtgccacaattcgt

SEQ ID NO: 148595 - DNA, 75 bp, Artificial Sequence
  Synthetic
gggtggcagcgtttaagggggatgattcagtggttctttgcagtgattaccgccagagccgcaatgcggctgccc

SEQ ID NO: 148596 - DNA, 75 bp, Artificial Sequence
  Synthetic
atacaacagggagatgtcgacgtggtggttgtgcccacccgggagctccgcaatagttggcgccgtcggggtttt

SEQ ID NO: 148597 - DNA, 75 bp, Artificial Sequence
  Synthetic
tactctacatgccgcaggagcttacggtgtccgatagtgtcttaatttttgaactcacggacatagttcactgtc

SEQ ID NO: 148598 - DNA, 75 bp, Artificial Sequence
  Synthetic
gaactcacggacatagttcactgtcgtatggccgcccctagtcaacgtaaggcggttctctccacgcttgtcggc

SEQ ID NO: 148599 - DNA, 75 bp, Artificial Sequence
  Synthetic
tgttgagacctccggggtggcggaagaggaggccacctctggtctcgttatgctttgcatacatggctcacccgt

SEQ ID NO: 148600 - DNA, 75 bp, Artificial Sequence
  Synthetic
accccgtggcaaccctgaccagaacttggacatcctgcaggcattccctccatcctgtcaaatcagtgcttacca

SEQ ID NO: 148601 - DNA, 75 bp, Artificial Sequence
  Synthetic
ggccatggttgagaagggccaggacggttccgctgtgcttgagcttgacctttgcaaccgtgatgtctcgcgtat

SEQ ID NO: 148602 - DNA, 75 bp, Artificial Sequence
  Synthetic
cgggtctctcgttactccagcactgctcgccaccgtcttcgccgcggtgcagatgggactgccgagctcaccacc

SEQ ID NO: 148603 - DNA, 75 bp, Artificial Sequence
  Synthetic
gctttatttggcccatggttccgtgccattgagaaggagattctggctctgctcccacccaatatcttttatggc

SEQ ID NO: 148604 - DNA, 75 bp, Artificial Sequence
  Synthetic
tttcatcttgatccacgggtgttggtttttgacgagtcggccccctgccattgtaggaccgcgatccgtaaggcg

SEQ ID NO: 148605 - DNA, 75 bp, Artificial Sequence
  Synthetic
ctgcggccatttctggggctggctccagtatggtttttgagaatgatttttctgagtttgatagcacccaaaata

SEQ ID NO: 148606 - DNA, 75 bp, Artificial Sequence
  Synthetic
cagtatggtttttgagaatgatttttctgagtttgatagcacccaaaataacttctctcttggccttgagtgcgc

SEQ ID NO: 148607 - DNA, 75 bp, Artificial Sequence
  Synthetic
ggtatctcggcctggagcaaaactttctgcgctctatttggaccgtggtttcgtgccattgagaaggaaatctta

SEQ ID NO: 148608 - DNA, 75 bp, Artificial Sequence
  Synthetic
agggcctgctctacatgccacaggagctcactgtgtccgatagtgtgttggtttttgagcttacggatatagtcc

SEQ ID NO: 148609 - DNA, 75 bp, Artificial Sequence
  Synthetic
gtttttgagcttacggatatagtccactgccgtatggccgctccaagccagcgaaaggctgttctctcaacactt

SEQ ID NO: 148610 - DNA, 75 bp, Artificial Sequence
  Synthetic
ctatggccgctggccctttcagtctcacctatgccgcctctgcagctgggctggaggtgcgctatgttgctgccg

SEQ ID NO: 148611 - DNA, 75 bp, Artificial Sequence
  Synthetic
ccaccacatgcgagttgtatgagttggttgaggctatggtggagaaaggtcaggatggctctgcagttctagagc

SEQ ID NO: 148612 - DNA, 75 bp, Artificial Sequence
  Synthetic
ttgtgattttcttcgaaggctgacgaatgttgcgcaggtctgtgttgatgttgtgtcccgtgtttatggggttag

SEQ ID NO: 148613 - DNA, 75 bp, Artificial Sequence
  Synthetic
ccccgggctggtgcataaccttattggcatgctacagactattgctgatggaaaggcccattttactgagactgt

SEQ ID NO: 148614 - DNA, 75 bp, Artificial Sequence
  Synthetic
tttgcgccgcggtgccgatgggacagccgagcttacaaccaccgcagccacacgttttatgaaggacttgcattt

SEQ ID NO: 148615 - DNA, 75 bp, Artificial Sequence
  Synthetic
gtgtgtggtcatggaggagtgcggcatgcctcaatggctaattaggttgtatcatctggttcggtcagcctggat

SEQ ID NO: 148616 - DNA, 75 bp, Artificial Sequence
  Synthetic
gttaggccttttctctctcaccagcagattgagatccttattaacctaatgcaacctcgccagcttgttttccgc

SEQ ID NO: 148617 - DNA, 75 bp, Artificial Sequence
  Synthetic
ctttgccatgcattttaccaaaggtaccccgcctcctttgatgctgcctcttttgtgatgcgcgacggcgcggcc

SEQ ID NO: 148618 - DNA, 75 bp, Artificial Sequence
  Synthetic
ggccgctgccttgaaattggtgcccacccccgctcaataaatgacaatcctaatgtggtccaccgctgcttcctc

SEQ ID NO: 148619 - DNA, 75 bp, Artificial Sequence
  Synthetic
ttcatgttgccgcctttaagggtgatgactcggtggtcctctgtagtgactatcgacagagccgcaatgcggctg

SEQ ID NO: 148620 - DNA, 75 bp, Artificial Sequence
  Synthetic
ccttaattgcaggctgtgggctcaaattgaaggttgattaccgccctattgggctgtatgctggggtggtggtgg

SEQ ID NO: 148621 - DNA, 75 bp, Artificial Sequence
  Synthetic
ctgatgttgactctcgtggcgctatcttgcgccgtcagtataatctgtccacctcccctttaacttcatctgttg

SEQ ID NO: 148622 - DNA, 75 bp, Artificial Sequence
  Synthetic
cccgctcctcgggaccggcatataccaggtgccgatcggccccagttttgacgcctgggagcggaaccaccgccc

SEQ ID NO: 148623 - DNA, 75 bp, Artificial Sequence
  Synthetic
tgattctcagcccttcgccctcccctatattcatccaaccaacccctttgccgccgacgtcgtaccacaacccgg

SEQ ID NO: 148624 - DNA, 75 bp, Artificial Sequence
  Synthetic
actgctagtgaccagatcctgatcgagaatgcagccggtcaccgtgttgccatatctacttataccactagtctt

SEQ ID NO: 148625 - DNA, 75 bp, Artificial Sequence
  Synthetic
ttgacgttgtatctcgtgtctatggagttagccccgggcttgtacataaccttattggcatgcttcagaccattg

SEQ ID NO: 148626 - DNA, 75 bp, Artificial Sequence
  Synthetic
tagtgctggttataaccacgatgtttccaacctgcgctcctggattagaaccactaaggttaccggagaccaccc

SEQ ID NO: 148627 - DNA, 75 bp, Artificial Sequence
  Synthetic
atagcctctgagttggtcatcccgagtgagcgccttcactatcgtaatcaaggctggcgctctgttgagacatcg

SEQ ID NO: 148628 - DNA, 75 bp, Artificial Sequence
  Synthetic
gtgagcgccttcactatcgtaatcaaggctggcgctctgttgagacatcgggtgtggccgaggaggaggcgacat

SEQ ID NO: 148629 - DNA, 75 bp, Artificial Sequence
  Synthetic
taagacccgggagtcttaattaattcccccctttgtgcccccttctaaactttgctctgttatttcttttttctg

SEQ ID NO: 148630 - DNA, 75 bp, Artificial Sequence
  Synthetic
cacatgcagcgggccgccaccgtccaccttcttggcgacccgaaccagatcccagccatcgactttgagcacgct

SEQ ID NO: 148631 - DNA, 75 bp, Artificial Sequence
  Synthetic
atatgcagcgctggcgagattgcccgcgacgcgggccagccaataacatccgccgttgcattctcacggggcgcc

SEQ ID NO: 148632 - DNA, 75 bp, Artificial Sequence
  Synthetic
cgcctctacagttggctctttgagaagtccggccgtgattatatccccggccgtcagttggagttctacgctcag

SEQ ID NO: 148633 - DNA, 75 bp, Artificial Sequence
  Synthetic
tgaagttgccagggcgatgcgtgctcatggtatgcacactctatacgctgtgatgcacttacctgctgaggcatt

SEQ ID NO: 148634 - DNA, 75 bp, Artificial Sequence
  Synthetic
cctcaaactacaactacccctacttctgttgacatgaattctattacttccactgatgtcagaatcttggttcag

SEQ ID NO: 148635 - DNA, 75 bp, Artificial Sequence
  Synthetic
gaacagggccttctctacctgccccaggagctcaccacctgtgatagtgtcgtaacatttgaattaacagacatt

SEQ ID NO: 148636 - DNA, 75 bp, Artificial Sequence
  Synthetic
aatcctatgtatgtttcagacactgtcacacttgttaatgtggcgacaggcgcccaggctgttgcccgatccctt

SEQ ID NO: 148637 - DNA, 75 bp, Artificial Sequence
  Synthetic
cggagatacatcggccggctacagccacgaccgcaagtccatccggtcttggattaaggccactagggtccgggg

SEQ ID NO: 148638 - DNA, 75 bp, Artificial Sequence
  Synthetic
cacgaccgcaagtccatccggtcttggattaaggccactagggtccggggctgttgcgcccttgtcatcgagcgc

SEQ ID NO: 148639 - DNA, 75 bp, Artificial Sequence
  Synthetic
accacgggtgtagccgaggaggaggctacttccggcctggtaatgctttgcattcacggctcccctgttaactcc

SEQ ID NO: 148640 - DNA, 75 bp, Artificial Sequence
  Synthetic
gcatgaacaagataggccaaccccttcgccagccccgtcccgccccttctcggtcctccgtgctaatgatgtctt

SEQ ID NO: 148641 - DNA, 75 bp, Artificial Sequence
  Synthetic
caggttacaacttgtgaattgtacgagctagtggaggccatggtcgagaagggccaggatggctccgccgtcctt

SEQ ID NO: 148642 - DNA, 75 bp, Artificial Sequence
  Synthetic
tatcccaaggccaccaccatctacgtgcgtagcctattcagtgctggcggaaatgccggccctctaggccccccc

SEQ ID NO: 148643 - DNA, 75 bp, Artificial Sequence
  Synthetic
cccgggaataccaacacccgtgtctcccggtatactagcacagctcgccaccggctgcgtcgcggtgctgatggg

SEQ ID NO: 148644 - DNA, 75 bp, Artificial Sequence
  Synthetic
atctacttacactactagtcttggcgccggccctgtgtctgtttctgcggtcggcgttcttgccccgcactctgc

SEQ ID NO: 148645 - DNA, 75 bp, Artificial Sequence
  Synthetic
gccggccctgtgtctgtttctgcggtcggcgttcttgccccgcactctgctctagctgtgcttgaagatactatt

SEQ ID NO: 148646 - DNA, 75 bp, Artificial Sequence
  Synthetic
tgcgtagcctattcagtgctggcggaaatgccggccctctaggcccccccccctggttgtgtgagaaggcccgtt

SEQ ID NO: 148647 - DNA, 75 bp, Artificial Sequence
  Synthetic
cccggtatactagcacagctcgccaccggctgcgtcgcggtgctgatgggacagcagagcttaccaccacagcag

SEQ ID NO: 148648 - DNA, 75 bp, Artificial Sequence
  Synthetic
tatggccgccggccctttcagtctcacctatgccgcctctgctgctgggctggaggtgcgctatgtcgctgccgg

SEQ ID NO: 148649 - DNA, 75 bp, Artificial Sequence
  Synthetic
ttctggccctgctccctcagggtgtgttttacggtgatgcctttgatgacaccgtcttctcggcggctgtggccg

SEQ ID NO: 148650 - DNA, 75 bp, Artificial Sequence
  Synthetic
acctatgccgcctctgctgctgggctggaggtgcgctatgtcgctgccgggcttgaccaccgggcggtttttgcc

SEQ ID NO: 148651 - DNA, 75 bp, Artificial Sequence
  Synthetic
accgtcttctcggcggctgtggccgcagcaaaggcatccatggtgtttgagaatgacttttctgagtttgactcc

SEQ ID NO: 148652 - DNA, 75 bp, Artificial Sequence
  Synthetic
tttgttgcagccgcctcatgacatatttgcgaggcatttcctttaaagtcactgttggcacagtcgtcgccaatg

SEQ ID NO: 148653 - DNA, 75 bp, Artificial Sequence
  Synthetic
tttgcgaggcatttcctttaaagtcactgttggcacagtcgtcgccaatgagggttggaccaccgacgagtacgc

SEQ ID NO: 148654 - DNA, 75 bp, Artificial Sequence
  Synthetic
tagagtgtgctattatggaggagtgtgggatgccgcagtggctcatccgcctgtatcaccttataaggtctgcgt

SEQ ID NO: 148655 - DNA, 75 bp, Artificial Sequence
  Synthetic
agcaggcagctctagcagcggccaactccgccctggcgaatgctgtggtggttcggcctttcctttcccggctac

SEQ ID NO: 148656 - DNA, 75 bp, Artificial Sequence
  Synthetic
ggggatcaagcgcctagccaaagagcatcaacaggggctgctcttccgtttgggggagtggctgctggcaaaggt

SEQ ID NO: 148657 - DNA, 75 bp, Artificial Sequence
  Synthetic
agacagagattctgataaacctgatgcagccccggcagcttgttttccggcctgaggttctgtggaatcacccaa

SEQ ID NO: 148658 - DNA, 75 bp, Artificial Sequence
  Synthetic
catcaacaggggctgctcttccgtttgggggagtggctgctggcaaaggtgtgcggaccgaaagagacattcgtc

SEQ ID NO: 148659 - DNA, 75 bp, Artificial Sequence
  Synthetic
ctctgttttgatcgggagtatgcctgcccttgcctcccgcttgagcgggcggtgcgtaaaggttgctgttgtgtt

SEQ ID NO: 148660 - DNA, 75 bp, Artificial Sequence
  Synthetic
acttcagcgtcttaaaatgaaggtaggtaaaacccgggagtcttaattaatttcatcctgtgcccccttctaggt

SEQ ID NO: 148661 - DNA, 75 bp, Artificial Sequence
  Synthetic
gcccttgcctcccgcttgagcgggcggtgcgtaaaggttgctgttgtgttgcccgcaagttgaagcaggtttgtg

SEQ ID NO: 148662 - DNA, 75 bp, Artificial Sequence
  Synthetic
aaaccccgcggtcgcgatgttcagcggtggtataccgcccctacccgcggccctgcagcgaactgccgccggtcg

SEQ ID NO: 148663 - DNA, 75 bp, Artificial Sequence
  Synthetic
ggtaaaacccgggagtcttaattaatttcatcctgtgcccccttctaggttctgctttatttcttttttctgcgt

SEQ ID NO: 148664 - DNA, 75 bp, Artificial Sequence
  Synthetic
tcagcagtattctaagacattttatgttctcccgcttcgcgggaagctttccttttgggaggccggtacgaccaa

SEQ ID NO: 148665 - DNA, 75 bp, Artificial Sequence
  Synthetic
cggaggcctactcgcccgccggcttagacaactggactattcgcgcccttacagatgccttgcaccaggcctccc

SEQ ID NO: 148666 - DNA, 75 bp, Artificial Sequence
  Synthetic
agacaactggactattcgcgcccttacagatgccttgcaccaggcctccctgcgtgctgtgagaaccggcgcaaa

SEQ ID NO: 148667 - DNA, 75 bp, Artificial Sequence
  Synthetic
actggggttgctctttattcactgcacgacctatggcctgccgacgtcgcggaggcaatggcccgtcacggtatg

SEQ ID NO: 148668 - DNA, 75 bp, Artificial Sequence
  Synthetic
ctgagtcagtaaaaccagtgctcgacttgacaaattcaatcttgtgtcgggtggaatgaataacatgtcttttgc

SEQ ID NO: 148669 - DNA, 75 bp, Artificial Sequence
  Synthetic
cgctatttctacctataccactagtttgggtgccggccctacttcgatatctgcggttggtgtactggctccaca

SEQ ID NO: 148670 - DNA, 75 bp, Artificial Sequence
  Synthetic
gccaggcccccccggtcgctggctggaggcggggccttactgggccgatgtgccgccgccacccacaccagacga

SEQ ID NO: 148671 - DNA, 75 bp, Artificial Sequence
  Synthetic
ttgggtgccggccctacttcgatatctgcggttggtgtactggctccacactcggccctcgccgttcttgaggac

SEQ ID NO: 148672 - DNA, 75 bp, Artificial Sequence
  Synthetic
aggttggaacataacccaaagaggcttgaggctgcctaccgggagacttgctcccgcctcggtaccgctgcatac

SEQ ID NO: 148673 - DNA, 75 bp, Artificial Sequence
  Synthetic
gaggcggggccttactgggccgatgtgccgccgccacccacaccagacgaggtaccgtatcggacgccggtgagc

SEQ ID NO: 148674 - DNA, 75 bp, Artificial Sequence
  Synthetic
gagtaccacgggcaccgccctgggtccgcgggcttctgggagccgtcccccacttccacatctgagagctcgctg

SEQ ID NO: 148675 - DNA, 75 bp, Artificial Sequence
  Synthetic
accccgccagtgcctgatgtcgactcccgcggcgccatcttgcgccggcagtataacctatcaacatctcccctt

SEQ ID NO: 148676 - DNA, 75 bp, Artificial Sequence
  Synthetic
ttgctgccagatggttcgaggccaataggccgacctgcccaactctcactataactgaggatgttgcacggacag

SEQ ID NO: 148677 - DNA, 75 bp, Artificial Sequence
  Synthetic
attccttctgtgcccccttcgtagctcttttggttttatttcttatttctgctttccgcgctccctggaaaaaaa

SEQ ID NO: 148678 - DNA, 75 bp, Artificial Sequence
  Synthetic
ccgcgggcttctgggagccgtcccccacttccacatctgagagctcgctgagtcgccatacatcccttcagagtg

SEQ ID NO: 148679 - DNA, 75 bp, Artificial Sequence
  Synthetic
tagtccgcttttaccccttcaggacggcaccaatacccatataatggccacggaagcttctaattatgcccagta

SEQ ID NO: 148680 - DNA, 75 bp, Artificial Sequence
  Synthetic
cagcaatttatgagggggatcttttcagctcgaattgcttctggcttgtcaacgcggccaacgcccaacacagcc

SEQ ID NO: 148681 - DNA, 75 bp, Artificial Sequence
  Synthetic
cagctcgaattgcttctggcttgtcaacgcggccaacgcccaacacagccctggggggggcgtgtgcggtgcgtt

SEQ ID NO: 148682 - DNA, 75 bp, Artificial Sequence
  Synthetic
attctggccacagaccaccaccaccccgacgtccgttgatatgaattcaataacctcgacggatgttcgtatttt

SEQ ID NO: 148683 - DNA, 75 bp, Artificial Sequence
  Synthetic
gacgcccaggcctataatacatgcagtggcacctgattataggcggcggagggacccagcagccttacaagtggc

SEQ ID NO: 148684 - DNA, 75 bp, Artificial Sequence
  Synthetic
gtggcacctgattataggcggcggagggacccagcagccttacaagtggcttatcaagaatgcctgtatagacag

SEQ ID NO: 148685 - DNA, 75 bp, Artificial Sequence
  Synthetic
cgcctttatagttggctgtttgagaagtccggccgtgattacatccccggccgtcagttgcagttttatgcccag

SEQ ID NO: 148686 - DNA, 75 bp, Artificial Sequence
  Synthetic
gataaccacctcccaggcgatgagatgtatttgttgccggctatgtcatcttggtaccgggcttggcgtgctcag

SEQ ID NO: 148687 - DNA, 75 bp, Artificial Sequence
  Synthetic
ttcatctcgacccacgcgtacttgtatttgatgaagcagccccctgccgctgtcgtaattttcttcggaaagctg

SEQ ID NO: 148688 - DNA, 75 bp, Artificial Sequence
  Synthetic
tccccagccggacccccgggaggaggttgcggagagccggcgccgaagcctccggcccatatattggtggtcacc

SEQ ID NO: 148689 - DNA, 75 bp, Artificial Sequence
  Synthetic
ttggtgagcagggttatgataatgaagcatttgaagggtcggatgttgaccctgctgaggaggcaactgtgagta

SEQ ID NO: 148690 - DNA, 75 bp, Artificial Sequence
  Synthetic
gttgcggagagccggcgccgaagcctccggcccatatattggtggtcaccccgggtttagctaacaccgccaatc

SEQ ID NO: 148691 - DNA, 75 bp, Artificial Sequence
  Synthetic
tctctgggtcatatattgtaactggtagccagctacagcctctatatcaggcgcttggtatcccctctgatcttg

SEQ ID NO: 148692 - DNA, 75 bp, Artificial Sequence
  Synthetic
cggagaggtgggccatcaccgcccctctgtgatacctcgtggcaaccctgatcggaaccttgatactctacaggc

SEQ ID NO: 148693 - DNA, 75 bp, Artificial Sequence
  Synthetic
cgacgccttctccagccccatcgcgccctttctctgtccttcgagctaatgatgtgctttggctctctctcaccg

SEQ ID NO: 148694 - DNA, 75 bp, Artificial Sequence
  Synthetic
ccctttctctgtccttcgagctaatgatgtgctttggctctctctcaccgctgccgagtatgaccagtccactta

SEQ ID NO: 148695 - DNA, 75 bp, Artificial Sequence
  Synthetic
ggtttgccgacagaattgatttcgtcggctggaggtcagctcttttactcccgcccagtcgtctcggccaatggc

SEQ ID NO: 148696 - DNA, 75 bp, Artificial Sequence
  Synthetic
ggggtcggggaagtccgttggtgtccggcgtgaagattgcgatctggtaatagttccgacaaatcagcttaaggc

SEQ ID NO: 148697 - DNA, 75 bp, Artificial Sequence
  Synthetic
gccaacgggccggagcagtatgtgctgtcattcgacccgattaaacaaactatggccgccggcccgcataatctt

SEQ ID NO: 148698 - DNA, 75 bp, Artificial Sequence
  Synthetic
tgtcattcgacccgattaaacaaactatggccgccggcccgcataatcttagttacaccctgacacctgcaggcc

SEQ ID NO: 148699 - DNA, 75 bp, Artificial Sequence
  Synthetic
tgcccggtcgctcgattggaccaaggtcacacttgacggtcgccccctctccaccatccagcagtactcgaagac

SEQ ID NO: 148700 - DNA, 75 bp, Artificial Sequence
  Synthetic
tattgatgaggcccccaccatcgcgccgcacctcctgctctgttatatgacctctgccgctgaagtagtcctact

SEQ ID NO: 148701 - DNA, 75 bp, Artificial Sequence
  Synthetic
tatggccgccggcccgcataatcttagttacaccctgacacctgcaggccttgaaatacatgttgtctctgccgg

SEQ ID NO: 148702 - DNA, 75 bp, Artificial Sequence
  Synthetic
ccgcacctcctgctctgttatatgacctctgccgctgaagtagtcctacttggggacccaaagcagatccccgcc

SEQ ID NO: 148703 - DNA, 75 bp, Artificial Sequence
  Synthetic
aggtgggcatctccgatgcaatcgttaataactttttccttgctggtggcgaaattggccaccagcgcccatctg

SEQ ID NO: 148704 - DNA, 75 bp, Artificial Sequence
  Synthetic
catcgttgcccccgagatgtgtgttatctgctgtcggccgattacccggggatgaccaccacaaaccccgtggtt

SEQ ID NO: 148705 - DNA, 75 bp, Artificial Sequence
  Synthetic
atctgctgtcggccgattacccggggatgaccaccacaaaccccgtggttaggtctctggtgttcaccgggcaag

SEQ ID NO: 148706 - DNA, 75 bp, Artificial Sequence
  Synthetic
caaagctctacaatgcctcccactctgatgttcgcgactctctcgcccgttttatcccggccattggccccgtac

SEQ ID NO: 148707 - DNA, 75 bp, Artificial Sequence
  Synthetic
ccccccactctgcgctagcattgcttgaggataccttggactaccctgcccgcgcccatacttttgatgatttct

SEQ ID NO: 148708 - DNA, 75 bp, Artificial Sequence
  Synthetic
aggggagcacattcaacacgaccaccctcattgtgacgaatgacgcccgcgggttgttggccgcgtcacgggccc

SEQ ID NO: 148709 - DNA, 75 bp, Artificial Sequence
  Synthetic
ccctcttgttgagactgacacacctacagttgttgataatatgcccccagttgtttctgtaccccttgagcaaat

SEQ ID NO: 148710 - DNA, 75 bp, Artificial Sequence
  Synthetic
tcaggctgcacatttgccgccgagacgggggttgcactctattcactgcacgatttgtggcctgccgatgttgcg

SEQ ID NO: 148711 - DNA, 75 bp, Artificial Sequence
  Synthetic
cctcattgtgacgaatgacgcccgcgggttgttggccgcgtcacgggcccattgtattgttgcattgacccggca

SEQ ID NO: 148712 - DNA, 75 bp, Artificial Sequence
  Synthetic
agcgcagtctgtagttcaaccatctgggcctcgccggcggctgcttcatacctatcctgatggctcgaaggtgta

SEQ ID NO: 148713 - DNA, 75 bp, Artificial Sequence
  Synthetic
tttctacctgacacagccggtggaggtacaggctcggccggccgccgtggagaaggcggagcggacggcaaattt

SEQ ID NO: 148714 - DNA, 75 bp, Artificial Sequence
  Synthetic
tttctacctgacacagccggtggaggttcaggctcggccggccgccgtggagaaggcggagcggacggcaaattt

SEQ ID NO: 148715 - DNA, 75 bp, Artificial Sequence
  Synthetic
tttctacctgacacagccggtggaggtccaggctcggccggccgccgtggagaaggcggagcggacggcaaattt

SEQ ID NO: 148716 - DNA, 75 bp, Artificial Sequence
  Synthetic
tttctacctgacacagccggtggaggtgcaggctcggccggccgccgtggagaaggcggagcggacggcaaattt

SEQ ID NO: 148717 - DNA, 75 bp, Artificial Sequence
  Synthetic
tcccccggaggtgttactcccccctggcacttaccataccacctcatacctcttaatccatgatggggatcgtgc

SEQ ID NO: 148718 - DNA, 75 bp, Artificial Sequence
  Synthetic
gtacaggctcggccggccgccgtggagaaggcggagcggacggcaaatttgcaggacatagatgcagttcccccc

SEQ ID NO: 148719 - DNA, 75 bp, Artificial Sequence
  Synthetic
gttcaggctcggccggccgccgtggagaaggcggagcggacggcaaatttgcaggacatagatgcagttcccccc

SEQ ID NO: 148720 - DNA, 75 bp, Artificial Sequence
  Synthetic
gtccaggctcggccggccgccgtggagaaggcggagcggacggcaaatttgcaggacatagatgcagttcccccc

SEQ ID NO: 148721 - DNA, 75 bp, Artificial Sequence
  Synthetic
gtgcaggctcggccggccgccgtggagaaggcggagcggacggcaaatttgcaggacatagatgcagttcccccc

SEQ ID NO: 148722 - DNA, 75 bp, Artificial Sequence
  Synthetic
gggcctcgccggcggctgcttcatacctatcctgatggctcgaaggtgtatgctggctccctttttgagtccgag

SEQ ID NO: 148723 - DNA, 75 bp, Artificial Sequence
  Synthetic
gaccaaggtcactggtgaccatccgctggtgattgagcgggtccgggctgtgggatgtcattttgtcctcctcct

SEQ ID NO: 148724 - DNA, 75 bp, Artificial Sequence
  Synthetic
ccactctgccccgcactggagcagggtaagctttacaccccttttaatttgtccggtcgggagcaggtgaccgtt

SEQ ID NO: 148725 - DNA, 75 bp, Artificial Sequence
  Synthetic
gtaagctttacaccccttttaatttgtccggtcgggagcaggtgaccgttttagccctctcccccactgtgcatt

SEQ ID NO: 148726 - DNA, 75 bp, Artificial Sequence
  Synthetic
cacagctgcacccgaaccgtcgccgatgccttacgttccatatcctcgttcgaccgaggtttatgttcgttctat

SEQ ID NO: 148727 - DNA, 75 bp, Artificial Sequence
  Synthetic
caacgttttgcaccgttgctttctgaaaccccgtggtcgcgacgttcagcggtggtacaccgcccccacccgcgg

SEQ ID NO: 148728 - DNA, 75 bp, Artificial Sequence
  Synthetic
ctctttccatctgcctgctcaaccaagtcaacatttcatgccgtccctgtgcatatatgggacaggcttatgctt

SEQ ID NO: 148729 - DNA, 75 bp, Artificial Sequence
  Synthetic
ctctttccatctgcctgctctaccaagtcaacatttcatgccgtccctgtgcatatatgggacaggcttatgctt

SEQ ID NO: 148730 - DNA, 75 bp, Artificial Sequence
  Synthetic
ctctttccatctgcctgctccaccaagtcaacatttcatgccgtccctgtgcatatatgggacaggcttatgctt

SEQ ID NO: 148731 - DNA, 75 bp, Artificial Sequence
  Synthetic
ctctttccatctgcctgctcgaccaagtcaacatttcatgccgtccctgtgcatatatgggacaggcttatgctt

SEQ ID NO: 148732 - DNA, 75 bp, Artificial Sequence
  Synthetic
tgtggcatgatgacgtggaggtggtgcgggagtcactccgtgtgctgatcccctcgctacagggggtcagggttt

SEQ ID NO: 148733 - DNA, 75 bp, Artificial Sequence
  Synthetic
gcgggagtcactccgtgtgctgatcccctcgctacagggggtcagggtttcgtcatgtgagctcgcggagttggt

SEQ ID NO: 148734 - DNA, 75 bp, Artificial Sequence
  Synthetic
gataacattcttccagaaggactgcaataaattcaccacagacgagccggttcaacatggcaaggtcgggcaggg

SEQ ID NO: 148735 - DNA, 75 bp, Artificial Sequence
  Synthetic
aataaattcaccacagacgagccggttcaacatggcaaggtcgggcagggcatttcggcgtggtcaaaaaccctt

SEQ ID NO: 148736 - DNA, 75 bp, Artificial Sequence
  Synthetic
ggtgtccctggctcgggtaaatcccggtcagtccagcagggggaggtggatgtggtagtagtaccaactcgtgag

SEQ ID NO: 148737 - DNA, 75 bp, Artificial Sequence
  Synthetic
ggtcagtccagcagggggaggtggatgtggtagtagtaccaactcgtgagctgcgtaactcgtggcggcgccgcg

SEQ ID NO: 148738 - DNA, 75 bp, Artificial Sequence
  Synthetic
gcctttatagttggttatttgagaagtctgggcgtgactacatccctggccgccagctgcagttttatgcccagt

SEQ ID NO: 148739 - DNA, 75 bp, Artificial Sequence
  Synthetic
gagcatgcacagaagtttataacacgcctttatagttggttatttgagaagtctgggcgtgactacatccctggc

SEQ ID NO: 148740 - DNA, 75 bp, Artificial Sequence
  Synthetic
ggggattgctatgttcaggagaagttagaggctgccgtggctggggcgaaagcatgccgcgtttttgagaacgac

SEQ ID NO: 148741 - DNA, 75 bp, Artificial Sequence
  Synthetic
tagaggctgccgtggctggggcgaaagcatgccgcgtttttgagaacgactttagtgagtttgatagcacacaga

SEQ ID NO: 148742 - DNA, 75 bp, Artificial Sequence
  Synthetic
agggttgttattgatgaggccccgtcgctccccccacacttgcttttgctgcatatgcagcgagcctcttcagtt

SEQ ID NO: 148743 - DNA, 75 bp, Artificial Sequence
  Synthetic
tccaccgaggtctatgtccggtccatttttggaccaggcggttcgccctctctcttcccatctgcttactcgact

SEQ ID NO: 148744 - DNA, 75 bp, Artificial Sequence
  Synthetic
acctgcttcgttcggcatgggtgttgcaggccccccaggagagcttgcggggtcgatggaagaaacactctggtg

SEQ ID NO: 148745 - DNA, 75 bp, Artificial Sequence
  Synthetic
gcaggccccccaggagagcttgcggggtcgatggaagaaacactctggtgagcctggcacactgctttggaacac

SEQ ID NO: 148746 - DNA, 75 bp, Artificial Sequence
  Synthetic
ccgctgaagaagccgttgtgagtatttctgggtcatatattgttaccggcagccagttgcagcccctctaccaag

SEQ ID NO: 148747 - DNA, 75 bp, Artificial Sequence
  Synthetic
gcgtactccgctctctgttctggggggaaccccctgtgggtcagaagttggtgttcactcaggcagcgaaggccg

SEQ ID NO: 148748 - DNA, 75 bp, Artificial Sequence
  Synthetic
aatcccctatattcatccaaccaaccccttcgcccccgatgtcaccgctgcggccggggctggacctcgtgttcg

SEQ ID NO: 148749 - DNA, 75 bp, Artificial Sequence
  Synthetic
aacgaaggctggaacgcctccgaggacgcgctgactgctgtaatcactgcagcttatcttaccatctgccatcag

SEQ ID NO: 148750 - DNA, 75 bp, Artificial Sequence
  Synthetic
acggttgaggtttctgatgctgacggccgtctcacctgtaagaccaccatgggtaataagacctttttaacagcc

SEQ ID NO: 148751 - DNA, 75 bp, Artificial Sequence
  Synthetic
ctctattgtgtgctgccggttctatcagcaggagccccgagccgcggcccttatcaccggctgcggccttaagct

SEQ ID NO: 148752 - DNA, 75 bp, Artificial Sequence
  Synthetic
gggtaataagacctttttaacagcctttactgatggcgcccagctggaggccaatgggccagagcagtacgtttt

SEQ ID NO: 148753 - DNA, 75 bp, Artificial Sequence
  Synthetic
cagcaggagccccgagccgcggcccttatcaccggctgcggccttaagctgaaggttaattttggtgatgtcggg

SEQ ID NO: 148754 - DNA, 75 bp, Artificial Sequence
  Synthetic
cagggcccatgcgattgtggctctgacccgccacacagagaaatgtgtggttgttgacgccccgggcctcctccg

SEQ ID NO: 148755 - DNA, 75 bp, Artificial Sequence
  Synthetic
gagaagaattggggcccagtgaaagagcggaaggaggaccttgagcagtctgtgcgcgattttgtcgcaagactc

SEQ ID NO: 148756 - DNA, 75 bp, Artificial Sequence
  Synthetic
tgaagtgcatgcggtttcggccgggcttgattgcaaggccgtctttccgtccggcgtagcggccccccctgctgc

SEQ ID NO: 148757 - DNA, 75 bp, Artificial Sequence
  Synthetic
cttgattgcaaggccgtctttccgtccggcgtagcggccccccctgctgccggggaggtatctgctttctgcgcg

SEQ ID NO: 148758 - DNA, 75 bp, Artificial Sequence
  Synthetic
tgctcgccacccgcttttacaagctggagcccggtctagcccttaatgcggtcgcaggcctgaaggccattgccg

SEQ ID NO: 148759 - DNA, 75 bp, Artificial Sequence
  Synthetic
gtgatgattcgatagtgctttgcagtgagtaccgtcagagcccaggggctgctgtcctgatcgccggctgtggct

SEQ ID NO: 148760 - DNA, 75 bp, Artificial Sequence
  Synthetic
ctaccatcagcttgccgaggagcttggccatcgaccggccccgattgctgctgtcttgcccccttgcccggagct

SEQ ID NO: 148761 - DNA, 75 bp, Artificial Sequence
  Synthetic
gttggcctgtttccaccgttctcccccggtcatagctgggagtctgctaatcctttttgtggtgaaagcaccctt

SEQ ID NO: 148762 - DNA, 75 bp, Artificial Sequence
  Synthetic
cctgctgaggaggcgactgtgagtatctctgggtcatatattgtaactgatagccagctacagcctttatatcag

SEQ ID NO: 148763 - DNA, 75 bp, Artificial Sequence
  Synthetic
gtggcccccggccttggcgcgcttcctgatgttgtgcgcttcgccggccggcttaccgagaagaattggggccct

SEQ ID NO: 148764 - DNA, 75 bp, Artificial Sequence
  Synthetic
gcttctctagttgcttctcaccacttgaaccttgtgccccgagcgagctgccccccgtggaggctagtaaacctg

SEQ ID NO: 148765 - DNA, 75 bp, Artificial Sequence
  Synthetic
tctctgggtcatatattgtaactgatagccagctacagcctttatatcaggcgcttggtataccctctgatctcg

SEQ ID NO: 148766 - DNA, 75 bp, Artificial Sequence
  Synthetic
cgctttcgtgctcgtgcctttgctgttcgtgccgctgctgctcgcggcccccatgcaccccgggggaacccgggg

SEQ ID NO: 148767 - DNA, 75 bp, Artificial Sequence
  Synthetic
gttgagacctccggggtggcggaggaggaggccacctctggtcttgttatgctctgcatacatggctcacctgta

SEQ ID NO: 148768 - DNA, 75 bp, Artificial Sequence
  Synthetic
caactggctatccccaaccaatccctttgctgccgaactctccaccatgccgcccctcggcaccgcctgggttga

SEQ ID NO: 148769 - DNA, 75 bp, Artificial Sequence
  Synthetic
ctgactcagttgataatagcgttagccttactcctcctagtgctcccactgtacttccggtgtcggcgccgcctg

SEQ ID NO: 148770 - DNA, 75 bp, Artificial Sequence
  Synthetic
tgggcaataaaaccttctcaacaatcttcactgatggtgcccagttggaggccaacgggccggagcagtatgtgc

SEQ ID NO: 148771 - DNA, 75 bp, Artificial Sequence
  Synthetic
ccggtgccctcgggctgttggactttgccctcgaacttgagttccgcaacctcacccccggtaataccaacacgc

SEQ ID NO: 148772 - DNA, 75 bp, Artificial Sequence
  Synthetic
tttgctgccgaactctccaccatgccgcccctcggcaccgcctgggttgatcggcgacgcggcaggccccgtaac

SEQ ID NO: 148773 - DNA, 75 bp, Artificial Sequence
  Synthetic
tcgaaatacatgttgtctccgccgggcttgactgtaaggccgtctttccatccggggttgcgaccccgtctgccc

SEQ ID NO: 148774 - DNA, 75 bp, Artificial Sequence
  Synthetic
tttttgattctgagtgtacttggctagttaatgcctccaaccccggtcaccgccctggtggcggtctttgtcatg

SEQ ID NO: 148775 - DNA, 75 bp, Artificial Sequence
  Synthetic
cctgatgtagacagccgaggctctattctacgccggcagtataacctttccacctcacctttgaccctgacagtc

SEQ ID NO: 148776 - DNA, 75 bp, Artificial Sequence
  Synthetic
gcttgactgtaaggccgtctttccatccggggttgcgaccccgtctgcccctggggaggtgtctgccttctgttc

SEQ ID NO: 148777 - DNA, 75 bp, Artificial Sequence
  Synthetic
ttctacgccggcagtataacctttccacctcacctttgaccctgacagtccctcagtcgtccaattccatactgt

SEQ ID NO: 148778 - DNA, 75 bp, Artificial Sequence
  Synthetic
cacagttttggccgctgccgttgcaggagcctccggttgtaaggtttttgagaatgatttttcagagtttgatag

SEQ ID NO: 148779 - DNA, 75 bp, Artificial Sequence
  Synthetic
tgttgctcccgactatcgggttgaacataaccctaagcggcttgaggccgcctatcgggagacatgctctcgccg

SEQ ID NO: 148780 - DNA, 75 bp, Artificial Sequence
  Synthetic
attatgcccagtaccgagtgcaggcttgcaccctgcgcttccgcccgctagttccaaactcggtgggcgggtacg

SEQ ID NO: 148781 - DNA, 75 bp, Artificial Sequence
  Synthetic
ctcagccaatggcgagccgactgttaagctgtatacatctgtagagaatgctcagcaggataagggtattgcaat

SEQ ID NO: 148782 - DNA, 75 bp, Artificial Sequence
  Synthetic
aagctgtatacatctgtagagaatgctcagcaggataagggtattgcaatcccgcatgacatcgacctcggggaa

SEQ ID NO: 148783 - DNA, 75 bp, Artificial Sequence
  Synthetic
ggggacggctgcctaccctttgctcggtgccggcatatatagggtccccgttgggttgagttttgatgcgtggga

SEQ ID NO: 148784 - DNA, 75 bp, Artificial Sequence
  Synthetic
actctaccatctcgtccgctccgcctgggtcctccaggccccgaaggagtccctgcggggtttttggaagaaaca

SEQ ID NO: 148785 - DNA, 75 bp, Artificial Sequence
  Synthetic
cttagccgcggagctcgtcgtgcctcgggagcggttacattaccgcaaccaaggctggcgctccgttgaaaccaa

SEQ ID NO: 148786 - DNA, 75 bp, Artificial Sequence
  Synthetic
accgcccattgaggctggtacgtctgttgctattaatgttccacccccaaccgtctctgtactgcctcagccccc

SEQ ID NO: 148787 - DNA, 75 bp, Artificial Sequence
  Synthetic
ttgcaccctgcgcttccgcccgctagttccaaactcggtgggcgggtacgcagtgtcaatgtccttctggcccca

SEQ ID NO: 148788 - DNA, 75 bp, Artificial Sequence
  Synthetic
cgggagcggttacattaccgcaaccaaggctggcgctccgttgaaaccaattctgtgccgcaggaagagtcgacc

SEQ ID NO: 148789 - DNA, 75 bp, Artificial Sequence
  Synthetic
cataaccctaagcggcttgaggccgcctatcgggagacatgctctcgccgggggacggctgcctaccctttgctc

SEQ ID NO: 148790 - DNA, 75 bp, Artificial Sequence
  Synthetic
tgcccccccggcgccagtgcagcccgtaacccacctatccgggccccgccggcggttacttcatacttatcctga

SEQ ID NO: 148791 - DNA, 75 bp, Artificial Sequence
  Synthetic
agtaggccgtgcgtgcgctggctgtcgtgtcgagcccggcgtagtccactatcaattcacggcgggtgtccccgg

SEQ ID NO: 148792 - DNA, 75 bp, Artificial Sequence
  Synthetic
ggcttgctagacattgccctccaggttgagtaccgcaacctgacccctggtaacactaacacccgtgtcaaccgg

SEQ ID NO: 148793 - DNA, 75 bp, Artificial Sequence
  Synthetic
ttgagtaccgcaacctgacccctggtaacactaacacccgtgtcaaccggttccgcaccacagcccctcataaga

SEQ ID NO: 148794 - DNA, 75 bp, Artificial Sequence
  Synthetic
cctgatgttgttaggtttgctgggcggctctcagagaaaaactgggggcccggtttggagagggcagagcagcta

SEQ ID NO: 148795 - DNA, 75 bp, Artificial Sequence
  Synthetic
ccggcgggaatggcgtgggtgacataggtaagggcattgtgcaggtcctgtttaacatcgctgacaccttgctgg

SEQ ID NO: 148796 - DNA, 75 bp, Artificial Sequence
  Synthetic
cgatggggccccttcacttccaccgcatctgctcctgttgcatatgcagcgggcctcatcggttcaccttctcgg

SEQ ID NO: 148797 - DNA, 75 bp, Artificial Sequence
  Synthetic
ccttacccccggtaacaccaacacgcgggtctcccgttattccagcactgctcgccaccgccttcgtcgcggtgc

SEQ ID NO: 148798 - DNA, 75 bp, Artificial Sequence
  Synthetic
cggtttggagagggcagagcagctacggctggctgtctgtgattttctgcgaaagttaacgaatgtggctcaggt

SEQ ID NO: 148799 - DNA, 75 bp, Artificial Sequence
  Synthetic
gcctaccgggagacgtgctcccgcctcgggacagcagcttatcctttacttggcgccggtatatataaggtacct

SEQ ID NO: 148800 - DNA, 75 bp, Artificial Sequence
  Synthetic
tataacaccactgctagtgaccaactgctcgttgagaatgccgctgggcatcgggttgctatttccacttacacc

SEQ ID NO: 148801 - DNA, 75 bp, Artificial Sequence
  Synthetic
ttgtgtggatgttgtctcacaagtgtatggtgttagccctggtctggtacataacctgattgggatgctccagac

SEQ ID NO: 148802 - DNA, 75 bp, Artificial Sequence
  Synthetic
ttctgttgaagcagcccaactagatcagggtgtgaccataccccatgatatagacctagggttgtctactgtcac

SEQ ID NO: 148803 - DNA, 75 bp, Artificial Sequence
  Synthetic
aggtaagggcattgtgcaggtcctgtttaacatcgctgacaccttgctgggtgggctccctaccgatctggtgtc

SEQ ID NO: 148804 - DNA, 75 bp, Artificial Sequence
  Synthetic
taatccgcggtgcatacccgaagattcagactgcgagccgcgtcctccgctctttgttttggggggagccccctg

SEQ ID NO: 148805 - DNA, 75 bp, Artificial Sequence
  Synthetic
gcttggtttgaggcaaaccggcccaccctcccagctcttactatcactgaggataccgcgcgtacggcgaacctg

SEQ ID NO: 148806 - DNA, 75 bp, Artificial Sequence
  Synthetic
gcgctctcgggctcttctgtttttgctcctcgtgtttctgcctatgctgcccgcgccaccggccggtcagccgtc

SEQ ID NO: 148807 - DNA, 75 bp, Artificial Sequence
  Synthetic
cagggtgtgaccataccccatgatatagacctagggttgtctactgtcacactgcaagattttgacaaccagcat

SEQ ID NO: 148808 - DNA, 75 bp, Artificial Sequence
  Synthetic
gtgaccttgccctccgctaagtacgctcagtcacagagcgctatggcttcccacccggcatactggtctgaagag

SEQ ID NO: 148809 - DNA, 75 bp, Artificial Sequence
  Synthetic
gtgcaacattcactgagactacgattattgccacggcagatgcccgtgggctgatccagtcttctagagcccacg

SEQ ID NO: 148810 - DNA, 75 bp, Artificial Sequence
  Synthetic
tattgccacggcagatgcccgtgggctgatccagtcttctagagcccacgcaattgtggctttgactcgccacac

SEQ ID NO: 148811 - DNA, 75 bp, Artificial Sequence
  Synthetic
gtcagcgggccctggtgtctagcgtcaagtgggatcaggtcaccttgaatggtaaggcactacataaggagacac

SEQ ID NO: 148812 - DNA, 75 bp, Artificial Sequence
  Synthetic
tttcctttctggcggtcagattggccagcaccgcccgtcggttataccgcgtggcactattgataataatgttga

SEQ ID NO: 148813 - DNA, 75 bp, Artificial Sequence
  Synthetic
cgacctgaggtcctttggaatcacccgatccagcgagtcatacacaatgagctagagcagtactgccgagctcgc

SEQ ID NO: 148814 - DNA, 75 bp, Artificial Sequence
  Synthetic
gctagagcagtactgccgagctcgcgctggccgctgccttgaggttggtgcccacccgagatccattaatgataa

SEQ ID NO: 148815 - DNA, 75 bp, Artificial Sequence
  Synthetic
tatatgttcctacttatactactatgctgggcgctgggcctgttaatatcaccggattgggagctatcggcccca

SEQ ID NO: 148816 - DNA, 75 bp, Artificial Sequence
  Synthetic
cgccccaattgcagctgttctgcccccctgtccggagctcgagcagggtttactttatatgcctcaggaactgac

SEQ ID NO: 148817 - DNA, 75 bp, Artificial Sequence
  Synthetic
cgacaaaatggtggcacgttactcatagatgcccagctgatgtctgtgagttaatccgcggtgcgtacccaaaga

SEQ ID NO: 148818 - DNA, 75 bp, Artificial Sequence
  Synthetic
agcggttctgtcaacccttgttggcaggtacggccgccgtaccaaattgtacgaggccgcacacgcggatgttcg

SEQ ID NO: 148819 - DNA, 75 bp, Artificial Sequence
  Synthetic
tcagcagcagccgccgatagtgtctagttatttcttttctttgttttatgtttttcctctattttctttttcttt

SEQ ID NO: 148820 - DNA, 75 bp, Artificial Sequence
  Synthetic
tgcagaggctatggcccgccatgggatgacgcgcttgtacgctgtccttcacctaccccctgaggttttgttacc

SEQ ID NO: 148821 - DNA, 75 bp, Artificial Sequence
  Synthetic
aggtacggccgccgtaccaaattgtacgaggccgcacacgcggatgttcgtgggtccctgaatcatttcattcct

SEQ ID NO: 148822 - DNA, 75 bp, Artificial Sequence
  Synthetic
ttatcgccacggcagacgcccgtgggctgattcagtcctccagggcccatgcgattgtggctctgacccgccaca

SEQ ID NO: 148823 - DNA, 75 bp, Artificial Sequence
  Synthetic
tactagtgcgggctataaccacgatgtgtccatacttcgtgcttggattcgcaccactaaaatagttggtgatca

SEQ ID NO: 148824 - DNA, 75 bp, Artificial Sequence
  Synthetic
aacattcttccagaaggattgtaataagtttacaacaggtgaaacgatagcgcatggtaaagtcgggcaggggat

SEQ ID NO: 148825 - DNA, 75 bp, Artificial Sequence
  Synthetic
atctctgacgctattgttaataatttcttcctttctggcggtcaggttggtcagcaccgcccgtcagtcatacca

SEQ ID NO: 148826 - DNA, 75 bp, Artificial Sequence
  Synthetic
atactggtgctctcggcctgctcgattttgcgcttgagcttgaatttcgtaatttgacacctggcaatacgaata

SEQ ID NO: 148827 - DNA, 75 bp, Artificial Sequence
  Synthetic
gctctgtttggcccatggttccgcgctattgagaaagaaattttggcagcgcttgcacctaatgtcttctacggt

SEQ ID NO: 148828 - DNA, 75 bp, Artificial Sequence
  Synthetic
ccctatgccttacgttccgtaccctcgctcaactgaggtgtatgtcaggtccatatttggccccggcgggtcgcc

SEQ ID NO: 148829 - DNA, 75 bp, Artificial Sequence
  Synthetic
cttgccgaggagcttggccatcgaccggccccgattgctgctgtcttgcctccctgcccggagcttgaacagggc

SEQ ID NO: 148830 - DNA, 75 bp, Artificial Sequence
  Synthetic
cggccccgattgctgctgtcttgcctccctgcccggagcttgaacagggcttgctctatatgcctcaggagctca

SEQ ID NO: 148831 - DNA, 75 bp, Artificial Sequence
  Synthetic
gcttttcggtgccaccttagatgatcaagccttctgctgctcgcggctcatgacctatctccgcgggatcagcta

SEQ ID NO: 148832 - DNA, 75 bp, Artificial Sequence
  Synthetic
aatcatggaggagtgtggaatgccgcagtggatgatccggctctatcacctcgttcgttccgcctggattttgca

SEQ ID NO: 148833 - DNA, 75 bp, Artificial Sequence
  Synthetic
aatcatggaggagtgtggtatgccgcagtggatgatccggctctatcacctcgttcgttccgcctggattttgca

SEQ ID NO: 148834 - DNA, 75 bp, Artificial Sequence
  Synthetic
aatcatggaggagtgtggcatgccgcagtggatgatccggctctatcacctcgttcgttccgcctggattttgca

SEQ ID NO: 148835 - DNA, 75 bp, Artificial Sequence
  Synthetic
aatcatggaggagtgtgggatgccgcagtggatgatccggctctatcacctcgttcgttccgcctggattttgca

SEQ ID NO: 148836 - DNA, 75 bp, Artificial Sequence
  Synthetic
caaggtgaccgtcggcgcacttgttgctaatgagggctggaatgcctcggaggatgcgcttaccgctgtgatcac

SEQ ID NO: 148837 - DNA, 75 bp, Artificial Sequence
  Synthetic
cgagctccgccctatcagtgtcaccacctgcgagctctatgagcttgtggaggccatggttgagaaaggccagga

SEQ ID NO: 148838 - DNA, 75 bp, Artificial Sequence
  Synthetic
accggacatactgttttgatggtttttctgggtgtacgtttgctgctgagactggggttgccctttattcactgc

SEQ ID NO: 148839 - DNA, 75 bp, Artificial Sequence
  Synthetic
ggttgagcacgcccaaaaatttatcacaagattatatagctggttgtttgagaagtcaggccgtgattacatccc

SEQ ID NO: 148840 - DNA, 75 bp, Artificial Sequence
  Synthetic
actggggttgccctttattcactgcacgatctatggcctgctgatgttgcagaggcaatggcccgccacggtatg

SEQ ID NO: 148841 - DNA, 75 bp, Artificial Sequence
  Synthetic
acaagattatatagctggttgtttgagaagtcaggccgtgattacatcccaggccgccagcttcagttctatgca

SEQ ID NO: 148842 - DNA, 75 bp, Artificial Sequence
  Synthetic
taagtttacaactggtgagacaatagcgcatggtaaagttgggcaggggatatctgcatggagtaaaaccttttg

SEQ ID NO: 148843 - DNA, 75 bp, Artificial Sequence
  Synthetic
attggctgccactttgtgctgttgctcactgccgctcctgaaccatcgcccatgccctatgtcccttttccccgc

SEQ ID NO: 148844 - DNA, 75 bp, Artificial Sequence
  Synthetic
ccttgtggccaatgagggttggaacgcctccgaggacgccctcacagctgttattactgccgcttatctaaccat

SEQ ID NO: 148845 - DNA, 75 bp, Artificial Sequence
  Synthetic
cgccttgttaggcccctggtttcgcgctattgagaaagaaattctagctgtgctcgcacctaatgtattctatgg

SEQ ID NO: 148846 - DNA, 75 bp, Artificial Sequence
  Synthetic
atgtttctgacactgtgacatttgttaatgtagcgaccggtgcccagggggtttcccgttccctggactggtcta

SEQ ID NO: 148847 - DNA, 75 bp, Artificial Sequence
  Synthetic
taggtttgctggccggctctcggagaagaactgggggccaggcccggagagggcggagcagctccgactggccgt

SEQ ID NO: 148848 - DNA, 75 bp, Artificial Sequence
  Synthetic
gggcggagcagctccgactggccgtttgtgattttctgcgaaagttaacgaatgtggctcaggtttgtgtggatg

SEQ ID NO: 148849 - DNA, 75 bp, Artificial Sequence
  Synthetic
cgctgccggagcttcttaaagaaggttgccgggaaattttgttgttttatgaaatggctgggtcaagagtgcacc

SEQ ID NO: 148850 - DNA, 75 bp, Artificial Sequence
  Synthetic
ttgccgggaaattttgttgttttatgaaatggctgggtcaagagtgcacctgctttttggagccagcggagggct

SEQ ID NO: 148851 - DNA, 75 bp, Artificial Sequence
  Synthetic
ttgtttcgcaggtttacggtgtcagccctggtttggtacataacctgatcgggatgcttcagaccattgccgatg

SEQ ID NO: 148852 - DNA, 75 bp, Artificial Sequence
  Synthetic
acatttctggtacttacgcggtccacggcagccagcttgaggccctttatagggcgctgaacatcccgcatgaca

SEQ ID NO: 148853 - DNA, 75 bp, Artificial Sequence
  Synthetic
cggcagccagcttgaggccctttatagggcgctgaacatcccgcatgacattgcagcccgcgcgtcacgtttgac

SEQ ID NO: 148854 - DNA, 75 bp, Artificial Sequence
  Synthetic
tccattatatatcgggtggaatgaataacatgttcttttgctctgtgcatggagatgccaccatgcgctctcggg

SEQ ID NO: 148855 - DNA, 75 bp, Artificial Sequence
  Synthetic
cgcacctcactctgtgctggccgctttggaggataccgttgattaccctgctcgtgctcataccttcgatgattt

SEQ ID NO: 148856 - DNA, 75 bp, Artificial Sequence
  Synthetic
atcgatagttgatggcgctcaccttgaagctaatggtcctgagcagtacgtcctgacatttgatgattcccgtca

SEQ ID NO: 148857 - DNA, 75 bp, Artificial Sequence
  Synthetic
ccgttgtgctctgtagcgattatcggcagagccgtgatgcggctgccctaattgcaggctgcgggctcaagttaa

SEQ ID NO: 148858 - DNA, 75 bp, Artificial Sequence
  Synthetic
ctgtcgctgagctacagcgtcttaaaatgaaggtgggtaaaactcgggagtattgatttattttccttgtgcctc

SEQ ID NO: 148859 - DNA, 75 bp, Artificial Sequence
  Synthetic
gcctgcgagttaaaataacctctaacggcttggactgtaccgcagtattcccgcctggcggggcgccaagcgcca

SEQ ID NO: 148860 - DNA, 75 bp, Artificial Sequence
  Synthetic
tgcgttttgctggccggctgtctgaaaaggattggggccccggcccagagcgtgctgagcagctgcgtcttgctg

SEQ ID NO: 148861 - DNA, 75 bp, Artificial Sequence
  Synthetic
gtccctgatgttgattctcgtggcgccattttacgtcgccagtacaatctgtccacatcccctctcacatctact

SEQ ID NO: 148862 - DNA, 75 bp, Artificial Sequence
  Synthetic
gtgggctgtggttgcaccctgaggggctccttggtttgttccctcctttctcccctgggcatctttgggagtctg

SEQ ID NO: 148863 - DNA, 75 bp, Artificial Sequence
  Synthetic
gctccttggtttgttccctcctttctcccctgggcatctttgggagtctgcgaaccccttttgtggtgagagtac

SEQ ID NO: 148864 - DNA, 75 bp, Artificial Sequence
  Synthetic
acccacattatggctactgaagcatctaattatgcccagtatcgtgttgttcgtgccaccattcgatatcgcccc

SEQ ID NO: 148865 - DNA, 75 bp, Artificial Sequence
  Synthetic
ctctttgagaagtctggccgtgattacatccctggccgtcagctggagttttacgcccagtgtaggcgctggctc

SEQ ID NO: 148866 - DNA, 75 bp, Artificial Sequence
  Synthetic
agcccttgacatggggccaccctcgggtgccccctcaactaccggtgatgtctgggtgtttccgccgccctccga

SEQ ID NO: 148867 - DNA, 75 bp, Artificial Sequence
  Synthetic
agcatttgaagggtcggatgtcgaccctgctgaggaggcaactgtgagtatctctgggtcatatattgtaactgg

SEQ ID NO: 148868 - DNA, 75 bp, Artificial Sequence
  Synthetic
ctgatgttcgtattcttgtccagcctggtatagcttctgagttggtgattcctagtgaacgcctgcattaccgaa

SEQ ID NO: 148869 - DNA, 75 bp, Artificial Sequence
  Synthetic
gcggtcggcggctgttctgtcacccggaaccccggtcagtaagcctgctagcttgcctagtcttattacacctag

SEQ ID NO: 148870 - DNA, 75 bp, Artificial Sequence
  Synthetic
gcgttgcgtggtctcccccctgccgaccgcacctactgttttgatggattttcccgctgtgcttttgccgcagag

SEQ ID NO: 148871 - DNA, 75 bp, Artificial Sequence
  Synthetic
atcagggatggcgttcggttgagacctctggcgtcgctgaggaagaagcgacttctggccttgttatgctctgta

SEQ ID NO: 148872 - DNA, 75 bp, Artificial Sequence
  Synthetic
ggaggctatggcccgccatgggatgacacgtctatacgctgcactccatctccctcctgaggtgctgttaccacc

SEQ ID NO: 148873 - DNA, 75 bp, Artificial Sequence
  Synthetic
ctcggcctacttgatttcgcactcgagcttgagtttcgcaatttgacacctggcaacactaatacgcgcgtttct

SEQ ID NO: 148874 - DNA, 75 bp, Artificial Sequence
  Synthetic
aggtctcgccgcatatactctgtgtccacgtccgattatccatgctgtggcccctgactatagggttgagcagaa

SEQ ID NO: 148875 - DNA, 75 bp, Artificial Sequence
  Synthetic
aattgcgccgagggcctgatggtactgctgagttaactactactgctgccacacgctttatgaaagatcttcatt

SEQ ID NO: 148876 - DNA, 75 bp, Artificial Sequence
  Synthetic
ccacgtccgattatccatgctgtggcccctgactatagggttgagcagaaccccaagaggctagaggcggcatat

SEQ ID NO: 148877 - DNA, 75 bp, Artificial Sequence
  Synthetic
aaacctgttggccgcgatgttcagcggtggtacaccgcccctacccgtggccctgcagcaaattgccggcggtcc

SEQ ID NO: 148878 - DNA, 75 bp, Artificial Sequence
  Synthetic
ctgtttaatcttgctgatacgctcctcggcgggcttccgacagaattgatttcgtcggctggaggtcaattattc

SEQ ID NO: 148879 - DNA, 75 bp, Artificial Sequence
  Synthetic
ttaagtttcgatgcctgggagcgtaaccaccgcccgggcgatgaactttatcttactgagccggccgccgcctgg

SEQ ID NO: 148880 - DNA, 75 bp, Artificial Sequence
  Synthetic
accaccgcccgggcgatgaactttatcttactgagccggccgccgcctggtttgaggctaataagccaacccagc

SEQ ID NO: 148881 - DNA, 75 bp, Artificial Sequence
  Synthetic
cccggtcatagctgggagtctgctaaccccttctgcggggagagtaccctttatacccgtacctggtcggtatcg

SEQ ID NO: 148882 - DNA, 75 bp, Artificial Sequence
  Synthetic
acgacctttggcctgctgatgtcgctgaggcaatggcccgccacggcatgacccggttgtacgcagccctccatc

SEQ ID NO: 148883 - DNA, 75 bp, Artificial Sequence
  Synthetic
gtgccgaatgcggttggcgggtacgccatatccatctccttttggcctcagacgacaaccaccccgacctcggtc

SEQ ID NO: 148884 - DNA, 75 bp, Artificial Sequence
  Synthetic
gccgggcttgtgccggttgtgctatcaaccccggagtcgtccactatcagtttactgccggggtccctggctctg

SEQ ID NO: 148885 - DNA, 75 bp, Artificial Sequence
  Synthetic
gcgttttgctgctcacggcttatgacatacctccgtggcattagttacaaggtcaccgttggagcgcttgttgct

SEQ ID NO: 148886 - DNA, 75 bp, Artificial Sequence
  Synthetic
ccctcttgttgaaactgacacacctgtagttgctgatactttgccttcagtagctccagtatcccccgagcaaat

SEQ ID NO: 148887 - DNA, 75 bp, Artificial Sequence
  Synthetic
caaccccggagtcgtccactatcagtttactgccggggtccctggctctgggaagtctaggtccatacaacaggg

SEQ ID NO: 148888 - DNA, 75 bp, Artificial Sequence
  Synthetic
gacatgaattccatcacatctactgatgtccgtatccttgttcagcctggtatagcctctgagcttgtgattcct

SEQ ID NO: 148889 - DNA, 75 bp, Artificial Sequence
  Synthetic
gctagtgattgagcgggtccgggccgtaggatgtcactttgtacttctccttacagctgcacctgaaccgtcacc

SEQ ID NO: 148890 - DNA, 75 bp, Artificial Sequence
  Synthetic
accacatacggcggcacgtgttactgctggccggcgtgttgtgatagatgaggcaccctcgcttccaccgcattt

SEQ ID NO: 148891 - DNA, 75 bp, Artificial Sequence
  Synthetic
ccaagggcatgcgccggttggaggttgagcacgcccagaaatttattacaagactctacagctggttatttgaga

SEQ ID NO: 148892 - DNA, 75 bp, Artificial Sequence
  Synthetic
tgagcacgcccagaaatttattacaagactctacagctggttatttgagaagtctggtcgtgattacatccccgg

SEQ ID NO: 148893 - DNA, 75 bp, Artificial Sequence
  Synthetic
gctggccggcgtgttgtgatagatgaggcaccctcgcttccaccgcatttgctgttgcttcacatgcagcgagcc

SEQ ID NO: 148894 - DNA, 75 bp, Artificial Sequence
  Synthetic
atccgccctgagcttgccccgaccagttggtggcatgtcacccaccgttgccccgccgatgtgtgtgagctcata

SEQ ID NO: 148895 - DNA, 75 bp, Artificial Sequence
  Synthetic
cactgctagtgaccagattctgattgagaatgcagccggccaccgagtctgcatctctacctacactactaattt

SEQ ID NO: 148896 - DNA, 75 bp, Artificial Sequence
  Synthetic
gagaatgcagccggccaccgagtctgcatctctacctacactactaatttgggctccgggcccgtgtctatttct

SEQ ID NO: 148897 - DNA, 75 bp, Artificial Sequence
  Synthetic
gttggtggcatgtcacccaccgttgccccgccgatgtgtgtgagctcatacgtggagcttatccaaagatccaaa

SEQ ID NO: 148898 - DNA, 75 bp, Artificial Sequence
  Synthetic
gtggttagggcaggagtgcacctgcttcttggagccagctgagggtttgatcggtgatcatggccatgataatga

SEQ ID NO: 148899 - DNA, 75 bp, Artificial Sequence
  Synthetic
ggtcacggtcggtgcccttgtcgccaacgagggctggaacgcttccgaagatgcgctgactgctgtgatcactgc

SEQ ID NO: 148900 - DNA, 75 bp, Artificial Sequence
  Synthetic
ctaaagcggctaaccctggcgcaattaccgtccatgaggcccagggcgctacgtttactgagaccaccattatag

SEQ ID NO: 148901 - DNA, 75 bp, Artificial Sequence
  Synthetic
gcgccagcttgagaccctctatagggcactcaacatcccgcaagatattgctgctcgagcggcccgattaacagc

SEQ ID NO: 148902 - DNA, 75 bp, Artificial Sequence
  Synthetic
gcactcaacatcccgcaagatattgctgctcgagcggcccgattaacagccaccgttgagcttgttgctggccca

SEQ ID NO: 148903 - DNA, 75 bp, Artificial Sequence
  Synthetic
gattcaggattatgataatcaacatgagcaagaccgtcccactccttcccctgctccctcacgtcccttctcggt

SEQ ID NO: 148904 - DNA, 75 bp, Artificial Sequence
  Synthetic
aatgtgttattttggacgcccctggcctactgcgtgaggtcggtatttctgacataattgttaataacttctttc

SEQ ID NO: 148905 - DNA, 75 bp, Artificial Sequence
  Synthetic
gtaaaacccgggagtattgatttatttttgtttgtgcccccttctgctacgcttccttttatttttcttttctgc

SEQ ID NO: 148906 - DNA, 75 bp, Artificial Sequence
  Synthetic
cgcctttatagttggttgtttgagaagtctgggcgtgactacattcctggccgtcagctacagttttacgcccag

SEQ ID NO: 148907 - DNA, 75 bp, Artificial Sequence
  Synthetic
cctactgcgtgaggtcggtatttctgacataattgttaataacttctttctggccggcggtgaagtgggccacca

SEQ ID NO: 148908 - DNA, 75 bp, Artificial Sequence
  Synthetic
gccaacggccctgagcaatgtgttttgtcgtttgatgcctcccgccagtctatgggggccgggtcacatagcctc

SEQ ID NO: 148909 - DNA, 75 bp, Artificial Sequence
  Synthetic
tgccggagctttctccgtaaggctgcccacaagttctgttgttttatgcggtggcttggccaagagtgtacctgc

SEQ ID NO: 148910 - DNA, 75 bp, Artificial Sequence
  Synthetic
tgtcgtttgatgcctcccgccagtctatgggggccgggtcacatagcctcacttatgagcttacgcctgctggcc

SEQ ID NO: 148911 - DNA, 75 bp, Artificial Sequence
  Synthetic
accaaactacttatggatcttccaccaatcctatgtatgtttctgacactgtgacatttgttaatgtagcgaccg

SEQ ID NO: 148912 - DNA, 75 bp, Artificial Sequence
  Synthetic
cccacaagttctgttgttttatgcggtggcttggccaagagtgtacctgccttctccagcccattgaggggaggg

SEQ ID NO: 148913 - DNA, 75 bp, Artificial Sequence
  Synthetic
tcagagagtcatacataatgaattagaacagtactgccggtctcgggctggtcgttgcctggagattggggccca

SEQ ID NO: 148914 - DNA, 75 bp, Artificial Sequence
  Synthetic
aatcagtgcctaccaccagctggctgaggagctgggccatcgaccggccccggtggccgccgttctgcccccctg

SEQ ID NO: 148915 - DNA, 75 bp, Artificial Sequence
  Synthetic
cgggggaggtggcggccttttgctccgctctttacaggtataacagatttacccaacggcattcgcttaccggcg

SEQ ID NO: 148916 - DNA, 75 bp, Artificial Sequence
  Synthetic
tgggaggctggcactactaaagctggctacccttataattataacaccactgccagtgatcagattttaattgaa

SEQ ID NO: 148917 - DNA, 75 bp, Artificial Sequence
  Synthetic
cacggacatagtccactgccgtatggctgcccctagtcaacgtaaggcggtcctctcaacactcgtcggcaggta

SEQ ID NO: 148918 - DNA, 75 bp, Artificial Sequence
  Synthetic
tttctgggtcatatattatcactggtagccagctgcagcccctctaccaagcactcggcataccttccgacctcg

SEQ ID NO: 148919 - DNA, 75 bp, Artificial Sequence
  Synthetic
cgctctttacaggtataacagatttacccaacggcattcgcttaccggcggtctgtggttacatcccgaggggct

SEQ ID NO: 148920 - DNA, 75 bp, Artificial Sequence
  Synthetic
tagccagctgcagcccctctaccaagcactcggcataccttccgacctcgccgcgcgtgccagtcgacttactgc

SEQ ID NO: 148921 - DNA, 75 bp, Artificial Sequence
  Synthetic
gtacactcgtacctggtccacatccggcttttctagtgatttctcccctcctgaggcggccgcccctgcaccggc

SEQ ID NO: 148922 - DNA, 75 bp, Artificial Sequence
  Synthetic
cttcaccgatggcacccagctggaggccaatgggccagaacagtgtgtcctgtcttttgaccctactaaacaaac

SEQ ID NO: 148923 - DNA, 75 bp, Artificial Sequence
  Synthetic
cggaccagtccaagccaccacatgcgagctatatgaactggttgaagctatggtggagaagggccaggacggctc

SEQ ID NO: 148924 - DNA, 75 bp, Artificial Sequence
  Synthetic
tgacctttggccagccgatgtcgcggaggctatggcccgccacgggatgacacgcctatacgctgcactccacct

SEQ ID NO: 148925 - DNA, 75 bp, Artificial Sequence
  Synthetic
ggcttttctagtgatttctcccctcctgaggcggccgcccctgcaccggctgctgccccaggatcgccccccccc

SEQ ID NO: 148926 - DNA, 75 bp, Artificial Sequence
  Synthetic
gaggctatggcccgccacgggatgacacgcctatacgctgcactccaccttccccctgaggtgctgttgccacct

SEQ ID NO: 148927 - DNA, 75 bp, Artificial Sequence
  Synthetic
gccaatgggccagaacagtgtgtcctgtcttttgaccctactaaacaaactatggcagcaggcccgcatagtctt

SEQ ID NO: 148928 - DNA, 75 bp, Artificial Sequence
  Synthetic
cccggcgtggctgccccctctgctgctggggaggtgtctgccttctgctcggctctgtacaggttcaaccgttgt

SEQ ID NO: 148929 - DNA, 75 bp, Artificial Sequence
  Synthetic
ctggggaggtgtctgccttctgctcggctctgtacaggttcaaccgttgtgttcaacggcactctctcatcgggg

SEQ ID NO: 148930 - DNA, 75 bp, Artificial Sequence
  Synthetic
agtgcaggctacaaccatgatgtctctatactccgtgcgtggatccgcacgactaaaatagttggtgaccacccg

SEQ ID NO: 148931 - DNA, 75 bp, Artificial Sequence
  Synthetic
ctatactccgtgcgtggatccgcacgactaaaatagttggtgaccacccgctggtcatagagcgtgttcgggcta

SEQ ID NO: 148932 - DNA, 75 bp, Artificial Sequence
  Synthetic
tgctctggctgcggctaactccgctttggcgaatgctgtggtggtccggccgttcttgtcccgtgcccagactga

SEQ ID NO: 148933 - DNA, 75 bp, Artificial Sequence
  Synthetic
gttaacaatttcttcctttctggcggtcaggttggtcagcaccgcccgtcagtcataccacgcggcactattgac

SEQ ID NO: 148934 - DNA, 75 bp, Artificial Sequence
  Synthetic
accccttttgtggcgagagcaccctctacaccgggacctggtcggtttcgggctcttctagttgtttctcaccgc

SEQ ID NO: 148935 - DNA, 75 bp, Artificial Sequence
  Synthetic
ctatgaggagtcagtgttctctgcagccatctctggagcgggctccagtatggtctttgaaaatgatttttctga

SEQ ID NO: 148936 - DNA, 75 bp, Artificial Sequence
  Synthetic
ctaacccgggccaccgccctgggggtggcctctgtcatgccttttaccaacgctttcctgaggcgttctacccaa

SEQ ID NO: 148937 - DNA, 75 bp, Artificial Sequence
  Synthetic
agttatacataatgagctggagcagtattgccgcgctcgcgctggccgctgcctggaggtgggagcccacccaag

SEQ ID NO: 148938 - DNA, 75 bp, Artificial Sequence
  Synthetic
cgacggaagtgtacgtccgatctatatttggtcctggcggctccccgtccctgtttccgtcagcctgctccacaa

SEQ ID NO: 148939 - DNA, 75 bp, Artificial Sequence
  Synthetic
ctacaccgggacctggtcggtttcgggctcttctagttgtttctcaccgctcgagccttgtgctccgagtgtgct

SEQ ID NO: 148940 - DNA, 75 bp, Artificial Sequence
  Synthetic
gccatctctggagcgggctccagtatggtctttgaaaatgatttttctgagtttgatagtacccagaataacttc

SEQ ID NO: 148941 - DNA, 75 bp, Artificial Sequence
  Synthetic
agctctcgagccagccgcgcctccacccgactcagctgatagtagtattaatcctattccacctagttctcctgc

SEQ ID NO: 148942 - DNA, 75 bp, Artificial Sequence
  Synthetic
tttggtgccactttggatgaccaggcgttctgttgctcacggctcatgacatacctccgtggtattagctacaag

SEQ ID NO: 148943 - DNA, 75 bp, Artificial Sequence
  Synthetic
cccgactcagctgatagtagtattaatcctattccacctagttctcctgccgcgcctccggcgccggtgcagcct

SEQ ID NO: 148944 - DNA, 75 bp, Artificial Sequence
  Synthetic
gctaattgccgccgctccgcgttacgtggtctacctcctgtcgaccgtacctactgtttcgacgggttttcccgc

SEQ ID NO: 148945 - DNA, 75 bp, Artificial Sequence
  Synthetic
cgaaagagtctctgaaaggtttttggaagaagcactctggcgaacccggcaccctcctttggaacactatctgga

SEQ ID NO: 148946 - DNA, 75 bp, Artificial Sequence
  Synthetic
ctactgtttcgacgggttttcccgctgcgccttcgccgccgagactgggattgctttatactcattacatgacct

SEQ ID NO: 148947 - DNA, 75 bp, Artificial Sequence
  Synthetic
ctctttgagtctgagtgcacctggctggttaatgcatcgaaccctggccaccgccctggtggcggcctctgtcat

SEQ ID NO: 148948 - DNA, 75 bp, Artificial Sequence
  Synthetic
gagcttgtggaggccatggttgagaaaggccaggacggctctgcggttctggagctcgacttgtgcagccgcgat

SEQ ID NO: 148949 - DNA, 75 bp, Artificial Sequence
  Synthetic
tgaggttttgttaccacctggcacttatcataccacctcttatttgttgatccacgatggcgaccgcgccgtcgt

SEQ ID NO: 148950 - DNA, 75 bp, Artificial Sequence
  Synthetic
cctgcgctggctgcactattagtcctgggatcgtacactatcagttcactgccggggttccgggctcaggcaaat

SEQ ID NO: 148951 - DNA, 75 bp, Artificial Sequence
  Synthetic
gtctggccgcgattacatccccggccgccagctccagttttatgctcagtgccggcggtggctatccgcaggttt

SEQ ID NO: 148952 - DNA, 75 bp, Artificial Sequence
  Synthetic
cggcgttgtagtggccccgggcctcggtgcactccctgatgtcgtccggttcgccggtcgactgtccgagaagaa

SEQ ID NO: 148953 - DNA, 75 bp, Artificial Sequence
  Synthetic
gacttatgagggggacaccagtgcgggctataatcatgatgtgtcaatactacgtgcatggattcgcacaaccaa

SEQ ID NO: 148954 - DNA, 75 bp, Artificial Sequence
  Synthetic
cgccagctccagttttatgctcagtgccggcggtggctatccgcaggtttccatttagatcccagagtacttgtt

SEQ ID NO: 148955 - DNA, 75 bp, Artificial Sequence
  Synthetic
atttcctccgagggctgacgaatgttgcgcaggtttgtgttgatgttgtatcccgtgtctatggggttagccccg

SEQ ID NO: 148956 - DNA, 75 bp, Artificial Sequence
  Synthetic
tggttagggcaggaatgcacctgcttcttggagccagctgagggcttagttggcgaccaaggccatgacaatgag

SEQ ID NO: 148957 - DNA, 75 bp, Artificial Sequence
  Synthetic
agcccctgaaccatctcctatgccttatgtcccatacccccgttcaacagaggtatatgtcaggtctatatttgg

SEQ ID NO: 148958 - DNA, 75 bp, Artificial Sequence
  Synthetic
attgtacctaactgagccagccatagcttggttcgaggctaaccgacctaccctcccagccttgactataactga

SEQ ID NO: 148959 - DNA, 75 bp, Artificial Sequence
  Synthetic
gctcactttactgagactgttaagcctgtactggatcttaccaattctatcatacagaggttagaatgaataaca

SEQ ID NO: 148960 - DNA, 75 bp, Artificial Sequence
  Synthetic
agatccccgccattgattttgagcacgctggtctggtccccgcaatccgccctgagcttgcaccaacgacctggt

SEQ ID NO: 148961 - DNA, 75 bp, Artificial Sequence
  Synthetic
tcttggagccagctgagggcttagttggcgaccaaggccatgacaatgaggcttatgagggttctgaggtcgacc

SEQ ID NO: 148962 - DNA, 75 bp, Artificial Sequence
  Synthetic
gcttggttcgaggctaaccgacctaccctcccagccttgactataactgaagacacggcccgtacagcgaatttg

SEQ ID NO: 148963 - DNA, 75 bp, Artificial Sequence
  Synthetic
gctgcccgcgccaccggccggtcagccgtctggccgccgtcgtgggcggcgcagcggcggttccggcggtggttt

SEQ ID NO: 148964 - DNA, 75 bp, Artificial Sequence
  Synthetic
cacttaacatcccccatgatattgctgcccgagcagcccgactaacggctactgttgagctcgctgcaggcccag

SEQ ID NO: 148965 - DNA, 75 bp, Artificial Sequence
  Synthetic
taccaatttacggcgggtgtccccggctctggcaagtccaggtcgattcagcagggggatgtggatgtgatcgtg

SEQ ID NO: 148966 - DNA, 75 bp, Artificial Sequence
  Synthetic
gccgggtgctacggtctctgttctggaatgaaccggctatcggccagaagctagtcttcacgcaggccgctaaag

SEQ ID NO: 148967 - DNA, 75 bp, Artificial Sequence
  Synthetic
gctctggcaagtccaggtcgattcagcagggggatgtggatgtgatcgtggtgccaacccgtgagctccgtaatt

SEQ ID NO: 148968 - DNA, 75 bp, Artificial Sequence
  Synthetic
tggaatactgtctggaatatggcagttatagcccattgttatgagttccgtgacctaaaagttgcggcgtttaag

SEQ ID NO: 148969 - DNA, 75 bp, Artificial Sequence
  Synthetic
cactgctgtaatcactgctgcgtacctgactatttgccatcagcgctacctccgaactcaggccatatctaaagg

SEQ ID NO: 148970 - DNA, 75 bp, Artificial Sequence
  Synthetic
tgaatggtcctgagcaatgtgtcctatcgttcgatgcctcccgacagtctatgggggccgggtcgcacagcctca

SEQ ID NO: 148971 - DNA, 75 bp, Artificial Sequence
  Synthetic
ggggatgattctgttgtgctctgtagtgactatcggcagagccgtgatgcagctgccttgattgccggctgtggg

SEQ ID NO: 148972 - DNA, 75 bp, Artificial Sequence
  Synthetic
ttgacgaggccccttcactcccaccgcatctgcttttgttgcatatgcagcgggcctcttcggtccatctccttg

SEQ ID NO: 148973 - DNA, 75 bp, Artificial Sequence
  Synthetic
cgtcgatctaccccaactggggctgcgccgctaactgctgtttcacctgcgcctgactcagccccagttcctgat

SEQ ID NO: 148974 - DNA, 75 bp, Artificial Sequence
  Synthetic
atcgttcgatgcctcccgacagtctatgggggccgggtcgcacagcctcacttacgagctcacgcctgctggctt

SEQ ID NO: 148975 - DNA, 75 bp, Artificial Sequence
  Synthetic
ctccagttttatgcgcagtgccgccgttggctctccgccggcttccacttagatcctagagtccttgttttcgat

SEQ ID NO: 148976 - DNA, 75 bp, Artificial Sequence
  Synthetic
gggggaggtagcggctttttgcagtgccctctacaggtataacagattcacccagcggcattcgctgaccggcgg

SEQ ID NO: 148977 - DNA, 75 bp, Artificial Sequence
  Synthetic
tcctttgacttcatctgtcgcttctggtaccaaccttgttttgtatgccgccccacttaatcctctcctgccact

SEQ ID NO: 148978 - DNA, 75 bp, Artificial Sequence
  Synthetic
tcctttgacttcatctgtcgcttctggtaccaaccttgttttgtatgccgccccacttaatcctctcctgcctct

SEQ ID NO: 148979 - DNA, 75 bp, Artificial Sequence
  Synthetic
tcctttgacttcatctgtcgcttctggtaccaaccttgttttgtatgccgccccacttaatcctctcctgcccct

SEQ ID NO: 148980 - DNA, 75 bp, Artificial Sequence
  Synthetic
tcctttgacttcatctgtcgcttctggtaccaaccttgttttgtatgccgccccacttaatcctctcctgccgct

SEQ ID NO: 148981 - DNA, 75 bp, Artificial Sequence
  Synthetic
ctctgtgataccccgtggcaaccctgaccagaaccttgagaccttacaggccttcccgccgtcttgtcagatcag

SEQ ID NO: 148982 - DNA, 75 bp, Artificial Sequence
  Synthetic
ggtaccaaccttgttttgtatgccgccccacttaatcctctcctgccactccaagatggcactaatactcatatc

SEQ ID NO: 148983 - DNA, 75 bp, Artificial Sequence
  Synthetic
ggtaccaaccttgttttgtatgccgccccacttaatcctctcctgcctctccaagatggcactaatactcatatc

SEQ ID NO: 148984 - DNA, 75 bp, Artificial Sequence
  Synthetic
ggtaccaaccttgttttgtatgccgccccacttaatcctctcctgcccctccaagatggcactaatactcatatc

SEQ ID NO: 148985 - DNA, 75 bp, Artificial Sequence
  Synthetic
ggtaccaaccttgttttgtatgccgccccacttaatcctctcctgccgctccaagatggcactaatactcatatc

SEQ ID NO: 148986 - DNA, 75 bp, Artificial Sequence
  Synthetic
ccttcccgccgtcttgtcagatcagtgcttaccatcagctggctgaggagttaggccaccgcccggctcctgttg

SEQ ID NO: 148987 - DNA, 75 bp, Artificial Sequence
  Synthetic
gggcaggagtgtacttgcttcctggagccggctgagggcttaattggtgactgtggccatgataatgaggcctat

SEQ ID NO: 148988 - DNA, 75 bp, Artificial Sequence
  Synthetic
tacacccgcacctggtccacatctggtttttctagtgacttctctcctcctgaggcggccgccctcgcgccggct

SEQ ID NO: 148989 - DNA, 75 bp, Artificial Sequence
  Synthetic
ctgtggccatgataatgaggcctatgagggttctgaggtagaccccgccgagcctgcctaccttgatgtctctgg

SEQ ID NO: 148990 - DNA, 75 bp, Artificial Sequence
  Synthetic
ataacttgattgggatgctccagactattgctgatggtaaggcgcattttacagaaacagttaaacctgtccttg

SEQ ID NO: 148991 - DNA, 75 bp, Artificial Sequence
  Synthetic
agcctgcctaccttgatgtctctgggacctacgcagttcatggccgccagcttgaggctttataccgggcgctta

SEQ ID NO: 148992 - DNA, 75 bp, Artificial Sequence
  Synthetic
gtgtgctggtttttgagctcactgatatagtccactgccgtatggctgctccaagtcagcggaaggccgtcctct

SEQ ID NO: 148993 - DNA, 75 bp, Artificial Sequence
  Synthetic
aatgccgtcggcggctatgcaatttccatctctttctggccccagactacaactacccctacttctgttgatatg

SEQ ID NO: 148994 - DNA, 75 bp, Artificial Sequence
  Synthetic
tgcgattacagttcacgaagcccagggtgcaacattcaccgagaccacgattattgctacggcagacgcccgtgg

SEQ ID NO: 148995 - DNA, 75 bp, Artificial Sequence
  Synthetic
caggccgatgcggcacctgtaccgcttgcccctgaacccgttgggttgcccggtcctgctgaacccatgcccccc

SEQ ID NO: 148996 - DNA, 75 bp, Artificial Sequence
  Synthetic
ggtgcaacattcaccgagaccacgattattgctacggcagacgcccgtgggcttatccaatcctctagagcccat

SEQ ID NO: 148997 - DNA, 75 bp, Artificial Sequence
  Synthetic
atctctgatgccattgttaacaactttttcctctctggtggtcagattggccaacaccgcccatcagttataccg

SEQ ID NO: 148998 - DNA, 75 bp, Artificial Sequence
  Synthetic
ttttcctctctggtggtcagattggccaacaccgcccatcagttataccgcgcggtactattgataacaatgttg

SEQ ID NO: 148999 - DNA, 75 bp, Artificial Sequence
  Synthetic
tgtccaggctaccacgtgcgagttatacgaactggttgaagccatggtggaaaagggccaggacggctctgccgt

SEQ ID NO: 149000 - DNA, 75 bp, Artificial Sequence
  Synthetic
tacgaactggttgaagccatggtggaaaagggccaggacggctctgccgtcctggagcttgatctatgcaatcgc

SEQ ID NO: 149001 - DNA, 75 bp, Artificial Sequence
  Synthetic
ccaagtcagcggaaggccgtcctctcaacacttgtggggaggtatggccgtaagacgaaactgtatgaggcagct

SEQ ID NO: 149002 - DNA, 75 bp, Artificial Sequence
  Synthetic
agctcacccccgctggtctgcaggtcaggatatcttctaatggcctagactgtactgctgttttcccccccggcg

SEQ ID NO: 149003 - DNA, 75 bp, Artificial Sequence
  Synthetic
ccgccccaattgctgccgttctacctccctgtccagagcttgagcagggcctactttatatgccccaggaattga

SEQ ID NO: 149004 - DNA, 75 bp, Artificial Sequence
  Synthetic
gtggtgccgacggcacggccgagctcacaaccactgcagccacacgttttatgaaggatctgcatttcactggga

SEQ ID NO: 149005 - DNA, 75 bp, Artificial Sequence
  Synthetic
tgagctcacggatatagtgcactgccgcatggcagcacccagccaacgtaaggcggtcttgtcaactcttgttgg

SEQ ID NO: 149006 - DNA, 75 bp, Artificial Sequence
  Synthetic
acatttgggaatcggcaaatcctttttgtggtgagggtacactttacacccggacttggtctacatctggtttct

SEQ ID NO: 149007 - DNA, 75 bp, Artificial Sequence
  Synthetic
tttcatttgatgaagcccgccagtgcatgggtgccgggccgcatagtcttgtgtatgagctcacccccagtgggc

SEQ ID NO: 149008 - DNA, 75 bp, Artificial Sequence
  Synthetic
cgagctcggccccattaatgttaccacttgtgagctttatgagcttgtggaggctatggtagagaagggtcagga

SEQ ID NO: 149009 - DNA, 75 bp, Artificial Sequence
  Synthetic
ccggttgtctcagccaatggcgagccgactgttaagttatacacctccgttgagaatgcacagcaggataagggc

SEQ ID NO: 149010 - DNA, 75 bp, Artificial Sequence
  Synthetic
ggcttttgccgccccagctcctgatctgggtctgcccctagacactccctcttccgtcagcgacgtctgggtgct

SEQ ID NO: 149011 - DNA, 75 bp, Artificial Sequence
  Synthetic
acttgtgagctttatgagcttgtggaggctatggtagagaagggtcaggacggctctgcggtcttagagcttgat

SEQ ID NO: 149012 - DNA, 75 bp, Artificial Sequence
  Synthetic
gatcggcccaccccgtcgccggctccgtcccgccctttctcggtcctccgggccaatgatgtcttgtggctctcc

SEQ ID NO: 149013 - DNA, 75 bp, Artificial Sequence
  Synthetic
gcgcatggtaaagttgggcagggaatatctgcatggagtaagactttttgtgctctgttcggtccatggttccgc

SEQ ID NO: 149014 - DNA, 75 bp, Artificial Sequence
  Synthetic
ccccactacgcctaacccccctgttcataagccactctcgccaccaacgcctaagccccccgttcgtaagccgcc

SEQ ID NO: 149015 - DNA, 75 bp, Artificial Sequence
  Synthetic
ttgtgccggttgcactgttagccctgggattgtacattatcagtttactgccggggtcccgggttcaggtaagtc

SEQ ID NO: 149016 - DNA, 75 bp, Artificial Sequence
  Synthetic
aagggtgatgattcggtggtcctctgtaccgactaccgacagagtcgtaatgcggcaaccttaattgcaggctgt

SEQ ID NO: 149017 - DNA, 75 bp, Artificial Sequence
  Synthetic
tatctgcatggagtaagactttttgtgctctgttcggtccatggttccgcgctattgagaaggaaatcctggcag

SEQ ID NO: 149018 - DNA, 75 bp, Artificial Sequence
  Synthetic
cgtcccgccctttctcggtcctccgggccaatgatgtcttgtggctctccctgactgcagctgaatatgaccaga

SEQ ID NO: 149019 - DNA, 75 bp, Artificial Sequence
  Synthetic
aggctgtcgcccgttcccttgactggtccaaggttaccttagacggccggcctcttactactatccagcagtact

SEQ ID NO: 149020 - DNA, 75 bp, Artificial Sequence
  Synthetic
gttcgagtcagactgtgactggctggttaacgcatccaaccctggccaccgccctggtggcggcctctgccatgc

SEQ ID NO: 149021 - DNA, 75 bp, Artificial Sequence
  Synthetic
tgcgcgccacaagttacgccgagggcctgatggtactgccgagttgaccacgactgctgctacacgcttcatgaa

SEQ ID NO: 149022 - DNA, 75 bp, Artificial Sequence
  Synthetic
ctgcctgatgtagtgcgatttgctggtcggctgtctgaaaagaactggggccccggcccagagcgtgctgagcag

SEQ ID NO: 149023 - DNA, 75 bp, Artificial Sequence
  Synthetic
gtccaaggttaccttagacggccggcctcttactactatccagcagtactctaaaacattttatgtgttgccgct

SEQ ID NO: 149024 - DNA, 75 bp, Artificial Sequence
  Synthetic
agtccacatttcatgccgtcccggtccacatctgggacaggcttatgttgtttggtgcaacgttggatgatcaag

SEQ ID NO: 149025 - DNA, 75 bp, Artificial Sequence
  Synthetic
gaccccacgaccaattattcatgccgtggctcctgactataggattgagcagaacccaaagaggctggaggcggc

SEQ ID NO: 149026 - DNA, 75 bp, Artificial Sequence
  Synthetic
tgaccagattttgattgagaatgcagccggccaccgtgttgctatatctacctatacaactagccttggtgctgg

SEQ ID NO: 149027 - DNA, 75 bp, Artificial Sequence
  Synthetic
aggccccgaaggagtctttgcgaggtttctggaagaaacactccggtgaacctggtaccctgttatggaatactg

SEQ ID NO: 149028 - DNA, 75 bp, Artificial Sequence
  Synthetic
gtggctcctgactataggattgagcagaacccaaagaggctggaggcggcgtatcgtgagacctgctcccgcctc

SEQ ID NO: 149029 - DNA, 75 bp, Artificial Sequence
  Synthetic
ccctgtgtctgtttctgcggttggcgtacttgccccacactctgctttagctatgcttgaggataccactgatta

SEQ ID NO: 149030 - DNA, 75 bp, Artificial Sequence
  Synthetic
cgtaaccatcgcccaggcgacgagctctatcttactgagcccgctgctgcgtggtttgaggctaataagccaacc

SEQ ID NO: 149031 - DNA, 75 bp, Artificial Sequence
  Synthetic
attgccggctgtgggttgaagcttaaagtggactttaggcctatagggttatatgctggtgtggttgtagccccg

SEQ ID NO: 149032 - DNA, 75 bp, Artificial Sequence
  Synthetic
gtggtttgaggctaataagccaacccaaccagctttgacaattactgaagacaccgctcgcacggctaacctcgc

SEQ ID NO: 149033 - DNA, 75 bp, Artificial Sequence
  Synthetic
gggagtcttaattaattttccgctgtgcccccttctaagttttgttttatttcttttttctgcgtttcgcgctcc

SEQ ID NO: 149034 - DNA, 75 bp, Artificial Sequence
  Synthetic
cattctagatgcccctggtttgctgcgtgaggtcggcatatcagatgtgattgtcaataactttttccttgctgg

SEQ ID NO: 149035 - DNA, 75 bp, Artificial Sequence
  Synthetic
cgtgaggtcggcatatcagatgtgattgtcaataactttttccttgctggtggagaggtgggtcatcaccgcccc

SEQ ID NO: 149036 - DNA, 75 bp, Artificial Sequence
  Synthetic
tcagtttaccgccggggtacctggttccgggaagtctaggtctatacaacaaggggacgtcgatgttgtggttgt

SEQ ID NO: 149037 - DNA, 75 bp, Artificial Sequence
  Synthetic
actttctttgttctgccacttcgtggcaagctctctttctgggaggccggcactaccaaggctggctatccttac

SEQ ID NO: 149038 - DNA, 75 bp, Artificial Sequence
  Synthetic
cccccccgctgccccccgtcgtcgatctgccccagccggggctgcgccgctgactgctatatcaccagctcctga

SEQ ID NO: 149039 - DNA, 75 bp, Artificial Sequence
  Synthetic
gcttaccaccagctggctgaggagctaggccaccgcccggcccctgttgctgccgtcttgcccccttgtcccgag

SEQ ID NO: 149040 - DNA, 75 bp, Artificial Sequence
  Synthetic
caccgccggccggcgtgttgtgattgatgaagcaccctcgctcccgccacacctgctactacttcatatgcagag

SEQ ID NO: 149041 - DNA, 75 bp, Artificial Sequence
  Synthetic
actactaatctcggttccggtcctgtttctatctctgctgttggtgtcctcgcacctcactctgcgctggccgct

SEQ ID NO: 149042 - DNA, 75 bp, Artificial Sequence
  Synthetic
tacgtcatctgtcgcctcgggtaccaatttggttctctatgctgccccattgaacccacttttaccccttcagga

SEQ ID NO: 149043 - DNA, 75 bp, Artificial Sequence
  Synthetic
atagttcactgccgtatggctgccccaagccagcggaaggccgtcctttcaacactcgtggggaggtatggccgt

SEQ ID NO: 149044 - DNA, 75 bp, Artificial Sequence
  Synthetic
aatttggttctctatgctgccccattgaacccacttttaccccttcaggacggcaccaacacccatatcatggct

SEQ ID NO: 149045 - DNA, 75 bp, Artificial Sequence
  Synthetic
aggacgaaactgtatgaggcagcccattcagatgtccgtgagtccctagctaggtttattcctactatcggacct

SEQ ID NO: 149046 - DNA, 75 bp, Artificial Sequence
  Synthetic
taggtttattcctactatcggacctgttcaggccaccacatgtgagttatatgaactggtcgaggccatggtgga

SEQ ID NO: 149047 - DNA, 75 bp, Artificial Sequence
  Synthetic
ctttttggccccagacaaccactacccctacttctgttgatatgaattctattacttctactgatgttaggattt

SEQ ID NO: 149048 - DNA, 75 bp, Artificial Sequence
  Synthetic
tattgatttatttttccttgtgcctcccttcagttctgtctcttttatttctcttttctgcgtttcgcgctccct

SEQ ID NO: 149049 - DNA, 75 bp, Artificial Sequence
  Synthetic
tgctctcactgccgtgatcactgctgcttatcttaccatctgccaccagaggtacctccgcacccaagccatatc

SEQ ID NO: 149050 - DNA, 75 bp, Artificial Sequence
  Synthetic
tattgctacgggcactaaccttgtactttatgctgccccgcttagtcctttactaccgcttcaggatggcaccaa

SEQ ID NO: 149051 - DNA, 75 bp, Artificial Sequence
  Synthetic
ctttatgctgccccgcttagtcctttactaccgcttcaggatggcaccaatactcacatcatggctactgaagct

SEQ ID NO: 149052 - DNA, 75 bp, Artificial Sequence
  Synthetic
tatcttctacggcgacgcctatgaggagtcggtgtttgccgccgctgtgtctggggcggggtcttgtatggtgtt

SEQ ID NO: 149053 - DNA, 75 bp, Artificial Sequence
  Synthetic
accaccgcccctctaccataccccgcggcaatcccgaccagaacttggacaccctgcaggcgttcccaccatcct

SEQ ID NO: 149054 - DNA, 75 bp, Artificial Sequence
  Synthetic
tatgctatatctatttctttctggccccagacaaccaccactccaacgtctgttgatatgaattcaattacttcc

SEQ ID NO: 149055 - DNA, 75 bp, Artificial Sequence
  Synthetic
cacttaatgtcccacaagatatcgccgccagagcatcccagctgacggctactgttgagctcgtagcaagtccgg

SEQ ID NO: 149056 - DNA, 75 bp, Artificial Sequence
  Synthetic
cccagacaaccaccactccaacgtctgttgatatgaattcaattacttccactgatgtccgcatacttgttcaac

SEQ ID NO: 149057 - DNA, 75 bp, Artificial Sequence
  Synthetic
tgcgtctaatgttgaccatcgccctggcggtgggctttgccatgcattctaccagaggtaccccacctcctttga

SEQ ID NO: 149058 - DNA, 75 bp, Artificial Sequence
  Synthetic
cctgcccagagcttgagcagggcctactttacatgccacaagagctcacagtgtctgatagtgttctggtctttg

SEQ ID NO: 149059 - DNA, 75 bp, Artificial Sequence
  Synthetic
gtgtctgatagtgttctggtctttgagctcacggacatagtccactgccgaatggcggcccctagtcagcggaag

SEQ ID NO: 149060 - DNA, 75 bp, Artificial Sequence
  Synthetic
cctctggggtcgctgaggaagaggcgacttccggcttagttatgctttgtattcacgggtcacctgtgaactcct

SEQ ID NO: 149061 - DNA, 75 bp, Artificial Sequence
  Synthetic
accggtgtggccctttattctctgcatgacctctggccggccgatgttgcggaggctatggcccgccacgggatg

SEQ ID NO: 149062 - DNA, 75 bp, Artificial Sequence
  Synthetic
gacttccggcttagttatgctttgtattcacgggtcacctgtgaactcctacactaatacaccttatactggtgc

SEQ ID NO: 149063 - DNA, 75 bp, Artificial Sequence
  Synthetic
taaagctatatacatctgttgagaatgcgcagcaggataagggtatcaccatcccgcatgacatagacctcggtg

SEQ ID NO: 149064 - DNA, 75 bp, Artificial Sequence
  Synthetic
cagtgactaccgacagagtcgtaatgcagcagccctagttgcaggatgtgggcttaagctgaaggttgattatcg

SEQ ID NO: 149065 - DNA, 75 bp, Artificial Sequence
  Synthetic
tcgttattcgagtagcgcgcgacacaaactgcgccgagggcctgatggtaccgctgagctcactactactgccgc

SEQ ID NO: 149066 - DNA, 75 bp, Artificial Sequence
  Synthetic
ctcctgatccatgatggcgaccgtgctgttgtgacgtatgaaggtgatactagtgcaggttacaaccatgacgtc

SEQ ID NO: 149067 - DNA, 75 bp, Artificial Sequence
  Synthetic
gagtccttagggaggtttatccctaccatcggaccagttcaggccaccacatgtgagctgtatgaattagttgag

SEQ ID NO: 149068 - DNA, 75 bp, Artificial Sequence
  Synthetic
gtagtggcccctggcctaggaacactgcctgatgtagtgcgttttgccggccggctgtctgagaagaattggggc

SEQ ID NO: 149069 - DNA, 75 bp, Artificial Sequence
  Synthetic
acattctttcagaaggattgcaataaattcacaacaggcgagactatcgcccacggtaaagtgggtcagggtatc

SEQ ID NO: 149070 - DNA, 75 bp, Artificial Sequence
  Synthetic
aattcacaacaggcgagactatcgcccacggtaaagtgggtcagggtatctcggcctggagtaaaaccttctgtg

SEQ ID NO: 149071 - DNA, 75 bp, Artificial Sequence
  Synthetic
ctcggagggcttccgacagaattgatttcgtcggctggaggtcagttattctactcccgccccgttgtctcagcc

SEQ ID NO: 149072 - DNA, 75 bp, Artificial Sequence
  Synthetic
cgccagctccagttctacgctcaatgccgccggtggttatcagctggttttcacctggaccctcgtgtccttgta

SEQ ID NO: 149073 - DNA, 75 bp, Artificial Sequence
  Synthetic
atgctttcgaagagtcagtgttctctgcagccatttccggggcaggctctagtatggtctttgagaatgatttct

SEQ ID NO: 149074 - DNA, 75 bp, Artificial Sequence
  Synthetic
cattctatgtcctcccgctccgcggtaagttgtctttctgggaagctggcacgaccaaggctggctacccttata

SEQ ID NO: 149075 - DNA, 75 bp, Artificial Sequence
  Synthetic
ctgagtttgacagtacccaaaatgatttttccctcggccttgagtgtgttatcatggaagagtgcggcatgcccc

SEQ ID NO: 149076 - DNA, 75 bp, Artificial Sequence
  Synthetic
aagctgaacctgcacatcttgatgtgtcggggacctatgctgtccatgggcgccagcttgaggccctctataggg

SEQ ID NO: 149077 - DNA, 75 bp, Artificial Sequence
  Synthetic
agtcaggtcagcttggactttgcaggccccgaaagagtcattgaaaggcttttggaagaagcactctggtgagcc

SEQ ID NO: 149078 - DNA, 75 bp, Artificial Sequence
  Synthetic
ccactagcctgggtgccggccctacctccatttctgcggttggtgtgctagccccgcactcagctctcgccgttc

SEQ ID NO: 149079 - DNA, 75 bp, Artificial Sequence
  Synthetic
gccccgaaagagtcattgaaaggcttttggaagaagcactctggtgagcctggcacactcctttggaacactgtc

SEQ ID NO: 149080 - DNA, 75 bp, Artificial Sequence
  Synthetic
ctttggactggtctaaggtcactcttgatggccgcccacttactaccattcagcagtactctaagaccttttatg

SEQ ID NO: 149081 - DNA, 75 bp, Artificial Sequence
  Synthetic
cgcgtggcgcgattttgcgccggcagtataatctgtctacgtccccgcttacgtcatccgttgctgcgggcacaa

SEQ ID NO: 149082 - DNA, 75 bp, Artificial Sequence
  Synthetic
tacagggttgtgcttttcagtctactgtcgctgagcttcagcgccttaaaatgaaggtaggtaaaacccgggagt

SEQ ID NO: 149083 - DNA, 75 bp, Artificial Sequence
  Synthetic
cctaattaattcttcctgtacccccttcgcagttgcttttgtcttatttcttttttctgcttttcgcgctccctg

SEQ ID NO: 149084 - DNA, 75 bp, Artificial Sequence
  Synthetic
atgctggtgttgtggtggccccgggtctcggggcactccctgatgtcgtccggtttgccggccggctgtctgaga

SEQ ID NO: 149085 - DNA, 75 bp, Artificial Sequence
  Synthetic
tttctggcctcaaacaactactacccccacctctgttgacatgaactctattacttctactgatgttagaatcct

SEQ ID NO: 149086 - DNA, 75 bp, Artificial Sequence
  Synthetic
tgtgatttcctccgaaggcttacgaatgtcgcgcaggtctgtgttgatgttgtgtcccgtgtttacgaagtcagc

SEQ ID NO: 149087 - DNA, 75 bp, Artificial Sequence
  Synthetic
cagcgctggtattctgcccccacccgcggccctgcagctaactgccgccgttccgcgctacgtggtctcccccct

SEQ ID NO: 149088 - DNA, 75 bp, Artificial Sequence
  Synthetic
taatttgatgcaaccccggcaattggttttccgccctgaagtgctttggaatcaccctatccagagagttataca

SEQ ID NO: 149089 - DNA, 75 bp, Artificial Sequence
  Synthetic
cgtgctgttgtgacttatgaaggtgatactagtgcaggctacaatcatgacgtctccatacttcgtgcatggatt

SEQ ID NO: 149090 - DNA, 75 bp, Artificial Sequence
  Synthetic
tttttatcacctaagcggtcaatgccatggaggcccgccggtttattaaggctcctgggctcccaaccgcccttg

SEQ ID NO: 149091 - DNA, 75 bp, Artificial Sequence
  Synthetic
ggctatcggatgtcattttgtgctgctgcttaccgcggctccagagccttcgcctatgccctacgtcccttaccc

SEQ ID NO: 149092 - DNA, 75 bp, Artificial Sequence
  Synthetic
attcggccgtttttgtcccgaacacagacagacatcctcattaaccttatgcccccccggcaactgggcttccgg

SEQ ID NO: 149093 - DNA, 75 bp, Artificial Sequence
  Synthetic
tacaaaatctactttccatgctgtcccggttcacatctgggaccggctcatgctttttggtgccaccttggacga

SEQ ID NO: 149094 - DNA, 75 bp, Artificial Sequence
  Synthetic
gtctcggatacagtcacacttgttaacgtggctactggtgctcaggctgttgcccgctctcttgattggtctaag

SEQ ID NO: 149095 - DNA, 75 bp, Artificial Sequence
  Synthetic
gggcgttgccttgaggttggagcccaccctaggtccatcaatgataacccaaatgtcctgcaccggtgtttcctt

SEQ ID NO: 149096 - DNA, 75 bp, Artificial Sequence
  Synthetic
ttgtgccggctgtaccgtcaaacctgggattgtgcactatcagtttactgccggggttccgggttcgggcaagtc

SEQ ID NO: 149097 - DNA, 75 bp, Artificial Sequence
  Synthetic
tggcctctgagttggtcatcccgagcgagcgtctccactaccgcaatcagggttggcgctctgttgagacatcgg

SEQ ID NO: 149098 - DNA, 75 bp, Artificial Sequence
  Synthetic
cgagcgtctccactaccgcaatcagggttggcgctctgttgagacatcgggcgtggccgaggaagaggcaacatc

SEQ ID NO: 149099 - DNA, 75 bp, Artificial Sequence
  Synthetic
ccgcagcctatttgaccatctgtcatcagcgctacctccgcacccaggcgatatccaagggcatgcgccggttgg

SEQ ID NO: 149100 - DNA, 75 bp, Artificial Sequence
  Synthetic
aagttgtctttctgggaggctggcacgaccaaggccggttatccttacaactataatacaactgctagtgatcaa

SEQ ID NO: 149101 - DNA, 75 bp, Artificial Sequence
  Synthetic
gcgctgcgcggtttaccccctgctgaccgtacctactgttttgatgggttctctggctgccccttcgcggctgag

SEQ ID NO: 149102 - DNA, 75 bp, Artificial Sequence
  Synthetic
atatccaagggcatgcgccggttggaggttgagcatgctcagaaatttatcacaagactttatagctggttattt

SEQ ID NO: 149103 - DNA, 75 bp, Artificial Sequence
  Synthetic
gcttcttgactttgcactcgagcttgaattcaggaatttgacccctgggaacaccaacactcgtgtgtcccggta

SEQ ID NO: 149104 - DNA, 75 bp, Artificial Sequence
  Synthetic
agctcgtgccagccggcttgcagctaccgtagaagttgaagacacaaacggccgccttgtctgcaggacaacctt

SEQ ID NO: 149105 - DNA, 75 bp, Artificial Sequence
  Synthetic
ggcttccacctagaccccagagtccttgtttttgacgagtcagtgccctgccgctgtaggactttccttaagaag

SEQ ID NO: 149106 - DNA, 75 bp, Artificial Sequence
  Synthetic
cttcatgaaggacctacacttcaccgggacgaatggcgttggtgaggtgggccgtggcatagccctaactctgtt

SEQ ID NO: 149107 - DNA, 75 bp, Artificial Sequence
  Synthetic
tgcggtggttggggcaggagtgcacctgtttcttggaaccagctgagggcttaattggcgaccacggccacgata

SEQ ID NO: 149108 - DNA, 75 bp, Artificial Sequence
  Synthetic
tgaaggtaggtaaaacccgggagttttgattaattcctcctgtgcccccttcgtagtttccttatgctttatttc

SEQ ID NO: 149109 - DNA, 75 bp, Artificial Sequence
  Synthetic
ctactaaagtcaccggcgaccacccgctggtgatagagcgcgtccgcgctattggctgccattttgtgttgttac

SEQ ID NO: 149110 - DNA, 75 bp, Artificial Sequence
  Synthetic
gctggtgatagagcgcgtccgcgctattggctgccattttgtgttgttacttaccgcagcccccgaaccctcgcc

SEQ ID NO: 149111 - DNA, 75 bp, Artificial Sequence
  Synthetic
actattgctgagcttcagcgccttaaaatgaaggtaggtaagaccagggagtcttaattaattcctccttgtgcc

SEQ ID NO: 149112 - DNA, 75 bp, Artificial Sequence
  Synthetic
atgggcaccagcttgaggccctttacagggcactcaacattccgcatgatattgccgctcgagcagcccgattaa

SEQ ID NO: 149113 - DNA, 75 bp, Artificial Sequence
  Synthetic
cggaaaccacaattatagccacggctgatgccagaggccttatccagacatctcgagcccatgctatagttgcac

SEQ ID NO: 149114 - DNA, 75 bp, Artificial Sequence
  Synthetic
cagctactgttgagctcgctgcaggccccgaccgtctggagtgccgtaccgtgctcgggaataagactttccgga

SEQ ID NO: 149115 - DNA, 75 bp, Artificial Sequence
  Synthetic
cttcccgtcagcatgctccacaaaatctacctttcacgccgtccctgtccatatttgggatagacttatgctttt

SEQ ID NO: 149116 - DNA, 75 bp, Artificial Sequence
  Synthetic
gggcattgccataccgcatgacatagatttaggggattcccgtgtggttatccaggactatgataatcagcatga

SEQ ID NO: 149117 - DNA, 75 bp, Artificial Sequence
  Synthetic
gttctatcgttcgacgcctcccgccagtctatgggggccgggtcacatagcctcacttatgagctcacacctgcc

SEQ ID NO: 149118 - DNA, 75 bp, Artificial Sequence
  Synthetic
ctcccttactgctgctgagtatgatcaaaccacttatggctcatcaaccaaccctatgtatgtttcagacactgt

SEQ ID NO: 149119 - DNA, 75 bp, Artificial Sequence
  Synthetic
accctatgtatgtttcagacactgttacctttgttaatgtggccacaggggcccaggctgtcgcccgctccctcg

SEQ ID NO: 149120 - DNA, 75 bp, Artificial Sequence
  Synthetic
tacctttgttaatgtggccacaggggcccaggctgtcgcccgctccctcgactggtctaaggtcacattggatgg

SEQ ID NO: 149121 - DNA, 75 bp, Artificial Sequence
  Synthetic
ttctgctgctcgcggcttatgacttaccttcgcggtattagttataaagtcaccgttggtgccctcgtagctaac

SEQ ID NO: 149122 - DNA, 75 bp, Artificial Sequence
  Synthetic
cctcacttatgagctcacacctgccggtttgcaggttaagatttcatccaacggcctagactgcactgccatatt

SEQ ID NO: 149123 - DNA, 75 bp, Artificial Sequence
  Synthetic
cttgagcagggcctgttatatatgccacaggagcttacggtgtccgatagtgtgctggtttttgagctcacggat

SEQ ID NO: 149124 - DNA, 75 bp, Artificial Sequence
  Synthetic
ggaggctggcactaccaaagctgggtacccctataactataacaccactgctagcgatcagattttgatagagaa

SEQ ID NO: 149125 - DNA, 75 bp, Artificial Sequence
  Synthetic
ctagcgatcagattttgatagagaatgcagccggtcaccgtgtcgctatctccacctatactactagtcttggtg

SEQ ID NO: 149126 - DNA, 75 bp, Artificial Sequence
  Synthetic
gccaaccccttctgcggtgagggtaccttgtatacccgcacctggtccacatctggcttttctagtgacttctct

SEQ ID NO: 149127 - DNA, 75 bp, Artificial Sequence
  Synthetic
aggagtttcgtaaagaatgtggctactaagatttgctgctttatgaaatggcttggtcgggagtgcacttgtttc

SEQ ID NO: 149128 - DNA, 75 bp, Artificial Sequence
  Synthetic
taggtttattcccactatcggacccgtccaggccaccacttgtgagctatatgaattggttgaggctatggtaga

SEQ ID NO: 149129 - DNA, 75 bp, Artificial Sequence
  Synthetic
ttggctgtgcttgaagatactattgattaccccgcccgcgcccatacttttgatgatttctgtcctgagtgccgt

SEQ ID NO: 149130 - DNA, 75 bp, Artificial Sequence
  Synthetic
tgggtgttaccgccgcctttagaagagccccaggtggaagcgccgcttgcgcctcccgcccccgagcctgttagg

SEQ ID NO: 149131 - DNA, 75 bp, Artificial Sequence
  Synthetic
tgatgatttctgtcctgagtgccgtaatcttggcctacagggctgtgcctttcaatctactatcgctgaacttca

SEQ ID NO: 149132 - DNA, 75 bp, Artificial Sequence
  Synthetic
atggccgccgggccgtacagcctggattttacactgacctctgcgggccttgaggtgcattttacatctgccggc

SEQ ID NO: 149133 - DNA, 75 bp, Artificial Sequence
  Synthetic
agccccaggtggaagcgccgcttgcgcctcccgcccccgagcctgttaggttgcctagccctactaaacctaacc

SEQ ID NO: 149134 - DNA, 75 bp, Artificial Sequence
  Synthetic
catggaggcccaccagttcattaaggctcctggcattactactgccattgagcaggctgctctggctgcggccaa

SEQ ID NO: 149135 - DNA, 75 bp, Artificial Sequence
  Synthetic
cggggacctatattgtccacgggcagctgctggtggatttatatagggcactcaacgttccgcatgatattgtag

SEQ ID NO: 149136 - DNA, 75 bp, Artificial Sequence
  Synthetic
ctaagatttgctgctttatgaaatggcttggtcgggagtgcacttgtttcttggagcctgcagagggcttgatag

SEQ ID NO: 149137 - DNA, 75 bp, Artificial Sequence
  Synthetic
aggtgtatgcggggtcactgtttgagtcagattgtgactggctggtgaatgcctctaacccgggccatcgtcctg

SEQ ID NO: 149138 - DNA, 75 bp, Artificial Sequence
  Synthetic
gctgctggtggatttatatagggcactcaacgttccgcatgatattgtagctcgggccgcacgtttgtcagctac

SEQ ID NO: 149139 - DNA, 75 bp, Artificial Sequence
  Synthetic
cctgaagtgctttggaatcatcctatccagcgggttatacacaatgaactagaacagtactgccgggcccgtgct

SEQ ID NO: 149140 - DNA, 75 bp, Artificial Sequence
  Synthetic
gggcgccgggccgcacagccttgtgtatgagcttacccccagtgggctgcaagttcgggtctcatctaacggtct

SEQ ID NO: 149141 - DNA, 75 bp, Artificial Sequence
  Synthetic
gtatataccaggtccctgttggtcttagttttgatgcttgggagcgtaatcatcgacctggcgatgagctttacc

SEQ ID NO: 149142 - DNA, 75 bp, Artificial Sequence
  Synthetic
cagcggcactcgattgttggcgggctatggttgcacccagaggggttgctgggcctttttccacctttctccccg

SEQ ID NO: 149143 - DNA, 75 bp, Artificial Sequence
  Synthetic
ctcccgttgtgcttttgctgcagagaccggtgtggccctttactctttgcatgacctttggccagctgatgttgc

SEQ ID NO: 149144 - DNA, 75 bp, Artificial Sequence
  Synthetic
cccgcacggccaacctagcattagagattgatgctgccacagaggtcggtcgtgcctgtgccggctgcactatta

SEQ ID NO: 149145 - DNA, 75 bp, Artificial Sequence
  Synthetic
acacggttgtatgccgcactacatcttcctcctgaggtgctgctaccacccggcacctatcacacaacttcgtat

SEQ ID NO: 149146 - DNA, 75 bp, Artificial Sequence
  Synthetic
ttctctagtgatttctcgccgcctgaggcgaccgccggcgtaccccctcctgttgacctgccttccaaatcggct

SEQ ID NO: 149147 - DNA, 75 bp, Artificial Sequence
  Synthetic
cgtgcctgtgccggctgcactattagtcctgggattgtgcactatcagtttactgccggggtcccgggctcaggc

SEQ ID NO: 149148 - DNA, 75 bp, Artificial Sequence
  Synthetic
gggccaggatggctccgccgtccttgagctcgatctttgcaaccgtgatgtgtccaggatcaccttcttccagaa

SEQ ID NO: 149149 - DNA, 75 bp, Artificial Sequence
  Synthetic
cccgaacccactgcctataagccaccggcgcaacctccggttcgtaaccgtcgccttctctacatctatccagat

SEQ ID NO: 149150 - DNA, 75 bp, Artificial Sequence
  Synthetic
gctttgtacaggttcaaccgttgtgttcagcggcattctcttattgggggcttgtggtattaccctgaggggcta

SEQ ID NO: 149151 - DNA, 75 bp, Artificial Sequence
  Synthetic
ttacagagactattaaacctgtgcttgaccttacaaattctatcatacagcgggtggaatgaataacatgtcttg

SEQ ID NO: 149152 - DNA, 75 bp, Artificial Sequence
  Synthetic
agcatgctggcctggtccccgcaattcgccctgagcttgcaccaactagctggtggcatgttacacatcgctgtc

SEQ ID NO: 149153 - DNA, 75 bp, Artificial Sequence
  Synthetic
tatactcgcacctggtcggtgtcgggcttctctagttgtttttctccactcgagccacccgctccagaactgtca

SEQ ID NO: 149154 - DNA, 75 bp, Artificial Sequence
  Synthetic
tggtggcatgttacacatcgctgtccggccgatgtatgcgagctcatacgcggggcctatcccaaaatccagacc

SEQ ID NO: 149155 - DNA, 75 bp, Artificial Sequence
  Synthetic
tttcgaccataccaagtttattatgcgggatgggcttgctgcttacaccctttcaccccgtcccatcattcatgc

SEQ ID NO: 149156 - DNA, 75 bp, Artificial Sequence
  Synthetic
gcgttctgttgttcacgactcatgacttacctccgtggtattagctacaaggtcactgttggtgcgcttgttgct

SEQ ID NO: 149157 - DNA, 75 bp, Artificial Sequence
  Synthetic
tggtacagccgcttacccgctgttgggctcgggtatttaccaggtccctgtaggcccgagctttgatgcttggga

SEQ ID NO: 149158 - DNA, 75 bp, Artificial Sequence
  Synthetic
gtctctgaacaggctgcgccaccgccggattcggtcgatggcggtgctgctccggcaccactgagcacctccgct

SEQ ID NO: 149159 - DNA, 75 bp, Artificial Sequence
  Synthetic
ggctcgggtatttaccaggtccctgtaggcccgagctttgatgcttgggagcgaaaccatcgacccggcgatgaa

SEQ ID NO: 149160 - DNA, 75 bp, Artificial Sequence
  Synthetic
cgctacctccgtacccaggcgatatccaagggcatgcgccggttggaggttgagcatgcccagaaatttatcaca

SEQ ID NO: 149161 - DNA, 75 bp, Artificial Sequence
  Synthetic
tgcacttacccgccacacagagaagtgcgttattttggatgcccctggtttgctacgcgaggtcggtatatcaga

SEQ ID NO: 149162 - DNA, 75 bp, Artificial Sequence
  Synthetic
gacatggccccagctgatcaccccgtagccggggccggcccaccacctcaggccaatactagtccggcactgccc

SEQ ID NO: 149163 - DNA, 75 bp, Artificial Sequence
  Synthetic
tagccggggccggcccaccacctcaggccaatactagtccggcactgcccgccctgactataacagaggacgcgg

SEQ ID NO: 149164 - DNA, 75 bp, Artificial Sequence
  Synthetic
tacataaccttattggcatgctgcagaccattgccgatggcaaggcccattttacagagactattaaacctgtgc

SEQ ID NO: 149165 - DNA, 75 bp, Artificial Sequence
  Synthetic
caggccttcccgccatcttgccagattagtgcttaccatcagttggctgaggagctaggccaccgcccggctcct

SEQ ID NO: 149166 - DNA, 75 bp, Artificial Sequence
  Synthetic
accccggagttgttcgataccgattcactgcaggcgtccctgggtccggtaaatcaaggtccatacagcagggtg

SEQ ID NO: 149167 - DNA, 75 bp, Artificial Sequence
  Synthetic
cgggtaaattctgctgttttatgcggtggttagggcaggagtgcacctgcttcttggagccagccgagggtttag

SEQ ID NO: 149168 - DNA, 75 bp, Artificial Sequence
  Synthetic
cactgcaggcgtccctgggtccggtaaatcaaggtccatacagcagggtgatgttgatgtggtggttgtgcctac

SEQ ID NO: 149169 - DNA, 75 bp, Artificial Sequence
  Synthetic
tttcggggacttatgccgtccacgggcaccagcttgtagccctctatagggcacttaatgtcccacatgatattg

SEQ ID NO: 149170 - DNA, 75 bp, Artificial Sequence
  Synthetic
cggtcggcgtgttgtaatcgatgaggcaccatcccttccgccccacctgcttttattgcatatgcagcgtgcttc

SEQ ID NO: 149171 - DNA, 75 bp, Artificial Sequence
  Synthetic
attaccgcaatcaaggctggcgctctgttgagactacgggtgtggctgaggaggaggctacttctggtttggtga

SEQ ID NO: 149172 - DNA, 75 bp, Artificial Sequence
  Synthetic
ctagctaggttcatccctactatcggacctgtccaggccaccacgtgtgagttatatgaactggttgaggccatg

SEQ ID NO: 149173 - DNA, 75 bp, Artificial Sequence
  Synthetic
aatcagattcccgcgattgattttgagcatgctggccttgtccctgcaatccgtcctgagctcgctcccaccagc

SEQ ID NO: 149174 - DNA, 75 bp, Artificial Sequence
  Synthetic
tgcaggttaggatctcatctaacggtctggattgcactgctacattcccccccggcggtgcccctagcgccgcgc

SEQ ID NO: 149175 - DNA, 75 bp, Artificial Sequence
  Synthetic
caactggtgagaccatcgcccatggtaaggttggccagggtatatcggcctggagtaagaccttttgtgctctgt

SEQ ID NO: 149176 - DNA, 75 bp, Artificial Sequence
  Synthetic
ttccaaaaagactgtaacaagtttacaactggtgagaccatcgcccatggtaaggttggccagggtatatcggcc

SEQ ID NO: 149177 - DNA, 75 bp, Artificial Sequence
  Synthetic
tctggattgcactgctacattcccccccggcggtgcccctagcgccgcgccaggggaggtggcagccttctgtgg

SEQ ID NO: 149178 - DNA, 75 bp, Artificial Sequence
  Synthetic
gctgggcatcttccctccattctcccctgggcatatctgggagtctgctaaccccttttgcggggaggggacttt

SEQ ID NO: 149179 - DNA, 75 bp, Artificial Sequence
  Synthetic
agtcgtctcgggcgcatgccattgccgcgcttacccgacacacagagaaatgtgttatattggacgccccggggt

SEQ ID NO: 149180 - DNA, 75 bp, Artificial Sequence
  Synthetic
atgaggagtcggtgtttgccgcggccgtgtccggggcggggtcttgcatggtatttgagaatgatttttcggaat

SEQ ID NO: 149181 - DNA, 75 bp, Artificial Sequence
  Synthetic
cgcgcttacccgacacacagagaaatgtgttatattggacgccccggggttattacgcgaggtgggcatttcaga

SEQ ID NO: 149182 - DNA, 75 bp, Artificial Sequence
  Synthetic
agaattgatttcgtcggccgggggtcagttgttctactcccgccctgtcgtctcggccaatggcgagccgactgt

SEQ ID NO: 149183 - DNA, 75 bp, Artificial Sequence
  Synthetic
ctgaggcggccgcccctgcttcggctgctgccccggggctgccccatcctaccccgcctgttagtgatatttggg

SEQ ID NO: 149184 - DNA, 75 bp, Artificial Sequence
  Synthetic
ccctgatcgaaacctcgatatccttcaggcattccctccctcttgtcagattagtgcctaccaccagctggctga

SEQ ID NO: 149185 - DNA, 75 bp, Artificial Sequence
  Synthetic
caggcattccctccctcttgtcagattagtgcctaccaccagctggctgaggagcttggccaccggcccgcacct

SEQ ID NO: 149186 - DNA, 75 bp, Artificial Sequence
  Synthetic
ttcccgtgtggttatccaggactatgacaaccagcacgagcaggaccggcctactccatcacccgccccctctcg

SEQ ID NO: 149187 - DNA, 75 bp, Artificial Sequence
  Synthetic
ccccccccctccccccgtgcgtaagccatcaacacccccgccttctcgtacccgtcgcctcctctacacctatcc

SEQ ID NO: 149188 - DNA, 75 bp, Artificial Sequence
  Synthetic
gacagcatcttagtttttgagctaactgatatagtccactgccgtatggctgctcccagccagcggaaagccgtt

SEQ ID NO: 149189 - DNA, 75 bp, Artificial Sequence
  Synthetic
ctgatatagtccactgccgtatggctgctcccagccagcggaaagccgttctttcgacgctcgttgggcgatacg

SEQ ID NO: 149190 - DNA, 75 bp, Artificial Sequence
  Synthetic
ccatcgccctggaggtggcctctgtcatgcctttcatcaacgttttccagaggcgttttattggactgaattcat

SEQ ID NO: 149191 - DNA, 75 bp, Artificial Sequence
  Synthetic
gccctgtgcaggctacaacgtgcgagctctatgagctcgttgaggcgatggtggagaaaggccaggatgggtcag

SEQ ID NO: 149192 - DNA, 75 bp, Artificial Sequence
  Synthetic
tttcagaaagactgtaataagtttacaactggtgagacgattgcccacggcaaagtgggccaggggatatcagcc

SEQ ID NO: 149193 - DNA, 75 bp, Artificial Sequence
  Synthetic
cggcgcagccggcgcttaccataactgaggacacggctcgtacggccaacctggcactagagatcgacgccgcta

SEQ ID NO: 149194 - DNA, 75 bp, Artificial Sequence
  Synthetic
atgaggactcagtgttctctgcggctgtcactggtgccgggtctagcatggtttttgagaacgatttttcggaat

SEQ ID NO: 149195 - DNA, 75 bp, Artificial Sequence
  Synthetic
cgcacggcaaagttgggcaggggatatctgcgtggagcaagaccttctgtgccctgtttggcccatggttccgtg

SEQ ID NO: 149196 - DNA, 75 bp, Artificial Sequence
  Synthetic
attgctgagcttcagcgccttaaaatgaaggtaggtaaaacccgggagtcttaattaattcttcctgtaccccct

SEQ ID NO: 149197 - DNA, 75 bp, Artificial Sequence
  Synthetic
atcctgacgctaatgtcgacaccctggccgccttcccaccgtcttgccagattagtgccttccatcagctggctg

SEQ ID NO: 149198 - DNA, 75 bp, Artificial Sequence
  Synthetic
cgggctcgggcaagtcaaggtccatacaacagggagatgtcgatgtggtggttgtgcccacccgggagctccgta

SEQ ID NO: 149199 - DNA, 75 bp, Artificial Sequence
  Synthetic
acaacagggagatgtcgatgtggtggttgtgcccacccgggagctccgtaatagttggcgccgccggggtttcgc

SEQ ID NO: 149200 - DNA, 75 bp, Artificial Sequence
  Synthetic
taattagactgtaccatctggtacggtctgcctggatcttgcaggccccaaaggaatctctcaaagggttttgga

SEQ ID NO: 149201 - DNA, 75 bp, Artificial Sequence
  Synthetic
tcgatctgccccagctggggctgcgccgttgactgctatatcaccagcccctgacacagcccctgtacctgatgt

SEQ ID NO: 149202 - DNA, 75 bp, Artificial Sequence
  Synthetic
tgattcacgcggcgcaattttgcgtcggcagtataatctgtctacatctccgcttacgtcatctgtcgcttcagg

SEQ ID NO: 149203 - DNA, 75 bp, Artificial Sequence
  Synthetic
gtctgcctggatcttgcaggccccaaaggaatctctcaaagggttttggaagaagcactccggtgagcccggcac

SEQ ID NO: 149204 - DNA, 75 bp, Artificial Sequence
  Synthetic
aatcatggaggagtgtggcatgccgcagtggatgatccgactttatcatcttgttcgctccgcctgggtcctgca

SEQ ID NO: 149205 - DNA, 75 bp, Artificial Sequence
  Synthetic
gtttaaaggggacgactcggtggtcctctgtagtgattatcgccagagccgcttcgcggcggccttgattgcggg

SEQ ID NO: 149206 - DNA, 75 bp, Artificial Sequence
  Synthetic
ttggatgccattttgtgctgctgctcaccgcggcccccgagccgtcgcctatgccttatgtcccttaccctcgtt

SEQ ID NO: 149207 - DNA, 75 bp, Artificial Sequence
  Synthetic
gagttgtggttgcccctggccttggaacgttgcccgatgtcgtccggttcgccggtcggctgtcagaaaagaatt

SEQ ID NO: 149208 - DNA, 75 bp, Artificial Sequence
  Synthetic
aaatccagaccacgagccgtgtgctacggtccctgttttggaatgaaccggctatcggccagaagttggttttta

SEQ ID NO: 149209 - DNA, 75 bp, Artificial Sequence
  Synthetic
atcctggtccagcccggtatcgcctccgagctggttattcccagcgagcgccttcattatcgcaatcagggttgg

SEQ ID NO: 149210 - DNA, 75 bp, Artificial Sequence
  Synthetic
ctcaggtgtgtgctgatgttgtgtctcgtgtttatggggtgagccctggccttgtacataaccttattggcatgt

SEQ ID NO: 149211 - DNA, 75 bp, Artificial Sequence
  Synthetic
gggcctcattcagtcatcccgggcccatgctatagttgcacttacccgccacaccgagaagtgcgtcattttgga

SEQ ID NO: 149212 - DNA, 75 bp, Artificial Sequence
  Synthetic
cctgttaattcttacacaaatacaccttatactggagcactggggcttcttgattttgcactagagcttgaattt

SEQ ID NO: 149213 - DNA, 75 bp, Artificial Sequence
  Synthetic
tgcagaggttggaatgaataacatgtcttttgcatcgctcatggggtcaccatgcgctctggggctgttttgctg

SEQ ID NO: 149214 - DNA, 75 bp, Artificial Sequence
  Synthetic
ccgacagaattgatttcgtcggctgggggtcagctattttactcccgccctgtcgtctcagccaatggcgagccg

SEQ ID NO: 149215 - DNA, 75 bp, Artificial Sequence
  Synthetic
ggcctgctttacatgccacaagagcttaccgtgtctgatagtgtgctggtttttgagcttacggacatagtccac

SEQ ID NO: 149216 - DNA, 75 bp, Artificial Sequence
  Synthetic
acggcggcccgtgttaccgcgggccgccgtgttgtgattgatgaggccccatctctcccaccgcacttgttgctg

SEQ ID NO: 149217 - DNA, 75 bp, Artificial Sequence
  Synthetic
actgtaaagttatatacatctgttgagaatgcgcagcaggataagggtattaccattccacatgacatagacctc

SEQ ID NO: 149218 - DNA, 75 bp, Artificial Sequence
  Synthetic
tcgatctaccccaactggggctgcgccgttgactgccgtttcacctgcacctgatacggcgcctgtcccagatgt

SEQ ID NO: 149219 - DNA, 75 bp, Artificial Sequence
  Synthetic
ttatatgaggcagcacattcagatgtccgtgagtccctagccaggttcatccccactatcgggcccgttcaggcc

SEQ ID NO: 149220 - DNA, 75 bp, Artificial Sequence
  Synthetic
ccctaacttccactgttgctgcaggcactaaccttgttctgtacgctgcaccgcttaaccccctcctgcctcttc

SEQ ID NO: 149221 - DNA, 75 bp, Artificial Sequence
  Synthetic
gatctctgcaatcgtgatgtctcgcgcatcacatttttccaaaaggattgcaacaagtttacaactggtgagact

SEQ ID NO: 149222 - DNA, 75 bp, Artificial Sequence
  Synthetic
tgtatgtctcggatacagtcacatttgtcaacgtggccactggtgctcaggctgttgcccgctcccttgattggt

SEQ ID NO: 149223 - DNA, 75 bp, Artificial Sequence
  Synthetic
gtatatcggcctggagcaagaccttctgcgctttgtttggcccgtggttccgtgccattgagaaagaaatactgg

SEQ ID NO: 149224 - DNA, 75 bp, Artificial Sequence
  Synthetic
ctgaacttgttataccgagtgagcgcctccactatcgcaaccaaggtggcgctctgtggagacctctggtgtgcc

SEQ ID NO: 149225 - DNA, 75 bp, Artificial Sequence
  Synthetic
atcaaattttaattgagaacgcagctggtcaccgtgtcgctatctctacttacactaccagcctgggagccggcc

SEQ ID NO: 149226 - DNA, 75 bp, Artificial Sequence
  Synthetic
cctccactatcgcaaccaaggtggcgctctgtggagacctctggtgtgccgagagaggccacttccgggcttgtc

SEQ ID NO: 149227 - DNA, 75 bp, Artificial Sequence
  Synthetic
gtgtggttatggaggagtgcggcatgcctcaatggttaattaggttgtatcacctggtacggtcagcctggattt

SEQ ID NO: 149228 - DNA, 75 bp, Artificial Sequence
  Synthetic
tgcgcttgagattgagttccggaatttgactccggggaacactaacacccgagtctcccggtataccagtactgc

SEQ ID NO: 149229 - DNA, 75 bp, Artificial Sequence
  Synthetic
gaacaatactgtcgagctcgtgccggccgctgccttgaagtgggcgcccacccacgttcaattaacgacaacccc

SEQ ID NO: 149230 - DNA, 75 bp, Artificial Sequence
  Synthetic
gacgggaccgccgaactcacgactacggctgcaacacggtttatgaaagaccttcatttcaccggcatgaatggg

SEQ ID NO: 149231 - DNA, 75 bp, Artificial Sequence
  Synthetic
atgatcagactacttatggttcttccactaatcctatgtatgtttctgatactgtgacatttgttaatgtggcga

SEQ ID NO: 149232 - DNA, 75 bp, Artificial Sequence
  Synthetic
gagtcttaattaatttgctttgtacccccttcgcagttttcttttgctttatttctcttttctgctttccgcgct

SEQ ID NO: 149233 - DNA, 75 bp, Artificial Sequence
  Synthetic
tgaaggttgactatcgccccattgggctgtatgctggggtggtggtggcccctggcttggggacactgcctgatg

SEQ ID NO: 149234 - DNA, 75 bp, Artificial Sequence
  Synthetic
ctgtttgtgatttccttcgagggttgacgaacgttgcgcaggtctgtgttgatgttgtgtcccgtgtctatggag

SEQ ID NO: 149235 - DNA, 75 bp, Artificial Sequence
  Synthetic
tcccgcgttgttctccaggactatgataatcaacatgagcaggaccggcctactccgtcaccggccccctcccgc

SEQ ID NO: 149236 - DNA, 75 bp, Artificial Sequence
  Synthetic
gtatctcaacctacactactaatcttggctctggccctgtttctatttctgctgtcggtgtccttgcacctcact

SEQ ID NO: 149237 - DNA, 75 bp, Artificial Sequence
  Synthetic
acctttgatgatttctgccctgagtgccgtacactcggccttcagggctgtgcctttcagtcaactgttgctgag

SEQ ID NO: 149238 - DNA, 75 bp, Artificial Sequence
  Synthetic
tgcctttcagtcaactgttgctgagctgcagcgtcttaaaatgaaggtgggtaaaacccgggagtattgatttat

SEQ ID NO: 149239 - DNA, 75 bp, Artificial Sequence
  Synthetic
gtaaaacccgggagtattgatttattttgcttgtaccttccttctgatttgtttcttttatttccttcttctgcg

SEQ ID NO: 149240 - DNA, 75 bp, Artificial Sequence
  Synthetic
gcccgctctcttgattggtctaaagttactctggacgggcggccgcttaccaccatccagcagcactctaagatg

SEQ ID NO: 149241 - DNA, 75 bp, Artificial Sequence
  Synthetic
tacaacaccactgccagtgaccagattttgattgaaaatgcggccgaccatcgtgtcgctgtttctacttacacc

SEQ ID NO: 149242 - DNA, 75 bp, Artificial Sequence
  Synthetic
ccatctttgcagttggtgtgctcgccccgcattcagtcctagctgttcttgaggatactattgattaccccgctc

SEQ ID NO: 149243 - DNA, 75 bp, Artificial Sequence
  Synthetic
agtcaacatttcatgccgtccctgtgcatatatgggacagactcatgctcttcggtgcgaccctcgatgaccagg

SEQ ID NO: 149244 - DNA, 75 bp, Artificial Sequence
  Synthetic
gtacctgatgttgattcacgtggtgctattctgcgtcggcagtataatttgtccacgtccccgctcacgtcatct

SEQ ID NO: 149245 - DNA, 75 bp, Artificial Sequence
  Synthetic
taattaattcttgctgtatcttccttttacgctgattgtgttattttttatttttgcgttccgcgctccctggaa

SEQ ID NO: 149246 - DNA, 75 bp, Artificial Sequence
  Synthetic
ccctcgttatcgagcgggttagggccattggctgccactttgttctcttgctcacggcagccccggagccatcac

SEQ ID NO: 149247 - DNA, 75 bp, Artificial Sequence
  Synthetic
cattggctgccactttgttctcttgctcacggcagccccggagccatcacctatgccttatgttccttacccccg

SEQ ID NO: 149248 - DNA, 75 bp, Artificial Sequence
  Synthetic
tccgctttggcgaatgctgtggtggttcggccctttttatcccggctacagacagaaatactcattaatctgatg

SEQ ID NO: 149249 - DNA, 75 bp, Artificial Sequence
  Synthetic
gttgatatgaattccatcacttccactgatgttaggattttggtccagcccggtattgcctccgagttagtcatc

SEQ ID NO: 149250 - DNA, 75 bp, Artificial Sequence
  Synthetic
atcaaggctggcgctctgttgagaccacaggtgtggctgaggaggaggctacctccggtctggtaatgctttgca

SEQ ID NO: 149251 - DNA, 75 bp, Artificial Sequence
  Synthetic
tgttcggggccaccttggatgaccaagccttttgctgctcccgtttaatgacctaccttcgcggcattagctaca

SEQ ID NO: 149252 - DNA, 75 bp, Artificial Sequence
  Synthetic
agccttttgctgctcccgtttaatgacctaccttcgcggcattagctacaaggtcactgttggtacccttgtggc

SEQ ID NO: 149253 - DNA, 75 bp, Artificial Sequence
  Synthetic
gtcgctgccttgaagtgggtgcccacccacgttctattaatgacaaccctaatgtattgcatcgctgctttttaa

SEQ ID NO: 149254 - DNA, 75 bp, Artificial Sequence
  Synthetic
cacaggtgtggctgaggaggaggctacctccggtctggtaatgctttgcattcatggctctcctgttaactctta

SEQ ID NO: 149255 - DNA, 75 bp, Artificial Sequence
  Synthetic
cgggaacaccaacacccgtgtttcccggtataccagcacagcccgccatcggttgcgccgcggtgctgatgggac

SEQ ID NO: 149256 - DNA, 75 bp, Artificial Sequence
  Synthetic
ccctccgcgggctcccacctgtagaccggacgtattgttttgatggtttctctggctgtacatttgccgcggaga

SEQ ID NO: 149257 - DNA, 75 bp, Artificial Sequence
  Synthetic
ccggacgtattgttttgatggtttctctggctgtacatttgccgcggagacggggattgctctctattcgctgca

SEQ ID NO: 149258 - DNA, 75 bp, Artificial Sequence
  Synthetic
ggtgggtcgcggtatcgccctgacactgttcaatctcgctgatacgcttctaggtggtttaccgacagaattgat

SEQ ID NO: 149259 - DNA, 75 bp, Artificial Sequence
  Synthetic
ccccccggaggtattgctcccccctggtacttatcataccacttcatacctccttatccacgacggcgaccgtgc

SEQ ID NO: 149260 - DNA, 75 bp, Artificial Sequence
  Synthetic
ggtacttatcataccacttcatacctccttatccacgacggcgaccgtgcagtaatcacatatgagggggattcc

SEQ ID NO: 149261 - DNA, 75 bp, Artificial Sequence
  Synthetic
gtcggcgaccagggtcatgataacgaatcctatgaggggtccgatgttgaccctgctgagtccgccattagtgac

SEQ ID NO: 149262 - DNA, 75 bp, Artificial Sequence
  Synthetic
aatcctatgaggggtccgatgttgaccctgctgagtccgccattagtgacatctctgggtcctatgtcgtccctg

SEQ ID NO: 149263 - DNA, 75 bp, Artificial Sequence
  Synthetic
ctggttattgaacgggtccgggcagtgggttgtcattttgtgctcctccttacagctgcacctgaaccatcgcca

SEQ ID NO: 149264 - DNA, 75 bp, Artificial Sequence
  Synthetic
tgggttgtcattttgtgctcctccttacagctgcacctgaaccatcgccaatgccatatgttccatatccccgtt

SEQ ID NO: 149265 - DNA, 75 bp, Artificial Sequence
  Synthetic
tggctctccctcactgccgctgagtacgatcagactacgtatgggtcgtctaccaaccctatgtatgtctctgat

SEQ ID NO: 149266 - DNA, 75 bp, Artificial Sequence
  Synthetic
ccacagtaaaggtctcccaggtcgatgggcggatcgattgcgagacccttcttggtaacaaaaccttccgcacgt

SEQ ID NO: 149267 - DNA, 75 bp, Artificial Sequence
  Synthetic
agtctacattccatgccgtccctgtgcatatatgggacaggcttatgctctttggtgcgaccctcgacgaccaag

SEQ ID NO: 149268 - DNA, 75 bp, Artificial Sequence
  Synthetic
gatccgacctgagcttgccccaactagttggtggcacgttacacatcgctgtcctgccgatgtatgcgagctcat

SEQ ID NO: 149269 - DNA, 75 bp, Artificial Sequence
  Synthetic
tctcccgctccgcgggaagctgtccttttgggaggctggcacaactagggccggctacccatataactataacac

SEQ ID NO: 149270 - DNA, 75 bp, Artificial Sequence
  Synthetic
acgagggctggaacgcctccgaagacgcattgactgccgtcatcaccgcggcttatcttactatctgccatcaga

SEQ ID NO: 149271 - DNA, 75 bp, Artificial Sequence
  Synthetic
tcagaagttggtcttcacgcaggccgctaaggcagccaatcccggcgcaattactgtccatgaggcccagggcgc

SEQ ID NO: 149272 - DNA, 75 bp, Artificial Sequence
  Synthetic
ggcttgaccatcgggcgatttttgcccccggtgtttcaccccggtcaaaccccggcgaggtcaccgccttctgct

SEQ ID NO: 149273 - DNA, 75 bp, Artificial Sequence
  Synthetic
cgcattgactgccgtcatcaccgcggcttatcttactatctgccatcagagatatcttcgcacgcaggctatctc

SEQ ID NO: 149274 - DNA, 75 bp, Artificial Sequence
  Synthetic
ggcccagcgccattcgctgaccggtaacttatggttccatcctgaggggcttattggcctctttgccccgttttc

SEQ ID NO: 149275 - DNA, 75 bp, Artificial Sequence
  Synthetic
gtccggccgtgattacatccccggccgtcagctgcagttctatgctcaatgccggcggtggctatctgccggctt

SEQ ID NO: 149276 - DNA, 75 bp, Artificial Sequence
  Synthetic
cgtcagctgcagttctatgctcaatgccggcggtggctatctgccggcttccatcttgatccccgtgtgctcgtt

SEQ ID NO: 149277 - DNA, 75 bp, Artificial Sequence
  Synthetic
tgcattccagtccactattgctgagcttcagcgccttaaaatgaaggtaggcaaaacccgggagtcttaattaat

SEQ ID NO: 149278 - DNA, 75 bp, Artificial Sequence
  Synthetic
gcaaaacccgggagtcttaattaattcctttcgtgcccccttcgcagtcttcctttcagctttatttcttatttc

SEQ ID NO: 149279 - DNA, 75 bp, Artificial Sequence
  Synthetic
gcaaaacccgggagtcttaattaattcctttcgtgcccccttcgcagtcttcctttctgctttatttcttatttc

SEQ ID NO: 149280 - DNA, 75 bp, Artificial Sequence
  Synthetic
gcaaaacccgggagtcttaattaattcctttcgtgcccccttcgcagtcttcctttccgctttatttcttatttc

SEQ ID NO: 149281 - DNA, 75 bp, Artificial Sequence
  Synthetic
gcaaaacccgggagtcttaattaattcctttcgtgcccccttcgcagtcttcctttcggctttatttcttatttc

SEQ ID NO: 149282 - DNA, 75 bp, Artificial Sequence
  Synthetic
tggttggggcaggattgtacttgcttcctccagcccgttgaggggagggtcggtgaacagggctatgataatgaa

SEQ ID NO: 149283 - DNA, 75 bp, Artificial Sequence
  Synthetic
ctcctatacctagtagggccgccacgcctaccttggcggcccctctacccccccttgcaccggacccttcccctc

SEQ ID NO: 149284 - DNA, 75 bp, Artificial Sequence
  Synthetic
tcctccagcccgttgaggggagggtcggtgaacagggctatgataatgaagcatttgaggggtcggatgtcgatc

SEQ ID NO: 149285 - DNA, 75 bp, Artificial Sequence
  Synthetic
gcaaccccggcagttagttttccgccctgaggtgctttggaatcaccctattcagagagttatacacaatgaatt

SEQ ID NO: 149286 - DNA, 75 bp, Artificial Sequence
  Synthetic
cgctcagtatcccctccgaccttgctgctcaggctggccggcttactgctaccgtcgaagtctcggatgccgatg

SEQ ID NO: 149287 - DNA, 75 bp, Artificial Sequence
  Synthetic
ttcagagagttatacacaatgaattggaacagtactgccgtgctcgggctggtcgttgcttggaggttggagccc

SEQ ID NO: 149288 - DNA, 75 bp, Artificial Sequence
  Synthetic
tgctcaggctggccggcttactgctaccgtcgaagtctcggatgccgatggccgtctcacttgcaagaccattat

SEQ ID NO: 149289 - DNA, 75 bp, Artificial Sequence
  Synthetic
ctgaagtcttctggaaccacccgattcagcgagtcatacataatgagttggaacaatactgccgagcccgcgctg

SEQ ID NO: 149290 - DNA, 75 bp, Artificial Sequence
  Synthetic
gtcattcgatcctgccaagcagaccatggccgctggcccgcatagtcttagttatgccttaacatctgcgggcct

SEQ ID NO: 149291 - DNA, 75 bp, Artificial Sequence
  Synthetic
atggccgctggcccgcatagtcttagttatgccttaacatctgcgggcctcgaggtgcgtgtcgtttccgccgga

SEQ ID NO: 149292 - DNA, 75 bp, Artificial Sequence
  Synthetic
accggtgtggccctttactctttgcatgatctttggccagccgatgttgcggaggccatggcccgccatgggatg

SEQ ID NO: 149293 - DNA, 75 bp, Artificial Sequence
  Synthetic
gctctgtataggtttaatcgttgtgtccagcggcattctctcattggaggcttgtggtactatcccgaggcgcta

SEQ ID NO: 149294 - DNA, 75 bp, Artificial Sequence
  Synthetic
ggaggccatggcccgccatgggatgacacgtctttatgccgcacttcatctcccccctgaggtgctgttaccacc

SEQ ID NO: 149295 - DNA, 75 bp, Artificial Sequence
  Synthetic
ctggtattctgcccccacccgtggtccagcggccaactgccgccgttccgcgctacgcggattgccccctgtcga

SEQ ID NO: 149296 - DNA, 75 bp, Artificial Sequence
  Synthetic
tccagcggcattctctcattggaggcttgtggtactatcccgaggcgctagttggtctgttcccgccgtttgctc

SEQ ID NO: 149297 - DNA, 75 bp, Artificial Sequence
  Synthetic
gcaacccccgatggagacccatcaatatgtcgccgccacgggggttaatactgctagagaggcccaggctactgc

SEQ ID NO: 149298 - DNA, 75 bp, Artificial Sequence
  Synthetic
tgacctctggccttcggacgttgcggaggccatggcccgccatgggatgacgcgtttgtatgccgttctccatct

SEQ ID NO: 149299 - DNA, 75 bp, Artificial Sequence
  Synthetic
gaggccatggcccgccatgggatgacgcgtttgtatgccgttctccatctaccccctgaagttctgttaccacct

SEQ ID NO: 149300 - DNA, 75 bp, Artificial Sequence
  Synthetic
ggttttctagctgcttctccccacttgagccctgtgttttggatctgtcatctcctgttgaggctgatacaccag

SEQ ID NO: 149301 - DNA, 75 bp, Artificial Sequence
  Synthetic
tgagccctgtgttttggatctgtcatctcctgttgaggctgatacaccagcggccgttgatgtcttaccttcggt

SEQ ID NO: 149302 - DNA, 75 bp, Artificial Sequence
  Synthetic
tctatactccgtgcgtggatccgcacgactaaaatagttggtgaacacccgctggttatagagcgcgtgcgggct

SEQ ID NO: 149303 - DNA, 75 bp, Artificial Sequence
  Synthetic
agtgcgggctacaaccacgatgtgtccatactccgtgcatggatccgcactactaaaatagttggtgaccaccca

SEQ ID NO: 149304 - DNA, 75 bp, Artificial Sequence
  Synthetic
tcgacggaagtgtacgttcgatctatatttggccctggcggctccccgtctctgttcccatcagcctgctccaca

SEQ ID NO: 149305 - DNA, 75 bp, Artificial Sequence
  Synthetic
cccggcccaaccggatgtttccaccgcaccccctgtgccagcgcagcccgtaacccatccttctgggcctcatcg

SEQ ID NO: 149306 - DNA, 75 bp, Artificial Sequence
  Synthetic
cccggccctaccggatgtttccaccgcaccccctgtgccagcgcagcccgtaacccatccttctgggcctcatcg

SEQ ID NO: 149307 - DNA, 75 bp, Artificial Sequence
  Synthetic
cccggccccaccggatgtttccaccgcaccccctgtgccagcgcagcccgtaacccatccttctgggcctcatcg

SEQ ID NO: 149308 - DNA, 75 bp, Artificial Sequence
  Synthetic
cccggcccgaccggatgtttccaccgcaccccctgtgccagcgcagcccgtaacccatccttctgggcctcatcg

SEQ ID NO: 149309 - DNA, 75 bp, Artificial Sequence
  Synthetic
tatttggccctggcggctccccgtctctgttcccatcagcctgctccacaaaatctacttttcatgccgtcccgg

SEQ ID NO: 149310 - DNA, 75 bp, Artificial Sequence
  Synthetic
cactgcagcccctgagccgtctcctatgccttatgttccgtaccctcgctcaacagaggtgtatgttaggtccat

SEQ ID NO: 149311 - DNA, 75 bp, Artificial Sequence
  Synthetic
gcaccccctgtgccagcgcagcccgtaacccatccttctgggcctcatcggcggttgcttcacacttacccagat

SEQ ID NO: 149312 - DNA, 75 bp, Artificial Sequence
  Synthetic
catatctccgtggcattagctacaaagtcaccgttggtgcgcttgttgctaatgagggttggaatgcctctgagg

SEQ ID NO: 149313 - DNA, 75 bp, Artificial Sequence
  Synthetic
tgttacccatcgctgccctgcggatgtatgtgagttgatccgtggtgcataccccatgatccagaccactagccg

SEQ ID NO: 149314 - DNA, 75 bp, Artificial Sequence
  Synthetic
cgtcctggtggcggtctttgccatgcattctttcagcgattcccggagtcatttgaccccgccgaattcgtcatg

SEQ ID NO: 149315 - DNA, 75 bp, Artificial Sequence
  Synthetic
atgcccttactgcagtaatcaccgcagcctacttgactatttgtcatcagcgctaccttcgtacccaggcaatat

SEQ ID NO: 149316 - DNA, 75 bp, Artificial Sequence
  Synthetic
acttagcccctacctcctggtggcatgttacccatcgctgccctgcggatgtatgtgagttgatccgtggtgcat

SEQ ID NO: 149317 - DNA, 75 bp, Artificial Sequence
  Synthetic
tgtcgctcccgattatcgagttgaacataaccctaagaggcttgaggccgcttacagagagacctgctcccgtcg

SEQ ID NO: 149318 - DNA, 75 bp, Artificial Sequence
  Synthetic
gagcctgccgtcgggcagaaactagtgttcacccaggcggccaagcccgccaaccccggctcagtgacggtccac

SEQ ID NO: 149319 - DNA, 75 bp, Artificial Sequence
  Synthetic
tttggtgccactctagacgaccaggccttttgctgctcgcggcttatgacctacctccgtgggattagttataaa

SEQ ID NO: 149320 - DNA, 75 bp, Artificial Sequence
  Synthetic
gcgtacctgactatttgccatcagcgctacctccggactcaggctatttccaaaggtatgcgccggctagagatt

SEQ ID NO: 149321 - DNA, 75 bp, Artificial Sequence
  Synthetic
gctacctccggactcaggctatttccaaaggtatgcgccggctagagattgagcatgcccaaaagtttattacaa

SEQ ID NO: 149322 - DNA, 75 bp, Artificial Sequence
  Synthetic
ccgccagctccagttttatgctcagtgccggcggtggctatctgcaggtttccatctggaccctagagtgcttgt

SEQ ID NO: 149323 - DNA, 75 bp, Artificial Sequence
  Synthetic
gcgtaaccatcggcctggggatgagttgtacctgaccgagccagctatagcttggtttgaggctaaccggcctac

SEQ ID NO: 149324 - DNA, 75 bp, Artificial Sequence
  Synthetic
gccgccgttggctctcggctggtttccatttagatcctagagtccttgtttttgatgaggcggttccctgccgtt

SEQ ID NO: 149325 - DNA, 75 bp, Artificial Sequence
  Synthetic
gtggctaggacaggaatgcacttgcttcttggagccagctgagggcttagttggcgaccaaggccatgataacga

SEQ ID NO: 149326 - DNA, 75 bp, Artificial Sequence
  Synthetic
ggttggccgggcgtgcgctggctgccgtgttgaacccggcgtcgttcactaccagttcacggcgggtgttcctgg

SEQ ID NO: 149327 - DNA, 75 bp, Artificial Sequence
  Synthetic
ccatttagatcctagagtccttgtttttgatgaggcggttccctgccgttgccggagcttcctcaagaaggtcgc

SEQ ID NO: 149328 - DNA, 75 bp, Artificial Sequence
  Synthetic
ttcttggagccagctgagggcttagttggcgaccaaggccatgataacgaggcttacgagggttctgaagtcgac

SEQ ID NO: 149329 - DNA, 75 bp, Artificial Sequence
  Synthetic
cgtgttgaacccggcgtcgttcactaccagttcacggcgggtgttcctggctccggtaagtcacggtcgattcag

SEQ ID NO: 149330 - DNA, 75 bp, Artificial Sequence
  Synthetic
aggcgactgtggccatgacaatgaggcttacgaggggtctgaggtggaccccgccgagcctgctcatcttgatgt

SEQ ID NO: 149331 - DNA, 75 bp, Artificial Sequence
  Synthetic
aggagctcaccacctgtgatagtgtcgtaacatttgaattaacagatattgtgcactgccgcatggccgccccga

SEQ ID NO: 149332 - DNA, 75 bp, Artificial Sequence
  Synthetic
gcacttaacatcccccatgacattgctgctcgagcagcccggcttacagctactgttgagctcgttgcaggtcca

SEQ ID NO: 149333 - DNA, 75 bp, Artificial Sequence
  Synthetic
tatacaccccacactgcggcccgcgttactcgtggccgtagaattgtcatcgacgaggccccgtcgcttccaccg

SEQ ID NO: 149334 - DNA, 75 bp, Artificial Sequence
  Synthetic
gcttacgaggggtctgaggtggaccccgccgagcctgctcatcttgatgtttctggcacctatgcggtttacggc

SEQ ID NO: 149335 - DNA, 75 bp, Artificial Sequence
  Synthetic
tgctgccccggggctgccccaccctaccccgcctgctagtgatatttgggcgttaccaccgccctccgaggagtg

SEQ ID NO: 149336 - DNA, 75 bp, Artificial Sequence
  Synthetic
gctaatggccctgaacaatatgttttatcgtttgatgcttcccaccagtccatgggggccgggtcacatagcctc

SEQ ID NO: 149337 - DNA, 75 bp, Artificial Sequence
  Synthetic
actgtggaacttgttgccagcccaggtcgacttgagtgccgcacggtgctcgggaataagaccttccgcacatcg

SEQ ID NO: 149338 - DNA, 75 bp, Artificial Sequence
  Synthetic
cggcgatccggcctgagctcgttccgacaaagtggtggcacctcacccatagatgtccggctgatgtctgtgagt

SEQ ID NO: 149339 - DNA, 75 bp, Artificial Sequence
  Synthetic
gccccgcaacaagatggcaggttatgtcacgcatctgatgaagcgaattcagagaggcccagtaagaggtatctc

SEQ ID NO: 149340 - DNA, 75 bp, Artificial Sequence
  Synthetic
gtcgacttgagtgccgcacggtgctcgggaataagaccttccgcacatcgatagctgacggtgcccacctcgagg

SEQ ID NO: 149341 - DNA, 75 bp, Artificial Sequence
  Synthetic
ttactcgtggccgtagaattgtcatcgacgaggccccgtcgcttccaccgcacctgcttttgctgcatatgcagc

SEQ ID NO: 149342 - DNA, 75 bp, Artificial Sequence
  Synthetic
cctggtggcgcccctagcgccgcgccgggagaggtagcggctttttgcagtgccctctacaggtataacagattc

SEQ ID NO: 149343 - DNA, 75 bp, Artificial Sequence
  Synthetic
gacaaagtggtggcacctcacccatagatgtccggctgatgtctgtgagttgattcgcggcgcgtacccaaagat

SEQ ID NO: 149344 - DNA, 75 bp, Artificial Sequence
  Synthetic
gacaaagtggtggcacctcacccatagatgtccggctgatgtctgtgagttgattcgcggcgcgttcccaaagat

SEQ ID NO: 149345 - DNA, 75 bp, Artificial Sequence
  Synthetic
gacaaagtggtggcacctcacccatagatgtccggctgatgtctgtgagttgattcgcggcgcgtccccaaagat

SEQ ID NO: 149346 - DNA, 75 bp, Artificial Sequence
  Synthetic
gacaaagtggtggcacctcacccatagatgtccggctgatgtctgtgagttgattcgcggcgcgtgcccaaagat

SEQ ID NO: 149347 - DNA, 75 bp, Artificial Sequence
  Synthetic
cgtatgaacttgtccctgccggtctgcaggttagaatatcctccaatggcctggattgtaccgctacattctccc

SEQ ID NO: 149348 - DNA, 75 bp, Artificial Sequence
  Synthetic
caatccgctaccgccctctggtgcccaatgctgttggcggctatgcaatttctatttccttttggccccagacta

SEQ ID NO: 149349 - DNA, 75 bp, Artificial Sequence
  Synthetic
ggcggcaaaagccgccaaccctggtgcaattacagttcacgaagcccagggcgctacatttactgagaccaccat

SEQ ID NO: 149350 - DNA, 75 bp, Artificial Sequence
  Synthetic
agattgtaacaagttcaccacaggtgagaccattgctcatggtaaagtgggccagggcatctcggcctggagcaa

SEQ ID NO: 149351 - DNA, 75 bp, Artificial Sequence
  Synthetic
ccctgttgtgtcaccttccccccccccccctccccccgtgcgtaagccatcaacacccccgccttctcgtacccg

SEQ ID NO: 149352 - DNA, 75 bp, Artificial Sequence
  Synthetic
accccttctgtggggaggggaccttgtacacccgcacctggtccacatctggtttttctagtgatttctcccctc

SEQ ID NO: 149353 - DNA, 75 bp, Artificial Sequence
  Synthetic
gcaggttagaatatcctccaatggcctggattgtaccgctacattctcccctggtggggcgccaagcgcttcacc

SEQ ID NO: 149354 - DNA, 75 bp, Artificial Sequence
  Synthetic
gcaattacagttcacgaagcccagggcgctacatttactgagaccaccattatcgccacagcagatgcccgtggg

SEQ ID NO: 149355 - DNA, 75 bp, Artificial Sequence
  Synthetic
ccagggctccttcgcgaggttggtatctctgatgctattgttaataactttttcctctctggtggccagattggc

SEQ ID NO: 149356 - DNA, 75 bp, Artificial Sequence
  Synthetic
cttggtttgttcccccctttctcccctggacatctttgggagtctgcaaatcccttttgcggtgagagtacgctt

SEQ ID NO: 149357 - DNA, 75 bp, Artificial Sequence
  Synthetic
tctctgatgctattgttaataactttttcctctctggtggccagattggccagcaccgtccatcagtcataccac

SEQ ID NO: 149358 - DNA, 75 bp, Artificial Sequence
  Synthetic
tgctgccaccgccctctgaagggtctcaggtcgacgtggtatctgtcccacctgcccctgagcctgctggcccgc

SEQ ID NO: 149359 - DNA, 75 bp, Artificial Sequence
  Synthetic
tcaggtcgacgtggtatctgtcccacctgcccctgagcctgctggcccgcctggttccaccgaacccttaccccc

SEQ ID NO: 149360 - DNA, 75 bp, Artificial Sequence
  Synthetic
cccgacacggggttacctccgtgtaccccctcatctgttagtgatgtctgggcgtttccaccgccctctgagggg

SEQ ID NO: 149361 - DNA, 75 bp, Artificial Sequence
  Synthetic
ccccctcatctgttagtgatgtctgggcgtttccaccgccctctgaggggtcggcgattgtcccactgcccgagg

SEQ ID NO: 149362 - DNA, 75 bp, Artificial Sequence
  Synthetic
ttgcagaggagcttggccaccgcccggccccgattgctgctgtcttgcccccttgcccggagctcgaacagggct

SEQ ID NO: 149363 - DNA, 75 bp, Artificial Sequence
  Synthetic
caccggcacgcacccgccggctcctttacacctaccccgacggggctaaggtatatgctggctctctgtttgagt

SEQ ID NO: 149364 - DNA, 75 bp, Artificial Sequence
  Synthetic
gtatggcggcgcccagccagcgtaaggcagtcttgtcgacccttgtcggcaggtatggccgccgtacgaagctgt

SEQ ID NO: 149365 - DNA, 75 bp, Artificial Sequence
  Synthetic
ctgaatttattatgcgtgagggtcttgcagcatataccctgaccccgcgccctataattcacgcggtggcccccg

SEQ ID NO: 149366 - DNA, 75 bp, Artificial Sequence
  Synthetic
ttacacctaccccgacggggctaaggtatatgctggctctctgtttgagtcagattgtgattggttggttaatgc

SEQ ID NO: 149367 - DNA, 75 bp, Artificial Sequence
  Synthetic
ggcagtcttgtcgacccttgtcggcaggtatggccgccgtacgaagctgtatgaggccacccatgcagatgtccg

SEQ ID NO: 149368 - DNA, 75 bp, Artificial Sequence
  Synthetic
ttgccgacagaattgatttcgtcggctggaggtcagctcttttactcccgcccagtcgtctcggccaatggcgag

SEQ ID NO: 149369 - DNA, 75 bp, Artificial Sequence
  Synthetic
cgctgattttgttatgcgtgaaggcctagccgcatacactttgagcccgcgtccgatcatccatgccgtggcccc

SEQ ID NO: 149370 - DNA, 75 bp, Artificial Sequence
  Synthetic
cctatccgcttcttggctcaggtatatatcaggtccctgttagtcttagttttgatgcttgggagcgcaaccacc

SEQ ID NO: 149371 - DNA, 75 bp, Artificial Sequence
  Synthetic
ggctatggttgagaagggccaggatggctctgcggttctggagctagacttatgcagccgtgatgtatcccgaat

SEQ ID NO: 149372 - DNA, 75 bp, Artificial Sequence
  Synthetic
ctagccgcatacactttgagcccgcgtccgatcatccatgccgtggcccctgattacagggtcgagcagaacccc

SEQ ID NO: 149373 - DNA, 75 bp, Artificial Sequence
  Synthetic
atatcaggtccctgttagtcttagttttgatgcttgggagcgcaaccaccgccccggtgatgaactctacctgac

SEQ ID NO: 149374 - DNA, 75 bp, Artificial Sequence
  Synthetic
ggctctgcggttctggagctagacttatgcagccgtgatgtatcccgaataacattctttcaaaaagactgtaat

SEQ ID NO: 149375 - DNA, 75 bp, Artificial Sequence
  Synthetic
atctaccaggtccctgtgggattaagtttcgacgcctgggagcgtaaccaccgcccaggcgatgagctttatctg

SEQ ID NO: 149376 - DNA, 75 bp, Artificial Sequence
  Synthetic
tacagccaacctagcactagagatcgatgctaccacagaggtcggtcgcgcttgtaccggttgtactgttagccc

SEQ ID NO: 149377 - DNA, 75 bp, Artificial Sequence
  Synthetic
gccctgtttggtccatggttccgtgctattgaaaaggaaattcttgcggcactttcacctaatgtattttatggt

SEQ ID NO: 149378 - DNA, 75 bp, Artificial Sequence
  Synthetic
gtttcgacgcctgggagcgtaaccaccgcccaggcgatgagctttatctgaccgaaccagccgctgcttggttcg

SEQ ID NO: 149379 - DNA, 75 bp, Artificial Sequence
  Synthetic
actttcacctaatgtattttatggtgatgcatacgaagatacagttctagctgccgctgttgctggggcccttgg

SEQ ID NO: 149380 - DNA, 75 bp, Artificial Sequence
  Synthetic
gatgctaccacagaggtcggtcgcgcttgtaccggttgtactgttagccctggggttgtgcactatcagtttact

SEQ ID NO: 149381 - DNA, 75 bp, Artificial Sequence
  Synthetic
cctcactgctgctgagtatgatcaaaccacttatggctcatcaaccaaccctatgtatgtttcagacactgttac

SEQ ID NO: 149382 - DNA, 75 bp, Artificial Sequence
  Synthetic
tagactccgctaccgaggtgggtcgcgcttgtgccggctgtactgttaaccccggggttgttcattaccaattta

SEQ ID NO: 149383 - DNA, 75 bp, Artificial Sequence
  Synthetic
gagctccgtaataactggcgccgctggggctttgcggccttcacacctcatacggcggcccgtgttactatgggc

SEQ ID NO: 149384 - DNA, 75 bp, Artificial Sequence
  Synthetic
cgcttgtgccggctgtactgttaaccccggggttgttcattaccaatttactgccggggttcctggctctgggaa

SEQ ID NO: 149385 - DNA, 75 bp, Artificial Sequence
  Synthetic
aattatggaggagtgcggcatgccgcagtggatgattcggctttaccatcttgtccgctccgcttgggttttgca

SEQ ID NO: 149386 - DNA, 75 bp, Artificial Sequence
  Synthetic
catcccttccaccgcacctgctgctacatatgcagcgggcctcatcggtccatctcctcggtgacccaaatcaaa

SEQ ID NO: 149387 - DNA, 75 bp, Artificial Sequence
  Synthetic
tatagccacggccgacgccaggggcctcattcagtcatcccgggcccatgctatagttgcacttacccgccacac

SEQ ID NO: 149388 - DNA, 75 bp, Artificial Sequence
  Synthetic
tcgcggctttgccgcttttacaccccatacggcagctcgcgttactgctggccggcgtgtcgtgatagacgaggc

SEQ ID NO: 149389 - DNA, 75 bp, Artificial Sequence
  Synthetic
ttggaacatggcagtcatagcgcactgctatgaattccgtgacctaaaagttgcagcgtttaagggggatgattc

SEQ ID NO: 149390 - DNA, 75 bp, Artificial Sequence
  Synthetic
catacggcagctcgcgttactgctggccggcgtgtcgtgatagacgaggcaccttcgcttccaccacatctactg

SEQ ID NO: 149391 - DNA, 75 bp, Artificial Sequence
  Synthetic
tgaagttgccagggcaatgcgtgctcatggtatgcacactctatatgctgtgatgcatctgccagctgaggcgtt

SEQ ID NO: 149392 - DNA, 75 bp, Artificial Sequence
  Synthetic
gcaggccacgtttgtggccgacgccatggaggcccaccagttcctcaaggcccctggcgtcactactgctattga

SEQ ID NO: 149393 - DNA, 75 bp, Artificial Sequence
  Synthetic
agtggattttagacctatcgggctgtatgctggtgtcgttgtggccccgggtcttgggacccttcctgatgttgt

SEQ ID NO: 149394 - DNA, 75 bp, Artificial Sequence
  Synthetic
catgccggtttggttcccgcgatccgccccgagctcgcccctactagctggtggcacgttacccatcgttgcccc

SEQ ID NO: 149395 - DNA, 75 bp, Artificial Sequence
  Synthetic
ccgggttgcccgtgccacgatccgttaccgcccgctggtccccaacgctgtcggcggttacgccatctccatctc

SEQ ID NO: 149396 - DNA, 75 bp, Artificial Sequence
  Synthetic
gccccgagctcgcccctactagctggtggcacgttacccatcgttgccccgccgatgtgtgtgagctcatacgtg

SEQ ID NO: 149397 - DNA, 75 bp, Artificial Sequence
  Synthetic
ggccaccaccgcccttctgtgatacctcgcggtaaccctgatcagaaccttgggactctacaggccttcccgccg

SEQ ID NO: 149398 - DNA, 75 bp, Artificial Sequence
  Synthetic
gcaggctgctctagcagcggccaactccgccttggcgaatgctgtggtggtacggccgttcctctcccgcttaca

SEQ ID NO: 149399 - DNA, 75 bp, Artificial Sequence
  Synthetic
gagaccacaattatagccacggctgacgccaggggtcttatccagtcatcccgtgctcatgctatagtggcactt

SEQ ID NO: 149400 - DNA, 75 bp, Artificial Sequence
  Synthetic
ccttgccccgagcttgagcagggcctgctttacatgccacaagagcttaccgtgtctgatagtgtgctggttttt

SEQ ID NO: 149401 - DNA, 75 bp, Artificial Sequence
  Synthetic
aactggtttttacgcaggcggccaaggcggccaaccccggcgcaattaccgtccacgaagcccagggtgccacgt

SEQ ID NO: 149402 - DNA, 75 bp, Artificial Sequence
  Synthetic
acagcgagttattcataatgagcttgagcagtactgtcggtcccgttcggggcggtgccttgaggtgggcgctca

SEQ ID NO: 149403 - DNA, 75 bp, Artificial Sequence
  Synthetic
ggcggccaaccccggcgcaattaccgtccacgaagcccagggtgccacgtttacagagaccaccattatagctac

SEQ ID NO: 149404 - DNA, 75 bp, Artificial Sequence
  Synthetic
tcgtttcgcaggtctatggtgtcagtcccggtttagtacataacctaattggtatgctccagaccattgctgatg

SEQ ID NO: 149405 - DNA, 75 bp, Artificial Sequence
  Synthetic
gagcagtactgtcggtcccgttcggggcggtgccttgaggtgggcgctcacccgcggtcgatcaatgacaaccca

SEQ ID NO: 149406 - DNA, 75 bp, Artificial Sequence
  Synthetic
gggaggtgggtcatcaccgcccctctgtgataccccgtggcaaccctgataagaaccttgacaccctacaggcct

SEQ ID NO: 149407 - DNA, 75 bp, Artificial Sequence
  Synthetic
aaattcctatactaatacaccctataccggtgcccttgggctgctggactttgcccttgagcttgagtttcgcaa

SEQ ID NO: 149408 - DNA, 75 bp, Artificial Sequence
  Synthetic
tgttatccttgacgcccccggcctgctgcgcgaggtcggtatttctgatataattgtcaataattttttcctggc

SEQ ID NO: 149409 - DNA, 75 bp, Artificial Sequence
  Synthetic
cccgctgctaattgtcgcaggtctgccctccgtggcaacccgcctgtggaccgtacctactgctttgatgggttc

SEQ ID NO: 149410 - DNA, 75 bp, Artificial Sequence
  Synthetic
ctgcgcgaggtcggtatttctgatataattgtcaataattttttcctggccggtggtgaagtgggtcaccaccgc

SEQ ID NO: 149411 - DNA, 75 bp, Artificial Sequence
  Synthetic
ccctccgtggcaacccgcctgtggaccgtacctactgctttgatgggttctctaactgtgcttttgctgctgaga

SEQ ID NO: 149412 - DNA, 75 bp, Artificial Sequence
  Synthetic
ccgttttgcccccttgtcctgagctcgagcagggcttgttatatatgccacaagagctcacagtgtccgatagtg

SEQ ID NO: 149413 - DNA, 75 bp, Artificial Sequence
  Synthetic
agtgcctaccaccaactggctgaggaactgggccaccggccggccccagtggccgccgttttgcccccttgccct

SEQ ID NO: 149414 - DNA, 75 bp, Artificial Sequence
  Synthetic
cccggctttacgcgacccttcacctacctcctgaggtcctacttccacctggcacctaccacactacctcgtacc

SEQ ID NO: 149415 - DNA, 75 bp, Artificial Sequence
  Synthetic
agtccactgccgtatggctgccccaagtcagcggaaggctgttctttcaacgctcgtggggaggtatggccgtaa

SEQ ID NO: 149416 - DNA, 75 bp, Artificial Sequence
  Synthetic
aactgggccaccggccggccccagtggccgccgttttgcccccttgccctgagcttgagcaggggttactctaca

SEQ ID NO: 149417 - DNA, 75 bp, Artificial Sequence
  Synthetic
acctcctgaggtcctacttccacctggcacctaccacactacctcgtacctcttaattcatgatgggcggcgggc

SEQ ID NO: 149418 - DNA, 75 bp, Artificial Sequence
  Synthetic
tccacccgtcgtcgacctgccccagctggggcttcgccgttaacggctgtggctccggcccctgatactgcccca

SEQ ID NO: 149419 - DNA, 75 bp, Artificial Sequence
  Synthetic
ctcccagtcagcgtaaggcggtcctttcgacactcgtcggtaggtacggtcgccggacgaagctgtatgaagcgg

SEQ ID NO: 149420 - DNA, 75 bp, Artificial Sequence
  Synthetic
attgccactggcactaatcttgttctatatgctgccccgttgagccctctgcttccacttcaagatggaactaat

SEQ ID NO: 149421 - DNA, 75 bp, Artificial Sequence
  Synthetic
aactaaggtcaccggcagccacccgttggtcatcgagcgtgtgcgggctataggttgccattttgtcctgctgct

SEQ ID NO: 149422 - DNA, 75 bp, Artificial Sequence
  Synthetic
ttcgacactcgtcggtaggtacggtcgccggacgaagctgtatgaagcggcccactctgatgttcgtgagtcatt

SEQ ID NO: 149423 - DNA, 75 bp, Artificial Sequence
  Synthetic
catgatcgtaaatccatccggtcctgtattaaggccactagggtccggggttgttgtgcgcttgtcatcgagcgt

SEQ ID NO: 149424 - DNA, 75 bp, Artificial Sequence
  Synthetic
tatatgctgccccgttgagccctctgcttccacttcaagatggaactaatacccatattatggctactgaggctt

SEQ ID NO: 149425 - DNA, 75 bp, Artificial Sequence
  Synthetic
ttggtcatcgagcgtgtgcgggctataggttgccattttgtcctgctgctgacggccgcccccgaaccatcgccg

SEQ ID NO: 149426 - DNA, 75 bp, Artificial Sequence
  Synthetic
ggagaagggccaggacggctctgctgtgcttgagcttgacctttgtagccgggacgtctcgcgtattacattctt

SEQ ID NO: 149427 - DNA, 75 bp, Artificial Sequence
  Synthetic
atgctatatctatttctttctggccccagacaacaactacccccacatctgttgatatgaactctatcacctcta

SEQ ID NO: 149428 - DNA, 75 bp, Artificial Sequence
  Synthetic
ctttttccatctgcctgctccactaagtcaacattccacgctgtgccggtacacatctgggataggctcatgttg

SEQ ID NO: 149429 - DNA, 75 bp, Artificial Sequence
  Synthetic
ttggaacatggcaatcatagcacattgctacgagttccgtgactttcgtgttgctgcctttaagggtgatgattc

SEQ ID NO: 149430 - DNA, 75 bp, Artificial Sequence
  Synthetic
gtgcttgagcttgacctttgtagccgggacgtctcgcgtattacattctttcagaaggactgtaataagtttaca

SEQ ID NO: 149431 - DNA, 75 bp, Artificial Sequence
  Synthetic
gtcggtgtttgctgctgctgtgtccggggcggggtcttgtatggtgtttgaaaatgacttttcggaatttgacag

SEQ ID NO: 149432 - DNA, 75 bp, Artificial Sequence
  Synthetic
ccagacaacaactacccccacatctgttgatatgaactctatcacctctactgatgtccgaatccttgttcaacc

SEQ ID NO: 149433 - DNA, 75 bp, Artificial Sequence
  Synthetic
ggcccgtggttccgcgccattgagaaggagattctggctctgctcccgcctaacatcttttatggcgatgcctat

SEQ ID NO: 149434 - DNA, 75 bp, Artificial Sequence
  Synthetic
ttctggtgtcgcggaggaggaggccacctccggccttgtcatgctctgcatccatggatcacccgtgaactccta

SEQ ID NO: 149435 - DNA, 75 bp, Artificial Sequence
  Synthetic
atgaaggctggaatgcgtctgaggacgctctgactgcggttatcactgccgcctatttaaccatctgccaccaga

SEQ ID NO: 149436 - DNA, 75 bp, Artificial Sequence
  Synthetic
acctccggccttgtcatgctctgcatccatggatcacccgtgaactcctacactaatacaccctatactggtgcc

SEQ ID NO: 149437 - DNA, 75 bp, Artificial Sequence
  Synthetic
gttgtatcacttggtccgatcagcttggatattacaggcgccgaaggagtctcttaaaggtttttggaagaagca

SEQ ID NO: 149438 - DNA, 75 bp, Artificial Sequence
  Synthetic
ctttgagaacgacttttctgagttcgatagtacccaaaacaacttttctcttggtcttgagtgtgtgattatgga

SEQ ID NO: 149439 - DNA, 75 bp, Artificial Sequence
  Synthetic
cgctctgactgcggttatcactgccgcctatttaaccatctgccaccagaggtacctgcgcacccaggcaatatc

SEQ ID NO: 149440 - DNA, 75 bp, Artificial Sequence
  Synthetic
cgctattcgagtagcgcacgccacaagttacgccgtgggcccgatggtactgctgaattgactactactgctgct

SEQ ID NO: 149441 - DNA, 75 bp, Artificial Sequence
  Synthetic
gtccggcagagattacatcccgggccggcagctgcagttctacgcccagtgccgtcgctggctgtcggccggttt

SEQ ID NO: 149442 - DNA, 75 bp, Artificial Sequence
  Synthetic
cggcagctgcagttctacgcccagtgccgtcgctggctgtcggccggtttccaccttgacccgcgcgttcttgtg

SEQ ID NO: 149443 - DNA, 75 bp, Artificial Sequence
  Synthetic
tgatttccgggttgctgcctttaggggtgatgattcggtggtcctctgtagtgactaccgacagagtcgtaatgc

SEQ ID NO: 149444 - DNA, 75 bp, Artificial Sequence
  Synthetic
agttacgccgtgggcccgatggtactgctgaattgactactactgctgctactcgtttcatgaaggatcttcatt

SEQ ID NO: 149445 - DNA, 75 bp, Artificial Sequence
  Synthetic
tggctcggtcaagagtgcacgtgcttcctccagcctgtagagggccgtattggagagcagggttatgataatgaa

SEQ ID NO: 149446 - DNA, 75 bp, Artificial Sequence
  Synthetic
tcctccagcctgtagagggccgtattggagagcagggttatgataatgaagcttatgaaggatctgatgtagacc

SEQ ID NO: 149447 - DNA, 75 bp, Artificial Sequence
  Synthetic
ctgtagtgactaccgtcaaagtcgtaatgcggccgccctaatagccggttgtgggttgaagttgaaggttgatta

SEQ ID NO: 149448 - DNA, 75 bp, Artificial Sequence
  Synthetic
ctccgccttggcgaatgctgtggtggtccggccttttctttcccggctacagacagagattctcataaacttgat

SEQ ID NO: 149449 - DNA, 75 bp, Artificial Sequence
  Synthetic
ccgccccataggtctgtacgccggcgttgtagtagctccgggcctcggggcactccctgacgtcgtccggtttgc

SEQ ID NO: 149450 - DNA, 75 bp, Artificial Sequence
  Synthetic
cgcttgggctgcccgacgacctggctgctcgcgccagccggcttacagctacagtagaggttgatgacactgatg

SEQ ID NO: 149451 - DNA, 75 bp, Artificial Sequence
  Synthetic
tgctcgcgccagccggcttacagctacagtagaggttgatgacactgatgggcacttcacttgtcggacggtctt

SEQ ID NO: 149452 - DNA, 75 bp, Artificial Sequence
  Synthetic
ccccagccccttcacgccctttttctgttcttcgtgccaatgatgtgctctggctttcgctcacagctgctgagt

SEQ ID NO: 149453 - DNA, 75 bp, Artificial Sequence
  Synthetic
tgcgcagtctgttcagcgctggcgggaacaccggcccgttaggccctccccctctattatgtgagaaggcccggt

SEQ ID NO: 149454 - DNA, 75 bp, Artificial Sequence
  Synthetic
cgagcagtactgccgagcccgagccggccgctgccttgaggtgggtgcccacccatggtctattaatgacaaccc

SEQ ID NO: 149455 - DNA, 75 bp, Artificial Sequence
  Synthetic
ggccgctgccttgaggtgggtgcccacccatggtctattaatgacaaccctaatgtcctgcaccgctgctttctt

SEQ ID NO: 149456 - DNA, 75 bp, Artificial Sequence
  Synthetic
ggggatctcggcatggagtaagaccttctgtgcgcttttcggcccctggttccgcgctattgagaaagagatcct

SEQ ID NO: 149457 - DNA, 75 bp, Artificial Sequence
  Synthetic
atcatttgattcggccaagcaatgtatggcagcaggcgcctataatctaagttatgcacagacatctgccggact

SEQ ID NO: 149458 - DNA, 75 bp, Artificial Sequence
  Synthetic
tgttcttcgtgccaatgatgtgctctggctttcgctcacagctgctgagtatgatcagaccacttatggttcttc

SEQ ID NO: 149459 - DNA, 75 bp, Artificial Sequence
  Synthetic
cctggattggtctaaagttactcttgatgggcgcccgcttactactattcagcagtattctaaaaccttttatgt

SEQ ID NO: 149460 - DNA, 75 bp, Artificial Sequence
  Synthetic
ccagcccctgacacagcccctgtacctgatgttgattcacgtggtgctattctgcgtcggcagtataatttgtcc

SEQ ID NO: 149461 - DNA, 75 bp, Artificial Sequence
  Synthetic
gcccttcgtggacttccacctgctgatcggacgtattgttttgacggcttttcaggctgtacttttgctgctgag

SEQ ID NO: 149462 - DNA, 75 bp, Artificial Sequence
  Synthetic
attttaccgagactgttaagcctgtgttggatcttacgaactcaatcatacagaggctggaatgaataacatgtt

SEQ ID NO: 149463 - DNA, 75 bp, Artificial Sequence
  Synthetic
atcggacgtattgttttgacggcttttcaggctgtacttttgctgctgagacaggtattgctctttattcattgc

SEQ ID NO: 149464 - DNA, 75 bp, Artificial Sequence
  Synthetic
gcactctaccggttcaaccgttgtgttcagcgtcactcggtcgctggcgggctgtggttctatcctgaggggttg

SEQ ID NO: 149465 - DNA, 75 bp, Artificial Sequence
  Synthetic
tactgctagtgatcagatcttgattgagaatgcagccggtcaccgtgtttgcatctcaacctatactactaatct

SEQ ID NO: 149466 - DNA, 75 bp, Artificial Sequence
  Synthetic
atggcagcaggcgcctataatctaagttatgcacagacatctgccggacttgaagtgcatttggtctgtgcaggc

SEQ ID NO: 149467 - DNA, 75 bp, Artificial Sequence
  Synthetic
atatcatggctactgaggcatccaactatgctcagtaccgggtcgttcgagctacgatccgctaccgcccgctgg

SEQ ID NO: 149468 - DNA, 75 bp, Artificial Sequence
  Synthetic
tccctccagaggtgctgcttcctcctggtacttaccacaccacctcgtatcttttaattcatgacggagaccgtg

SEQ ID NO: 149469 - DNA, 75 bp, Artificial Sequence
  Synthetic
tggtacttaccacaccacctcgtatcttttaattcatgacggagaccgtgcagtaattacgtacgagggggattc

SEQ ID NO: 149470 - DNA, 75 bp, Artificial Sequence
  Synthetic
ctccgctgccccccgtcgtcgacctgccccagctggggctgcgccgttgactgccgtatcgccagcacctgatac

SEQ ID NO: 149471 - DNA, 75 bp, Artificial Sequence
  Synthetic
tatttctatttctttttggcctcaaactacaactacccctacttctgttgatatgaattctattacttccactga

SEQ ID NO: 149472 - DNA, 75 bp, Artificial Sequence
  Synthetic
ggttttccagcaatttctccccgtttgagaccggtgcggctgatcagccacctggcgtaggggccgttgttttaa

SEQ ID NO: 149473 - DNA, 75 bp, Artificial Sequence
  Synthetic
ttcagcgtcactcggtcgctggcgggctgtggttctatcctgaggggttgatcgggcttttccctccttttgccc

SEQ ID NO: 149474 - DNA, 75 bp, Artificial Sequence
  Synthetic
tgagaccggtgcggctgatcagccacctggcgtaggggccgttgttttaagtgctgaggctgcacgccccccggt

SEQ ID NO: 149475 - DNA, 75 bp, Artificial Sequence
  Synthetic
gctggtgatcgagcgggtccgagctgtgggatgtcatttcgtgcttcttcttacggccgcccctgagccgccgcc

SEQ ID NO: 149476 - DNA, 75 bp, Artificial Sequence
  Synthetic
gtcatctgttgcctcaggtactaatttggttctctatgctgccccgttgaaccctctgttaccccttcaggatgg

SEQ ID NO: 149477 - DNA, 75 bp, Artificial Sequence
  Synthetic
tctgtttgtgctctccttctgccttgatcttccttttatttttcttttctgcgttccgcgctccctggaaaaaaa

SEQ ID NO: 149478 - DNA, 75 bp, Artificial Sequence
  Synthetic
tgcagcccctgtggccgctgtcccctgccctcagccccccgcccagcctgttggcaccggcttttctgtgccggg

SEQ ID NO: 149479 - DNA, 75 bp, Artificial Sequence
  Synthetic
ttggttctctatgctgccccgttgaaccctctgttaccccttcaggatggcaccaatacccatattatggccacc

SEQ ID NO: 149480 - DNA, 75 bp, Artificial Sequence
  Synthetic
tgccctcagccccccgcccagcctgttggcaccggcttttctgtgccgggtcgtcggcttctgcacgcctacccc

SEQ ID NO: 149481 - DNA, 75 bp, Artificial Sequence
  Synthetic
ttgacttcgtctgtcgcctctgggaccaatcttgttttgtatgccgctccgctcaacccccttctgcccctccag

SEQ ID NO: 149482 - DNA, 75 bp, Artificial Sequence
  Synthetic
cctttttccgactgcctgctctactaagtctacatttcatgccgtccctgtccatatatgggacaggcttatgct

SEQ ID NO: 149483 - DNA, 75 bp, Artificial Sequence
  Synthetic
ggcggttacgccatctctatctctttctggcctcaaacaactactacccctacttctgttgacatgaactctatc

SEQ ID NO: 149484 - DNA, 75 bp, Artificial Sequence
  Synthetic
aagtctacatttcatgccgtccctgtccatatatgggacaggcttatgctttttggtgcaaccctcgatgaccag

SEQ ID NO: 149485 - DNA, 75 bp, Artificial Sequence
  Synthetic
caccaacctggcgggggcctgtgccatgcattttaccagcggttcccggagtcttttgaccacacgcaatttgtt

SEQ ID NO: 149486 - DNA, 75 bp, Artificial Sequence
  Synthetic
tacttctgttgacatgaactctatcacctctactgatgttagaatcctggtccagcctggcattgcctccgagct

SEQ ID NO: 149487 - DNA, 75 bp, Artificial Sequence
  Synthetic
ccaatcttgttttgtatgccgctccgctcaacccccttctgcccctccaggatggcaccaatacccatatcatgg

SEQ ID NO: 149488 - DNA, 75 bp, Artificial Sequence
  Synthetic
aacgagggctggaatgcctccgaagacgcgttgactgctgtgattactgcagcctacctcactatttgtcatcag

SEQ ID NO: 149489 - DNA, 75 bp, Artificial Sequence
  Synthetic
ccgttggtggctatgcaatatctatctccttctggccccagaccacgactacacccacttctgttgacatgaact

SEQ ID NO: 149490 - DNA, 75 bp, Artificial Sequence
  Synthetic
acgcgttgactgctgtgattactgcagcctacctcactatttgtcatcagaggtacctccgcacgcaagcgatct

SEQ ID NO: 149491 - DNA, 75 bp, Artificial Sequence
  Synthetic
tctacgaggcatttcttttaaagtcaccgtcggcacggttgtcgccaacgagggctggaccaccgatgaatatgc

SEQ ID NO: 149492 - DNA, 75 bp, Artificial Sequence
  Synthetic
cggcttaccgtgagacatgctcgcgccttggcaccgccgcctaccctctgctaggcgccgggatctataaggtcc

SEQ ID NO: 149493 - DNA, 75 bp, Artificial Sequence
  Synthetic
attcttatactaatacaccttacactggtgcactggggcttcttgattttgcattagagcttgaatttaggaatt

SEQ ID NO: 149494 - DNA, 75 bp, Artificial Sequence
  Synthetic
tggtgcactggggcttcttgattttgcattagagcttgaatttaggaatttgacacctgggaacactaacactcg

SEQ ID NO: 149495 - DNA, 75 bp, Artificial Sequence
  Synthetic
aatctgggcgcgattatatccctggtcgtcagctgcagttctatgctcagtgtcgacggtggttgtctgccggct

SEQ ID NO: 149496 - DNA, 75 bp, Artificial Sequence
  Synthetic
gaggaggaggcgacatcaggcttagttatgctttgtatccatggttcccctgttaattcttataccaatacgccc

SEQ ID NO: 149497 - DNA, 75 bp, Artificial Sequence
  Synthetic
tcgtcagctgcagttctatgctcagtgtcgacggtggttgtctgccggctttcatctcgacccccgtgtgcttgt

SEQ ID NO: 149498 - DNA, 75 bp, Artificial Sequence
  Synthetic
ccttggcaccgccgcctaccctctgctaggcgccgggatctataaggtccctgtgagttcgagctttgacgcgtg

SEQ ID NO: 149499 - DNA, 75 bp, Artificial Sequence
  Synthetic
agccctacctgccttgactataactgaggacatagctcgtacggcaaatctggcactggagatggatgctgccac

SEQ ID NO: 149500 - DNA, 75 bp, Artificial Sequence
  Synthetic
ggcggccacgcgttttatgaaagacctgcattttactggtacgaatggggttggtgaggtgggccgaggtattgc

SEQ ID NO: 149501 - DNA, 75 bp, Artificial Sequence
  Synthetic
gaggacatagctcgtacggcaaatctggcactggagatggatgctgccaccgatgtgggtcgtgcgtgtgccggg

SEQ ID NO: 149502 - DNA, 75 bp, Artificial Sequence
  Synthetic
gtggttaggccaggactgtacttgcttcctccagcctgttgaggggcgggttggtgaacagggttatgataacga

SEQ ID NO: 149503 - DNA, 75 bp, Artificial Sequence
  Synthetic
acccgtgtgtctcgctacactagtacggcccgacaccgtttgcgtcgcggcgccgatgggacggccgagcttaca

SEQ ID NO: 149504 - DNA, 75 bp, Artificial Sequence
  Synthetic
ttcctccagcctgttgaggggcgggttggtgaacagggttatgataacgaggcattcgaaggttcggatgttgac

SEQ ID NO: 149505 - DNA, 75 bp, Artificial Sequence
  Synthetic
cagcagggcgatgtggacgttgttgttgtcccaacgcgcgagctgcgcaactcgtggcggcgccggggctttgcg

SEQ ID NO: 149506 - DNA, 75 bp, Artificial Sequence
  Synthetic
ttgtcccaacgcgcgagctgcgcaactcgtggcggcgccggggctttgcggcctttacacctcatacagcagccc

SEQ ID NO: 149507 - DNA, 75 bp, Artificial Sequence
  Synthetic
gcacttggcataccttctgatcttgttgcacgtgcaagccggctcaccgccaccgttgaggtctctgacgctgac

SEQ ID NO: 149508 - DNA, 75 bp, Artificial Sequence
  Synthetic
ttgcacgtgcaagccggctcaccgccaccgttgaggtctctgacgctgacggccgtctagcttgtaagaccatta

SEQ ID NO: 149509 - DNA, 75 bp, Artificial Sequence
  Synthetic
cccgtgtggtcatccaggattatgacaaccagcatgagcaggatcggcctaccccgtcacccgccccctctcgcc

SEQ ID NO: 149510 - DNA, 75 bp, Artificial Sequence
  Synthetic
agcgatctgcatctgtccatcttctgggtgaccccaaccagatccctgccattgattttgagcacgccggccttg

SEQ ID NO: 149511 - DNA, 75 bp, Artificial Sequence
  Synthetic
tgaattccataacctcgacggatgttcgtatccttgtccagcccggtatagcctccgagcttgtgatcccaagtg

SEQ ID NO: 149512 - DNA, 75 bp, Artificial Sequence
  Synthetic
gggtgaccccaaccagatccctgccattgattttgagcacgccggccttgtgccggcgattaggccggaacttgc

SEQ ID NO: 149513 - DNA, 75 bp, Artificial Sequence
  Synthetic
tgtcatttgacccggctaagcaaaccatggccgccggccagcatagcctcagctatactctaacgcctgccggtc

SEQ ID NO: 149514 - DNA, 75 bp, Artificial Sequence
  Synthetic
gccggccctacctcgatctccgcggtgggtgtattagccccacactcggcccttgctgttcttgaggacactgtt

SEQ ID NO: 149515 - DNA, 75 bp, Artificial Sequence
  Synthetic
ggcctaccccgtcgccagctccgtcccggcctttctcggtcctccgagctaatgatgttctgtggctctctttga

SEQ ID NO: 149516 - DNA, 75 bp, Artificial Sequence
  Synthetic
tcgaggtttccattgtctctgctggacttgactgtaaggctgtctttccatctggcgttgctacgccctcagctt

SEQ ID NO: 149517 - DNA, 75 bp, Artificial Sequence
  Synthetic
gatccagaccaccagccgagttcttagatctctgttttggaatgagcctgccatcggtcagaaattggtgtttac

SEQ ID NO: 149518 - DNA, 75 bp, Artificial Sequence
  Synthetic
gctgagtatgaccagactacgtatgggtcctccaccaacccaatgtatgtctcggatacagtcacacttgttaac

SEQ ID NO: 149519 - DNA, 75 bp, Artificial Sequence
  Synthetic
ccggcctttctcggtcctccgagctaatgatgttctgtggctctctttgactgcagctgaatatgaccagactac

SEQ ID NO: 149520 - DNA, 75 bp, Artificial Sequence
  Synthetic
agatctctgttttggaatgagcctgccatcggtcagaaattggtgtttactcaggctgccaaggctgccaaccct

SEQ ID NO: 149521 - DNA, 75 bp, Artificial Sequence
  Synthetic
gctgtctttctgggaggctggcacgactaaagccggttatccgtataactataacacaaccgctagtgatcaaat

SEQ ID NO: 149522 - DNA, 75 bp, Artificial Sequence
  Synthetic
gcttgtggtattaccctgaggggctagttggcctgtttccgccgttctccccgggccacagctgggagtctgcta

SEQ ID NO: 149523 - DNA, 75 bp, Artificial Sequence
  Synthetic
ggttgctcgttcccttgattggtccaaggtcactctggacggtcggcctctcactaccatccagcagtattccaa

SEQ ID NO: 149524 - DNA, 75 bp, Artificial Sequence
  Synthetic
gggttgatccagtcgtcccgtgcccatgccattgtagccctgacccgtcatacggagaaatgtgttgtacttgat

SEQ ID NO: 149525 - DNA, 75 bp, Artificial Sequence
  Synthetic
tctaattgagaacgcagctggccaccgtgttgccatctctacttataccaccagcctgggcgctggccctacctc

SEQ ID NO: 149526 - DNA, 75 bp, Artificial Sequence
  Synthetic
agttggcctgtttccgccgttctccccgggccacagctgggagtctgctaaccctttctgcggtgagagtacact

SEQ ID NO: 149527 - DNA, 75 bp, Artificial Sequence
  Synthetic
aaggtcactctggacggtcggcctctcactaccatccagcagtattccaagacgttttatgtgctgccgcttcgt

SEQ ID NO: 149528 - DNA, 75 bp, Artificial Sequence
  Synthetic
atgccattgtagccctgacccgtcatacggagaaatgtgttgtacttgatgcccccggccttcttcgtgaggtcg

SEQ ID NO: 149529 - DNA, 75 bp, Artificial Sequence
  Synthetic
accatctgctaatattaatatgcctgttcatcccccttctcctgtaacccctgtacaaaccaaatcaccggtccc

SEQ ID NO: 149530 - DNA, 75 bp, Artificial Sequence
  Synthetic
caaattctaattgaaaatgcagctggccaccgcgttgctatatccacttacactaccagccttggtgctggccct

SEQ ID NO: 149531 - DNA, 75 bp, Artificial Sequence
  Synthetic
cccgtggcactattgattgcaatgtagaaacgctcagtgccttccccccgacctgccaaatcagcgcctatcatc

SEQ ID NO: 149532 - DNA, 75 bp, Artificial Sequence
  Synthetic
cactaccagccttggtgctggccctgtgtccgtatctgcggttggcgttcttgccccgcattctgctttagccat

SEQ ID NO: 149533 - DNA, 75 bp, Artificial Sequence
  Synthetic
ttacctgactgtggtgccggccctattttgaccggcacccccgcggcgccccccgcgccgccgcagtctataacc

SEQ ID NO: 149534 - DNA, 75 bp, Artificial Sequence
  Synthetic
agaaacgctcagtgccttccccccgacctgccaaatcagcgcctatcatcagctggctgaggagttgggccaccg

SEQ ID NO: 149535 - DNA, 75 bp, Artificial Sequence
  Synthetic
aattaattcctcctgtgcccccttcgtagtcttctttgctttatttctcttttctgctttccgcgctccccggac

SEQ ID NO: 149536 - DNA, 75 bp, Artificial Sequence
  Synthetic
ggcgacctccgacagcgtcctggtctttgaactcacggatatagttcattgccgtatggcggcccctagtcaacg

SEQ ID NO: 149537 - DNA, 75 bp, Artificial Sequence
  Synthetic
tttgaactcacggatatagttcattgccgtatggcggcccctagtcaacgtaaggccgtcttatccactcttgtc

SEQ ID NO: 149538 - DNA, 75 bp, Artificial Sequence
  Synthetic
atgcgtctaaccccggccaccgccctggcggcggcctttgccatgcattctatcagcggttcccggagtcgtttg

SEQ ID NO: 149539 - DNA, 75 bp, Artificial Sequence
  Synthetic
aaatgaaggtaggtaagacccgggagtcttaattaattctcttttgtgcccccttctagatcctccttgttattt

SEQ ID NO: 149540 - DNA, 75 bp, Artificial Sequence
  Synthetic
tttgatgacttctgccctgagtgtcgtgcgctcggccttcagggctgtgccttccagtcaactgttgctgagttg

SEQ ID NO: 149541 - DNA, 75 bp, Artificial Sequence
  Synthetic
ccctcattgggccgggttagtgcaactacttgtgaattatttgagcttgttgaggccatggttgaaaagggccag

SEQ ID NO: 149542 - DNA, 75 bp, Artificial Sequence
  Synthetic
cccctgactaccgagttgagcaaaaccctaagcggcttgaggccgcttatcgggagacatgttcccgccggggga

SEQ ID NO: 149543 - DNA, 75 bp, Artificial Sequence
  Synthetic
ccctaagcggcttgaggccgcttatcgggagacatgttcccgccgggggactgccgcttaccccttgcttggcgc

SEQ ID NO: 149544 - DNA, 75 bp, Artificial Sequence
  Synthetic
ctacttgtgaattatttgagcttgttgaggccatggttgaaaagggccaggatgggactgccgtgctcgagcttg

SEQ ID NO: 149545 - DNA, 75 bp, Artificial Sequence
  Synthetic
tagctcatggtaaggtcggccaggggatttcggcttggagtaagaccttttgtgcgttgtttggcccctggttcc

SEQ ID NO: 149546 - DNA, 75 bp, Artificial Sequence
  Synthetic
cctgaccgagccagctatagcttggtttgaagctaaccgacctaccctacctgctttgaccattactgaggatgc

SEQ ID NO: 149547 - DNA, 75 bp, Artificial Sequence
  Synthetic
tccgccctgccgggcgtgatgttcagcgttggtatactgcccctacccgcgggccggctgctaattgccggcgtt

SEQ ID NO: 149548 - DNA, 75 bp, Artificial Sequence
  Synthetic
gatttcggcttggagtaagaccttttgtgcgttgtttggcccctggttccgtgccattgagaaggagatcctggc

SEQ ID NO: 149549 - DNA, 75 bp, Artificial Sequence
  Synthetic
gcccgtgcctcccgctagagcgggtggtgcgcaaaggatgttgctgtgttgcccgtaagttgaagcaggtttgtg

SEQ ID NO: 149550 - DNA, 75 bp, Artificial Sequence
  Synthetic
cggttctaaggtgtttgagaatgacttttcagagtttgacagtacacagaacaatttttctctcggtttggagtg

SEQ ID NO: 149551 - DNA, 75 bp, Artificial Sequence
  Synthetic
cgagcccggtgtggttcactatcagtttacagctggtgttcctggctctggtaagtctaggtcgatccaacaggg

SEQ ID NO: 149552 - DNA, 75 bp, Artificial Sequence
  Synthetic
ttttcagagtttgacagtacacagaacaatttttctctcggtttggagtgtgctattatggaggagtgtggcatg

SEQ ID NO: 149553 - DNA, 75 bp, Artificial Sequence
  Synthetic
taagctctccttttgggaggctggcaccaccaaagctggctacccttataattataatactactgccagtgatca

SEQ ID NO: 149554 - DNA, 75 bp, Artificial Sequence
  Synthetic
ggcttctggaagaaacactctggtgagcctgggaccttgctgtggaacactgtttggaatgctgcggtgatcgcg

SEQ ID NO: 149555 - DNA, 75 bp, Artificial Sequence
  Synthetic
agcctgggaccttgctgtggaacactgtttggaatgctgcggtgatcgcgcattgttatgagttccgtgatatga

SEQ ID NO: 149556 - DNA, 75 bp, Artificial Sequence
  Synthetic
cgcggccgtagggttgttattgatgaggccccttcgcttccaccgcacctgctcttgctgcatatgcagcgggcc

SEQ ID NO: 149557 - DNA, 75 bp, Artificial Sequence
  Synthetic
atacgacctgagcttgtcccaactaaatggtggcatcttacccatagatgcccggcagatgtctgtgagctgatc

SEQ ID NO: 149558 - DNA, 75 bp, Artificial Sequence
  Synthetic
tgatctctggctgcggactgaaattaaaggttgactttaggccagtgggcctgtatgctggtgtggtcgttgccc

SEQ ID NO: 149559 - DNA, 75 bp, Artificial Sequence
  Synthetic
aaaggttgactttaggccagtgggcctgtatgctggtgtggtcgttgcccccggccttggtgccctgcccgatgt

SEQ ID NO: 149560 - DNA, 75 bp, Artificial Sequence
  Synthetic
ccaacgggccggagcagtatgtgctgtcatttgatccgattaaacaaactatggctgccggcccgcataatctta

SEQ ID NO: 149561 - DNA, 75 bp, Artificial Sequence
  Synthetic
cagaagttggtatttacccaggctgcaaaggccgccaaccccggggcaatcacagttcatgaagcccagggtgca

SEQ ID NO: 149562 - DNA, 75 bp, Artificial Sequence
  Synthetic
tgtttgcgactttcttagaaggcttacgaatgtcgcgcaggtttgtgtgaatgttgtgtcgattgcttatggtgt

SEQ ID NO: 149563 - DNA, 75 bp, Artificial Sequence
  Synthetic
acatttactgagactacaattattgccactgcagacgcccgtgggctgatccagtcttctagggcccatgcgatc

SEQ ID NO: 149564 - DNA, 75 bp, Artificial Sequence
  Synthetic
acgaatgtcgcgcaggtttgtgtgaatgttgtgtcgattgcttatggtgtgagtcctggtctggtacataacctt

SEQ ID NO: 149565 - DNA, 75 bp, Artificial Sequence
  Synthetic
aatgtgtggtggtcgatgccccagggctcctccgtgaggtcggtatctccgatgccatagtcaataacttctttc

SEQ ID NO: 149566 - DNA, 75 bp, Artificial Sequence
  Synthetic
gatgccattcggcatcgggtagaatgaataacatgttcctttgcttcgcctgtgggtatgccaccatgcgcccta

SEQ ID NO: 149567 - DNA, 75 bp, Artificial Sequence
  Synthetic
gaataacatgttcctttgcttcgcctgtgggtatgccaccatgcgccctagggctattttgctgctgctcgtcgt

SEQ ID NO: 149568 - DNA, 75 bp, Artificial Sequence
  Synthetic
cggtagtggtttctggggtgaccgggttgactctcagcccttcgccctcccctatattcacccaaccaacccctt

SEQ ID NO: 149569 - DNA, 75 bp, Artificial Sequence
  Synthetic
gttgactctcagcccttcgccctcccctatattcacccaaccaacccctttgcatccgataccatcgctgcaacc

SEQ ID NO: 149570 - DNA, 75 bp, Artificial Sequence
  Synthetic
cggatagtgtgctcactttcgaactcacggacatagtgcattgccgtatggcagcgccgagtcagcgcaaggcag

SEQ ID NO: 149571 - DNA, 75 bp, Artificial Sequence
  Synthetic
gctgcctcccgtcgtagatctaccccaaccggggcttcgccgttgacagctgttgctccggccccagacactaga

SEQ ID NO: 149572 - DNA, 75 bp, Artificial Sequence
  Synthetic
caaccggggcttcgccgttgacagctgttgctccggccccagacactagacctgtccctgatgtggattcccgcg

SEQ ID NO: 149573 - DNA, 75 bp, Artificial Sequence
  Synthetic
ctctaaatcatttcatccctgagctcggccccattagtgtcactacctgtgagctttacgagctcgtagaggcta

SEQ ID NO: 149574 - DNA, 75 bp, Artificial Sequence
  Synthetic
tgctgtatgctgccccacttagccctcttttgcctctgcaggatgggactaatactcacattatggccactgagg

SEQ ID NO: 149575 - DNA, 75 bp, Artificial Sequence
  Synthetic
tctttcagaaggactgcaataagtttactacaggtgagacgatagcgcatggtaaggtcgggcagggcatatctg

SEQ ID NO: 149576 - DNA, 75 bp, Artificial Sequence
  Synthetic
tactacaggtgagacgatagcgcatggtaaggtcgggcagggcatatctgcgtggagtaagactttttgcgcttt

SEQ ID NO: 149577 - DNA, 75 bp, Artificial Sequence
  Synthetic
tcttttgcctctgcaggatgggactaatactcacattatggccactgaggcttctaactatgctcagtaccgtgt

SEQ ID NO: 149578 - DNA, 75 bp, Artificial Sequence
  Synthetic
gccccaaacgactactacccccacgtccgttgacatgaactcgattacatctaccgatgtccggattgttgtgca

SEQ ID NO: 149579 - DNA, 75 bp, Artificial Sequence
  Synthetic
atatgaggacacagtactggccgctgctgttgcgggtgctcctggctgtaaggtttttgagaatgatttttccga

SEQ ID NO: 149580 - DNA, 75 bp, Artificial Sequence
  Synthetic
gctgttgcgggtgctcctggctgtaaggtttttgagaatgatttttccgagtttgatagtacccaaaataatttc

SEQ ID NO: 149581 - DNA, 75 bp, Artificial Sequence
  Synthetic
tccgttgacatgaactcgattacatctaccgatgtccggattgttgtgcaaccaggccttgcctcggagttggta

SEQ ID NO: 149582 - DNA, 75 bp, Artificial Sequence
  Synthetic
gccacttccggtcttgtcatgttgtgcatccatggctccccagttaattcttatactaacacaccctatactggg

SEQ ID NO: 149583 - DNA, 75 bp, Artificial Sequence
  Synthetic
gcatccatggctccccagttaattcttatactaacacaccctatactggggccttagggctgcttgattttgccc

SEQ ID NO: 149584 - DNA, 75 bp, Artificial Sequence
  Synthetic
ataggctacaccgtggcgctgatggaaccgcagaattgaccactactgcagccacacggtttatgaaggatctaa

SEQ ID NO: 149585 - DNA, 75 bp, Artificial Sequence
  Synthetic
ataggctacaccgtggcgctgatggaaccgcagaattgaccactactgcagccacacggtttatgaaggatctat

SEQ ID NO: 149586 - DNA, 75 bp, Artificial Sequence
  Synthetic
ataggctacaccgtggcgctgatggaaccgcagaattgaccactactgcagccacacggtttatgaaggatctac

SEQ ID NO: 149587 - DNA, 75 bp, Artificial Sequence
  Synthetic
ataggctacaccgtggcgctgatggaaccgcagaattgaccactactgcagccacacggtttatgaaggatctag

SEQ ID NO: 149588 - DNA, 75 bp, Artificial Sequence
  Synthetic
gtaatgttgatacacttgatgcattcccgccttcttgtcagtttagtgcctaccatcagcttgccgaggagcttg

SEQ ID NO: 149589 - DNA, 75 bp, Artificial Sequence
  Synthetic
gatttcgtcggctggaggtcaactgttttactcccgccctgttgtctcagccaatggcgagcctacagtcaagct

SEQ ID NO: 149590 - DNA, 75 bp, Artificial Sequence
  Synthetic
tgttgttatccaggattatgacaaccagcacgagcaggaccggcccacaccgtcaccggccccttctcgtccctt

SEQ ID NO: 149591 - DNA, 75 bp, Artificial Sequence
  Synthetic
cagcacgagcaggaccggcccacaccgtcaccggccccttctcgtcccttctctgttcttcgtgtcaatgatgtg

SEQ ID NO: 149592 - DNA, 75 bp, Artificial Sequence
  Synthetic
gagacaatagcacatggtaaagttgggcagggaatatctgcatggagtaaaaccttctgtgccctgtttggcccc

SEQ ID NO: 149593 - DNA, 75 bp, Artificial Sequence
  Synthetic
gctgttgcccgctccctcgattggtctaaagttactctggatggccgtcccctcactaccatccagcagtattct

SEQ ID NO: 149594 - DNA, 75 bp, Artificial Sequence
  Synthetic
gacactgtgacttttgttaacgtggcaactggtgcacaaggtgtggcccgttctcttgactggtctaaggttacc

SEQ ID NO: 149595 - DNA, 75 bp, Artificial Sequence
  Synthetic
caactggtgcacaaggtgtggcccgttctcttgactggtctaaggttacccttgacggccgcccgcttaccacca

SEQ ID NO: 149596 - DNA, 75 bp, Artificial Sequence
  Synthetic
cttcaggacggcaccaatacccatataatggccacggaagcctctaattatgcccagtatcgggttgttcgtgcc

SEQ ID NO: 149597 - DNA, 75 bp, Artificial Sequence
  Synthetic
tagagtgtgctattatggaggagtgcgggatgccgcagtggctcatccgcttgtaccaccttataaggtctgcgt

SEQ ID NO: 149598 - DNA, 75 bp, Artificial Sequence
  Synthetic
aggctggctacccttataattataatacaacagctagtgaccaaatcttaattgagaatgcagccgggcaccgtg

SEQ ID NO: 149599 - DNA, 75 bp, Artificial Sequence
  Synthetic
tacaacagctagtgaccaaatcttaattgagaatgcagccgggcaccgtgtgtgtatatctacatacacgacaag

SEQ ID NO: 149600 - DNA, 75 bp, Artificial Sequence
  Synthetic
ctgcgggcttttgggagccgtctcctgcccctacatccgagagttcactaagccgccatacgtcccttcagagcg

SEQ ID NO: 149601 - DNA, 75 bp, Artificial Sequence
  Synthetic
cactgttgactacccagcccgtgcccatacttttgatgacttttgccctgaatgccgcacgctcggccttcaagg

SEQ ID NO: 149602 - DNA, 75 bp, Artificial Sequence
  Synthetic
catccccgcttacgtctaccattgctactggcactaatcttgtgttgtatgctgcccctctcagccctctgctcc

SEQ ID NO: 149603 - DNA, 75 bp, Artificial Sequence
  Synthetic
tattttacttgtacccttccctgaggtttctttcattcttttcttattttctttttctgcgttccgcgctccctg

SEQ ID NO: 149604 - DNA, 75 bp, Artificial Sequence
  Synthetic
ccaccatccggtaccgccccctggtgccgaacgccgtcggcgggtatgctatatctatttctttctggcctcaaa

SEQ ID NO: 149605 - DNA, 75 bp, Artificial Sequence
  Synthetic
accaacacgccctataccggggcattggggctccttgactttgcactcgagcttgaatttagaaatttgacccct

SEQ ID NO: 149606 - DNA, 75 bp, Artificial Sequence
  Synthetic
tgagcgcctgcactaccgtaatcagggttggcgctcggttgagacttcaggcgttgctgaggaggaggccacctc

SEQ ID NO: 149607 - DNA, 75 bp, Artificial Sequence
  Synthetic
ggccggtcggtagggacgtccagcgctggtattctgcccccacccgcggccctgctgccaattgccgccgttctg

SEQ ID NO: 149608 - DNA, 75 bp, Artificial Sequence
  Synthetic
ctggtattctgcccccacccgcggccctgctgccaattgccgccgttctgcgttacgtggtctcccccctgtcga

SEQ ID NO: 149609 - DNA, 75 bp, Artificial Sequence
  Synthetic
cctgcttgattttgcactcgagctcgagtttcgcaacttgacacctggtaatacgaatacgcgtgtctctcgtta

SEQ ID NO: 149610 - DNA, 75 bp, Artificial Sequence
  Synthetic
ccgtacctactgttttgatggattttctcgctgcgcctttgccgctgagaccggcgtggccctttactctttgca

SEQ ID NO: 149611 - DNA, 75 bp, Artificial Sequence
  Synthetic
agttaactactactgctgccacacgctttatgaaagatcttcattttactgggactaatggcgttggtgaagttg

SEQ ID NO: 149612 - DNA, 75 bp, Artificial Sequence
  Synthetic
ggtacctaccacacaacctcgtatctcttgatccatgatggtgaccgtgctgttgtgacttacgagggtgatact

SEQ ID NO: 149613 - DNA, 75 bp, Artificial Sequence
  Synthetic
caattcagattgcttctggcttgtcaacgcggctaatgcccagcacaaccccggggggggtgtgtgtggtgcatt

SEQ ID NO: 149614 - DNA, 75 bp, Artificial Sequence
  Synthetic
gagccgactgtgaaactttacacctcagtcgagaatgctcagcaggataagggtatagctatcccacatgatatt

SEQ ID NO: 149615 - DNA, 75 bp, Artificial Sequence
  Synthetic
tgggctcgggtatatatcaggtccctgttggcccgagctttgatgcctgggagcgaaaccaccggcccggggatg

SEQ ID NO: 149616 - DNA, 75 bp, Artificial Sequence
  Synthetic
gctccctcccgtcctttttctgttcttcgtgctaacgatgtgctttggctttcacttacagctgctgaatacgac

SEQ ID NO: 149617 - DNA, 75 bp, Artificial Sequence
  Synthetic
gacatttgttaacgtggctaccggtgcccagggggttgcacgctctctggactggtccaaggtcacccttgatgg

SEQ ID NO: 149618 - DNA, 75 bp, Artificial Sequence
  Synthetic
ggaggctggtactactaaagctggatacccatataattataatactactgccagtgaccagattttgattgagaa

SEQ ID NO: 149619 - DNA, 75 bp, Artificial Sequence
  Synthetic
tcttggaaccagctgagggcctggttggcgaccaaggccatgataatgaggcttatgagggctctgaggtcgacc

SEQ ID NO: 149620 - DNA, 75 bp, Artificial Sequence
  Synthetic
ctgggcctgtttctatttctgctgtgggtgttctagcgccccactctgttctggctgttttggaggacacggccg

SEQ ID NO: 149621 - DNA, 75 bp, Artificial Sequence
  Synthetic
tgtcgctgagttgcagcgtcttaaaatgaaggtgggtaaaacccgggagtattgatttattttccttgtgcctcc

SEQ ID NO: 149622 - DNA, 75 bp, Artificial Sequence
  Synthetic
acgtcttaaaatgaaggtgggtaaaacccgggagtattgatttattttcctttgtgccttcctttgtattgttct

SEQ ID NO: 149623 - DNA, 75 bp, Artificial Sequence
  Synthetic
gtggcgcctgactataggcgacgtagagacccagccgccttgcaggtagcttatcaagaatgtctgtataggcag

SEQ ID NO: 149624 - DNA, 75 bp, Artificial Sequence
  Synthetic
cgcctaacatcttttatggtgatgcctatgaggactctgtgttctctgcggctgtcaccggtgccgggtcaagca

SEQ ID NO: 149625 - DNA, 75 bp, Artificial Sequence
  Synthetic
tgcagccccggcagcttgttttccggcctgaggtcttgtggaatcaccctatccagcgtgtgatccacaatgagc

SEQ ID NO: 149626 - DNA, 75 bp, Artificial Sequence
  Synthetic
ccagcgcgtaatccataacgagcttgagcagtattgccgagcccgcgctggtcgctgccttgaggtgggggccca

SEQ ID NO: 149627 - DNA, 75 bp, Artificial Sequence
  Synthetic
gtggtacactgccccaacccgcggccccgcagcgaattgccgccgatcggccctccgtgggcttccgcctgttga

SEQ ID NO: 149628 - DNA, 75 bp, Artificial Sequence
  Synthetic
gccctgcggcaaactgccgccggtctgccctccgtgggctcccacctgttgatcgtacatactgttttgacggct

SEQ ID NO: 149629 - DNA, 75 bp, Artificial Sequence
  Synthetic
ccctccgtgggcttccgcctgttgaccggacatactgttttgatggcttttctgggtgtacgtttgctgctgaga

SEQ ID NO: 149630 - DNA, 75 bp, Artificial Sequence
  Synthetic
tctgggtgtacgtttgctgctgagactggggttgctctttattcattgcacgatctatggcctgctgacgtcgca

SEQ ID NO: 149631 - DNA, 75 bp, Artificial Sequence
  Synthetic
ggtacctaccatactacttcataccttctgattcatgatggcgatcgtgctgtgattacgtatgagggcgactcg

SEQ ID NO: 149632 - DNA, 75 bp, Artificial Sequence
  Synthetic
ttctgattcatgatggcgatcgtgctgtgattacgtatgagggcgactcgagcgcggggtacaaccatgatgtgt

SEQ ID NO: 149633 - DNA, 75 bp, Artificial Sequence
  Synthetic
cgctggcatactgctcccactcgcgggccggatgctaactgccggcgttccgcgttgcgtgggcttcccgctgct

SEQ ID NO: 149634 - DNA, 75 bp, Artificial Sequence
  Synthetic
ccccgccgctgcctcacgtcgtagacctaccacagctggggccgcgccgctaaccgcggtcgctccggcccatga

SEQ ID NO: 149635 - DNA, 75 bp, Artificial Sequence
  Synthetic
gctcccctgtaaattcatataccaacaccccttacacaggtgctttggggcttcttgattttgcgcttgagattg

SEQ ID NO: 149636 - DNA, 75 bp, Artificial Sequence
  Synthetic
cgctggtgattgagcgagtccgagcggtggggtgccattttgtgctcctccttactgccgctcctgaaccatcgc

SEQ ID NO: 149637 - DNA, 75 bp, Artificial Sequence
  Synthetic
gtaccttcgtggtattagctataaggttacagtcggtgccctcgttgctaacgaaggctggaatgcctccgagga

SEQ ID NO: 149638 - DNA, 75 bp, Artificial Sequence
  Synthetic
acgaaggctggaatgcctccgaggacgcactgactgctgtaattaccgcagcttatcttaccatttgtcatcaga

SEQ ID NO: 149639 - DNA, 75 bp, Artificial Sequence
  Synthetic
caacgagggctggaatgcctctgaggatgcgttgaccgccgtaatcactgcggcttaccttactatctgccatca

SEQ ID NO: 149640 - DNA, 75 bp, Artificial Sequence
  Synthetic
ccccctctcgccctttctccgttctacgtgctaatgatgtgctgtggctttcgctaactgctgcagagtatgacc

SEQ ID NO: 149641 - DNA, 75 bp, Artificial Sequence
  Synthetic
gtccggccgtgattacatccccggccgtcaattgcagttttatgcccagtgccgccggtggttgtctgccggctt

SEQ ID NO: 149642 - DNA, 75 bp, Artificial Sequence
  Synthetic
cttaccctaaaatccagaccacgagccgtgtgctacggtctctgttctggaatgagccggctattggccagaagt

SEQ ID NO: 149643 - DNA, 75 bp, Artificial Sequence
  Synthetic
agtggcttggtcaggagtgcacctgtttccttcaacctgcagaaggcgtcgtcggcgaccagggtcatgataatg

SEQ ID NO: 149644 - DNA, 75 bp, Artificial Sequence
  Synthetic
ccacaagttttgttgcttcatgcggtggttaggacaagattgcacctgctttctccagcctatagagggacgggt

SEQ ID NO: 149645 - DNA, 75 bp, Artificial Sequence
  Synthetic
tggttaggacaagattgcacctgctttctccagcctatagagggacgggttggtgagcagggctatgataatgaa

SEQ ID NO: 149646 - DNA, 75 bp, Artificial Sequence
  Synthetic
tgctaaccccggtgcgattacggtccatgaggcccagggtgccacctttacagagactacaattatagctacggc

SEQ ID NO: 149647 - DNA, 75 bp, Artificial Sequence
  Synthetic
ggtggctgggtcaagactgcacctgttttcttcagcccattgaggggagggttggtgagcagggttatgataatg

SEQ ID NO: 149648 - DNA, 75 bp, Artificial Sequence
  Synthetic
gccgtcaattgcagcctttataccaagcgcttggcataccatctgatttagccgcgcgtgctggtcggcttgctg

SEQ ID NO: 149649 - DNA, 75 bp, Artificial Sequence
  Synthetic
cacttggtatcccctctgatcttgctgctcgtgccggccgtctcactgctactgtcgaagtttctgatgcagacg

SEQ ID NO: 149650 - DNA, 75 bp, Artificial Sequence
  Synthetic
agcgcttggcataccatctgatttagccgcgcgtgctggtcggcttgctgctactgttgaagtttcagatgctga

SEQ ID NO: 149651 - DNA, 75 bp, Artificial Sequence
  Synthetic
ctatggccgctggctctctcagtctcacctatgccgtctctgcagacgggctggaggtgcgctatgttgctgccg

SEQ ID NO: 149652 - DNA, 75 bp, Artificial Sequence
  Synthetic
atggctgccggcccgcataatctcagttataccttgacatctgcaggcctcgaaatacatgtcgtctctgccggg

SEQ ID NO: 149653 - DNA, 75 bp, Artificial Sequence
  Synthetic
ctatggctgctggcccgcatagtcttagctacaccttagcatctgcgggccttgaagtgcatattgtttctgccg

SEQ ID NO: 149654 - DNA, 75 bp, Artificial Sequence
  Synthetic
cgccacagcggatgctcgcgggctgattcagtcctctagggctcatgccattgtagccctgacccgtcacacgga

SEQ ID NO: 149655 - DNA, 75 bp, Artificial Sequence
  Synthetic
gcattgtatagattcaaccgctgtgtccagcggcactccctcgttgggggtgtgtggtaccaccctgaggggcta

SEQ ID NO: 149656 - DNA, 75 bp, Artificial Sequence
  Synthetic
tccagcggcactccctcgttgggggtgtgtggtaccaccctgaggggctagtcggcctgttccccccgttctccc

SEQ ID NO: 149657 - DNA, 75 bp, Artificial Sequence
  Synthetic
ggtttgtggtactatcctgagagcctggtcggtttgttcccaccgttttcccctggtcatagctgggaatctgcc

SEQ ID NO: 149658 - DNA, 75 bp, Artificial Sequence
  Synthetic
cccgacttaggttttgtgtctgagccctctatacctagtagggccgccacgcctaccttggcggcccctctaccc

SEQ ID NO: 149659 - DNA, 75 bp, Artificial Sequence
  Synthetic
agctggttatttgagaagtctggccgtgactacatccccggccgccagctccagttttatgctcagtgtcggcgg

SEQ ID NO: 149660 - DNA, 75 bp, Artificial Sequence
  Synthetic
gcttttccagctgcttttctccccttgaactaggggccccggacccgccccctcttgctgagactgacgcaccta

SEQ ID NO: 149661 - DNA, 75 bp, Artificial Sequence
  Synthetic
ttcgagcctcgcgccccagagctgccgccttccggtgacaccgacacatctgtagctattgatgccccaccattg

SEQ ID NO: 149662 - DNA, 75 bp, Artificial Sequence
  Synthetic
cgccttccggtgacaccgacacatctgtagctattgatgccccaccattggtttcccctgtacagactcagcccc

SEQ ID NO: 149663 - DNA, 75 bp, Artificial Sequence
  Synthetic
cgcccctgtcgtgccaccagcaccagtgcattccgtggcccagccgtctggacctcgtcgccggctgcttcatac

SEQ ID NO: 149664 - DNA, 75 bp, Artificial Sequence
  Synthetic
gacctcgtcgccggctgcttcatacctaccctgatggctcgaaggtgtatgctggctccttgtttgagtccgaat

SEQ ID NO: 149665 - DNA, 75 bp, Artificial Sequence
  Synthetic
tgtaatccagcccgggccccgtcgacgattgctccatacttaccccgatggttcgaaggtgtatgccggatctct

SEQ ID NO: 149666 - DNA, 75 bp, Artificial Sequence
  Synthetic
tcccagagtcatttgatcccgctgagtttgttatgtcagatgggcttgcagcctacaccctgtccccccggccta

SEQ ID NO: 149667 - DNA, 75 bp, Artificial Sequence
  Synthetic
gagtgccgcaccgtgctcgggaataagaccttccggacgacggtggttgatggcgcccaccttgaggcgaacggc

SEQ ID NO: 149668 - DNA, 75 bp, Artificial Sequence
  Synthetic
attctaccagcggtttccagagtccttcgaccctgctgagtttattatgtccgacgggtttgcagcctacaccct

SEQ ID NO: 149669 - DNA, 75 bp, Artificial Sequence
  Synthetic
acagcccctgtccctgatgttgattcacgtggcgctattctgcgccggcagtataatttatccacgtccccgctt

SEQ ID NO: 149670 - DNA, 75 bp, Artificial Sequence
  Synthetic
ccgacgggtttgcagcctacaccctgacgcctcggcccataatccacgctgttgcccccgattatcgggttgaac

SEQ ID NO: 149671 - DNA, 75 bp, Artificial Sequence
  Synthetic
ctagaggccgcctatcgggagacgtgctcccgtcttgggacagcagcttaccccctacttggtgccggtatatat

SEQ ID NO: 149672 - DNA, 75 bp, Artificial Sequence
  Synthetic
aaggtgcctgttgggttgagctttgacgcctgggaacgtaaccaccggcccggggatgagctgtatctgactgag

SEQ ID NO: 149673 - DNA, 75 bp, Artificial Sequence
  Synthetic
ggtaccaatacccatattatggccaccgaggcgtctaattacgcccagtaccgggtggttcgggctacaatccgt

SEQ ID NO: 149674 - DNA, 75 bp, Artificial Sequence
  Synthetic
cggattgagctttgacgcctgggaacgtaaccatcgacccggggacgagttgtacttgaccgagccggctatagc

SEQ ID NO: 149675 - DNA, 75 bp, Artificial Sequence
  Synthetic
acgcctgggaacgtaaccaccggcccggggatgagctgtatctgactgagccagctgtggcttggtttgaggcaa

SEQ ID NO: 149676 - DNA, 75 bp, Artificial Sequence
  Synthetic
catcgcccgtcagtggtaccccgtggcaccattagcagcaatgttgatacacttgacgcattccccccttcctgc

SEQ ID NO: 149677 - DNA, 75 bp, Artificial Sequence
  Synthetic
gcgaacctggcactggagttagactctgccactgaagttggccgagcgtgtgctggctgccgtgtcgagcctggc

SEQ ID NO: 149678 - DNA, 75 bp, Artificial Sequence
  Synthetic
cctacttctgttgatatgaactctattacctctactgatgtcaggattctggtccagcccggcattgcctccgag

SEQ ID NO: 149679 - DNA, 75 bp, Artificial Sequence
  Synthetic
actggagttggatgcggccactgaggtcggccgtgcgtgcgctggctgccgtgttgaacccggcgtggtccatta

SEQ ID NO: 149680 - DNA, 75 bp, Artificial Sequence
  Synthetic
gcggggaaggtaccctgtacacccgcacctggtccacatctggcttttctagtgacttctccccccctgaggcgg

SEQ ID NO: 149681 - DNA, 75 bp, Artificial Sequence
  Synthetic
gtgtccctggctcaggtaaatcccggtcggttcagcagggggaggtggatgtagtagtggtaccgactcgtgagc

SEQ ID NO: 149682 - DNA, 75 bp, Artificial Sequence
  Synthetic
gtcggccgtgcgtgcgctggctgccgtgttgaacccggcgtggtccattaccagttcacagctggtgtccctggc

SEQ ID NO: 149683 - DNA, 75 bp, Artificial Sequence
  Synthetic
tggcgccgccgtggattcgcagcctacacacctcatactgcagcccgtgttacccgaggccgcagagttgttatt

SEQ ID NO: 149684 - DNA, 75 bp, Artificial Sequence
  Synthetic
acacacctcatactgcagcccgtgttacccgaggccgcagagttgttattgacgaggccccctcgcttccaccac

SEQ ID NO: 149685 - DNA, 75 bp, Artificial Sequence
  Synthetic
gggttgtcattgatgaggccccgtcgctccccccacacttgctcttgttacatatgcagcgggcctcctcagttc

SEQ ID NO: 149686 - DNA, 75 bp, Artificial Sequence
  Synthetic
ccaatgttgacaccctggctgccttccctccgtcttgccagattagtgtcttccatcagttgggtgaggagcttg

SEQ ID NO: 149687 - DNA, 75 bp, Artificial Sequence
  Synthetic
acccgccgtctcctttatacctatcctgacggcgctaaggtgtatgcggggtcattgtttgagtcagattgtgac

SEQ ID NO: 149688 - DNA, 75 bp, Artificial Sequence
  Synthetic
ctgacggcgctaaggtgtatgcggggtcattgtttgagtcagattgtgactggctggtgaatgcttctaacccgg

SEQ ID NO: 149689 - DNA, 75 bp, Artificial Sequence
  Synthetic
agttggtcccgacaaagtggtggcacgttactcatagatgcccagctgatgtctgtgagctaatccgcggtgcgt

SEQ ID NO: 149690 - DNA, 75 bp, Artificial Sequence
  Synthetic
atttcggacatgccggcctcgttccagcaatccggcctgagttggtcccaactaagtggtggcaccttactcata

SEQ ID NO: 149691 - DNA, 75 bp, Artificial Sequence
  Synthetic
cgtgacatttgaattaacagatattgtgcactgccgaatggccgccccgagacagagcaaggccgtggtgaccac

SEQ ID NO: 149692 - DNA, 75 bp, Artificial Sequence
  Synthetic
ttatgcgtgagggccttgcagcatacaccctgaccccgcgccctattattcatgcagtggcccccgactataggg

SEQ ID NO: 149693 - DNA, 75 bp, Artificial Sequence
  Synthetic
tgttcacccaggcggcgaaggccgccaaccctggtgcgattacagtccatgaagcccagggtgccacatttactg

SEQ ID NO: 149694 - DNA, 75 bp, Artificial Sequence
  Synthetic
aggccagaagctggtcttcactcaagcggccaaggctgctaaccctggtgcaatcacggttcatgaggcacaggg

SEQ ID NO: 149695 - DNA, 75 bp, Artificial Sequence
  Synthetic
atgcactgactgctgtaattactgcagcatatctcaccatttgtcatcagaggtacctccgcacgcaggccattt

SEQ ID NO: 149696 - DNA, 75 bp, Artificial Sequence
  Synthetic
cccgccacacagagaaatgtgtggttgttgatgccccgggtctcctccgtgaagtgggtatttcagacgctattg

SEQ ID NO: 149697 - DNA, 75 bp, Artificial Sequence
  Synthetic
cctagcattagagatcgatgctgccacagaggtgggccgtgcttgtgccggctgcactgttagccctggaattgt

SEQ ID NO: 149698 - DNA, 75 bp, Artificial Sequence
  Synthetic
tggcactattggcagcaatgtcgacacgcttgatgcgtttcccccctcctgccagtttagcgcgtaccaccagct

SEQ ID NO: 149699 - DNA, 75 bp, Artificial Sequence
  Synthetic
cccacaagttttgttgcttcatgcggtggttaggtcaggattgcacctgtttcctccaacctatcgagggacggg

SEQ ID NO: 149700 - DNA, 75 bp, Artificial Sequence
  Synthetic
gccaccgaccggccccgatcgccgctgtcttgcctccatgcccagagctcgaacagggcttgctttatatgcctc

SEQ ID NO: 149701 - DNA, 75 bp, Artificial Sequence
  Synthetic
gtgcactgccgtatggcggcgcctagtcagcgtaaggcagtcctgtcgactcttgtcggcaggtatggccgccgt

SEQ ID NO: 149702 - DNA, 75 bp, Artificial Sequence
  Synthetic
tagccagctacagcctctatatcaggcgcttggtatcccctctgatcttgctgcccgtgccggccggctcactgc

SEQ ID NO: 149703 - DNA, 75 bp, Artificial Sequence
  Synthetic
gtgattgatgaggccccatctctcccaccgcacttgttgctgttgcacatgcagcgggcctcctcggtccatctc

SEQ ID NO: 149704 - DNA, 75 bp, Artificial Sequence
  Synthetic
tatggcggcgcccagccagcgtaaggcggttctgtcgacccttgtcggcaggtatggccgccgcacgaagctgta

SEQ ID NO: 149705 - DNA, 75 bp, Artificial Sequence
  Synthetic
gcaccaacgagttggtggcatgttacacatcgctgcccggccgatgtatgtgagctcatacgtggggcttatcct

SEQ ID NO: 149706 - DNA, 75 bp, Artificial Sequence
  Synthetic
ctgaggtcctgtggaaccacccgattcagcgggtcatacataacgagctggagcagtattgccgggctcgtgctg

SEQ ID NO: 149707 - DNA, 75 bp, Artificial Sequence
  Synthetic
tcagcgggtcatacataacgagctggagcagtattgccgggctcgtgctggtcgctgcctcgaggtcggcgctca

SEQ ID NO: 149708 - DNA, 75 bp, Artificial Sequence
  Synthetic
taagacccgggagtcttaattaatttccctttgtgcccccttctaaactttgctctgttatttcttttttcgggg

SEQ ID NO: 149709 - DNA, 75 bp, Artificial Sequence
  Synthetic
acgcaggccgctaaagccgccaaccctggtgcgatcacggtccatgaagcccagggcgctacctttacagagact

SEQ ID NO: 149710 - DNA, 75 bp, Artificial Sequence
  Synthetic
ctggtattctgctcctacccgcggcccggcggccaactgtcgccgctctgcgttgcgtggtctgccccctgtcga

SEQ ID NO: 149711 - DNA, 75 bp, Artificial Sequence
  Synthetic
agcattgtacagatttaaccgctgtgtccagcggcactccctcattgggggtgtgtggtaccaccctgaggggct

SEQ ID NO: 149712 - DNA, 75 bp, Artificial Sequence
  Synthetic
gtgtgtggtaccaccctgaggggctagtcggcctgttcccgccgttttcccccggccatagctgggagtctgcta

SEQ ID NO: 149713 - DNA, 75 bp, Artificial Sequence
  Synthetic
ctttatttggcccgtggttccgcgctatcgagaagaagattttggcggcgcttgcgcccaatatcttttatggtg

SEQ ID NO: 149714 - DNA, 75 bp, Artificial Sequence
  Synthetic
ccggcggccaactgtcgccgctctgcgttgcgtggtctgccccctgtcgaccgcacatactgtttcgacgggttc

SEQ ID NO: 149715 - DNA, 75 bp, Artificial Sequence
  Synthetic
tggagtgtataattatggaggagtgcggcatgcctcagtggatgattcgactttaccatctcgtccgctccgctt

SEQ ID NO: 149716 - DNA, 75 bp, Artificial Sequence
  Synthetic
gaagctatggcccgccacgggatgacacgtttgtacgcagtcctccatctgccccctgaggtcttgttaccacct

SEQ ID NO: 149717 - DNA, 75 bp, Artificial Sequence
  Synthetic
ccctcttgttgagactgacacgcctacagttgttgatactctgcctccagttgtttcagtaccccttgagcaaat

SEQ ID NO: 149718 - DNA, 75 bp, Artificial Sequence
  Synthetic
tgttcgctctgcctgggtcttgcaggccccaaaagagtccctgcgtggcttctggaagaagcactctggcgagcc

SEQ ID NO: 149719 - DNA, 75 bp, Artificial Sequence
  Synthetic
cggcatgcctcagtggatgattcgactttaccatctcgtccgctccgcttgggtcctccaggccccgaaagagtc

SEQ ID NO: 149720 - DNA, 75 bp, Artificial Sequence
  Synthetic
ggtagaccacgtacgttgctcgcgtacgtggtcgatgccatggaggcccaccagttcattaaggctcctggcatc

SEQ ID NO: 149721 - DNA, 75 bp, Artificial Sequence
  Synthetic
tggcaccctgctgtggaataccgtttggaacatggcggttatagcgcactgttatgagttccgtgacctcaaagt

SEQ ID NO: 149722 - DNA, 75 bp, Artificial Sequence
  Synthetic
tatagcccattgttatgagttccgcgacttaaaagttgcggcgtttaagggggatgattctgttgtgctctgtag

SEQ ID NO: 149723 - DNA, 75 bp, Artificial Sequence
  Synthetic
ccatacttcgtgcatggattcgcactactaagatagttggcgatcacccgttagtgatcgagagggtccgcgcca

SEQ ID NO: 149724 - DNA, 75 bp, Artificial Sequence
  Synthetic
tggaacatggcggttatagcgcactgttatgagttccgtgacctcaaagttgcggcatttaagggggatgactct

SEQ ID NO: 149725 - DNA, 75 bp, Artificial Sequence
  Synthetic
tgactatcggcagagccatgatgcagctgccttaattgccggctgcgggctgaagcttaaggtggattttaggcc

SEQ ID NO: 149726 - DNA, 75 bp, Artificial Sequence
  Synthetic
tgactatcggcagagccttgatgcagctgccttaattgccggctgcgggctgaagcttaaggtggattttaggcc

SEQ ID NO: 149727 - DNA, 75 bp, Artificial Sequence
  Synthetic
tgactatcggcagagccctgatgcagctgccttaattgccggctgcgggctgaagcttaaggtggattttaggcc

SEQ ID NO: 149728 - DNA, 75 bp, Artificial Sequence
  Synthetic
tgactatcggcagagccgtgatgcagctgccttaattgccggctgcgggctgaagcttaaggtggattttaggcc

SEQ ID NO: 149729 - DNA, 75 bp, Artificial Sequence
  Synthetic
tactaagatagttggcgatcacccgttagtgatcgagagggtccgcgccatcggctgccattttgttttgcttct

SEQ ID NO: 149730 - DNA, 75 bp, Artificial Sequence
  Synthetic
accctggccaccgccctggtggcggcctctgccatgcgttttaccaacggttcccagagtcatttgatcccgctg

SEQ ID NO: 149731 - DNA, 75 bp, Artificial Sequence
  Synthetic
atttggcccaggcgggtcaccctccctatttccttcagcctgctctaccaagtcaacatttcatgctgttccggt

SEQ ID NO: 149732 - DNA, 75 bp, Artificial Sequence
  Synthetic
ctatttccttcagcctgctctaccaagtcaacatttcatgctgttccggtccatatatgggaccggcttatgctt

SEQ ID NO: 149733 - DNA, 75 bp, Artificial Sequence
  Synthetic
atcgggttgaacataaccctaagaggcttgaggccgcctatcgggagacgtgctctcgtctcgggactgcagctt

SEQ ID NO: 149734 - DNA, 75 bp, Artificial Sequence
  Synthetic
gtgaccgttggcgcgctcgtcgccaacgagggctggaacgcttcggaggatgcgctcaccgccgtgattactgca

SEQ ID NO: 149735 - DNA, 75 bp, Artificial Sequence
  Synthetic
acgagggctggaacgcttcggaggatgcgctcaccgccgtgattactgcagcatatctgaccatctgccaccagc

SEQ ID NO: 149736 - DNA, 75 bp, Artificial Sequence
  Synthetic
ccatcactgaggataccgcgcgtacggcgaacctggcattggagctagactccgccactgaagtcggccgggcgt

SEQ ID NO: 149737 - DNA, 75 bp, Artificial Sequence
  Synthetic
gactatatagctggttgttcgagaagtccggccgtgattatatccccggccgtcagcttcagttttacgcacagt

SEQ ID NO: 149738 - DNA, 75 bp, Artificial Sequence
  Synthetic
gtccggccgtgattatatccccggccgtcagcttcagttttacgcacagtgccgccgttggctatcggccggctt

SEQ ID NO: 149739 - DNA, 75 bp, Artificial Sequence
  Synthetic
cggcaagtcctgctgtttcatgaagtggctagggcaggagtgtacctgttttttggaaccggcggagggcttggt

SEQ ID NO: 149740 - DNA, 75 bp, Artificial Sequence
  Synthetic
tggctagggcaggagtgtacctgttttttggaaccggcggagggcttggtaggtgactgcggccatgataatgag

SEQ ID NO: 149741 - DNA, 75 bp, Artificial Sequence
  Synthetic
agggttgttattgatgaggccccgtcgctccctccacacttgcttttgctgcatatgcagcgggcctcctcagtc

SEQ ID NO: 149742 - DNA, 75 bp, Artificial Sequence
  Synthetic
accgtttggaatatggcgatcatagcacactgctatgagtttcgcgattttcgggttgccgcctttaagggtgat

SEQ ID NO: 149743 - DNA, 75 bp, Artificial Sequence
  Synthetic
ccgcccgtcgtcgatctgccccagccggggcttcgccgttgacggctgtagccccggcccctgacactgccccgg

SEQ ID NO: 149744 - DNA, 75 bp, Artificial Sequence
  Synthetic
cgccagctcgagcctctttatagagcgttaaacatcccacacgacattgcggcccgtgcatcgcgtctgactgcc

SEQ ID NO: 149745 - DNA, 75 bp, Artificial Sequence
  Synthetic
tctcgtggtgctatattgcgccgccagtacaatctgtccacgtcaccgcttacgtccactattgctactggcact

SEQ ID NO: 149746 - DNA, 75 bp, Artificial Sequence
  Synthetic
cgttaaacatcccacacgacattgcggcccgtgcatcgcgtctgactgccactgtggagcttgttgccagcccgg

SEQ ID NO: 149747 - DNA, 75 bp, Artificial Sequence
  Synthetic
agtacaatctgtccacgtcaccgcttacgtccactattgctactggcactaatcttgtactatatgctgccccac

SEQ ID NO: 149748 - DNA, 75 bp, Artificial Sequence
  Synthetic
ttgccactggaactaatctcgtgctatatgctgccccgcttagccctctactcccgcttcaagacggtactaaca

SEQ ID NO: 149749 - DNA, 75 bp, Artificial Sequence
  Synthetic
ctaatggccctgaacagtatgttttaacatttgatgactcccgtcaagtgatgggggctgggtcccacagcctca

SEQ ID NO: 149750 - DNA, 75 bp, Artificial Sequence
  Synthetic
aacatttgatgactcccgtcaagtgatgggggctgggtcccacagcctcatgtatgagctcgtccctgccggcct

SEQ ID NO: 149751 - DNA, 75 bp, Artificial Sequence
  Synthetic
ggagttatagtttatttgcttgtgccccccttctttctgttgcttatttctcttttctgcgttccgcgctccctg

SEQ ID NO: 149752 - DNA, 75 bp, Artificial Sequence
  Synthetic
atcacttccaccgatgtccgtatcctcgttcagcccggcatagcctctgaacttgtgattcctagtgagcgcctg

SEQ ID NO: 149753 - DNA, 75 bp, Artificial Sequence
  Synthetic
gggtgaggtggcagccttttgcagtgccctatacaggtacaataggtttacccagcgccactcgttgaccggcgg

SEQ ID NO: 149754 - DNA, 75 bp, Artificial Sequence
  Synthetic
gccctatacaggtacaataggtttacccagcgccactcgttgaccggcgggctgtggctacaccctgaggggctt

SEQ ID NO: 149755 - DNA, 75 bp, Artificial Sequence
  Synthetic
tcagggctggcgctcagttgagacctctggtgttgctgaggaggaggctacctccggccttgttatgctctgcat

SEQ ID NO: 149756 - DNA, 75 bp, Artificial Sequence
  Synthetic
ttctgcctatgctgcccgcgccaccggccggccagccgtctggccgccgtcgtgggcggcgcagcggcggtgccg

SEQ ID NO: 149757 - DNA, 75 bp, Artificial Sequence
  Synthetic
tacacccggacctggtccacttctggattctctagtgatttttccccccccgatgcggcttttgttacccccgct

SEQ ID NO: 149758 - DNA, 75 bp, Artificial Sequence
  Synthetic
gcttgagttccgtaatttgacgcccggcaacacaaatacgcgcgtctctcgttattcgagtagtgcgcgccataa

SEQ ID NO: 149759 - DNA, 75 bp, Artificial Sequence
  Synthetic
gtccaagccaggccggccgctgtagagaaggcggagcggacgaccaacttacaggatatagatgcagtgcctccg

SEQ ID NO: 149760 - DNA, 75 bp, Artificial Sequence
  Synthetic
gattctctagtgatttttccccccccgatgcggcttttgttacccccgctcctgacgtggggctgtcgggtcccc

SEQ ID NO: 149761 - DNA, 75 bp, Artificial Sequence
  Synthetic
gactgctgctacacgctttatgaaggatcttcattttacagggactaatggtgttggtgaggttggccgtggtat

SEQ ID NO: 149762 - DNA, 75 bp, Artificial Sequence
  Synthetic
cggttagtaagcctgctaatctacccagtcccgttgcacctaagccccctgcccgtaagccgcccgcgccgccgt

SEQ ID NO: 149763 - DNA, 75 bp, Artificial Sequence
  Synthetic
agtcagcgcaaggcagtcctgtcgactcttgtcggtaggtatggccgccgtacgaagctgtatgaagctgctcat

SEQ ID NO: 149764 - DNA, 75 bp, Artificial Sequence
  Synthetic
cagtcccgttgcacctaagccccctgcccgtaagccgcccgcgccgccgtcggtccgcacccgtcggctccttta

SEQ ID NO: 149765 - DNA, 75 bp, Artificial Sequence
  Synthetic
tgacctttggccagccgatgttgcggaggctatggcccgccacgggatgacacgtctgtatgctgcactccatct

SEQ ID NO: 149766 - DNA, 75 bp, Artificial Sequence
  Synthetic
caaccctggccaccgccccggtggtggcctctgccacgcattctaccagcgcttcccggaatcgtttcaccctac

SEQ ID NO: 149767 - DNA, 75 bp, Artificial Sequence
  Synthetic
ggcctctgccacgcattctaccagcgcttcccggaatcgtttcaccctaccgattttgtcatgcgtgagggtctt

SEQ ID NO: 149768 - DNA, 75 bp, Artificial Sequence
  Synthetic
agtcccgggttgttattcaggattatgacaatcaacatgagcaagaccgtcccaccccttctcccgctccctcac

SEQ ID NO: 149769 - DNA, 75 bp, Artificial Sequence
  Synthetic
ttttacccctccaggatggcaccaacacccatattatggctaccgaggcatctaattatgcccagtaccgggtgg

SEQ ID NO: 149770 - DNA, 75 bp, Artificial Sequence
  Synthetic
aggttggaggcggcatatcgtgagacttgctcccgcctcggcacagccgcctacccattgctggagtcggggatc

SEQ ID NO: 149771 - DNA, 75 bp, Artificial Sequence
  Synthetic
tcggatgtcattttgtactgctgctcactgcggctcctgagccgtcgcctatgccttatgttccttacccccgtt

SEQ ID NO: 149772 - DNA, 75 bp, Artificial Sequence
  Synthetic
cttgctcccgcctcggcacagccgcctacccattgctggagtcggggatctatcaggtccctgtgggcttaagct

SEQ ID NO: 149773 - DNA, 75 bp, Artificial Sequence
  Synthetic
acaaaccctatgtatgtttctgatactgtgacgttcgtcaatgtggccaccggtgcccagggggtttcgcgctct

SEQ ID NO: 149774 - DNA, 75 bp, Artificial Sequence
  Synthetic
tgtttctgatactgtaacatttgtcaatgtggcgaccggtgctcagggggtctctcgttccctggactggtccaa

SEQ ID NO: 149775 - DNA, 75 bp, Artificial Sequence
  Synthetic
ctgtgacgttcgtcaatgtggccaccggtgcccagggggtttcgcgctctctggactggtctaaagtcacacttg

SEQ ID NO: 149776 - DNA, 75 bp, Artificial Sequence
  Synthetic
ctaataagccgacccagccagccctaacaatcactgaggacaccgcccgcacggctaacctcgcgcttgagattg

SEQ ID NO: 149777 - DNA, 75 bp, Artificial Sequence
  Synthetic
aacaatcactgaggacaccgcccgcacggctaacctcgcgcttgagattgactctgctaccgaggtcggccgtgc

SEQ ID NO: 149778 - DNA, 75 bp, Artificial Sequence
  Synthetic
tttgggaggcgggtactactaaggccggctacccctacaattataataccactgctagtgatcaggtcttgattg

SEQ ID NO: 149779 - DNA, 75 bp, Artificial Sequence
  Synthetic
gtcactgttggtgcacttgtcgctaatgagggttggaacgcctctgaagatgcccttaccgctgtaattactgca

SEQ ID NO: 149780 - DNA, 75 bp, Artificial Sequence
  Synthetic
ctactaatcttggctccggccctgtttctatctctgctgttggtgtcctcgcacctcactctgcgctggccgctt

SEQ ID NO: 149781 - DNA, 75 bp, Artificial Sequence
  Synthetic
taggtctatacagcagggggacgttgatgttgtggttgtgccaacccgcgagctccgtaatagttggcggcgccg

SEQ ID NO: 149782 - DNA, 75 bp, Artificial Sequence
  Synthetic
gatgttgtggttgtgccaacccgcgagctccgtaatagttggcggcgccgcggtttcgctgctttcacaccccat

SEQ ID NO: 149783 - DNA, 75 bp, Artificial Sequence
  Synthetic
cttcacatgcagcgggcctcgtcggtccaccttcttggtgaccccaatcagatacctgctattgattttgagcac

SEQ ID NO: 149784 - DNA, 75 bp, Artificial Sequence
  Synthetic
atgaaggtgggtaaaacccgggagtattgatttatttttcttgtgcctcccttcagttctgtttcttttatttct

SEQ ID NO: 149785 - DNA, 75 bp, Artificial Sequence
  Synthetic
attgatttatttttcttgtgcctcccttcagttctgtttcttttatttctcttttctgcgtttcgcgctccctgg

SEQ ID NO: 149786 - DNA, 75 bp, Artificial Sequence
  Synthetic
tggccgctgtattaccgccctgccctgagcttgagcagggtctactttatatgccacaagagctcacagtttctg

SEQ ID NO: 149787 - DNA, 75 bp, Artificial Sequence
  Synthetic
ttttcttttatcttctttttctgcgctccgcgcctccctgggaaaaaaaaaaaaaaaaaaaaaaaaaaaaaaaaa

SEQ ID NO: 149788 - DNA, 75 bp, Artificial Sequence
  Synthetic
ctcggcggcctgccgacagaattgatttcgtcggctgggggtcagctgttttactcccgccctgttgtctcagcc

SEQ ID NO: 149789 - DNA, 75 bp, Artificial Sequence
  Synthetic
tcttggaaccagttgagggcttagttggcgaccaaggccatgacaatgaggcttatgagggctctgaagtcgacc

SEQ ID NO: 149790 - DNA, 75 bp, Artificial Sequence
  Synthetic
cttaccccaagatccagactaccagccgcgtgctgcgatccctgttctggaacgagtctgctgtgggccggaaat

SEQ ID NO: 149791 - DNA, 75 bp, Artificial Sequence
  Synthetic
tccaccttcttggtgaccccaatcagatacctgctattgattttgagcacgcaggcttggttccggcgatccgcc

SEQ ID NO: 149792 - DNA, 75 bp, Artificial Sequence
  Synthetic
ccgcgtgctgcgatccctgttctggaacgagtctgctgtgggccggaaattggtgtttacgcaggcggctaaggc

SEQ ID NO: 149793 - DNA, 75 bp, Artificial Sequence
  Synthetic
gacagagatacttattaacttgatgcagccccggcagcttgttttccggcctgaggtcctgtggaatcaccccat

SEQ ID NO: 149794 - DNA, 75 bp, Artificial Sequence
  Synthetic
cactcaacattccgcatgacattgctgctcgggcggcccgactaacagctactgttgagctcgctgcaggcccag

SEQ ID NO: 149795 - DNA, 75 bp, Artificial Sequence
  Synthetic
cgatgctagaggcctcattcagtcctcccgcgcacacgccatcgttgcgctcacccgccacacagaaaaatgcgt

SEQ ID NO: 149796 - DNA, 75 bp, Artificial Sequence
  Synthetic
actgttgagctcgctgcaggcccagaccgcctggagtgtcgcaccgtgctcgggaacaaaactttccggacgacg

SEQ ID NO: 149797 - DNA, 75 bp, Artificial Sequence
  Synthetic
tcccgcgcacacgccatcgttgcgctcacccgccacacagaaaaatgcgttattctggacgcccccggcttactg

SEQ ID NO: 149798 - DNA, 75 bp, Artificial Sequence
  Synthetic
gccgctgtcttgaagtgggcgcccacccacgttcgatcaacgacaaccccaacgtcttgcatcgctgttttttaa

SEQ ID NO: 149799 - DNA, 75 bp, Artificial Sequence
  Synthetic
gcaccttgctgtggaataccgtctggaacatggcggttatagcgcactgttatgagtttcgtgaccttaaagttg

SEQ ID NO: 149800 - DNA, 75 bp, Artificial Sequence
  Synthetic
tccaccatacctcgtggctatccggaccagaatttagacaccctgcgagcatttcctccatcttgccaaatcagc

SEQ ID NO: 149801 - DNA, 75 bp, Artificial Sequence
  Synthetic
acactgccccggttcccgacgtggactcccgtggtgctatattgcgccgccagtacaacttgtccacgtcaccgc

SEQ ID NO: 149802 - DNA, 75 bp, Artificial Sequence
  Synthetic
gccctttataggtataacagacacacccagcggcattcgctgaccggtggtttgtggctacaccctgaggggctg

SEQ ID NO: 149803 - DNA, 75 bp, Artificial Sequence
  Synthetic
cttgaacagggtttactctatatgccacaggagctcacagtgtctgatagtgttttgatctttgagctcacgaac

SEQ ID NO: 149804 - DNA, 75 bp, Artificial Sequence
  Synthetic
cacaggagctcacagtgtctgatagtgttttgatctttgagctcacgaacatagttcactgccgcatggctgctc

SEQ ID NO: 149805 - DNA, 75 bp, Artificial Sequence
  Synthetic
tatcgcgttgtccgtgccactattcggtaccggcctctggtgccgaatgcggttggcgggtacgccatatccatc

SEQ ID NO: 149806 - DNA, 75 bp, Artificial Sequence
  Synthetic
gcttttctagtgatttctcccctcctgaggcggccgcccctgcaccggctgccgccccagggctgtcatacccca

SEQ ID NO: 149807 - DNA, 75 bp, Artificial Sequence
  Synthetic
gaggtttatccctaccatcgggccagtccaggccaccacatgtgagctatatgagctggttgaggctatggtgga

SEQ ID NO: 149808 - DNA, 75 bp, Artificial Sequence
  Synthetic
agcttgtgatccctagtgagcgcctgcattatcgcaatcagggttggcgctcggttgagacttctggtgttgcgg

SEQ ID NO: 149809 - DNA, 75 bp, Artificial Sequence
  Synthetic
ccgcccctgagccagttaggccgcccagccctgttaaaccgcctccccctgtgcgtaagccaccggcattgtcgc

SEQ ID NO: 149810 - DNA, 75 bp, Artificial Sequence
  Synthetic
gaaggactgtaacaaatttacaacaggtgagaccattgcccacggcaaggtgggccagggtatttcggcctggag

SEQ ID NO: 149811 - DNA, 75 bp, Artificial Sequence
  Synthetic
gcccatatctgggaccgtctcatgctgttcggggccaccctagatgaccaagccttttgctgctcccgtctaatg

SEQ ID NO: 149812 - DNA, 75 bp, Artificial Sequence
  Synthetic
ggtgagaccattgcccacggcaaggtgggccagggtatttcggcctggagcaagaccttttgcgccctattcggc

SEQ ID NO: 149813 - DNA, 75 bp, Artificial Sequence
  Synthetic
tatgcagggtcactatttgagtcggattgttactggttggtgaatgcctctaacccgggccatcgtcctgggggc

SEQ ID NO: 149814 - DNA, 75 bp, Artificial Sequence
  Synthetic
tgggagcccacccaagatccattaatgacaaccctaatgttttgcaccggtgttttcttcgtccggttgggagag

SEQ ID NO: 149815 - DNA, 75 bp, Artificial Sequence
  Synthetic
gagtcggtgttctctgcagccatttctggggcgggctcttgtatggtctttgaaaacgacttttctgagtttgac

SEQ ID NO: 149816 - DNA, 75 bp, Artificial Sequence
  Synthetic
tgaaaacgacttttctgagtttgacagcacccaaaataacttctctctcggtcttgagtgcgttattatggagga

SEQ ID NO: 149817 - DNA, 75 bp, Artificial Sequence
  Synthetic
ggactttagacctattgggctatatgctggtgttgttgtggctccgggtcttgggacccttccggatgttgtcag

SEQ ID NO: 149818 - DNA, 75 bp, Artificial Sequence
  Synthetic
gaaagggatgaaaagactggagcttgagcacgcacagaagtttataacacgtctttacagctggttgtttgaaaa

SEQ ID NO: 149819 - DNA, 75 bp, Artificial Sequence
  Synthetic
tatcaggtccctgtcggtcttagttttgatgcctgggagcgtaaccatcgtcctggcgacgagctttatctaact

SEQ ID NO: 149820 - DNA, 75 bp, Artificial Sequence
  Synthetic
ctaataagccggcacagccggcacttatgataacggaagatacggctcgcacggccaacctagcactagaaatag

SEQ ID NO: 149821 - DNA, 75 bp, Artificial Sequence
  Synthetic
cattccacatgatattgaccttggtgagtcccgagttgtgattcaggattatgataatcaacacgagcaagaccg

SEQ ID NO: 149822 - DNA, 75 bp, Artificial Sequence
  Synthetic
tagtgattaccgccagagccgcaatgcggctgccctgattgctggctgtgggctgaaattgaaggttgattaccg

SEQ ID NO: 149823 - DNA, 75 bp, Artificial Sequence
  Synthetic
catgatgtgtcaattctccgtgcatggattcgcacaaccaaaatagtcggtgaccacccgttggtcatagagagg

SEQ ID NO: 149824 - DNA, 75 bp, Artificial Sequence
  Synthetic
gtggtggccccgggtcttggggcacttcctgacgttgtccggttcgccggccggctgtccgagaagaactggggc

SEQ ID NO: 149825 - DNA, 75 bp, Artificial Sequence
  Synthetic
atgatgtgctttggctttcattgacggctgctgaatacgatcaaactacttatggttcttccactaatcctatgt

SEQ ID NO: 149826 - DNA, 75 bp, Artificial Sequence
  Synthetic
cgtgatgtttcacgtatcacattcttccagaaggattgtaataaatttacaacaggcgagactattgcccatggc

SEQ ID NO: 149827 - DNA, 75 bp, Artificial Sequence
  Synthetic
cactactaaagctggctacccttataattataacactactgccagtgatcagatcttaattgaaaatgcacctgg

SEQ ID NO: 149828 - DNA, 75 bp, Artificial Sequence
  Synthetic
tgccatcagcgttacctccgaactcaggccatatctaaaggcatgcgtcggctagaggtcgagcacgcccagaaa

SEQ ID NO: 149829 - DNA, 75 bp, Artificial Sequence
  Synthetic
tgatgctaggggtcttatccagtcatcccgagctcatgctatagttgcacttacccgtcacacagagaaatgcgt

SEQ ID NO: 149830 - DNA, 75 bp, Artificial Sequence
  Synthetic
ccctccgctgccccccgccgtcgatctaccccagctggggctgcgccgctgactgctgtttcgcctgcacctgat

SEQ ID NO: 149831 - DNA, 75 bp, Artificial Sequence
  Synthetic
acttaccccggcggcccctctacccccccctgcaccggatccttcccctactccctctgctccggcgcgtggcga

SEQ ID NO: 149832 - DNA, 75 bp, Artificial Sequence
  Synthetic
tctgtaatacctcgtggaaaccccgacaagaatcttgataccctacaggccttcccgccatcttgccagattagt

SEQ ID NO: 149833 - DNA, 75 bp, Artificial Sequence
  Synthetic
acctcatctgttgcctccggaaccaatcttgttttgtatgctgccccgcttaaccctcttctgcccctccaggac

SEQ ID NO: 149834 - DNA, 75 bp, Artificial Sequence
  Synthetic
ccagcgcgtgatccacaatgagctcgagcagtattgccgagcccgagccggccgctgccttgaggtgggtgccca

SEQ ID NO: 149835 - DNA, 75 bp, Artificial Sequence
  Synthetic
cagaggcatctaattatgcccagtatcgagttgttagggccacaattcgctaccgccccttggtgccgaatgctg

SEQ ID NO: 149836 - DNA, 75 bp, Artificial Sequence
  Synthetic
gctagcccaggccgccttgaatgccgtacggtgcttggaaataagaccttccgcacatcaataactgatggtgct

SEQ ID NO: 149837 - DNA, 75 bp, Artificial Sequence
  Synthetic
ggctcaaaagtgtatgctggctccctttttgagtctgagtgtacttggttagttaatgcatccaatcctggtcac

SEQ ID NO: 149838 - DNA, 75 bp, Artificial Sequence
  Synthetic
gtggtataccgccccaacccgtggccctgcagcgaactgccgccggtccgcccttcgtgggcttccacctgttga

SEQ ID NO: 149839 - DNA, 75 bp, Artificial Sequence
  Synthetic
tttttgagtctgagtgtacttggttagttaatgcatccaatcctggtcaccgccccggtggcggcctttgccacg

SEQ ID NO: 149840 - DNA, 75 bp, Artificial Sequence
  Synthetic
ttacttctactgatgtcaggattttggtccagcctggtatagcctctgagttggtcatcccgagcgagcgcctcc

SEQ ID NO: 149841 - DNA, 75 bp, Artificial Sequence
  Synthetic
tgatctgtggcccgctgatgtcgcagaggcaatggcccgccatggtatgacccggctgtatgctgccctccacct

SEQ ID NO: 149842 - DNA, 75 bp, Artificial Sequence
  Synthetic
atgaactggttgaggccatggtggagaagggccaagacggctctgccgtcctggagctcgacctatgtaaccgtg

SEQ ID NO: 149843 - DNA, 75 bp, Artificial Sequence
  Synthetic
tgttgagacctcgggtgtggccgaggaggaggcgacatcaggtttggttatgctttgcatacatggctcccccgt

SEQ ID NO: 149844 - DNA, 75 bp, Artificial Sequence
  Synthetic
ttgggctgagctttgatgcctgggagcgtaaccaccgacccggggatgagttgtacctgactgagccggctatag

SEQ ID NO: 149845 - DNA, 75 bp, Artificial Sequence
  Synthetic
agtaatcacttatgagggggactctagtgccgggtataaccatgatgtgtctatcctgcgtgcttggatccggac

SEQ ID NO: 149846 - DNA, 75 bp, Artificial Sequence
  Synthetic
ttggccagggtatatcagcctggagtaagaccttttgcgccttgtttggcccgtggttccgtgccattgagaaag

SEQ ID NO: 149847 - DNA, 75 bp, Artificial Sequence
  Synthetic
tttaacccctgggaacactaatacccgtgtgtcccggtacaccagcacagcccgacaccgactgcgtcgcggcgc

SEQ ID NO: 149848 - DNA, 75 bp, Artificial Sequence
  Synthetic
cgtgtgtcccggtacaccagcacagcccgacaccgactgcgtcgcggcgctgacggaactgctgagcttacaact

SEQ ID NO: 149849 - DNA, 75 bp, Artificial Sequence
  Synthetic
taagaccttttgcgccttgtttggcccgtggttccgtgccattgagaaagagatactgaccctgcttccgcctaa

SEQ ID NO: 149850 - DNA, 75 bp, Artificial Sequence
  Synthetic
cacggctgcccctgagccgtcgccaatgccgtatgttccatacccccgttcgaccgaggtctatgtccggtccat

SEQ ID NO: 149851 - DNA, 75 bp, Artificial Sequence
  Synthetic
ctttttccatctgcctgctctactaagtccacatttcatgccgtccctgtacatatatgggacaggcttatgctc

SEQ ID NO: 149852 - DNA, 75 bp, Artificial Sequence
  Synthetic
tctcagccaatggcgagccgactgttaagctgtacacctccgtcgagaatgcacagcaggataagggcattgcta

SEQ ID NO: 149853 - DNA, 75 bp, Artificial Sequence
  Synthetic
ccttttgctgctcgaggctcatgacctatctacgtggtatcagctacaaggtcacggttggcgctcttgtcgcca

SEQ ID NO: 149854 - DNA, 75 bp, Artificial Sequence
  Synthetic
ctatctacgtggtatcagctacaaggtcacggttggcgctcttgtcgccaacgagggctggaatgcctccgaaga

SEQ ID NO: 149855 - DNA, 75 bp, Artificial Sequence
  Synthetic
tttggaacaccatttggaacatggcgatcatagcacattgctatgagttccgcgattttcgggttgccgctttca

SEQ ID NO: 149856 - DNA, 75 bp, Artificial Sequence
  Synthetic
ctaccccgtcgccagctccgtctcgccctttctcggtcctccgggccaatgatgttctgtggctctctctaactg

SEQ ID NO: 149857 - DNA, 75 bp, Artificial Sequence
  Synthetic
ccctttctcggtcctccgggccaatgatgttctgtggctctctctaactgctgctgaatatgatcagaccaccta

SEQ ID NO: 149858 - DNA, 75 bp, Artificial Sequence
  Synthetic
tgcccgctctcttgattggtctaaggtcactttggatggtcgacctctcaccaccattcagcagtactccaagac

SEQ ID NO: 149859 - DNA, 75 bp, Artificial Sequence
  Synthetic
tttgatgaggcggccccttgccgctgccggagtttcctccgcaaggcagctcacaagttctgctgctttatgcgg

SEQ ID NO: 149860 - DNA, 75 bp, Artificial Sequence
  Synthetic
tgcgtcttgctgtctgtgacttccttcgagggttaacgaatgttgcgcaggtctgtgttgatgttgtgtcccgtg

SEQ ID NO: 149861 - DNA, 75 bp, Artificial Sequence
  Synthetic
ttacaacaccactgccagcgaccagatcttgatcgagaatgcagctggccaccgtgtcgctatatctacttatac

SEQ ID NO: 149862 - DNA, 75 bp, Artificial Sequence
  Synthetic
tcacaagttctgctgctttatgcggtggttgggccaggactgcacttgcttcctccagcctattgaggggcggat

SEQ ID NO: 149863 - DNA, 75 bp, Artificial Sequence
  Synthetic
ctgccgaggaggccactgtcagtatctccgggtcgtatattgttactggcagccagctgcaacccctctaccaag

SEQ ID NO: 149864 - DNA, 75 bp, Artificial Sequence
  Synthetic
ctccgggtcgtatattgttactggcagccagctgcaacccctctaccaagcacttggtataccttctgatcttgc

SEQ ID NO: 149865 - DNA, 75 bp, Artificial Sequence
  Synthetic
tgaaggtaggtaagacccgggagtcctaattaatttccctcttgtgcccccttctgagttctgctttatttcttt

SEQ ID NO: 149866 - DNA, 75 bp, Artificial Sequence
  Synthetic
aggcaataaaactttttcaacggtctttgccgatggggcccagctagaggccaatgggccggaacagtacgtgct

SEQ ID NO: 149867 - DNA, 75 bp, Artificial Sequence
  Synthetic
tttgccgatggggcccagctagaggccaatgggccggaacagtacgtgctgtcatttgacccggctaagcaaacc

SEQ ID NO: 149868 - DNA, 75 bp, Artificial Sequence
  Synthetic
gtatggcggcacctagtcagcgcaaagcagtcctgtcgactcttgtcggcaggtacggccgccgtacgaagttgt

SEQ ID NO: 149869 - DNA, 75 bp, Artificial Sequence
  Synthetic
ctcgattgtaaggccgtctttccacccggtgttgctacgccctcagcctctggggaggtgtctgcattctgctcg

SEQ ID NO: 149870 - DNA, 75 bp, Artificial Sequence
  Synthetic
ccggtgttgctacgccctcagcctctggggaggtgtctgcattctgctcggccctgtataggttcaaccgttgcg

SEQ ID NO: 149871 - DNA, 75 bp, Artificial Sequence
  Synthetic
accgtttggagtgccgcactgtgctcgggaacaagactttccggacgacggtggttgatggcgcccatcttgagg

SEQ ID NO: 149872 - DNA, 75 bp, Artificial Sequence
  Synthetic
cgggccacagctgggagtctgctaaccccttttgtggtgagagcacactttatacccgcacctggtcggtatcag

SEQ ID NO: 149873 - DNA, 75 bp, Artificial Sequence
  Synthetic
ccccttttgtggtgagagcacactttatacccgcacctggtcggtatcaggcttttcgagttgtttctccccgct

SEQ ID NO: 149874 - DNA, 75 bp, Artificial Sequence
  Synthetic
tccatgaagcccagggcgctacatttacagagaccaccattatagctacggctgatgccaggggccttatccagt

SEQ ID NO: 149875 - DNA, 75 bp, Artificial Sequence
  Synthetic
ggtccagcccggtatcgcctccgagttggtcattcccagtgagcgtctccattatcgcaaccaaggttggcgctc

SEQ ID NO: 149876 - DNA, 75 bp, Artificial Sequence
  Synthetic
tgtacagactcaaccaccggttcccgagcaggtggtaccccccttggatttacctgaccgtggtgctagtcccac

SEQ ID NO: 149877 - DNA, 75 bp, Artificial Sequence
  Synthetic
acccagaataatttttccttgggcctagagtgtgctattatggaggagtgtgggatgccgcagtggctcatccgc

SEQ ID NO: 149878 - DNA, 75 bp, Artificial Sequence
  Synthetic
tacctgaccgtggtgctagtcccactttgaccggcgcccccatagcgccccctgcgccgtcgcactccgtaaccc

SEQ ID NO: 149879 - DNA, 75 bp, Artificial Sequence
  Synthetic
taattcttacaccaatacaccttataccggtgcgctggggctccttgattttgcactagagctcgaattcaggaa

SEQ ID NO: 149880 - DNA, 75 bp, Artificial Sequence
  Synthetic
agtctgaatgcacttggctggtcaatgcgtctaaccccggccaccgccctggcggtggcctttgccatgcattct

SEQ ID NO: 149881 - DNA, 75 bp, Artificial Sequence
  Synthetic
tgacgggaccgctgagcttactactacggcggccacgcgttttatgaaggatctgcattttactggcacaaatgg

SEQ ID NO: 149882 - DNA, 75 bp, Artificial Sequence
  Synthetic
cccggccgatcatccatgctgttgctcccgactatcgagttgagcaaaaccctaagcggcttgaggctgcttatc

SEQ ID NO: 149883 - DNA, 75 bp, Artificial Sequence
  Synthetic
tcccgactatcgagttgagcaaaaccctaagcggcttgaggctgcttatcgggaaacatgttcccgccgggggac

SEQ ID NO: 149884 - DNA, 75 bp, Artificial Sequence
  Synthetic
tcactctgatgtccgtgagtccttagggaggtttatccctaccatcggaccagtccaggccaccacatgtgagct

SEQ ID NO: 149885 - DNA, 75 bp, Artificial Sequence
  Synthetic
tcagtttcgatgcctgggaacgtaaccaccgccctggggatgaactatatctgaccgagccggctatagcttggt

SEQ ID NO: 149886 - DNA, 75 bp, Artificial Sequence
  Synthetic
gagaagggccaggacggttccgctgtgttagagcttgatctctgtagccgtgatgtctcacgcatcacattcttt

SEQ ID NO: 149887 - DNA, 75 bp, Artificial Sequence
  Synthetic
ctgaccgagccggctatagcttggtttgaggctaaccggcctaccctacctgccttgaccattactgaggatgca

SEQ ID NO: 149888 - DNA, 75 bp, Artificial Sequence
  Synthetic
ccactccttcacctgccccctctcgccctttttcggtccttcgtgctaatgatgttttgtggctctcccttaccg

SEQ ID NO: 149889 - DNA, 75 bp, Artificial Sequence
  Synthetic
gagcccggtgtggtccactatcagtttacagccggtgttcctggctctggcaagtctcggtcgatccagcaaggg

SEQ ID NO: 149890 - DNA, 75 bp, Artificial Sequence
  Synthetic
acgtagctactggagctcaggctgttgcccgttcccttgattggtctaaagttactctggatggccgtcccctca

SEQ ID NO: 149891 - DNA, 75 bp, Artificial Sequence
  Synthetic
tgcccgttcccttgattggtctaaagttactctggatggccgtcccctcactactattcagcagtattccaagac

SEQ ID NO: 149892 - DNA, 75 bp, Artificial Sequence
  Synthetic
tcaacatccggcttttctagtgatttctccccccctgaggcggccgctcttgctccggctgctgccccggggttg

SEQ ID NO: 149893 - DNA, 75 bp, Artificial Sequence
  Synthetic
ttataacacaactgctagtgatcagatcttaattgagaatgcagccggtcaccgtgttgctatctctacctacac

SEQ ID NO: 149894 - DNA, 75 bp, Artificial Sequence
  Synthetic
cactagccttggtgctggtcccacctctatttctgcggtcggcgtattagctccgcactcggctcttgctgttct

SEQ ID NO: 149895 - DNA, 75 bp, Artificial Sequence
  Synthetic
acttggttctttacgccgctcctcttagcccgcttctacccctccaggacggcaccaatactcatataatggcta

SEQ ID NO: 149896 - DNA, 75 bp, Artificial Sequence
  Synthetic
tacgacctgagctcgtcccaacgaaatggtggcacctcacccatagatgcccggcggatgtctgtgagctgatcc

SEQ ID NO: 149897 - DNA, 75 bp, Artificial Sequence
  Synthetic
taaccaaatccctgccattgattttgagcatgccggcctagttccggcaatacgacctgagctcgtcccaacgaa

SEQ ID NO: 149898 - DNA, 75 bp, Artificial Sequence
  Synthetic
ccggcggatgtctgtgagctgatccgcggcgcgtatccaaagattcagactgcaagtcgcgtcctccgctccctg

SEQ ID NO: 149899 - DNA, 75 bp, Artificial Sequence
  Synthetic
taaaggggatgattcagtggtcctctgcactgattaccgccagagccgtaatgcggccgccttgattgctggttg

SEQ ID NO: 149900 - DNA, 75 bp, Artificial Sequence
  Synthetic
ttggtggctacgccatctccatctcgttctggccacagaccaccaccaccccgacgtccgtcgacatgaattcaa

SEQ ID NO: 149901 - DNA, 75 bp, Artificial Sequence
  Synthetic
catttactgagactacaattattgccactgcagatgcccgtgggctgattcagtcttctagggctcatgcgattg

SEQ ID NO: 149902 - DNA, 75 bp, Artificial Sequence
  Synthetic
aacctgatgcagccccggcagcttgttttccggcctgaggttctgtggaatcacccgatccagcgggtgatacat

SEQ ID NO: 149903 - DNA, 75 bp, Artificial Sequence
  Synthetic
acgccatagttaataatttctttctttccggcggtcaggtcggccagcaccgcccgtcggtcataccacgtggca

SEQ ID NO: 149904 - DNA, 75 bp, Artificial Sequence
  Synthetic
gacaaccccaatgttttgcatcgttgcttcttaaaacctgttggccgtgatgtccaacggtggtacaccgccccc

SEQ ID NO: 149905 - DNA, 75 bp, Artificial Sequence
  Synthetic
cgggccggtcgctgcctggagattggggctcacccaagatctattaatgataaccccaatgttttgcaccggtgt

SEQ ID NO: 149906 - DNA, 75 bp, Artificial Sequence
  Synthetic
gccgttcagcccttcgcgggcttccaccagtcgaccggacttactgtttcgacggtttttccggttgtacttttg

SEQ ID NO: 149907 - DNA, 75 bp, Artificial Sequence
  Synthetic
cgttctgctctacgtggtctcccccctgttgaccgtacttactgttttgatggattttctcgctgtgcctttgcc

SEQ ID NO: 149908 - DNA, 75 bp, Artificial Sequence
  Synthetic
acggacatagtgcattgccgtatggcggcgccaagtcagcgcaaggcagttctgtcgactttagtcggtaggtat

SEQ ID NO: 149909 - DNA, 75 bp, Artificial Sequence
  Synthetic
atggtatgacccggctgtatgcagccctccacctccccccggaggtgctgctcccccctggcacctatcgtacca

SEQ ID NO: 149910 - DNA, 75 bp, Artificial Sequence
  Synthetic
tgttgctgaggccatggcccgccacgggatgacacgtttatatgctgcactccacctcccccctgaggtgctgct

SEQ ID NO: 149911 - DNA, 75 bp, Artificial Sequence
  Synthetic
atgatgtgtctatcctgcgtgcctggatccgtaccacaaaggtcaccggtgatcacccgctagtaattgagcggg

SEQ ID NO: 149912 - DNA, 75 bp, Artificial Sequence
  Synthetic
atacggctccggtccccgatgttgattctcgcggagctattttacgccgccagtataacttgtctacatctcctt

SEQ ID NO: 149913 - DNA, 75 bp, Artificial Sequence
  Synthetic
tccgggcggtcgggtgccattttgtactccttttaacagctgcacctgagccatcaccaatgccttatgttccat

SEQ ID NO: 149914 - DNA, 75 bp, Artificial Sequence
  Synthetic
gacgtctctatactccgagcgtggatccgaacgactaaaatagttggtgaccatccgctggttatagagcgtgtg

SEQ ID NO: 149915 - DNA, 75 bp, Artificial Sequence
  Synthetic
gtcacacttgatggtcgccccctttccaccatccagcagtattcaaagaccttctttgtcctgccgctccgcggt

SEQ ID NO: 149916 - DNA, 75 bp, Artificial Sequence
  Synthetic
aaaaggagattttagctgcgctcgcccctaatgtcttttatggtgatgcatatgaggacacagtactggccgctg

SEQ ID NO: 149917 - DNA, 75 bp, Artificial Sequence
  Synthetic
gctcgactaagtctacatttcatgccgtccctgtgcatatatgggacaggcttatgctttttggtgcgacccttg

SEQ ID NO: 149918 - DNA, 75 bp, Artificial Sequence
  Synthetic
ctgcccgccaggccatgtcagctggcccttatagcctcacttatgaagtaacacctgctggcttgcgggtccatg

SEQ ID NO: 149919 - DNA, 75 bp, Artificial Sequence
  Synthetic
ctactaaagccgggtacccttataattataataccactgctagtgaccaactgctcgttgagaatgccgccgggc

SEQ ID NO: 149920 - DNA, 75 bp, Artificial Sequence
  Synthetic
ggtttttgagaatgatttttctgagtttgatagcacccaaaataatttctcattggggttggagtgtataatcat

SEQ ID NO: 149921 - DNA, 75 bp, Artificial Sequence
  Synthetic
ctgctcgttgagaatgccgccgggcatcgggttgctatttccacttacaccactagcctgggtgctggccccgtc

SEQ ID NO: 149922 - DNA, 75 bp, Artificial Sequence
  Synthetic
agctataaagtcacggttggcgctctcgtcgccaatgaaggctggaatgcctccgaagacgcattgacagctgtg

SEQ ID NO: 149923 - DNA, 75 bp, Artificial Sequence
  Synthetic
gaccaggcgttttgctgctcacggctcatgacatacctccgtggcattagctacaaggtcactgtcggtgcgctt

SEQ ID NO: 149924 - DNA, 75 bp, Artificial Sequence
  Synthetic
tcatgacatacctccgtggcattagctacaaggtcactgtcggtgcgcttgttgctaatgaggggtggaacgcct

SEQ ID NO: 149925 - DNA, 75 bp, Artificial Sequence
  Synthetic
agggctggcgctcagttgagacctctggtgtcgctgaggaggaggctacttccggtctcgttatgctctgcattc

SEQ ID NO: 149926 - DNA, 75 bp, Artificial Sequence
  Synthetic
aagctctccttttgggaggcgggtactactaaagccgggtacccttataattataataccactgctagtgaccaa

SEQ ID NO: 149927 - DNA, 75 bp, Artificial Sequence
  Synthetic
tggctttcacttacagctgctgagtatgatcagactacttatggttcttccactaatcctatgtatgtctctgat

SEQ ID NO: 149928 - DNA, 75 bp, Artificial Sequence
  Synthetic
ttggagcttgaacatgcccaaaagtttataacacgcctttatagctggctgtttgagaagtccggtcgtgattat

SEQ ID NO: 149929 - DNA, 75 bp, Artificial Sequence
  Synthetic
catttaagggggatgattctgttgtgctctgtagcgattatcggcagagccgcaatgcggctgcgctgatcgctg

SEQ ID NO: 149930 - DNA, 75 bp, Artificial Sequence
  Synthetic
atcacaagactttacagctggttatttgagaagtctggccgcgattacatccccggccgccaactccagttttat

SEQ ID NO: 149931 - DNA, 75 bp, Artificial Sequence
  Synthetic
gtgcttgtgtttgatgaggcagctccctgccgttgtcgcagccttcttcgcagggctgcccacaagttctgttgt

SEQ ID NO: 149932 - DNA, 75 bp, Artificial Sequence
  Synthetic
cctgccgttgtcgcagccttcttcgcagggctgcccacaagttctgttgtttcatgcgatggctggggcaggatt

SEQ ID NO: 149933 - DNA, 75 bp, Artificial Sequence
  Synthetic
atgtcgatccggccgaggaggctactgtgagcatttccgggtcttacatcgtcaccggcagtcagctacagcccc

SEQ ID NO: 149934 - DNA, 75 bp, Artificial Sequence
  Synthetic
tgtgagcatttccgggtcttacatcgtcaccggcagtcagctacagcccctctatcaggcgctcggcatcccttc

SEQ ID NO: 149935 - DNA, 75 bp, Artificial Sequence
  Synthetic
atgcacagcaggacaagggcattgccataccacatgacatagatctaggggattctcgtgtggttatccaggact

SEQ ID NO: 149936 - DNA, 75 bp, Artificial Sequence
  Synthetic
gaccatcttgggcaataaaactttttcaacagcctttgccgacggcgcccagctagaggctaacgggccggagca

SEQ ID NO: 149937 - DNA, 75 bp, Artificial Sequence
  Synthetic
cgttggtatactgctcccactcgcgggccggctgctaattgccgccgttccgcgttgcgcgggctccccgctgct

SEQ ID NO: 149938 - DNA, 75 bp, Artificial Sequence
  Synthetic
tcaacagcctttgccgacggcgcccagctagaggctaacgggccggagcagtatgtgttatcgtttgattcagcc

SEQ ID NO: 149939 - DNA, 75 bp, Artificial Sequence
  Synthetic
tatagggcactcaatatcccgcatgatattgctgctcgagcggcccgattaacagctactgtcgagctcgccgca

SEQ ID NO: 149940 - DNA, 75 bp, Artificial Sequence
  Synthetic
tccagcgggttatacataatgaattagaacagtactgtcggtcccgagctggccgctgtctggaggttggagctc

SEQ ID NO: 149941 - DNA, 75 bp, Artificial Sequence
  Synthetic
cttgaggcgaacggccctgaacaatatgtcctctcatttgacgcctcccgccagtctatgggggccgggtcgcat

SEQ ID NO: 149942 - DNA, 75 bp, Artificial Sequence
  Synthetic
agaacagtactgtcggtcccgagctggccgctgtctggaggttggagctcacccgagatctattaatgacaaccc

SEQ ID NO: 149943 - DNA, 75 bp, Artificial Sequence
  Synthetic
tccgcgggacttgattgtaagacggtcttcccgtctggtgttgcgaccccctccgctcccggggaggtgtctgcc

SEQ ID NO: 149944 - DNA, 75 bp, Artificial Sequence
  Synthetic
agcctcacttacgagctcacgcctgccggcctgcaggttaagattacatctaatggtctagattgcactgccaca

SEQ ID NO: 149945 - DNA, 75 bp, Artificial Sequence
  Synthetic
tcttcccgtctggtgttgcgaccccctccgctcccggggaggtgtctgccttctgttcagccctatataggttca

SEQ ID NO: 149946 - DNA, 75 bp, Artificial Sequence
  Synthetic
ctggcacatatcgcaccgcatcgtacttgctgattcatgacggcaggcgcgttgtggtgacgtatgagggtgata

SEQ ID NO: 149947 - DNA, 75 bp, Artificial Sequence
  Synthetic
ctccttctggccccagaccacgactacacccacttctgttgacatgaactctatcacttctactgatgttaggat

SEQ ID NO: 149948 - DNA, 75 bp, Artificial Sequence
  Synthetic
cgttttctcccggccatagctgggagtctgccaaccctttctgcggtgagagcaccctttacacccgtacctggt

SEQ ID NO: 149949 - DNA, 75 bp, Artificial Sequence
  Synthetic
gtctgccaaccctttctgcggtgagagcaccctttacacccgtacctggtcggtgtcgggcttttctagttgctt

SEQ ID NO: 149950 - DNA, 75 bp, Artificial Sequence
  Synthetic
agatttacccagcggcattcgctgaccggcggtttgtggttacaccctgaggggttgctgggcatctttccccct

SEQ ID NO: 149951 - DNA, 75 bp, Artificial Sequence
  Synthetic
gatgttgattcacgcggtgctattctgcgccgtcagtataatttgtccacatccccgcttacgtctactattgca

SEQ ID NO: 149952 - DNA, 75 bp, Artificial Sequence
  Synthetic
agaagctatggcccgccatgggatgacacgcctttatgcagcactgcatctcccccctgaggtgctgttaccgcc

SEQ ID NO: 149953 - DNA, 75 bp, Artificial Sequence
  Synthetic
acatctggcttctctagtgatttctccccccccgaggcggccgcccctgcaccggttgctgccccagggctgcct

SEQ ID NO: 149954 - DNA, 75 bp, Artificial Sequence
  Synthetic
accattagttacttcagagcaacttcgccccccagttcttgaacaggtcgcgccctcactggccttagttggcag

SEQ ID NO: 149955 - DNA, 75 bp, Artificial Sequence
  Synthetic
cgccccccagttcttgaacaggtcgcgccctcactggccttagttggcagcgccgctggcccggcctcaggctcc

SEQ ID NO: 149956 - DNA, 75 bp, Artificial Sequence
  Synthetic
attatggcaactgaggcctcaaattatgcacagtaccgcgtcgtgcgcgctaccatccggtaccgtcccctggtg

SEQ ID NO: 149957 - DNA, 75 bp, Artificial Sequence
  Synthetic
tctatacttcgtgcgtggattcgcacgactaaaatagttggtgaccacccgttggttatagagcgtgtgcgggct

SEQ ID NO: 149958 - DNA, 75 bp, Artificial Sequence
  Synthetic
taccatccggtaccgtcccctggtgccgaatgccgtcggcgggtatgccatatctatttctttttggcctcaaac

SEQ ID NO: 149959 - DNA, 75 bp, Artificial Sequence
  Synthetic
tttgggtgttaccaccgccctcagtagagtctcaagctgatgcagcgtccgtaccccccgcccctgagtctgctg

SEQ ID NO: 149960 - DNA, 75 bp, Artificial Sequence
  Synthetic
cgactaaaatagttggtgaccacccgttggttatagagcgtgtgcgggctataggctgccattttgtgttgctac

SEQ ID NO: 149961 - DNA, 75 bp, Artificial Sequence
  Synthetic
cctgacggctcaaaggtttatgctggctccctctttgagtctgagtgtacctggctggtcaatgcatctaaccct

SEQ ID NO: 149962 - DNA, 75 bp, Artificial Sequence
  Synthetic
gcggtatctccgcacccaggctatatccaaggggatgcgtcgtctggagcgggagcatgcccagaagtttataac

SEQ ID NO: 149963 - DNA, 75 bp, Artificial Sequence
  Synthetic
aaatccacatttcatgctgtcccggttcatatctgggaccggctcatgctctttggcgccaccctggatgatcag

SEQ ID NO: 149964 - DNA, 75 bp, Artificial Sequence
  Synthetic
attatgtctgacgggtttgcggcctatactttaaccccacggcctattattcatgctgttgcccccgactaccgg

SEQ ID NO: 149965 - DNA, 75 bp, Artificial Sequence
  Synthetic
cagaggttttctggaatcatcccattcaacgtgttatacataatgagttagaacagtattgtcgggctcgtgcgg

SEQ ID NO: 149966 - DNA, 75 bp, Artificial Sequence
  Synthetic
gggagcatgcccagaagtttataacacgcctttacagctggctcttcgagaagtccggccgtgactacatccccg

SEQ ID NO: 149967 - DNA, 75 bp, Artificial Sequence
  Synthetic
gggtcttgcagcatataccttgaccccgcgccctattattcatgcagtggctcccgactacagggttgagcagaa

SEQ ID NO: 149968 - DNA, 75 bp, Artificial Sequence
  Synthetic
tacaccttacaccggcgcccttggcttacttgactttgcacttgagctcgagttccgtaatttgacacctggtaa

SEQ ID NO: 149969 - DNA, 75 bp, Artificial Sequence
  Synthetic
atactttaaccccacggcctattattcatgctgttgcccccgactaccgggtcgaacataaccctaagaggcttg

SEQ ID NO: 149970 - DNA, 75 bp, Artificial Sequence
  Synthetic
cgatctaccccaactggggctgcgccgttaactgctgtttcccctgcgcctgatacggccccagttcctgatgtt

SEQ ID NO: 149971 - DNA, 75 bp, Artificial Sequence
  Synthetic
ggcctgtcgggagagatgtccagcggtggtactccgcccccacccgtggccctgctgctaactgccgccgctctg

SEQ ID NO: 149972 - DNA, 75 bp, Artificial Sequence
  Synthetic
tgcctgttgggcttagttttgatgcttgggagcgcaaccatcggcccggggatgagctctacctgactgagccag

SEQ ID NO: 149973 - DNA, 75 bp, Artificial Sequence
  Synthetic
gctaactactactgctgctacacgttttatgaaagatcttcattttactgggactaatggtgttggtgaagttgg

SEQ ID NO: 149974 - DNA, 75 bp, Artificial Sequence
  Synthetic
aggcatataccaggtccctgttggtcttagtttcgacgcctgggagcgcaatcaccgccccggcgacgagcttta

SEQ ID NO: 149975 - DNA, 75 bp, Artificial Sequence
  Synthetic
cttagtttcgacgcctgggagcgcaatcaccgccccggcgacgagctttacctgactgaacctgctgcggcctgg

SEQ ID NO: 149976 - DNA, 75 bp, Artificial Sequence
  Synthetic
acttggcgctggagctggactcggccaccgaggttggccgggcttgtgctggttgtcgcgttgagccaggtgtcg

SEQ ID NO: 149977 - DNA, 75 bp, Artificial Sequence
  Synthetic
caccgaggttggccgggcttgtgctggttgtcgcgttgagccaggtgtcgttcactaccagtttacggcgggtgt

SEQ ID NO: 149978 - DNA, 75 bp, Artificial Sequence
  Synthetic
ctttgacgagtcagtaccctgtcgatgtaggacgttcctaaagaaagttgcaggcaaattctgttgtttcatgcg

SEQ ID NO: 149979 - DNA, 75 bp, Artificial Sequence
  Synthetic
tgtaggacgttcctaaagaaagttgcaggcaaattctgttgtttcatgcggtggttagggcaggagtgcacctgc

SEQ ID NO: 149980 - DNA, 75 bp, Artificial Sequence
  Synthetic
cgccccgtcgtctcagccaatggcgagccgactgtgaaactttacacttcagtcgagaatgcccagcaggataag

SEQ ID NO: 149981 - DNA, 75 bp, Artificial Sequence
  Synthetic
cgtcgtaacttatgaaggtgacactagtgctggctataaccatgatgtctctattcttcgcgcttggatccgcac

SEQ ID NO: 149982 - DNA, 75 bp, Artificial Sequence
  Synthetic
taactcgtggcgccgccgcgggttcgcagcttacacaccccacactgcagcccgcgttacccgtggccgtagggt

SEQ ID NO: 149983 - DNA, 75 bp, Artificial Sequence
  Synthetic
caagatcgtcctactccgtctcctgccccctctcgtcctttttctgttcttcgtgctaatgatgtgctttggctt

SEQ ID NO: 149984 - DNA, 75 bp, Artificial Sequence
  Synthetic
ccccctctcgtcctttttctgttcttcgtgctaatgatgtgctttggctttcacttacagctgctgaatacgatc

SEQ ID NO: 149985 - DNA, 75 bp, Artificial Sequence
  Synthetic
tctctgggacctatgctgtccacgggcgccagctcgaggccctttatagggcactcaatatcccgcatgatatcg

SEQ ID NO: 149986 - DNA, 75 bp, Artificial Sequence
  Synthetic
tcacttacagctgctgaatacgatcagactacctatggctcctctactaatcctatgtatgtttctgacaccgta

SEQ ID NO: 149987 - DNA, 75 bp, Artificial Sequence
  Synthetic
agtgctggctataaccatgatgtctctattcttcgcgcttggatccgcacgacaaaaatcgtcggcgaacacccg

SEQ ID NO: 149988 - DNA, 75 bp, Artificial Sequence
  Synthetic
atgccttacgtccctttcccccgctctacagaggtatttgttcgttcaatattcggtccgggtggttcaccctcc

SEQ ID NO: 149989 - DNA, 75 bp, Artificial Sequence
  Synthetic
gccattgactttgagcacgccggccttgtcccggcaattcggcctgagcttgttccaacaaagtggtggcacctt

SEQ ID NO: 149990 - DNA, 75 bp, Artificial Sequence
  Synthetic
gcagcttacacaccccacactgcagcccgcgttacccgtggccgtagggtcgttatcgacgaggctccgtcactt

SEQ ID NO: 149991 - DNA, 75 bp, Artificial Sequence
  Synthetic
ttggaaataagactttccggacgacggtggttgatggagctcatcttgaggcgaacggccctgagcagtatgttt

SEQ ID NO: 149992 - DNA, 75 bp, Artificial Sequence
  Synthetic
cgtccacttaccactattcagcagtattctaagactttctttgttttaccccttcgtggtaaactttctttttgg

SEQ ID NO: 149993 - DNA, 75 bp, Artificial Sequence
  Synthetic
aatctactttccatgccgtccctgttcatatttgggataggctcatgctctttggcgctacgctggacgatcagg

SEQ ID NO: 149994 - DNA, 75 bp, Artificial Sequence
  Synthetic
attctaagactttctttgttttaccccttcgtggtaaactttctttttgggaggccggtaccactaaggctggtt

SEQ ID NO: 149995 - DNA, 75 bp, Artificial Sequence
  Synthetic
cccctgttggccagaagcttgtattcactcaggcggcgaaggccgctaatcctggtgcgattacagtccatgagg

SEQ ID NO: 149996 - DNA, 75 bp, Artificial Sequence
  Synthetic
cactcaggcggcgaaggccgctaatcctggtgcgattacagtccatgaggctcaaggtgccacattcactgagac

SEQ ID NO: 149997 - DNA, 75 bp, Artificial Sequence
  Synthetic
tgcaagttaagatttcatctaatggtctggactgcacagcaacattcccccccggtggtgctcccagcgccgcgc

SEQ ID NO: 149998 - DNA, 75 bp, Artificial Sequence
  Synthetic
cagaagttggtcttcacgcaggctgctaaagctgctaaccctggtgcgattacggtccatgaagcccagggcgcc

SEQ ID NO: 149999 - DNA, 75 bp, Artificial Sequence
  Synthetic
acgagggctggaatgcttctgaggatgccctcactgcagtgatcaccgcggcgtacctcaccatctgccaccagc

SEQ ID NO: 150000 - DNA, 75 bp, Artificial Sequence
  Synthetic
ctaaagctgctaaccctggtgcgattacggtccatgaagcccagggcgccaccttcacagagaccacaattatag

SEQ ID NO: 150001 - DNA, 75 bp, Artificial Sequence
  Synthetic
ctacttacactactaatttaggctctgggcctgtttctatttctgctgtgggtgttttagcaccccattctgcct

SEQ ID NO: 150002 - DNA, 75 bp, Artificial Sequence
  Synthetic
gtctgtggttgcaccccgaggggctgttgggcatcttcccccctttctctcctgggcatatctgggagtctgcta

SEQ ID NO: 150003 - DNA, 75 bp, Artificial Sequence
  Synthetic
gttgggcatcttcccccctttctctcctgggcatatctgggagtctgctaaccccttctgtggggagaggacttt

SEQ ID NO: 150004 - DNA, 75 bp, Artificial Sequence
  Synthetic
gtccggccgcgactatatccccggccgccagctccagttttatgcgcagtgccggcgctggctctctgccggttt

SEQ ID NO: 150005 - DNA, 75 bp, Artificial Sequence
  Synthetic
cgcttggcctccagggctgtgcttttcaatctactgtcgctgagttacaacgtcttaaaatgaaggtgggtaaaa

SEQ ID NO: 150006 - DNA, 75 bp, Artificial Sequence
  Synthetic
cgccagctccagttttatgcgcagtgccggcgctggctctctgccggttttcacttggacccgagagtacttgtc

SEQ ID NO: 150007 - DNA, 75 bp, Artificial Sequence
  Synthetic
cccgggagtattgatttattttccttgtgccttcctttgtactgttttctttatttctcttttctgcgtttcgcg

SEQ ID NO: 150008 - DNA, 75 bp, Artificial Sequence
  Synthetic
ccctcctgccagtttagtgcttaccaccagctggcagaggagctcggccatcgaccggccccaattgctgccgtc

SEQ ID NO: 150009 - DNA, 75 bp, Artificial Sequence
  Synthetic
ggctgccccaggaccacctcactctactccacccgctagtgatatttgggtgttaccaccaccctctgaagactc

SEQ ID NO: 150010 - DNA, 75 bp, Artificial Sequence
  Synthetic
tacaggccttcccgccatcttgtcagattagtgcttaccaccagttggctgaggagctaggtcaccgcccggctc

SEQ ID NO: 150011 - DNA, 75 bp, Artificial Sequence
  Synthetic
tggctcggccaggagtgcacctgcttcttggagcctgcggaaggcctgcttggtgaccaaggtcatgacaacgag

SEQ ID NO: 150012 - DNA, 75 bp, Artificial Sequence
  Synthetic
actccacccgctagtgatatttgggtgttaccaccaccctctgaagactcccggactagcacgactcttgtgcct

SEQ ID NO: 150013 - DNA, 75 bp, Artificial Sequence
  Synthetic
accagctggcagaggagctcggccatcgaccggccccaattgctgccgtcctgccgccttgcccggagctcgagc

SEQ ID NO: 150014 - DNA, 75 bp, Artificial Sequence
  Synthetic
actgccgtatggcggcgcccagtcagcgcaaggcagttttgtcaactcttgtcggcaggtacggccgccgcacga

SEQ ID NO: 150015 - DNA, 75 bp, Artificial Sequence
  Synthetic
ccgatagtgtgttggtctttgaactcacggatatagtccactgccgtatggctgccccaagccagcggaaggccg

SEQ ID NO: 150016 - DNA, 75 bp, Artificial Sequence
  Synthetic
ccccctcgcacccgccgtctcctttacacctaccccgatggcgctaaggtgtatgcggggtcactgtttgagtcg

SEQ ID NO: 150017 - DNA, 75 bp, Artificial Sequence
  Synthetic
cgactgttggtggacctgtataaagcacttaatgtcccgcaggatattgtagcgcgggccgcccgtttatcggct

SEQ ID NO: 150018 - DNA, 75 bp, Artificial Sequence
  Synthetic
acacctaccccgatggcgctaaggtgtatgcggggtcactgtttgagtcggactgcgattggttggttaacgcct

SEQ ID NO: 150019 - DNA, 75 bp, Artificial Sequence
  Synthetic
cacttaatgtcccgcaggatattgtagcgcgggccgcccgtttatcggctactgtcgagctcgctgttggcccag

SEQ ID NO: 150020 - DNA, 75 bp, Artificial Sequence
  Synthetic
gcgcaaggcagttttgtcaactcttgtcggcaggtacggccgccgcacgaaactgtacgaggctgcccatgcaga

SEQ ID NO: 150021 - DNA, 75 bp, Artificial Sequence
  Synthetic
cggcctgttggcagagacgtccagcggtggtattccgcccctactcgtggccctgctgctaattgtcgtcgctcc

SEQ ID NO: 150022 - DNA, 75 bp, Artificial Sequence
  Synthetic
ctgaatttatcatgcgcgaaggacttgcagcatatactctgactccgcgccctatcatccacgcggtggcccccg

SEQ ID NO: 150023 - DNA, 75 bp, Artificial Sequence
  Synthetic
caaatggccctgagcagtacgtcctttcatttgatgaagcccgccagtgcatgggtgccgggccgcatagccttg

SEQ ID NO: 150024 - DNA, 75 bp, Artificial Sequence
  Synthetic
cgtcgaggctatggtggagaaaggtcaggatggctcggcggttctggagcttgacctgtgtagccgtgatgtgtc

SEQ ID NO: 150025 - DNA, 75 bp, Artificial Sequence
  Synthetic
gcgttgcgtggcctccctcctgttgaccgtacttactgttttgatgggttttccagctgcacgtttgcagctgag

SEQ ID NO: 150026 - DNA, 75 bp, Artificial Sequence
  Synthetic
tgcagcatatactctgactccgcgccctatcatccacgcggtggcccccgactatagggctgagcagaacccaaa

SEQ ID NO: 150027 - DNA, 75 bp, Artificial Sequence
  Synthetic
ttcatttgatgaagcccgccagtgcatgggtgccgggccgcatagccttgcctatgagctcactccaagtgggct

SEQ ID NO: 150028 - DNA, 75 bp, Artificial Sequence
  Synthetic
ttttgtgccttgtttggcccttggtttcgtgctattgagaaggaaatcctggcggtgcttgcacctaatgttttc

SEQ ID NO: 150029 - DNA, 75 bp, Artificial Sequence
  Synthetic
ctaccgggtccctgttagcctcagctttgatgcttgggagcgcaaccatcgtcccggtgatgagctttatttgac

SEQ ID NO: 150030 - DNA, 75 bp, Artificial Sequence
  Synthetic
gcacgtctgtatgctgtactgcacctccctcctgaggtcttactgccaccaggcacttaccacaccacctcctac

SEQ ID NO: 150031 - DNA, 75 bp, Artificial Sequence
  Synthetic
tgcggaggttacggccttttgcagcgctttgtatagatacaatagaaccatccagcggcactcgattgttggcgg

SEQ ID NO: 150032 - DNA, 75 bp, Artificial Sequence
  Synthetic
tccctcctgaggtcttactgccaccaggcacttaccacaccacctcctaccttctgattcacgacggcagtcgtg

SEQ ID NO: 150033 - DNA, 75 bp, Artificial Sequence
  Synthetic
gctttgtatagatacaatagaaccatccagcggcactcgattgttggcgggctatggttacacccggaggggctg

SEQ ID NO: 150034 - DNA, 75 bp, Artificial Sequence
  Synthetic
ttcgtgctattgagaaggaaatcctggcggtgcttgcacctaatgttttctacggtgacgcatatgaggacacag

SEQ ID NO: 150035 - DNA, 75 bp, Artificial Sequence
  Synthetic
aaaacaacttctcgctcggattggagtgtataattatggaggagtgtggtatgccgcagtggatgatccggcttt

SEQ ID NO: 150036 - DNA, 75 bp, Artificial Sequence
  Synthetic
gtgtataattatggaggagtgtggtatgccgcagtggatgatccggctttatcatcttgtccgctctgcctgggt

SEQ ID NO: 150037 - DNA, 75 bp, Artificial Sequence
  Synthetic
tacactagaacttggtctgagtccggcttctctagtgatttcctaccacctgaggtggccgctactgtcccccgt

SEQ ID NO: 150038 - DNA, 75 bp, Artificial Sequence
  Synthetic
cgacaaaaatcaccggcgaccacccgctggtgatagagcgggtccgcgctattggctgccattttgtgttgttgc

SEQ ID NO: 150039 - DNA, 75 bp, Artificial Sequence
  Synthetic
gcttctctagtgatttcctaccacctgaggtggccgctactgtcccccgttccgttgacctgccccatgcaccga

SEQ ID NO: 150040 - DNA, 75 bp, Artificial Sequence
  Synthetic
tgatgtggtggtcgtccccacccgggaactccgtaacagctggcgtcgccggggttttgcagcttttacacccca

SEQ ID NO: 150041 - DNA, 75 bp, Artificial Sequence
  Synthetic
tactgtctggaacatggcagtcatagcacattgctacgagttccgtgacctgagggttgcggcgttcaaagggga

SEQ ID NO: 150042 - DNA, 75 bp, Artificial Sequence
  Synthetic
gaactccgtaacagctggcgtcgccggggttttgcagcttttacaccccacacggcggcccgtgtcactataggc

SEQ ID NO: 150043 - DNA, 75 bp, Artificial Sequence
  Synthetic
cgcctaggccttctgcccataagccgccgggaccgtctctagcccgtaaccgtcggctcctttacacctacccgg

SEQ ID NO: 150044 - DNA, 75 bp, Artificial Sequence
  Synthetic
aaatctacctttcacgccgtccctgtccatatttgggataggctcatgctttttggcgccacgctggatgaccag

SEQ ID NO: 150045 - DNA, 75 bp, Artificial Sequence
  Synthetic
gccgggaccgtctctagcccgtaaccgtcggctcctttacacctacccggatggcgctaagatttactcagggtc

SEQ ID NO: 150046 - DNA, 75 bp, Artificial Sequence
  Synthetic
gcacattgctacgagttccgtgacctgagggttgcggcgttcaaaggggatgactctgttgtactctgcagcgat

SEQ ID NO: 150047 - DNA, 75 bp, Artificial Sequence
  Synthetic
ccctccgtcttgccagattagtgctttccaccagctggctgaggagctcggccacagacctgcccctgttgcagc

SEQ ID NO: 150048 - DNA, 75 bp, Artificial Sequence
  Synthetic
tgctggcctggtccccgcgatccgccctgagctcgcgccaactagctggtggcatgttacacaccgctgcccggc

SEQ ID NO: 150049 - DNA, 75 bp, Artificial Sequence
  Synthetic
tgctttctaccagcgcttcccacagtcttttgaccacactaagtttattatgcaggatgggctcgccgcatacac

SEQ ID NO: 150050 - DNA, 75 bp, Artificial Sequence
  Synthetic
atgccctcactgcagtgatcaccgcggcgtaccccaccatctgccaccagcgctacctccgcacccaggcgattt

SEQ ID NO: 150051 - DNA, 75 bp, Artificial Sequence
  Synthetic
tgcaggatgggctcgccgcatacaccctgacacctcgcccgatcatccatgcggttgcccccgattatagagtgg

SEQ ID NO: 150052 - DNA, 75 bp, Artificial Sequence
  Synthetic
ccccgggtctcgggacccttcctgatgttgtcaggtttgctggacggctctcagagaagaactgggggcctggct

SEQ ID NO: 150053 - DNA, 75 bp, Artificial Sequence
  Synthetic
tgagcacgcccagaagtttatcaccaggctctatagctggctgtttgaaaagtctggccgtgattatatccctgg

SEQ ID NO: 150054 - DNA, 75 bp, Artificial Sequence
  Synthetic
tggatgttgtttcgcaagtttatggtgtcagccctggtttagtacataacctgattgggatgctccaaaccatcg

SEQ ID NO: 150055 - DNA, 75 bp, Artificial Sequence
  Synthetic
ttggttttcacccaggctgctaaggctgctaaccccggcgcgatcacagttcatgaagcccagggtgccactttt

SEQ ID NO: 150056 - DNA, 75 bp, Artificial Sequence
  Synthetic
aggctctatagctggctgtttgaaaagtctggccgtgattatatccctggccgccagctccagttttatgcgcag

SEQ ID NO: 150057 - DNA, 75 bp, Artificial Sequence
  Synthetic
tgtaggcccaagttttgacgcctgggaacgaaaccaccgacccggtgatgaactttatcttaccgaacttgcgac

SEQ ID NO: 150058 - DNA, 75 bp, Artificial Sequence
  Synthetic
ctcacccgccacacagagaagtgcgtcattttggatgcccccggtctgttgcgcgaggtcggtatatcagatgtg

SEQ ID NO: 150059 - DNA, 75 bp, Artificial Sequence
  Synthetic
tgcagcaggtgccggcctttcattaggggccggcgccgccccagcactgcccgccctgaccataacagaggatac

SEQ ID NO: 150060 - DNA, 75 bp, Artificial Sequence
  Synthetic
ggggccggcgccgccccagcactgcccgccctgaccataacagaggatacagcccgggctgccaatcttgcattg

SEQ ID NO: 150061 - DNA, 75 bp, Artificial Sequence
  Synthetic
gatcacaaccttgataccctacaggccttcccaccgtcttgtcagatcagtgcttatcatcaactggccgaggag

SEQ ID NO: 150062 - DNA, 75 bp, Artificial Sequence
  Synthetic
tcccctatattcatccaaccaaccccttcgcatctgacattccaaccgccgccggggctggagctcgccctcggc

SEQ ID NO: 150063 - DNA, 75 bp, Artificial Sequence
  Synthetic
gcaactgttggtagatttatatagggcactcaacgttccgcatgatattgctgcccgagccgcacgtttgtcggc

SEQ ID NO: 150064 - DNA, 75 bp, Artificial Sequence
  Synthetic
tttactgcgggcgttcccgggtctggtaagtcaaggtctatacaacagggtgatgttgatgttgtggttgtgccc

SEQ ID NO: 150065 - DNA, 75 bp, Artificial Sequence
  Synthetic
gtaagtcaaggtctatacaacagggtgatgttgatgttgtggttgtgcccacccgcgagctccgtggcagttggc

SEQ ID NO: 150066 - DNA, 75 bp, Artificial Sequence
  Synthetic
gattactgacggtgcccaattggaggcaaatggccctgagcagtatgtcctttcatttgatgaagcccgccagtg

SEQ ID NO: 150067 - DNA, 75 bp, Artificial Sequence
  Synthetic
aagcaccatctctcccgccccatttgctgctactacatatgcagcgtgcttcatcagtgcaccttcttggtgacc

SEQ ID NO: 150068 - DNA, 75 bp, Artificial Sequence
  Synthetic
tctaccattgccactggtactaatcttgtgctgtatgctgctccgctgagtcctctgcttccgcttcaagatggg

SEQ ID NO: 150069 - DNA, 75 bp, Artificial Sequence
  Synthetic
tccggtgagcccggcactcttctatggaatactgtctggaacatggctgttattacccactgttatgacttccgc

SEQ ID NO: 150070 - DNA, 75 bp, Artificial Sequence
  Synthetic
ttgtgctgtatgctgctccgctgagtcctctgcttccgcttcaagatgggactaacacgcatattatggccactg

SEQ ID NO: 150071 - DNA, 75 bp, Artificial Sequence
  Synthetic
cgccttgtatagatacaacaggaccatccagcggcactcgattgttggcgggctatggttacacccagaggggtt

SEQ ID NO: 150072 - DNA, 75 bp, Artificial Sequence
  Synthetic
gatgtttcgcgcatcacatttttccaaaaagactgtaataagtttacaactggtgagaccattgcccatggcaag

SEQ ID NO: 150073 - DNA, 75 bp, Artificial Sequence
  Synthetic
atggctaccgaggcatctaattatgcccagtaccgggtggtccgagctacaatccgctaccgcccgctggtgcca

SEQ ID NO: 150074 - DNA, 75 bp, Artificial Sequence
  Synthetic
gcggctatgctatatctatttctttctggccccagacaacgactaccccaacgtctgttgatatgaattccatca

SEQ ID NO: 150075 - DNA, 75 bp, Artificial Sequence
  Synthetic
gctggtggcacgttacgcaccggtgccctgcggatgtctgcgaacttatacgtggggcgtaccccaagattcaga

SEQ ID NO: 150076 - DNA, 75 bp, Artificial Sequence
  Synthetic
aaaaagactgtaataagtttacaactggtgagaccattgcccatggcaaggttggtcagggcatatcggcctgga

SEQ ID NO: 150077 - DNA, 75 bp, Artificial Sequence
  Synthetic
cactacccccacctccgttgatatgaattctattacttctactgatgttaggatcctggtccagcccggtattgc

SEQ ID NO: 150078 - DNA, 75 bp, Artificial Sequence
  Synthetic
gtaagaccttttgtgctttgtttggcccgtggttccgtgccattgaaaaggagatattggccctgctcccgccta

SEQ ID NO: 150079 - DNA, 75 bp, Artificial Sequence
  Synthetic
aattctattacttctactgatgttaggatcctggtccagcccggtattgcttctgagttggtcatccccagtgag

SEQ ID NO: 150080 - DNA, 75 bp, Artificial Sequence
  Synthetic
tgagacctctggtgttgctgaggaggaggcgacttccggccttgtcatgctctgcatccacggttcacctgtgaa

SEQ ID NO: 150081 - DNA, 75 bp, Artificial Sequence
  Synthetic
gccttgctgttagtgacttcctccgcaagctcacgaatgtcgctcagatgtgtgtggacgtcgtttcccgtgttt

SEQ ID NO: 150082 - DNA, 75 bp, Artificial Sequence
  Synthetic
ttgaaaatgacttctccgagtttgacagtacccagaataacttttcccttggccttgagtgtgtcattatggagg

SEQ ID NO: 150083 - DNA, 75 bp, Artificial Sequence
  Synthetic
tcctgttgacctgccttccaaaccggctcctcctgagattgccgttcgagccccgtcaccaccccccgtggcccc

SEQ ID NO: 150084 - DNA, 75 bp, Artificial Sequence
  Synthetic
acatttactgagaccactatcatcgccacggctgatgcaagaggcctcatccagtcgtcccgggcacatgctatt

SEQ ID NO: 150085 - DNA, 75 bp, Artificial Sequence
  Synthetic
gatgtgatagttaataacttctttctagctggtggtgagattggccaccaccgcccctctgtcatacctcgcggc

SEQ ID NO: 150086 - DNA, 75 bp, Artificial Sequence
  Synthetic
tagctggtggtgagattggccaccaccgcccctctgtcatacctcgcggcaacccagatcgaaactttgacactc

SEQ ID NO: 150087 - DNA, 75 bp, Artificial Sequence
  Synthetic
gtctcccgttattcgagtagtgcacgtcacaagctacgccgtgggcctgatggcaccgctgaattgactacgact

SEQ ID NO: 150088 - DNA, 75 bp, Artificial Sequence
  Synthetic
gaggcgacttccggccttgtcatgctctgcatccacggttcacctgtgaactcttacactaacacaccctatacc

SEQ ID NO: 150089 - DNA, 75 bp, Artificial Sequence
  Synthetic
gtcacaagctacgccgtgggcctgatggcaccgctgaattgactacgactgctgctacacgtttcatgaaagacc

SEQ ID NO: 150090 - DNA, 75 bp, Artificial Sequence
  Synthetic
caccgcccgggcggcggcctctgtcatgccttttaccaacgtttcccccagtcttttgaccataccaagtttatt

SEQ ID NO: 150091 - DNA, 75 bp, Artificial Sequence
  Synthetic
atgccttttaccaacgtttcccccagtcttttgaccataccaagtttattatgcgggacgggctggctgcttaca

SEQ ID NO: 150092 - DNA, 75 bp, Artificial Sequence
  Synthetic
ctgtggcagctgtcctgccgccctgccccgagctcgagcagggcctgctctacatgcctcaggagctcacagtgt

SEQ ID NO: 150093 - DNA, 75 bp, Artificial Sequence
  Synthetic
atgcgggacgggctggctgcttacaccctgacacctcgcccgatcattcatgcagttgcccctgattatagagtt

SEQ ID NO: 150094 - DNA, 75 bp, Artificial Sequence
  Synthetic
acctcttccgtggccaccggtactaacctggttctttatgccgcccctcttagtccgcttttacccctccaggac

SEQ ID NO: 150095 - DNA, 75 bp, Artificial Sequence
  Synthetic
cgcttctcggtgggcttccgacagaattgatttcgtcggccggtggtcagctgttttactctcgccccgtcgtct

SEQ ID NO: 150096 - DNA, 75 bp, Artificial Sequence
  Synthetic
taccgacagaattgatttcgtcggctgggggtcagttgttttactcccgccctgtcgtctcagccaatggcgagc

SEQ ID NO: 150097 - DNA, 75 bp, Artificial Sequence
  Synthetic
actttacacttcagttgagaatgcccagcaggataagggaatagctataccgcatgatatcgatcttggtgagtc

SEQ ID NO: 150098 - DNA, 75 bp, Artificial Sequence
  Synthetic
cctgtcgtctcagccaatggcgagccgactgtaaagttatatacatctgttgagaatgcgcagcaggataagggc

SEQ ID NO: 150099 - DNA, 75 bp, Artificial Sequence
  Synthetic
gctgcccactcggacgtgcgtgaatcactcactaggttcatccccaccatcggccctgtgcaggctaccacttgc

SEQ ID NO: 150100 - DNA, 75 bp, Artificial Sequence
  Synthetic
ctgttggcccgagctttgatgcctgggagcgaaaccatcgacccggggatgaactttatctcaccgagcctgcaa

SEQ ID NO: 150101 - DNA, 75 bp, Artificial Sequence
  Synthetic
gtgctttggctctcacttacagctgctgagtatgatcagaccacttatggttcctctacaaatcctatgtatgtc

SEQ ID NO: 150102 - DNA, 75 bp, Artificial Sequence
  Synthetic
ctgcaaccggggccggccctcgacctgaggctgataccggtccggcactgcccgccctgactataacagaggatg

SEQ ID NO: 150103 - DNA, 75 bp, Artificial Sequence
  Synthetic
tgctaatgatgttttgtggctctctcttaccgctgccgagtatgaccagactacgtatgggtcgtccaccaaccc

SEQ ID NO: 150104 - DNA, 75 bp, Artificial Sequence
  Synthetic
gaggaggccacctctggtcttgttatgctttgcatacatggctcacccgtaaattcctatactaatacaccctat

SEQ ID NO: 150105 - DNA, 75 bp, Artificial Sequence
  Synthetic
agccgggatgtgtcccgaataacgttctttcagaaagactgtaataagttcacgaccggggagacgatcgctcac

SEQ ID NO: 150106 - DNA, 75 bp, Artificial Sequence
  Synthetic
cccgccctgactataacagaggatgcagctcggacggccaaccttgccttggaaatcgactccaggactgagcta

SEQ ID NO: 150107 - DNA, 75 bp, Artificial Sequence
  Synthetic
accttggatgggcgcccgcttatgactatccagcagtattctaagactttctttgttttgccccttcgtggcaaa

SEQ ID NO: 150108 - DNA, 75 bp, Artificial Sequence
  Synthetic
tctttcagaaagactgtaataagttcacgaccggggagacgatcgctcacggcaaagtgggtcaggggatatcag

SEQ ID NO: 150109 - DNA, 75 bp, Artificial Sequence
  Synthetic
cgcccaacatattttatggtgatgcttttgaggattccgtgttctccgctgctgttactggtgcggggtcgagca

SEQ ID NO: 150110 - DNA, 75 bp, Artificial Sequence
  Synthetic
ttttgaggattccgtgttctccgctgctgttactggtgcggggtcgagcatggtgtttgagaacgacttctcgga

SEQ ID NO: 150111 - DNA, 75 bp, Artificial Sequence
  Synthetic
ctatccagcagtattctaagactttctttgttttgccccttcgtggcaaactttccttctgggaagctggtacta

SEQ ID NO: 150112 - DNA, 75 bp, Artificial Sequence
  Synthetic
gtgtttgtatctcgacttacactactaatcttggatctggccctgtttctatttctgctgttggtgtcctcgcac

SEQ ID NO: 150113 - DNA, 75 bp, Artificial Sequence
  Synthetic
taatcttggatctggccctgtttctatttctgctgttggtgtcctcgcacctcattctgcgttagctgcattaga

SEQ ID NO: 150114 - DNA, 75 bp, Artificial Sequence
  Synthetic
gttagttagattgtaccacctggtgcgatctgcctgggttttacaggccccaaaggagtctctaaaaggcctttg

SEQ ID NO: 150115 - DNA, 75 bp, Artificial Sequence
  Synthetic
cctataccactagcctgggtgctggccccacatctatttctgcggtcggcgtattagccccgcactcagcccttg

SEQ ID NO: 150116 - DNA, 75 bp, Artificial Sequence
  Synthetic
cgatctgcctgggttttacaggccccaaaggagtctctaaaaggcctttggaagaagcattccggcgagcccggt

SEQ ID NO: 150117 - DNA, 75 bp, Artificial Sequence
  Synthetic
ccgaaccagattcccgcaattgattttgagcatgctggtcttgtccccgcaatccgtcctgagctcgcccccacc

SEQ ID NO: 150118 - DNA, 75 bp, Artificial Sequence
  Synthetic
gcatttaaaggggacgactcggtggttctttgcagtgattaccgccagagtcgatttgcggcggcactgattgca

SEQ ID NO: 150119 - DNA, 75 bp, Artificial Sequence
  Synthetic
agtataatctgtctacgtctccactcacgtcgtctgtcgcctcgggcactaatttggttctttatgctgccccgc

SEQ ID NO: 150120 - DNA, 75 bp, Artificial Sequence
  Synthetic
actaccagccgtgtgctgaggtctctgttctggggtgacccccccgttggccagaagttggttttcacgcaagcc

SEQ ID NO: 150121 - DNA, 75 bp, Artificial Sequence
  Synthetic
tgttctggggtgacccccccgttggccagaagttggttttcacgcaagccgcaaaagcagccaatcctggtgcga

SEQ ID NO: 150122 - DNA, 75 bp, Artificial Sequence
  Synthetic
gggagtcttaattaatttttcctgtgcccccttcgcagtcttctttagttttatttcttttttctgcttttcgcg

SEQ ID NO: 150123 - DNA, 75 bp, Artificial Sequence
  Synthetic
cacgtcgtctgtcgcctcgggcactaatttggttctttatgctgccccgctgaatccccttttaccccttcagga

SEQ ID NO: 150124 - DNA, 75 bp, Artificial Sequence
  Synthetic
tcactgttcatgaggcccagggggctacattcactgagaccactattatcgcgacggctgatgcaagaggcctca

SEQ ID NO: 150125 - DNA, 75 bp, Artificial Sequence
  Synthetic
tcgccgggcggcttacagagaagaactggggccctggccctgaaagggccgagcagttacgcctagccgtctgtg

SEQ ID NO: 150126 - DNA, 75 bp, Artificial Sequence
  Synthetic
ttaccgcccgttggtgccaaacgctgtaggcggttatgccatttctatttctttttggcctcaaactacgactac

SEQ ID NO: 150127 - DNA, 75 bp, Artificial Sequence
  Synthetic
tcatctccggcgccggtgcagtctgtaacccgcccatctgggccccgtcggcggctacttcatacttatcctgat

SEQ ID NO: 150128 - DNA, 75 bp, Artificial Sequence
  Synthetic
ttctttgcagtgattaccgccagagtcgatttgcggcggcactgattgcaggctgcgggctcaagcttaaagtcg

SEQ ID NO: 150129 - DNA, 75 bp, Artificial Sequence
  Synthetic
ctggggccctggccctgaaagggccgagcagttacgcctagccgtctgtgacttcttgagaaagctgacgaatgt

SEQ ID NO: 150130 - DNA, 75 bp, Artificial Sequence
  Synthetic
gacgggcatcgccctctattctctccatgatatgtcaccatctgatgtcgccgaggctatgttccgccatggtat

SEQ ID NO: 150131 - DNA, 75 bp, Artificial Sequence
  Synthetic
caactaaggccgggtacccttataattacaacaccactgctagcgaccaactgcttgtcgagaatgccgccgggc

SEQ ID NO: 150132 - DNA, 75 bp, Artificial Sequence
  Synthetic
agatgtgatagttaataatttctttttagctggcggtgagattggccatcaccgcccctctgttataccccgcgg

SEQ ID NO: 150133 - DNA, 75 bp, Artificial Sequence
  Synthetic
gctgcagactatcgccgatggcaaagcccactatactgaaactgtgaagcctgtgttggaccttacaaataccat

SEQ ID NO: 150134 - DNA, 75 bp, Artificial Sequence
  Synthetic
ttagctggcggtgagattggccatcaccgcccctctgttataccccgcggcaacccagatcgaaacttagacacc

SEQ ID NO: 150135 - DNA, 75 bp, Artificial Sequence
  Synthetic
gcccactatactgaaactgtgaagcctgtgttggaccttacaaataccattatgcagaggttggaatgaataaca

SEQ ID NO: 150136 - DNA, 75 bp, Artificial Sequence
  Synthetic
ctgatcagaatctcggaactctacaggccttcccgccgtcctgccagattagtgcctaccatcagttggctgagg

SEQ ID NO: 150137 - DNA, 75 bp, Artificial Sequence
  Synthetic
cctgtggcagccgtcctcccgccctgccctgagctcgagcagggcttgctctacatgccgcaggagctcacagtg

SEQ ID NO: 150138 - DNA, 75 bp, Artificial Sequence
  Synthetic
gcccgccatcggctgcgccgcggtgccgatggaaccgccgagcttactactacagcagccacacgcttcatgaaa

SEQ ID NO: 150139 - DNA, 75 bp, Artificial Sequence
  Synthetic
cgtcgatctgccccaactggggctgcgccgttaactgccgtctcacccgctcctgacacggcccccgtcccggat

SEQ ID NO: 150140 - DNA, 75 bp, Artificial Sequence
  Synthetic
cgccgttaactgccgtctcacccgctcctgacacggcccccgtcccggatgttgattctcgcggggctattctgc

SEQ ID NO: 150141 - DNA, 75 bp, Artificial Sequence
  Synthetic
cctgaggtactttggaatcatcctatccagcgggtaatacataatgaactggaacagtactgccgagcccgggct

SEQ ID NO: 150142 - DNA, 75 bp, Artificial Sequence
  Synthetic
cattgacgcaccaggcctgcttcgcgaggtgggcatttccgatgcaatcgttaataactttttcctcgctggtgg

SEQ ID NO: 150143 - DNA, 75 bp, Artificial Sequence
  Synthetic
tggcaaagtagcccagggaatatcagcttggagcaagaccttttgcgctttatttggtccctggttccgagctat

SEQ ID NO: 150144 - DNA, 75 bp, Artificial Sequence
  Synthetic
tgacaaccagcacgaacaagatcgacctaccccgtcacctgccccctctcgccctttttcggtgcttcgtgctaa

SEQ ID NO: 150145 - DNA, 75 bp, Artificial Sequence
  Synthetic
cgccgctcaaccccctcctgcctctccaggacggcactaatacccacatcatggcgactgaggcatccaactacg

SEQ ID NO: 150146 - DNA, 75 bp, Artificial Sequence
  Synthetic
caacgtcctgcaccggtgcttccttagaccggttggccgagatgtccagcgctggtactctgcccccacccgtgg

SEQ ID NO: 150147 - DNA, 75 bp, Artificial Sequence
  Synthetic
tgatgttctgtggctctctctcactgcagccaagtatgaccagaccacatatgggtcgtccaccaacccaatgta

SEQ ID NO: 150148 - DNA, 75 bp, Artificial Sequence
  Synthetic
gcttggagcaagaccttttgcgctttatttggtccctggttccgagctattgagaaaaaggtaatactcttgctc

SEQ ID NO: 150149 - DNA, 75 bp, Artificial Sequence
  Synthetic
cgttctaccagcgatttccagagtcatttgaccccgccgaatttgttatgtcagatgggcttgcggcctacactc

SEQ ID NO: 150150 - DNA, 75 bp, Artificial Sequence
  Synthetic
atggtttttgagaatgacttttccgagtttgacagcacccagaataacttctcactcggccttgaatgtgtgatt

SEQ ID NO: 150151 - DNA, 75 bp, Artificial Sequence
  Synthetic
tactacccctacttctgtcgacatgaactcaatcacttcaactgatgttaggattcttgtccaacctggtttggc

SEQ ID NO: 150152 - DNA, 75 bp, Artificial Sequence
  Synthetic
agtttgacagcacccagaataacttctcactcggccttgaatgtgtgattatggaggagtgtggcatgccccaat

SEQ ID NO: 150153 - DNA, 75 bp, Artificial Sequence
  Synthetic
acacgcctatacgccgcactgcaccttcctcccgaggtgctgctaccacccggcacctaccacacaacctcgtac

SEQ ID NO: 150154 - DNA, 75 bp, Artificial Sequence
  Synthetic
aactcaatcacttcaactgatgttaggattcttgtccaacctggtttggcctccgaacttgtcataccaagtgag

SEQ ID NO: 150155 - DNA, 75 bp, Artificial Sequence
  Synthetic
agttactctggatggccgcccccttactaccattcagcagtactctaagacattttatgtccttccacttcgtgg

SEQ ID NO: 150156 - DNA, 75 bp, Artificial Sequence
  Synthetic
ggaagaagcactccggcgagcccggtacactactctggaataccgtttggaacatggcggttatagcacattgct

SEQ ID NO: 150157 - DNA, 75 bp, Artificial Sequence
  Synthetic
cttgtcatgctttgcattcacggatcccctgttaattcatacactaataccccttacacaggggccctggggctt

SEQ ID NO: 150158 - DNA, 75 bp, Artificial Sequence
  Synthetic
aattttgatcgagaacgcggctggccaccgtgttgccatttccacctacaccactagcctgggtgccggtcccac

SEQ ID NO: 150159 - DNA, 75 bp, Artificial Sequence
  Synthetic
tacactactctggaataccgtttggaacatggcggttatagcacattgctatgagttccgtgactttagggttgc

SEQ ID NO: 150160 - DNA, 75 bp, Artificial Sequence
  Synthetic
ccactagcctgggtgccggtcccacctcaatttctgcggtcggtgtgttagctccacactcggcccttgctgtcc

SEQ ID NO: 150161 - DNA, 75 bp, Artificial Sequence
  Synthetic
cccctgttaattcatacactaataccccttacacaggggccctggggcttctcgattttgcgcttgagattgagt

SEQ ID NO: 150162 - DNA, 75 bp, Artificial Sequence
  Synthetic
attggctgtcattttgtgctgctgctcaccgcagcccctgaaccgtcacctatgccttatgtcccctaccctcgt

SEQ ID NO: 150163 - DNA, 75 bp, Artificial Sequence
  Synthetic
aggctgtgggctcaagcttaaggtcgactaccgccctatcgggctttatgccggagttgtggttgcccccggtct

SEQ ID NO: 150164 - DNA, 75 bp, Artificial Sequence
  Synthetic
gcggcgccgatgggaccgccgaacttacaactacggcggccacacggtttatgaaagatcttcattttactggga

SEQ ID NO: 150165 - DNA, 75 bp, Artificial Sequence
  Synthetic
tatgccttatgtcccctaccctcgttcaacggaggtgtatgttcgatccatatttggccctggcggctccccatc

SEQ ID NO: 150166 - DNA, 75 bp, Artificial Sequence
  Synthetic
ttcgtagctatctttgctttatttttcttttctgcttttcgcgctccctggaaaaaaaaaaaaaaaaaaaaaaaa

SEQ ID NO: 150167 - DNA, 75 bp, Artificial Sequence
  Synthetic
gcagaccacgtaagtggtcgatgccatggaagcgcatcagtttattaaagcgccgggcattaccaccgcgattga

SEQ ID NO: 150168 - DNA, 75 bp, Artificial Sequence
  Synthetic
cgccgggcattaccaccgcgattgaacaggcggcgctggcggcggcgaacagcgcgctggcgaacgcggtggtga

SEQ ID NO: 150169 - DNA, 75 bp, Artificial Sequence
  Synthetic
acaggcggcgctggcggcggcgaacagcgcgctggcgaacgcggtggtgattcgtccgtttctgagccgtaccca

SEQ ID NO: 150170 - DNA, 75 bp, Artificial Sequence
  Synthetic
ggactatgataatcaacatgagcaagatcggcctaccccgtcaccggccccctctcgccctttttccgtcctacg

SEQ ID NO: 150171 - DNA, 75 bp, Artificial Sequence
  Synthetic
gatcggcctaccccgtcaccggccccctctcgccctttttccgtcctacgcgcaaacgatgtgttgtgggtatca

SEQ ID NO: 150172 - DNA, 75 bp, Artificial Sequence
  Synthetic
gatcggcctaccccgtcaccggccccctctcgccctttttccgtcctacgcgctaacgatgtgttgtgggtatca

SEQ ID NO: 150173 - DNA, 75 bp, Artificial Sequence
  Synthetic
gatcggcctaccccgtcaccggccccctctcgccctttttccgtcctacgcgccaacgatgtgttgtgggtatca

SEQ ID NO: 150174 - DNA, 75 bp, Artificial Sequence
  Synthetic
gatcggcctaccccgtcaccggccccctctcgccctttttccgtcctacgcgcgaacgatgtgttgtgggtatca

SEQ ID NO: 150175 - DNA, 75 bp, Artificial Sequence
  Synthetic
tgggaccgccgcctaccccctgcttggcgctggtatatataaggttcccgttgggttgagttttgatgcttggga

SEQ ID NO: 150176 - DNA, 75 bp, Artificial Sequence
  Synthetic
tcagcgtgtgattcataacgaactggaacagtattgccgtgcgcgtgcgggccgttgcctggaagtgggcgcgca

SEQ ID NO: 150177 - DNA, 75 bp, Artificial Sequence
  Synthetic
tgctgcccgcgccaccggccggtcagtcgactgcccgccgtcgtgggcggcgcggcggcggttccggcggtggtt

SEQ ID NO: 150178 - DNA, 75 bp, Artificial Sequence
  Synthetic
tttgtcaacgttgcaacaggtgctcaggccgtcgcccgctctcttgactggtctaaagtgacattggatgggcga

SEQ ID NO: 150179 - DNA, 75 bp, Artificial Sequence
  Synthetic
ttttgatgaatcagtgccatgccgctgcaggacgtttttgaagaaagtcgcaggtaagttctgctgttttatgcg

SEQ ID NO: 150180 - DNA, 75 bp, Artificial Sequence
  Synthetic
gaacagtattgccgtgcgcgtgcgggccgttgcctggaagtgggcgcgcatccgcgtagcattaacgataacccg

SEQ ID NO: 150181 - DNA, 75 bp, Artificial Sequence
  Synthetic
ccgcttactaccatccagcagcattccaaaatattttatgtccttcccctccgtggcaagctctccttttgggag

SEQ ID NO: 150182 - DNA, 75 bp, Artificial Sequence
  Synthetic
ccggcggcgaactgccgtcgtagcgcgctgcgtggcctgccgccggcggatcgtacctattgctttgatggcttt

SEQ ID NO: 150183 - DNA, 75 bp, Artificial Sequence
  Synthetic
cgctgcgtggcctgccgccggcggatcgtacctattgctttgatggctttagcggctgcacctttgcggcggaaa

SEQ ID NO: 150184 - DNA, 75 bp, Artificial Sequence
  Synthetic
ccgctcgagcctcccgcctaacggctactgttgagctcactgcaagcccagaccgtttagagtgccgcactgtgc

SEQ ID NO: 150185 - DNA, 75 bp, Artificial Sequence
  Synthetic
ggatcctgcaggccccgaaggagtctctgcgagggttttggaagaaacactccggtgagcccggcacccttctat

SEQ ID NO: 150186 - DNA, 75 bp, Artificial Sequence
  Synthetic
cgcgtctgtatgcggtgctgcatctgccgccggaagcgctgctgccgccgggcacctatcataccaccacctatc

SEQ ID NO: 150187 - DNA, 75 bp, Artificial Sequence
  Synthetic
gcgccgcttaacccccttctgcccctccaggatggcactaatactcacatcatggcgaccgaggcatctaattac

SEQ ID NO: 150188 - DNA, 75 bp, Artificial Sequence
  Synthetic
ccccgcccgcgctcacactttcgacgatttctgccctgagtgccgtacccttggccttcagggttgtgccttcca

SEQ ID NO: 150189 - DNA, 75 bp, Artificial Sequence
  Synthetic
catggcgaccgaggcatctaattacgcccaataccgagttgtccgggccacaatccgctaccgccctttggtgcc

SEQ ID NO: 150190 - DNA, 75 bp, Artificial Sequence
  Synthetic
gccgccggaagcgctgctgccgccgggcacctatcataccaccacctatctgctgattcatgatggcgcgcgtgc

SEQ ID NO: 150191 - DNA, 75 bp, Artificial Sequence
  Synthetic
caccaaagtgaccggcgatcatccgctggtgattgaacgtgtgcgtgcgattggctgccattttgtgctgctgct

SEQ ID NO: 150192 - DNA, 75 bp, Artificial Sequence
  Synthetic
ctggtgattgaacgtgtgcgtgcgattggctgccattttgtgctgctgctgaccgcggcgccggaaccgagcccg

SEQ ID NO: 150193 - DNA, 75 bp, Artificial Sequence
  Synthetic
acgccctcacagctgtcatcactgccgcctaccttaccatttgccaccagcggtacctccgcacccaggctatat

SEQ ID NO: 150194 - DNA, 75 bp, Artificial Sequence
  Synthetic
ctgtttccgagcgcgtgcagcaccaaaagcatttttcatgcggtgccggtgcatatttgggatcgtctgatgctg

SEQ ID NO: 150195 - DNA, 75 bp, Artificial Sequence
  Synthetic
aaagcatttttcatgcggtgccggtgcatatttgggatcgtctgatgctgtttggcgcgaccctggatgatcagg

SEQ ID NO: 150196 - DNA, 75 bp, Artificial Sequence
  Synthetic
ggttatggctacaccctgagggattgctgggcatcttcccccctttctcccctgggcacatttgggagtctgcta

SEQ ID NO: 150197 - DNA, 75 bp, Artificial Sequence
  Synthetic
accctttctgcggggaggggactttgtatacccggacttggtcaacatctggcttttctagcgatttctcccccc

SEQ ID NO: 150198 - DNA, 75 bp, Artificial Sequence
  Synthetic
cgcggtgctgacgggactgccgaacttacaactacagcggccacacggtttatgaaagacctccacttcactggg

SEQ ID NO: 150199 - DNA, 75 bp, Artificial Sequence
  Synthetic
gacacggcgcgcacagctaatttggcgctggagttggacgcggctactgaggttggccgcgcttgtgctggttgc

SEQ ID NO: 150200 - DNA, 75 bp, Artificial Sequence
  Synthetic
acgaaggctggaacgcgagcgaagatgcgctgaccgcggtgattaccgcggcgtatctgaccatttgccatcagc

SEQ ID NO: 150201 - DNA, 75 bp, Artificial Sequence
  Synthetic
cgctgccccggggctgccccaccctaccccacctgttagtgacatttgggtgttaccaccaccttcagaggagtc

SEQ ID NO: 150202 - DNA, 75 bp, Artificial Sequence
  Synthetic
tgcgctgaccgcggtgattaccgcggcgtatctgaccatttgccatcagcgttatctgcgtacccaggcgattct

SEQ ID NO: 150203 - DNA, 75 bp, Artificial Sequence
  Synthetic
ttgatgggttttctggctgtagtttcccagccgagacgggcattgccctctactccctccacgatatgtcaccat

SEQ ID NO: 150204 - DNA, 75 bp, Artificial Sequence
  Synthetic
cccagccgagacgggcattgccctctactccctccacgatatgtcaccatccgatgtcgcagaggccatgttccg

SEQ ID NO: 150205 - DNA, 75 bp, Artificial Sequence
  Synthetic
cccccccctccctcctgtgcgtaagccaccaacacccccgccttcccgcactcgtcgtctcctctacacctatcc

SEQ ID NO: 150206 - DNA, 75 bp, Artificial Sequence
  Synthetic
aagcggccgtgattatattccgggccgtcagctggaattttatgcgcagtgccgtcgttggctgagcgcgggctt

SEQ ID NO: 150207 - DNA, 75 bp, Artificial Sequence
  Synthetic
ctcgtcgtctcctctacacctatcccgacggggcaaaggtgtatgcggggtcattgtttgaatcagactgtaact

SEQ ID NO: 150208 - DNA, 75 bp, Artificial Sequence
  Synthetic
aggactatgataatcagcatgagcaagatcggcccaccccgtcaccggctccttctcgtcctttttccgttctcc

SEQ ID NO: 150209 - DNA, 75 bp, Artificial Sequence
  Synthetic
cgtcagctggaattttatgcgcagtgccgtcgttggctgagcgcgggctttcatctggatccgcgtgtgctggtg

SEQ ID NO: 150210 - DNA, 75 bp, Artificial Sequence
  Synthetic
cgcgtcgtaccttctaattcatgatggcaggcgtgttgtggtgacgtatgagggtgataccagtgctggctataa

SEQ ID NO: 150211 - DNA, 75 bp, Artificial Sequence
  Synthetic
agatcggcccaccccgtcaccggctccttctcgtcctttttccgttctccgcgctaacgatgtgttgtgggtttc

SEQ ID NO: 150212 - DNA, 75 bp, Artificial Sequence
  Synthetic
tggctgggccaggaatgcacctgctttctggaaccggcggaaggcctgattggcgatcagggccatgataacgaa

SEQ ID NO: 150213 - DNA, 75 bp, Artificial Sequence
  Synthetic
atttgtcaatgtggcaacaggtgctcaggccgtcgctcgctcccttgattggactaaagtgactttggatgggcg

SEQ ID NO: 150214 - DNA, 75 bp, Artificial Sequence
  Synthetic
ttctggaaccggcggaaggcctgattggcgatcagggccatgataacgaagcgtatgaaggcagcgaagtggatc

SEQ ID NO: 150215 - DNA, 75 bp, Artificial Sequence
  Synthetic
accctgaccccgcgccctatcattcatgcagtggcccccgactatagggttgagcagaatccgaagaggcttgag

SEQ ID NO: 150216 - DNA, 75 bp, Artificial Sequence
  Synthetic
caggccgtcgctcgctcccttgattggactaaagtgactttggatgggcggccgctcactaccatccagcagcat

SEQ ID NO: 150217 - DNA, 75 bp, Artificial Sequence
  Synthetic
cgctgaacgtgccgcatgatattgcggcgcgtgcggcgcgtctgagcgcgaccgtggaactgaccgcgggcccgg

SEQ ID NO: 150218 - DNA, 75 bp, Artificial Sequence
  Synthetic
ccttacaactataacactacagccagcgaccaaattttgatagagaacgcggctgagcatcgtgttgctgtctca

SEQ ID NO: 150219 - DNA, 75 bp, Artificial Sequence
  Synthetic
ggcgcgtgcggcgcgtctgagcgcgaccgtggaactgaccgcgggcccgggccgtctggaatgccgtaccattct

SEQ ID NO: 150220 - DNA, 75 bp, Artificial Sequence
  Synthetic
atgctctactaagtcaactttccatgctgttcctgtccatatctgggatcgtctcatgttgttcggggccaccct

SEQ ID NO: 150221 - DNA, 75 bp, Artificial Sequence
  Synthetic
gagctttgatgaagcgggccagtgcatgggcgcgggcccgcatagcctggtgtatgaatttaccagcagcggctt

SEQ ID NO: 150222 - DNA, 75 bp, Artificial Sequence
  Synthetic
tgaggacacagcccgtacggccaacctagcgttagagatcgatgctgccacagatgttggccgtgcttgtgccgg

SEQ ID NO: 150223 - DNA, 75 bp, Artificial Sequence
  Synthetic
ttacacccgtacttggtcggaggttgatgccgtctctagtccagcccggcccgacttaggttttatgtctgagcc

SEQ ID NO: 150224 - DNA, 75 bp, Artificial Sequence
  Synthetic
tgaggataccatggactaccctgcccgcgcccatactttcgatgacttctgcccagagtgccgcccccttggcct

SEQ ID NO: 150225 - DNA, 75 bp, Artificial Sequence
  Synthetic
gcagtccttgaggataccgttgattaccctgcccgtgctcatacttttgatgatttctgccctgagtgtcgtact

SEQ ID NO: 150226 - DNA, 75 bp, Artificial Sequence
  Synthetic
tcaggtgaaaattagcagcaacggcctggatcgtgtggcggtgtttccgagcggccgtgcgccgagcgtgggcgc

SEQ ID NO: 150227 - DNA, 75 bp, Artificial Sequence
  Synthetic
accctgcccgtgctcatacttttgatgatttctgccctgagtgtcgtactcttggcctgcagggctgtgcttttc

SEQ ID NO: 150228 - DNA, 75 bp, Artificial Sequence
  Synthetic
tgccctccttctatgctgattgttttatttcttatttctgcgtttcgcgctccctggaaaaaaaaaaaaaaaaaa

SEQ ID NO: 150229 - DNA, 75 bp, Artificial Sequence
  Synthetic
gcgctgtatcgttataaccgtaccattcagcgtcatagcattgtgggcggcctgtggctgcatccggaaggcctg

SEQ ID NO: 150230 - DNA, 75 bp, Artificial Sequence
  Synthetic
gttcattacacgcctttacagttggctctttgagaagtctggccgtgattacatccctggccgtcagctggagtt

SEQ ID NO: 150231 - DNA, 75 bp, Artificial Sequence
  Synthetic
ttcagcgtcatagcattgtgggcggcctgtggctgcatccggaaggcctgctgggcctgtttccgccgtttagcc

SEQ ID NO: 150232 - DNA, 75 bp, Artificial Sequence
  Synthetic
ccggcaccgccgcctgctctttacctacccggatggctctaaggtattcgccggctcgctgttcgagtcgacatg

SEQ ID NO: 150233 - DNA, 75 bp, Artificial Sequence
  Synthetic
tccacacctgttgctgttacacatgcagcgggcctcctcggtccatctccttggtgacccaaatcagatccctgc

SEQ ID NO: 150234 - DNA, 75 bp, Artificial Sequence
  Synthetic
ttccaacccgtgagttgcgcaactcatggcggcgtcgtgggtttgcagcttatacacctcacactgcagcccgcg

SEQ ID NO: 150235 - DNA, 75 bp, Artificial Sequence
  Synthetic
gctttagcagcgattttagcccgccggaagcgaccgcgggcgcgccgccgccggcgagcctgccgtgcaccccgg

SEQ ID NO: 150236 - DNA, 75 bp, Artificial Sequence
  Synthetic
ccaacgtgtgatccacaatgagctcgaacaatattgtcgagctcgtgccggccgctgccttgaagtgggtgccca

SEQ ID NO: 150237 - DNA, 75 bp, Artificial Sequence
  Synthetic
cgtagggcggtctcaaagttttgctgttttatgaagtggcttggccaagagtgtacctgcttcctacagcctgca

SEQ ID NO: 150238 - DNA, 75 bp, Artificial Sequence
  Synthetic
ctccaacgagctggtggcacgttacacaccgttgcccggccgatgtatgcgagctcatacgcggagcctacccta

SEQ ID NO: 150239 - DNA, 75 bp, Artificial Sequence
  Synthetic
ggaagcgaccgcgggcgcgccgccgccggcgagcctgccgtgcaccccggcgccgagcgaaattgcggtgcgtac

SEQ ID NO: 150240 - DNA, 75 bp, Artificial Sequence
  Synthetic
aaccagttggccgcgatgttcagcggtggtatactgcccccacccgtggccctgcggcaaactgtcgccggtctg

SEQ ID NO: 150241 - DNA, 75 bp, Artificial Sequence
  Synthetic
gttttatgaagtggcttggccaagagtgtacctgcttcctacagcctgcagaagggggtgttggtgaccagggcc

SEQ ID NO: 150242 - DNA, 75 bp, Artificial Sequence
  Synthetic
gccggaacgtagcagcgcgcgtaaccgtcgtctgctgtatacctatccggatggcgcgaaagtgtatagcggcag

SEQ ID NO: 150243 - DNA, 75 bp, Artificial Sequence
  Synthetic
tggtacctggtgctgcccttcaaccgctctaccaagctcttgatcttcccgccgacattgtggcccgtgcaggcc

SEQ ID NO: 150244 - DNA, 75 bp, Artificial Sequence
  Synthetic
cgtcgtctgctgtatacctatccggatggcgcgaaagtgtatagcggcagcctgtttgaaagcgattgcgattgg

SEQ ID NO: 150245 - DNA, 75 bp, Artificial Sequence
  Synthetic
gaggcgatggcccgccatggaatgactcggctctatgcagcccttcacctcccccctgaagtgctactaccccct

SEQ ID NO: 150246 - DNA, 75 bp, Artificial Sequence
  Synthetic
agctttgatcataccaaatttattatgcgtgatggcctggcggcgtataccctgctgccgcgtccgattattcat

SEQ ID NO: 150247 - DNA, 75 bp, Artificial Sequence
  Synthetic
gagaccctcattggtaataaaactttccgcacgtcgttcgtcgacggggcggtcttagagaccaacggcccagag

SEQ ID NO: 150248 - DNA, 75 bp, Artificial Sequence
  Synthetic
ataactgaggatgttgcacggacagcgaatctggccatcgagcttgactcagccacagatgtcggccgggcctgt

SEQ ID NO: 150249 - DNA, 75 bp, Artificial Sequence
  Synthetic
tgcgtgatggcctggcggcgtataccctgctgccgcgtccgattattcatgcggtggcgccggattatcgtgtgg

SEQ ID NO: 150250 - DNA, 75 bp, Artificial Sequence
  Synthetic
acactgagaagtgtgttattctggatgctcccggcctgctgcgtgaggtcggcatttcggatgtgattgtcaata

SEQ ID NO: 150251 - DNA, 75 bp, Artificial Sequence
  Synthetic
cggccatcaccgcccttctgtgataccccgcggtaaccctgatcagaacctcgggactctacaggccttcccgcc

SEQ ID NO: 150252 - DNA, 75 bp, Artificial Sequence
  Synthetic
ttgttcagtaccagtttaccgcaggtgtgcctggatccggcaagtcccgctctatcacccaagccgatgtggacg

SEQ ID NO: 150253 - DNA, 75 bp, Artificial Sequence
  Synthetic
tgggcagcggcatttatcaggtgccggtgggcccgagctttgatgcgtgggaacgtaaccatcgtccgggcgatg

SEQ ID NO: 150254 - DNA, 75 bp, Artificial Sequence
  Synthetic
ctggtgattgagcgagtccgagcagtggggtgccattttgtgctcctccttacagctgcccccgaaccgtcgccg

SEQ ID NO: 150255 - DNA, 75 bp, Artificial Sequence
  Synthetic
cggtcggctcccggtgaggtcaccgccttctgctccgccctatacaggttcaatcgtgaggcccagcgccattca

SEQ ID NO: 150256 - DNA, 75 bp, Artificial Sequence
  Synthetic
ggtgggcccgagctttgatgcgtgggaacgtaaccatcgtccgggcgatgaactgtatctgaccgaaccggcgac

SEQ ID NO: 150257 - DNA, 75 bp, Artificial Sequence
  Synthetic
ctttttccatctgcctgctctactaagtcaacatttcatgccgtccctgtgcacatatgggataggcttatgctt

SEQ ID NO: 150258 - DNA, 75 bp, Artificial Sequence
  Synthetic
gccgaccggcgcgggcagcccgccggaagcggataccggcccggcgctgccggcgctgaccattaccgaagatgc

SEQ ID NO: 150259 - DNA, 75 bp, Artificial Sequence
  Synthetic
gaaaggctgttctctcaacacttgtagggagatacggccgtaggacgaaattatatgaggcagcgcattcagatg

SEQ ID NO: 150260 - DNA, 75 bp, Artificial Sequence
  Synthetic
tttggtgcgacccttgacgaccaagccttttgctgctctaggcttatgacatatctccgcggcattagctataag

SEQ ID NO: 150261 - DNA, 75 bp, Artificial Sequence
  Synthetic
gaagcggataccggcccggcgctgccggcgctgaccattaccgaagatgcggcgcgtaccgcgaacctggcgctg

SEQ ID NO: 150262 - DNA, 75 bp, Artificial Sequence
  Synthetic
gagtcggccaacccgttttgtggtgagagcacactctacacccgtacttggtcggaagttgatgctgtctccggc

SEQ ID NO: 150263 - DNA, 75 bp, Artificial Sequence
  Synthetic
cccttaccctctgttgtattaggcccctcccctcctccttctgccccggcgtccagcgagccggcccctggtgct

SEQ ID NO: 150264 - DNA, 75 bp, Artificial Sequence
  Synthetic
tttaccgcgggcgtgccgggcagcggcaaaagccgtagcattcagcagggcgatgtggatgtggtggtggtgccg

SEQ ID NO: 150265 - DNA, 75 bp, Artificial Sequence
  Synthetic
gcaaaagccgtagcattcagcagggcgatgtggatgtggtggtggtgccgacccgtgaactgcgtaacagctggc

SEQ ID NO: 150266 - DNA, 75 bp, Artificial Sequence
  Synthetic
gcttatcttaccatctgccatcagaggtatctccgtacgcaggctatctcgaaggggatgaaaaggctggagctt

SEQ ID NO: 150267 - DNA, 75 bp, Artificial Sequence
  Synthetic
cctcccctcctccttctgccccggcgtccagcgagccggcccctggtgctagcgccgggaccccggccataaccc

SEQ ID NO: 150268 - DNA, 75 bp, Artificial Sequence
  Synthetic
caacaagtttacaactggtgagactatcgcccatggcaaggttggtcagggtatatcggcctggagtaagacctt

SEQ ID NO: 150269 - DNA, 75 bp, Artificial Sequence
  Synthetic
atcgcccatggcaaggttggtcagggtatatcggcctggagtaagaccttctgtgccctgtttggcccgtggttc

SEQ ID NO: 150270 - DNA, 75 bp, Artificial Sequence
  Synthetic
aagcgccgagcctgccgccgcatctgctgctgctgcatatgcagcgtgcgagcagcgtgcatctgctgggcgatc

SEQ ID NO: 150271 - DNA, 75 bp, Artificial Sequence
  Synthetic
agtcggcgtgtacgtggcttgttaatgcgtctaatgttgaccatcgccctggcggtgggctttgccatgcattct

SEQ ID NO: 150272 - DNA, 75 bp, Artificial Sequence
  Synthetic
gccgccggtggctatctgcaggtttccacctcgatcctcgtgtgctcgtttttgatgaagccgccccttgccgct

SEQ ID NO: 150273 - DNA, 75 bp, Artificial Sequence
  Synthetic
gctgctgctgcatatgcagcgtgcgagcagcgtgcatctgctgggcgatccgaaccagattccggcgattgattt

SEQ ID NO: 150274 - DNA, 75 bp, Artificial Sequence
  Synthetic
ccctactcccgcctaatatcttttatggcgacgcctatgaggaatcagtgttcgctgccgctgtgtccggggcgg

SEQ ID NO: 150275 - DNA, 75 bp, Artificial Sequence
  Synthetic
gcaggcagctctagcagcggccaactccgccttggcgaatgctgtggtggttcggccctttttatcccgcctaca

SEQ ID NO: 150276 - DNA, 75 bp, Artificial Sequence
  Synthetic
ccctgattataggttggaacataacccaaaaaggcttgaggctgcctatcgggagacttgctctcgcctcggcac

SEQ ID NO: 150277 - DNA, 75 bp, Artificial Sequence
  Synthetic
cccggcggatgtgtgcgaactgattcgtggcgcgtatccgaaaattcagaccaccagccgtgtgctgcgtagcct

SEQ ID NO: 150278 - DNA, 75 bp, Artificial Sequence
  Synthetic
caatgttgacaccctggctgccttcccgccgtcttgccagattagtgccttccatcagttggctgaggagcttgg

SEQ ID NO: 150279 - DNA, 75 bp, Artificial Sequence
  Synthetic
ttctccagcccattgagggaagggtcggtgaacaaggttatgataatgaggcgtttgaggggtcggatgtcgacc

SEQ ID NO: 150280 - DNA, 75 bp, Artificial Sequence
  Synthetic
gccccagtggctaattaggttgtatcatctggttcggtcagcctggattttgcaggcgccgaaggagtctcttaa

SEQ ID NO: 150281 - DNA, 75 bp, Artificial Sequence
  Synthetic
cgtggcgcgtatccgaaaattcagaccaccagccgtgtgctgcgtagcctgttttggggcgatccgccggtgggc

SEQ ID NO: 150282 - DNA, 75 bp, Artificial Sequence
  Synthetic
ccaccgccccggggatgagctctatctacctgagcttgctgctaaatggttcgaggccaataagccgacccgtcc

SEQ ID NO: 150283 - DNA, 75 bp, Artificial Sequence
  Synthetic
ctccgggtcatatatcgtcactggccgtcagttgcagcctttatatcaagcgcttggcataccatcagatcttgc

SEQ ID NO: 150284 - DNA, 75 bp, Artificial Sequence
  Synthetic
acctttaccgaaaccaccattattgcgaccgcggatgcgcgtggcctgattcagagcagccgtgcgcatgcgatt

SEQ ID NO: 150285 - DNA, 75 bp, Artificial Sequence
  Synthetic
cgaccgcggatgcgcgtggcctgattcagagcagccgtgcgcatgcgattgtggcgctgacccgtcataccgaaa

SEQ ID NO: 150286 - DNA, 75 bp, Artificial Sequence
  Synthetic
cggtgaacaaggttatgataatgaggcgtttgaggggtcggatgtcgaccctgctgaggaggccaccgtgagcat

SEQ ID NO: 150287 - DNA, 75 bp, Artificial Sequence
  Synthetic
ctacctgagcttgctgctaaatggttcgaggccaataagccgacccgtccgactctcactataactgaggatgtt

SEQ ID NO: 150288 - DNA, 75 bp, Artificial Sequence
  Synthetic
gggcaataaaaccttttcaacggtattcactgatggcgctcagctggaggccaacgggccagagcagtatgttct

SEQ ID NO: 150289 - DNA, 75 bp, Artificial Sequence
  Synthetic
acccccggtgttgtgcagtaccagtttaccgcaggtgtgcccgggtctggcaagtcccgttctgttatccaaact

SEQ ID NO: 150290 - DNA, 75 bp, Artificial Sequence
  Synthetic
cctgcggcaaattgtcgccggtctgctctccgtgggctcccacctgtcgaccgcacatactgttttgacggcttc

SEQ ID NO: 150291 - DNA, 75 bp, Artificial Sequence
  Synthetic
tggcgggcggcgaaattggccatcatcgtccgagcgtgattccgcgtggcaacccggatcgtaacctggatattc

SEQ ID NO: 150292 - DNA, 75 bp, Artificial Sequence
  Synthetic
atggctgctggcccgcacagtcttagctacactttaacatctgcaggccttgaagtgcgtattatttctgctggg

SEQ ID NO: 150293 - DNA, 75 bp, Artificial Sequence
  Synthetic
ccgcacatactgttttgacggcttctccggctgcacttttgccgctgagacaggtattgctctttactcactgca

SEQ ID NO: 150294 - DNA, 75 bp, Artificial Sequence
  Synthetic
tcgtccgagcgtgattccgcgtggcaacccggatcgtaacctggatattctgcaggcgtttccgccgagctgcca

SEQ ID NO: 150295 - DNA, 75 bp, Artificial Sequence
  Synthetic
ttaccgcaggtgtgcccgggtctggcaagtcccgttctgttatccaaactgacgtggatgttgttgtggttccga

SEQ ID NO: 150296 - DNA, 75 bp, Artificial Sequence
  Synthetic
cccccctgaagtgctactaccccctggcacatatcatactacctcatatcttttgatccatgatggggaccgtgc

SEQ ID NO: 150297 - DNA, 75 bp, Artificial Sequence
  Synthetic
aggggcgccgggtcgttattgatgaggctccatcactcccccctcacctgctgctgctccatatgcagcgggccg

SEQ ID NO: 150298 - DNA, 75 bp, Artificial Sequence
  Synthetic
gctctttacaggtttaaccgctgtgttcagcggcattcccttattggaggtttgtggtactatcctgagagctta

SEQ ID NO: 150299 - DNA, 75 bp, Artificial Sequence
  Synthetic
ttcagcggcattcccttattggaggtttgtggtactatcctgagagcttagttggtttgttcccaccgttttccc

SEQ ID NO: 150300 - DNA, 75 bp, Artificial Sequence
  Synthetic
cccggaactggaacagggcctgctgtatatgccgcaggaactgaccgtgagcgatagcgtgctggtgtttgaact

SEQ ID NO: 150301 - DNA, 75 bp, Artificial Sequence
  Synthetic
tatatgccgcaggaactgaccgtgagcgatagcgtgctggtgtttgaactgaccgatattgtgcattgccgtatg

SEQ ID NO: 150302 - DNA, 75 bp, Artificial Sequence
  Synthetic
caccaaggtcaccggtgaccacccgctggtgattgagcgagtccgagcggtggggtgtcattttgtgctcctcct

SEQ ID NO: 150303 - DNA, 75 bp, Artificial Sequence
  Synthetic
ctgctgctccatatgcagcgggccgccaccgtccaccttctcggtgacccgaaccagatcccagccattgacttc

SEQ ID NO: 150304 - DNA, 75 bp, Artificial Sequence
  Synthetic
agtcaacattccacgctgtgccggtacacatctgggataggctcatgttgtttggtgcaactttggatgaccagg

SEQ ID NO: 150305 - DNA, 75 bp, Artificial Sequence
  Synthetic
gcggcgcatgcggatgtgcgtgaaagcctgagccgttttattccggcgattggcccggtgcaggcgaccacctgc

SEQ ID NO: 150306 - DNA, 75 bp, Artificial Sequence
  Synthetic
cgagcctcgcgccccggagatgccaccttctgaagacattgatatgcctgtagttattgacaccccaccatcgat

SEQ ID NO: 150307 - DNA, 75 bp, Artificial Sequence
  Synthetic
ttttggggcgaacctgccgtcggccagaaattagtgttcacccaggcggccaaggctgcgaaccccggctcggtg

SEQ ID NO: 150308 - DNA, 75 bp, Artificial Sequence
  Synthetic
catgggatcaccatgcgccctagggctgttctgttgttgctcttcgtgcttctgcctatgctgcccgcgccaccg

SEQ ID NO: 150309 - DNA, 75 bp, Artificial Sequence
  Synthetic
gcctgagccgttttattccggcgattggcccggtgcaggcgaccacctgcgaactgtatgaactggtgcaggcga

SEQ ID NO: 150310 - DNA, 75 bp, Artificial Sequence
  Synthetic
tagacttggttgatggtggtgctggccctggcctgactagcgtctctgtcgaacccccggcgtccgtgcagcctg

SEQ ID NO: 150311 - DNA, 75 bp, Artificial Sequence
  Synthetic
tttttcagaaagattgcaacaaatttaccaccggcgaaaccattgcgcatggcaaagtgggccagggcattagcg

SEQ ID NO: 150312 - DNA, 75 bp, Artificial Sequence
  Synthetic
taccaccggcgaaaccattgcgcatggcaaagtgggccagggcattagcgcgtggagcaaaaccttttgcgcgct

SEQ ID NO: 150313 - DNA, 75 bp, Artificial Sequence
  Synthetic
cagtcgtcccgggctcatgccattgttgccctgacgcgccacactgagaagtgcgtcattattgacgcacctggt

SEQ ID NO: 150314 - DNA, 75 bp, Artificial Sequence
  Synthetic
gtcacggtgggtgctctcgttgccaacgagggctggaatgcctctgaggatgcgctgaccgctgtaatcactgcg

SEQ ID NO: 150315 - DNA, 75 bp, Artificial Sequence
  Synthetic
atttgcaggtggctgcctttaaaggtgatgattcgatagtgctttgcagtgagtatcgtcagagcccaggagctg

SEQ ID NO: 150316 - DNA, 75 bp, Artificial Sequence
  Synthetic
ttgagtccgagtgcacatggctggttaatgcctctaacccgggccaccgccctggtggcggcctttgccatgcat

SEQ ID NO: 150317 - DNA, 75 bp, Artificial Sequence
  Synthetic
gccccccgtcgtcgatctgccccagctggggctgcgccgctgactgctgtatcaccggcccccgacacagctcct

SEQ ID NO: 150318 - DNA, 75 bp, Artificial Sequence
  Synthetic
gtatgaagatagcgtgtttagcgcggcggtgaccggcgcgggcagcagcatggtgtttgaaaacgattttagcga

SEQ ID NO: 150319 - DNA, 75 bp, Artificial Sequence
  Synthetic
cgcccgtctgttattccccgcggcaatcctgacgctaatgtcgacaccctggccgccttcccaccgtcttgccag

SEQ ID NO: 150320 - DNA, 75 bp, Artificial Sequence
  Synthetic
gtacctgatgttgactcacgtggtgctatcctgcgccggcagtacaatctgtctacgtccccgctcacgtcatct

SEQ ID NO: 150321 - DNA, 75 bp, Artificial Sequence
  Synthetic
gcggtgaccggcgcgggcagcagcatggtgtttgaaaacgattttagcgaatttgatagcacccagaacaacttt

SEQ ID NO: 150322 - DNA, 75 bp, Artificial Sequence
  Synthetic
tgatgttgtgcgcttcgccggccggcttaccgagaagaattggggccctggccctgagcgggcggagcagctccg

SEQ ID NO: 150323 - DNA, 75 bp, Artificial Sequence
  Synthetic
taatgcctctaacccgggccaccgccctggtggcggcctttgccatgcattttaccagcggttcccagagtcttt

SEQ ID NO: 150324 - DNA, 75 bp, Artificial Sequence
  Synthetic
gccgccggtggttatctgcaggcttccaccttgaccctcgtgtgcttgtatttgatgaagccgccccctgccgct

SEQ ID NO: 150325 - DNA, 75 bp, Artificial Sequence
  Synthetic
cgtagcgcgtggattctgcaggcgccgaaagaaagcctgaaaggcttttggaaaaaacatagcggcgaaccgggc

SEQ ID NO: 150326 - DNA, 75 bp, Artificial Sequence
  Synthetic
accgggagacgtgctcccgccgaggaacagcagcctaccccctgcttggcgctggtatatataaggtccccgtcg

SEQ ID NO: 150327 - DNA, 75 bp, Artificial Sequence
  Synthetic
ccaattatgctcagtatcgggttgttcgagctacgatccgttatcgcccgctggtgccaaatgctgttggtggct

SEQ ID NO: 150328 - DNA, 75 bp, Artificial Sequence
  Synthetic
ccgccccgagccagcgcaaggccgtgctctccacacttgtgggccggtacggccgtcgcacgaagctttataatg

SEQ ID NO: 150329 - DNA, 75 bp, Artificial Sequence
  Synthetic
cgaaagaaagcctgaaaggcttttggaaaaaacatagcggcgaaccgggcaccctgctgtggaacaccgtgtgga

SEQ ID NO: 150330 - DNA, 75 bp, Artificial Sequence
  Synthetic
ggtttgaagccaaccgacctaccctccctgctttgactattactgaggacacagcgcgcacggcgaacttagcac

SEQ ID NO: 150331 - DNA, 75 bp, Artificial Sequence
  Synthetic
tgctgtgcagcgattatcgtcagagccgttttgcggcggcgctgattgcgggctgcggcctgaaactgaaagtgg

SEQ ID NO: 150332 - DNA, 75 bp, Artificial Sequence
  Synthetic
ccgttttgcggcggcgctgattgcgggctgcggcctgaaactgaaagtggattatcgtccggtgggcctgtatgc

SEQ ID NO: 150333 - DNA, 75 bp, Artificial Sequence
  Synthetic
cgcacgtgctggccggcttgctgccaccgttgaggtttcagatgctgacggtcgcctcacctgtaagaccatttt

SEQ ID NO: 150334 - DNA, 75 bp, Artificial Sequence
  Synthetic
acctccggtctggtaatgctttgcattcacggttctcctgttaactcctatactaacacaccttacactggtgca

SEQ ID NO: 150335 - DNA, 75 bp, Artificial Sequence
  Synthetic
ctggggcccgggcccggaacgtgcggaacagctgcgtctggcggtgtgcgattttctgcgtaaactgaccaacgt

SEQ ID NO: 150336 - DNA, 75 bp, Artificial Sequence
  Synthetic
gcaaagtgggtcagggtatttcggcatggagcaagactttctgtgccctctttggcccctggttccgtgctattg

SEQ ID NO: 150337 - DNA, 75 bp, Artificial Sequence
  Synthetic
gcctggtgcataacctgattggcatgctgcagaccattgcggatggcaaagcgcattataccgaaaccgtgaaac

SEQ ID NO: 150338 - DNA, 75 bp, Artificial Sequence
  Synthetic
ttcacggttctcctgttaactcctatactaacacaccttacactggtgcattggggctccttgattttgcattag

SEQ ID NO: 150339 - DNA, 75 bp, Artificial Sequence
  Synthetic
agaaggccatcttggctctgctcccccagggcgtattctatggggacgcttttgatgacactgtcttctctgcgg

SEQ ID NO: 150340 - DNA, 75 bp, Artificial Sequence
  Synthetic
cgaggccccctcgcttccaccacatttgcttctgttgcatatgcagcgggcctcgtcagtccatcttcttggtga

SEQ ID NO: 150341 - DNA, 75 bp, Artificial Sequence
  Synthetic
accgttgaggtttcagatgctgacggtcgcctcacctgtaagaccattttgggtaataagacctttttaacggtg

SEQ ID NO: 150342 - DNA, 75 bp, Artificial Sequence
  Synthetic
taagtggtggcaccttacccataggtgccctgcagatgtctgtgagttgatccgtggtgcataccctaagatcca

SEQ ID NO: 150343 - DNA, 75 bp, Artificial Sequence
  Synthetic
tacagcggcattcccttattggaggtttgtggtactatcctgagagcttagtcggcctgtttccaccgttctccc

SEQ ID NO: 150344 - DNA, 75 bp, Artificial Sequence
  Synthetic
ctctcttatggaatactgtctggaatatggccgttatcacccactgttatgacttccgggacttgcaagtggctg

SEQ ID NO: 150345 - DNA, 75 bp, Artificial Sequence
  Synthetic
gacaagggcattaccatcccacacgatatagatctgggtgattcccgtgtggttattcaggattatgataaccag

SEQ ID NO: 150346 - DNA, 75 bp, Artificial Sequence
  Synthetic
gcttttccagctgtttctcccccttcgagccctgcgccccggagccgccgccctcaagtggcatcgaagcacctg

SEQ ID NO: 150347 - DNA, 75 bp, Artificial Sequence
  Synthetic
gtccagcccggcatagcctctgagcttgtgatcccaagtgagcgcctacactatcgtaaccaaggttggcgctcc

SEQ ID NO: 150348 - DNA, 75 bp, Artificial Sequence
  Synthetic
gctttgcagtgagtaccgtcaaagtccgggtgctgcagtcctgattgctggctgcggcttgaagctgaaggtgga

SEQ ID NO: 150349 - DNA, 75 bp, Artificial Sequence
  Synthetic
tacacttgacgcgtttccaccctcctgccagttcagtgcctaccaccagctggccgaagagcttggccatcgtcc

SEQ ID NO: 150350 - DNA, 75 bp, Artificial Sequence
  Synthetic
atatagatctgggtgattcccgtgtggttattcaggattatgataaccagcacgagcaagaccgacctactccgt

SEQ ID NO: 150351 - DNA, 75 bp, Artificial Sequence
  Synthetic
cagacttggttgatggtggtgtccgccttgacctgactagcgcctctgcggagcccccggcgcccgtgcagtctg

SEQ ID NO: 150352 - DNA, 75 bp, Artificial Sequence
  Synthetic
acgatcagactacatatgggtcgtccaccaaccctatgtatgtctccgatacggtcacgctagttaatgtggcca

SEQ ID NO: 150353 - DNA, 75 bp, Artificial Sequence
  Synthetic
catcgcccgtcagttgtgccccgtggcaccattagcagcaacgtcgatacgcttgatgcattccccccttcctgc

SEQ ID NO: 150354 - DNA, 75 bp, Artificial Sequence
  Synthetic
ttttcttcgcaagctcacgaatgtagcccaaatgtgtgtggatgttgtttctcgtgtttatggggtctccccggg

SEQ ID NO: 150355 - DNA, 75 bp, Artificial Sequence
  Synthetic
tttatatgcctcaggagttaactacatcggacagtgtcctcacttttgaactaacggacatcgtgcactgccgta

SEQ ID NO: 150356 - DNA, 75 bp, Artificial Sequence
  Synthetic
gagaacgcggctggccaccgtgttgctatctctacctataccactagcttgggtgccggccctacctcgatttcc

SEQ ID NO: 150357 - DNA, 75 bp, Artificial Sequence
  Synthetic
atcggacagtgtcctcacttttgaactaacggacatcgtgcactgccgtatggcggcgcccagccagcgtaaggc

SEQ ID NO: 150358 - DNA, 75 bp, Artificial Sequence
  Synthetic
ctcctggcgtcactactgctattgagcaggctgctctggcggctgctaatactgccttggcgaatgctgtggtgg

SEQ ID NO: 150359 - DNA, 75 bp, Artificial Sequence
  Synthetic
ctcctggcgtcactactgctattgagcaggctgctctggcggctgctaattctgccttggcgaatgctgtggtgg

SEQ ID NO: 150360 - DNA, 75 bp, Artificial Sequence
  Synthetic
ctcctggcgtcactactgctattgagcaggctgctctggcggctgctaatcctgccttggcgaatgctgtggtgg

SEQ ID NO: 150361 - DNA, 75 bp, Artificial Sequence
  Synthetic
ctcctggcgtcactactgctattgagcaggctgctctggcggctgctaatgctgccttggcgaatgctgtggtgg

SEQ ID NO: 150362 - DNA, 75 bp, Artificial Sequence
  Synthetic
cgcccctgactaccgggttgaacataaccctaagagacttgaggccgcttaccgggagacgtgctcccgtcgtgg

SEQ ID NO: 150363 - DNA, 75 bp, Artificial Sequence
  Synthetic
gcaggctgctctggcggctgctaatactgccttggcgaatgctgtggtggtccggccgtttttgtcccgattaca

SEQ ID NO: 150364 - DNA, 75 bp, Artificial Sequence
  Synthetic
gcaggctgctctggcggctgctaattctgccttggcgaatgctgtggtggtccggccgtttttgtcccgattaca

SEQ ID NO: 150365 - DNA, 75 bp, Artificial Sequence
  Synthetic
gcaggctgctctggcggctgctaatcctgccttggcgaatgctgtggtggtccggccgtttttgtcccgattaca

SEQ ID NO: 150366 - DNA, 75 bp, Artificial Sequence
  Synthetic
gcaggctgctctggcggctgctaatgctgccttggcgaatgctgtggtggtccggccgtttttgtcccgattaca

SEQ ID NO: 150367 - DNA, 75 bp, Artificial Sequence
  Synthetic
aaccctaagagacttgaggccgcttaccgggagacgtgctcccgtcgtgggacagcagcctaccctctgctcggc

SEQ ID NO: 150368 - DNA, 75 bp, Artificial Sequence
  Synthetic
acttttgatgatttctgcccggagtgccgcacccttggtttgcagggttgtgcattccagtctactattgctgag

SEQ ID NO: 150369 - DNA, 75 bp, Artificial Sequence
  Synthetic
gtccctgaatcatttcattcctgagcttggccctattaatgttaccacctgtgagctttatgagcttgtagaggc

SEQ ID NO: 150370 - DNA, 75 bp, Artificial Sequence
  Synthetic
gcaggccacgtctgtggccgacgccatggaggcccaccagtttattaaggctcctggcgtcactactgctattga

SEQ ID NO: 150371 - DNA, 75 bp, Artificial Sequence
  Synthetic
tcagcgtgtcattcataatgagcttgagcagtactgccgcgcccgtgctggtcgttgccttgaggtgggcgctca

SEQ ID NO: 150372 - DNA, 75 bp, Artificial Sequence
  Synthetic
tacttgaccgagccagcaatagcctggttcgaggctaaccgacccaccctccccgctttgactatcactgaggac

SEQ ID NO: 150373 - DNA, 75 bp, Artificial Sequence
  Synthetic
catggtagagaagggccaggacggctctgcggtcctggagcttgacttatgtaaccgtgatgtgtcccggataac

SEQ ID NO: 150374 - DNA, 75 bp, Artificial Sequence
  Synthetic
gagcagtactgccgcgcccgtgctggtcgttgccttgaggtgggcgctcatccgcgctcgattaatgacaacccc

SEQ ID NO: 150375 - DNA, 75 bp, Artificial Sequence
  Synthetic
ggttcgaggctaaccgacccaccctccccgctttgactatcactgaggacacggcgcgtacggcgaacctagcgt

SEQ ID NO: 150376 - DNA, 75 bp, Artificial Sequence
  Synthetic
tgcgtggagcaagaccttctgcgctttatttggtccgtggttccgtgctattgagaaggagatcttggcagcgct

SEQ ID NO: 150377 - DNA, 75 bp, Artificial Sequence
  Synthetic
ccagccgcaaactgccgccgatcggcccttcgcggtctaccaccaactgaccgcacttactgctttaatggattt

SEQ ID NO: 150378 - DNA, 75 bp, Artificial Sequence
  Synthetic
cgcgccgctgaccgcggtcgctccggcccatgacaccccgccggtgtccgatgttgattctcgtggcgctatctt

SEQ ID NO: 150379 - DNA, 75 bp, Artificial Sequence
  Synthetic
agttcacagccggcgtccctggctccggtaaatcgcggtcaatccaacagggagatgtggatgtaatagtggtac

SEQ ID NO: 150380 - DNA, 75 bp, Artificial Sequence
  Synthetic
cccttcgcggtctaccaccaactgaccgcacttactgctttaatggatttgctggctgcacttttgctgctgaga

SEQ ID NO: 150381 - DNA, 75 bp, Artificial Sequence
  Synthetic
cggtaaatcgcggtcaatccaacagggagatgtggatgtaatagtggtaccaacccgtgagttgcgcaattcatg

SEQ ID NO: 150382 - DNA, 75 bp, Artificial Sequence
  Synthetic
attcggccgtttttgtcccgaacacagacagacatcctcattaaccttatgcagccccggcaactggtcttccgc

SEQ ID NO: 150383 - DNA, 75 bp, Artificial Sequence
  Synthetic
gcccatgacaccccgccggtgtccgatgttgattctcgtggcgctatcttgcgccgacagtataatctttcaaca

SEQ ID NO: 150384 - DNA, 75 bp, Artificial Sequence
  Synthetic
cgaggccccctcgcttccaccgcacttgctcctgctgcatatgcagcgggcctcgtcggttcatctccttggtga

SEQ ID NO: 150385 - DNA, 75 bp, Artificial Sequence
  Synthetic
gggcgttgtcttgaggtcggagctcatccaagatctatcaatgacaacccaaatattttgcaccggtgcttcctc

SEQ ID NO: 150386 - DNA, 75 bp, Artificial Sequence
  Synthetic
ctaggctatatgcagctcttcacctaccccctgaggtgctgcttccacctggcacctatcacacaacatcttatc

SEQ ID NO: 150387 - DNA, 75 bp, Artificial Sequence
  Synthetic
accccctgaggtgctgcttccacctggcacctatcacacaacatcttatctgcttattcatgatgggaatcgagc

SEQ ID NO: 150388 - DNA, 75 bp, Artificial Sequence
  Synthetic
cggcctgttggtagagacgtccagcggtggtactctgcccccactcgtggccctgctgctaattgccgccgctct

SEQ ID NO: 150389 - DNA, 75 bp, Artificial Sequence
  Synthetic
ttgctcctgctgcatatgcagcgggcctcgtcggttcatctccttggtgatcctaatcaaatccccgctattgat

SEQ ID NO: 150390 - DNA, 75 bp, Artificial Sequence
  Synthetic
accactaccccgacgtccgttgacatgaattccataacctcgacggatgttcgtatccttgtccagcccggtata

SEQ ID NO: 150391 - DNA, 75 bp, Artificial Sequence
  Synthetic
gactaaggtcactggcaaccacccgctggtgatcgagcgtgtgcgtgccgtgggctgccattttgtactgttgct

SEQ ID NO: 150392 - DNA, 75 bp, Artificial Sequence
  Synthetic
tgccctgcggatgtctgtgagttgatccgcggcgcatatccaaagattcaaaccgcaagccgtgtcctccgttct

SEQ ID NO: 150393 - DNA, 75 bp, Artificial Sequence
  Synthetic
ctggtgatcgagcgtgtgcgtgccgtgggctgccattttgtactgttgcttacggctgtgcctgaaccatcaccc

SEQ ID NO: 150394 - DNA, 75 bp, Artificial Sequence
  Synthetic
accggtgttgctctttactccctacatgacctgtggcctgctgacgttgcggaggcaatggcgcatcacgggatg

SEQ ID NO: 150395 - DNA, 75 bp, Artificial Sequence
  Synthetic
atgacctgtggcctgctgacgttgcggaggcaatggcgcatcacgggatgtcacgcctgtatgctgtactgcacc

SEQ ID NO: 150396 - DNA, 75 bp, Artificial Sequence
  Synthetic
ctgggtgtgggctgaagcttaaggtggattttaggcctattgggctgtatgctggtgttgttgtggccccgggtc

SEQ ID NO: 150397 - DNA, 75 bp, Artificial Sequence
  Synthetic
ctgctagagaggcccaggctactgcggcagcggctaccgcctttgctaatgctcaggtggtacgcccatacctgt

SEQ ID NO: 150398 - DNA, 75 bp, Artificial Sequence
  Synthetic
cgacatttactgagactacaattatcgccacagcggatgctcgcgggctgattcagtcctctagggctcatgcca

SEQ ID NO: 150399 - DNA, 75 bp, Artificial Sequence
  Synthetic
ctcttcccctctgcctgctctactaagtccacatttcatgccgtcccggtccacatctgggacaggcttatgttg

SEQ ID NO: 150400 - DNA, 75 bp, Artificial Sequence
  Synthetic
gccttgttatgctctgtatacatggctcacctgtgaactcttatactaatacaccctacaccggtgccctcgggc

SEQ ID NO: 150401 - DNA, 75 bp, Artificial Sequence
  Synthetic
tgagcttttctcccctctgcagcttgtctttgagcctgctgtttcttggtcgcatccggtacagcgcgttattca

SEQ ID NO: 150402 - DNA, 75 bp, Artificial Sequence
  Synthetic
accaatacgcgggtctcccgttactccagcactgcccgccaccgtcttcgccgcggcgcagacggcaccgctgag

SEQ ID NO: 150403 - DNA, 75 bp, Artificial Sequence
  Synthetic
tgactttttgcgaaagttaacgaatgtggctcaggtctgtgtggatgttgtttcgcaggtttatggtgttagccc

SEQ ID NO: 150404 - DNA, 75 bp, Artificial Sequence
  Synthetic
tggcacttaccacaccacctcctaccttctgattcatgacggcagccgcgccgtcgtaacctatgaaggtgatac

SEQ ID NO: 150405 - DNA, 75 bp, Artificial Sequence
  Synthetic
gctggtgatagagcgtgtccgcgcgattggctgccactttgtgctgttgctcactgccgctcctgaaccatcgcc

SEQ ID NO: 150406 - DNA, 75 bp, Artificial Sequence
  Synthetic
cgcaaggctggctcttgcctggaggtcggtgcgcaccctcgatctattaatgagcacgccaatgtcatacataga

SEQ ID NO: 150407 - DNA, 75 bp, Artificial Sequence
  Synthetic
atgaaggctggagtgcctctgaggatgctctcactgccgtgatcactgctgcttatcttaccatctgccaccaga

SEQ ID NO: 150408 - DNA, 75 bp, Artificial Sequence
  Synthetic
cgcgggatcgcccttaccctgtttaaccttgctgacactctgcttggcggcctaccgacagaattgatttcgtcg

SEQ ID NO: 150409 - DNA, 75 bp, Artificial Sequence
  Synthetic
cctctctggcggtgagattggccagcatcgcccgtcagtggtaccccgtggcaccattagcagcaatgttgatac

SEQ ID NO: 150410 - DNA, 75 bp, Artificial Sequence
  Synthetic
tgagcacgccaatgtcatacatagatgttttctcccgcctgatggtagagatatgcagcgttggcgagattgccc

SEQ ID NO: 150411 - DNA, 75 bp, Artificial Sequence
  Synthetic
atatgcagcgttggcgagattgcccgcggcgtgggccagctaataacatccgccgttgcattctcacagggcgcc

SEQ ID NO: 150412 - DNA, 75 bp, Artificial Sequence
  Synthetic
aagtccaccttctacgccgtccctgtccatatttgggataggctcatgcttttcggcgccacgctagacgatcag

SEQ ID NO: 150413 - DNA, 75 bp, Artificial Sequence
  Synthetic
atcgggccgggattatatccctggtcgccagctccagttctacgctcaatgccgccggtggttatcagctggttt

SEQ ID NO: 150414 - DNA, 75 bp, Artificial Sequence
  Synthetic
tgcccggagcttgaacagggcttactttatatgcctcaggagttaactacatcggatagcgttctcacctttgag

SEQ ID NO: 150415 - DNA, 75 bp, Artificial Sequence
  Synthetic
actccttgcacgatctacatccgcgtgaagttgccagggcaatgcgtgctcatggtatgcacactctatatgctg

SEQ ID NO: 150416 - DNA, 75 bp, Artificial Sequence
  Synthetic
atcggatagcgttctcacctttgagctaacagacattgtgcactgccgcatggcggcacccagccagcgcaaggc

SEQ ID NO: 150417 - DNA, 75 bp, Artificial Sequence
  Synthetic
acctgttcttgaccttactaattctataatatatcgggtggaatgaataacatgttcttttgctctctgcatggc

SEQ ID NO: 150418 - DNA, 75 bp, Artificial Sequence
  Synthetic
tccatatttgggataggctcatgcttttcggcgccacgctagacgatcaggccttctgctgctcgcggcttatga

SEQ ID NO: 150419 - DNA, 75 bp, Artificial Sequence
  Synthetic
ccaatcccagcgccccgccgctcccgcccgtcgtcgatctaccccagctggggcttcgccgttgacggctgtagc

SEQ ID NO: 150420 - DNA, 75 bp, Artificial Sequence
  Synthetic
tggcttggccaggagtgcacgtgcttccttcagcctgttgaggggcacattggtgaccagggccatgataatgag

SEQ ID NO: 150421 - DNA, 75 bp, Artificial Sequence
  Synthetic
cgttacctccgcacccaagcgatctctaaaggtatgcgccggctggaggtagagcacgctcagaagtttgttacc

SEQ ID NO: 150422 - DNA, 75 bp, Artificial Sequence
  Synthetic
gcgagctctatgagcttgtagaggccatggtagagaagggccaagacggctctgcagtcctggagcttgacctat

SEQ ID NO: 150423 - DNA, 75 bp, Artificial Sequence
  Synthetic
gggggatacatcggccggctacagccatgatcgtaaatccatccggtcctgtattaaggccactagggtccgggg

SEQ ID NO: 150424 - DNA, 75 bp, Artificial Sequence
  Synthetic
gggcttcgccgttgacggctgtagctccggcccccgatactgccccggtccctgatgttgattcgcgtggcgcta

SEQ ID NO: 150425 - DNA, 75 bp, Artificial Sequence
  Synthetic
tctgcagtcctggagcttgacctatgtaatcgtgatgtgtcccgaataacctttttccagaaagactgcaacaaa

SEQ ID NO: 150426 - DNA, 75 bp, Artificial Sequence
  Synthetic
cgctcggcataccggctgaccttgtagctcgtgccagccggcttgcagctaccgtagaagttgaagacacaaacg

SEQ ID NO: 150427 - DNA, 75 bp, Artificial Sequence
  Synthetic
tgccggcgctggctttctgctggctttcacttggaccctcgggtgcttgtcttcgatgagtctgtgcactgccgt

SEQ ID NO: 150428 - DNA, 75 bp, Artificial Sequence
  Synthetic
tccttcagcctgttgaggggcacattggtgaccagggccatgataatgaggcttttgagggatctgatattgatc

SEQ ID NO: 150429 - DNA, 75 bp, Artificial Sequence
  Synthetic
tacccgaaggctactaccatctatgtgcgcagtctgttcagcgctggcgggaacaccggcccgttaggccctccc

SEQ ID NO: 150430 - DNA, 75 bp, Artificial Sequence
  Synthetic
ttattcggcccgtggttccgcgctattgagaaagaaatcctggcagcgcttgcacccaatgtcttttatggtgat

SEQ ID NO: 150431 - DNA, 75 bp, Artificial Sequence
  Synthetic
aggcgggtactactaaagccgggtacccttataattataataccactgctagcgaccaattgctcatcgagaacg

SEQ ID NO: 150432 - DNA, 75 bp, Artificial Sequence
  Synthetic
agcgaccaattgctcatcgagaacgtcgctgggcatcgggtggctatttccacctataccactagcttaggtgca

SEQ ID NO: 150433 - DNA, 75 bp, Artificial Sequence
  Synthetic
gtcatttgattctgctaaacagtgcatggccgccgggccgtacagcctggattttacactgacctctgcgggcct

SEQ ID NO: 150434 - DNA, 75 bp, Artificial Sequence
  Synthetic
ttggcgaccaaggtcatgacaacgaggcctacgaggggtctgaggttgaccccgccgagcccgcccctaccgatg

SEQ ID NO: 150435 - DNA, 75 bp, Artificial Sequence
  Synthetic
gatatgaactccatcacttccactgatgtccgcatccttgttcaacccggtatagcctccgagttggtgattccc

SEQ ID NO: 150436 - DNA, 75 bp, Artificial Sequence
  Synthetic
tctgttgcagccgcctaatgacatatctacgaggcatttcttttaaagtcaccgtcggcacggttgtcgccaacg

SEQ ID NO: 150437 - DNA, 75 bp, Artificial Sequence
  Synthetic
gagtttgatagtacccaaaataatttctcactcgggcttgagtgtataatcatggaggagtgcggcatgccacaa

SEQ ID NO: 150438 - DNA, 75 bp, Artificial Sequence
  Synthetic
gcgactgctggtggacctatataaagcactcaacgtcccgcaagagatagtagcccgggctgcgcgtttgccggc

SEQ ID NO: 150439 - DNA, 75 bp, Artificial Sequence
  Synthetic
agtgagcgcctgcactatcgcaaccagggctggcgttcagttgagacctctggcgttgctgaggaggaagctact

SEQ ID NO: 150440 - DNA, 75 bp, Artificial Sequence
  Synthetic
gctttgtatcggtttaaccgctgcgcccagcggcattccgctgcaggcgggctctggttccacccggaaggtctt

SEQ ID NO: 150441 - DNA, 75 bp, Artificial Sequence
  Synthetic
cagtctactgtcgctgagctccagcggcttaagatgaaggtgggtaaaactcgggagttatagtttatttgcttg

SEQ ID NO: 150442 - DNA, 75 bp, Artificial Sequence
  Synthetic
tttttggagcctgtagagggcctgcttggcgaccaaggtcatgacaacgaggcctacgaggggtctgaggttgac

SEQ ID NO: 150443 - DNA, 75 bp, Artificial Sequence
  Synthetic
ggggatcaagcgtctggccaaagagcatcaacaggggctgctcttccgtttgggggagtggctcttggctaaggt

SEQ ID NO: 150444 - DNA, 75 bp, Artificial Sequence
  Synthetic
gttcactgacggcgcccaactggaggcaaatggccctgagcagtatgttctttcatttgatgaagcccgccagtg

SEQ ID NO: 150445 - DNA, 75 bp, Artificial Sequence
  Synthetic
ggcctactcgattttgcgcttgaacttgagtttcgtaatttgacacctggtaatacgaatacgcgcgtctctcgt

SEQ ID NO: 150446 - DNA, 75 bp, Artificial Sequence
  Synthetic
cccagcggcattccgctgcaggcgggctctggttccacccggaaggtcttgtcgggctgttcgcccccttctctc

SEQ ID NO: 150447 - DNA, 75 bp, Artificial Sequence
  Synthetic
gcttctctagctcttttcatccattgggacccgacgcggttgatgcaccgcccgctgctgattctactgattcta

SEQ ID NO: 150448 - DNA, 75 bp, Artificial Sequence
  Synthetic
gggacccgacgcggttgatgcaccgcccgctgctgattctactgattctactactacaattggtttgtgccctgc

SEQ ID NO: 150449 - DNA, 75 bp, Artificial Sequence
  Synthetic
ccggctgtggactgaagcttaaggtggactttagacctattgggctatatgctggtgttgttgtggctccgggtc

SEQ ID NO: 150450 - DNA, 75 bp, Artificial Sequence
  Synthetic
ctttgttttgaccgagagtatgcttgcccgtgcctcccgctagagcgggtggtgcgcaaaggatgttgctgtgtt

SEQ ID NO: 150451 - DNA, 75 bp, Artificial Sequence
  Synthetic
catcaacaggggctgctcttccgtttgggggagtggctcttggctaaggtgtgcgggccaaaagagacgtttgtc

SEQ ID NO: 150452 - DNA, 75 bp, Artificial Sequence
  Synthetic
ctgcagaggtcacggccttctgcagcgctttgtatagatataacagaaccatccaacggcactcaattgttggcg

SEQ ID NO: 150453 - DNA, 75 bp, Artificial Sequence
  Synthetic
cgctttgtatagatataacagaaccatccaacggcactcaattgttggcgggctatggttacatccggggggatt

SEQ ID NO: 150454 - DNA, 75 bp, Artificial Sequence
  Synthetic
gttttccgccctgaggtgctttggaatcatcctatccagcgggttatacacaatgaattagaacagtactgccgg

SEQ ID NO: 150455 - DNA, 75 bp, Artificial Sequence
  Synthetic
gcccataacccttgaggcccctacccccccccctcaaacgtcagctcaatccttagcggttggctttactacgcc

SEQ ID NO: 150456 - DNA, 75 bp, Artificial Sequence
  Synthetic
tgacttcttgcgaaagttaacgaatgtggctcatgtttgtgttgatgttgtttcgcaggtctacggtgttagccc

SEQ ID NO: 150457 - DNA, 75 bp, Artificial Sequence
  Synthetic
ctcagtcgagaatgcccagcaggataaggggattgctatcccacatgatattgatcttggtgagtcccgagttgt

SEQ ID NO: 150458 - DNA, 75 bp, Artificial Sequence
  Synthetic
cggaggcctatgagcctgccggcttggacaactggactgtgcgcgcccttacagatgccctccaccaggcgtccc

SEQ ID NO: 150459 - DNA, 75 bp, Artificial Sequence
  Synthetic
ttacaccagaacctggtctgagtctggctcctccagtgattttctaccacctgaggcagtcgttagtacccatcc

SEQ ID NO: 150460 - DNA, 75 bp, Artificial Sequence
  Synthetic
tgctttcttagaccggctggccgagatgttcagcgttggtactctgcccccacccgtggtcccgcagccaattgc

SEQ ID NO: 150461 - DNA, 75 bp, Artificial Sequence
  Synthetic
ggccaccgcccgggtggcggcttatgccatgctttttaccagcggtaccctgagtcttttgatcatactcagttt

SEQ ID NO: 150462 - DNA, 75 bp, Artificial Sequence
  Synthetic
tatccaggattatgacaatcaacaagagcaagaccgccccactccctctcctgctccttcccgtcctttctctgt

SEQ ID NO: 150463 - DNA, 75 bp, Artificial Sequence
  Synthetic
tatccaggattatgacaatcaacatgagcaagaccgccccactccctctcctgctccttcccgtcctttctctgt

SEQ ID NO: 150464 - DNA, 75 bp, Artificial Sequence
  Synthetic
tatccaggattatgacaatcaacacgagcaagaccgccccactccctctcctgctccttcccgtcctttctctgt

SEQ ID NO: 150465 - DNA, 75 bp, Artificial Sequence
  Synthetic
tatccaggattatgacaatcaacaggagcaagaccgccccactccctctcctgctccttcccgtcctttctctgt

SEQ ID NO: 150466 - DNA, 75 bp, Artificial Sequence
  Synthetic
cccccccctcaaacgtcagctcaatccttagcggttggctttactacgcccagccgccgcctgctgcatacttac

SEQ ID NO: 150467 - DNA, 75 bp, Artificial Sequence
  Synthetic
gcctggcccccccggccgccggctggaggcggggccctactgggccgatgcgccgccaccacccacaccggatga

SEQ ID NO: 150468 - DNA, 75 bp, Artificial Sequence
  Synthetic
gcccgttatcccccctcacggcccccggggttgttggcccacccgtcagcacccccgggccctctgctcataagc

SEQ ID NO: 150469 - DNA, 75 bp, Artificial Sequence
  Synthetic
gccatgctttttaccagcggtaccctgagtcttttgatcatactcagtttgtgatgaccgatggcctggcggctt

SEQ ID NO: 150470 - DNA, 75 bp, Artificial Sequence
  Synthetic
ggacaactggactgtgcgcgcccttacagatgccctccaccaggcgtccctacgggccgtgaggaccggctcaaa

SEQ ID NO: 150471 - DNA, 75 bp, Artificial Sequence
  Synthetic
aggcggcctatcgcgaaacgtgctctcgccttgggactgccgcctacccccttttgggggcggggatctataaag

SEQ ID NO: 150472 - DNA, 75 bp, Artificial Sequence
  Synthetic
tcgccttgggactgccgcctacccccttttgggggcggggatctataaagtccccataagcctaagctttgatgc

SEQ ID NO: 150473 - DNA, 75 bp, Artificial Sequence
  Synthetic
ccctgtttgagtcagactgcgattggctggttaatgcatctaaccccggccaccgtccgggcggcggcctctgtc

SEQ ID NO: 150474 - DNA, 75 bp, Artificial Sequence
  Synthetic
gaataccgtggccaccgccctgagtctgcgggcttttgggagccgtctcctgcccctacatccgagagttcacta

SEQ ID NO: 150475 - DNA, 75 bp, Artificial Sequence
  Synthetic
gctggttaatgcatctaaccccggccaccgtccgggcggcggcctctgtcatgccttttaccagcgtttcccaca

SEQ ID NO: 150476 - DNA, 75 bp, Artificial Sequence
  Synthetic
gaggcggggccctactgggccgatgcgccgccaccacccacaccggatgaggtaccatatcaaacgccggtgagc

SEQ ID NO: 150477 - DNA, 75 bp, Artificial Sequence
  Synthetic
gctatccttataattataatactactgctagtgatcagatcttgattgagaatgcagctggccatcgggtttgca

SEQ ID NO: 150478 - DNA, 75 bp, Artificial Sequence
  Synthetic
accgaccctccccgccctaactgttaccgaggacacggctcgagccgccaatcttgctttagagctggatgctgc

SEQ ID NO: 150479 - DNA, 75 bp, Artificial Sequence
  Synthetic
accgaccctccccgccctaactgttaccgaggacacggctcgagccgccattcttgctttagagctggatgctgc

SEQ ID NO: 150480 - DNA, 75 bp, Artificial Sequence
  Synthetic
accgaccctccccgccctaactgttaccgaggacacggctcgagccgccactcttgctttagagctggatgctgc

SEQ ID NO: 150481 - DNA, 75 bp, Artificial Sequence
  Synthetic
accgaccctccccgccctaactgttaccgaggacacggctcgagccgccagtcttgctttagagctggatgctgc

SEQ ID NO: 150482 - DNA, 75 bp, Artificial Sequence
  Synthetic
gggcttcgccgttgacggctgtggccccggcgcctgatactgccccggtccctgatgttgattcgcgtggtgcta

SEQ ID NO: 150483 - DNA, 75 bp, Artificial Sequence
  Synthetic
tgcggttgcccccgattatagagtagcaaataacccaaaaagattggaagcagcgtaccgtgagacttgttctcg

SEQ ID NO: 150484 - DNA, 75 bp, Artificial Sequence
  Synthetic
cggcggtctatgaaggggaccttttcaattcagattgcttctggcttgtcaacgcggctaatgcccagcacaacc

SEQ ID NO: 150485 - DNA, 75 bp, Artificial Sequence
  Synthetic
ctctgggcctgtttctatctctgctgtcggagtcctcgcacctcattctgcattggctgctttagaggacaccgt

SEQ ID NO: 150486 - DNA, 75 bp, Artificial Sequence
  Synthetic
accgaggacacggctcgagccgccaatcttgctttagagctggatgctgccactgatgtcgggcgtgcgtgtgcc

SEQ ID NO: 150487 - DNA, 75 bp, Artificial Sequence
  Synthetic
accgaggacacggctcgagccgccattcttgctttagagctggatgctgccactgatgtcgggcgtgcgtgtgcc

SEQ ID NO: 150488 - DNA, 75 bp, Artificial Sequence
  Synthetic
accgaggacacggctcgagccgccactcttgctttagagctggatgctgccactgatgtcgggcgtgcgtgtgcc

SEQ ID NO: 150489 - DNA, 75 bp, Artificial Sequence
  Synthetic
accgaggacacggctcgagccgccagtcttgctttagagctggatgctgccactgatgtcgggcgtgcgtgtgcc

SEQ ID NO: 150490 - DNA, 75 bp, Artificial Sequence
  Synthetic
ctgggctcaggcatctaccaggtccctgtaggcccgagtttcgacgcctgggaacgaaaccaccgacccggtgat

SEQ ID NO: 150491 - DNA, 75 bp, Artificial Sequence
  Synthetic
atccaacagggagaggtcgatgttattgttgtcccgactcgagagctgcgcaactcatggaggcgccgtgggttt

SEQ ID NO: 150492 - DNA, 75 bp, Artificial Sequence
  Synthetic
ctgtaggcccgagtttcgacgcctgggaacgaaaccaccgacccggtgatgaactttatcttaccgagcttgcaa

SEQ ID NO: 150493 - DNA, 75 bp, Artificial Sequence
  Synthetic
ttgttgtcccgactcgagagctgcgcaactcatggaggcgccgtgggtttgcggccttcacgcctcacactgctg

SEQ ID NO: 150494 - DNA, 75 bp, Artificial Sequence
  Synthetic
aacacccaggcccataatacatgctgtggcgcctgactataggcgacgtagagacccagccgccttgcaggtagc

SEQ ID NO: 150495 - DNA, 75 bp, Artificial Sequence
  Synthetic
gtgccgaacgctgttggcgggtatgctatatctatctccttctggccccagacgacgaccaccccgacgtccgtg

SEQ ID NO: 150496 - DNA, 75 bp, Artificial Sequence
  Synthetic
gcttgtgcctcccttctacctcttttcttttattttccctcttctgcgtcccgcgctccctggaaaaaaaaaaaa

SEQ ID NO: 150497 - DNA, 75 bp, Artificial Sequence
  Synthetic
ccgcaacaggtgccggcctctcaccgggggccgacaccggcccggcactgcccgccctgactataacagaggata

SEQ ID NO: 150498 - DNA, 75 bp, Artificial Sequence
  Synthetic
tgcaacgcgccgcgtctgtccatctcctcggagatcctaaccaaatccctgcaattgacttcgagcacactggcc

SEQ ID NO: 150499 - DNA, 75 bp, Artificial Sequence
  Synthetic
ggcttatgacttacctccgtggtattagttataaagtcactgttggcgcgcttgtcgctaatgaaggatggaacg

SEQ ID NO: 150500 - DNA, 75 bp, Artificial Sequence
  Synthetic
cccgccctgactataacagaggatacagctcggactgccaatcttgcattggaaattgattctcggaccgagcta

SEQ ID NO: 150501 - DNA, 75 bp, Artificial Sequence
  Synthetic
agtgagcgcctgcactatcgcaaccagggctggcgctcagttgagacctctggtgtcgctgaggaggaggctact

SEQ ID NO: 150502 - DNA, 75 bp, Artificial Sequence
  Synthetic
gacaatcatctccccggcgatgagatgtatctgctgccggccatgtcatcttggtaccgggcctggcgtgcgcag

SEQ ID NO: 150503 - DNA, 75 bp, Artificial Sequence
  Synthetic
aggcgatatccaagggcatgcgccggttggaggtcgaacacgcccagaaatttatcacaagactttacagttggc

SEQ ID NO: 150504 - DNA, 75 bp, Artificial Sequence
  Synthetic
cgtgctgttgtgacgtatgaaggtgatactagtgcaggctacaatcatgacgtctccatactccgtgcatggatc

SEQ ID NO: 150505 - DNA, 75 bp, Artificial Sequence
  Synthetic
ggcaaatcgaggtctatacagcagggtgatgttgatgttgtggttgtgcctacccgcgagctccgcggtaattgg

SEQ ID NO: 150506 - DNA, 75 bp, Artificial Sequence
  Synthetic
aaagatccagaccactagccgggttcttcgttcgctgttttggggtgaaccggctgttggtcagaagctggtgtt

SEQ ID NO: 150507 - DNA, 75 bp, Artificial Sequence
  Synthetic
cccccagtcgggccccctgggggtggcggcggggggccggggtcggggcccccgacccatatattagtggtcacc

SEQ ID NO: 150508 - DNA, 75 bp, Artificial Sequence
  Synthetic
cctcggagatcctaaccaaatccctgcaattgacttcgagcacactggcctcgtgccggccattaggcctgaact

SEQ ID NO: 150509 - DNA, 75 bp, Artificial Sequence
  Synthetic
caccccactcggccgcccgtgttactagcggtcgtcgtgttgtcatcgatgaagcaccatctctcccgcctcatt

SEQ ID NO: 150510 - DNA, 75 bp, Artificial Sequence
  Synthetic
cttcgttcgctgttttggggtgaaccggctgttggtcagaagctggtgtttactcaggctgcaaaagctgcccat

SEQ ID NO: 150511 - DNA, 75 bp, Artificial Sequence
  Synthetic
gcggcggggggccggggtcggggcccccgacccatatattagtggtcaccccaggcttggccaatactgccaatc

SEQ ID NO: 150512 - DNA, 75 bp, Artificial Sequence
  Synthetic
cgtgggttgattcagtcgtctcgagcccacgccatcgtggctttgactcgccacacagagaagtgtgtggtgctt

SEQ ID NO: 150513 - DNA, 75 bp, Artificial Sequence
  Synthetic
cccacgccatcgtggctttgactcgccacacagagaagtgtgtggtgcttgatgccccgggcctccttcgcgagg

SEQ ID NO: 150514 - DNA, 75 bp, Artificial Sequence
  Synthetic
actaccggttcgtggcgggggtcccggggtcggggaagtccgtcggtgtccggcgtgaagattgcgatctggtga

SEQ ID NO: 150515 - DNA, 75 bp, Artificial Sequence
  Synthetic
ttgagcatgctggccttgtccccgcaatccgccctgagctcgcccccaccagctggtggcacgttacgcaccggt

SEQ ID NO: 150516 - DNA, 75 bp, Artificial Sequence
  Synthetic
ggggtcggggaagtccgtcggtgtccggcgtgaagattgcgatctggtgattgtcccaacgaaccagcttaaggc

SEQ ID NO: 150517 - DNA, 75 bp, Artificial Sequence
  Synthetic
tgtacctgcttcttggagccagccgagggtttagttggcgatcaaggccatgacaacgaggcctatgagggttct

SEQ ID NO: 150518 - DNA, 75 bp, Artificial Sequence
  Synthetic
gtcccgcggacgtctgcgagcttatacgtggggcgtaccccaagattcagactaccagccgtgtgctgagatctc

SEQ ID NO: 150519 - DNA, 75 bp, Artificial Sequence
  Synthetic
tcccccgtggtgccgtagagtgtaacatcgacacgctcagtgcctttcccccctcctgccagttcagcgctttcc

SEQ ID NO: 150520 - DNA, 75 bp, Artificial Sequence
  Synthetic
ctctatagggcacttaatgtcccacacgatattgccgcccgagcctcccgattaacggctactgttgagctcgtt

SEQ ID NO: 150521 - DNA, 75 bp, Artificial Sequence
  Synthetic
cattgatgaggcccctaccatcgcgccgcacctcttgctctgttatatgaccaccgccgctgacgtagtcctgct

SEQ ID NO: 150522 - DNA, 75 bp, Artificial Sequence
  Synthetic
attaacggctactgttgagctcgttgcaagtccagaccgcttagagtgccgtactgtgctcggcaataagacctt

SEQ ID NO: 150523 - DNA, 75 bp, Artificial Sequence
  Synthetic
catcgacacgctcagtgcctttcccccctcctgccagttcagcgctttccaccagcttgctgaggagctgggtca

SEQ ID NO: 150524 - DNA, 75 bp, Artificial Sequence
  Synthetic
tatccaggactatgacaatcaacatgagcaagatcgccctactccctcccctgctccttctcgccccttctctgt

SEQ ID NO: 150525 - DNA, 75 bp, Artificial Sequence
  Synthetic
ccgcacctcttgctctgttatatgaccaccgccgctgacgtagtcctgcttggggacccgaggcagatccccgct

SEQ ID NO: 150526 - DNA, 75 bp, Artificial Sequence
  Synthetic
gctgactgcctctgacagtgtgttagtctttgagctcacggacatagtccactgccgtatggccgcccccagcca

SEQ ID NO: 150527 - DNA, 75 bp, Artificial Sequence
  Synthetic
gtctttgagctcacggacatagtccactgccgtatggccgcccccagccagcgaaaggctgttctgtccaccctt

SEQ ID NO: 150528 - DNA, 75 bp, Artificial Sequence
  Synthetic
tgttgcgcttacccgtcacacagagaagtgtgttattttggatgccccgggactgcttcgcgaggtgggcatatc

SEQ ID NO: 150529 - DNA, 75 bp, Artificial Sequence
  Synthetic
catcgatgccccagagatgtgtgccatctgttgtcggccgattacccggggatgaccactacaaatcctgtagtc

SEQ ID NO: 150530 - DNA, 75 bp, Artificial Sequence
  Synthetic
atctgttgtcggccgattacccggggatgaccactacaaatcctgtagtcaggtctttgatgttctctgggcagg

SEQ ID NO: 150531 - DNA, 75 bp, Artificial Sequence
  Synthetic
gcgctgcgccgggggaggtggcagccttttgcagtgccctttatagatataataggttcacccagcggcactcgc

SEQ ID NO: 150532 - DNA, 75 bp, Artificial Sequence
  Synthetic
taaccctgatcgaaaccttgacaccctccaggccttccccccctcctgccagatcagcgccttccaccagctggc

SEQ ID NO: 150533 - DNA, 75 bp, Artificial Sequence
  Synthetic
gtgcctgtactggggcgtgtcagtgtcaccacatgtgagctatttgaatttgttgaggccatggttgcaaaaggt

SEQ ID NO: 150534 - DNA, 75 bp, Artificial Sequence
  Synthetic
aggggagcacttttaacaccaccaccctcattgtgacaaacgatgctcgtgggctgctggctgcgtcgcgggctc

SEQ ID NO: 150535 - DNA, 75 bp, Artificial Sequence
  Synthetic
agatcagcgccttccaccagctggctgaggagcttggtcatcggcccgcgcctgtggcagctgtccttccgccct

SEQ ID NO: 150536 - DNA, 75 bp, Artificial Sequence
  Synthetic
tcaccacatgtgagctatttgaatttgttgaggccatggttgcaaaaggtcaagacggctctgcagtccttgagc

SEQ ID NO: 150537 - DNA, 75 bp, Artificial Sequence
  Synthetic
cctcattgtgacaaacgatgctcgtgggctgctggctgcgtcgcgggctcactgtattgttgccctgacccggca

SEQ ID NO: 150538 - DNA, 75 bp, Artificial Sequence
  Synthetic
ctatagcgcacggcaaagttggccaggggatctcggcatggagtaagaccttctgtgcgcttttcggcccctggt

SEQ ID NO: 150539 - DNA, 75 bp, Artificial Sequence
  Synthetic
ggggaccctgtatacccggacctggtcaacatccggcttttctagtgatttctccccccctgaggcggccgctct

SEQ ID NO: 150540 - DNA, 75 bp, Artificial Sequence
  Synthetic
tttttatctgacacagccggtggaggtccaagccaggccggccgctgtagagaaggcggagcggacgaccaactt

SEQ ID NO: 150541 - DNA, 75 bp, Artificial Sequence
  Synthetic
taactgatatagtccattgccgcatggccgcccctagccagcgcaaggccgtcctttccacgctcgttgggcgtt

SEQ ID NO: 150542 - DNA, 75 bp, Artificial Sequence
  Synthetic
ttctgggcctgtttctatatctgctgtcggtgtcctcgcacctcactctgtactggctgctttagaggacactgt

SEQ ID NO: 150543 - DNA, 75 bp, Artificial Sequence
  Synthetic
gtcctttccacgctcgttgggcgttacgggcgtcggacgaagttatatgaagctgcccactcggacgtgcgcgaa

SEQ ID NO: 150544 - DNA, 75 bp, Artificial Sequence
  Synthetic
cgttaatgtggccactggtgctcaggctgttgcccgctccctcgattggtctaaagttactctggatggtcgtcc

SEQ ID NO: 150545 - DNA, 75 bp, Artificial Sequence
  Synthetic
ctctggttctgaagtatttgaaaatgacttttctgagtttgatagcacccagaataacttctcactaggtctaga

SEQ ID NO: 150546 - DNA, 75 bp, Artificial Sequence
  Synthetic
tcggccctgtgcaggccacgacgtgcgagctttatgaactggtcgaggcgatggtggagaaaggtcaggatgggt

SEQ ID NO: 150547 - DNA, 75 bp, Artificial Sequence
  Synthetic
ccgccttgccccgccctagagcagggcaagctttacacccctttcaatctgactggccgggagcaggtgaccatc

SEQ ID NO: 150548 - DNA, 75 bp, Artificial Sequence
  Synthetic
tctgtgccccttgtccctgaacctgctggattgtccggccctgttgtacttaaccctcctcttccccccctcccc

SEQ ID NO: 150549 - DNA, 75 bp, Artificial Sequence
  Synthetic
aaacccgggagtattgatttattctgcttgtgcctcccttctagctctagtggtttagtagacatcagctgcgaa

SEQ ID NO: 150550 - DNA, 75 bp, Artificial Sequence
  Synthetic
gacttttctgagtttgatagcacccagaataacttctcactaggtctagagtgtgctatcatggaagagtgcggc

SEQ ID NO: 150551 - DNA, 75 bp, Artificial Sequence
  Synthetic
gtgtatgcagggtctttgtttgaatcagattgtgactggttggttaatgcctcaaaccccggccaccgccccgga

SEQ ID NO: 150552 - DNA, 75 bp, Artificial Sequence
  Synthetic
agagggttttggaagaagcattccggtgagcctggcactttgttgtggaatacggtttggaatatgactgttatt

SEQ ID NO: 150553 - DNA, 75 bp, Artificial Sequence
  Synthetic
tcacaaccggtgagacgatcgcccacggcaaagtaggccagggaatatcagcttggagcaagaccctttgcgctt

SEQ ID NO: 150554 - DNA, 75 bp, Artificial Sequence
  Synthetic
tatggcatgatgatgtggaagcagtgcgggagtcactacgtgtgttgattccttcgctacagggtgtcaaggttt

SEQ ID NO: 150555 - DNA, 75 bp, Artificial Sequence
  Synthetic
cggcaaagtaggccagggaatatcagcttggagcaagaccctttgcgctttattcggcccctggttccgggccat

SEQ ID NO: 150556 - DNA, 75 bp, Artificial Sequence
  Synthetic
gtgagcctggcactttgttgtggaatacggtttggaatatgactgttattgcccattgctatgacttccgcaatt

SEQ ID NO: 150557 - DNA, 75 bp, Artificial Sequence
  Synthetic
gcaagctttacacccctttcaatctgactggccgggagcaggtgaccatcttagccctctcctccactgtgcact

SEQ ID NO: 150558 - DNA, 75 bp, Artificial Sequence
  Synthetic
gcgggagtcactacgtgtgttgattccttcgctacagggtgtcaaggtttcgtcgtgcgagcttgccgagctcgt

SEQ ID NO: 150559 - DNA, 75 bp, Artificial Sequence
  Synthetic
cgctgtcactggtgcggggtcaagcatggtatttgagaatgatttttcagaatttgatagtacccagaataactt

SEQ ID NO: 150560 - DNA, 75 bp, Artificial Sequence
  Synthetic
ccctgattgcgggttgcgggcttaagctgaaagttgattttaggccggtaggtttgtatgccggtgtggttgttg

SEQ ID NO: 150561 - DNA, 75 bp, Artificial Sequence
  Synthetic
gataacgttctttcagaaggactgcaacaagttcaccacagatgagccggtccaacatggtaaggtcgggcaggg

SEQ ID NO: 150562 - DNA, 75 bp, Artificial Sequence
  Synthetic
gctgaaagttgattttaggccggtaggtttgtatgccggtgtggttgttgccccgggcctcggggcactcccaga

SEQ ID NO: 150563 - DNA, 75 bp, Artificial Sequence
  Synthetic
aacaagttcaccacagatgagccggtccaacatggtaaggtcgggcagggtatttcggcgtggtcaaagaccctt

SEQ ID NO: 150564 - DNA, 75 bp, Artificial Sequence
  Synthetic
ttcactcggccttgaatgtgtgattatggaagaatgtggcatgccccaatggctggttagattgtaccatctggt

SEQ ID NO: 150565 - DNA, 75 bp, Artificial Sequence
  Synthetic
agctgtgtgtgactttttacgaaagttaacgaatgttgctcaggtctgtgtggacgttgtttcgagagcttatgg

SEQ ID NO: 150566 - DNA, 75 bp, Artificial Sequence
  Synthetic
tacattgctctggaataccgtctggaatatggcggttatagctcactgctatgaattccgtgatttcagggttgc

SEQ ID NO: 150567 - DNA, 75 bp, Artificial Sequence
  Synthetic
ggcgattgttatgcccaggagaaattggaagccgccgtggccggggcgaaagcttgccgtgtttttgagaatgat

SEQ ID NO: 150568 - DNA, 75 bp, Artificial Sequence
  Synthetic
atgaattccgtgatttcagggttgccgcgtttaaaggggatgactcggtggttctttgcagtgactatcgtcaga

SEQ ID NO: 150569 - DNA, 75 bp, Artificial Sequence
  Synthetic
ctgatggtaaggcacactttaccgagactattaaacctgttctggatttgactagtgctattatacatcgggtag

SEQ ID NO: 150570 - DNA, 75 bp, Artificial Sequence
  Synthetic
tggaagccgccgtggccggggcgaaagcttgccgtgtttttgagaatgatttcagcgagtttgatagcacgcaaa

SEQ ID NO: 150571 - DNA, 75 bp, Artificial Sequence
  Synthetic
ctcccccctggtacctatcataccacctcgtacctactcatccatgatggggaccgtgcagtgattacatatgag

SEQ ID NO: 150572 - DNA, 75 bp, Artificial Sequence
  Synthetic
ccggagttgtggttgcccctggtctcggaacgctgcctgatatcgtccggttcgccggacggctgtcagaaaaga

SEQ ID NO: 150573 - DNA, 75 bp, Artificial Sequence
  Synthetic
acctgctccgttcggcgtgggtgttgcaggctccccaggaaagtttgcggggtcgatggaagaaacattccggtg

SEQ ID NO: 150574 - DNA, 75 bp, Artificial Sequence
  Synthetic
gcaggctccccaggaaagtttgcggggtcgatggaagaaacattccggtgagcccggcacattgctttggaatac

SEQ ID NO: 150575 - DNA, 75 bp, Artificial Sequence
  Synthetic
gccgccgcgttgtgatcgatgaggccccatctctcccgccacacctgttgctgttacatatgcagcgggcctcct

SEQ ID NO: 150576 - DNA, 75 bp, Artificial Sequence
  Synthetic
accggggccccggccctgaaagagcggagcagttacgcttagccgtctgcgactttttgagaaagttgacgaacg

SEQ ID NO: 150577 - DNA, 75 bp, Artificial Sequence
  Synthetic
gaccacccgctggtgattgagcgagttcgggcggtgggttgtcattttgtgctccttctaacagctgcacctgaa

SEQ ID NO: 150578 - DNA, 75 bp, Artificial Sequence
  Synthetic
ttgctcaggtctgtgttgatgttgtgtcgcgtgtttatggggtgagccctgggcttgtacataaccttatcggca

SEQ ID NO: 150579 - DNA, 75 bp, Artificial Sequence
  Synthetic
ctctatcgtatgctgccggttctatcagcaggagcctcgggctgcggccctcatcaccggctgtggccttaagtt

SEQ ID NO: 150580 - DNA, 75 bp, Artificial Sequence
  Synthetic
accggggctggagctcgccctcggcaggcaacccgcccacttggttccgcctggcgcgaccagtcccagcgcccc

SEQ ID NO: 150581 - DNA, 75 bp, Artificial Sequence
  Synthetic
gccctgagcttgcgccaacgagctggtggcatgttacgcaccgctgcccggccgatgtgtgcgagctcatacgtg

SEQ ID NO: 150582 - DNA, 75 bp, Artificial Sequence
  Synthetic
aggcaacccgcccacttggttccgcctggcgcgaccagtcccagcgccccgccgctaccgcgcgtcgtagatcta

SEQ ID NO: 150583 - DNA, 75 bp, Artificial Sequence
  Synthetic
gctttgttcggcccatggttccgcgccattgagaaggagatccttgctgcacttgctcccaatgtattctatggt

SEQ ID NO: 150584 - DNA, 75 bp, Artificial Sequence
  Synthetic
ttgtgcagaggttagaatgaataacacgttttctgcatcgcccatgggatcgccatgcgcactggggttgttctg

SEQ ID NO: 150585 - DNA, 75 bp, Artificial Sequence
  Synthetic
gagaagaactggggcccagtgaaggagcgaaaggaggacctcgagcagtccgtgcgcgactttgtggcaaggctg

SEQ ID NO: 150586 - DNA, 75 bp, Artificial Sequence
  Synthetic
cagcaggagcctcgggctgcggccctcatcaccggctgtggccttaagttgaaggtcaactttggtgacgtcggg

SEQ ID NO: 150587 - DNA, 75 bp, Artificial Sequence
  Synthetic
ggggtgcgattcttcgccgccaatataatttgtcaacttcacccctgacctctacggttgcttctggcaccaacc

SEQ ID NO: 150588 - DNA, 75 bp, Artificial Sequence
  Synthetic
taatttgtcaacttcacccctgacctctacggttgcttctggcaccaaccttgtgctttatgctgcccctctcag

SEQ ID NO: 150589 - DNA, 75 bp, Artificial Sequence
  Synthetic
tgcttgctacccgcttttacaaactggagcccggtctggcccttaatgcggtcgcgggcctgaaggctatcgccg

SEQ ID NO: 150590 - DNA, 75 bp, Artificial Sequence
  Synthetic
tcacggagaccacaattatagccacggccgacgccaggggccttatccagtcatctcgggcccatgctatagttg

SEQ ID NO: 150591 - DNA, 75 bp, Artificial Sequence
  Synthetic
tcatctcgggcccatgctatagttgcacttacccgccatactgagaagtgtgtcattttggatgcccctggctta

SEQ ID NO: 150592 - DNA, 75 bp, Artificial Sequence
  Synthetic
tgttgttcgggccacgatccgctaccgccctctagtcccgaatgcggttggcgggtatgcgatttctatctcctt

SEQ ID NO: 150593 - DNA, 75 bp, Artificial Sequence
  Synthetic
tgtagcatgtgtgcggaatgcgtgtcgctttcgtgctcgtgtttttgctgttcgtgccgctgctgctcgcggccc

SEQ ID NO: 150594 - DNA, 75 bp, Artificial Sequence
  Synthetic
cgccctctagtcccgaatgcggttggcgggtatgcgatttctatctccttttggccccaaacgaccactactccc

SEQ ID NO: 150595 - DNA, 75 bp, Artificial Sequence
  Synthetic
agtcggtcgtggtatagcgctaactctgtttaatcttgctgacacgcttctcggcgggctcccgacagaattgat

SEQ ID NO: 150596 - DNA, 75 bp, Artificial Sequence
  Synthetic
cgctttcgtgctcgtgtttttgctgttcgtgccgctgctgctcgcggcccccatgtaccccggaggaacccgggg

SEQ ID NO: 150597 - DNA, 75 bp, Artificial Sequence
  Synthetic
gcgccgttgactgccgtttcacccgcacctgacacggcgcctgtcccggatgtcgactctcgcggggctattctg

SEQ ID NO: 150598 - DNA, 75 bp, Artificial Sequence
  Synthetic
atggcgagccgacagtgaagctttatacttcagtcgagaacgctcagcaggataagggtatagctatcccacatg

SEQ ID NO: 150599 - DNA, 75 bp, Artificial Sequence
  Synthetic
gtgatacctagtgagcgcctgcactatcgcaatcagggctggcgctctgttgagacatcaggagttgctgaggag

SEQ ID NO: 150600 - DNA, 75 bp, Artificial Sequence
  Synthetic
caattggctatccccaaccaatccctttgctgccgaactctccgccatgcccccactcggcactgcctggatcga

SEQ ID NO: 150601 - DNA, 75 bp, Artificial Sequence
  Synthetic
atcgcaatcagggctggcgctctgttgagacatcaggagttgctgaggaggaagcaacttccggtcttgtcatgt

SEQ ID NO: 150602 - DNA, 75 bp, Artificial Sequence
  Synthetic
tttgctgccgaactctccgccatgcccccactcggcactgcctggatcgatcggcgccgcggcaagccccgtaac

SEQ ID NO: 150603 - DNA, 75 bp, Artificial Sequence
  Synthetic
tgccacaagagcttactgtgtccgatagtgtgttggttttcgagcttacggatatagtccattgccgcatggccg

SEQ ID NO: 150604 - DNA, 75 bp, Artificial Sequence
  Synthetic
gcgccgcttaacccccttctgcccctccaggatggcactaacactcacatcatggccactgaggcatccaattac

SEQ ID NO: 150605 - DNA, 75 bp, Artificial Sequence
  Synthetic
catggccactgaggcatccaattacgcccagtatcgggttgtccgagccacaatccgttaccgacctttggtgcc

SEQ ID NO: 150606 - DNA, 75 bp, Artificial Sequence
  Synthetic
ctcttgaacttgaatttcggaacctgacaccgggaaacactaacactcgtgtttcccgttacacgagcactgcac

SEQ ID NO: 150607 - DNA, 75 bp, Artificial Sequence
  Synthetic
cccgatgtgggcagccgaggctccatcttgcgccggcagtataatctttctacttcacctttgaccctaacagta

SEQ ID NO: 150608 - DNA, 75 bp, Artificial Sequence
  Synthetic
gacaccgggaaacactaacactcgtgtttcccgttacacgagcactgcacgccataggctgcgtcgcgggcctga

SEQ ID NO: 150609 - DNA, 75 bp, Artificial Sequence
  Synthetic
tcttgcgccggcagtataatctttctacttcacctttgaccctaacagtaccccagtcgtctaattccatcctgt

SEQ ID NO: 150610 - DNA, 75 bp, Artificial Sequence
  Synthetic
atgcattttaccagcggttcccggagtcttttgaccacacgcaatttgttatgtctgatggtcttgcggcttata

SEQ ID NO: 150611 - DNA, 75 bp, Artificial Sequence
  Synthetic
gaattcaattacttcgactgatgttaggattcttgtccaacccggcctagcctccgaactcgtcataccaagtga

SEQ ID NO: 150612 - DNA, 75 bp, Artificial Sequence
  Synthetic
aggattcttgtccaacccggcctagcctccgaactcgtcataccaagtgagcgtctccactatcgtaatcagggt

SEQ ID NO: 150613 - DNA, 75 bp, Artificial Sequence
  Synthetic
aggtgaggtcggtcgcggcatagctttaactttgtttaatcttgctgacactctcctcggtgggctaccgacaga

SEQ ID NO: 150614 - DNA, 75 bp, Artificial Sequence
  Synthetic
attatgcccagtatcgagtgcaggcgtgcaccttgcgcttccgcccgctagtcccaaactcggtgggcggatacg

SEQ ID NO: 150615 - DNA, 75 bp, Artificial Sequence
  Synthetic
ttaactttgtttaatcttgctgacactctcctcggtgggctaccgacagaattgatttcgtcggctggaggtcag

SEQ ID NO: 150616 - DNA, 75 bp, Artificial Sequence
  Synthetic
gtgcaccttgcgcttccgcccgctagtcccaaactcggtgggcggatacgcggtgtcaatgtcattctggcctca

SEQ ID NO: 150617 - DNA, 75 bp, Artificial Sequence
  Synthetic
tcccctgttaattcatacactaataccccttacactggggctctgggccttctcgattttgcgcttgaggttgaa

SEQ ID NO: 150618 - DNA, 75 bp, Artificial Sequence
  Synthetic
cagcaggacaaagggattgctatcccccacgaaatagacctcggtgattctagggttaccatccaagattatgac

SEQ ID NO: 150619 - DNA, 75 bp, Artificial Sequence
  Synthetic
cctggctgcagagctcgtcgtgcctcgggagcggttgcattaccgcaatcagggctggcgctctgttgaaaccaa

SEQ ID NO: 150620 - DNA, 75 bp, Artificial Sequence
  Synthetic
cccacgaaatagacctcggtgattctagggttaccatccaagattatgacaaccagcatgagcaagaccggccga

SEQ ID NO: 150621 - DNA, 75 bp, Artificial Sequence
  Synthetic
gaggagtcagtgtttgccgccgctgtgtccggggcagggtcatgtatggtatttgaaaatgacttttctgagttt

SEQ ID NO: 150622 - DNA, 75 bp, Artificial Sequence
  Synthetic
cgtggcgccgatggaaccgccgaactcacaactacggcggccacacggtttatgaaagacctccacttcactggg

SEQ ID NO: 150623 - DNA, 75 bp, Artificial Sequence
  Synthetic
gcattgccgcatggccgccccgagccagcgcaaggccgtgctgtccacacttgtgggtcgatacggtcggcgtac

SEQ ID NO: 150624 - DNA, 75 bp, Artificial Sequence
  Synthetic
gacagtacccagaacaatttctctctcggccttgagtgtgtggttatggaggagtgcggcatgcctcaatggtta

SEQ ID NO: 150625 - DNA, 75 bp, Artificial Sequence
  Synthetic
ctgaatatgaccaaactacctatggctctaccacaaatcctatgtatgtttctgacactgtgacatttgttaatg

SEQ ID NO: 150626 - DNA, 75 bp, Artificial Sequence
  Synthetic
ggcctgcttgatatcgccctccaggttgaatatcgcaacttgacccctggcaacaccaacacccgtgttaaccgg

SEQ ID NO: 150627 - DNA, 75 bp, Artificial Sequence
  Synthetic
ctctaccacaaatcctatgtatgtttctgacactgtgacatttgttaatgtggctactggtgcacagggtgttgc

SEQ ID NO: 150628 - DNA, 75 bp, Artificial Sequence
  Synthetic
cgggagcggttgcattaccgcaatcagggctggcgctctgttgaaaccaactctgtgccacaggaagagtcaacc

SEQ ID NO: 150629 - DNA, 75 bp, Artificial Sequence
  Synthetic
ttgaatatcgcaacttgacccctggcaacaccaacacccgtgttaaccggttccgcaccacagccccccataaga

SEQ ID NO: 150630 - DNA, 75 bp, Artificial Sequence
  Synthetic
ttgagaatgcacagcaggacaaggggatcgcaatacctcatgatattgacctaggcgattcccgtgttgtcatcc

SEQ ID NO: 150631 - DNA, 75 bp, Artificial Sequence
  Synthetic
cttcgttctgcccctgcgtggtaagctttctttttgggaggccggtaccactaaagctgggtacccttataatta

SEQ ID NO: 150632 - DNA, 75 bp, Artificial Sequence
  Synthetic
ctggtggcaatggtgtgggtgatataggtaagggcattgtgcaggtcttgtttaatatcgcagataccctattgg

SEQ ID NO: 150633 - DNA, 75 bp, Artificial Sequence
  Synthetic
ctttctttttgggaggccggtaccactaaagctgggtacccttataattacaacacaacagccagtgatcagatc

SEQ ID NO: 150634 - DNA, 75 bp, Artificial Sequence
  Synthetic
aggtaagggcattgtgcaggtcttgtttaatatcgcagataccctattgggcggactcccgacggatttggtgtc

SEQ ID NO: 150635 - DNA, 75 bp, Artificial Sequence
  Synthetic
gcgccaacgatgtgttgtgggtctcactgactgccgctgaatatgatcagactacatatggttcgtcgactaatc

SEQ ID NO: 150636 - DNA, 75 bp, Artificial Sequence
  Synthetic
gtggtggtggcccctggtttggggacactgcccgatgtggtgcgttttgctggtcggttgtctgaaaagaattgg

SEQ ID NO: 150637 - DNA, 75 bp, Artificial Sequence
  Synthetic
atctcaggcgtcggcgtgcttgcgcctcatgcagtgcttgctgcatttgaggacaccgtcgactcgcccgcccgt

SEQ ID NO: 150638 - DNA, 75 bp, Artificial Sequence
  Synthetic
ttctgtcgaggcagcccagttagaccagggtgtgaccatacctcatgacatagacctagggttatctgctgtcac

SEQ ID NO: 150639 - DNA, 75 bp, Artificial Sequence
  Synthetic
ctcatgcagtgcttgctgcatttgaggacaccgtcgactcgcccgcccgtgcacatacttttgatgacttttgcc

SEQ ID NO: 150640 - DNA, 75 bp, Artificial Sequence
  Synthetic
caggccgtcgcccgctctcttgattggtctaaagtaactctggatgggcggccgcttactaccatccagcagcac

SEQ ID NO: 150641 - DNA, 75 bp, Artificial Sequence
  Synthetic
ggtctaaagtaactctggatgggcggccgcttactaccatccagcagcactctaagatattttatgtcctccccc

SEQ ID NO: 150642 - DNA, 75 bp, Artificial Sequence
  Synthetic
cagggtgtgaccatacctcatgacatagacctagggttatctgctgtcacattgcaggattttgacaaccaacat

SEQ ID NO: 150643 - DNA, 75 bp, Artificial Sequence
  Synthetic
aggtaggtaaaacccgggagtcttaatctattctttctgtgcccccttcgaattccctttactttattttcctct

SEQ ID NO: 150644 - DNA, 75 bp, Artificial Sequence
  Synthetic
gtgaccctgccctctgctgagtacgctcagtcgcagagtgccatgggctcccacccggcgtactggtctgaggag

SEQ ID NO: 150645 - DNA, 75 bp, Artificial Sequence
  Synthetic
gcgatcaaatcctgatcgagaatgcagccgaccatcgtgttgctgtctcgacttaccctacaagtttgggtgctg

SEQ ID NO: 150646 - DNA, 75 bp, Artificial Sequence
  Synthetic
gccagcgggccttggtgtctagtgttaaatgggatcaggtcaccttgaatggtaaggcattacataaggaaacac

SEQ ID NO: 150647 - DNA, 75 bp, Artificial Sequence
  Synthetic
acttaccctacaagtttgggtgctggccctgcgtctatttccgcagtcggtgtgctcgctcccccctctgttctg

SEQ ID NO: 150648 - DNA, 75 bp, Artificial Sequence
  Synthetic
tacaacgtgtgattcacaatgagctcgagcaatattgtcgagctcgcgccggccgctgccttgaagtgggcgccc

SEQ ID NO: 150649 - DNA, 75 bp, Artificial Sequence
  Synthetic
gctatacatataattacaacaccacggactctgatagtctgtgggtttggtgggatgggacctctaaagcttatc

SEQ ID NO: 150650 - DNA, 75 bp, Artificial Sequence
  Synthetic
cttggcctgcagggttgtgcttttcagtttactgttgctgagcttcaacgtcttaagatgaaggtgggtaaaacc

SEQ ID NO: 150651 - DNA, 75 bp, Artificial Sequence
  Synthetic
tttatgtttctacctatactactatgctgggtgctggacctgttaacatcactggactgggagctatcggcccca

SEQ ID NO: 150652 - DNA, 75 bp, Artificial Sequence
  Synthetic
tgccccccttctatgttgattgttttattttttatttttgcgtttcgcgctccctgggaaaaaaaaaaaaaaaaa

SEQ ID NO: 150653 - DNA, 75 bp, Artificial Sequence
  Synthetic
ggtggtacactgcccccacccgtggtcctgcggcaaactgtcgccggtccgctctccgcgggcttccacctgttg

SEQ ID NO: 150654 - DNA, 75 bp, Artificial Sequence
  Synthetic
ggctctcttcctgcctcgtggctgatgctatggcgcgagtgcaggccctgtcagcagcagccgccgatagtgtct

SEQ ID NO: 150655 - DNA, 75 bp, Artificial Sequence
  Synthetic
actcacgtggcgctatcctgcgccggcagtacaacctgtctacgtccccgctcacgtcatccgtcgcttcgggta

SEQ ID NO: 150656 - DNA, 75 bp, Artificial Sequence
  Synthetic
tcagcagcagccgccgatagtgtctaattatttctttcttgtctttatgcttttctttattttccttttcttttt

SEQ ID NO: 150657 - DNA, 75 bp, Artificial Sequence
  Synthetic
gatggcaccaatactcatattatggctactgaggcatctaattatgcccagtatcgggttgttcgagctacgatc

SEQ ID NO: 150658 - DNA, 75 bp, Artificial Sequence
  Synthetic
cttttaattcatgatggggaccgtgcagtgattacatacgagggggattctagtgcaggatataatcatgatgtg

SEQ ID NO: 150659 - DNA, 75 bp, Artificial Sequence
  Synthetic
gtcgctgcctggagattggggctcacccaagatctattaatgacaaccccaatgttttgcaccggtgtttcctca

SEQ ID NO: 150660 - DNA, 75 bp, Artificial Sequence
  Synthetic
gttggtgattgagcgagtccgagcggtcgggtgccattttgtgctcctccttacagccgctcccgaaccatcgcc

SEQ ID NO: 150661 - DNA, 75 bp, Artificial Sequence
  Synthetic
ccgtacctactgttttgatggattttcccgctgtgcctttgccgcagagactggtgtggctctttactctctgca

SEQ ID NO: 150662 - DNA, 75 bp, Artificial Sequence
  Synthetic
aagtcaacatttcatgccgtccctgtgcatatatgggataggcttatgctttttggtgcgactcttgacgaccaa

SEQ ID NO: 150663 - DNA, 75 bp, Artificial Sequence
  Synthetic
cccccctgaggtgctgctaccacccggtacctaccatacaacctcgtacctcctgatccatgacggcgaccgtgc

SEQ ID NO: 150664 - DNA, 75 bp, Artificial Sequence
  Synthetic
taatgctctgcatccatggttcccctgttaattcctatactaatacaccttacactggcgcactagggcttcttg

SEQ ID NO: 150665 - DNA, 75 bp, Artificial Sequence
  Synthetic
tcctgatccatgacggcgaccgtgctgttgtgacttatgagggcgatacaagtgcaggctacaaccatgacgtct

SEQ ID NO: 150666 - DNA, 75 bp, Artificial Sequence
  Synthetic
ggtcacggtgggcgccctcgttgccaacgagggttggaatgcttctgaggacgcgctgaccgccgtaatcactgc

SEQ ID NO: 150667 - DNA, 75 bp, Artificial Sequence
  Synthetic
cagcccgccaccggctgcgccgcggtgctgatgggactgctgagcttaccaccacagcagccacacgtttcatga

SEQ ID NO: 150668 - DNA, 75 bp, Artificial Sequence
  Synthetic
agtccgggcgtgactatatccccggccgccaactgcagttttatgctcagtgccgccggtggttatctgctggtt

SEQ ID NO: 150669 - DNA, 75 bp, Artificial Sequence
  Synthetic
ttgttcccatcagcctgctctacaaaatctactttccatgctgtccctgttcacatctgggaccggctcatgctt

SEQ ID NO: 150670 - DNA, 75 bp, Artificial Sequence
  Synthetic
ggcgccggcatatataaggtgcctgttgggcttagttttgatgcctgggagcgcaaccatcggcccggggatgag

SEQ ID NO: 150671 - DNA, 75 bp, Artificial Sequence
  Synthetic
tcggtgaacaaggttatgacaatgaagcgtttgaggggtcggatgttgaccctgctgaggaagctaccgtgagca

SEQ ID NO: 150672 - DNA, 75 bp, Artificial Sequence
  Synthetic
gacctactccgtcacctgccccctcccgccctttctcagttctccgtgccaatgatgttttgtggctttccctca

SEQ ID NO: 150673 - DNA, 75 bp, Artificial Sequence
  Synthetic
ctgccgctgagtatgatcagaccacgtatgggtcgtccaccaaccctatgtatgtctctgatacagttacgcttg

SEQ ID NO: 150674 - DNA, 75 bp, Artificial Sequence
  Synthetic
gcgcttggcataccatctgatcttgctgcacgtgccagtcggcttgccgctaccgttgaagtctcagatgccgag

SEQ ID NO: 150675 - DNA, 75 bp, Artificial Sequence
  Synthetic
ttactaccattcagcagtattctaagacattttatgttctcccgctccgcgggaagctgtccttttgggaggctg

SEQ ID NO: 150676 - DNA, 75 bp, Artificial Sequence
  Synthetic
gggaagctgtccttttgggaggctggtacgactaaggccggctatccgtataattataatactactgctagtgac

SEQ ID NO: 150677 - DNA, 75 bp, Artificial Sequence
  Synthetic
tttgacgagtcagtgccttgccgctgtaggactttcttaaagaaggtcgcgggtaaattctgttgtttcatgcgg

SEQ ID NO: 150678 - DNA, 75 bp, Artificial Sequence
  Synthetic
gcttatgagggctctgaggtcgaccaggccgaacctgcacatctcgatgtgtcggggacctatgctgtccacggg

SEQ ID NO: 150679 - DNA, 75 bp, Artificial Sequence
  Synthetic
gtcggggacctatgctgtccacgggcaccaactcgaggccctctacagggcactcaacattccgcatgacattgc

SEQ ID NO: 150680 - DNA, 75 bp, Artificial Sequence
  Synthetic
agctctctataggtttaaccgctgtatccagcggcattcccttattggaggtttgtggtactatcctgagagctt

SEQ ID NO: 150681 - DNA, 75 bp, Artificial Sequence
  Synthetic
gtcttaattaattccttctgtgcccccttcatggtcctcttttgctttatttcttatttctgccttccgcgcccc

SEQ ID NO: 150682 - DNA, 75 bp, Artificial Sequence
  Synthetic
tcgagccttgcgccccggagttgccaccttcgggtcacattgacatgtctgtagttactgataccccgccattgg

SEQ ID NO: 150683 - DNA, 75 bp, Artificial Sequence
  Synthetic
atgggagccgggtcgcatagccttacctatgagctcacgcctgctggcttgcaggttaggatttcatctaatggc

SEQ ID NO: 150684 - DNA, 75 bp, Artificial Sequence
  Synthetic
tggccccgggcctcgggaccctccctgatgtcgttaggtttgctgggcggctctcagagaaaaactgggggccgg

SEQ ID NO: 150685 - DNA, 75 bp, Artificial Sequence
  Synthetic
accttcgggtcacattgacatgtctgtagttactgataccccgccattggtctcccctgtgcaggttcagcccca

SEQ ID NO: 150686 - DNA, 75 bp, Artificial Sequence
  Synthetic
aaaacccgggagtattgatttattctacttgtgccttccttctgtcttttcccttttattttccttttctgcgtt

SEQ ID NO: 150687 - DNA, 75 bp, Artificial Sequence
  Synthetic
ggagcccccggcgcccgtgcagtctgtaacccaacccgggccccgtcgacgactgctccacacttaccccgacgg

SEQ ID NO: 150688 - DNA, 75 bp, Artificial Sequence
  Synthetic
ccccttctgtggggaaggtaccttgtacactcgtacatggtctacatctggcttctctagtgacttctccccacc

SEQ ID NO: 150689 - DNA, 75 bp, Artificial Sequence
  Synthetic
gttaccaccgccctcagaggggtctcgggccgatgcggcgcccgtaccccccgcccctgagcccgttgggttgtc

SEQ ID NO: 150690 - DNA, 75 bp, Artificial Sequence
  Synthetic
cgggccgatgcggcgcccgtaccccccgcccctgagcccgttgggttgtccagccctatcgaacccccccccccc

SEQ ID NO: 150691 - DNA, 75 bp, Artificial Sequence
  Synthetic
taccgggagacgtgctctcgccgtgggacagcagcttaccccctgctcggcgctggtatatacaaggtccctgtt

SEQ ID NO: 150692 - DNA, 75 bp, Artificial Sequence
  Synthetic
agcagtattctaagactttctttgttctgcccctccgtggcaagctctccttctgggaggccggtaccactaagg

SEQ ID NO: 150693 - DNA, 75 bp, Artificial Sequence
  Synthetic
cgctggtatatacaaggtccctgttgggttgagctttgatgcctgggaacgtaaccatcgacctggagacgagct

SEQ ID NO: 150694 - DNA, 75 bp, Artificial Sequence
  Synthetic
tggtttgaggccaaccgacctactctccctgctctgactattactgaggacacggcgcgcacggcgaacctagca

SEQ ID NO: 150695 - DNA, 75 bp, Artificial Sequence
  Synthetic
ttggagctggatgcggccactgaggtcggccgggcgtgcgctggctgtcgtgttgaacccggtgtagtccattat

SEQ ID NO: 150696 - DNA, 75 bp, Artificial Sequence
  Synthetic
gtcgttgcctggagattggggctcacccaagatctattaatgataaccccaatgttttgcaccggtgctttctca

SEQ ID NO: 150697 - DNA, 75 bp, Artificial Sequence
  Synthetic
ccatcattcatgcagtggcccccgattatagggttgagcagaatccgaagaggcttgaggcagcgtaccgagaaa

SEQ ID NO: 150698 - DNA, 75 bp, Artificial Sequence
  Synthetic
ccggtaaatcccggtcaatccagcaaggggatgtagacgtaatagtggtaccaacccgtgagctacgtaattcgt

SEQ ID NO: 150699 - DNA, 75 bp, Artificial Sequence
  Synthetic
ttgatgcctgggagcgcaatcaccgccccggcgatgaactctacctgactgaacctgctgcggcctggtttgaag

SEQ ID NO: 150700 - DNA, 75 bp, Artificial Sequence
  Synthetic
ccccggcgatgaactctacctgactgaacctgctgcggcctggtttgaagttaacaagccaacgcagccggcact

SEQ ID NO: 150701 - DNA, 75 bp, Artificial Sequence
  Synthetic
gccgccggtggttgtctgccggcttccaccttgaccctcgggtacttgtatttgatgaggcggccccttgtcgtt

SEQ ID NO: 150702 - DNA, 75 bp, Artificial Sequence
  Synthetic
ttgtgctggctgcactatccgccccggagtcgtgcattatcagttcaccgccggcgtcccaggctcaggtaagtc

SEQ ID NO: 150703 - DNA, 75 bp, Artificial Sequence
  Synthetic
ccacaggttctgctgcttcatgcggtggcttggtcaggactgtacttgttttctccagcccattgaggggagggt

SEQ ID NO: 150704 - DNA, 75 bp, Artificial Sequence
  Synthetic
gggttttgcggcttttacaccccacacggcggcccgtgttactataggccgccgtgttgtgattgacgaggcccc

SEQ ID NO: 150705 - DNA, 75 bp, Artificial Sequence
  Synthetic
acggcggcccgtgttactataggccgccgtgttgtgattgacgaggccccatctctcccaccgcacttgttgctg

SEQ ID NO: 150706 - DNA, 75 bp, Artificial Sequence
  Synthetic
gattacagttcatgaagcccagggcgcgacatttactgagactacaattatcgccacggcggacgctcgcgggct

SEQ ID NO: 150707 - DNA, 75 bp, Artificial Sequence
  Synthetic
ctggggcttcgccgctgactgctgtggccccggcccccgatactgttcctgttcccgatgtcgattctcgcggcg

SEQ ID NO: 150708 - DNA, 75 bp, Artificial Sequence
  Synthetic
agaattgatttcgtcggctggtggccagctattttactctcgccccgtcgtctcagccaatggcgagccgacagt

SEQ ID NO: 150709 - DNA, 75 bp, Artificial Sequence
  Synthetic
attgtggccctgactcgtcacacggagaagtgcgtggtggttgatgccccggggcttcttcgtgaggtgggtatc

SEQ ID NO: 150710 - DNA, 75 bp, Artificial Sequence
  Synthetic
gctggcctggtccccgcaatccgccctgagctcgcaccaacgagctggtggcatgttacgcaccgctgcccggcc

SEQ ID NO: 150711 - DNA, 75 bp, Artificial Sequence
  Synthetic
tccacctcctcggtgacccaaaccagatccctgccattgattttgagcatgctggcctggtccccgcaatccgcc

SEQ ID NO: 150712 - DNA, 75 bp, Artificial Sequence
  Synthetic
cctaccctaaaatccaaaccacgagtcgtgtgctacggtctctgttttggaatgagccggctattggccagaagt

SEQ ID NO: 150713 - DNA, 75 bp, Artificial Sequence
  Synthetic
cgcttgatgcatttcccccttcttgtcagtttagcgcgtaccatcaactggccgaagagcttggccaccggcccg

SEQ ID NO: 150714 - DNA, 75 bp, Artificial Sequence
  Synthetic
tcgtgtgctacggtctctgttttggaatgagccggctattggccagaagttggtcttcacacaggctgctaaagc

SEQ ID NO: 150715 - DNA, 75 bp, Artificial Sequence
  Synthetic
cgccgattgctgctgtcttgcccccctgcccagagcttgaacagggtttactttatatgcctcaggagctaacta

SEQ ID NO: 150716 - DNA, 75 bp, Artificial Sequence
  Synthetic
ctttatatgcctcaggagctaactacatcggacagtgttctcacctttgaactaacggacattgtgcactgccgt

SEQ ID NO: 150717 - DNA, 75 bp, Artificial Sequence
  Synthetic
catcggacagtgttctcacctttgaactaacggacattgtgcactgccgtatggcggcacctagccagcgtaagg

SEQ ID NO: 150718 - DNA, 75 bp, Artificial Sequence
  Synthetic
gaggctgcccatacagatgtccgcgggtccctgaatcactttattcctgagcttggccctataaacgtcaccacc

SEQ ID NO: 150719 - DNA, 75 bp, Artificial Sequence
  Synthetic
tggagaggtaggccaccaccgcccctctgtgataccccgtggcaaccctgatcagaatcttgagaccctgcaggc

SEQ ID NO: 150720 - DNA, 75 bp, Artificial Sequence
  Synthetic
gcttttctagttgcttctcaccacttgaaccctgtgccccgagcgagttgccccccgtcgaggctagtaaacctg

SEQ ID NO: 150721 - DNA, 75 bp, Artificial Sequence
  Synthetic
gctgtcggtgtcctcgcacctcactctgcgctggccgctttagaggacactgttgactatcctgctcgtgctcat

SEQ ID NO: 150722 - DNA, 75 bp, Artificial Sequence
  Synthetic
cttcccgccttcttgtcagatcagtgcttaccaccagttagctgaggaattaggtcatcgtccggcccctgtcgc

SEQ ID NO: 150723 - DNA, 75 bp, Artificial Sequence
  Synthetic
ctgcgctggccgctttagaggacactgttgactatcctgctcgtgctcatacttttgatgatttctgccctgagt

SEQ ID NO: 150724 - DNA, 75 bp, Artificial Sequence
  Synthetic
atagtccattgccgtatggctgccccaagccagcggaaggctgttctctcaacacttgtagggaggtatggtcgt

SEQ ID NO: 150725 - DNA, 75 bp, Artificial Sequence
  Synthetic
gtaaggtttttgagaatgatttttctgagtttgatagtactcaaaataatttttcacttgggcttgagtgtataa

SEQ ID NO: 150726 - DNA, 75 bp, Artificial Sequence
  Synthetic
tgaccccccggcctattattcatgctgttgctcccgactatcgggttgaacataaccctaagcggcttgaggccg

SEQ ID NO: 150727 - DNA, 75 bp, Artificial Sequence
  Synthetic
cacccccgctcaataaatgataatcctaatgtggtccaccgctgcttcctccgccctgccgggcgtgatgttcag

SEQ ID NO: 150728 - DNA, 75 bp, Artificial Sequence
  Synthetic
ctggtgctcagggggtatctcgctctctggactggtctaaagtcacccttgatgggcgcccacttatgactatcc

SEQ ID NO: 150729 - DNA, 75 bp, Artificial Sequence
  Synthetic
ggaatatggcggttatagcgcactgctatgagttccgtgaccttaaagttgcggcatttaaaggggatgattctg

SEQ ID NO: 150730 - DNA, 75 bp, Artificial Sequence
  Synthetic
ctggaagaagcactctggtgaacctggcaccctgctgtggaataccgtctggaatatggcggttatagcgcactg

SEQ ID NO: 150731 - DNA, 75 bp, Artificial Sequence
  Synthetic
ctgtacctgactgagccagccatagcttggtttgaggctaatcggcctaccctccctgccttgactataactgag

SEQ ID NO: 150732 - DNA, 75 bp, Artificial Sequence
  Synthetic
tatcttttacggcgacgcctatgaggagtcggtgtttgctgcggccgtgtctggggcggggtcttgcatggtatt

SEQ ID NO: 150733 - DNA, 75 bp, Artificial Sequence
  Synthetic
ctctggtaagtccaggtcgattcaacagggggatgtagatgtgatagtggtgccaacccgtgagctgcgtaattc

SEQ ID NO: 150734 - DNA, 75 bp, Artificial Sequence
  Synthetic
gtcccttagaggtttctggaagaagcactccggcgagcccggcaccctactctggaacactgtttggaacatggc

SEQ ID NO: 150735 - DNA, 75 bp, Artificial Sequence
  Synthetic
agggtgatgattcggtggtcctttgtagtgattaccgacagagtcgcaatgcggcagccttaattgcaggctgtg

SEQ ID NO: 150736 - DNA, 75 bp, Artificial Sequence
  Synthetic
tataatatatcgggtggaatgaataacatgttcttttgctctttgcatggcgatgccaccatgcgctctcgggct

SEQ ID NO: 150737 - DNA, 75 bp, Artificial Sequence
  Synthetic
tacagatacaatagattcactcagcgccactcgcttaccggcgggttgtggctgcatcccgaggggcttttgggc

SEQ ID NO: 150738 - DNA, 75 bp, Artificial Sequence
  Synthetic
tgcctgatgtggtgcgatttgccggacggctgtctgaaaagaactggggccccggcccagagcgtgctgagcagt

SEQ ID NO: 150739 - DNA, 75 bp, Artificial Sequence
  Synthetic
gaacagtattgccgggcccgggctggtcgctgcctggagattggggctcacccaagatctattaatgacaacccc

SEQ ID NO: 150740 - DNA, 75 bp, Artificial Sequence
  Synthetic
cgcccgtcgtcgatctgccccagccggggcttcgccgctgacggctgtggctccggcccctgatactgccccggt

SEQ ID NO: 150741 - DNA, 75 bp, Artificial Sequence
  Synthetic
tcctgatccatgatggtgaccgtgccgttgtgacctatgagggtgatactagtgcaggttacaatcatgacgttt

SEQ ID NO: 150742 - DNA, 75 bp, Artificial Sequence
  Synthetic
ccagcgggttatacataatgagcttgagcagtattgccgagcccgcgctggccgctgtctagaggtgggcgccca

SEQ ID NO: 150743 - DNA, 75 bp, Artificial Sequence
  Synthetic
gccgctgtctagaggtgggcgcccatccaagatccatcaatgataaccctaatgtcctacaccggtgctttctcc

SEQ ID NO: 150744 - DNA, 75 bp, Artificial Sequence
  Synthetic
aatttttggttccatcctgaggggctccttggcccctttgccccgttttcgcccgggcatgtttgggagtcggct

SEQ ID NO: 150745 - DNA, 75 bp, Artificial Sequence
  Synthetic
aggtacggccgtcgtaccaaattgtacgaggccgcacacgcagatgttcgtgggtccttgaatcactttattcct

SEQ ID NO: 150746 - DNA, 75 bp, Artificial Sequence
  Synthetic
gcccgggcatgtttgggagtcggctaatccattttgtggcgagagcacactttacacccgcacttggtcggaggt

SEQ ID NO: 150747 - DNA, 75 bp, Artificial Sequence
  Synthetic
acagcccctgtacctgatgttgattcacgtggcgctatcttgcgccggcagtataatctgtctacgtccccgctc

SEQ ID NO: 150748 - DNA, 75 bp, Artificial Sequence
  Synthetic
ggctccgcagttctggagcttgatctgtgcagccgtgatgtgtctcggataacattcttccagaaggattgtaat

SEQ ID NO: 150749 - DNA, 75 bp, Artificial Sequence
  Synthetic
ggcaccaacacccatattatggctactgaggcgtctaattatgcccagtaccgggtggtccgagccacaattcgc

SEQ ID NO: 150750 - DNA, 75 bp, Artificial Sequence
  Synthetic
ttattcgagcagtgcgcgccacaaactgcgccgaggggccgacggcactgctgagctaactactactgctgctac

SEQ ID NO: 150751 - DNA, 75 bp, Artificial Sequence
  Synthetic
ctgcgccgaggggccgacggcactgctgagctaactactactgctgctacacggtttatgaaggatcttcatttt

SEQ ID NO: 150752 - DNA, 75 bp, Artificial Sequence
  Synthetic
cctacttccgttgacatgaactcaattacttctactgatgttaggatcctggtccagcccggtatcgcctccgag

SEQ ID NO: 150753 - DNA, 75 bp, Artificial Sequence
  Synthetic
gaggaggctacttctggcctggtaatgctttgcattcatggctcccctgttaattcttatactaacacaccctat

SEQ ID NO: 150754 - DNA, 75 bp, Artificial Sequence
  Synthetic
actggtgcactggggctccttgattttgcattagagcttgaatttaggaatttgacacccgggaacaccaacacc

SEQ ID NO: 150755 - DNA, 75 bp, Artificial Sequence
  Synthetic
ttggaacatggctgtcatagcacactgttatgagttccgcgacctcaaagtcgcagcatttaaaggagatgactc

SEQ ID NO: 150756 - DNA, 75 bp, Artificial Sequence
  Synthetic
tttgatgagtcagtgccctgccgctgtaggactttcttaaagaaggtcgcgggtaaattctgttgcttcatgcgg

SEQ ID NO: 150757 - DNA, 75 bp, Artificial Sequence
  Synthetic
gtaggactttcttaaagaaggtcgcgggtaaattctgttgcttcatgcggtggctagggcaggagtgtacctgct

SEQ ID NO: 150758 - DNA, 75 bp, Artificial Sequence
  Synthetic
ctatctccgcgggattagctataaagtgactgttggcgcactcgtcgccaacgaaggctggaatgcctcggagga

SEQ ID NO: 150759 - DNA, 75 bp, Artificial Sequence
  Synthetic
actgcagccacgcgttttatgaaggacttgcatttcactggcacgaacggagttggtgaggttggccgaggcatt

SEQ ID NO: 150760 - DNA, 75 bp, Artificial Sequence
  Synthetic
aggctgagcccgcacatcttgatgtgtctgggacttatgccgtccacgggcgccagcttgaggccctctacagag

SEQ ID NO: 150761 - DNA, 75 bp, Artificial Sequence
  Synthetic
gtctgggacttatgccgtccacgggcgccagcttgaggccctctacagagcacttaacatcccgcaagacattgc

SEQ ID NO: 150762 - DNA, 75 bp, Artificial Sequence
  Synthetic
cgggaataagaccttccggacgacgatcgttgatggtgcccaccttgaggcgaacggccctgagcagtatgttct

SEQ ID NO: 150763 - DNA, 75 bp, Artificial Sequence
  Synthetic
tgggtcatccaccaaccctatgtatgtctcggatacagtcacatttgttaacgtggccactggtgctcaggctgt

SEQ ID NO: 150764 - DNA, 75 bp, Artificial Sequence
  Synthetic
gtctcggatacagtcacatttgttaacgtggccactggtgctcaggctgtttctcgctctcttgattggtctaaa

SEQ ID NO: 150765 - DNA, 75 bp, Artificial Sequence
  Synthetic
ttttgatgatttctgccctgagtgccgtgcgcttggtcttcagggttgtgcttttcagtcaactgttgctgagtt

SEQ ID NO: 150766 - DNA, 75 bp, Artificial Sequence
  Synthetic
actgtagaacttgccgccagcccaggccgactcgagtgccgtacggtgcttgggaataagacttttcgtacatca

SEQ ID NO: 150767 - DNA, 75 bp, Artificial Sequence
  Synthetic
ctaccatccagcagtattctaagacattctatgtcctcccgctccgtggcaagctgtctttctgggaggctggca

SEQ ID NO: 150768 - DNA, 75 bp, Artificial Sequence
  Synthetic
aaaacccgggagtattgatttattccgcttgtaccttccttctgtcttttccttttattttcctcttctgcgttt

SEQ ID NO: 150769 - DNA, 75 bp, Artificial Sequence
  Synthetic
cgaccaaggctggttacccctataattacaatacgactgctagtgaccaaattttaattgagaacgcagccggcc

SEQ ID NO: 150770 - DNA, 75 bp, Artificial Sequence
  Synthetic
tacactcgtacttggtctacatctggcttctctagtgacttctccccgcctgaggcggccgtccctgtaccggct

SEQ ID NO: 150771 - DNA, 75 bp, Artificial Sequence
  Synthetic
ccccgcattcggcccttgccgttcttgaggacactgctgactaccccgcccgtgcccatactttcgatgatttct

SEQ ID NO: 150772 - DNA, 75 bp, Artificial Sequence
  Synthetic
cgtgcccatactttcgatgatttctgcccggaatgccgcacccttggtttgcagggttgcgctttccagtctact

SEQ ID NO: 150773 - DNA, 75 bp, Artificial Sequence
  Synthetic
caggttgatgcggtgcgcgtaccccccatccccgagcccgttgggccacccagccctactgaacttcctcccccc

SEQ ID NO: 150774 - DNA, 75 bp, Artificial Sequence
  Synthetic
tgaaggtaggtaaaacccgggagtcttaattaattcttcctgtaccccttcgcagttttctttcgttttatttct

SEQ ID NO: 150775 - DNA, 75 bp, Artificial Sequence
  Synthetic
cacctaccctgacggcgctaaggtgtacgcggggtcactgttcgagtcagattgtgattggctggtcaatgcctc

SEQ ID NO: 150776 - DNA, 75 bp, Artificial Sequence
  Synthetic
gccaagccttactacatccaggtcccctgcccgtgagccgcccacaccaccaccggctctaaccccggtcagtga

SEQ ID NO: 150777 - DNA, 75 bp, Artificial Sequence
  Synthetic
gaaagggatgaaaagattggagcttgagcatgcacagaagtttataacacgtctttatagctggttgtttgaaaa

SEQ ID NO: 150778 - DNA, 75 bp, Artificial Sequence
  Synthetic
aattagaacagtactgccggtcccgggctggtcgctgtctggaggttggagctcacccgagatctattaatgata

SEQ ID NO: 150779 - DNA, 75 bp, Artificial Sequence
  Synthetic
gctggtcaacgcatctaaccctggtcaccgtcctggtggtggtctctgccatgcgttttaccagcgtttcccgga

SEQ ID NO: 150780 - DNA, 75 bp, Artificial Sequence
  Synthetic
gtggtcccgcggctaactgccgccgttctgcgttgcgaggcctcccccctgttgaccgcacctactgttttgatg

SEQ ID NO: 150781 - DNA, 75 bp, Artificial Sequence
  Synthetic
ttctgcgttgcgaggcctcccccctgttgaccgcacctactgttttgatggattttcccgttgtagctttgctgc

SEQ ID NO: 150782 - DNA, 75 bp, Artificial Sequence
  Synthetic
ccggggttccgggttcaggtaagtcaaggtccatacagcagggggatgttgatgttgtggttgtccccacccggg

SEQ ID NO: 150783 - DNA, 75 bp, Artificial Sequence
  Synthetic
gagcagaaccccaagaggcttgaggcggcatatcgtgagacctgctcccgcctcggcacagctgcttatcctcta

SEQ ID NO: 150784 - DNA, 75 bp, Artificial Sequence
  Synthetic
gatgacacgcctttatgctgcactgcatctccctcctgaggtgctgttaccacctggcacctatcacacgacctc

SEQ ID NO: 150785 - DNA, 75 bp, Artificial Sequence
  Synthetic
cgtgctgttgtgacctatgagggtgatactagtgcaggctataaccatgatgtttctatacttcgtgcgtggatt

SEQ ID NO: 150786 - DNA, 75 bp, Artificial Sequence
  Synthetic
cgcacgactaagatagttggtgaccacccgttggttatagagcgtgtacgggctatcggatgccattttgtgctg

SEQ ID NO: 150787 - DNA, 75 bp, Artificial Sequence
  Synthetic
tggctttcacttactgctgctgagtatgatcaaacgacttatggttcctctaccaaccccatgtatgtttctggc

SEQ ID NO: 150788 - DNA, 75 bp, Artificial Sequence
  Synthetic
ctgagcttgcaccaacgagttggtggcatgttacgcaccgctgtccggccgatgtatgtgagctcatacgtgggg

SEQ ID NO: 150789 - DNA, 75 bp, Artificial Sequence
  Synthetic
tgtactattaaccctgggattgtccactaccagttcaccgccggggtccctggctctgggaagtctagatctata

SEQ ID NO: 150790 - DNA, 75 bp, Artificial Sequence
  Synthetic
tccatattcggccctggcggctccccgtccctgttcccatcagcctgctctacaaaatccacatttcacgctgtc

SEQ ID NO: 150791 - DNA, 75 bp, Artificial Sequence
  Synthetic
tcgtgtgctacggtctctgttctggaatgagccggctattggccaaaagttagtctttacgcaggctgctaaagc

SEQ ID NO: 150792 - DNA, 75 bp, Artificial Sequence
  Synthetic
atgacctaccttcgtggcattagctacaaggtcacagttggtgcgcttgttgctaatgaggggtggaatgcatcc

SEQ ID NO: 150793 - DNA, 75 bp, Artificial Sequence
  Synthetic
tgacgccaggggtttaattcagtcatcccgggcacatgctatagttgcactcacccgccacacagagaagtgcgt

SEQ ID NO: 150794 - DNA, 75 bp, Artificial Sequence
  Synthetic
tattctagatgcccccggtctgctgcgtgaggttggcatatcagatgtgattgttaacaacttcttccttgctgg

SEQ ID NO: 150795 - DNA, 75 bp, Artificial Sequence
  Synthetic
acttttgatgatttctgccctgagtgccgtgcactcggcctacagggttgtgcctttcaatctactgttgctgag

SEQ ID NO: 150796 - DNA, 75 bp, Artificial Sequence
  Synthetic
aggttgagcatgctcagaaatttatcacaagactctacagctggctatttgagaagtctggccgtgactacatcc

SEQ ID NO: 150797 - DNA, 75 bp, Artificial Sequence
  Synthetic
ccaccttgatcctcgtgtgctcgtttttgatgaagctgccccttgccgctgccggagctttctgcgcaaagccgc

SEQ ID NO: 150798 - DNA, 75 bp, Artificial Sequence
  Synthetic
gtaaaacccgggagtattgatttattctgcttgtgcccccttctgctacgcttcctttatttctcatttctgcgt

SEQ ID NO: 150799 - DNA, 75 bp, Artificial Sequence
  Synthetic
tcgtttttgacgagtcagtaccctgtcgatgtaggacgtttctaaagaaagctgcgagcaaattctgttgtttca

SEQ ID NO: 150800 - DNA, 75 bp, Artificial Sequence
  Synthetic
tcgatgtaggacgtttctaaagaaagctgcgagcaaattctgttgtttcatgcggtggttagggcaggagtgcac

SEQ ID NO: 150801 - DNA, 75 bp, Artificial Sequence
  Synthetic
gtatttctgacataattgtcaataactttttcttggctggtggtgaagtgggccaccatcgcccctctaccatac

SEQ ID NO: 150802 - DNA, 75 bp, Artificial Sequence
  Synthetic
tgatccggccgaacctgcacatctagatgtctcggggacctatgctgtccacgggcgccagctcgaggcccttta

SEQ ID NO: 150803 - DNA, 75 bp, Artificial Sequence
  Synthetic
gatgtctcggggacctatgctgtccacgggcgccagctcgaggccctttatagggcgctcaatattccgcatgac

SEQ ID NO: 150804 - DNA, 75 bp, Artificial Sequence
  Synthetic
gtgcttggaaataagactttccgcacgacggtggttgatggcgctcatcttgaggcgaatggccctgagcagtat

SEQ ID NO: 150805 - DNA, 75 bp, Artificial Sequence
  Synthetic
agactctacagttggctatttgagaagtctggccgcgattacatccccggccgccagctccagttctacgcacag

SEQ ID NO: 150806 - DNA, 75 bp, Artificial Sequence
  Synthetic
ggcttgcaggttaatatttcatctaatggcttggactgcacagcaacattcccccccggtggtgcacccagcgcc

SEQ ID NO: 150807 - DNA, 75 bp, Artificial Sequence
  Synthetic
tgtaggacgtttttgaagaaagtcgcgggtaaattctgctgttttatgcggtggttagggcaggagtgcacctgc

SEQ ID NO: 150808 - DNA, 75 bp, Artificial Sequence
  Synthetic
tgaaaatgacttctcagaatttgatagtactcagaataatttctctcttggccttgagtgtgtggttatggaaga

SEQ ID NO: 150809 - DNA, 75 bp, Artificial Sequence
  Synthetic
ggctgttgggcattttcccccctttctcccctgggcatacctgggagtctgctaaccccttttgtggggagggga

SEQ ID NO: 150810 - DNA, 75 bp, Artificial Sequence
  Synthetic
cccagccatcgactttgagcacgctgggctcgtccccgccatcaggcccgacttagcccctacctcctggtggca

SEQ ID NO: 150811 - DNA, 75 bp, Artificial Sequence
  Synthetic
gtgtggtatgcctcagtggttaatcaggttgtatcatctggtccggtcggcctggatcttacaggcgccgaagga

SEQ ID NO: 150812 - DNA, 75 bp, Artificial Sequence
  Synthetic
cggcggctgccccagggccgtctcaccctactccacctgctagtgacatttgggtgctaccaccaccttctgaag

SEQ ID NO: 150813 - DNA, 75 bp, Artificial Sequence
  Synthetic
ccctactccacctgctagtgacatttgggtgctaccaccaccttctgaagacacccggactagcacgacccttgt

SEQ ID NO: 150814 - DNA, 75 bp, Artificial Sequence
  Synthetic
agggtgatgattcggtggttctgtgtagtgattaccgccagagtcgtaatgcggcagccttaattgcaggttgtg

SEQ ID NO: 150815 - DNA, 75 bp, Artificial Sequence
  Synthetic
caaccccggctcagtgacagtccacgaggcgcagggcgctacctacacggagactactattattgccacggcaga

SEQ ID NO: 150816 - DNA, 75 bp, Artificial Sequence
  Synthetic
accgcctcctcgcactcgccgtctcctttacacctaccccgacggtgccaaggtgtatgcggggtcattgtttga

SEQ ID NO: 150817 - DNA, 75 bp, Artificial Sequence
  Synthetic
ttcagtggttctttgcagtgattaccgccagagccgcaatgcggctaccctgatagccggctgtgggttgaaatt

SEQ ID NO: 150818 - DNA, 75 bp, Artificial Sequence
  Synthetic
gcctctaacccaggtcatcgtcctgggggtggtctctgccatgctttttatcagcgcttccccgaggcattttat

SEQ ID NO: 150819 - DNA, 75 bp, Artificial Sequence
  Synthetic
cttttgcggtgagagcacactttatacacgaacttggtccacatctggtttttctagcgacttctccccacccga

SEQ ID NO: 150820 - DNA, 75 bp, Artificial Sequence
  Synthetic
aacttgatgcaaccccggcagcttgtgttccgacctgaagtcctctggaaccacccgatccagcgagtcatacac

SEQ ID NO: 150821 - DNA, 75 bp, Artificial Sequence
  Synthetic
caaagaggcttgaggcagcgtaccgagaaacctgctcccgccgtggcaccgccgcctacccgcttctaggctcgg

SEQ ID NO: 150822 - DNA, 75 bp, Artificial Sequence
  Synthetic
gctttctccgcccggttgggagagacgtccagcgctggtattctgcccccacccgtggtcccgcggccaattgcc

SEQ ID NO: 150823 - DNA, 75 bp, Artificial Sequence
  Synthetic
tgactgagcctgccgtagcttggtttgaggccaataagccgatgcagccggcacttacaataactgaagatacag

SEQ ID NO: 150824 - DNA, 75 bp, Artificial Sequence
  Synthetic
cgcggtcgctccggcccatgacaccccgccagtgcctgatgtcgactcccgcggcgccatcttgcgccggcagta

SEQ ID NO: 150825 - DNA, 75 bp, Artificial Sequence
  Synthetic
gattgacgctgccacagaggtcggccgtgcctgcgccggctgcactgtcagccccggggttgttcattaccagtt

SEQ ID NO: 150826 - DNA, 75 bp, Artificial Sequence
  Synthetic
acagcccctgtacctgatgttgattcacgtggcgctatcctgcgccggcagtacaatttgtccacgtccccgctt

SEQ ID NO: 150827 - DNA, 75 bp, Artificial Sequence
  Synthetic
ctgccccagctggggctgcgccgctgactgctatatcacctgctcctgacacagcccctgtacctgatgttgatt

SEQ ID NO: 150828 - DNA, 75 bp, Artificial Sequence
  Synthetic
cacgtggcgctatcctgcgccggcagtacaatttgtccacgtccccgcttacgtcatctgtcgcctcgggtacta

SEQ ID NO: 150829 - DNA, 75 bp, Artificial Sequence
  Synthetic
ccgggagctccgtaacagctggcgtcgccggggctttgcagcttttacacctcacacggcggcccgtgttactat

SEQ ID NO: 150830 - DNA, 75 bp, Artificial Sequence
  Synthetic
ccgaggcatctaattacgcccagtaccgggtggttcgagctacaatccgctaccgcccgctggtgccaaatgctg

SEQ ID NO: 150831 - DNA, 75 bp, Artificial Sequence
  Synthetic
gtcggttcatctcctcggcgacccgaaccagatccccgccattgattttgaacatgctggcctggtccctgcgat

SEQ ID NO: 150832 - DNA, 75 bp, Artificial Sequence
  Synthetic
ctacagcgccttaaaatgaaggtgggtaaaacccgggagtactgatttattctacttgtaccttccttctgtttt

SEQ ID NO: 150833 - DNA, 75 bp, Artificial Sequence
  Synthetic
ttacctctactgatgtcaggatcttggtccagcccggtattgcctccgagttggtcattcccagtgagcgtcttc

SEQ ID NO: 150834 - DNA, 75 bp, Artificial Sequence
  Synthetic
ttgcctctccaagacggcacgaatactcacattatggcgactgaggcgtctaattacgctcagtatcgggttgtc

SEQ ID NO: 150835 - DNA, 75 bp, Artificial Sequence
  Synthetic
aacatgctggcctggtccctgcgatccgccctgaactcgcgccgacgagctggtggcatgttacacatcgctgcc

SEQ ID NO: 150836 - DNA, 75 bp, Artificial Sequence
  Synthetic
cagactacaactacacccacctctgttgatatgaattctattacttctactgatgttaggattttagtccagcct

SEQ ID NO: 150837 - DNA, 75 bp, Artificial Sequence
  Synthetic
tttggaatgagccggccatcggtcagaagctggttttcacccaggctgctaaggctgctaaccctggtgcgatca

SEQ ID NO: 150838 - DNA, 75 bp, Artificial Sequence
  Synthetic
tcaaggctggcgctctgttgagacatcgggtgtggccgaggaggaggcgacatcaggcttggtcatgctttgtat

SEQ ID NO: 150839 - DNA, 75 bp, Artificial Sequence
  Synthetic
gaagctggttttcacccaggctgctaaggctgctaaccctggtgcgatcacagttcatgaagcccagggagccac

SEQ ID NO: 150840 - DNA, 75 bp, Artificial Sequence
  Synthetic
cgtgtatcccgatataccagcacagcccgccatcggctgcgccgtggtgccgacgggactgctgagcttaccact

SEQ ID NO: 150841 - DNA, 75 bp, Artificial Sequence
  Synthetic
cgggactgccgagctcaccaccacggctgctacccgctttatgaaggacctctattttactagtactaatggtgt

SEQ ID NO: 150842 - DNA, 75 bp, Artificial Sequence
  Synthetic
tgcactcactcgccacacggagaagtgcgtcattttggatgctcccggtttgttgcgcgaggtcggcatatcaga

SEQ ID NO: 150843 - DNA, 75 bp, Artificial Sequence
  Synthetic
tgcgtcattttggatgctcccggtttgttgcgcgaggtcggcatatcagatgtgattgtcaacaattttttcctt

SEQ ID NO: 150844 - DNA, 75 bp, Artificial Sequence
  Synthetic
gccgagcttacaaccactgcagccacacgttttatgaaggacttgcatttcaccgggacaaatggtgttggcgag

SEQ ID NO: 150845 - DNA, 75 bp, Artificial Sequence
  Synthetic
cgacgggactgctgagcttaccactacggcggccacgcgttttatgaaggacctgcattttactggcacgaacgg

SEQ ID NO: 150846 - DNA, 75 bp, Artificial Sequence
  Synthetic
cacgatatgtcaccatctgacgtcgccgaggccatgtcccgccatggtatgacgcggctttatgccgccctccat

SEQ ID NO: 150847 - DNA, 75 bp, Artificial Sequence
  Synthetic
tatgccacaggagcttactgtgtccgatagtgtgttggtttttgagctcacggatatagttcattgtcgtatggc

SEQ ID NO: 150848 - DNA, 75 bp, Artificial Sequence
  Synthetic
tctgactctgtgaccttggttaatgttgcgaccggcgcgcaggccgttgcccggtcgctcgattggaccaaggtc

SEQ ID NO: 150849 - DNA, 75 bp, Artificial Sequence
  Synthetic
ggctcattcagatgtccgtgaatctctagccaggttcatccccactattggacctgtccaggccaccacatgtga

SEQ ID NO: 150850 - DNA, 75 bp, Artificial Sequence
  Synthetic
acctcgaagccaacggccccgagcagtacgtcttgacattcgacgattctcgccaggcaatgggggctgggcctc

SEQ ID NO: 150851 - DNA, 75 bp, Artificial Sequence
  Synthetic
ttataatacaactgctagtgaccaaattttgattgagaatgcagctggccaccgtgttgctatctccacctacac

SEQ ID NO: 150852 - DNA, 75 bp, Artificial Sequence
  Synthetic
gggagcatgcccagaagtttataacacgtctctacagctggctcttcgagaagtccggccgtgattacatccccg

SEQ ID NO: 150853 - DNA, 75 bp, Artificial Sequence
  Synthetic
atgaggaatcagtgtttgccgccgctgtgtccggggcggggtcttgtatggtgtttgaaaatgacttctccgagt

SEQ ID NO: 150854 - DNA, 75 bp, Artificial Sequence
  Synthetic
ttgacagtacccaaaataacttttccctcggccttgaatgtgtcattatggaggagtgtggcatgcctcagtggt

SEQ ID NO: 150855 - DNA, 75 bp, Artificial Sequence
  Synthetic
ttcagcgtcttagaatgaaggtaggtaagacccgggagtcttaattaattccccttttgtgcccccttctaaacc

SEQ ID NO: 150856 - DNA, 75 bp, Artificial Sequence
  Synthetic
gccccagctcctgacatggcactgccctcgggcgccccctcgtcagctggtgatgtctgggcattcccaccgccc

SEQ ID NO: 150857 - DNA, 75 bp, Artificial Sequence
  Synthetic
agaaacattctggtgagcctggtacccttctttggaatactgtctggaacatggcgattatagcacattgctatg

SEQ ID NO: 150858 - DNA, 75 bp, Artificial Sequence
  Synthetic
tttctgtacccccttcgcagtttccttttgctttatttctcttttctgctttccgcgctccctggaaaaaaaaaa

SEQ ID NO: 150859 - DNA, 75 bp, Artificial Sequence
  Synthetic
ctgaggtgctttggaatcatcctatccagagggttatacataatgaattagaacagtactgccgggcccgggccg

SEQ ID NO: 150860 - DNA, 75 bp, Artificial Sequence
  Synthetic
ccttctttggaatactgtctggaacatggcgattatagcacattgctatgagttccgtgattttcgggttgctgc

SEQ ID NO: 150861 - DNA, 75 bp, Artificial Sequence
  Synthetic
cctcgggcgccccctcgtcagctggtgatgtctgggcattcccaccgccctccgaggggtctgcagtagttccac

SEQ ID NO: 150862 - DNA, 75 bp, Artificial Sequence
  Synthetic
atgtgggctcaaactgaaggttgattaccgccctattgggctgtatgctggtgtggtggtggctcccggtttggg

SEQ ID NO: 150863 - DNA, 75 bp, Artificial Sequence
  Synthetic
ggggccaaggtgtatgcgggctctttgtttgagtcagactgtgactggctggttaatgcatctaaccctggccac

SEQ ID NO: 150864 - DNA, 75 bp, Artificial Sequence
  Synthetic
taccgccctattgggctgtatgctggtgtggtggtggctcccggtttggggacactacctgatgtggtgcgtttt

SEQ ID NO: 150865 - DNA, 75 bp, Artificial Sequence
  Synthetic
gttccacccgactgactttgttatgcgtgaaggcctcgccgcatacactttgagcccgcgtcctatcattcatgc

SEQ ID NO: 150866 - DNA, 75 bp, Artificial Sequence
  Synthetic
ttccttcgaaggttgacgaatgttgcgcaggtctgtgttgatgttgtgtctcgtgtctacggggttagtcccggg

SEQ ID NO: 150867 - DNA, 75 bp, Artificial Sequence
  Synthetic
ctgaagtactttggaaccatcccatccaacgtgtcatacataatgaactagagcagtactgccgggctcgggctg

SEQ ID NO: 150868 - DNA, 75 bp, Artificial Sequence
  Synthetic
ccaacgtgtcatacataatgaactagagcagtactgccgggctcgggctggccgttgtttggaagttggagccca

SEQ ID NO: 150869 - DNA, 75 bp, Artificial Sequence
  Synthetic
ctggtattccgcccccacccgcggtcctgcggcaaactgccgccgatccgcgttgcgtggccttccccctgtcga

SEQ ID NO: 150870 - DNA, 75 bp, Artificial Sequence
  Synthetic
ctcgacagccggcccgccccctcggctcctcttggcgtgaccagtcccagcgcccccccgctgccccccgtcgtc

SEQ ID NO: 150871 - DNA, 75 bp, Artificial Sequence
  Synthetic
tgatctctggccagctgatgtcgcggaggccatggcccgacatgggatgacacgcttatacgctgcactacacct

SEQ ID NO: 150872 - DNA, 75 bp, Artificial Sequence
  Synthetic
gaggccatggcccgacatgggatgacacgcttatacgctgcactacacctcccccctgaggtactgctaccacct

SEQ ID NO: 150873 - DNA, 75 bp, Artificial Sequence
  Synthetic
ccagtataatttgtccacctctcctttaacttcatctgttgcttctggaactaatcttgtcttgtatgctgcccc

SEQ ID NO: 150874 - DNA, 75 bp, Artificial Sequence
  Synthetic
gacggcacgaatactcacatcatggcgactgaggcgtctaattacgctcagtatcgggttgttcgggctacgatc

SEQ ID NO: 150875 - DNA, 75 bp, Artificial Sequence
  Synthetic
ccgctgaacccccttttacctcttcaggatggcaccaacactcacattatggctactgaggcatctaattacgcc

SEQ ID NO: 150876 - DNA, 75 bp, Artificial Sequence
  Synthetic
cactagttggtggcacgtcacccatcgctgccccgctgatgtttgtgagctcatacgcggggcttacccaaagat

SEQ ID NO: 150877 - DNA, 75 bp, Artificial Sequence
  Synthetic
atgccttatgtcccgtacccccggtcgacagaggtgtatgtccgctctatatttggtcccggcggatccccatcc

SEQ ID NO: 150878 - DNA, 75 bp, Artificial Sequence
  Synthetic
atcttggtccagcctggtatcgcctctgagttggtcatccctagcgagcgcctccattatcgtaatcaaggctgg

SEQ ID NO: 150879 - DNA, 75 bp, Artificial Sequence
  Synthetic
ttcggcgctaccctggatgaccaggcgttctgctgctcacggcttatgacctacctccgtgggattagctacaag

SEQ ID NO: 150880 - DNA, 75 bp, Artificial Sequence
  Synthetic
cgttctgctgctcacggcttatgacctacctccgtgggattagctacaaggttaccgtcggcgcccttgtagcca

SEQ ID NO: 150881 - DNA, 75 bp, Artificial Sequence
  Synthetic
cgctctgttgagaccacgggtgtggccgaggaggaggctacttccggtctggtgatgctttgcattcacggctct

SEQ ID NO: 150882 - DNA, 75 bp, Artificial Sequence
  Synthetic
gcaattaccgttcacgaggcccagggcgccacattcacggagactaccatcatagccacggctgatgccaggggt

SEQ ID NO: 150883 - DNA, 75 bp, Artificial Sequence
  Synthetic
ggtgatgctttgcattcacggctctcctgttaattcttatactaatacaccttatactggtgcactggggcttct

SEQ ID NO: 150884 - DNA, 75 bp, Artificial Sequence
  Synthetic
gctacctccgtacacaagcaatatctaagggtatgcgtcggttggaggttgaacatgctcagaaatttattacaa

SEQ ID NO: 150885 - DNA, 75 bp, Artificial Sequence
  Synthetic
taagggtatgcgtcggttggaggttgaacatgctcagaaatttattacaagactttacagttggttatttgagaa

SEQ ID NO: 150886 - DNA, 75 bp, Artificial Sequence
  Synthetic
gccgctagagtcacccaggggcgccgggttgttattgatgaggctccgtcactccctcctcacctgctgctgctc

SEQ ID NO: 150887 - DNA, 75 bp, Artificial Sequence
  Synthetic
ccatcttgatccgagggtgcttgtctttgatgagtcggtgccctgccgttgtaggacgttccttaagaaggttgc

SEQ ID NO: 150888 - DNA, 75 bp, Artificial Sequence
  Synthetic
tttgatgagtcggtgccctgccgttgtaggacgttccttaagaaggttgcgggcaaattctgttgctttatgaag

SEQ ID NO: 150889 - DNA, 75 bp, Artificial Sequence
  Synthetic
agctgatacgcttcttggcggtctgccgacagaactgatttcgtcggccgggggtcaattgttttactcccgccc

SEQ ID NO: 150890 - DNA, 75 bp, Artificial Sequence
  Synthetic
ggggtcaattgttttactcccgccctgtcgtctcggccaatggcgagccgactgtaaagctctatacatctgttg

SEQ ID NO: 150891 - DNA, 75 bp, Artificial Sequence
  Synthetic
gcctatgagggctcagaggttgatcaggccgaactcgctcacatcgacgtttcggggacctatgctgttcatggg

SEQ ID NO: 150892 - DNA, 75 bp, Artificial Sequence
  Synthetic
aggccgaactcgctcacatcgacgtttcggggacctatgctgttcatgggcgccagcttgaagccctgtataggg

SEQ ID NO: 150893 - DNA, 75 bp, Artificial Sequence
  Synthetic
attgagcaggctgctctggctgcggccaattccgccttggcgaatgctgtggtggttcggccgtttttatctcgt

SEQ ID NO: 150894 - DNA, 75 bp, Artificial Sequence
  Synthetic
ggctatggttgagaagggccaggacggttccgccgtgctcgaacttgacctctgcagccgtgatgtctcgcgtat

SEQ ID NO: 150895 - DNA, 75 bp, Artificial Sequence
  Synthetic
tatgtttcagatactgtcacatttgttaatgtggcgacgggtgcccaggccgttgcccgatcccttgattggtcc

SEQ ID NO: 150896 - DNA, 75 bp, Artificial Sequence
  Synthetic
ggttccgccgtgctcgaacttgacctctgcagccgtgatgtctcgcgtattacattctttcagaaagattgtaat

SEQ ID NO: 150897 - DNA, 75 bp, Artificial Sequence
  Synthetic
atcgcctagagtgccgcactgtattggggaacaagaccttcaggacaacggtggtcgacggcgcccatcttgaag

SEQ ID NO: 150898 - DNA, 75 bp, Artificial Sequence
  Synthetic
ggggaacaagaccttcaggacaacggtggtcgacggcgcccatcttgaagcaaatggccccgagcagtatgtcct

SEQ ID NO: 150899 - DNA, 75 bp, Artificial Sequence
  Synthetic
cgcgccacactgagaagtgcgtcatcattgacgcaccgggcctgcttcgcgaggtgggcatctccgatgcaatcg

SEQ ID NO: 150900 - DNA, 75 bp, Artificial Sequence
  Synthetic
tcactaccatccagcagtactccaagacattttatgtactgccgcttcgtggcaagctttccttttgggaagctg

SEQ ID NO: 150901 - DNA, 75 bp, Artificial Sequence
  Synthetic
tgtatgtttcagatacagtcacacttgttaacgtggctactggtgcccaggcagtcgcccgttctcttgattggt

SEQ ID NO: 150902 - DNA, 75 bp, Artificial Sequence
  Synthetic
tgttaacgtggctactggtgcccaggcagtcgcccgttctcttgattggtctaaagtcaccctggacggccgccc

SEQ ID NO: 150903 - DNA, 75 bp, Artificial Sequence
  Synthetic
gcaggtgaaaatctcgtccaacggcctagactgcactgcgacgttccccccaggcggcgcccctagcgccgcacc

SEQ ID NO: 150904 - DNA, 75 bp, Artificial Sequence
  Synthetic
ctagactgcactgcgacgttccccccaggcggcgcccctagcgccgcaccaggtgaggtagccgccttttgcagt

SEQ ID NO: 150905 - DNA, 75 bp, Artificial Sequence
  Synthetic
tggcactaccaaggcaggttacccctataattataatacaactgctagtgaccaaattctgattgagaatgcggc

SEQ ID NO: 150906 - DNA, 75 bp, Artificial Sequence
  Synthetic
gaacagggcctcctctacctgccccaggaactcaccacctgtgatagcgttgtaacatttgaattaacagatatt

SEQ ID NO: 150907 - DNA, 75 bp, Artificial Sequence
  Synthetic
tagttagatcagcctggaccctgcaagccccgaaagagtctctgaaaggtttttggaagaagcattccggcgaac

SEQ ID NO: 150908 - DNA, 75 bp, Artificial Sequence
  Synthetic
tgtaacatttgaattaacagatattgtgcactgccgcatggccgccccgagccagcgcaaggccgtgctgtccac

SEQ ID NO: 150909 - DNA, 75 bp, Artificial Sequence
  Synthetic
tatgacacgcctatatgccgcactgcatcttcctccagaggtactgctaccacccggcacctaccatacgacctc

SEQ ID NO: 150910 - DNA, 75 bp, Artificial Sequence
  Synthetic
ttgggtatctttccccctttctcccccggccatctctgggagtctgccaaccccttctgcggggaggggactttg

SEQ ID NO: 150911 - DNA, 75 bp, Artificial Sequence
  Synthetic
gttagccccacactcggcccttgccgtccttgaggacactattgactatcctgcccgtgcccacactttcgatga

SEQ ID NO: 150912 - DNA, 75 bp, Artificial Sequence
  Synthetic
agccccgaaagagtctctgaaaggtttttggaagaagcattccggcgaacccggcactctcctttggaacaccgt

SEQ ID NO: 150913 - DNA, 75 bp, Artificial Sequence
  Synthetic
ccggccatctctgggagtctgccaaccccttctgcggggaggggactttgtatacccggacttggtctacatcag

SEQ ID NO: 150914 - DNA, 75 bp, Artificial Sequence
  Synthetic
cgccccctgttagtgatatttgggtactgccgccaccctctgaagagccccagattgatgtggagcctgctccct

SEQ ID NO: 150915 - DNA, 75 bp, Artificial Sequence
  Synthetic
agtggttctttgcagcgactaccgccagagccgcaatgcagccaccctgattgccggttgtgggttgaaattgaa

SEQ ID NO: 150916 - DNA, 75 bp, Artificial Sequence
  Synthetic
actgccgccaccctctgaagagccccagattgatgtggagcctgctccctctgcccctgagtttgttcaaccgcc

SEQ ID NO: 150917 - DNA, 75 bp, Artificial Sequence
  Synthetic
ggttgattaccggcctataggtttgtatgccggcgttgtcgtggccccgggcctcggtgcacttcctgatgttgt

SEQ ID NO: 150918 - DNA, 75 bp, Artificial Sequence
  Synthetic
taaaatgaaggtaggtaaaacccgggagtcttaattaattcttcttgtgcccccttcgtagtaatctttgcttta

SEQ ID NO: 150919 - DNA, 75 bp, Artificial Sequence
  Synthetic
gcaggctgctctggctgcggccaattccgccttggcgaatgctgtggtggttcggccgtttttatcccgtgttca

SEQ ID NO: 150920 - DNA, 75 bp, Artificial Sequence
  Synthetic
cacctacccggacggcgccaaggtgtacgcggggtcactgtttgagtcggattgtgactggctggttaatgcgtc

SEQ ID NO: 150921 - DNA, 75 bp, Artificial Sequence
  Synthetic
attgtgactggctggttaatgcgtctaaccctggccaccgccctgggggcgggctttgcctcgctttttaccaac

SEQ ID NO: 150922 - DNA, 75 bp, Artificial Sequence
  Synthetic
ttatagggttgagcagaacccaaagaggctcgaggcggcgtatcgggagacctgctctcgccgtggtactgctgc

SEQ ID NO: 150923 - DNA, 75 bp, Artificial Sequence
  Synthetic
gcccggttggaagagacgtccagcgctggtattctgcccctactcgtggtccagcggccaactgccgccgttctg

SEQ ID NO: 150924 - DNA, 75 bp, Artificial Sequence
  Synthetic
ccagcggccaactgccgccgttctgcgctacgcggcttgccccctgtcgatcgcacatactgcttcgacgggttc

SEQ ID NO: 150925 - DNA, 75 bp, Artificial Sequence
  Synthetic
atatccaagggtatgcgccggttggaggttgagcacgctcagaaatttatcacaagactctacagctggctattt

SEQ ID NO: 150926 - DNA, 75 bp, Artificial Sequence
  Synthetic
ccctggagatgagctctacctgaccgatcccgctgctgcctggttcgaggccaataaaccaacacagccagccct

SEQ ID NO: 150927 - DNA, 75 bp, Artificial Sequence
  Synthetic
gatcccgctgctgcctggttcgaggccaataaaccaacacagccagcccttaccataactgaggatacagcccgc

SEQ ID NO: 150928 - DNA, 75 bp, Artificial Sequence
  Synthetic
acagtgccgacggtggctatctgcaggcttccaccttgaccccagggtgcttgtttttgatgaatcagtgccatg

SEQ ID NO: 150929 - DNA, 75 bp, Artificial Sequence
  Synthetic
gggattgtgcactaccagttcacagccggtgtcccaggatcagggaagtcgaggtctatacagcagggagatgtt

SEQ ID NO: 150930 - DNA, 75 bp, Artificial Sequence
  Synthetic
tgcggtggttggggcaggagtgtacctgctttctggagccagccgagggtttagttggcgaccaaggccatgaca

SEQ ID NO: 150931 - DNA, 75 bp, Artificial Sequence
  Synthetic
ccggcgcctgatacggccccagtccctgatgttgattcccgtggcgctattttgcgccgccagtataacttgtct

SEQ ID NO: 150932 - DNA, 75 bp, Artificial Sequence
  Synthetic
agtgcgggctataaccacgatgtgtctatactccgtgcatggatccgcactaccaaaatagttggtgatcaccca

SEQ ID NO: 150933 - DNA, 75 bp, Artificial Sequence
  Synthetic
ccggtgtcccaggatcagggaagtcgaggtctatacagcagggagatgttgatgtggtagttgtccccacccggg

SEQ ID NO: 150934 - DNA, 75 bp, Artificial Sequence
  Synthetic
acgggcaccagcttgaggccctttatagggcgctcaatgtcccacaagatattgccgctcgagcttcccgactaa

SEQ ID NO: 150935 - DNA, 75 bp, Artificial Sequence
  Synthetic
cccctccaagacggcaccaatactcacatcatggcgactgaggcgtctaattacgctcagtatcgggttgttcgg

SEQ ID NO: 150936 - DNA, 75 bp, Artificial Sequence
  Synthetic
gccgcgttgtcattgatgaggccccgtccctcccgccacatctgttgctgctccacatgcagcgggcctcgtcgg

SEQ ID NO: 150937 - DNA, 75 bp, Artificial Sequence
  Synthetic
atttggccctggtgggtcgccttctcttttcccatcagcctgctctaccaaatctacattccatgctgttccggt

SEQ ID NO: 150938 - DNA, 75 bp, Artificial Sequence
  Synthetic
gtccctcccgccacatctgttgctgctccacatgcagcgggcctcgtcggtccatcttcttggcgatccaaatca

SEQ ID NO: 150939 - DNA, 75 bp, Artificial Sequence
  Synthetic
aatttctatttctttctggcctcagactacaaccacgcccacctctgttgatatgaattccattacctccactga

SEQ ID NO: 150940 - DNA, 75 bp, Artificial Sequence
  Synthetic
gcatgtcacgcaccgttgccctgctgatgtgtgcgaactcatacgcggggcttaccctaagatccagaccacgag

SEQ ID NO: 150941 - DNA, 75 bp, Artificial Sequence
  Synthetic
ccttctgctgctcgcggcttatgacttatctccgcgggatcagctataaagtgaccgttggtgcacttgtcgcca

SEQ ID NO: 150942 - DNA, 75 bp, Artificial Sequence
  Synthetic
gatgtgtgcgaactcatacgcggggcttaccctaagatccagaccacgagccgtgtattgcggtccctattttgg

SEQ ID NO: 150943 - DNA, 75 bp, Artificial Sequence
  Synthetic
gtgagcgtcttcactaccgtaatcaaggttggcgttcagttgagacatcgggtgtggccgaggaggaggcgacat

SEQ ID NO: 150944 - DNA, 75 bp, Artificial Sequence
  Synthetic
atgagggctggaatgcctcggaggatgcacttacagctgtgatcactgcagcgtacttgactatttgccaccagc

SEQ ID NO: 150945 - DNA, 75 bp, Artificial Sequence
  Synthetic
catgaagcccaaggtgccactttcacggagaccacgattatagctacggctgacgccaggggccttatccagtca

SEQ ID NO: 150946 - DNA, 75 bp, Artificial Sequence
  Synthetic
cggagaccacgattatagctacggctgacgccaggggccttatccagtcatccagggcctatgctatagtcgcac

SEQ ID NO: 150947 - DNA, 75 bp, Artificial Sequence
  Synthetic
gcgccgggggaggtggccgccttttgcagtgccctttatagatataacaggttcacccagcggcactcgctgact

SEQ ID NO: 150948 - DNA, 75 bp, Artificial Sequence
  Synthetic
cgccagctccagttttatgcgcagtgtcgccgttggctctcggctggcttccatctggaccctagggtcctcgtt

SEQ ID NO: 150949 - DNA, 75 bp, Artificial Sequence
  Synthetic
gctaacccttcttgtggggaggggactttgtatactcggacctggtcaacatctggtttttctagtgacttctcc

SEQ ID NO: 150950 - DNA, 75 bp, Artificial Sequence
  Synthetic
ttgttaataacttcttccttgctggcggagaagtgggccaccaccgcccctctgtgataccccgcggcagccctg

SEQ ID NO: 150951 - DNA, 75 bp, Artificial Sequence
  Synthetic
ccgacgtccgtcgatatgaattcaataacttcgacggatgttcgtattttagtccagcccggcatagcctctgag

SEQ ID NO: 150952 - DNA, 75 bp, Artificial Sequence
  Synthetic
ctttgtatactcggacctggtcaacatctggtttttctagtgacttctccccccctgaggcagccgctcctgctc

SEQ ID NO: 150953 - DNA, 75 bp, Artificial Sequence
  Synthetic
cggaaaattttgttgttttatgaaatggttggggcaggagtgcacctgctttctggagccagcggaaggcctggt

SEQ ID NO: 150954 - DNA, 75 bp, Artificial Sequence
  Synthetic
cggagaagtgggccaccaccgcccctctgtgataccccgcggcagccctgaccagaatcttgacacactgcaggc

SEQ ID NO: 150955 - DNA, 75 bp, Artificial Sequence
  Synthetic
ttctggagccagcggaaggcctggttggtgactgtggtcatgataatgaggcctatgaagggtctgaggtggacc

SEQ ID NO: 150956 - DNA, 75 bp, Artificial Sequence
  Synthetic
agtctcgggttgatgcggcatctgtgccccctgtctctgagccggccggaccgcccagccccattgtacttaacc

SEQ ID NO: 150957 - DNA, 75 bp, Artificial Sequence
  Synthetic
cgctgttttgcctccctgtccggagctcgagcagggtctgctgtacatgccgcaagagctcacggtgtctgatag

SEQ ID NO: 150958 - DNA, 75 bp, Artificial Sequence
  Synthetic
gcctatgaagggtctgaggtggaccctgccgagcccgcccaccttgatgtttccgggacttatgcggtccacggc

SEQ ID NO: 150959 - DNA, 75 bp, Artificial Sequence
  Synthetic
gccccctgtctctgagccggccggaccgcccagccccattgtacttaacccccccccccccccccctctcgcgcg

SEQ ID NO: 150960 - DNA, 75 bp, Artificial Sequence
  Synthetic
ctcgagcagggtctgctgtacatgccgcaagagctcacggtgtctgatagtgtgctggtgttcgagctcacggat

SEQ ID NO: 150961 - DNA, 75 bp, Artificial Sequence
  Synthetic
agacttaggggattcccgtgtggttatacaagactatgacaaccaacatgaacaggaccggcctaccccgtcgcc

SEQ ID NO: 150962 - DNA, 75 bp, Artificial Sequence
  Synthetic
actgtggaacttgccgccagcccgggccgacttgagtgccgcacggtgcttgggaataagaccttccgtacatca

SEQ ID NO: 150963 - DNA, 75 bp, Artificial Sequence
  Synthetic
ggggtcattgtttgaatcagattgtgactggttggttaacgcctcaaacccgggccatcgccccggaggcggcct

SEQ ID NO: 150964 - DNA, 75 bp, Artificial Sequence
  Synthetic
aagacgaaattgtacgaggctgcccattctgacgtccgtgaatccttagccaggttcatccccaccatcggacct

SEQ ID NO: 150965 - DNA, 75 bp, Artificial Sequence
  Synthetic
gccgacttgagtgccgcacggtgcttgggaataagaccttccgtacatcaataactgatggtgctcacctcgaag

SEQ ID NO: 150966 - DNA, 75 bp, Artificial Sequence
  Synthetic
attctgacgtccgtgaatccttagccaggttcatccccaccatcggacctgttcaggctaccacgtgcgagctgt

SEQ ID NO: 150967 - DNA, 75 bp, Artificial Sequence
  Synthetic
atacaccttgaccccgcgtcccattattcatgcagtggctcctgactatagggttgagcaaaacccgaagaggct

SEQ ID NO: 150968 - DNA, 75 bp, Artificial Sequence
  Synthetic
cgtacgaacttgtctctgctggtctccaggttaaaatatcttctaatggcttggattgtaccgctatatttcccc

SEQ ID NO: 150969 - DNA, 75 bp, Artificial Sequence
  Synthetic
acgtttcgcgtattacgttcttccaaaaagactgtaacaagtttactactggcgagactatcgcccacggcaaag

SEQ ID NO: 150970 - DNA, 75 bp, Artificial Sequence
  Synthetic
ccaggttaaaatatcttctaatggcttggattgtaccgctatatttccccccggcggagcgccaagcgctgcacc

SEQ ID NO: 150971 - DNA, 75 bp, Artificial Sequence
  Synthetic
tcccgtcgcggtaccgctgcctacccgctcttgggctcaggtatatctcaagtccctgttggcctcagctatgat

SEQ ID NO: 150972 - DNA, 75 bp, Artificial Sequence
  Synthetic
ttacatttgttaatgtggcgacaggcgcccaggctgttgcccgttcccttgattggtctaaggtcactttggatg

SEQ ID NO: 150973 - DNA, 75 bp, Artificial Sequence
  Synthetic
gggaggctggcacgactaaggccggttatccttataattataacactactgctagtgaccagattttgattgaga

SEQ ID NO: 150974 - DNA, 75 bp, Artificial Sequence
  Synthetic
taagaccttttgcgccctgtttggcccctggttccgtgccattgagaaggagatattggccctactcccacctaa

SEQ ID NO: 150975 - DNA, 75 bp, Artificial Sequence
  Synthetic
gctgtggctgcaccctgaggggctccttggcctgttcccccctttttccccggggcatctttgggagtctgcaaa

SEQ ID NO: 150976 - DNA, 75 bp, Artificial Sequence
  Synthetic
cttggcctgttcccccctttttccccggggcatctttgggagtctgcaaaccccttttgcggtgagagcacgctc

SEQ ID NO: 150977 - DNA, 75 bp, Artificial Sequence
  Synthetic
aagccggcgcagccggcgctcactataactgaggatacggcccgtacggccaacctggcattagagatcgatgcc

SEQ ID NO: 150978 - DNA, 75 bp, Artificial Sequence
  Synthetic
taactgaggatacggcccgtacggccaacctggcattagagatcgatgccaccacagaggttggccgtgcttgtg

SEQ ID NO: 150979 - DNA, 75 bp, Artificial Sequence
  Synthetic
tgaaaatgacttctccgagttcgatagtactcagaataatttctctcttggccttgagtgtgtggttatggagga

SEQ ID NO: 150980 - DNA, 75 bp, Artificial Sequence
  Synthetic
tttagctgtgcttgaagatactattgactatcctgcccgtgcccatactttcgatgatttctgccctgagtgccg

SEQ ID NO: 150981 - DNA, 75 bp, Artificial Sequence
  Synthetic
agtactcagaataatttctctcttggccttgagtgtgtggttatggaggagtgtggcatgccccagtggctaatt

SEQ ID NO: 150982 - DNA, 75 bp, Artificial Sequence
  Synthetic
cctggcgcgggactacccccgggtactccctcgtccgctagtgatgcttgggtgttcccgccgccctctgagggg

SEQ ID NO: 150983 - DNA, 75 bp, Artificial Sequence
  Synthetic
ctccctcgtccgctagtgatgcttgggtgttcccgccgccctctgaggggtcggtggtcgccccgccacccgaag

SEQ ID NO: 150984 - DNA, 75 bp, Artificial Sequence
  Synthetic
ctatacaacaaggggatgtggatgtcgtggttgtgcccacccgggagctccgtaatagttggcgtcgccgaggtt

SEQ ID NO: 150985 - DNA, 75 bp, Artificial Sequence
  Synthetic
cattctggcgagcctggcacccttctctggaacaccgtttggaatatggcaattatagcacattgttatgagttc

SEQ ID NO: 150986 - DNA, 75 bp, Artificial Sequence
  Synthetic
gacccgggagtcttaattaatttccccctttgtgcccccttctgaaccttgccctgttatttcttttttctgcgt

SEQ ID NO: 150987 - DNA, 75 bp, Artificial Sequence
  Synthetic
tctggaacaccgtttggaatatggcaattatagcacattgttatgagttccgcgactttagggtcgctgctttca

SEQ ID NO: 150988 - DNA, 75 bp, Artificial Sequence
  Synthetic
cacctacaccaccaccggcccgcacccgccggctactttatacataccctgatggggctaaggtgtatgcaggct

SEQ ID NO: 150989 - DNA, 75 bp, Artificial Sequence
  Synthetic
gtcgtgattgatgaggccccatctcttccaccgcacttgttgctgttacacatgcagcgggcctcctctgttcac

SEQ ID NO: 150990 - DNA, 75 bp, Artificial Sequence
  Synthetic
ccgccggctactttatacataccctgatggggctaaggtgtatgcaggctctttgtttgagtcagattgtgattg

SEQ ID NO: 150991 - DNA, 75 bp, Artificial Sequence
  Synthetic
gacttaagttgaaggttgactaccgccctattggtctgtatgctggtgtggtggtggctcccggtttgggcacgc

SEQ ID NO: 150992 - DNA, 75 bp, Artificial Sequence
  Synthetic
ccctattggtctgtatgctggtgtggtggtggctcccggtttgggcacgctgcctgatgtggtgcgttttgctgg

SEQ ID NO: 150993 - DNA, 75 bp, Artificial Sequence
  Synthetic
gtcgttccacccgactgattttgttatgcgtgaaggtctcgccgcatacactttgtgcccgcgtccgatcatcca

SEQ ID NO: 150994 - DNA, 75 bp, Artificial Sequence
  Synthetic
aatgtcctgcatcggtgctttcttagaccggttggtagggacgtccaacgttggtactctgcccccacccgtggc

SEQ ID NO: 150995 - DNA, 75 bp, Artificial Sequence
  Synthetic
cccaagatccagaccactagccgtgtgctacgatccttgttttggaacgaaccggctataggccagaagttggtt

SEQ ID NO: 150996 - DNA, 75 bp, Artificial Sequence
  Synthetic
acgagggttaacgaatgttgcgcaggtctgtgttgatgttgtatcccgtgtttatggagttagtcctgggctggt

SEQ ID NO: 150997 - DNA, 75 bp, Artificial Sequence
  Synthetic
gaccggttggtagggacgtccaacgttggtactctgcccccacccgtggccccgcagctaattgccgtcgttctg

SEQ ID NO: 150998 - DNA, 75 bp, Artificial Sequence
  Synthetic
cctcggcacagcagcctatccgctactggggtcggggatatatcaggtccctgtaggcttaagctttgacgcctg

SEQ ID NO: 150999 - DNA, 75 bp, Artificial Sequence
  Synthetic
gtctgtgttgatgttgtatcccgtgtttatggagttagtcctgggctggtacataaccttatcggcatgttgcag

SEQ ID NO: 151000 - DNA, 75 bp, Artificial Sequence
  Synthetic
accacaattatagccacggccgacgccaggggccttattcagtcatctcgggcccatgctatagttgcactcact

SEQ ID NO: 151001 - DNA, 75 bp, Artificial Sequence
  Synthetic
aataactttttccttgccggtggagaggtcggccaccatcgtccctctgtgataccccgtggtaaccctgatcat

SEQ ID NO: 151002 - DNA, 75 bp, Artificial Sequence
  Synthetic
tggaatcatcctatacagcgggttatccacaatgaactagaacaatattgccgtgcccgtgctggtcgttgcctt

SEQ ID NO: 151003 - DNA, 75 bp, Artificial Sequence
  Synthetic
tgttgtgacttatgaaggcgatactagtgcgggctacaatcatgacgtctcaatactccgtgcatggatccgtac

SEQ ID NO: 151004 - DNA, 75 bp, Artificial Sequence
  Synthetic
tccacaatgaactagaacaatattgccgtgcccgtgctggtcgttgccttgaggttggggcccatcctcgctcta

SEQ ID NO: 151005 - DNA, 75 bp, Artificial Sequence
  Synthetic
agtgcgggctacaatcatgacgtctcaatactccgtgcatggatccgtactaccaagatagttggcgatcatccg

SEQ ID NO: 151006 - DNA, 75 bp, Artificial Sequence
  Synthetic
cagcagggggatgttgatgttgtggtcgtgccaactcgtgagcttcgtaacagttggcggcgccgcggctttgct

SEQ ID NO: 151007 - DNA, 75 bp, Artificial Sequence
  Synthetic
catcgcccggcccctgtcgccgccgttttgcccccttgccccgagcttgagcagggcctgctctatatgccacaa

SEQ ID NO: 151008 - DNA, 75 bp, Artificial Sequence
  Synthetic
atgggggctgggccccacagcctcacgtatgaacttgtccccgctggtctgcaggttaaaatatcttctaatggc

SEQ ID NO: 151009 - DNA, 75 bp, Artificial Sequence
  Synthetic
ctcccacccgtggcccagctgccaactgccgcaggtcagcactccgcggtctctcgcccgttgatcgcacttatt

SEQ ID NO: 151010 - DNA, 75 bp, Artificial Sequence
  Synthetic
ctgccgcaggtcagcactccgcggtctctcgcccgttgatcgcacttattgtttcgacggcttttctcggtgctc

SEQ ID NO: 151011 - DNA, 75 bp, Artificial Sequence
  Synthetic
gatagacgaagcaccttcgctaccaccgcacttgctgttgctccatatgcagcgggcctcatcggtccatctcct

SEQ ID NO: 151012 - DNA, 75 bp, Artificial Sequence
  Synthetic
ccattgccgcatggccgctccaagccagcgaaaggctgttctctcaacacttgtggggaggtacggccgtaggac

SEQ ID NO: 151013 - DNA, 75 bp, Artificial Sequence
  Synthetic
cgacggaagtgtatgtccgatctatatttggccctggcggctctccgtccctgtttccatcagcctgctccacaa

SEQ ID NO: 151014 - DNA, 75 bp, Artificial Sequence
  Synthetic
ccggcacggcatgacccgtctgtatgcagttctccacctcccacccgaggttctcctgcctcctggcacttatca

SEQ ID NO: 151015 - DNA, 75 bp, Artificial Sequence
  Synthetic
acgtcatctgttgcctcgggcactaatttggttctttatgctgccccgttaaaccctcttttgcctcttcaggac

SEQ ID NO: 151016 - DNA, 75 bp, Artificial Sequence
  Synthetic
gcagttctccacctcccacccgaggttctcctgcctcctggcacttatcatactacctcatacctactgattcat

SEQ ID NO: 151017 - DNA, 75 bp, Artificial Sequence
  Synthetic
atttggttctttatgctgccccgttaaaccctcttttgcctcttcaggacggcaccaatacacacatcatggcta

SEQ ID NO: 151018 - DNA, 75 bp, Artificial Sequence
  Synthetic
catcgctgccccgctgatgtttgtgagctcatacgcggggcctatccaaagatccagacgactagccgtgtgttg

SEQ ID NO: 151019 - DNA, 75 bp, Artificial Sequence
  Synthetic
ttggttgaggccatggttgagaagggtcaggacggctctgccgttctagagcttgatctttgcaatcgtgatgtc

SEQ ID NO: 151020 - DNA, 75 bp, Artificial Sequence
  Synthetic
gcttgggtccgcacgactaaggtcaccgggaaccaccccttggttattgagagggtccgagctatcggctgccat

SEQ ID NO: 151021 - DNA, 75 bp, Artificial Sequence
  Synthetic
ggcgcaatcactgttcatgaggcccagggcgccacgtttacggaaactaccatcatagccacggctgatgctagg

SEQ ID NO: 151022 - DNA, 75 bp, Artificial Sequence
  Synthetic
ttggcggctacgcaatttctatctcattctggcctcagaccactaccacccctacatctgtagatatgaattcca

SEQ ID NO: 151023 - DNA, 75 bp, Artificial Sequence
  Synthetic
cctacatctgtagatatgaattccattacctccactgatgtcaggattttggtccaacccggtattgcttctgaa

SEQ ID NO: 151024 - DNA, 75 bp, Artificial Sequence
  Synthetic
ccgggaaccaccccttggttattgagagggtccgagctatcggctgccattttgttctgctcctcactgcggcac

SEQ ID NO: 151025 - DNA, 75 bp, Artificial Sequence
  Synthetic
agggcgccacgtttacggaaactaccatcatagccacggctgatgctaggggccttatccaatcctcccgtgcac

SEQ ID NO: 151026 - DNA, 75 bp, Artificial Sequence
  Synthetic
gccggcggtggttatccgcaggtttccacctagaccccagagtgcttgtttttgatgagtcagtgccctgccgct

SEQ ID NO: 151027 - DNA, 75 bp, Artificial Sequence
  Synthetic
gcgggtcgccttctttgtttccatcagcttgctcgactaaatctacttttcacgctgtcccagtccatatctggg

SEQ ID NO: 151028 - DNA, 75 bp, Artificial Sequence
  Synthetic
agcttgctcgactaaatctacttttcacgctgtcccagtccatatctgggatcggctcatgctctttggtgccac

SEQ ID NO: 151029 - DNA, 75 bp, Artificial Sequence
  Synthetic
ttttttcctggctggtggtgaagttggccaccaccgcccttccaccataccccgtggcaacccggatcagaattt

SEQ ID NO: 151030 - DNA, 75 bp, Artificial Sequence
  Synthetic
tgctctgcatccatggctcccctgttaattcttatactaacaccccttacaccggggcgctggggctgcttgatt

SEQ ID NO: 151031 - DNA, 75 bp, Artificial Sequence
  Synthetic
tcttggaaccagctgagggcttagtcggtgatcaaggccatgataatgaggcttatgagggttctgaggttgacc

SEQ ID NO: 151032 - DNA, 75 bp, Artificial Sequence
  Synthetic
cggtgatcaaggccatgataatgaggcttatgagggttctgaggttgacccagccgaacctgcgtattttgatgt

SEQ ID NO: 151033 - DNA, 75 bp, Artificial Sequence
  Synthetic
agccctggttgccaacgagggctggagtgcatcggaggatgcgctcactgctgtgattacagctgcctatctcac

SEQ ID NO: 151034 - DNA, 75 bp, Artificial Sequence
  Synthetic
agtgcatcggaggatgcgctcactgctgtgattacagctgcctatctcactatttgccaccaacgttacctccgc

SEQ ID NO: 151035 - DNA, 75 bp, Artificial Sequence
  Synthetic
cccgccaccggctgcgccgcggtgccgacggtaccgctgagcttaccaccacggcagccacgcgctttatgaagg

SEQ ID NO: 151036 - DNA, 75 bp, Artificial Sequence
  Synthetic
aacaccgtctggaacatggcgattatagcacactgctatgagtcccgtgacttccgtgttgccgctttcaagggt

SEQ ID NO: 151037 - DNA, 75 bp, Artificial Sequence
  Synthetic
cgacggtaccgctgagcttaccaccacggcagccacgcgctttatgaaggacttgcattttaccggcacaaatgg

SEQ ID NO: 151038 - DNA, 75 bp, Artificial Sequence
  Synthetic
tgcccgggctgcccgattaacagctactgttgagctcgctgcgagtccagaccgtttggagtgccgcactataat

SEQ ID NO: 151039 - DNA, 75 bp, Artificial Sequence
  Synthetic
tggcttttcgagaagtcgggccgcgattatatccccggccgtcaattggaattttatgcacagtgccggcgttgg

SEQ ID NO: 151040 - DNA, 75 bp, Artificial Sequence
  Synthetic
ggtaggtacggccgccgaacgaagctgtatgaagcggcccattctgatgttcgtgagtctttaaggaggttcatc

SEQ ID NO: 151041 - DNA, 75 bp, Artificial Sequence
  Synthetic
attatatccccggccgtcaattggaattttatgcacagtgccggcgttggctttctgccggatttcatctcgacc

SEQ ID NO: 151042 - DNA, 75 bp, Artificial Sequence
  Synthetic
tgaacggccctgagcagtacgttctatcgtttgatgcttcccgccagactatgggagccgggtcgcatagcctca

SEQ ID NO: 151043 - DNA, 75 bp, Artificial Sequence
  Synthetic
cctactattggcccggtccgggctaccacgtgcgagctatacgagttggtagaggctatggtggagaagggccag

SEQ ID NO: 151044 - DNA, 75 bp, Artificial Sequence
  Synthetic
ggagcgtaatcatcgcccaggcgatgaactttatcttactgagccggctgccgcctggttcgaggctaataagcc

SEQ ID NO: 151045 - DNA, 75 bp, Artificial Sequence
  Synthetic
gctgcttcatgcggtggctgggtcaggagtgcaactgtttcctccaacctgtagagggtcttattggcgatgaag

SEQ ID NO: 151046 - DNA, 75 bp, Artificial Sequence
  Synthetic
ctctcgtgtggtcatccaggactatgataaccaacatgagcaagaccggcccactccttcgcccgctccatctcg

SEQ ID NO: 151047 - DNA, 75 bp, Artificial Sequence
  Synthetic
ggagtgcaactgtttcctccaacctgtagagggtcttattggcgatgaaggccatgataacgaggcctatgaggg

SEQ ID NO: 151048 - DNA, 75 bp, Artificial Sequence
  Synthetic
gggcgaggtagcggctttttgcagtgccctctacaggtataacagattcacccagcggcactcgttgactggcgg

SEQ ID NO: 151049 - DNA, 75 bp, Artificial Sequence
  Synthetic
gataaccaacatgagcaagaccggcccactccttcgcccgctccatctcgccctttttcggtccttcgcgcaaat

SEQ ID NO: 151050 - DNA, 75 bp, Artificial Sequence
  Synthetic
tgcgttgtaccgggcccttggccttcctactgatctggccgctcgtgcctcccggctcgttgccaccgttgaatt

SEQ ID NO: 151051 - DNA, 75 bp, Artificial Sequence
  Synthetic
gtctcggacaccgttacatttgttaatgtggccacaggtgctcaggctgttgcccgttctcttgactggtctaag

SEQ ID NO: 151052 - DNA, 75 bp, Artificial Sequence
  Synthetic
tcccttctgtggggaagggaccttgtatactcgtacctggtccacttctggtttttctagtgatttctcccctcc

SEQ ID NO: 151053 - DNA, 75 bp, Artificial Sequence
  Synthetic
cctactgatctggccgctcgtgcctcccggctcgttgccaccgttgaattgacatcccacccaggccgcatcgag

SEQ ID NO: 151054 - DNA, 75 bp, Artificial Sequence
  Synthetic
ttccagtatggtttttgagaatgatttttctgagtttgatagcacccaaaacaacttttctctcggccttgagtg

SEQ ID NO: 151055 - DNA, 75 bp, Artificial Sequence
  Synthetic
atgtggccacaggtgctcaggctgttgcccgttctcttgactggtctaaggttaccctggacggccgccctctta

SEQ ID NO: 151056 - DNA, 75 bp, Artificial Sequence
  Synthetic
gatagatgaagcaccttcgctcccaccgcacctgctgttgctccatatgcagcgagcctcatcagtccatcttct

SEQ ID NO: 151057 - DNA, 75 bp, Artificial Sequence
  Synthetic
gaggagtttatactatcttttgatgccgaccgtcagaccatgtcggctggccccaacagccttacatatgagata

SEQ ID NO: 151058 - DNA, 75 bp, Artificial Sequence
  Synthetic
caaccaaggcaggctacccttataattataacacgacagctagtgaccaaatcctgaccgaaaatgcggctggtc

SEQ ID NO: 151059 - DNA, 75 bp, Artificial Sequence
  Synthetic
caggttgacatggcacccgtaccacctgctcccaagcctgttgggctgccgagctctaatgaacccataaccccc

SEQ ID NO: 151060 - DNA, 75 bp, Artificial Sequence
  Synthetic
ccgaccgtcagaccatgtcggctggccccaacagccttacatatgagataacgcctgctggtttgcgggttcaca

SEQ ID NO: 151061 - DNA, 75 bp, Artificial Sequence
  Synthetic
tatactcgtacctggtccacttctggtttttctagtgatttctcccctcctgaggcggccgaccatgcaccggct

SEQ ID NO: 151062 - DNA, 75 bp, Artificial Sequence
  Synthetic
ctgctcccaagcctgttgggctgccgagctctaatgaacccataacccccgtgcgtaagccacctgcaccaccgg

SEQ ID NO: 151063 - DNA, 75 bp, Artificial Sequence
  Synthetic
tcagtttccgcggtcggtgttttagccccccattcggctcttgctattcttgaagacactactgactacccggct

SEQ ID NO: 151064 - DNA, 75 bp, Artificial Sequence
  Synthetic
ctgcattttgttcggcgctgtatcggtttaaccggtccatccaacggcattcacttgtaggaaccctctggtatc

SEQ ID NO: 151065 - DNA, 75 bp, Artificial Sequence
  Synthetic
gtttaaccggtccatccaacggcattcacttgtaggaaccctctggtatcatccagagggcttacttggtctctt

SEQ ID NO: 151066 - DNA, 75 bp, Artificial Sequence
  Synthetic
attgtgactggctggttaatgcctctaacccgggccaccgccccggaggtggtctctgtcatgccttttaccagc

SEQ ID NO: 151067 - DNA, 75 bp, Artificial Sequence
  Synthetic
ttcagtggttctctgtagtgattaccgtcagagccgcaatgcggccaccttcatagccggctgtgggttgaaatt

SEQ ID NO: 151068 - DNA, 75 bp, Artificial Sequence
  Synthetic
taacccgggccaccgccccggaggtggtctctgtcatgccttttaccagcgtttccctgaggctttctaccccac

SEQ ID NO: 151069 - DNA, 75 bp, Artificial Sequence
  Synthetic
ccctgtacctgatgttgattcacgtggtgctattctgcgtcggcagtacaacctgtccacgtctccgcttacgtc

SEQ ID NO: 151070 - DNA, 75 bp, Artificial Sequence
  Synthetic
tgaaggtaggtaaaacccgggagttttaattaattcttcttgtgcccccttcatagcttttgctttatttctctt

SEQ ID NO: 151071 - DNA, 75 bp, Artificial Sequence
  Synthetic
ttggtccgtctctggcttttccagtgattttgcaccagtcgggatgtctggtctggcgcccgagcagcctggcgt

SEQ ID NO: 151072 - DNA, 75 bp, Artificial Sequence
  Synthetic
gattttgcaccagtcgggatgtctggtctggcgcccgagcagcctggcgtcagaactgtttgttcccccccgccc

SEQ ID NO: 151073 - DNA, 75 bp, Artificial Sequence
  Synthetic
ctatagggttgagcagaatccaaagaggcttgaggcagcgtaccgagagacctgctctcgtcgtggcaccgctgc

SEQ ID NO: 151074 - DNA, 75 bp, Artificial Sequence
  Synthetic
caacactcatattatggctactgaggcatctaattatgcccagtatcgggttgttcgagctacgatccgttatcg

SEQ ID NO: 151075 - DNA, 75 bp, Artificial Sequence
  Synthetic
cctgtcagcctcagttttgatgcctgggaacgcaatcaccgccccggcgatgagctttatttgactgagcccgcc

SEQ ID NO: 151076 - DNA, 75 bp, Artificial Sequence
  Synthetic
acgaatgttgcgcaggtttgtgttgatgttgtgtcccgtgtctatggggttagccccgggctggtgcataacctt

SEQ ID NO: 151077 - DNA, 75 bp, Artificial Sequence
  Synthetic
cctgctctcgtcgtggcaccgctgcctatccgcttctcggatcaggtatataccaggtccctgtcagtctcagtt

SEQ ID NO: 151078 - DNA, 75 bp, Artificial Sequence
  Synthetic
ggctatgccatttctatttctttttggcctcaaactacaactacccctacttctgttgacatgaattctattacc

SEQ ID NO: 151079 - DNA, 75 bp, Artificial Sequence
  Synthetic
tccgtgggttcggtaagggcgcccactgcccaggggcctgtcccatcggtttgccgtaaccgccgcctcctcttc

SEQ ID NO: 151080 - DNA, 75 bp, Artificial Sequence
  Synthetic
ctgcccaggggcctgtcccatcggtttgccgtaaccgccgcctcctcttcacttatcctgatggagccaaagtgt

SEQ ID NO: 151081 - DNA, 75 bp, Artificial Sequence
  Synthetic
cacaataacggaagatacggcccgcacggccaacctagcattagagatcgatgctgctacagaggttggccgcgc

SEQ ID NO: 151082 - DNA, 75 bp, Artificial Sequence
  Synthetic
gccggccccagtggccgccgtcctgcccccctgccctgagcttgagcaggggttactctacatgccgcaggagct

SEQ ID NO: 151083 - DNA, 75 bp, Artificial Sequence
  Synthetic
gtatatcggcctggagtaagaccttctgtgctctgtttggcccgtggttccgtgccattgaaaaagaaatactgg

SEQ ID NO: 151084 - DNA, 75 bp, Artificial Sequence
  Synthetic
gcctctgtcatgcatttttccaacgttttcctgagtcttttgatcatactaaatttatcatgcgtgagggtcttg

SEQ ID NO: 151085 - DNA, 75 bp, Artificial Sequence
  Synthetic
ttttcctgagtcttttgatcatactaaatttatcatgcgtgagggtcttgctgcctacacccttgcgccccggcc

SEQ ID NO: 151086 - DNA, 75 bp, Artificial Sequence
  Synthetic
tgcatccatggctctcctgttaactcctatactaacacaccttacactggtgcattggggcttcttgattttgca

SEQ ID NO: 151087 - DNA, 75 bp, Artificial Sequence
  Synthetic
aaggtctatacagcagggggatgttgacgtcgtggttgtccccacccgagagcttcgcaatagctggcgtcgccg

SEQ ID NO: 151088 - DNA, 75 bp, Artificial Sequence
  Synthetic
aattctattatacagaggttggaatgaataacatgttctgtgcattgcccatgggatcgccatgcgccctagggc

SEQ ID NO: 151089 - DNA, 75 bp, Artificial Sequence
  Synthetic
ttgctcccgtctcgggacagcagcctatccactgcttggctccggaatttatcaggtcccggtcggccccagctt

SEQ ID NO: 151090 - DNA, 75 bp, Artificial Sequence
  Synthetic
tatccactgcttggctccggaatttatcaggtcccggtcggccccagctttgatgcttgggagcgtaatcatcgc

SEQ ID NO: 151091 - DNA, 75 bp, Artificial Sequence
  Synthetic
gtcgcttccaccgcacttgttgttgttacatatgcagcgggcctcttcggtccatcttctcggtgaccctaatca

SEQ ID NO: 151092 - DNA, 75 bp, Artificial Sequence
  Synthetic
cacgtttgtacgcagtcctccatctgccccctgaggtcttgttaccacctggcacttaccatacaacttcttatc

SEQ ID NO: 151093 - DNA, 75 bp, Artificial Sequence
  Synthetic
catttcactggcacgaacggcgttggtgaggtgggccgtgggaccgctctgacattgtttaatcttgctgacacg

SEQ ID NO: 151094 - DNA, 75 bp, Artificial Sequence
  Synthetic
actatcactgaagatgttgcgaggactgccaacctcgccctcgagatagatgctgcgaccgaggtcggccgggct

SEQ ID NO: 151095 - DNA, 75 bp, Artificial Sequence
  Synthetic
tccctgatgttgactctcgtggcgctatcttgcgccgccagtataatttgtccacttctcctttaacttcatctg

SEQ ID NO: 151096 - DNA, 75 bp, Artificial Sequence
  Synthetic
cggtcgattcagcagggtgacgttgacgttgttgttgtcccgacgcgggaacttcgggatagctggcgtcgtcgt

SEQ ID NO: 151097 - DNA, 75 bp, Artificial Sequence
  Synthetic
gtgtggttattcaggattatgataaccagcacgagcaagatcgacctactccgtcacctgccccctcccgccctt

SEQ ID NO: 151098 - DNA, 75 bp, Artificial Sequence
  Synthetic
caattatgctcagtatcgggttgtccgggccacaatccgctaccgccccttggtgccgaatgccgtcggtggtta

SEQ ID NO: 151099 - DNA, 75 bp, Artificial Sequence
  Synthetic
acgttgttgttgtcccgacgcgggaacttcgggatagctggcgtcgtcgtggttttgcggcctttaccccgcaca

SEQ ID NO: 151100 - DNA, 75 bp, Artificial Sequence
  Synthetic
tcaccttcttggcgacccgaatcagatccccgctatagactttgagaacacggggttggtcccggcaatccgccc

SEQ ID NO: 151101 - DNA, 75 bp, Artificial Sequence
  Synthetic
ggcatagcctctgagctggtcatcccgagtgaacgcctccactatcgtaaccaaggttggcgctctgttgagaca

SEQ ID NO: 151102 - DNA, 75 bp, Artificial Sequence
  Synthetic
ccaaggttggcgctctgttgagacatcgggtgtggccgaggaggaggcgacatcaggtttggttatgctttgtat

SEQ ID NO: 151103 - DNA, 75 bp, Artificial Sequence
  Synthetic
tggggaggtgggccataaccgcccttctgtgataccccgtggcaaccctgatcagaacgttgagactctacaagc

SEQ ID NO: 151104 - DNA, 75 bp, Artificial Sequence
  Synthetic
tcatggctcccctgttaattcctacaccaacacgccctacactggtgcgttagggctccttgactttgcacttga

SEQ ID NO: 151105 - DNA, 75 bp, Artificial Sequence
  Synthetic
ctaccccaagatccagactgccagccgtgtcctgcgttcgctcttttggggtgagcccccggttggccagaaact

SEQ ID NO: 151106 - DNA, 75 bp, Artificial Sequence
  Synthetic
cttcccgccatcctgccagattagtgcttaccaccaactggctgaagagttaggccaccgtcccgctcctgttgc

SEQ ID NO: 151107 - DNA, 75 bp, Artificial Sequence
  Synthetic
cgtgtcctgcgttcgctcttttggggtgagcccccggttggccagaaacttgtatttacacaggcagctaaggcc

SEQ ID NO: 151108 - DNA, 75 bp, Artificial Sequence
  Synthetic
gattgagaacgcggccggccaccgtgttgctatttccacctataccactagcctaggtgccggtcctacctcgat

SEQ ID NO: 151109 - DNA, 75 bp, Artificial Sequence
  Synthetic
gatgcccgggggctaattcagtcttcacgtgcacatgcaattgtcgcactcacccgtcacactgagaagtgtgtg

SEQ ID NO: 151110 - DNA, 75 bp, Artificial Sequence
  Synthetic
cacgttttatgaaggacttgcatttcaccgggacaaatggcgttggtgaggtgggtcgtggcatagccctaacat

SEQ ID NO: 151111 - DNA, 75 bp, Artificial Sequence
  Synthetic
cacgtgcacatgcaattgtcgcactcacccgtcacactgagaagtgtgtggtgcttgatgccccaggccttctta

SEQ ID NO: 151112 - DNA, 75 bp, Artificial Sequence
  Synthetic
actcccgccccgtcgtctcagccaatggcgagccgactgttaagttatacacctctgtcgagaatgctcagcagg

SEQ ID NO: 151113 - DNA, 75 bp, Artificial Sequence
  Synthetic
cagtcataccccgtggcacccctgatcttaatgttgccacgttagatgccttcccaccctcttgccagatcagcg

SEQ ID NO: 151114 - DNA, 75 bp, Artificial Sequence
  Synthetic
gtaggtaaaacccgggagtcttaattaatttctcttgtgcccccttcgcagtttccttttgttttatttcttatt

SEQ ID NO: 151115 - DNA, 75 bp, Artificial Sequence
  Synthetic
tcttaatgttgccacgttagatgccttcccaccctcttgccagatcagcgcttatcaccagcttgctgaggaact

SEQ ID NO: 151116 - DNA, 75 bp, Artificial Sequence
  Synthetic
gaaggattgtaataagtttacaaccggtgagaccattgcccacggtaaagttggccagggtatatcggcctggag

SEQ ID NO: 151117 - DNA, 75 bp, Artificial Sequence
  Synthetic
tcaggagctcaccgcctccgatagcgtcctggtgtttgagcttactgatatagtccactgccggatggctgcgcc

SEQ ID NO: 151118 - DNA, 75 bp, Artificial Sequence
  Synthetic
gttcttcgagccaatgatgttctgtggctctctctgactgcagctgaatatgatcagactacttacggctcgtca

SEQ ID NO: 151119 - DNA, 75 bp, Artificial Sequence
  Synthetic
gtcctggtgtttgagcttactgatatagtccactgccggatggctgcgccgagccagcgtaaagctgtgctctcc

SEQ ID NO: 151120 - DNA, 75 bp, Artificial Sequence
  Synthetic
aagtttattcccaccatcggtcctgtgcgagccactacttgcgaactctatgagcttgttgaagccatggtggag

SEQ ID NO: 151121 - DNA, 75 bp, Artificial Sequence
  Synthetic
tgcgagccactacttgcgaactctatgagcttgttgaagccatggtggagaagggtcaggatgggtcggccgtcc

SEQ ID NO: 151122 - DNA, 75 bp, Artificial Sequence
  Synthetic
agaatgcagccggtcaccgcgttgctatatccacttacactactagtctcggtgctggccctgtgtctgtctccg

SEQ ID NO: 151123 - DNA, 75 bp, Artificial Sequence
  Synthetic
gcgagacgattactcatggtaaagtcggtcaaggtatatctgcgtggagtaaaacattttgtgccttattcgggc

SEQ ID NO: 151124 - DNA, 75 bp, Artificial Sequence
  Synthetic
cggtcaaggtatatctgcgtggagtaaaacattttgtgccttattcgggccttggttccgcgccattgaaaaaca

SEQ ID NO: 151125 - DNA, 75 bp, Artificial Sequence
  Synthetic
tgtcgtgacttatgagggtgacactagtgcaggctacaaccatgacgtctccatacttcgtgcgtggattcgtac

SEQ ID NO: 151126 - DNA, 75 bp, Artificial Sequence
  Synthetic
cggcgcaaaagctagcatggtttttgagaatgacttctctgagtttgacagcacacagaataacttttctttggg

SEQ ID NO: 151127 - DNA, 75 bp, Artificial Sequence
  Synthetic
ctggtcatagaacgtgtgcgggccatcggatgccattttgtgttgctgctcaccgcggcccctgagccgtcgcct

SEQ ID NO: 151128 - DNA, 75 bp, Artificial Sequence
  Synthetic
tcttgagtgtgttattatggaagagtgcggtatgcccgcttggttaatccgtctttaccatcttgttcgctctgc

SEQ ID NO: 151129 - DNA, 75 bp, Artificial Sequence
  Synthetic
taagacccgggagtcttaattaattttccttttgtgcccccttctaaaccccgctttgttatttcttttttctgc

SEQ ID NO: 151130 - DNA, 75 bp, Artificial Sequence
  Synthetic
atgccttatgttccttaccctcgttcgacggaggtgtatgttcgatctatatttggccctggcggctccccgtcc

SEQ ID NO: 151131 - DNA, 75 bp, Artificial Sequence
  Synthetic
ccgatcggtttgtatgccggtgtcgtggtggctcccggcctcggggcccttccagacgtcgtccggtttgccgga

SEQ ID NO: 151132 - DNA, 75 bp, Artificial Sequence
  Synthetic
tggtggctcccggcctcggggcccttccagacgtcgtccggtttgccggaaggctgtctgagaaaaattggggcc

SEQ ID NO: 151133 - DNA, 75 bp, Artificial Sequence
  Synthetic
tgtgtgtggatgttgtttcacgtgtttatggtgtcagccctggtttggtgcataaccttattggtatgcttcaga

SEQ ID NO: 151134 - DNA, 75 bp, Artificial Sequence
  Synthetic
gactgctacatcaccagctcctgacacagcccctgtacctgatgttgactcacgcggcgccatcttgcgccggca

SEQ ID NO: 151135 - DNA, 75 bp, Artificial Sequence
  Synthetic
tagggtgccattttgtgcttttgctcacagctgcgcctgagccttcaccgatgccttatgtcccataccctcgct

SEQ ID NO: 151136 - DNA, 75 bp, Artificial Sequence
  Synthetic
taccgagacaattaagccagttcttgaccttacagacgccattatacaacggcgtgaatgaataacatgtcttct

SEQ ID NO: 151137 - DNA, 75 bp, Artificial Sequence
  Synthetic
agtctacatttcacgccgtccctgtgcatatctgggacaggcttatgctttttggtgcgacccttgatgaccagg

SEQ ID NO: 151138 - DNA, 75 bp, Artificial Sequence
  Synthetic
ggcaccaatacccatattatggctactgaagcatctaattatgcccagtaccgggtggttcgcgctacaatccgt

SEQ ID NO: 151139 - DNA, 75 bp, Artificial Sequence
  Synthetic
gcatatctgggacaggcttatgctttttggtgcgacccttgatgaccaggctttctgctgctcgaggcttatgac

SEQ ID NO: 151140 - DNA, 75 bp, Artificial Sequence
  Synthetic
actgctagtgaccagattctgattgagaatgcagccggccatcgtgttgctatatctacttacactactagtctt

SEQ ID NO: 151141 - DNA, 75 bp, Artificial Sequence
  Synthetic
actatcgcaatcaaggttggcgctctgtcgagaccacgggcgtggctgaagaggaggctacttccggcctagtaa

SEQ ID NO: 151142 - DNA, 75 bp, Artificial Sequence
  Synthetic
cctccgttccccctcgtcgccgagctgccccttccggggctgcgccgctgaccgctgttgctcccgccccaggca

SEQ ID NO: 151143 - DNA, 75 bp, Artificial Sequence
  Synthetic
tgccccttccggggctgcgccgctgaccgctgttgctcccgccccaggcactgctcccgtccctgatgttgattc

SEQ ID NO: 151144 - DNA, 75 bp, Artificial Sequence
  Synthetic
ccaatgttgacaccttggctgccttcccgccgtcttgccagattagcgccttccatcagttggctgaggagcttg

SEQ ID NO: 151145 - DNA, 75 bp, Artificial Sequence
  Synthetic
atgggggccgggtcgcatagcctcacttatgagttgacgcccgccggcttgcaggttaggatttcatctaatggc

SEQ ID NO: 151146 - DNA, 75 bp, Artificial Sequence
  Synthetic
gtgttactgccggccggcgtgtggtgatagacgaggcaccttcgcttccaccgcacttgttgctgctccacatgc

SEQ ID NO: 151147 - DNA, 75 bp, Artificial Sequence
  Synthetic
ttgcattggagcttgaatttaggaatttgacacctgggaatactaacacccgtgtatcccgatataccagcacag

SEQ ID NO: 151148 - DNA, 75 bp, Artificial Sequence
  Synthetic
tcttgttctttatgctgctccgcttaacccgcttttaccccttcaggatggtaccaatactcatatcatggctac

SEQ ID NO: 151149 - DNA, 75 bp, Artificial Sequence
  Synthetic
aacccgcttttaccccttcaggatggtaccaatactcatatcatggctacagaggcgtccaactatgctcaatac

SEQ ID NO: 151150 - DNA, 75 bp, Artificial Sequence
  Synthetic
taagacccgggagtcttaattaattcctccttgtgcccccttctaatttctgtcttgttatttcttttttctgcg

SEQ ID NO: 151151 - DNA, 75 bp, Artificial Sequence
  Synthetic
ttttggcctcagactactaccacaccgacgtcggttgatatgaattcaatcacttcgactgatgtccggattgtt

SEQ ID NO: 151152 - DNA, 75 bp, Artificial Sequence
  Synthetic
cgacgtcggttgatatgaattcaatcacttcgactgatgtccggattgttgttcaacctggtctcgcctccgaac

SEQ ID NO: 151153 - DNA, 75 bp, Artificial Sequence
  Synthetic
ccccaccagttagtgatatttgggtgttaccaccgccctcggaggagtctcaggtttccacagtgctcacacccc

SEQ ID NO: 151154 - DNA, 75 bp, Artificial Sequence
  Synthetic
gcacagcaggataaaggcatcaccatcccgcacgatatagatcttggtgactcccgtgtggttattcaggattat

SEQ ID NO: 151155 - DNA, 75 bp, Artificial Sequence
  Synthetic
aggaagcgacatccggtctagttatgctttgtgtccacggttcccctgttaattcgtatactaatacaccttaca

SEQ ID NO: 151156 - DNA, 75 bp, Artificial Sequence
  Synthetic
tgaactgggggccccggacccgccccctcttgctgagactgacgcacctacagttgttgacactttgcctccggc

SEQ ID NO: 151157 - DNA, 75 bp, Artificial Sequence
  Synthetic
gctttgtgtccacggttcccctgttaattcgtatactaatacaccttacactggtgctttaggcttgcttgactt

SEQ ID NO: 151158 - DNA, 75 bp, Artificial Sequence
  Synthetic
cttctcgcacccgccgtctcctttatacctatcctgatggcgctaaggtgtacgcagggtcactgtttgaatcag

SEQ ID NO: 151159 - DNA, 75 bp, Artificial Sequence
  Synthetic
ccgtcaccgcttgaaacgtggtgccgatggtacggctgttctaacgaccacagcagccactaggttcatgaagga

SEQ ID NO: 151160 - DNA, 75 bp, Artificial Sequence
  Synthetic
gtctcggacacagtcacgtttgttaacgtggccactggagctcaggctgttgcccgctccctcgattggtctaag

SEQ ID NO: 151161 - DNA, 75 bp, Artificial Sequence
  Synthetic
gatggtacggctgttctaacgaccacagcagccactaggttcatgaaggatctgcactttaccggcacgaatggt

SEQ ID NO: 151162 - DNA, 75 bp, Artificial Sequence
  Synthetic
cttttcccgtcagcttgctctaccaaatctacatttcatgctgttccggtccatatctgggaccggctcatgctt

SEQ ID NO: 151163 - DNA, 75 bp, Artificial Sequence
  Synthetic
ctatagggttgagcagaacccgaagaggcttgaggcagcgtaccgagaaacctgctcccgccgtggcactgccgc

SEQ ID NO: 151164 - DNA, 75 bp, Artificial Sequence
  Synthetic
gaattgatttcgtcagctggaggccagctcttttactcccgcccagtcgtttcagccaatggcgagccgtctgtg

SEQ ID NO: 151165 - DNA, 75 bp, Artificial Sequence
  Synthetic
agctcttttactcccgcccagtcgtttcagccaatggcgagccgtctgtgaagctttatacttctgtcgagaatg

SEQ ID NO: 151166 - DNA, 75 bp, Artificial Sequence
  Synthetic
tctatctctgcggtcggtgtcttagccccacactcggcccttgccgttcttgaggacactgttgactaccccgcc

SEQ ID NO: 151167 - DNA, 75 bp, Artificial Sequence
  Synthetic
ataaccaacatgaacaggatcggcccactccgtctccggctccctcccgtccattctctgttctccgcgccaatg

SEQ ID NO: 151168 - DNA, 75 bp, Artificial Sequence
  Synthetic
cactccgtctccggctccctcccgtccattctctgttctccgcgccaatgatgttctttggctttcgctgaccgc

SEQ ID NO: 151169 - DNA, 75 bp, Artificial Sequence
  Synthetic
ttgtgccggctgcactattagccccggaattgtgcactatcagtttactgctggagttccgggctcaggtaagtc

SEQ ID NO: 151170 - DNA, 75 bp, Artificial Sequence
  Synthetic
ggaattgtgcactatcagtttactgctggagttccgggctcaggtaagtcaaggtccatacagcagggggatgtt

SEQ ID NO: 151171 - DNA, 75 bp, Artificial Sequence
  Synthetic
ctgctgaacccgctcaccttgatgtctctgggacctacgcagtccatggccgccagctcgaggctctatacaggg

SEQ ID NO: 151172 - DNA, 75 bp, Artificial Sequence
  Synthetic
tgttgccactggcgcccaggccgtggcccgcactcttgactggaccaaggtcacgctggatggtcaacccctaaa

SEQ ID NO: 151173 - DNA, 75 bp, Artificial Sequence
  Synthetic
ttaattaattttcctgtgcccccttcgtggttctctttcgatttatttctcttttctgctctccgcgctccctgg

SEQ ID NO: 151174 - DNA, 75 bp, Artificial Sequence
  Synthetic
tggaaataagaccttccgcacatcaataactgatggcgcccacctcgaggtcaacggccctgagcagtatgttct

SEQ ID NO: 151175 - DNA, 75 bp, Artificial Sequence
  Synthetic
gcccgcactcttgactggaccaaggtcacgctggatggtcaacccctaaagaccatcaatcagtattctaagaca

SEQ ID NO: 151176 - DNA, 75 bp, Artificial Sequence
  Synthetic
acggcggcccgagttactacgggccgtcgtgttgtgattgacgaggccccatctctcccaccgcatttgttgttg

SEQ ID NO: 151177 - DNA, 75 bp, Artificial Sequence
  Synthetic
tacaatactacagctagtgatcatatactaattgagaacgcagccggtcatcgtgttgcgatctctacttacacc

SEQ ID NO: 151178 - DNA, 75 bp, Artificial Sequence
  Synthetic
tactaattgagaacgcagccggtcatcgtgttgcgatctctacttacaccactagtcttggtgctggcccggttg

SEQ ID NO: 151179 - DNA, 75 bp, Artificial Sequence
  Synthetic
gattcctgccattgatttcgagcatgctggcctggtccccgcaatccgccctgagcttgcaccaacgagttggtg

SEQ ID NO: 151180 - DNA, 75 bp, Artificial Sequence
  Synthetic
gcatgttacacatcgctgcccagccgatgtatgtgagctcatacgcggggcctatcctaaaatccagaccacgag

SEQ ID NO: 151181 - DNA, 75 bp, Artificial Sequence
  Synthetic
gtgcccatacatatgatgacttctgccctgagtgccgtacactcggtctccagggttgtgcatttcagtctacta

SEQ ID NO: 151182 - DNA, 75 bp, Artificial Sequence
  Synthetic
gaaggtgggtaaaactcgggagtattaatctattctttttgtgccccccttctttgctttccttattttcttttt

SEQ ID NO: 151183 - DNA, 75 bp, Artificial Sequence
  Synthetic
agcgtcactacctgcgagctctatgaacttgtggaggccatggtagagaagggccaggacggctctgcggttttg

SEQ ID NO: 151184 - DNA, 75 bp, Artificial Sequence
  Synthetic
tgtctccatactccgtgcgtggattcgtactactaaaatagttggtgaccacccgttggttatagagcgtgtgcg

SEQ ID NO: 151185 - DNA, 75 bp, Artificial Sequence
  Synthetic
cggagaggtgggccaccaccgcccctctgtgataccccgtggtaaccctgaccagaaccttgagaccctacaggc

SEQ ID NO: 151186 - DNA, 75 bp, Artificial Sequence
  Synthetic
acaaggtcactgttggcgcgcttgttgctaatgaggggtggaacgcctctgaagacgctctcactgcagtgatca

SEQ ID NO: 151187 - DNA, 75 bp, Artificial Sequence
  Synthetic
accagaaccttgagaccctacaggccttcccgccatcttgccagattagtgcttaccaccagttggctgaggagc

SEQ ID NO: 151188 - DNA, 75 bp, Artificial Sequence
  Synthetic
gttttgatgcctgggagcgtaaccatcgcccaggcgatgagctctacctcactgagcccgctgccgcatggtttg

SEQ ID NO: 151189 - DNA, 75 bp, Artificial Sequence
  Synthetic
gttgtggtgacgtatgagggtgatactagtgctggttataaccacgatgtctccaacctgcgctcctggattaga

SEQ ID NO: 151190 - DNA, 75 bp, Artificial Sequence
  Synthetic
ctcacggcagccccggagccatcacctatgccttatgtcccttacccccggtctaccgaggtctatgtccgatcg

SEQ ID NO: 151191 - DNA, 75 bp, Artificial Sequence
  Synthetic
ctatgccttatgtcccttacccccggtctaccgaggtctatgtccgatcgatcttcggcccgggtggtacccctt

SEQ ID NO: 151192 - DNA, 75 bp, Artificial Sequence
  Synthetic
gtccaggccactacgtgtgagttatatgaactggttgaggccatggtggagaagggccaggacggctcagccgtc

SEQ ID NO: 151193 - DNA, 75 bp, Artificial Sequence
  Synthetic
tgtgtggatgttgtttcgcaagtatatggtgttagtcctggcttggtacataacctgattggaatgcttcagact

SEQ ID NO: 151194 - DNA, 75 bp, Artificial Sequence
  Synthetic
gtggaatgaataacatgttcttttgctctgtgcatggagatgccaccatgcgctctcgggctcttctgtttctgc

SEQ ID NO: 151195 - DNA, 75 bp, Artificial Sequence
  Synthetic
tatcttttatggtgatgcttatgaggagtcggtgttcgctgcggccgtgtctggggcggggtcttgcatggtatt

SEQ ID NO: 151196 - DNA, 75 bp, Artificial Sequence
  Synthetic
tcccgtcgtggcactgctgcctaccctctcttgggctcgggtatataccaggtccctgttagccttagctttgat

SEQ ID NO: 151197 - DNA, 75 bp, Artificial Sequence
  Synthetic
ggaccgtggttccgtgccattgagaaagagatcttagccctgctcccacctaacattttctatggtgatgctttt

SEQ ID NO: 151198 - DNA, 75 bp, Artificial Sequence
  Synthetic
acataaccttatcggcatgctgcagactattgctgatggcaaggcccattttacagagactgttaaacctgtgct

SEQ ID NO: 151199 - DNA, 75 bp, Artificial Sequence
  Synthetic
ggtacataaccttattggtatgctacagactatagccgatgggaaggctcactttactgagactgttaaacctgt

SEQ ID NO: 151200 - DNA, 75 bp, Artificial Sequence
  Synthetic
gtgcgagctcatacgtggagcctaccctaaaatccagaccacgagccgtgtgctacggtccctgttttggaacga

SEQ ID NO: 151201 - DNA, 75 bp, Artificial Sequence
  Synthetic
ctactaatcttggttccggccctgtttctatctctgctgttggtgtcctcgcacctcactctgtgctggccgctt

SEQ ID NO: 151202 - DNA, 75 bp, Artificial Sequence
  Synthetic
tgctacggtccctgttttggaacgagccagctattggtcagaagctggtattcacgcaggctgctaaggctgcca

SEQ ID NO: 151203 - DNA, 75 bp, Artificial Sequence
  Synthetic
gtataatttgtccacgtccccgctcacgtcatctgttgcctcgggcactaatttggtcctctatgctgccccact

SEQ ID NO: 151204 - DNA, 75 bp, Artificial Sequence
  Synthetic
acgtcatctgttgcctcgggcactaatttggtcctctatgctgccccactgaatcctcttttaccccttcaggat

SEQ ID NO: 151205 - DNA, 75 bp, Artificial Sequence
  Synthetic
gatggcaccaatacccatatcatggcgactgaggcgtctaattacgcccagtatcgggttgttcgggccacaatc

SEQ ID NO: 151206 - DNA, 75 bp, Artificial Sequence
  Synthetic
gtgtgcctgggtccggcaagtcccgctctatcacccaagccgatgtggacgttgtcgtggtcccgacgcgtgagt

SEQ ID NO: 151207 - DNA, 75 bp, Artificial Sequence
  Synthetic
tatcgtccgctggtaccaaatgctgttggtggctatgctatttctatttccttttggccccagacaaccaccacc

SEQ ID NO: 151208 - DNA, 75 bp, Artificial Sequence
  Synthetic
aggtcggccatcaccgcccttctgtgataccccgcggtaaccctgatcagaatcttgggaccctacaggctttcc

SEQ ID NO: 151209 - DNA, 75 bp, Artificial Sequence
  Synthetic
gttgtcgtggtcccgacgcgtgagttgcgtaatgcctggcgccgtcgcggctttgctgctttcaccccgcatact

SEQ ID NO: 151210 - DNA, 75 bp, Artificial Sequence
  Synthetic
gataccccgcggtaaccctgatcagaatcttgggaccctacaggctttcccgccatcctgccagattagtgctta

SEQ ID NO: 151211 - DNA, 75 bp, Artificial Sequence
  Synthetic
ggtccagcccggcattgcctctgagttggtcattcccagtgagcgtctccactatcgtaatcaaggttggcgctc

SEQ ID NO: 151212 - DNA, 75 bp, Artificial Sequence
  Synthetic
cacatgcagcgggccgccaccgtccaccttcttggcgacccgaatcagatcccagccattgactttgagcacgct

SEQ ID NO: 151213 - DNA, 75 bp, Artificial Sequence
  Synthetic
ccaacgggttatccataatgaacttgaacagtactgtcgggcccgggctggtcgttgtctagaggttggggccca

SEQ ID NO: 151214 - DNA, 75 bp, Artificial Sequence
  Synthetic
gaacagtactgtcgggcccgggctggtcgttgtctagaggttggggcccacccaagatccattaatgacaaccca

SEQ ID NO: 151215 - DNA, 75 bp, Artificial Sequence
  Synthetic
ctcctggcattactactgccattgagcaagctgctctggctgcggccaattctgccctggcgaatgctgtggtgg

SEQ ID NO: 151216 - DNA, 75 bp, Artificial Sequence
  Synthetic
gaaattatatgaggcggcgcattcagatgttcgtgagtccttagccaggttcatccccactattgggcctgttca

SEQ ID NO: 151217 - DNA, 75 bp, Artificial Sequence
  Synthetic
cctgcggctaactgccgccgttctgccttgcgtggcctcccccctgctgatcgtacctattgttttgatggattc

SEQ ID NO: 151218 - DNA, 75 bp, Artificial Sequence
  Synthetic
aggacctgcattttactgggacgaatggcgttggcgaggtgggccgtggcatagccctaactttattcaaccttg

SEQ ID NO: 151219 - DNA, 75 bp, Artificial Sequence
  Synthetic
ctattattcatgcagtggcccccgattatagggttgagcagaacccaaagaggcttgaggcggcgtatcgggaga

SEQ ID NO: 151220 - DNA, 75 bp, Artificial Sequence
  Synthetic
ccttgcgtggcctcccccctgctgatcgtacctattgttttgatggattctcccgctgctcatttgctgcagaaa

SEQ ID NO: 151221 - DNA, 75 bp, Artificial Sequence
  Synthetic
gccctgacactgttcaatcttgctgatacgcttctcggcggtttaccgacagaattgatttcgtcggctgggggt

SEQ ID NO: 151222 - DNA, 75 bp, Artificial Sequence
  Synthetic
cacgcttgtatgccgcactacatctcccccctgaagtgctactaccacccggtacttaccatacaacttcatacc

SEQ ID NO: 151223 - DNA, 75 bp, Artificial Sequence
  Synthetic
agtgcaggctacaatcatgatgtttccatactccgtgcatggatccgcacaactaagatagtcggcgatcatccg

SEQ ID NO: 151224 - DNA, 75 bp, Artificial Sequence
  Synthetic
tctacggcgacgcctatgaggagtcagtgtttgccgccgctgtgtccggggcggggtcatgtatggtatttgaaa

SEQ ID NO: 151225 - DNA, 75 bp, Artificial Sequence
  Synthetic
ctcccgtgtggttatccaggactacgacaaccagcatgaacaggatcggcctactccctcacccgctccctctcg

SEQ ID NO: 151226 - DNA, 75 bp, Artificial Sequence
  Synthetic
atgccttacgttccatacccccggtcgacagaggtgtatgtccgctctatattcggccctggcgggtccccatcc

SEQ ID NO: 151227 - DNA, 75 bp, Artificial Sequence
  Synthetic
tggtgagcccggcacccttctttggaacaccgtctggaacatggcgatcatagcacattgctatgagttccgtga

SEQ ID NO: 151228 - DNA, 75 bp, Artificial Sequence
  Synthetic
tttggtgctactctggatgatcaggcgttttgctgttcacggcttatgacctacctccgcgggattagttacaag

SEQ ID NO: 151229 - DNA, 75 bp, Artificial Sequence
  Synthetic
cgcccgctcccttgattggtctaaagtcactctggatggccgccccctcactaccatccagcagtattctaagac

SEQ ID NO: 151230 - DNA, 75 bp, Artificial Sequence
  Synthetic
cgttttgctgttcacggcttatgacctacctccgcgggattagttacaaggtcactgttggcgcccttgtcgcta

SEQ ID NO: 151231 - DNA, 75 bp, Artificial Sequence
  Synthetic
gtcactctggatggccgccccctcactaccatccagcagtattctaagacattctacgtcctcccgctccgtggt

SEQ ID NO: 151232 - DNA, 75 bp, Artificial Sequence
  Synthetic
tcccgagcccatgctatagttgcacttacccgccacacagagaagtgcgtcattttagatgcccctggtttgctg

SEQ ID NO: 151233 - DNA, 75 bp, Artificial Sequence
  Synthetic
tgccttaattgcaggttgtgggctcaaattgaaggttgattatcgccctatcgggctgtatgctggggtggtggt

SEQ ID NO: 151234 - DNA, 75 bp, Artificial Sequence
  Synthetic
gttacctccgtactcaagctatatccaagggtatgcgtcgactggaggttgagcatgcccaaaaattcattacaa

SEQ ID NO: 151235 - DNA, 75 bp, Artificial Sequence
  Synthetic
caagggtatgcgtcgactggaggttgagcatgcccaaaaattcattacaagactttatagttggctgttcgagaa

SEQ ID NO: 151236 - DNA, 75 bp, Artificial Sequence
  Synthetic
tgaggatactgttgattaccccgcccgtgcccatacttttgatgatttctgcccggaatgtcgcgcccttggttt

SEQ ID NO: 151237 - DNA, 75 bp, Artificial Sequence
  Synthetic
tcatcttgacccaagggtgcttgtttttgatgagtctgtaccctgccgttgtaggacatttcttaagaaggctgt

SEQ ID NO: 151238 - DNA, 75 bp, Artificial Sequence
  Synthetic
gtaggacatttcttaagaaggctgtgggtaagttctgctgttttatgaagtggttgggacaggagtgcacctgct

SEQ ID NO: 151239 - DNA, 75 bp, Artificial Sequence
  Synthetic
cgatctgtggcctgccgatgttgctgaggctatggcccgccatggcatgacccggttgtatgcagccctccacct

SEQ ID NO: 151240 - DNA, 75 bp, Artificial Sequence
  Synthetic
ttaattaattctacctgtacccccttcgcaattctttttgctttatttctcttttctgcttttcgcgctccctgg

SEQ ID NO: 151241 - DNA, 75 bp, Artificial Sequence
  Synthetic
gaggctatggcccgccatggcatgacccggttgtatgcagccctccacctccccccagaagtgctgctccctccc

SEQ ID NO: 151242 - DNA, 75 bp, Artificial Sequence
  Synthetic
tgggatgccgcagtggctcatccgcctgtatcatcttataaggtccgcgtggatcttgcaggccccgaaggagtc

SEQ ID NO: 151243 - DNA, 75 bp, Artificial Sequence
  Synthetic
aggccgagcccgcccatctcgatgtttctgggacctatgccgtccatggccgtcaacttgaggccctgtatagag

SEQ ID NO: 151244 - DNA, 75 bp, Artificial Sequence
  Synthetic
ctagtgattgagcgggtccgggcagtaggctgtcattttgtgctccttctcacagccgcacctgagccgtcgcca

SEQ ID NO: 151245 - DNA, 75 bp, Artificial Sequence
  Synthetic
gtggttgacggcgcccatcttgaggcgaatggccccgagcagtacgttctttcgtttgatgcctctcgccagtcc

SEQ ID NO: 151246 - DNA, 75 bp, Artificial Sequence
  Synthetic
cctggattctgcaggcgccgaaggagtctcttaaaggtttctggaagaagcactctggtgagcctggcacccttc

SEQ ID NO: 151247 - DNA, 75 bp, Artificial Sequence
  Synthetic
ctggattgcactgcaacattccccccgggcggggcccctagtgctgctccggaggaggtagcagccttttgcagt

SEQ ID NO: 151248 - DNA, 75 bp, Artificial Sequence
  Synthetic
ccctgtacctgatgtagattcacgtggcgctattctgcgtcgccagtataatttgtccacgtctccgcttacgtc

SEQ ID NO: 151249 - DNA, 75 bp, Artificial Sequence
  Synthetic
cgggcggggcccctagtgctgctccggaggaggtagcagccttttgcagtgctctttacaggtataacaggttca

SEQ ID NO: 151250 - DNA, 75 bp, Artificial Sequence
  Synthetic
ctgggcacctctgggagtctgctaaccctttttgtggggagggaaccttgtacacccggacatggtcaacatctg

SEQ ID NO: 151251 - DNA, 75 bp, Artificial Sequence
  Synthetic
tacacccggacatggtcaacatctggtttttctagtgacttctccccccctgaggcagccgccgcagcgccggct

SEQ ID NO: 151252 - DNA, 75 bp, Artificial Sequence
  Synthetic
cgtcagttgcagttttatgcccaatgccgtcggtggttatctgccggcttccaccttgaccctcgtgtgcttgtt

SEQ ID NO: 151253 - DNA, 75 bp, Artificial Sequence
  Synthetic
taacctcgacggatgttcgtattctagtccagcccggcatagcctctgagcttgtgatcccaagcgagcgcctac

SEQ ID NO: 151254 - DNA, 75 bp, Artificial Sequence
  Synthetic
caggttggcacagcgcccgctccccctgcccctgcgcccgctcaaccatccaaccccgccgggccaaaggccccc

SEQ ID NO: 151255 - DNA, 75 bp, Artificial Sequence
  Synthetic
cgtaatcaaggctggcgctctgttgagaccacgggtgtggctgaggaggaggctacttccggtctggtaatgctt

SEQ ID NO: 151256 - DNA, 75 bp, Artificial Sequence
  Synthetic
caaccccgccgggccaaaggcccccgtgcgtaagctgccaatgcttcgagggttaacgaatgttgcgcaggtatg

SEQ ID NO: 151257 - DNA, 75 bp, Artificial Sequence
  Synthetic
ttctggatcttacattgtcactggtagtcagttacagcccctttatcaggcgcttggtattccttctgaccttgc

SEQ ID NO: 151258 - DNA, 75 bp, Artificial Sequence
  Synthetic
caccggctgcgccgcggtgccgacggtaccgctgagcttactgccactgcagccacacgtttcatgaaagatctg

SEQ ID NO: 151259 - DNA, 75 bp, Artificial Sequence
  Synthetic
caaaggcccccgtgcgtaagctgccaatgccaccatccccgcgcacccgccgccttctttacacctatccggatg

SEQ ID NO: 151260 - DNA, 75 bp, Artificial Sequence
  Synthetic
gtttgagtctgactgtgattggctggttaatgcgtcgaatcccggccatcgccctggaggcggcctttgccatgc

SEQ ID NO: 151261 - DNA, 75 bp, Artificial Sequence
  Synthetic
gccctggaggcggcctttgccatgccttctaccaacgctaccccgagtctttccacccaactgagttcattatgc

SEQ ID NO: 151262 - DNA, 75 bp, Artificial Sequence
  Synthetic
ataaccccaagaggcttgaggcggcataccgagagacttgctctcgccgcggtaccgccgcctacccactcctcg

SEQ ID NO: 151263 - DNA, 75 bp, Artificial Sequence
  Synthetic
tgaggataccttggattaccctgcccgcgcccatacttttgatgatttctgcccagagtgccgcccccttggcct

SEQ ID NO: 151264 - DNA, 75 bp, Artificial Sequence
  Synthetic
cagcctcagctttgacgcttgggagcgtaaccaccgccccggggatgagctctacctaaccgacctcgccgctac

SEQ ID NO: 151265 - DNA, 75 bp, Artificial Sequence
  Synthetic
gggtacgaccagactacgtatgggtcgtctaccaaccctatgtatgtctccgatactgtcacatttgttaatgtg

SEQ ID NO: 151266 - DNA, 75 bp, Artificial Sequence
  Synthetic
ggttctctagctgcttctccccgcttgagccttgcgccccgggtttgtcaccgcccgttgagactgacgtgcctg

SEQ ID NO: 151267 - DNA, 75 bp, Artificial Sequence
  Synthetic
atgcggcccgtacagccaacctagcactggagatcgatgctgctacggaggtcggccgggcttgtgccggctgcg

SEQ ID NO: 151268 - DNA, 75 bp, Artificial Sequence
  Synthetic
ctgaggtgctctggaaccatcctattcagcgggttatccataatgagctggagcaatactgccgggctcgggcag

SEQ ID NO: 151269 - DNA, 75 bp, Artificial Sequence
  Synthetic
cagttagtcctggggttgtgcactatcagtttactgctggggtcccaggttcggggaagtcgcgctctatacagc

SEQ ID NO: 151270 - DNA, 75 bp, Artificial Sequence
  Synthetic
attcagcagtactctaagacattttatgttctcccgctccgcgggaagttgtccttctgggaggctggcacaact

SEQ ID NO: 151271 - DNA, 75 bp, Artificial Sequence
  Synthetic
tcagcgggttatccataatgagctggagcaatactgccgggctcgggcaggtcgttgcctagaagtaggggccca

SEQ ID NO: 151272 - DNA, 75 bp, Artificial Sequence
  Synthetic
atgttctcccgctccgcgggaagttgtccttctgggaggctggcacaactaaggccggctacccgtacaattata

SEQ ID NO: 151273 - DNA, 75 bp, Artificial Sequence
  Synthetic
ttacacctcatacggcggcccgtgtcaccacgggccgtcgtgttgtgattgatgaggccccatccctcccaccgc

SEQ ID NO: 151274 - DNA, 75 bp, Artificial Sequence
  Synthetic
ctggtattccgcccccacccgcggccctgcggctaactgccgccgctccgctttgcgtggcctcccccccgtcga

SEQ ID NO: 151275 - DNA, 75 bp, Artificial Sequence
  Synthetic
gccttggtgccggccctacctcgatctccgcggtcggtgtattagccccacacacggcccttgctgttcttgagg

SEQ ID NO: 151276 - DNA, 75 bp, Artificial Sequence
  Synthetic
caccacgggccgtcgtgttgtgattgatgaggccccatccctcccaccgcatttgttgctactacacatgcagcg

SEQ ID NO: 151277 - DNA, 75 bp, Artificial Sequence
  Synthetic
cctgcggctaactgccgccgctccgctttgcgtggcctcccccccgtcgatcgcacttactgttttgacggtttt

SEQ ID NO: 151278 - DNA, 75 bp, Artificial Sequence
  Synthetic
cgcaatacgtcctgagcttgcgcccaccagttggtggcatgtcacccatcgctgccccgctgacgtgtgcgagct

SEQ ID NO: 151279 - DNA, 75 bp, Artificial Sequence
  Synthetic
gaagccatggcccggcacgggatgacacgcctgtatgccgcactacatctcccccctgaggtgttgctaccaccc

SEQ ID NO: 151280 - DNA, 75 bp, Artificial Sequence
  Synthetic
cgcgcccatacttttgatgatttttgtccggaatgtcgcaccctcggtttgcagggttgcgctttccagtccact

SEQ ID NO: 151281 - DNA, 75 bp, Artificial Sequence
  Synthetic
gctgccccgctgacgtgtgcgagcttatacgcggggcctatcccaaaatccaaaccactagccgcgtgctgcggt

SEQ ID NO: 151282 - DNA, 75 bp, Artificial Sequence
  Synthetic
taattccttttgtgcccccttcgtagtttccctttggttttatttcttatttctgcttttcgcgctccctggaaa

SEQ ID NO: 151283 - DNA, 75 bp, Artificial Sequence
  Synthetic
cacgcctgtatgccgcactacatctcccccctgaggtgttgctaccacccggtacctaccacacaacttcgtacc

SEQ ID NO: 151284 - DNA, 75 bp, Artificial Sequence
  Synthetic
ccatacttcgagcatggattcgcacaaccaagatagttggtgaccacccattggtaatagagcgtgtgcgggcta

SEQ ID NO: 151285 - DNA, 75 bp, Artificial Sequence
  Synthetic
cgattacagtccacgaggcccagggcgctactttcacggagactacaatcatagccacggctgatgctagggggc

SEQ ID NO: 151286 - DNA, 75 bp, Artificial Sequence
  Synthetic
cgctactttcacggagactacaatcatagccacggctgatgctagggggctcatccaatcttcccgagcccatgc

SEQ ID NO: 151287 - DNA, 75 bp, Artificial Sequence
  Synthetic
aaccaagatagttggtgaccacccattggtaatagagcgtgtgcgggctattggttgtcactttgtgctgctgct

SEQ ID NO: 151288 - DNA, 75 bp, Artificial Sequence
  Synthetic
atttggtcctggtgggtccccgtctctgttcccgtcagcttgctctactaaatccacatttcatgccgtcccggt

SEQ ID NO: 151289 - DNA, 75 bp, Artificial Sequence
  Synthetic
atcggatgtgattgtcaacaattttttcctcgccggcggggaggtgggtcaccatcgcccctctgtgataccccg

SEQ ID NO: 151290 - DNA, 75 bp, Artificial Sequence
  Synthetic
ccagcgggtcatacataatgagcttgagcaatactgccgagcccgtgctggccgctgtttagaggtgggcgctca

SEQ ID NO: 151291 - DNA, 75 bp, Artificial Sequence
  Synthetic
gccgctgtttagaggtgggcgctcatccaagatccatcaatgacaatcccaatgtcctgcaccggtgctttctcc

SEQ ID NO: 151292 - DNA, 75 bp, Artificial Sequence
  Synthetic
ctgttcccgtcagcttgctctactaaatccacatttcatgccgtcccggttcatatctgggatcggcttatgctt

SEQ ID NO: 151293 - DNA, 75 bp, Artificial Sequence
  Synthetic
acactacaggcctttccaccttcctgccagattagtgcctaccaccagctagctgaggaacttggccaccgccca

SEQ ID NO: 151294 - DNA, 75 bp, Artificial Sequence
  Synthetic
gccagattagtgcctaccaccagctagctgaggaacttggccaccgcccagctcccgtcgccgctgtcttgcccc

SEQ ID NO: 151295 - DNA, 75 bp, Artificial Sequence
  Synthetic
gtcactgtaggtgccctcgttgctaacgaggggtggaatgcctcggaggacgcccttacagctgttattactgca

SEQ ID NO: 151296 - DNA, 75 bp, Artificial Sequence
  Synthetic
acgaggggtggaatgcctcggaggacgcccttacagctgttattactgcagcgtatctgaccatttgccaccagc

SEQ ID NO: 151297 - DNA, 75 bp, Artificial Sequence
  Synthetic
cgctacgtggtttgccccctgtcgaccgcacatattgcttcgatgggttctcccgctgcgcctttgctgctgaga

SEQ ID NO: 151298 - DNA, 75 bp, Artificial Sequence
  Synthetic
aactcacggacatagtccactgccggatggccgcccccagccagcggaaggccgtcctatcgacgctcgtgggta

SEQ ID NO: 151299 - DNA, 75 bp, Artificial Sequence
  Synthetic
gatggccgcccccagccagcggaaggccgtcctatcgacgctcgtgggtaggtatggccgtcggacgaagctgta

SEQ ID NO: 151300 - DNA, 75 bp, Artificial Sequence
  Synthetic
gactttatagttggttatttgagaagtctggccgtgattacatccccggccgccagctccagttttacgcacagt

SEQ ID NO: 151301 - DNA, 75 bp, Artificial Sequence
  Synthetic
agatgtcctgccgatgtctgcgagctgattcgtggcgcatacccaaagatccaaactgctagccgtgtcctccgc

SEQ ID NO: 151302 - DNA, 75 bp, Artificial Sequence
  Synthetic
gaggccatggctcgccacgggatgacgcgcctgtatgctgccctccacctacctcctgaggtcctgctaccacct

SEQ ID NO: 151303 - DNA, 75 bp, Artificial Sequence
  Synthetic
gtctggccgtgattacatccccggccgccagctccagttttacgcacagtgccgccgctggttgtcagcaggctt

SEQ ID NO: 151304 - DNA, 75 bp, Artificial Sequence
  Synthetic
gtgtgagttatatgagctggttgaggccatggtggagaaaggtcaggatggctctgccgtgcttgagctcgacct

SEQ ID NO: 151305 - DNA, 75 bp, Artificial Sequence
  Synthetic
aggtaaattctgttgctttatgaagtggttagggcaggagtgcacctgtttcctggagccggcagagggtctagt

SEQ ID NO: 151306 - DNA, 75 bp, Artificial Sequence
  Synthetic
ttgcaatcgtgatgtatcgcgtatcacatttttccagaaagattgtaacaaattcaccacaggggagaccattgc

SEQ ID NO: 151307 - DNA, 75 bp, Artificial Sequence
  Synthetic
tggttagggcaggagtgcacctgtttcctggagccggcagagggtctagttggcgaccacggtcatgataatgag

SEQ ID NO: 151308 - DNA, 75 bp, Artificial Sequence
  Synthetic
cgccagctcgaggccctgtatagggcccttaacatcccacatgacattgccgctcgggcgtctcgcttaactgcc

SEQ ID NO: 151309 - DNA, 75 bp, Artificial Sequence
  Synthetic
tattgaaaaagaaatactagccctgctcccacctaatattttctacggcgacgcatacgaggagtctgtgtttgc

SEQ ID NO: 151310 - DNA, 75 bp, Artificial Sequence
  Synthetic
cccttaacatcccacatgacattgccgctcgggcgtctcgcttaactgccactgttgagcttgttgcaggcccgg

SEQ ID NO: 151311 - DNA, 75 bp, Artificial Sequence
  Synthetic
cttctcccttggtctcgagtgtgtagtcatggaggaatgtggcatgccccagtggctaatccggttgtaccattt

SEQ ID NO: 151312 - DNA, 75 bp, Artificial Sequence
  Synthetic
caaatggccccgagcagtatgttctctcgtttgatgcctctcgtcagtctatgggagccgggccgcataacctca

SEQ ID NO: 151313 - DNA, 75 bp, Artificial Sequence
  Synthetic
ctcgtttgatgcctctcgtcagtctatgggagccgggccgcataacctcacatacgagctcacctccgctggttt

SEQ ID NO: 151314 - DNA, 75 bp, Artificial Sequence
  Synthetic
ggtccggtcggcctggatcctacaggcgccgaaggagtctctcaagggattttggaagaagcattctggtgagcc

SEQ ID NO: 151315 - DNA, 75 bp, Artificial Sequence
  Synthetic
tttggaagaagcattctggtgagcccggcaccctcctctggaacactgtttggaatatggcgatcatagcacatt

SEQ ID NO: 151316 - DNA, 75 bp, Artificial Sequence
  Synthetic
gctacctacgaacacaggctatttccaaaggcatgcgtcggctagaggttgagcatgcccaaaagtttatcacaa

SEQ ID NO: 151317 - DNA, 75 bp, Artificial Sequence
  Synthetic
gagcatgcccaaaagtttatcacaaggttatatagttggctgtttgaaaagtcaggccgcgactacatccccggt

SEQ ID NO: 151318 - DNA, 75 bp, Artificial Sequence
  Synthetic
gctatgaatttcgtgattttagagttgccgctttcaagggagatgattccgtggtcctctgtagcgattaccgtc

SEQ ID NO: 151319 - DNA, 75 bp, Artificial Sequence
  Synthetic
gggggaggtagctgcgttttgcagcgccctttataggtataacaggttcacccagcggcactcgcttacgggcgg

SEQ ID NO: 151320 - DNA, 75 bp, Artificial Sequence
  Synthetic
tgccgctttcaagggagatgattccgtggtcctctgtagcgattaccgtcagagccgcaatgcagcggccctgat

SEQ ID NO: 151321 - DNA, 75 bp, Artificial Sequence
  Synthetic
tcacaagttttgctgctttatgcggtggctgggtcaagactgcacctgttttctccagcccattgaggggagggt

SEQ ID NO: 151322 - DNA, 75 bp, Artificial Sequence
  Synthetic
ccctgcagcgaactgccgccggtcggccctccgtgggcttccacctgttgaccggacgtattgttttgacggctt

SEQ ID NO: 151323 - DNA, 75 bp, Artificial Sequence
  Synthetic
tttgacgaagcggtcccttgccgctgccggagctttctaaagaaggctgctgggaaattttgttgttttatgaaa

SEQ ID NO: 151324 - DNA, 75 bp, Artificial Sequence
  Synthetic
gccctttataggtataacaggttcacccagcggcactcgcttacgggcggtttgtggctgcaccctgaggggctg

SEQ ID NO: 151325 - DNA, 75 bp, Artificial Sequence
  Synthetic
cctagggacgctacccgatgtggtgcgctttgccggccggctgtctgagaagaactggggccctgggccggagcg

SEQ ID NO: 151326 - DNA, 75 bp, Artificial Sequence
  Synthetic
aacattctttcagaaggattgtaataaatttacaacaggcgagacgatagcacacggcaaagttgggcaggggat

SEQ ID NO: 151327 - DNA, 75 bp, Artificial Sequence
  Synthetic
tacacgcggacttggtctacatctggtttctctagtgattttgcccccccggaggcggctgttcctgcaccggcc

SEQ ID NO: 151328 - DNA, 75 bp, Artificial Sequence
  Synthetic
tggtgactgtggccatgacaacgaggcctatgaggggtctgaggtggaccccgccgagcctgctcaccttgacgt

SEQ ID NO: 151329 - DNA, 75 bp, Artificial Sequence
  Synthetic
ttccgggtcatatatcgtcaccggccgtcagctgcagcctttataccgagcacttggcataccatctgaccttgc

SEQ ID NO: 151330 - DNA, 75 bp, Artificial Sequence
  Synthetic
atgttgcgcaggtatgtgttgatgttgtatcccgagtttacggggttagccctgggctggtacataaccttattg

SEQ ID NO: 151331 - DNA, 75 bp, Artificial Sequence
  Synthetic
gtttctctagtgattttgcccccccggaggcggctgttcctgcaccggccgctattctggggccacctcgttcta

SEQ ID NO: 151332 - DNA, 75 bp, Artificial Sequence
  Synthetic
tcgcccctgagcccgctcaaccgcccaacccggccaaatctgagacccctgtgcgtaggccgtcaacacaactgc

SEQ ID NO: 151333 - DNA, 75 bp, Artificial Sequence
  Synthetic
caacccggccaaatctgagacccctgtgcgtaggccgtcaacacaactgctccatcgcactcgtcgcctccttta

SEQ ID NO: 151334 - DNA, 75 bp, Artificial Sequence
  Synthetic
gccgactcgagtgtcgtacggtgcttgggaataagacttttcgtacatcgataactgatggtgcccacctcgaag

SEQ ID NO: 151335 - DNA, 75 bp, Artificial Sequence
  Synthetic
atggctgctggcccgcacagccttagctacactctaacatctgcaggccttgaagtgcatattatttctgctggg

SEQ ID NO: 151336 - DNA, 75 bp, Artificial Sequence
  Synthetic
tcacagctgcacctgagccgtcgccaatgccctatgttccataccctcgttctaccgaggtctatgtccggtcca

SEQ ID NO: 151337 - DNA, 75 bp, Artificial Sequence
  Synthetic
aaaccctggccatcgccctgggggcggtctttgccatgccttttaccagcgctaccctgagtcgtttcacccaac

SEQ ID NO: 151338 - DNA, 75 bp, Artificial Sequence
  Synthetic
ggtctttgccatgccttttaccagcgctaccctgagtcgtttcacccaactgagttcattatgcgtgatggtctt

SEQ ID NO: 151339 - DNA, 75 bp, Artificial Sequence
  Synthetic
cgtatgaacttgtccctgccggtttgcaggtcaaaatatcttctaatggcttggattgtaccgctatattccccc

SEQ ID NO: 151340 - DNA, 75 bp, Artificial Sequence
  Synthetic
tcagcccttcgccctcccctatattcatccaaccaacccctttgccgccgatgtcgtaccgcaatccggggctag

SEQ ID NO: 151341 - DNA, 75 bp, Artificial Sequence
  Synthetic
aggcttgaggcggcgtatcgagagacctgctcccgccgtggtaccgccgcctacccacttctgggttcgggtata

SEQ ID NO: 151342 - DNA, 75 bp, Artificial Sequence
  Synthetic
tggcttgaggcggcgtatcgagagacctgctcccgccgtggtaccgccgcctacccacttctgggttcgggtata

SEQ ID NO: 151343 - DNA, 75 bp, Artificial Sequence
  Synthetic
cggcttgaggcggcgtatcgagagacctgctcccgccgtggtaccgccgcctacccacttctgggttcgggtata

SEQ ID NO: 151344 - DNA, 75 bp, Artificial Sequence
  Synthetic
gggcttgaggcggcgtatcgagagacctgctcccgccgtggtaccgccgcctacccacttctgggttcgggtata

SEQ ID NO: 151345 - DNA, 75 bp, Artificial Sequence
  Synthetic
gccctatacaggtacaataggttcacccagcgccattcgctgaccggcgggctgtggctgcaccctgaggggctt

SEQ ID NO: 151346 - DNA, 75 bp, Artificial Sequence
  Synthetic
cccagcgccattcgctgaccggcgggctgtggctgcaccctgaggggcttcttggcctgttcccccctttctctc

SEQ ID NO: 151347 - DNA, 75 bp, Artificial Sequence
  Synthetic
ggtggactttaggcctattgggctctatgctggtgttgttgtggccccgggtctcgggacccttcctgatgtcgt

SEQ ID NO: 151348 - DNA, 75 bp, Artificial Sequence
  Synthetic
acgtcgtcgatctgccccagccggggctgcgccgctgactgccgtttcacctgctcccgacacagctcctgtacc

SEQ ID NO: 151349 - DNA, 75 bp, Artificial Sequence
  Synthetic
tacactcgcacttggtctgtgtcgggcttttccagctgtttttctcccctcgagcctcgcgccccggagctccca

SEQ ID NO: 151350 - DNA, 75 bp, Artificial Sequence
  Synthetic
ccccttttgcggtgagagcacactttatacgcgaacttggtctacatctggtttctctagcgacttctctccacc

SEQ ID NO: 151351 - DNA, 75 bp, Artificial Sequence
  Synthetic
ctaataagccgacacagccggcccttacaataacagaagacacagctcgcacggctaacctagcattggagattg

SEQ ID NO: 151352 - DNA, 75 bp, Artificial Sequence
  Synthetic
tgatgttgactcgcgcggcgccatactgcgacgccagtacaatttatccacatccccgctcacatcatctgttgc

SEQ ID NO: 151353 - DNA, 75 bp, Artificial Sequence
  Synthetic
acccccggtcgcgtggcgcccccgccagacttggttgatggtggcgctagccctggcctgactagtgtctctgtg

SEQ ID NO: 151354 - DNA, 75 bp, Artificial Sequence
  Synthetic
cctgctcccgccgtggtaccgccgcctacccacttctgggttcgggtatataccaggtccccgtcggccttagtt

SEQ ID NO: 151355 - DNA, 75 bp, Artificial Sequence
  Synthetic
cagacttggttgatggtggcgctagccctggcctgactagtgtctctgtggaacccccggcgtctgcgcagcctg

SEQ ID NO: 151356 - DNA, 75 bp, Artificial Sequence
  Synthetic
cccttcaggatggcactaacactcatatcatggccactgaggcatctaattatgcccagtatcgggttgtccgag

SEQ ID NO: 151357 - DNA, 75 bp, Artificial Sequence
  Synthetic
ggtgcttccgccgccctctgagaggtcggcgatcgcaccgtcacccgtagccccggttagtaagccagctaaccc

SEQ ID NO: 151358 - DNA, 75 bp, Artificial Sequence
  Synthetic
gggattgtgcactaccaatttaccgctggggttccaggttcagggaagtcaagatccatacagcagggggatgtt

SEQ ID NO: 151359 - DNA, 75 bp, Artificial Sequence
  Synthetic
gccaagtcttactacacccaggccccctgcccgtgagccgcccacaccaccaccggctctaactccggtcagtga

SEQ ID NO: 151360 - DNA, 75 bp, Artificial Sequence
  Synthetic
gccaaatgctgtcggcggctatgcaatatccatctcattctggcctcagactactactacccccacgtctgttga

SEQ ID NO: 151361 - DNA, 75 bp, Artificial Sequence
  Synthetic
taatgcctctaacccgggccaccgccctggtggtggcctttgtcatgcattttaccagcggttcccagagtcctt

SEQ ID NO: 151362 - DNA, 75 bp, Artificial Sequence
  Synthetic
tttaccagcggttcccagagtccttcgaccccgctgagttcattatgtccgacgggtttgcggcctataccctga

SEQ ID NO: 151363 - DNA, 75 bp, Artificial Sequence
  Synthetic
gccgtgttgtgattgatgaggccccatctctcccaccgcacttgttgctgttgcatatgcagcgggcttcgtctg

SEQ ID NO: 151364 - DNA, 75 bp, Artificial Sequence
  Synthetic
tcgccggctcctttacacataccctgatggggccaaggtgtatgcaggttctttgttcgagtcagattgtgattg

SEQ ID NO: 151365 - DNA, 75 bp, Artificial Sequence
  Synthetic
tgagcgcctccattatcgtaaccagggctggcgctctgtggagacctctggcgtggctgaagaggaggctacttc

SEQ ID NO: 151366 - DNA, 75 bp, Artificial Sequence
  Synthetic
tagccagctacagcccttttatcaggcgctcggcatcccttctgaccttgctgcccgagccagtcggcttaccgc

SEQ ID NO: 151367 - DNA, 75 bp, Artificial Sequence
  Synthetic
caccgtcctggcggtggtctctgccatgcattttaccagcgtttcccggaatcgttccatccgactgattttgtt

SEQ ID NO: 151368 - DNA, 75 bp, Artificial Sequence
  Synthetic
ctgagctagcacctaccagttggtggcacgtcacacaccgatgccctgctgatgtgtgcgagctcatacgtggag

SEQ ID NO: 151369 - DNA, 75 bp, Artificial Sequence
  Synthetic
cggtttggtaatgctttgtatccatggctctcctgttaattcctacaccaataccccctataccggggcgcttgg

SEQ ID NO: 151370 - DNA, 75 bp, Artificial Sequence
  Synthetic
ctggggcttcgccgttaacggctgtggctccggcccctgacaccgccccagttcctgatgttgattctcgtggcg

SEQ ID NO: 151371 - DNA, 75 bp, Artificial Sequence
  Synthetic
taggcaacaagacttttaaaacagttcttactgatggtgcccagttagaggctaatgggccagagcaatatgtgc

SEQ ID NO: 151372 - DNA, 75 bp, Artificial Sequence
  Synthetic
acaccaacactcgtgtgtcccggtatacaagcacagcccgtcatcggctgcgccgcggtgctgatggcaccgccg

SEQ ID NO: 151373 - DNA, 75 bp, Artificial Sequence
  Synthetic
gcacgtcacacaccgatgccctgctgatgtgtgcgagctcatacgtggagcctacccgaaaatccagaccaccag

SEQ ID NO: 151374 - DNA, 75 bp, Artificial Sequence
  Synthetic
cgctaaccctggtgcaatcacagtccatgaagctcaaggcgccactttcacggagaccacagttatagctacggc

SEQ ID NO: 151375 - DNA, 75 bp, Artificial Sequence
  Synthetic
catgaagctcaaggcgccactttcacggagaccacagttatagctacggctgatgctaggggccttattcaatct

SEQ ID NO: 151376 - DNA, 75 bp, Artificial Sequence
  Synthetic
ccctgctttgactattactgaggacacggcgcgcacggcgaacctagcactagagttggacgcggccaccgaggt

SEQ ID NO: 151377 - DNA, 75 bp, Artificial Sequence
  Synthetic
tacaagcacagcccgtcatcggctgcgccgcggtgctgatggcaccgccgaacttaccaccacagcggccacgcg

SEQ ID NO: 151378 - DNA, 75 bp, Artificial Sequence
  Synthetic
ggagcgcaatcaccgtccaggcgatgaactatatcttactgagccagctgccgcctggttcgaggccaataagcc

SEQ ID NO: 151379 - DNA, 75 bp, Artificial Sequence
  Synthetic
cggcaaatcccggtcgatccaacagggcgatgtggatgtaatagtggtaccaacccgcgagctacgcaattcgtg

SEQ ID NO: 151380 - DNA, 75 bp, Artificial Sequence
  Synthetic
cgcgaagttggcatttcggatataattgtcaacaatttctttcttgctggcggggaggtgggtcaccatcgcccc

SEQ ID NO: 151381 - DNA, 75 bp, Artificial Sequence
  Synthetic
ttgtcaacaatttctttcttgctggcggggaggtgggtcaccatcgcccctctgtgatacctcgcggtaaccccg

SEQ ID NO: 151382 - DNA, 75 bp, Artificial Sequence
  Synthetic
ttgcgcttgagattgactctgctactgaggtgggccgagcttgcgccggctgtactattaaccccgggattgtcc

SEQ ID NO: 151383 - DNA, 75 bp, Artificial Sequence
  Synthetic
tgaagccccctcgctcccaccgcacctgcttctgctgcacatgcagcgggcctcgtcagttcatcttcttggtga

SEQ ID NO: 151384 - DNA, 75 bp, Artificial Sequence
  Synthetic
gggttctctagctgcttttccccgtttgagccccgtgccccggatttgtcaccgcctgttgagactgacatgcct

SEQ ID NO: 151385 - DNA, 75 bp, Artificial Sequence
  Synthetic
tcggccaccgcccggcccctgtcgccgctgttttgcctccctgccctgagcttgaacagggcttgttatatatgc

SEQ ID NO: 151386 - DNA, 75 bp, Artificial Sequence
  Synthetic
ttgtgccaactcgtgagcttcgtaacagttggcggcgccgcggctttgctgcttttacaccccacacagcagctc

SEQ ID NO: 151387 - DNA, 75 bp, Artificial Sequence
  Synthetic
cgctgttttgcctccctgccctgagcttgaacagggcttgttatatatgccgcaggagctcacggtgtctgatag

SEQ ID NO: 151388 - DNA, 75 bp, Artificial Sequence
  Synthetic
agcctccgaacgggcggccccttcactaaacctagctgatagcggtgctgtttcggccctatcggacgccgccgt

SEQ ID NO: 151389 - DNA, 75 bp, Artificial Sequence
  Synthetic
agctcgagtttcgtaatctaacacctggcaatacgaacactcgtgtctcccgttattctagcagtgcacgccaca

SEQ ID NO: 151390 - DNA, 75 bp, Artificial Sequence
  Synthetic
agcgggcctcatcggttcatcttcttggtgaccccaaccagatccctgccattgactttgagcatgccggtttgg

SEQ ID NO: 151391 - DNA, 75 bp, Artificial Sequence
  Synthetic
gacgcttgtggggaggtatggtcgtaggacgaaactgtatgaggcagctcactcagatgtccgtgagtccctggc

SEQ ID NO: 151392 - DNA, 75 bp, Artificial Sequence
  Synthetic
tggtgaccccaaccagatccctgccattgactttgagcatgccggtttggtcccagcgattcgccccgaactagc

SEQ ID NO: 151393 - DNA, 75 bp, Artificial Sequence
  Synthetic
aggacgaaactgtatgaggcagctcactcagatgtccgtgagtccctggctaggttcatccccaccatcgggccc

SEQ ID NO: 151394 - DNA, 75 bp, Artificial Sequence
  Synthetic
attcaatcttctagagctcatgccatcgtggccctgactcgtcacacggagaaatgtgtggtggttgatgctcca

SEQ ID NO: 151395 - DNA, 75 bp, Artificial Sequence
  Synthetic
gattcagacgaccagccgtgtgttgagatctttattttggaacgagcctgcggtgggtcagaggctggttttcac

SEQ ID NO: 151396 - DNA, 75 bp, Artificial Sequence
  Synthetic
cttgagcttgacctttgcaaccgtgacgtatcacgtatcacatttttccaaaaagattgcaacaagtttactacc

SEQ ID NO: 151397 - DNA, 75 bp, Artificial Sequence
  Synthetic
tccacgtataccaccagcttgggcgctggccctgtgtctgtttctgcagtcggtgttttagccccacattcggct

SEQ ID NO: 151398 - DNA, 75 bp, Artificial Sequence
  Synthetic
cggtgggtcagaggctggttttcacgcaggctgccaaagcggccaaccccggcgcaatcactgtccatgaagccc

SEQ ID NO: 151399 - DNA, 75 bp, Artificial Sequence
  Synthetic
cggtgttttagccccacattcggctcttgcagtccttgaagacactattgactactctgcccgtgcccacacttt

SEQ ID NO: 151400 - DNA, 75 bp, Artificial Sequence
  Synthetic
aaggtgccacgttcactgagactactatcatagccacggccgacgctagaggtcttattcaatcttcccgcgcac

SEQ ID NO: 151401 - DNA, 75 bp, Artificial Sequence
  Synthetic
tatcatagccacggccgacgctagaggtcttattcaatcttcccgcgcacatgccatcgttgcgcttactcgcca

SEQ ID NO: 151402 - DNA, 75 bp, Artificial Sequence
  Synthetic
aaatactgaccctgcttccgcctaacatcttttatggcgacgcatatgaggagtctgtgttcgcagctgctgtgt

SEQ ID NO: 151403 - DNA, 75 bp, Artificial Sequence
  Synthetic
acgtatcacgtatcacatttttccaaaaagattgcaacaagtttactaccggggagaccatcgcccacggcaagg

SEQ ID NO: 151404 - DNA, 75 bp, Artificial Sequence
  Synthetic
gcaccatcagcagcaacgtcgatacgcttgatgcatttcccccttcttgccagtttagtgcgtaccaccagttgg

SEQ ID NO: 151405 - DNA, 75 bp, Artificial Sequence
  Synthetic
acccgggagttttaatcaatttcctttgtgcccccttcatagcttttgctttatttcttttttctgcgtttcgcg

SEQ ID NO: 151406 - DNA, 75 bp, Artificial Sequence
  Synthetic
agcacccagaataacttctcccttggccttgagtgtgtagttatggaggaatgtggcatgcctcagtggctaatt

SEQ ID NO: 151407 - DNA, 75 bp, Artificial Sequence
  Synthetic
atcggacagtgtcctcacctttgaactaactgacatcgtgcactgccgtatggcggcacccagccagcgtaaggc

SEQ ID NO: 151408 - DNA, 75 bp, Artificial Sequence
  Synthetic
tcctgtcaaatcagtgcctaccaccagctggctgaggagctgggccaccgaccggccccagtggccgccgtcctg

SEQ ID NO: 151409 - DNA, 75 bp, Artificial Sequence
  Synthetic
tccgccttggcgaatgctgtggtggtccggccgtttttatctcgtgttcaaactgagatccttattaacctgatg

SEQ ID NO: 151410 - DNA, 75 bp, Artificial Sequence
  Synthetic
cccccctgccctgagcttgagcaggggctactctacatgccgcaggagcttacggtgtccgatagcgtcctaatt

SEQ ID NO: 151411 - DNA, 75 bp, Artificial Sequence
  Synthetic
gtccctgaaccactttattcctgagcttggccctattaacgttaccacctgcgagctctatgagcttgtagaggc

SEQ ID NO: 151412 - DNA, 75 bp, Artificial Sequence
  Synthetic
tctggaacaccgtctggaatatggcgatcatagcgcattgctatgagtttcgcgactttagggttgccgcattta

SEQ ID NO: 151413 - DNA, 75 bp, Artificial Sequence
  Synthetic
tatggtggagaagggccaagacggctctgcggtcttggagcttgacttatgcaatcgtgatgtgtcccggataac

SEQ ID NO: 151414 - DNA, 75 bp, Artificial Sequence
  Synthetic
ctacacacctcatactgcggcccgtgtcacccgtggccgcaggattgttattgatgaggccccatcgcttccacc

SEQ ID NO: 151415 - DNA, 75 bp, Artificial Sequence
  Synthetic
ggctcaaattgaaggttgattaccgccctatcgggctgtatgctggtgtggtggtggcccctggcttggggacac

SEQ ID NO: 151416 - DNA, 75 bp, Artificial Sequence
  Synthetic
aatgtcctacaccggtgctttctccgcccggttggaagagacgtccagcgctggtactccgcccccacccgtggt

SEQ ID NO: 151417 - DNA, 75 bp, Artificial Sequence
  Synthetic
gtgaccccaaccagatccctgccattgattttgagcatgctggccttgttccggcgatccggccagagcttgtcc

SEQ ID NO: 151418 - DNA, 75 bp, Artificial Sequence
  Synthetic
gtgaccccaaccagatccctgccattgattttgagcatgctggccttgttccggcgatccggcctgagcttgtcc

SEQ ID NO: 151419 - DNA, 75 bp, Artificial Sequence
  Synthetic
gtgaccccaaccagatccctgccattgattttgagcatgctggccttgttccggcgatccggcccgagcttgtcc

SEQ ID NO: 151420 - DNA, 75 bp, Artificial Sequence
  Synthetic
gtgaccccaaccagatccctgccattgattttgagcatgctggccttgttccggcgatccggccggagcttgtcc

SEQ ID NO: 151421 - DNA, 75 bp, Artificial Sequence
  Synthetic
cctactatcggaccggtccaggccaccacatgtgagttatatgagctggttgaggccatggtggagaagggtcag

SEQ ID NO: 151422 - DNA, 75 bp, Artificial Sequence
  Synthetic
tgcctgatgttgtgcgctttgccggccggttatctgagaagaactggggtcctggaccagagcgggctgagcagt

SEQ ID NO: 151423 - DNA, 75 bp, Artificial Sequence
  Synthetic
tgacctttggccctcggacgttgcggaggctatggcccgccacgggatgacgcgcctgtatgccgccctccacct

SEQ ID NO: 151424 - DNA, 75 bp, Artificial Sequence
  Synthetic
catttcggcttggagcaagaccttctgtgctttatttggcccgtggttccgtgccattgagaaggagattctggc

SEQ ID NO: 151425 - DNA, 75 bp, Artificial Sequence
  Synthetic
tgcaattacagtccatgaggcccagggcgccacatttactgaaactactattattgccacagcagatgctcgcgg

SEQ ID NO: 151426 - DNA, 75 bp, Artificial Sequence
  Synthetic
accccctgaggttttgttaccacctggcacttaccacacaacctcctatcttttgattcacgacggcaatcgtgc

SEQ ID NO: 151427 - DNA, 75 bp, Artificial Sequence
  Synthetic
tttctgcagccatttctggggccagctccagtatggtttttgagaacgatttttctgagtttgatagtacccaaa

SEQ ID NO: 151428 - DNA, 75 bp, Artificial Sequence
  Synthetic
cggagaagtgcgtggttgttgacgcccctgggctccttcgtgaggtcggcatttccgatgctatcgtcaataatt

SEQ ID NO: 151429 - DNA, 75 bp, Artificial Sequence
  Synthetic
ctatacttcgtgcatggatccgcaccactaaaatagttggtgatcacccactggtaatagagagggttcgtgcca

SEQ ID NO: 151430 - DNA, 75 bp, Artificial Sequence
  Synthetic
ataatttttctctcggccttgagtgtgttattatggaggagtgtggcatgccccagtggcttatccgactgtatc

SEQ ID NO: 151431 - DNA, 75 bp, Artificial Sequence
  Synthetic
tcggctgccattttgttttactccttactgcagcccccgagccatccccaatgccttatgttccgtaccctcgtt

SEQ ID NO: 151432 - DNA, 75 bp, Artificial Sequence
  Synthetic
tactgcagcccccgagccatccccaatgccttatgttccgtaccctcgttcaacagaggtgtatgttagatccat

SEQ ID NO: 151433 - DNA, 75 bp, Artificial Sequence
  Synthetic
gcaggccccgaaagagtctttgaaaggtttttggaagaagcattccggcgagcctggcaccctcctttggaacac

SEQ ID NO: 151434 - DNA, 75 bp, Artificial Sequence
  Synthetic
atttggccctggcgggtcgccatctctttttccatcagcctgctccaccaagtctacattccatgctgtcccggt

SEQ ID NO: 151435 - DNA, 75 bp, Artificial Sequence
  Synthetic
cttgcggaggagctaggccatcgaccggccccaatcgctgctgtcctgcccccttgcccggagcttgagcaaggc

SEQ ID NO: 151436 - DNA, 75 bp, Artificial Sequence
  Synthetic
ccctccgctgccccccgccgtcgatctgccccaactggggctgcgccgctgaccgccatatcaccggcccccgat

SEQ ID NO: 151437 - DNA, 75 bp, Artificial Sequence
  Synthetic
ctctggctgcacctttgccgccgagacaggtattgccctctattcactgcatgacctatggcctgctgatgtcgc

SEQ ID NO: 151438 - DNA, 75 bp, Artificial Sequence
  Synthetic
acgtcatctgttgcttcgggtaccaatttggtcctttatgctgccccgctgaatcctcttctacctctccaggac

SEQ ID NO: 151439 - DNA, 75 bp, Artificial Sequence
  Synthetic
tgcgcttaccgctgtgattactgcagcgtatttgactatctgtcaccagcgctacctacgaacacaggccatttc

SEQ ID NO: 151440 - DNA, 75 bp, Artificial Sequence
  Synthetic
gcgtatttgactatctgtcaccagcgctacctacgaacacaggccatttctaaaggcatgcgtcggctagaggtc

SEQ ID NO: 151441 - DNA, 75 bp, Artificial Sequence
  Synthetic
tgagcttagccctattagtgtcaccacttgtgagctttatgagcttgtagaggctatggtggagaagggccagga

SEQ ID NO: 151442 - DNA, 75 bp, Artificial Sequence
  Synthetic
atttggtcctttatgctgccccgctgaatcctcttctacctctccaggacggcaccaacactcatattatggcca

SEQ ID NO: 151443 - DNA, 75 bp, Artificial Sequence
  Synthetic
tcggcggttatgcaatttctatctcattttggccccagactactaccacccctacatctgttgatatgaactcta

SEQ ID NO: 151444 - DNA, 75 bp, Artificial Sequence
  Synthetic
cctacatctgttgatatgaactctatcacctccactgatgttagaattctggtccagcccggtattgcctccgaa

SEQ ID NO: 151445 - DNA, 75 bp, Artificial Sequence
  Synthetic
tttgatgaggcggtcccctgccgctgccggagcttcctaaagaaagttaccgggaaattttgttgttttatgaaa

SEQ ID NO: 151446 - DNA, 75 bp, Artificial Sequence
  Synthetic
tgtcaaacctgtgctggatcttacaaattctatcatacagaggttggaatgaataacatgttttgtgcatcgccc

SEQ ID NO: 151447 - DNA, 75 bp, Artificial Sequence
  Synthetic
gaggaggctacctccggtttggttatgctttgtattcatggctcccctgttaattcgtatactaacaccccttat

SEQ ID NO: 151448 - DNA, 75 bp, Artificial Sequence
  Synthetic
gcctatgaagggtctgaggtggaccccgccgagcctgctcaccttgatgtttccgggacctatgcggtccacggc

SEQ ID NO: 151449 - DNA, 75 bp, Artificial Sequence
  Synthetic
cgtgtatcccggtatacgagcacagcccgtcatcggttgcgccgtggcgctgatggtaccgctgagctcactacc

SEQ ID NO: 151450 - DNA, 75 bp, Artificial Sequence
  Synthetic
actgtggaacttgctgccagcccaggccgactcgagtgccgtacggtgcttgggaataagaccttccgcacatca

SEQ ID NO: 151451 - DNA, 75 bp, Artificial Sequence
  Synthetic
gccgactcgagtgccgtacggtgcttgggaataagaccttccgcacatcaataactgacggtgcccatctcgagg

SEQ ID NO: 151452 - DNA, 75 bp, Artificial Sequence
  Synthetic
gaccagtcccagcgcccccccgctgccccccgtcgtcgatctaccccaactggggctgcgccgttaactgctgtt

SEQ ID NO: 151453 - DNA, 75 bp, Artificial Sequence
  Synthetic
cttgactccccggcctattatccatgctgttgcccctgactaccgggtcgaacataaccccaagaggctcgaggc

SEQ ID NO: 151454 - DNA, 75 bp, Artificial Sequence
  Synthetic
cgaaggggatgaaaaggttggagctcgagcacgcacagaaatttataacacgcctttacagttggctatttgaaa

SEQ ID NO: 151455 - DNA, 75 bp, Artificial Sequence
  Synthetic
cccgtcatcggttgcgccgtggcgctgatggtaccgctgagctcactaccacggcggccacgcgcttcatgaagg

SEQ ID NO: 151456 - DNA, 75 bp, Artificial Sequence
  Synthetic
acacgcttcttggtggtctgccgacagaattgatttcgtcggctgggggacagttgttctactcccgccctgtcg

SEQ ID NO: 151457 - DNA, 75 bp, Artificial Sequence
  Synthetic
ttcatcttgatcctcgtgtgctcgtttttgatgaatccgccccctgccgctgtcggagtttcctgcgtaaagccg

SEQ ID NO: 151458 - DNA, 75 bp, Artificial Sequence
  Synthetic
tcccgcatgacatagatctgggtgactctcgtgtggtgatccaggactatgataatcagcatgagcaggatcggc

SEQ ID NO: 151459 - DNA, 75 bp, Artificial Sequence
  Synthetic
ctctcgtgtggtgatccaggactatgataatcagcatgagcaggatcggcctaccccctcacctgccccgtcccg

SEQ ID NO: 151460 - DNA, 75 bp, Artificial Sequence
  Synthetic
gctgtggctacaccctgaggggctccttggcctgtttcctcctttctccccggggcatctctgggagtctgcaaa

SEQ ID NO: 151461 - DNA, 75 bp, Artificial Sequence
  Synthetic
tgatgttaggattttagtccagcctggcatagcctctgagctggtcatcccgagtgagcgccttcactatcgtaa

SEQ ID NO: 151462 - DNA, 75 bp, Artificial Sequence
  Synthetic
cgaggccgcttgtgcagctccggtccctgacatagggttaccctcgggtaccccctcgtccgctggcgatatctg

SEQ ID NO: 151463 - DNA, 75 bp, Artificial Sequence
  Synthetic
tgggtcgtccaccaacccgatgtatgtctcggacactgttacatttgttaatgtagccacaggagcccaggctgt

SEQ ID NO: 151464 - DNA, 75 bp, Artificial Sequence
  Synthetic
gtctcggacactgttacatttgttaatgtagccacaggagcccaggctgtcgcccgttctcttgactggtccaag

SEQ ID NO: 151465 - DNA, 75 bp, Artificial Sequence
  Synthetic
aagttgtctttttgggaggccggcacaaccaaggccggctatccgtataattacaacactactgctagtgatcag

SEQ ID NO: 151466 - DNA, 75 bp, Artificial Sequence
  Synthetic
gcctagtctaattatacccaggcctcccgtccgtgagccgcccacgccaccgccggccctaacctcgctcagtaa

SEQ ID NO: 151467 - DNA, 75 bp, Artificial Sequence
  Synthetic
tatattcatccaaccaaccccttcgcatctgacatatcaaccgccgccggggctggagctcgccctcggcagccg

SEQ ID NO: 151468 - DNA, 75 bp, Artificial Sequence
  Synthetic
tcgatttctgcagtcggcgtgttggccccacattcggccctcgctgttcttgaagacactgttgactaccctgcc

SEQ ID NO: 151469 - DNA, 75 bp, Artificial Sequence
  Synthetic
ccgccggctcctttatacatatcctgatggggccaaggtgtatgcaggctctttgtttgagtcagattgtgactg

SEQ ID NO: 151470 - DNA, 75 bp, Artificial Sequence
  Synthetic
gtttgtggtactatcctgagagcttagttggtttgttcccaccgttttcccccggtcatagctgggagtccacca

SEQ ID NO: 151471 - DNA, 75 bp, Artificial Sequence
  Synthetic
gcttcgtgctaatgatgtgctttggctttcacttacggctgctgaatatgaccagactacttatggctcttccac

SEQ ID NO: 151472 - DNA, 75 bp, Artificial Sequence
  Synthetic
ctttgtttgagtcagattgtgactggttggttaatgcatctaatcctggccaccgccctggtggtggcctttgtc

SEQ ID NO: 151473 - DNA, 75 bp, Artificial Sequence
  Synthetic
atcctttttgcggtgagagcactctttacactcgcacttggtctgtgtcgggcttttccagctgtttctctcctc

SEQ ID NO: 151474 - DNA, 75 bp, Artificial Sequence
  Synthetic
ctttcacttacggctgctgaatatgaccagactacttatggctcttccactaaccctatgtatgtttctgacact

SEQ ID NO: 151475 - DNA, 75 bp, Artificial Sequence
  Synthetic
tgaaggtaggtaaaacccgggagttttaattaattctttcgtacccccttcatagctctccgctttatttctctt

SEQ ID NO: 151476 - DNA, 75 bp, Artificial Sequence
  Synthetic
ctttgagcccgcgtccgatcattcatgctgtggcccccgactacagggttgagcagaaccccaagaggttagagg

SEQ ID NO: 151477 - DNA, 75 bp, Artificial Sequence
  Synthetic
accttcaggtgacattgacatgtctgtagctgttgatacccagccattggttccccctgtgcagactcagcccca

SEQ ID NO: 151478 - DNA, 75 bp, Artificial Sequence
  Synthetic
tgctgtggcccccgactacagggttgagcagaaccccaagaggttagaggcggcataccgtgagacctgttcccg

SEQ ID NO: 151479 - DNA, 75 bp, Artificial Sequence
  Synthetic
agtattccaagactttctatgttttgccccttcgtggtaagctttctttttgggaggctggtaccactaaagccg

SEQ ID NO: 151480 - DNA, 75 bp, Artificial Sequence
  Synthetic
cggcgggttgccgacagaattgatttcgtcggctggaggtcaactgttttactcccgcccggttgtctcagccaa

SEQ ID NO: 151481 - DNA, 75 bp, Artificial Sequence
  Synthetic
cccagacaacaactactccgacatctgttgatatgaactctatcacctccactgatgttcgaattcttgtccaac

SEQ ID NO: 151482 - DNA, 75 bp, Artificial Sequence
  Synthetic
ggagcccccggcgcccgtgcagcctgtaatccagcccgggccccgtcgacgactgctccatacttaccccgatgg

SEQ ID NO: 151483 - DNA, 75 bp, Artificial Sequence
  Synthetic
ccgcctggttcgaggctaataagccaacccagccagccttaacaattactgaggacaccgcccgcacagctaacc

SEQ ID NO: 151484 - DNA, 75 bp, Artificial Sequence
  Synthetic
cctgaggttttgtggaaccacccgatccagcgagtcatacacaatgagttggagcagtactgtcgtgctcgtgct

SEQ ID NO: 151485 - DNA, 75 bp, Artificial Sequence
  Synthetic
tttctacctacactactaatctaggctccgggcctgtttctatttctgctgttggggtcctcgcgcctcattctg

SEQ ID NO: 151486 - DNA, 75 bp, Artificial Sequence
  Synthetic
aacccagccagccttaacaattactgaggacaccgcccgcacagctaaccttgcgcttgagattgactctgctac

SEQ ID NO: 151487 - DNA, 75 bp, Artificial Sequence
  Synthetic
atccaaggtccattaacgacaaccccaatgttttgcaccggtgtttccttcgtccagttgggagagacgtacagc

SEQ ID NO: 151488 - DNA, 75 bp, Artificial Sequence
  Synthetic
tgcactattaaccctgggattgtccactaccagttcactgctggggtccctggctccgggaagtctaggtctata

SEQ ID NO: 151489 - DNA, 75 bp, Artificial Sequence
  Synthetic
attatgataaccagcatgaacaagatcgacctactccgtcacctgccccctcccgccctttttcggtgctccgtg

SEQ ID NO: 151490 - DNA, 75 bp, Artificial Sequence
  Synthetic
tttacagggactaatggtgttggtgaggttggtcgtggcatagcgttaaccctgtttaaccttgctgacacgctt

SEQ ID NO: 151491 - DNA, 75 bp, Artificial Sequence
  Synthetic
acacgcttgtatgcagccctacacctgccccccgaggttttgctaccacctggcacttatcataccacctcttat

SEQ ID NO: 151492 - DNA, 75 bp, Artificial Sequence
  Synthetic
gctttccagtctactgttgctgagcttcagcgtcttagaatgaaggtaggtaagacccgggagtcttaattaatt

SEQ ID NO: 151493 - DNA, 75 bp, Artificial Sequence
  Synthetic
tggtgaccccaaccagattcctgccatcgattttgagcacgccggtttggtcccagcgattcgccctgagctagc

SEQ ID NO: 151494 - DNA, 75 bp, Artificial Sequence
  Synthetic
tccattctccgtgcatggattcgcacaaccaaaatagttggtgaccacccgctggtcatagagagggttcgtgct

SEQ ID NO: 151495 - DNA, 75 bp, Artificial Sequence
  Synthetic
gcagccccggcagcttgtttttcggccagaggttctgtggaatcatccaattcagcgtgtgatccataatgaact

SEQ ID NO: 151496 - DNA, 75 bp, Artificial Sequence
  Synthetic
tcaacggaggtgtatgttaggtctatattcggccctggtgggtcgccctctctcttcccatcagcctgctctact

SEQ ID NO: 151497 - DNA, 75 bp, Artificial Sequence
  Synthetic
tattcggccctggtgggtcgccctctctcttcccatcagcctgctctactaaatctacatttcacgccgttccag

SEQ ID NO: 151498 - DNA, 75 bp, Artificial Sequence
  Synthetic
taatgtccttcaccgctgttttctcaaacctgtcggccgtgacgttcaacggtggtacactgctcccacccgtgg

SEQ ID NO: 151499 - DNA, 75 bp, Artificial Sequence
  Synthetic
cagcagtattctaaaacattctatgtcttgcctctccgcggtaaactttccttctgggaggctggtaccaccaag

SEQ ID NO: 151500 - DNA, 75 bp, Artificial Sequence
  Synthetic
gctcctggcctgttgcgtgaggtcggcatttctgatataattgttaataatttcttcctggctggtggcgaagtg

SEQ ID NO: 151501 - DNA, 75 bp, Artificial Sequence
  Synthetic
aaacctgtcggccgtgacgttcaacggtggtacactgctcccacccgtggcccagcagcgaattgccgtcggtct

SEQ ID NO: 151502 - DNA, 75 bp, Artificial Sequence
  Synthetic
cccgcggcaacccagaccagaacttagacaccctacgagcatttcctccgtcctgccaaattagtgcctaccacc

SEQ ID NO: 151503 - DNA, 75 bp, Artificial Sequence
  Synthetic
tgagaatgcggctggtcaccgcgtctgtatttcaacttatactactaacctcggctccggccccgtctctatttc

SEQ ID NO: 151504 - DNA, 75 bp, Artificial Sequence
  Synthetic
accgggattgctctttattcactgcatgatttatggcctgccgatgtcgcagaggccatggcccgccatggcatg

SEQ ID NO: 151505 - DNA, 75 bp, Artificial Sequence
  Synthetic
agctggctgaggagctgggccatcggccggctccagtggccgccgtcctgcccccttgccctgagcttgagcagg

SEQ ID NO: 151506 - DNA, 75 bp, Artificial Sequence
  Synthetic
tccctccggaggtgttgctcccccctggtacttaccatacaacttcatatcttttaatccatgatggagaccgtg

SEQ ID NO: 151507 - DNA, 75 bp, Artificial Sequence
  Synthetic
ccgtcagctccagttctatgcgcagtgccgccgctggctctctgccggcttccacctagaccctagagtccttgt

SEQ ID NO: 151508 - DNA, 75 bp, Artificial Sequence
  Synthetic
gccgtatggccgcccccagtcaacgtaaggcggtcctttctacgctcgtcggcaggtacggccgccgaacgaagc

SEQ ID NO: 151509 - DNA, 75 bp, Artificial Sequence
  Synthetic
tgccgccgctggctctctgccggcttccacctagaccctagagtccttgttttcgatgaagcggtcccttgccgt

SEQ ID NO: 151510 - DNA, 75 bp, Artificial Sequence
  Synthetic
agaagtgcgtggtagttgatgccccggggcttcttcgtgaggtgggtatctctgatgctattgttaacaacttct

SEQ ID NO: 151511 - DNA, 75 bp, Artificial Sequence
  Synthetic
ggtaaaactcgggagtattgatttattttgtttgtgcctcccttctgctttgtttcttttatttttcttttctgc

SEQ ID NO: 151512 - DNA, 75 bp, Artificial Sequence
  Synthetic
ctactaaggtcactggtgaccacccgctggtgatcgagcgggttcgggcggtgggctgtcattttgtgctcctcc

SEQ ID NO: 151513 - DNA, 75 bp, Artificial Sequence
  Synthetic
cctactatcggaccggtccaggccacaacatgcgagctatatgagctggttgaggccatggtggagaagggccag

SEQ ID NO: 151514 - DNA, 75 bp, Artificial Sequence
  Synthetic
ttcctggagccggctgagggcttgattggtgattgtggccatgataatgaggcctatgagggctcggaggtggac

SEQ ID NO: 151515 - DNA, 75 bp, Artificial Sequence
  Synthetic
gctggtgatcgagcgggttcgggcggtgggctgtcattttgtgctcctccttacggccgcacccgagccatcgcc

SEQ ID NO: 151516 - DNA, 75 bp, Artificial Sequence
  Synthetic
tatcacatttttccagaaggattgtaataaatttacaacaggtgagaccattgcccacggcaaggtgggccaggg

SEQ ID NO: 151517 - DNA, 75 bp, Artificial Sequence
  Synthetic
ccttttcccatctgcctgctctaccaagtccacatttcatgccgtccccgtgcatatatgggacaggcttatgct

SEQ ID NO: 151518 - DNA, 75 bp, Artificial Sequence
  Synthetic
ccgtctgcttgagcctttatacagggcgctcaacatcccacatgatattgcagctcgcgcatcacgcttgacagc

SEQ ID NO: 151519 - DNA, 75 bp, Artificial Sequence
  Synthetic
aagtccacatttcatgccgtccccgtgcatatatgggacaggcttatgctttttggtgcaaccctcgatgatcag

SEQ ID NO: 151520 - DNA, 75 bp, Artificial Sequence
  Synthetic
cggtcctgtcgactcttgtcggcaggtacggccgccgcacgaagctgtacgaggctgcccatacagatgtccgcg

SEQ ID NO: 151521 - DNA, 75 bp, Artificial Sequence
  Synthetic
gagcagtattgccgagcccgggctggtcgctgccttgaagtgggcgcccacccacgttctattaatgacaaccct

SEQ ID NO: 151522 - DNA, 75 bp, Artificial Sequence
  Synthetic
ggcgatgcttatgaggagtcagtgttttctgcagccatttctggggctggctctagtatggtttttgagaacgat

SEQ ID NO: 151523 - DNA, 75 bp, Artificial Sequence
  Synthetic
aatgagggttggaacgcctctgaagatgcactgactgctgtcatcactgcagcttacctcaccatttgtcatcag

SEQ ID NO: 151524 - DNA, 75 bp, Artificial Sequence
  Synthetic
gtcgctgccttgaagtgggcgcccacccacgttctattaatgacaaccctaatgttctgcaccgctgtttcctta

SEQ ID NO: 151525 - DNA, 75 bp, Artificial Sequence
  Synthetic
gtcaatggccctgagcagtatgttctgacatttgacgactcccgtcaagtgatgggggctgggcctcatagtctt

SEQ ID NO: 151526 - DNA, 75 bp, Artificial Sequence
  Synthetic
tgtaaccgtgatgtgtcccggataaccttcttccagaaagactgtaataaatttacaacaggtgagacgatagcg

SEQ ID NO: 151527 - DNA, 75 bp, Artificial Sequence
  Synthetic
ccctccgtgggcttccacctgttgatcggacttattgttttgatggtttttccggctgcacatttgccgctgaga

SEQ ID NO: 151528 - DNA, 75 bp, Artificial Sequence
  Synthetic
cctggtggggcaccaagtgccgcaccgggtgaggttgcagccttctgtagcgctttatatagatataacagattt

SEQ ID NO: 151529 - DNA, 75 bp, Artificial Sequence
  Synthetic
cgggtgaggttgcagccttctgtagcgctttatatagatataacagatttactcagcgccactcgcttacaggcg

SEQ ID NO: 151530 - DNA, 75 bp, Artificial Sequence
  Synthetic
tcggacttattgttttgatggtttttccggctgcacatttgccgctgagacagggattgctctctactcactgca

SEQ ID NO: 151531 - DNA, 75 bp, Artificial Sequence
  Synthetic
tgccggagtttcctccgcagagccgctcacaagttctgctgcttcatgcggtggttaggccaagactgtacctgc

SEQ ID NO: 151532 - DNA, 75 bp, Artificial Sequence
  Synthetic
atccattttgtggtgagggtacactttacacccgaacttggtctacatctggtttttctagtgatttttctcccc

SEQ ID NO: 151533 - DNA, 75 bp, Artificial Sequence
  Synthetic
ccctccagaagtgctactcccacctggcacttaccatactacgtcataccttttgattcatgatggggaccgtgc

SEQ ID NO: 151534 - DNA, 75 bp, Artificial Sequence
  Synthetic
tgagtttgatagtacccaaaataacttttcacttgggcttgagtgtataattatggaggagtgtggtatgccaca

SEQ ID NO: 151535 - DNA, 75 bp, Artificial Sequence
  Synthetic
ttatctgtgaaactactataggcaacaagacttttaaaacagttcttactgatggtgcccagttagaggctaatg

SEQ ID NO: 151536 - DNA, 75 bp, Artificial Sequence
  Synthetic
gaaggttgattaccggcctataggtttgtatgctggcgttgtggtggctccgggcctcggtgcacttccagatgt

SEQ ID NO: 151537 - DNA, 75 bp, Artificial Sequence
  Synthetic
cctgccgaggaggccattgtgagtatctctgggtcgtatattgtagctggcagccagttacagcccctctatcag

SEQ ID NO: 151538 - DNA, 75 bp, Artificial Sequence
  Synthetic
tgtccggtttgccggtcgactatctgagaagaactggggcccgggccccgagcgcgccgaacagttgcgcctagc

SEQ ID NO: 151539 - DNA, 75 bp, Artificial Sequence
  Synthetic
gtcagtggctgctttatcacttgcagccccggttagcaagcctgttagccctcctggccccgctacgcctaaatc

SEQ ID NO: 151540 - DNA, 75 bp, Artificial Sequence
  Synthetic
cactaaggtcacaggtgatcacccgcttgttatcgaacgagtccgtgccgtggggtgccattttgtgctcctcct

SEQ ID NO: 151541 - DNA, 75 bp, Artificial Sequence
  Synthetic
tctctgggtcgtatattgtagctggcagccagttacagcccctctatcaggcacttggtataccttctgaccttg

SEQ ID NO: 151542 - DNA, 75 bp, Artificial Sequence
  Synthetic
ttacacccgaacttggtctacatctggtttttctagtgatttttctccccccgaggcggcttttaccgccccagc

SEQ ID NO: 151543 - DNA, 75 bp, Artificial Sequence
  Synthetic
gccccggttagcaagcctgttagccctcctggccccgctacgcctaaatcccctgttcgtaagccaccctcaccg

SEQ ID NO: 151544 - DNA, 75 bp, Artificial Sequence
  Synthetic
taggcaacaaaacttttttaacggtctttattgacggcgcccaactagaggccaatggaccggaacaatatgtgt

SEQ ID NO: 151545 - DNA, 75 bp, Artificial Sequence
  Synthetic
ctttattgacggcgcccaactagaggccaatggaccggaacaatatgtgttgtctctagatttagccaagcagac

SEQ ID NO: 151546 - DNA, 75 bp, Artificial Sequence
  Synthetic
tcagattgtgattggctggtaaacgcgtctaaccctggccaccgccctggcggcggtctttgtcacgccttttat

SEQ ID NO: 151547 - DNA, 75 bp, Artificial Sequence
  Synthetic
cttgttatcgaacgagtccgtgccgtggggtgccattttgtgctcctcctcacagccgcacccgagccatcgccg

SEQ ID NO: 151548 - DNA, 75 bp, Artificial Sequence
  Synthetic
agtctacatttcacgctgtccctgtgcatatatgggacaggcttatgctttttggtgctaccctagatgatcagg

SEQ ID NO: 151549 - DNA, 75 bp, Artificial Sequence
  Synthetic
gcttgactgtaaggtagtttttccacccggtgtagctgccccctctgctcctggagaggtgtctgctttttgctc

SEQ ID NO: 151550 - DNA, 75 bp, Artificial Sequence
  Synthetic
acgagggctggaatgcctctgaggatgcactgactgctgtgattactgcggcttacctcactatttgccaccagc

SEQ ID NO: 151551 - DNA, 75 bp, Artificial Sequence
  Synthetic
gaactgggggccaggcccggagagggtggagcagctccggctggccgtttgtgactttttgcgaaagttaacgaa

SEQ ID NO: 151552 - DNA, 75 bp, Artificial Sequence
  Synthetic
cccggtgtagctgccccctctgctcctggagaggtgtctgctttttgctcagccctatacaggtttaaccgctgc

SEQ ID NO: 151553 - DNA, 75 bp, Artificial Sequence
  Synthetic
tgcactgactgctgtgattactgcggcttacctcactatttgccaccagcggtatctccgcacacaggctatctc

SEQ ID NO: 151554 - DNA, 75 bp, Artificial Sequence
  Synthetic
cccggtcacagttgggagtcagctaaccctttttgcggtgagagtacgctctatacccgcacctggtcggtgtca

SEQ ID NO: 151555 - DNA, 75 bp, Artificial Sequence
  Synthetic
gtctgggcgtgattacattcctggccgccaacttcaattctacgcccagtgccgtcggtggctgtctgccggctt

SEQ ID NO: 151556 - DNA, 75 bp, Artificial Sequence
  Synthetic
ctatacccgcacctggtcggtgtcaggtttctctagttgtttttccccacttgagccttgtatccaggacccgcc

SEQ ID NO: 151557 - DNA, 75 bp, Artificial Sequence
  Synthetic
gaggctaataagccaacccagccagctttaacaatcactgaagatactgctcgcacggctaacctcgcgctcgag

SEQ ID NO: 151558 - DNA, 75 bp, Artificial Sequence
  Synthetic
cgccaacttcaattctacgcccagtgccgtcggtggctgtctgccggcttccaccttgaccctcgcgtgcttgtt

SEQ ID NO: 151559 - DNA, 75 bp, Artificial Sequence
  Synthetic
cagcacatacccagttgtcggtccctgagcggatggcaccccccccggatttatctgacggaggcgctcgctccg

SEQ ID NO: 151560 - DNA, 75 bp, Artificial Sequence
  Synthetic
tggctcggtcaggattgtacttgttttctccagcctattgaggggagggttggtgagcaaggctatgataatgag

SEQ ID NO: 151561 - DNA, 75 bp, Artificial Sequence
  Synthetic
tgagcggatggcaccccccccggatttatctgacggaggcgctcgctccgccacacccggtgctcctgctacacc

SEQ ID NO: 151562 - DNA, 75 bp, Artificial Sequence
  Synthetic
tcgcctctggaactaatcttgtcttgtatgccgccccgcttaatcctcttctgcctctccaagacggcactaaca

SEQ ID NO: 151563 - DNA, 75 bp, Artificial Sequence
  Synthetic
ttctccagcctattgaggggagggttggtgagcaaggctatgataatgaggcgtttgaggggtcggatgtggacc

SEQ ID NO: 151564 - DNA, 75 bp, Artificial Sequence
  Synthetic
ctgcctctccaagacggcactaacactcacatcatggcgaccgaggcgtctaattacgctcagtatcgggtcgtc

SEQ ID NO: 151565 - DNA, 75 bp, Artificial Sequence
  Synthetic
actgccggggtgcctggttccgggaagtctaggtctatacaacaaggggacgtcgatgttgtggttgtgccaaca

SEQ ID NO: 151566 - DNA, 75 bp, Artificial Sequence
  Synthetic
aaaagtatatgccggctctctttttgagtctgaatgcacttggctggttaatgcatccaatcccggtcaccgccc

SEQ ID NO: 151567 - DNA, 75 bp, Artificial Sequence
  Synthetic
gggcggcgtgttgtgattgatgaagcaccttcgctcccgccacatttgctactgcttcatatgcagagggcgtcg

SEQ ID NO: 151568 - DNA, 75 bp, Artificial Sequence
  Synthetic
cgctcggtataccttccgacctcgccgcgcgcgccagccggctcactgctaccgtcgaggtctccgatgctgacg

SEQ ID NO: 151569 - DNA, 75 bp, Artificial Sequence
  Synthetic
tatgctgccccgcttagccctctactcccacttcaggatggcaccaacactcatattatggctactgaggcttct

SEQ ID NO: 151570 - DNA, 75 bp, Artificial Sequence
  Synthetic
tcggtccaccttctcggcgaccccaaccaaatccccgctattgattttgagcacgcgggcttggtgccggcgatt

SEQ ID NO: 151571 - DNA, 75 bp, Artificial Sequence
  Synthetic
gagtctgaatgcacttggctggttaatgcatccaatcccggtcaccgccctggtggcggcctctgtcatgcattc

SEQ ID NO: 151572 - DNA, 75 bp, Artificial Sequence
  Synthetic
cgcgcgcgccagccggctcactgctaccgtcgaggtctccgatgctgacggttgtctcacctgtaagactattat

SEQ ID NO: 151573 - DNA, 75 bp, Artificial Sequence
  Synthetic
ccccggccaattattcatgctgtcgcccctgactatcgggttgaacataaccccaagcgactcgaggccgcttat

SEQ ID NO: 151574 - DNA, 75 bp, Artificial Sequence
  Synthetic
gcgccaccattcggtatcgccccttggtgccgaatgctgtcggtgggtatgctatatctatctctttttggcccc

SEQ ID NO: 151575 - DNA, 75 bp, Artificial Sequence
  Synthetic
gtcgttcgacttagccaagcagactatggccgccggcccgcacagtctcagttttaccttgacatctgcgggtct

SEQ ID NO: 151576 - DNA, 75 bp, Artificial Sequence
  Synthetic
ggggcctaccctaagatccaaactaccagtcgcgtgatgcgatctttgttttggaatgagcctgcggtaggccag

SEQ ID NO: 151577 - DNA, 75 bp, Artificial Sequence
  Synthetic
ggtgccgaatgctgtcggtgggtatgctatatctatctctttttggccccaaacaaccaccaccccgacgtccgt

SEQ ID NO: 151578 - DNA, 75 bp, Artificial Sequence
  Synthetic
cccctgactatcgggttgaacataaccccaagcgactcgaggccgcttatcgggagacatgctctcgccgaggga

SEQ ID NO: 151579 - DNA, 75 bp, Artificial Sequence
  Synthetic
atggccgccggcccgcacagtctcagttttaccttgacatctgcgggtctcgaggtccatgttgtttccgctggg

SEQ ID NO: 151580 - DNA, 75 bp, Artificial Sequence
  Synthetic
tggggctccttgactttgcactcgagcttgaatttagaaatttgacccctgggaacactaacacccgtgtgtccc

SEQ ID NO: 151581 - DNA, 75 bp, Artificial Sequence
  Synthetic
atcaccgacccggggatgagctgtacttaaccgagccagctatagcttggtttgaggccaaccggcctactttac

SEQ ID NO: 151582 - DNA, 75 bp, Artificial Sequence
  Synthetic
gccttgtataggtttaatcgttgtgtccagcggcattctctcattgggggcctgtggtaccatcctgaggggctg

SEQ ID NO: 151583 - DNA, 75 bp, Artificial Sequence
  Synthetic
ctcgtgagttgcgtaattcgtggcggcgccgcgggttcgcagcctacacacctcatactgcggcccgtgtcaccc

SEQ ID NO: 151584 - DNA, 75 bp, Artificial Sequence
  Synthetic
cgtccatgaggctcagggcgccacatttacagagactaccatcatagctacggccgatgctaggggccttatcca

SEQ ID NO: 151585 - DNA, 75 bp, Artificial Sequence
  Synthetic
cttaaccgagccagctatagcttggtttgaggccaaccggcctactttacctgccctgaccatcaccgaggatac

SEQ ID NO: 151586 - DNA, 75 bp, Artificial Sequence
  Synthetic
tccagcggcattctctcattgggggcctgtggtaccatcctgaggggctggttggtttattcccgcccttctccc

SEQ ID NO: 151587 - DNA, 75 bp, Artificial Sequence
  Synthetic
tgagcccggtgtggttcattaccagtttacagctggtgtccctggctctggtaaatctcggtcgatccagcaggg

SEQ ID NO: 151588 - DNA, 75 bp, Artificial Sequence
  Synthetic
gtttttctagctgtttttctccacttgatccttgtgttccggacgtgccgcccccggccgagactgctacacccc

SEQ ID NO: 151589 - DNA, 75 bp, Artificial Sequence
  Synthetic
tttacagctggtgtccctggctctggtaaatctcggtcgatccagcagggggaagttgatgtggtggtagtgcca

SEQ ID NO: 151590 - DNA, 75 bp, Artificial Sequence
  Synthetic
tgatccttgtgttccggacgtgccgcccccggccgagactgctacacccctgactgttaatgttttgcccccagt

SEQ ID NO: 151591 - DNA, 75 bp, Artificial Sequence
  Synthetic
ataattgttaacaatttctttctggccggcggtgaggtaggccaccaccgcccctccaccatacccagaggtaat

SEQ ID NO: 151592 - DNA, 75 bp, Artificial Sequence
  Synthetic
actcccgcccggttgtctcagccaatggcgagccgactgttaagttatacacctctgtcgagaatgcacagcagg

SEQ ID NO: 151593 - DNA, 75 bp, Artificial Sequence
  Synthetic
tggcgagccgactgttaagttatacacctctgtcgagaatgcacagcaggacaagggcattgctataccacatga

SEQ ID NO: 151594 - DNA, 75 bp, Artificial Sequence
  Synthetic
cgtggccgtagggttgttattgatgaggccccatcactcccgccgcatctgctactgttgcatatgcaacgggct

SEQ ID NO: 151595 - DNA, 75 bp, Artificial Sequence
  Synthetic
gaactgggccaccgaccggccccagtggccgctgtattaccgccctgccctgagcttgagcagggtctactttat

SEQ ID NO: 151596 - DNA, 75 bp, Artificial Sequence
  Synthetic
ttcccgccccgtcgtctcagccaatggcgagccgacagtgaaactttacacttcagtcgagaatgctcagcagga

SEQ ID NO: 151597 - DNA, 75 bp, Artificial Sequence
  Synthetic
ctctacattgcctgacgcccctatgtcatctccggcgccggtgcagtctgtaacccgcccatctgggccccgtcg

SEQ ID NO: 151598 - DNA, 75 bp, Artificial Sequence
  Synthetic
aggccccatcactcccgccgcatctgctactgttgcatatgcaacgggcttcatcagttcatcttcttggtgatc

SEQ ID NO: 151599 - DNA, 75 bp, Artificial Sequence
  Synthetic
gccggccccgtcccgtcccttttcagtccttcgagccaatgatgtcctatggctctctttgactgcggctgaata

SEQ ID NO: 151600 - DNA, 75 bp, Artificial Sequence
  Synthetic
attgatcttggtgagtcccgagttgttatccaggactatgacaatcaacatgagcaagaccgccctactccctct

SEQ ID NO: 151601 - DNA, 75 bp, Artificial Sequence
  Synthetic
attggtggcacctcacgcacagatgcccggcggatgtttgcgagctgattcgcggtgcatacccgaagatccaaa

SEQ ID NO: 151602 - DNA, 75 bp, Artificial Sequence
  Synthetic
tttcaacgctcgtcggcaggtacggccgccgaactaagctgtatgaggcggctcactctgatgtccgtgagtctc

SEQ ID NO: 151603 - DNA, 75 bp, Artificial Sequence
  Synthetic
cgccctggcggtggcctctgccatgcgttctaccagcgatttccagagtcatttgaccccgccgaatttgttatg

SEQ ID NO: 151604 - DNA, 75 bp, Artificial Sequence
  Synthetic
cccggcggatgtttgcgagctgattcgcggtgcatacccgaagatccaaaccgcaagccgtgtccttcgctcact

SEQ ID NO: 151605 - DNA, 75 bp, Artificial Sequence
  Synthetic
gtccttcgagccaatgatgtcctatggctctctttgactgcggctgaatatgaccagactacttatggttcgtcg

SEQ ID NO: 151606 - DNA, 75 bp, Artificial Sequence
  Synthetic
cttgattggtccaaggtcaccttggatggccggccactcactaccatccagcagtactccaagacattttacgtg

SEQ ID NO: 151607 - DNA, 75 bp, Artificial Sequence
  Synthetic
ccgccgaactaagctgtatgaggcggctcactctgatgtccgtgagtctctaggaaagtttatccctaccatcgg

SEQ ID NO: 151608 - DNA, 75 bp, Artificial Sequence
  Synthetic
gcagtactccaagacattttacgtgctgccgcttcgtggcaagctttccttttgggaagctggtacgactaaggc

SEQ ID NO: 151609 - DNA, 75 bp, Artificial Sequence
  Synthetic
tacagtccatgaagcccagggtgcaacattcactgagactacaatcattgctaccgctgatgcccgtgggctgat

SEQ ID NO: 151610 - DNA, 75 bp, Artificial Sequence
  Synthetic
tgtgttggagcttgatctctgcagccgtgatgtttcacgtatcacattcttccagaaggattgtaataaatttac

SEQ ID NO: 151611 - DNA, 75 bp, Artificial Sequence
  Synthetic
tgggcgcccactaactactatccagcagtattccaagactttctatgttttgcctcttcgtggtaagctttcttt

SEQ ID NO: 151612 - DNA, 75 bp, Artificial Sequence
  Synthetic
cctatcgggagacttgctcccgtcgtgggaccgccgcctaccccctgcttggcgctggtatatataaggttcccg

SEQ ID NO: 151613 - DNA, 75 bp, Artificial Sequence
  Synthetic
tgcctcttcgtggtaagctttctttttgggaggcgggtactactaaagccggttatccttataattataatacta

SEQ ID NO: 151614 - DNA, 75 bp, Artificial Sequence
  Synthetic
acattcactgagactacaatcattgctaccgctgatgcccgtgggctgattcaatcttctagggcccacgcaatt

SEQ ID NO: 151615 - DNA, 75 bp, Artificial Sequence
  Synthetic
gacgccatagtcaacaattttttcctttccggtggccaggttggccagcatcgtccgtcggtcataccacgtggc

SEQ ID NO: 151616 - DNA, 75 bp, Artificial Sequence
  Synthetic
aaggagatcttagccctgcttccacctaatatcttttatggtgatgcttttgaagagtcagtgttttcagcagcc

SEQ ID NO: 151617 - DNA, 75 bp, Artificial Sequence
  Synthetic
tcttcctgctctgactatctctgaggacacggcgcgcacagctaatttggcgctggagttggacgcggctactga

SEQ ID NO: 151618 - DNA, 75 bp, Artificial Sequence
  Synthetic
tttccggtggccaggttggccagcatcgtccgtcggtcataccacgtggcactattgacagcaatgttgatacgc

SEQ ID NO: 151619 - DNA, 75 bp, Artificial Sequence
  Synthetic
gctctgggcctgtttctatttctgctgtcggtgtcctcgcacctcactctgcattggctgttttggaggacactg

SEQ ID NO: 151620 - DNA, 75 bp, Artificial Sequence
  Synthetic
ccgtaatctcggcttgcagggctgtgctttccagtctactatcgctgagcttcagcgtcttaaaatgaaggtagg

SEQ ID NO: 151621 - DNA, 75 bp, Artificial Sequence
  Synthetic
gctttccagtctactatcgctgagcttcagcgtcttaaaatgaaggtaggtaagacccgggagtcttaattaatt

SEQ ID NO: 151622 - DNA, 75 bp, Artificial Sequence
  Synthetic
cgattgctgctgtcttgcccccctgtccagagcttgagcagggcctgctttatatgcctcaggagctaactacat

SEQ ID NO: 151623 - DNA, 75 bp, Artificial Sequence
  Synthetic
caaggtgatgtggacgtgattgtggttccaacccgtgagttgcgcaactcatggcggcgtcgtgggtttgcagct

SEQ ID NO: 151624 - DNA, 75 bp, Artificial Sequence
  Synthetic
ctcggcctcgagtgtgttatcatggaagagtgcggcatgccccagtggctcatccgactgtaccacttagtcagg

SEQ ID NO: 151625 - DNA, 75 bp, Artificial Sequence
  Synthetic
tccagagcttgagcagggcctgctttatatgcctcaggagctaactacatcggatagtgtgcttaccttcgagct

SEQ ID NO: 151626 - DNA, 75 bp, Artificial Sequence
  Synthetic
gcagcgtcttaaaatgaaggtgggtaaaacccgggagtattgatttattctacttgtgccttccttctgtctttt

SEQ ID NO: 151627 - DNA, 75 bp, Artificial Sequence
  Synthetic
ccagttcattaaggctcctggcatcacaactgccattgagcaagccgctctggcagcggccaattccgccttggc

SEQ ID NO: 151628 - DNA, 75 bp, Artificial Sequence
  Synthetic
ctcctttggaacaccgtctggaatatggcgatcatagcgcactgctatgaatttcgtgatttgagagtggcagcg

SEQ ID NO: 151629 - DNA, 75 bp, Artificial Sequence
  Synthetic
tggtcgccgcacaaaattgtacgaagctgcccatgcagatgtccgcgggtctctgaatcatttcatccctgagct

SEQ ID NO: 151630 - DNA, 75 bp, Artificial Sequence
  Synthetic
gggcttcgtcagtccacctccttggtgaccccaatcaaatccccgccattgattttgagcatgctggccttgttc

SEQ ID NO: 151631 - DNA, 75 bp, Artificial Sequence
  Synthetic
acaactgccattgagcaagccgctctggcagcggccaattccgccttggcgaatgctgtggtggttcggccgttt

SEQ ID NO: 151632 - DNA, 75 bp, Artificial Sequence
  Synthetic
gctgcccatgcagatgtccgcgggtctctgaatcatttcatccctgagctcggtcccattagtgttaccacctgc

SEQ ID NO: 151633 - DNA, 75 bp, Artificial Sequence
  Synthetic
atttcgtgatttgagagtggcagcgtttaaaggggatgactcagtggtcctctgtagtgactatcgccagagccg

SEQ ID NO: 151634 - DNA, 75 bp, Artificial Sequence
  Synthetic
tggaatcatcccatacagcgggtcattcacaatgagttagaacaatattgtcgtgcccgtgctggacgctgcctt

SEQ ID NO: 151635 - DNA, 75 bp, Artificial Sequence
  Synthetic
ttcacaatgagttagaacaatattgtcgtgcccgtgctggacgctgccttgaggttggggctcacccacgctcta

SEQ ID NO: 151636 - DNA, 75 bp, Artificial Sequence
  Synthetic
agccgtgatgtgtcccgaataacatttttccaaaaggattgtaataaatttaccacaggtgagacaatagcgcac

SEQ ID NO: 151637 - DNA, 75 bp, Artificial Sequence
  Synthetic
tcagactgcaagccgcgtcctccgctccctattttggggcgagccccccgtcggccagaaattagtgttcaccca

SEQ ID NO: 151638 - DNA, 75 bp, Artificial Sequence
  Synthetic
tgaccccaatcaaatccccgccattgattttgagcatgctggccttgttcctgctatccggcccgagctggttcc

SEQ ID NO: 151639 - DNA, 75 bp, Artificial Sequence
  Synthetic
aatgttttgcatcgttgttttcttaaaccagttggccgtgatgttcagcggtggtatactgcccccacccgtggc

SEQ ID NO: 151640 - DNA, 75 bp, Artificial Sequence
  Synthetic
tcctccgaaggttgacgaatgttgcgcaggtctgtgttgatgttgtgtcccgtgtttacggggttagtcctggcc

SEQ ID NO: 151641 - DNA, 75 bp, Artificial Sequence
  Synthetic
cgtggagtaagactttctgcgctctgtttggcccctggttccgcgctattgaaaaggagattttggctgcgctcg

SEQ ID NO: 151642 - DNA, 75 bp, Artificial Sequence
  Synthetic
ccccaacgcgcggtccggctgccaactgtcgtaggtctgcactccgtggtctcccgcctgtcgatcgcacctact

SEQ ID NO: 151643 - DNA, 75 bp, Artificial Sequence
  Synthetic
ctgatccaatcttcaagggcccatgcgattgtggctttgactcgccacacagagaagtgtgtggtggttgacgcc

SEQ ID NO: 151644 - DNA, 75 bp, Artificial Sequence
  Synthetic
ctgtcgtaggtctgcactccgtggtctcccgcctgtcgatcgcacctactgtttcgacggtttttcgcggtgctc

SEQ ID NO: 151645 - DNA, 75 bp, Artificial Sequence
  Synthetic
tccctattttggggcgagccccccgtcggccagaaattagtgttcacccaggcggcgaaggccgctaatcctggt

SEQ ID NO: 151646 - DNA, 75 bp, Artificial Sequence
  Synthetic
cgattgtggctttgactcgccacacagagaagtgtgtggtggttgacgcccccgggcttcttcgtgaagtcggca

SEQ ID NO: 151647 - DNA, 75 bp, Artificial Sequence
  Synthetic
tcggcatggcatgacccgcttgtacgcagttctgcaccttccacctgaggttcttctgccacctggtacctatca

SEQ ID NO: 151648 - DNA, 75 bp, Artificial Sequence
  Synthetic
gcagttctgcaccttccacctgaggttcttctgccacctggtacctatcacactacctcatacctgctgattcac

SEQ ID NO: 151649 - DNA, 75 bp, Artificial Sequence
  Synthetic
gctctgcagtgactaccggcagagccgcaatgcggccgcattaattgctggctgtgggctgaaacttaaggtgga

SEQ ID NO: 151650 - DNA, 75 bp, Artificial Sequence
  Synthetic
gtggtactattgatagcaatgttgatacacttgacgcgtttccaccctcctgccagttcagtgcctaccaccagc

SEQ ID NO: 151651 - DNA, 75 bp, Artificial Sequence
  Synthetic
cgaaggagtccctgcgcggcttctggaagaaacattctggtgaacccggcactttgttatggaatacagtttgga

SEQ ID NO: 151652 - DNA, 75 bp, Artificial Sequence
  Synthetic
gaagaaacattctggtgaacccggcactttgttatggaatacagtttggaatatggcagtcatagcacactgtta

SEQ ID NO: 151653 - DNA, 75 bp, Artificial Sequence
  Synthetic
agtgcaggatataaccatgatgtgtccattctgcgggcatggatccgtaccactaaggtcaccggtgatcatccg

SEQ ID NO: 151654 - DNA, 75 bp, Artificial Sequence
  Synthetic
gcctgggtccgtacgaccaaggttactggggaccatcctttagttattgagagagttcgtgcgattggctgccac

SEQ ID NO: 151655 - DNA, 75 bp, Artificial Sequence
  Synthetic
ctggggaccatcctttagttattgagagagttcgtgcgattggctgccactttgttctgctcctcactgcggcac

SEQ ID NO: 151656 - DNA, 75 bp, Artificial Sequence
  Synthetic
tacatcggatagtgttctcacctttgagctcacggatatagtccactgtcgtatggcggcccccagccagcgcaa

SEQ ID NO: 151657 - DNA, 75 bp, Artificial Sequence
  Synthetic
ctggtgattgagcgagtccgagcggtggggtgccattttgtccttctcctcacagctgcccccgaaccgtcgccg

SEQ ID NO: 151658 - DNA, 75 bp, Artificial Sequence
  Synthetic
ccgtaacgcagctgcgttgatcgccggttgtgggttaaagcttaaggtagatttcaggcctataggcctatatgc

SEQ ID NO: 151659 - DNA, 75 bp, Artificial Sequence
  Synthetic
ggttgtgggttaaagcttaaggtagatttcaggcctataggcctatatgctggtgttgttgtggccccgggcctt

SEQ ID NO: 151660 - DNA, 75 bp, Artificial Sequence
  Synthetic
gagctcacggatatagtccactgtcgtatggcggcccccagccagcgcaaagcggtcttgtcgactcttgttggt

SEQ ID NO: 151661 - DNA, 75 bp, Artificial Sequence
  Synthetic
gtgggtcgccttctctgtttccatctgcctgttcgaccaagtctaccttccatgcagttccagttcacatttggg

SEQ ID NO: 151662 - DNA, 75 bp, Artificial Sequence
  Synthetic
tgcctgttcgaccaagtctaccttccatgcagttccagttcacatttgggaccggctcatgctcttcggcgccac

SEQ ID NO: 151663 - DNA, 75 bp, Artificial Sequence
  Synthetic
gagcttggccctatccatgtcaccacctgcgagctttatgagctcgttgaggccatggtcgagaagggccagggt

SEQ ID NO: 151664 - DNA, 75 bp, Artificial Sequence
  Synthetic
cctgcgagctttatgagctcgttgaggccatggtcgagaagggccagggtggctccgcagttttggagctcgatc

SEQ ID NO: 151665 - DNA, 75 bp, Artificial Sequence
  Synthetic
gagcagcttcggctggcagtctgtgattttctacgaaagctaactaatgtggctcaggtgtgtgtggatgttgtc

SEQ ID NO: 151666 - DNA, 75 bp, Artificial Sequence
  Synthetic
tttgacttcttctgtagcttctggtaccaatcttgtcctttatgctgccccgctcaatcctctcctacctcttca

SEQ ID NO: 151667 - DNA, 75 bp, Artificial Sequence
  Synthetic
ggctcaggtgtgtgtggatgttgtctcgcgggtctatggtgttagtcccggtttggtacataacctgatcgggat

SEQ ID NO: 151668 - DNA, 75 bp, Artificial Sequence
  Synthetic
tgctttagttgccaacgaaggctggagtgcgtcggaggatgcgctcactgcagtgattacggccgcgtatcttac

SEQ ID NO: 151669 - DNA, 75 bp, Artificial Sequence
  Synthetic
agtgcgtcggaggatgcgctcactgcagtgattacggccgcgtatcttaccatctgccaccagcgctacctccgc

SEQ ID NO: 151670 - DNA, 75 bp, Artificial Sequence
  Synthetic
cacacgggaaagttggccaggggatatctgcatggagtaagaccttttgcgccttgtttggcccctggtttcgtg

SEQ ID NO: 151671 - DNA, 75 bp, Artificial Sequence
  Synthetic
accaatcttgtcctttatgctgccccgctcaatcctctcctacctcttcaggacggcaccaatacccacatcatg

SEQ ID NO: 151672 - DNA, 75 bp, Artificial Sequence
  Synthetic
gctgttggtggctatgcgatttctatttctttttggcctcagactacaactacccccacctctgttgatatgaat

SEQ ID NO: 151673 - DNA, 75 bp, Artificial Sequence
  Synthetic
gagcacgcgcagaagtttataacacgcctttacagctggttatttgaaaagtccgggcgtgactatatccccggc

SEQ ID NO: 151674 - DNA, 75 bp, Artificial Sequence
  Synthetic
atctgcatggagtaagaccttttgcgccttgtttggcccctggtttcgtgctatcgaaaaggagatcctggcggc

SEQ ID NO: 151675 - DNA, 75 bp, Artificial Sequence
  Synthetic
atcccagcgccccgccgcttcctcccgccgtcgatctgccccagctggggcttcgccgttgacggccgtggctcc

SEQ ID NO: 151676 - DNA, 75 bp, Artificial Sequence
  Synthetic
cgccaactgcagttttatgcccagtgccgccggtggctatctgcaggtttccaccttgatcctcgtgtgctcgtt

SEQ ID NO: 151677 - DNA, 75 bp, Artificial Sequence
  Synthetic
tggctttttgagaagtcgggtcgcgattacattccaggccgccagctggaattttatgcacagtgtaggcgctgg

SEQ ID NO: 151678 - DNA, 75 bp, Artificial Sequence
  Synthetic
ctgtaaagtttttgagaatgatttctctgagtttgacagtacccagaataatttctcacttggcctagagtgtat

SEQ ID NO: 151679 - DNA, 75 bp, Artificial Sequence
  Synthetic
ctccattatcgtaatcagggttggcgctctgttgaaacctcgggtgtggccgaggaggaggcgacatcgggcttg

SEQ ID NO: 151680 - DNA, 75 bp, Artificial Sequence
  Synthetic
attacattccaggccgccagctggaattttatgcacagtgtaggcgctggctttctgccgggttccatctcgacc

SEQ ID NO: 151681 - DNA, 75 bp, Artificial Sequence
  Synthetic
tctgagtttgacagtacccagaataatttctcacttggcctagagtgtataattatggaggagtgtggcatgcct

SEQ ID NO: 151682 - DNA, 75 bp, Artificial Sequence
  Synthetic
gctgtttcatgcggtggctgggtcaggagtgcaattgcttcctccagcctgtggaaggtcttatcggtgatgaag

SEQ ID NO: 151683 - DNA, 75 bp, Artificial Sequence
  Synthetic
ggagtgcaattgcttcctccagcctgtggaaggtcttatcggtgatgaaggccatgataatgaggcctatgaggg

SEQ ID NO: 151684 - DNA, 75 bp, Artificial Sequence
  Synthetic
gattttgcacttgagcttgaattcaggaatttgacccctgggaacactaacacccgtgtgtcccggtataccagc

SEQ ID NO: 151685 - DNA, 75 bp, Artificial Sequence
  Synthetic
ttttggaagaagcattctggtgaaccaggcactttgttatggaataccgtctggaacatggcagtcattgcacac

SEQ ID NO: 151686 - DNA, 75 bp, Artificial Sequence
  Synthetic
cacccgtgtgtcccggtataccagcacggcccgccaccgcttgcgccgtggcgccgacggaactgcagagctcac

SEQ ID NO: 151687 - DNA, 75 bp, Artificial Sequence
  Synthetic
tgctatgagttccgtgacttaaaagttgcagcatttaaaggggacgattctgttgtgctttgtagcgattaccgg

SEQ ID NO: 151688 - DNA, 75 bp, Artificial Sequence
  Synthetic
tgcgttataccgagctctcggccttcccatcgaccttgccgcccgtgcttctcgccttacagccaccgttgagtt

SEQ ID NO: 151689 - DNA, 75 bp, Artificial Sequence
  Synthetic
catccccgcttacatctactattgctacaggtactaatcttgtgctgtatgctgccccccttagtcccctgctcc

SEQ ID NO: 151690 - DNA, 75 bp, Artificial Sequence
  Synthetic
tacaggtactaatcttgtgctgtatgctgccccccttagtcccctgctcccgcttcaggatgggaccaatactca

SEQ ID NO: 151691 - DNA, 75 bp, Artificial Sequence
  Synthetic
cccatcgaccttgccgcccgtgcttctcgccttacagccaccgttgagttatcttcctaccccggccgcattgag

SEQ ID NO: 151692 - DNA, 75 bp, Artificial Sequence
  Synthetic
accgttgaagtttcagatgcagagggccgtcttacctgcaagaccatcttgggcaacaaaacctttttatcggta

SEQ ID NO: 151693 - DNA, 75 bp, Artificial Sequence
  Synthetic
gaggagtttgtcctttcttttgatgctgcccgccaggccatgtcagctggcccttatagcctcacttatgaagta

SEQ ID NO: 151694 - DNA, 75 bp, Artificial Sequence
  Synthetic
ggtcttgttatgctttgcatccacggatcacctgtgaactcctataccaatacgccttatactggtgcacttggc

SEQ ID NO: 151695 - DNA, 75 bp, Artificial Sequence
  Synthetic
gccgaatgccgttggcgggtacgctatatctatttcattttggccccaaacgacgactaccccgacatctgttga

SEQ ID NO: 151696 - DNA, 75 bp, Artificial Sequence
  Synthetic
atggccgccggcacgcatagtcttagttacaccctaacatcagaaggccttgaggtgcatattatttctgccggg

SEQ ID NO: 151697 - DNA, 75 bp, Artificial Sequence
  Synthetic
gagactcgcgtgtggttatccaggactatgataatcagcatgaacaggataggcctaccccttcacctgccccgt

SEQ ID NO: 151698 - DNA, 75 bp, Artificial Sequence
  Synthetic
aatgttgcccaggtctgtgttgatgttgtttcgcaggtctatggtgttagccctggtttagtacataacctaatc

SEQ ID NO: 151699 - DNA, 75 bp, Artificial Sequence
  Synthetic
tggggaggtgtctgctttttgttcagctctttacaggtttaaccgctatgtccagcggcattcccttatcggagg

SEQ ID NO: 151700 - DNA, 75 bp, Artificial Sequence
  Synthetic
gcgcattttgttcggcgctataccggtttaaccgatctgtccagcggcactcacttttgggtacattatggtatc

SEQ ID NO: 151701 - DNA, 75 bp, Artificial Sequence
  Synthetic
ggttggcgctcggtcgagacctcgggtgtcgctgaggaggaggcgacctccggccttgtcatgctttgcatccat

SEQ ID NO: 151702 - DNA, 75 bp, Artificial Sequence
  Synthetic
atatctatttcattttggccccaaacgacgactaccccgacatctgttgatatgaattctattacttctactgat

SEQ ID NO: 151703 - DNA, 75 bp, Artificial Sequence
  Synthetic
gtgtcgctgaggaggaggcgacctccggccttgtcatgctttgcatccatggatcacctgtaaattcttatacaa

SEQ ID NO: 151704 - DNA, 75 bp, Artificial Sequence
  Synthetic
gtatgtctcagacactgttacctttgtcaatgtggctacgggagctcaggctgtttctcgctcccttgactggtc

SEQ ID NO: 151705 - DNA, 75 bp, Artificial Sequence
  Synthetic
gtttaaccgatctgtccagcggcactcacttttgggtacattatggtatcatccggagggcctactgggcctctt

SEQ ID NO: 151706 - DNA, 75 bp, Artificial Sequence
  Synthetic
ctatgataatcagcatgaacaggataggcctaccccttcacctgccccgtctcgccccttctcggtccttcgtgc

SEQ ID NO: 151707 - DNA, 75 bp, Artificial Sequence
  Synthetic
ctggtctgtttctggcttctctagtgatttcgcaccagtcggggtatctgacccggcacctgacatgtctgctgc

SEQ ID NO: 151708 - DNA, 75 bp, Artificial Sequence
  Synthetic
gatttcgcaccagtcggggtatctgacccggcacctgacatgtctgctgccggagccatctgcccccccccgcct

SEQ ID NO: 151709 - DNA, 75 bp, Artificial Sequence
  Synthetic
gtcaatgtggctacgggagctcaggctgtttctcgctcccttgactggtctaaggttaccttggatggtcgacct

SEQ ID NO: 151710 - DNA, 75 bp, Artificial Sequence
  Synthetic
taggtgctgataccccgccaccggttccccttgcacagactcagccccctactcccagttatgtggtgcccccgc

SEQ ID NO: 151711 - DNA, 75 bp, Artificial Sequence
  Synthetic
ggcactaccaaggccgggtatccctataactataacaccactgctagtgatcagatcttgatagagaatgcagcc

SEQ ID NO: 151712 - DNA, 75 bp, Artificial Sequence
  Synthetic
atacgaacacgcgtgtttctcgctactcgagcagcgcgcgtcataagttgcgccgagggcctgacggtactgctg

SEQ ID NO: 151713 - DNA, 75 bp, Artificial Sequence
  Synthetic
cgatcagtcccagcgccccgccgctcccgcccgtcgtcgatctgccccagctggggcttcgccgttgacggccac

SEQ ID NO: 151714 - DNA, 75 bp, Artificial Sequence
  Synthetic
cctgcgagttcgaccatggtgcccattgcacagggccatacatcgccggttcgccgcaaccgccgtctacttttc

SEQ ID NO: 151715 - DNA, 75 bp, Artificial Sequence
  Synthetic
acactactagcctcggtgctggtccagtgtctgtctctgcggttggtgttcttgccccgcattctgctttagctg

SEQ ID NO: 151716 - DNA, 75 bp, Artificial Sequence
  Synthetic
taatcttgctgatacgcttctcggcgggctcccgacagaattaatttcgtcggctggtggtcaactattttattc

SEQ ID NO: 151717 - DNA, 75 bp, Artificial Sequence
  Synthetic
ttgcacagggccatacatcgccggttcgccgcaaccgccgtctacttttcacctatcccgatggagctaaagttt

SEQ ID NO: 151718 - DNA, 75 bp, Artificial Sequence
  Synthetic
gtctacgtcccctcttacatctactattgctactggcactaaccttgtactatatgctgccccgcttagtccttt

SEQ ID NO: 151719 - DNA, 75 bp, Artificial Sequence
  Synthetic
attgctactggcactaaccttgtactatatgctgccccgcttagtcctttgctcccgctccaagatggcactaat

SEQ ID NO: 151720 - DNA, 75 bp, Artificial Sequence
  Synthetic
gcctacagggttgtgcttttcaatctactattgctgaacttcagcgtcttaaaatgaaggtaggtaaaacccggg

SEQ ID NO: 151721 - DNA, 75 bp, Artificial Sequence
  Synthetic
gggtattgctattccacatgatatagatcttggtgagtcccgagtggtcatccaggattatgacaatcaacatga

SEQ ID NO: 151722 - DNA, 75 bp, Artificial Sequence
  Synthetic
gcctttgtcatgctttctttcagcgttttcccgaatcttttgaccacactaaatttgtcatgcgtgagggtcttg

SEQ ID NO: 151723 - DNA, 75 bp, Artificial Sequence
  Synthetic
tccaggattatgacaatcaacatgagcaagaccgtcccaccccgtcacctgccccttctcgtcctttttctgtcc

SEQ ID NO: 151724 - DNA, 75 bp, Artificial Sequence
  Synthetic
ttttcccgaatcttttgaccacactaaatttgtcatgcgtgagggtcttgccgcctataccctcacacctcggcc

SEQ ID NO: 151725 - DNA, 75 bp, Artificial Sequence
  Synthetic
ttggtgccgaatgctgttggcgggtatgctatatctatctccttctggcctcagactacaaccaccccaacgtct

SEQ ID NO: 151726 - DNA, 75 bp, Artificial Sequence
  Synthetic
atgctatatctatctccttctggcctcagactacaaccaccccaacgtctgtggatatgaattccattacttcta

SEQ ID NO: 151727 - DNA, 75 bp, Artificial Sequence
  Synthetic
caaactacctatggttcttctaccaatcctatgtatgtttctgatactgtgacgtttgtcaacgtggccactgga

SEQ ID NO: 151728 - DNA, 75 bp, Artificial Sequence
  Synthetic
ttgctcacgtcttgggacagcggcttacccgttgctcggctcgggtatctaccaagttccggttggccccagttt

SEQ ID NO: 151729 - DNA, 75 bp, Artificial Sequence
  Synthetic
atcctatgtatgtttctgatactgtgacgtttgtcaacgtggccactggagcccagggggtcgcacgttctctgg

SEQ ID NO: 151730 - DNA, 75 bp, Artificial Sequence
  Synthetic
tacccgttgctcggctcgggtatctaccaagttccggttggccccagttttgatgcctgggagcgtaaccaccgc

SEQ ID NO: 151731 - DNA, 75 bp, Artificial Sequence
  Synthetic
agtcttaattaatttcatcctgtacccccttctaggctttgctatattttcttttttctgcgtttcgcgctccct

SEQ ID NO: 151732 - DNA, 75 bp, Artificial Sequence
  Synthetic
atcaaggctggcgctcggttgagacctccggtgtcgcggaggaggaggcgacctctggcctagttatgttgtgta

SEQ ID NO: 151733 - DNA, 75 bp, Artificial Sequence
  Synthetic
ctccggtgtcgcggaggaggaggcgacctctggcctagttatgttgtgtatccatggatcacctgtgaattctta

SEQ ID NO: 151734 - DNA, 75 bp, Artificial Sequence
  Synthetic
ccctccgtggtaaactttctttctgggaggccggcactaccaaatctggctacccctacaattacaatactactg

SEQ ID NO: 151735 - DNA, 75 bp, Artificial Sequence
  Synthetic
accatcactgaggatactgcgaggactgccaacctcgctcttgagatagatgctgccactgagataggccgggcc

SEQ ID NO: 151736 - DNA, 75 bp, Artificial Sequence
  Synthetic
tggagctggatgcggccaccgaggtcggccgggcgtgcgctggttgtcgtgttgaacctggtgttgttcattatc

SEQ ID NO: 151737 - DNA, 75 bp, Artificial Sequence
  Synthetic
tggcaatacgaacacccgtgtgtctcgttactcgagcagcgcgcgtcataagttgcgccggggggctgatggcac

SEQ ID NO: 151738 - DNA, 75 bp, Artificial Sequence
  Synthetic
ctgggcccgtctctatttctgctgtgggtgtactagcaccccattctgcattggctgctctggaggacacggttg

SEQ ID NO: 151739 - DNA, 75 bp, Artificial Sequence
  Synthetic
cggtcgattcagcaaggcgatgttgatgttgttgttgtcccgacgcgtgaactccgcgatagctggcgacgccgt

SEQ ID NO: 151740 - DNA, 75 bp, Artificial Sequence
  Synthetic
tgctgagttaaccactactgctgctacacgttttatgaaggacctccattttactgggaccaacggtgttggtga

SEQ ID NO: 151741 - DNA, 75 bp, Artificial Sequence
  Synthetic
atgttgttgttgtcccgacgcgtgaactccgcgatagctggcgacgccgtggctttgcggccttcaccccgcaca

SEQ ID NO: 151742 - DNA, 75 bp, Artificial Sequence
  Synthetic
tgcatatgcagagggctgcctccgttcaccttctcggtgacccgaatcagatccccgctatagactttgagaaca

SEQ ID NO: 151743 - DNA, 75 bp, Artificial Sequence
  Synthetic
ttacttttgctgcacatgcagcgggcctcttcagtccatctccttggtgaccctaaccaaatccctgctattgat

SEQ ID NO: 151744 - DNA, 75 bp, Artificial Sequence
  Synthetic
ttttgcttgtgccttccttcgattagttttctttatttctctcttctgcgtttcgcgctccctggaaaaaaaaaa

SEQ ID NO: 151745 - DNA, 75 bp, Artificial Sequence
  Synthetic
tcaccttctcggtgacccgaatcagatccccgctatagactttgagaacacggggctggtcccggcaattcgccc

SEQ ID NO: 151746 - DNA, 75 bp, Artificial Sequence
  Synthetic
ttatccaaaaatccagactgctagccgtgtcctgcgttcgcttttctggggtgaggccccagtcggccagaagct

SEQ ID NO: 151747 - DNA, 75 bp, Artificial Sequence
  Synthetic
cgtgtcctgcgttcgcttttctggggtgaggccccagtcggccagaagcttgtgtttacacaggcggccaaggct

SEQ ID NO: 151748 - DNA, 75 bp, Artificial Sequence
  Synthetic
ttgttttggggggagccccctgtgggccagaagctggtattcacccaagcggccaaggctgctaaccctggtgca

SEQ ID NO: 151749 - DNA, 75 bp, Artificial Sequence
  Synthetic
ctcctgccccttctcgtcctttctcagttcttcgtgctaatgatgttctctggctttcccttacagctgctgagt

SEQ ID NO: 151750 - DNA, 75 bp, Artificial Sequence
  Synthetic
agttcttcgtgctaatgatgttctctggctttcccttacagctgctgagtacgatcagactacgtatggttcttc

SEQ ID NO: 151751 - DNA, 75 bp, Artificial Sequence
  Synthetic
attacagttcatgaagcccagggcgcgacatttactgagactacgatcatcgccacggcggatgctcgcgggctg

SEQ ID NO: 151752 - DNA, 75 bp, Artificial Sequence
  Synthetic
ttttccggcctgaggttttatggaatcacccaattcagcgtgtgatccacaatgagctcgaacagtattgtcggg

SEQ ID NO: 151753 - DNA, 75 bp, Artificial Sequence
  Synthetic
gatgcccgagggttgattcagtcttcacgagcgcatgcaattgttgctctgacccgtcacaccgagaagtgcgtg

SEQ ID NO: 151754 - DNA, 75 bp, Artificial Sequence
  Synthetic
cacgagcgcatgcaattgttgctctgacccgtcacaccgagaagtgcgtggtgcttgatgctcctggccttctca

SEQ ID NO: 151755 - DNA, 75 bp, Artificial Sequence
  Synthetic
gctttttaaaacctgttggccgcgatgttcagcggtggtacaccgcccctacccgtggccctgcagcgaactgtc

SEQ ID NO: 151756 - DNA, 75 bp, Artificial Sequence
  Synthetic
ccttgattggtccaaggttacccttgatgggcgcccgcttaccactatccagcagtattctaaaactttctttgt

SEQ ID NO: 151757 - DNA, 75 bp, Artificial Sequence
  Synthetic
gaagtgtgtggtagttgatgccccagggcttctccgtgaggtaggtatctccgatgccattgtcaataatttctt

SEQ ID NO: 151758 - DNA, 75 bp, Artificial Sequence
  Synthetic
tgttcagcggtggtacaccgcccctacccgtggccctgcagcgaactgtcgccgatcggcccttcgtggccttcc

SEQ ID NO: 151759 - DNA, 75 bp, Artificial Sequence
  Synthetic
gatgggcgcccgcttaccactatccagcagtattctaaaactttctttgtccttcctctccgtggtaagctctcc

SEQ ID NO: 151760 - DNA, 75 bp, Artificial Sequence
  Synthetic
cagtcatacctcgtggcacccctgacctcaatgctgccacgctagatgctttcccgccctcctgtcagatcagtg

SEQ ID NO: 151761 - DNA, 75 bp, Artificial Sequence
  Synthetic
cctcaatgctgccacgctagatgctttcccgccctcctgtcagatcagtgcttattatcagcttgctgaggagct

SEQ ID NO: 151762 - DNA, 75 bp, Artificial Sequence
  Synthetic
ctcactgcacgatctctggcccgccgatgtcgctgaggcgatggctcgccacggcatgactcggttgtatgcagc

SEQ ID NO: 151763 - DNA, 75 bp, Artificial Sequence
  Synthetic
gagaatgcagccgggcaccgtgtctgcatctctacctatacaactaatttaggttctgggcctgtttctatctct

SEQ ID NO: 151764 - DNA, 75 bp, Artificial Sequence
  Synthetic
gatgtcgctgaggcgatggctcgccacggcatgactcggttgtatgcagccctccacctccccccggaggtgcta

SEQ ID NO: 151765 - DNA, 75 bp, Artificial Sequence
  Synthetic
gtgcgggccattgggtgtcattttgtgctgctgctcaccgcagcccctgaaccgtcacctatgccttatgttccc

SEQ ID NO: 151766 - DNA, 75 bp, Artificial Sequence
  Synthetic
tcaagaactcacggcctccgatagtgtcctggtattcgagctcaccgatatagtccactgtcgcatggccgcgcc

SEQ ID NO: 151767 - DNA, 75 bp, Artificial Sequence
  Synthetic
gtcctggtattcgagctcaccgatatagtccactgtcgcatggccgcgccaagccagcggaaggctgtgctttcc

SEQ ID NO: 151768 - DNA, 75 bp, Artificial Sequence
  Synthetic
ggggactctagcgctgggtacaaccatgatgtatccatcctgcgcgcctggatccgcactaccaaggtcactggt

SEQ ID NO: 151769 - DNA, 75 bp, Artificial Sequence
  Synthetic
gtaaaacccgggagtactgatttattctttctgtgccttccttctgtcctgtttcttttattttccttttctgcg

SEQ ID NO: 151770 - DNA, 75 bp, Artificial Sequence
  Synthetic
aagtttattcccaccatcggccctgtgcaggccaccacttgcgaactttatgagcttgttgaagccatggtggag

SEQ ID NO: 151771 - DNA, 75 bp, Artificial Sequence
  Synthetic
gctcctcctcacagccgcgcctgaaccatcaccaatgccctatgttccatatcctcgttctaccgaggtttatgt

SEQ ID NO: 151772 - DNA, 75 bp, Artificial Sequence
  Synthetic
tgcaggccaccacttgcgaactttatgagcttgttgaagccatggtggagaagggccaggacgggtcggccgtct

SEQ ID NO: 151773 - DNA, 75 bp, Artificial Sequence
  Synthetic
tccactcgagccacccgccccagaactatcatctcctgttgaggttgatacacctgtggctgttggcgtcccatc

SEQ ID NO: 151774 - DNA, 75 bp, Artificial Sequence
  Synthetic
gtgagacgattgcccatggcaaagttggccagggtatatccgcgtggagcaaaacattctgtgccctattcgggc

SEQ ID NO: 151775 - DNA, 75 bp, Artificial Sequence
  Synthetic
tggccagggtatatccgcgtggagcaaaacattctgtgccctattcgggccttggtttcgtgccattgagaaacg

SEQ ID NO: 151776 - DNA, 75 bp, Artificial Sequence
  Synthetic
gctaatgacatacctccgtggcattagttacaaggttacggtcggtgctctcgtcgccaatgagggttggaatgc

SEQ ID NO: 151777 - DNA, 75 bp, Artificial Sequence
  Synthetic
tgctgctccggccccactgagcacctctactacacccccggtgccagcgcagcatgtaacccacccatctggctc

SEQ ID NO: 151778 - DNA, 75 bp, Artificial Sequence
  Synthetic
ttgaaaaggagattttggcagcgcttgcacccaatatcttttatggtgatgcttatgaggacacagttttggccg

SEQ ID NO: 151779 - DNA, 75 bp, Artificial Sequence
  Synthetic
tggtgcaaaggccagcatggtttttgagaatgacttttctgagtttgacagtacacaaaataacttctcactggg

SEQ ID NO: 151780 - DNA, 75 bp, Artificial Sequence
  Synthetic
tcttgagtgtgttattatggaagagtgcggtatgcctccgtggctaatccgcctttaccatctagtccgttccgc

SEQ ID NO: 151781 - DNA, 75 bp, Artificial Sequence
  Synthetic
tgacaacgaggcctatgaaggttctgaggtcgacccagctgagcctgcacatcttgatgtctcggggacttatgc

SEQ ID NO: 151782 - DNA, 75 bp, Artificial Sequence
  Synthetic
tgctggtttccaccttgatcctcgtgtgctcgtctttgacgaagcagccccctgccgctgccgtagccttctccg

SEQ ID NO: 151783 - DNA, 75 bp, Artificial Sequence
  Synthetic
tggaagaagcactctggtgagcctggcaccctgctgtggaataccgtctggaacatggcggttatagcacactgt

SEQ ID NO: 151784 - DNA, 75 bp, Artificial Sequence
  Synthetic
ctggaacactgtttggaatatggctattatagcgcattgttatgagttccgcaatctccaggctgccgcttttaa

SEQ ID NO: 151785 - DNA, 75 bp, Artificial Sequence
  Synthetic
attatagcgcattgttatgagttccgcaatctccaggctgccgcttttaaaggtgatgactctatggtgctctgc

SEQ ID NO: 151786 - DNA, 75 bp, Artificial Sequence
  Synthetic
gtacctgtttcctccagcccatcgaaggaagggttggtgagcagggttatgacaatgaggcatttgaggggtcgg

SEQ ID NO: 151787 - DNA, 75 bp, Artificial Sequence
  Synthetic
gtgtaggcgctggctttcggccggctttcatcttgatccacgggtgctggtttttgacgagtcggccccctgcca

SEQ ID NO: 151788 - DNA, 75 bp, Artificial Sequence
  Synthetic
ctgggtgtgggctaaaacttaaggtggattttaggcctattgggctatatgctggtgttgttgtggctccgggtc

SEQ ID NO: 151789 - DNA, 75 bp, Artificial Sequence
  Synthetic
ccgatcggcctgtacgccggcgttgtggtagctccaggtcttggggccctcccggatgttgtccggttcgccggg

SEQ ID NO: 151790 - DNA, 75 bp, Artificial Sequence
  Synthetic
tggtagctccaggtcttggggccctcccggatgttgtccggttcgccgggaggttgtctgagaaaaactggggcc

SEQ ID NO: 151791 - DNA, 75 bp, Artificial Sequence
  Synthetic
tctaccaggcgcttggcatcccttctgatcttgccgcccgagcgggtcggcttactgccaccgtcgaagtctctg

SEQ ID NO: 151792 - DNA, 75 bp, Artificial Sequence
  Synthetic
ctgccggtctgcaggtaaagatttcatctaatggtctggattgcactgccacattccccccaggtggcgccccta

SEQ ID NO: 151793 - DNA, 75 bp, Artificial Sequence
  Synthetic
ctgccggtctgcaggtaaagatttcatctaatggtctggattgcactgccacattcccccctggtggcgccccta

SEQ ID NO: 151794 - DNA, 75 bp, Artificial Sequence
  Synthetic
ctgccggtctgcaggtaaagatttcatctaatggtctggattgcactgccacattcccccccggtggcgccccta

SEQ ID NO: 151795 - DNA, 75 bp, Artificial Sequence
  Synthetic
ctgccggtctgcaggtaaagatttcatctaatggtctggattgcactgccacattccccccgggtggcgccccta

SEQ ID NO: 151796 - DNA, 75 bp, Artificial Sequence
  Synthetic
acattccccccaggtggcgcccctagcgccgcgccgggggaggtggcagccttctgcagtgctctttatagatac

SEQ ID NO: 151797 - DNA, 75 bp, Artificial Sequence
  Synthetic
acattccccccaggtggcgcccctagcgccgcgccgggggaggtggctgccttctgcagtgctctttatagatac

SEQ ID NO: 151798 - DNA, 75 bp, Artificial Sequence
  Synthetic
acattccccccaggtggcgcccctagcgccgcgccgggggaggtggccgccttctgcagtgctctttatagatac

SEQ ID NO: 151799 - DNA, 75 bp, Artificial Sequence
  Synthetic
acattccccccaggtggcgcccctagcgccgcgccgggggaggtggcggccttctgcagtgctctttatagatac

SEQ ID NO: 151800 - DNA, 75 bp, Artificial Sequence
  Synthetic
acattcccccctggtggcgcccctagcgccgcgccgggggaggtggcagccttctgcagtgctctttatagatac

SEQ ID NO: 151801 - DNA, 75 bp, Artificial Sequence
  Synthetic
acattcccccctggtggcgcccctagcgccgcgccgggggaggtggctgccttctgcagtgctctttatagatac

SEQ ID NO: 151802 - DNA, 75 bp, Artificial Sequence
  Synthetic
acattcccccctggtggcgcccctagcgccgcgccgggggaggtggccgccttctgcagtgctctttatagatac

SEQ ID NO: 151803 - DNA, 75 bp, Artificial Sequence
  Synthetic
acattcccccctggtggcgcccctagcgccgcgccgggggaggtggcggccttctgcagtgctctttatagatac

SEQ ID NO: 151804 - DNA, 75 bp, Artificial Sequence
  Synthetic
acattcccccccggtggcgcccctagcgccgcgccgggggaggtggcagccttctgcagtgctctttatagatac

SEQ ID NO: 151805 - DNA, 75 bp, Artificial Sequence
  Synthetic
acattcccccccggtggcgcccctagcgccgcgccgggggaggtggctgccttctgcagtgctctttatagatac

SEQ ID NO: 151806 - DNA, 75 bp, Artificial Sequence
  Synthetic
acattcccccccggtggcgcccctagcgccgcgccgggggaggtggccgccttctgcagtgctctttatagatac

SEQ ID NO: 151807 - DNA, 75 bp, Artificial Sequence
  Synthetic
acattcccccccggtggcgcccctagcgccgcgccgggggaggtggcggccttctgcagtgctctttatagatac

SEQ ID NO: 151808 - DNA, 75 bp, Artificial Sequence
  Synthetic
acattccccccgggtggcgcccctagcgccgcgccgggggaggtggcagccttctgcagtgctctttatagatac

SEQ ID NO: 151809 - DNA, 75 bp, Artificial Sequence
  Synthetic
acattccccccgggtggcgcccctagcgccgcgccgggggaggtggctgccttctgcagtgctctttatagatac

SEQ ID NO: 151810 - DNA, 75 bp, Artificial Sequence
  Synthetic
acattccccccgggtggcgcccctagcgccgcgccgggggaggtggccgccttctgcagtgctctttatagatac

SEQ ID NO: 151811 - DNA, 75 bp, Artificial Sequence
  Synthetic
acattccccccgggtggcgcccctagcgccgcgccgggggaggtggcggccttctgcagtgctctttatagatac

SEQ ID NO: 151812 - DNA, 75 bp, Artificial Sequence
  Synthetic
tgtgcgtggatgttgtttctcgtgtttatggtgtcagcccgggtctggtacataaccttattggtatgctccaaa

SEQ ID NO: 151813 - DNA, 75 bp, Artificial Sequence
  Synthetic
agctagaggtcaacgggccagagcaatatgtgctgtcgtttgatttggctaaacagacgatggccgctggcccgc

SEQ ID NO: 151814 - DNA, 75 bp, Artificial Sequence
  Synthetic
tactgagacaatcaaaccagttcttgacctcacagacgctatcgtccagcggcgtgaatgaataacatgtttctt

SEQ ID NO: 151815 - DNA, 75 bp, Artificial Sequence
  Synthetic
atagccttagttatgttctgacatccgcgggccttgaggtgcgtgttgtttctgctgggcttgactgtaaggctg

SEQ ID NO: 151816 - DNA, 75 bp, Artificial Sequence
  Synthetic
ggggactttgtatacccgaacctggtcaacctctggtttttctagtgatttctccccccctgaggcggccgctcc

SEQ ID NO: 151817 - DNA, 75 bp, Artificial Sequence
  Synthetic
accgttgcgttcagcggcattctcttattgggggcttgtggtattaccctgaggggctaatcggcctgttcccac

SEQ ID NO: 151818 - DNA, 75 bp, Artificial Sequence
  Synthetic
gacagggttgattctcagcccttcgcactcccctatattcatccaaccaacccattcgccgctgatgtctccgca

SEQ ID NO: 151819 - DNA, 75 bp, Artificial Sequence
  Synthetic
cggtgtcagggttttctagctgtttctccccacttgagccccctgcctcgggttcactaccccctgcggagatcg

SEQ ID NO: 151820 - DNA, 75 bp, Artificial Sequence
  Synthetic
gtgcgtaagccggcaacatccccgcctccccgcactcgccgtctcctttacacctaccccgacggcgccaaggtg

SEQ ID NO: 151821 - DNA, 75 bp, Artificial Sequence
  Synthetic
ctccccacttgagccccctgcctcgggttcactaccccctgcggagatcgacccacccgtgactgttgatgcccc

SEQ ID NO: 151822 - DNA, 75 bp, Artificial Sequence
  Synthetic
ccccccgcttccactcgccgccgatctgccccatccggggctgcgccgctgactgctgttgctcccgccccaggt

SEQ ID NO: 151823 - DNA, 75 bp, Artificial Sequence
  Synthetic
ctgccccatccggggctgcgccgctgactgctgttgctcccgccccaggtactgctcccgtcccagacgttgatt

SEQ ID NO: 151824 - DNA, 75 bp, Artificial Sequence
  Synthetic
ggcctctgccatgctttttatcaacgtttcccagaagcgttctactcgactgaattcatcatgcgcgagggcctt

SEQ ID NO: 151825 - DNA, 75 bp, Artificial Sequence
  Synthetic
cgctgctgcttcggccccgccaggtgcccctggtgtgcccccggcaccagcgcggcctgtaacccacccatccgg

SEQ ID NO: 151826 - DNA, 75 bp, Artificial Sequence
  Synthetic
gcccctggtgtgcccccggcaccagcgcggcctgtaacccacccatccgggccccgccggcggttactccatact

SEQ ID NO: 151827 - DNA, 75 bp, Artificial Sequence
  Synthetic
accttgttctttatgccgccccactcaatccgcttttgcccctccaggacggtactaacacccacattatggcca

SEQ ID NO: 151828 - DNA, 75 bp, Artificial Sequence
  Synthetic
caatccgcttttgcccctccaggacggtactaacacccacattatggccacagaggcgtctaactatgctcaata

SEQ ID NO: 151829 - DNA, 75 bp, Artificial Sequence
  Synthetic
ctatagggttgagcaaaacccgaagaggcttgaggcagcgtaccgggaaacttgctcccgtcgtggcaccgctgc

SEQ ID NO: 151830 - DNA, 75 bp, Artificial Sequence
  Synthetic
cccggtcaccgccctggtggcggtctctgccatgcgttttaccagcggtttccggagtcatttgatcccgccgag

SEQ ID NO: 151831 - DNA, 75 bp, Artificial Sequence
  Synthetic
cttgctcccgtcgtggcaccgctgcctacccgcttttgggctcgggtatataccaggtccctgttagcctcagtt

SEQ ID NO: 151832 - DNA, 75 bp, Artificial Sequence
  Synthetic
cttctggcctcagaccactactacaccaacgtcagttgatatgaattcaattacttcgactgacgtccggatagt

SEQ ID NO: 151833 - DNA, 75 bp, Artificial Sequence
  Synthetic
ccaacgtcagttgatatgaattcaattacttcgactgacgtccggatagttgttcaacctggtcttgcctccgaa

SEQ ID NO: 151834 - DNA, 75 bp, Artificial Sequence
  Synthetic
aattcacgctgttgctcccgattatcgagtagaacataatcctaagaggctcgaggctgcctatcgggagacgtg

SEQ ID NO: 151835 - DNA, 75 bp, Artificial Sequence
  Synthetic
tactataactgaggacacggcccgtacggccaacctggcattagagattgatgccgccacagaggttggccgtgc

SEQ ID NO: 151836 - DNA, 75 bp, Artificial Sequence
  Synthetic
atggatcacctgtgaactcctacactaatacaccttacactggtgctctcggcttgctcgattttgcgcttgaac

SEQ ID NO: 151837 - DNA, 75 bp, Artificial Sequence
  Synthetic
gaggaggcaacatctggtttggttatgctctgcgttcatggctcccctgttaattcgtatactaatacaccttac

SEQ ID NO: 151838 - DNA, 75 bp, Artificial Sequence
  Synthetic
tgcctgggaacgtaaccaccggcccggggatgagttgtacctgaccgagccagctatagcttggtttgaggctaa

SEQ ID NO: 151839 - DNA, 75 bp, Artificial Sequence
  Synthetic
tgctctgcgttcatggctcccctgttaattcgtatactaatacaccttacactggtgctttaggtttgctagact

SEQ ID NO: 151840 - DNA, 75 bp, Artificial Sequence
  Synthetic
ggggatgagttgtacctgaccgagccagctatagcttggtttgaggctaaccggcctactctccctgcgcttacc

SEQ ID NO: 151841 - DNA, 75 bp, Artificial Sequence
  Synthetic
ctcgccatcgccttaagcgtggtgctgacggcacagctgttttaactactacagcggccactaggtttatgaagg

SEQ ID NO: 151842 - DNA, 75 bp, Artificial Sequence
  Synthetic
gccggctgtcgtgttgagcctggtgtcgtccactaccagtttacggcaggtgtccctggctccggcaagtcacgg

SEQ ID NO: 151843 - DNA, 75 bp, Artificial Sequence
  Synthetic
atctctcccaccgcacctgctgctgttacacatgcagcgggcctcctcggtccatctccttggtgatccaaacca

SEQ ID NO: 151844 - DNA, 75 bp, Artificial Sequence
  Synthetic
tgacggcacagctgttttaactactacagcggccactaggtttatgaaggatctgcattttactggtatgaatgg

SEQ ID NO: 151845 - DNA, 75 bp, Artificial Sequence
  Synthetic
tcgtccactaccagtttacggcaggtgtccctggctccggcaagtcacggtcaattcagcagggtgaggtcgatg

SEQ ID NO: 151846 - DNA, 75 bp, Artificial Sequence
  Synthetic
gccggcctggtccccgcgatccgccccgagcttgcgccaacgagctggtggcacgttacacaccgttgcccggcc

SEQ ID NO: 151847 - DNA, 75 bp, Artificial Sequence
  Synthetic
agaattgatttcgtcggctggaggccagctcttttattctcgtccagtcgtttcagccaatggcgaaccgtctgt

SEQ ID NO: 151848 - DNA, 75 bp, Artificial Sequence
  Synthetic
cggcccgcgtcacccgcggtcgcaggattgttattgacgaggccccggcacttccaccacatttacttctgctac

SEQ ID NO: 151849 - DNA, 75 bp, Artificial Sequence
  Synthetic
cagctcttttattctcgtccagtcgtttcagccaatggcgaaccgtctgtgaagctttacacctctgtggagaat

SEQ ID NO: 151850 - DNA, 75 bp, Artificial Sequence
  Synthetic
gattgttattgacgaggccccggcacttccaccacatttacttctgctacatatgcagcgggcctcgtcagtcca

SEQ ID NO: 151851 - DNA, 75 bp, Artificial Sequence
  Synthetic
cctaccccaaaattcagaccacgagccgtgtgctacggtccctgttttggaacgaaccggccatcggccaaaagt

SEQ ID NO: 151852 - DNA, 75 bp, Artificial Sequence
  Synthetic
gataatcaacatgagcaggaccggcctaccccgtcccctgccccctcccgacccttctctgtgcttcgcgctaat

SEQ ID NO: 151853 - DNA, 75 bp, Artificial Sequence
  Synthetic
gcttgtcccaacaaagtggtggcatcttacccataggtgcccagcagacgtctgtgagctaattcgtggcgcgta

SEQ ID NO: 151854 - DNA, 75 bp, Artificial Sequence
  Synthetic
cggagaccacaattatagccacggccgacgctaggggcctcattcagtcatcccgggcccatgctatagtcgcac

SEQ ID NO: 151855 - DNA, 75 bp, Artificial Sequence
  Synthetic
gtgcccagggggtctcgcgctccatggactggtctaaggtcacccttgatggacgcccgctaactactatccagc

SEQ ID NO: 151856 - DNA, 75 bp, Artificial Sequence
  Synthetic
ctaccccgtcccctgccccctcccgacccttctctgtgcttcgcgctaatgatgttctttggctttcactgactg

SEQ ID NO: 151857 - DNA, 75 bp, Artificial Sequence
  Synthetic
cgacgctaggggcctcattcagtcatcccgggcccatgctatagtcgcactcacccgccatactgagaagtgtgt

SEQ ID NO: 151858 - DNA, 75 bp, Artificial Sequence
  Synthetic
cttacccataggtgcccagcagacgtctgtgagctaattcgtggcgcgtatccaaagatccagacggcaagccgt

SEQ ID NO: 151859 - DNA, 75 bp, Artificial Sequence
  Synthetic
atgttgccaccggcgcccaggccgtggcccgcacccttgattggactaaggtcacgctggatggtcagcctctta

SEQ ID NO: 151860 - DNA, 75 bp, Artificial Sequence
  Synthetic
ggcccgcacccttgattggactaaggtcacgctggatggtcagcctcttaagaccatcaatcagtactctaagac

SEQ ID NO: 151861 - DNA, 75 bp, Artificial Sequence
  Synthetic
tggagaggtcggccatcaccgcccttctgtgatacctcgcggcaatcctgatcagaacctcgggactctacaggc

SEQ ID NO: 151862 - DNA, 75 bp, Artificial Sequence
  Synthetic
aaccctggtgcaattacagtccatgaggcccagggtgccacatttactgagaccactattattgctacggcagac

SEQ ID NO: 151863 - DNA, 75 bp, Artificial Sequence
  Synthetic
acttaaggtggattttaggcctattgggctgtatgctggtgttgttgtggccccgggcctcgggacccttcctga

SEQ ID NO: 151864 - DNA, 75 bp, Artificial Sequence
  Synthetic
ttacaacaccacagctagtgaccatatattaattgagaatgcagcaggccaccgtgttgcgatctccacttatac

SEQ ID NO: 151865 - DNA, 75 bp, Artificial Sequence
  Synthetic
gttgatgccccggggctccttcgtgaggttggtatttctgatgctattgttaataactttttcctttccggcggc

SEQ ID NO: 151866 - DNA, 75 bp, Artificial Sequence
  Synthetic
atattaattgagaatgcagcaggccaccgtgttgcgatctccacttataccacaagcctaggtgccggaccggtt

SEQ ID NO: 151867 - DNA, 75 bp, Artificial Sequence
  Synthetic
aggttggtatttctgatgctattgttaataactttttcctttccggcggccagattggtcaacaccgcccatcag

SEQ ID NO: 151868 - DNA, 75 bp, Artificial Sequence
  Synthetic
cgggctcatacatatgatgacttctgccctgagtgccgtactctcggcctccagggctgtgcatttcagtctact

SEQ ID NO: 151869 - DNA, 75 bp, Artificial Sequence
  Synthetic
accatcagcttgcggaggaactcggtcatcgaccggctccgatcgctgccgttttgcccccctgcccagagctcg

SEQ ID NO: 151870 - DNA, 75 bp, Artificial Sequence
  Synthetic
tcatcgaccggctccgatcgctgccgttttgcccccctgcccagagctcgaacagggtctgctttatatgcccca

SEQ ID NO: 151871 - DNA, 75 bp, Artificial Sequence
  Synthetic
tgaaggtgggtaaaactcgggagtactaatctatttttcttgtgccctccttcttttactcttttattttccttt

SEQ ID NO: 151872 - DNA, 75 bp, Artificial Sequence
  Synthetic
ccagcgcaaggcagtcctgtcgacccttgtcggcaggtatggccgtcgtacgaagttgtatgaggccgcccatgc

SEQ ID NO: 151873 - DNA, 75 bp, Artificial Sequence
  Synthetic
gactgaaattctcattaaccttatgcaacctcggcagctggttttccgcccggaggttttctggaaccaccctat

SEQ ID NO: 151874 - DNA, 75 bp, Artificial Sequence
  Synthetic
tttatccccgagctcggccccattagtgttaccacctgtgagctttacgagcttgtggaggctatggtagagaag

SEQ ID NO: 151875 - DNA, 75 bp, Artificial Sequence
  Synthetic
gagcagtattgccgtgctcgagctggtcgctgcctggaggtgggggctcatccaagatctatcaatgacaatcca

SEQ ID NO: 151876 - DNA, 75 bp, Artificial Sequence
  Synthetic
aaatattggccctactcccgcctaatatcttttatggcgacgcctatgaggagtcagtgtttgctgccgctgtgt

SEQ ID NO: 151877 - DNA, 75 bp, Artificial Sequence
  Synthetic
gacttctccgagtttgacagtacccagaataacttttccctcggcatagagtgtgctataatggaagagtgtggt

SEQ ID NO: 151878 - DNA, 75 bp, Artificial Sequence
  Synthetic
gacttctccgagtttgacagtacccagaataacttttccctcggcttagagtgtgctataatggaagagtgtggt

SEQ ID NO: 151879 - DNA, 75 bp, Artificial Sequence
  Synthetic
gacttctccgagtttgacagtacccagaataacttttccctcggcctagagtgtgctataatggaagagtgtggt

SEQ ID NO: 151880 - DNA, 75 bp, Artificial Sequence
  Synthetic
gacttctccgagtttgacagtacccagaataacttttccctcggcgtagagtgtgctataatggaagagtgtggt

SEQ ID NO: 151881 - DNA, 75 bp, Artificial Sequence
  Synthetic
gattgtaataaatttacgacaggagagacaatagcacacggcaaagttgggcaggggatatctgcgtggagcaaa

SEQ ID NO: 151882 - DNA, 75 bp, Artificial Sequence
  Synthetic
gcaggctgctctagcagcggccaattccgccctggcgaatgctgtggtggtacggccgttcctttcccgtatgca

SEQ ID NO: 151883 - DNA, 75 bp, Artificial Sequence
  Synthetic
ccggcggccaactgccgccgctccgctttacgcggcttaccccctgtcgatcgcacctactgcttcgacgggttc

SEQ ID NO: 151884 - DNA, 75 bp, Artificial Sequence
  Synthetic
ctttacgcggcttaccccctgtcgatcgcacctactgcttcgacgggttctcccgctgcgcctttgctgccgaga

SEQ ID NO: 151885 - DNA, 75 bp, Artificial Sequence
  Synthetic
ttctatggtgatgcatatgaagacacagtcctggccgctgctgttgctggggctcctggctgcaaggtttttgag

SEQ ID NO: 151886 - DNA, 75 bp, Artificial Sequence
  Synthetic
acagcgggttattcataacgagcttgaacaatactgtcgggctcgtgcgggtcgttgcctcgaagtcggggccca

SEQ ID NO: 151887 - DNA, 75 bp, Artificial Sequence
  Synthetic
cagtcctggccgctgctgttgctggggctcctggctgcaaggtttttgagaatgatttttctgagtttgatagca

SEQ ID NO: 151888 - DNA, 75 bp, Artificial Sequence
  Synthetic
cacgcctgtatgcggcccttcacttaccccctgaggttctgctaccacctggtacttatcataccacctcttatt

SEQ ID NO: 151889 - DNA, 75 bp, Artificial Sequence
  Synthetic
gaacaatactgtcgggctcgtgcgggtcgttgcctcgaagtcggggcccacccccgttcgatcaatgataaccct

SEQ ID NO: 151890 - DNA, 75 bp, Artificial Sequence
  Synthetic
accccctgaggttctgctaccacctggtacttatcataccacctcttatttgttgattcacgacggcgaccgcgc

SEQ ID NO: 151891 - DNA, 75 bp, Artificial Sequence
  Synthetic
tttaccatcttgtccgctctgcctgggtcctgcaagccccaaaggagtccctgcggggtttctggaagaagcact

SEQ ID NO: 151892 - DNA, 75 bp, Artificial Sequence
  Synthetic
ccggcggccaactgccgccggtcggcgctgcgcggcacccatcctgtggaccgtacctactgctttaatggattc

SEQ ID NO: 151893 - DNA, 75 bp, Artificial Sequence
  Synthetic
gactaaagtcaccggcgaccatccgctcgtgatagagcgtgttcgcgctattggctgccatttcgtgttactgct

SEQ ID NO: 151894 - DNA, 75 bp, Artificial Sequence
  Synthetic
cgctgcgcggcacccatcctgtggaccgtacctactgctttaatggattctcgggctgcacttttgcagccgaga

SEQ ID NO: 151895 - DNA, 75 bp, Artificial Sequence
  Synthetic
gaacacggtctggaacatggcggtaatagcacactgttacgagttccgcgacttgaaagtcgcggcgtttaaagg

SEQ ID NO: 151896 - DNA, 75 bp, Artificial Sequence
  Synthetic
gtgattcccagtgagcgcctgcactatcgcaatcagggctggcgttcggttgagacctctggtgtcgcggaggag

SEQ ID NO: 151897 - DNA, 75 bp, Artificial Sequence
  Synthetic
tgagacctctggtgtcgcggaggaggaggcgacctccggccttgttatgctctgcatccatggatcacctgtgaa

SEQ ID NO: 151898 - DNA, 75 bp, Artificial Sequence
  Synthetic
ccagactgtatgcggttttacacctcccccctgaagtactgctcccacctggcacctaccacacaacatcctatc

SEQ ID NO: 151899 - DNA, 75 bp, Artificial Sequence
  Synthetic
cccccctgaagtactgctcccacctggcacctaccacacaacatcctatcttctcattcatgatgggaatcgtgc

SEQ ID NO: 151900 - DNA, 75 bp, Artificial Sequence
  Synthetic
tctatggagttagccccgggctggtacataaccttattggcatgctgcagaccattgctgatggcaaggcccact

SEQ ID NO: 151901 - DNA, 75 bp, Artificial Sequence
  Synthetic
ctatctccgcgggatcagttataaggtgaccgttggtgcacttgtcgccaacgaaggctggaacgcctctgagga

SEQ ID NO: 151902 - DNA, 75 bp, Artificial Sequence
  Synthetic
gaccaaggtcaccggcgaccacccgttggtgattgagcgagttcgcgctataggctgtcactttgtgctactcct

SEQ ID NO: 151903 - DNA, 75 bp, Artificial Sequence
  Synthetic
ttggtgattgagcgagttcgcgctataggctgtcactttgtgctactcctcacagctgtgcctgaaccgtcgccg

SEQ ID NO: 151904 - DNA, 75 bp, Artificial Sequence
  Synthetic
cgcttggcgtgaccagtcccagcgcccctccgctgccccccgtcgtcgatctgccccagctggggctgcgccgct

SEQ ID NO: 151905 - DNA, 75 bp, Artificial Sequence
  Synthetic
ctctttccctctgcctgctctacaaagtctacattccatgccgtccctgtcaatatctgggacaggcttatgctg

SEQ ID NO: 151906 - DNA, 75 bp, Artificial Sequence
  Synthetic
cggtgaccagggccatgataacgaggcttatgaggggtctgaggtcgaccctgctgagcccgccccgtctgatgt

SEQ ID NO: 151907 - DNA, 75 bp, Artificial Sequence
  Synthetic
agtctacattccatgccgtccctgtcaatatctgggacaggcttatgctgtttggtgcgacgctggacgatcagg

SEQ ID NO: 151908 - DNA, 75 bp, Artificial Sequence
  Synthetic
gcgagccggggaccttgttgtggaatacagtttggaacatggctgtgattgcgcattgttatgagttccgcagcc

SEQ ID NO: 151909 - DNA, 75 bp, Artificial Sequence
  Synthetic
tttgatgaggcagtcccttgtcgttgtaggagttttctaaagaaagttgctggcaagttttgttgctttatgaag

SEQ ID NO: 151910 - DNA, 75 bp, Artificial Sequence
  Synthetic
acgagggctggaatgcctctgaggatgccctgaccgcggtgatcacagcggcctacctcaccatctgccaccaga

SEQ ID NO: 151911 - DNA, 75 bp, Artificial Sequence
  Synthetic
tgccctgaccgcggtgatcacagcggcctacctcaccatctgccaccagaggtaccttcgcacccaggcaatatc

SEQ ID NO: 151912 - DNA, 75 bp, Artificial Sequence
  Synthetic
gtaggagttttctaaagaaagttgctggcaagttttgttgctttatgaagtggcttgggcaggagtgcacttgtt

SEQ ID NO: 151913 - DNA, 75 bp, Artificial Sequence
  Synthetic
ttggtggctatgccatttccatttctttctggccccaaactacaactacccctacttctgtcgatatgaattcta

SEQ ID NO: 151914 - DNA, 75 bp, Artificial Sequence
  Synthetic
atccggccgtgattatatccctggccgccagctgcagttttatgcccagtgccgccggtggctatccgccgggtt

SEQ ID NO: 151915 - DNA, 75 bp, Artificial Sequence
  Synthetic
cgccagctgcagttttatgcccagtgccgccggtggctatccgccgggttccatcttgaccctcgggtgcttgtg

SEQ ID NO: 151916 - DNA, 75 bp, Artificial Sequence
  Synthetic
gactgctgtggccccggctcctgataccgctcctgtccccgatgttgattctcgcggcgcaatattacgccgcca

SEQ ID NO: 151917 - DNA, 75 bp, Artificial Sequence
  Synthetic
ttagactgtgtggcagtcttcccctccgggagggccccgagtgtcggggccgcagaggttacggccttctgtagc

SEQ ID NO: 151918 - DNA, 75 bp, Artificial Sequence
  Synthetic
accgctcctgtccccgatgttgattctcgcggcgcaatattacgccgccaatataatttatctacatccccgctt

SEQ ID NO: 151919 - DNA, 75 bp, Artificial Sequence
  Synthetic
tgttgagaccacgggtgtggctgaggaggaggctacttccggtctggtaatgctttgcattcatggctctcctgt

SEQ ID NO: 151920 - DNA, 75 bp, Artificial Sequence
  Synthetic
tggcttgggcaagagtgcacgtgtttcctccaacccatcgagggccgtgtcggtgacgagggttacgacaatgag

SEQ ID NO: 151921 - DNA, 75 bp, Artificial Sequence
  Synthetic
tcctccaacccatcgagggccgtgtcggtgacgagggttacgacaatgaggcttttgaggggtctgatgtggacc

SEQ ID NO: 151922 - DNA, 75 bp, Artificial Sequence
  Synthetic
actggtgcgctggggcttcttgattttgcactagagcttgaatttaggaatttgacacccgggaacaccaacacc

SEQ ID NO: 151923 - DNA, 75 bp, Artificial Sequence
  Synthetic
ggaactaatactcatattatggctactgaagcatcaaactacgcccagtatcgcgttgtccgcgccactattcgg

SEQ ID NO: 151924 - DNA, 75 bp, Artificial Sequence
  Synthetic
tacaccagaacttggtccatgtctggcttctctagtgatttttcgccacctgaggcgactgccggcgcccccccc

SEQ ID NO: 151925 - DNA, 75 bp, Artificial Sequence
  Synthetic
atgggggctgggccccatagtctaacatatgagctcacccctgctggtttgcaggttaggatatcctccaacggc

SEQ ID NO: 151926 - DNA, 75 bp, Artificial Sequence
  Synthetic
cacttgggatcccgcccgatttggctgctcgtgctagccggcttgcggccactgttgaggttgatgatactgccg

SEQ ID NO: 151927 - DNA, 75 bp, Artificial Sequence
  Synthetic
cccgctagcctgccctgcacaccggctccctccgagattgccgttcgaaccctgccgccccctcccgtggactca

SEQ ID NO: 151928 - DNA, 75 bp, Artificial Sequence
  Synthetic
ctgaagcatcaaactacgcccagtatcgcgttgtccgcgccactattcggtaccgtccactcgtgccgaatgccg

SEQ ID NO: 151929 - DNA, 75 bp, Artificial Sequence
  Synthetic
tcacttccaccgatgttcggattcttgtccagcctggtattgcctctgaacttgtgatccctagcgagcgcctgc

SEQ ID NO: 151930 - DNA, 75 bp, Artificial Sequence
  Synthetic
tgtccagcctggtattgcctctgaacttgtgatccctagcgagcgcctgcattaccgtaatcaaggctggcgttc

SEQ ID NO: 151931 - DNA, 75 bp, Artificial Sequence
  Synthetic
tgctcgtgctagccggcttgcggccactgttgaggttgatgatactgccggccgccttgcctgcaggacaactct

SEQ ID NO: 151932 - DNA, 75 bp, Artificial Sequence
  Synthetic
cccagcgccactcgctaaccggcgggttgtggttgcaccctgaggggctcttgggtctgttccctcccttctccc

SEQ ID NO: 151933 - DNA, 75 bp, Artificial Sequence
  Synthetic
cgccgccttctttacacctacccagatggtgctaaagtttattcagggtccttgtttgagtctgattgtgactgg

SEQ ID NO: 151934 - DNA, 75 bp, Artificial Sequence
  Synthetic
ctcgtttgattcagctaagcagtgcatggcggctgggccgcatagtctcagctatacattgacctccgcgggtct

SEQ ID NO: 151935 - DNA, 75 bp, Artificial Sequence
  Synthetic
tctcagccaatggcgagccaacagtaaagttatatacatctgttgagaatgcgcagcaagacaagggcatcacca

SEQ ID NO: 151936 - DNA, 75 bp, Artificial Sequence
  Synthetic
gaattcttatactaatacaccctatactggtgcccttggtttgctcgattttgcactcgagcttgagttccgcaa

SEQ ID NO: 151937 - DNA, 75 bp, Artificial Sequence
  Synthetic
gcttttctagtgacttttccccccctgaggcggctttcgccgccccaacctttgacgagaggttgcccccgggca

SEQ ID NO: 151938 - DNA, 75 bp, Artificial Sequence
  Synthetic
atggcggctgggccgcatagtctcagctatacattgacctccgcgggtcttgaagtgcagttgactactgccggg

SEQ ID NO: 151939 - DNA, 75 bp, Artificial Sequence
  Synthetic
tttgacacctggtaatacaaatacgcgcgtttcccgatactcgagcagcgcgcgccacaagcttcgccgcgggcc

SEQ ID NO: 151940 - DNA, 75 bp, Artificial Sequence
  Synthetic
gccttataccggtttaaccgctctactcagcggcactccattgccggcggactgtggtaccaccctgaggggctg

SEQ ID NO: 151941 - DNA, 75 bp, Artificial Sequence
  Synthetic
ctcagcggcactccattgccggcggactgtggtaccaccctgaggggctgctgggtccgttccccccgttctccc

SEQ ID NO: 151942 - DNA, 75 bp, Artificial Sequence
  Synthetic
gcccagccccgctccgcctaagccccccgtccgtaagccaacccctccaccaccaacccgtaaccgtcggcttct

SEQ ID NO: 151943 - DNA, 75 bp, Artificial Sequence
  Synthetic
agctcgaacagtattgccgagcccgggccggccgctgccttgaagtgggtgcccacccacgttctattaatgaca

SEQ ID NO: 151944 - DNA, 75 bp, Artificial Sequence
  Synthetic
ccgctgagtatgaccagactacgtatgggtcgtccaccaaccctatgtatgtctctgacacagttacgcttgtta

SEQ ID NO: 151945 - DNA, 75 bp, Artificial Sequence
  Synthetic
tgaggcggctttcgccgccccaacctttgacgagaggttgcccccgggcaccccctcttctgttagtgacgtctg

SEQ ID NO: 151946 - DNA, 75 bp, Artificial Sequence
  Synthetic
gagcgaaaccatcggcccggggatgaactttacctcacagagccagccaccgcttggtttgaggccaataagcct

SEQ ID NO: 151947 - DNA, 75 bp, Artificial Sequence
  Synthetic
gcttttcgagccatttctccccccctgacttagatttggttgatgccccgccggccgctgagcttactgcttttc

SEQ ID NO: 151948 - DNA, 75 bp, Artificial Sequence
  Synthetic
cagattgtgattggctgattaatgcgtccaaccccggccaccgtcctggtggtggcctctgtcatgccttttacc

SEQ ID NO: 151949 - DNA, 75 bp, Artificial Sequence
  Synthetic
cagattgtgattggctgtttaatgcgtccaaccccggccaccgtcctggtggtggcctctgtcatgccttttacc

SEQ ID NO: 151950 - DNA, 75 bp, Artificial Sequence
  Synthetic
cagattgtgattggctgcttaatgcgtccaaccccggccaccgtcctggtggtggcctctgtcatgccttttacc

SEQ ID NO: 151951 - DNA, 75 bp, Artificial Sequence
  Synthetic
cagattgtgattggctggttaatgcgtccaaccccggccaccgtcctggtggtggcctctgtcatgccttttacc

SEQ ID NO: 151952 - DNA, 75 bp, Artificial Sequence
  Synthetic
tgacttagatttggttgatgccccgccggccgctgagcttactgcttttcctgtagaaattgacccgcgtcccgt

SEQ ID NO: 151953 - DNA, 75 bp, Artificial Sequence
  Synthetic
gtcggcccttcgtgggcttccacctgttgaccggacatattgttttgatggcttctctggctgtacatttgctgc

SEQ ID NO: 151954 - DNA, 75 bp, Artificial Sequence
  Synthetic
gcctgtggcccgggaggcccacccgcctgaccctcagcccccggtccgctctccggccatcggtttttccttgcc

SEQ ID NO: 151955 - DNA, 75 bp, Artificial Sequence
  Synthetic
cctgaccctcagcccccggtccgctctccggccatcggtttttccttgcccggccgccggctactgcacacctac

SEQ ID NO: 151956 - DNA, 75 bp, Artificial Sequence
  Synthetic
catgacccggctgtatgcagcccttcatctccccccggaggtactacttccccccggcacctatcatactacttc

SEQ ID NO: 151957 - DNA, 75 bp, Artificial Sequence
  Synthetic
cgcttacccactactggggtcggggatttatcaagtccctgtgggtttaagttttgacgcctgggagcgcaacca

SEQ ID NO: 151958 - DNA, 75 bp, Artificial Sequence
  Synthetic
atttatcaagtccctgtgggtttaagttttgacgcctgggagcgcaaccaccgtccgggcgatgagctctaccta

SEQ ID NO: 151959 - DNA, 75 bp, Artificial Sequence
  Synthetic
atttatcaagtccctgtgggtttaagttttgacgcctgggagcgcaaccaccgtccgggcgatgagctctacctt

SEQ ID NO: 151960 - DNA, 75 bp, Artificial Sequence
  Synthetic
atttatcaagtccctgtgggtttaagttttgacgcctgggagcgcaaccaccgtccgggcgatgagctctacctc

SEQ ID NO: 151961 - DNA, 75 bp, Artificial Sequence
  Synthetic
atttatcaagtccctgtgggtttaagttttgacgcctgggagcgcaaccaccgtccgggcgatgagctctacctg

SEQ ID NO: 151962 - DNA, 75 bp, Artificial Sequence
  Synthetic
ctccacactctgcccttgccgttcttgaggatactattgattaccccgcccgtgcccatacttttgatgattttt

SEQ ID NO: 151963 - DNA, 75 bp, Artificial Sequence
  Synthetic
cgtgctgtgattacatatgagggggactctagtgccgggtataatcacgacgtgtccatcttgcgcgcctggatc

SEQ ID NO: 151964 - DNA, 75 bp, Artificial Sequence
  Synthetic
ggccaccgccccggtgggggcctgtgtcatgcattctaccagcggtttcctgagtccttcgacccttcccagttt

SEQ ID NO: 151965 - DNA, 75 bp, Artificial Sequence
  Synthetic
gtcatgcattctaccagcggtttcctgagtccttcgacccttcccagtttgtgatgactgatggccatgcagctt

SEQ ID NO: 151966 - DNA, 75 bp, Artificial Sequence
  Synthetic
gttaccctcgatgggcgcccgcttactactattcagcagtactctaagaccttctttgtcctaccccttcgcggt

SEQ ID NO: 151967 - DNA, 75 bp, Artificial Sequence
  Synthetic
cgcacggctaaccttgcgcttgagattgactctgccaccgaggtgggccgtgcctgtgctggctgcactgttagc

SEQ ID NO: 151968 - DNA, 75 bp, Artificial Sequence
  Synthetic
ttaattaattccttctgtgcccccttcgtagtttctttcgcttttatttcttatttctgctttccgcgctccctg

SEQ ID NO: 151969 - DNA, 75 bp, Artificial Sequence
  Synthetic
tgcctgtgctggctgcactgttagccctggggttgttcattatcagtttactgccggggtacctggttctgggaa

SEQ ID NO: 151970 - DNA, 75 bp, Artificial Sequence
  Synthetic
aggcggcctaccgtgaaacgtgtgcccgtcgcgggactgccgcctaccccctgttgggcgccgggatttatcaag

SEQ ID NO: 151971 - DNA, 75 bp, Artificial Sequence
  Synthetic
cttctttgtcctaccccttcgcggtaagctttccttctgggaggctggtactactaaggctggctatccgtacaa

SEQ ID NO: 151972 - DNA, 75 bp, Artificial Sequence
  Synthetic
ccgtcgcgggactgccgcctaccccctgttgggcgccgggatttatcaagtccctgtgagtttgagttttgacgc

SEQ ID NO: 151973 - DNA, 75 bp, Artificial Sequence
  Synthetic
cgccaatgccttatgtcccataccctcgttctactgaggtttatgtccggtccattttcggccccggcggatcgc

SEQ ID NO: 151974 - DNA, 75 bp, Artificial Sequence
  Synthetic
tccgccttggcgaatgctgtggtggttcggccgtttttgtctcgtgtgcaaaccgagattcttattaatttgatg

SEQ ID NO: 151975 - DNA, 75 bp, Artificial Sequence
  Synthetic
tgctttttggtgcaactcttgacgaccaggctttttgctgttcgagacttatgacgtatcttcgtggcattagtt

SEQ ID NO: 151976 - DNA, 75 bp, Artificial Sequence
  Synthetic
aaccgagattcttattaatttgatgcaaccccggcagttggttttccgccctgaggtgctttggaatcatcctat

SEQ ID NO: 151977 - DNA, 75 bp, Artificial Sequence
  Synthetic
accggcttcgcctgtcctaaccattactgaggacacagcgcgtgcggctaatcttgcgctgcaattggacgccgc

SEQ ID NO: 151978 - DNA, 75 bp, Artificial Sequence
  Synthetic
cggttcatcttctcggcgacccaaaccagattccagccatcgactttgaacatgcaggcttggtgccggcgattc

SEQ ID NO: 151979 - DNA, 75 bp, Artificial Sequence
  Synthetic
ccaggctttttgctgttcgagacttatgacgtatcttcgtggcattagttacaaggtcacggtcggcgcccttgt

SEQ ID NO: 151980 - DNA, 75 bp, Artificial Sequence
  Synthetic
actgaggacacagcgcgtgcggctaatcttgcgctgcaattggacgccgccactgaggtgggccgtgcgtgtgcc

SEQ ID NO: 151981 - DNA, 75 bp, Artificial Sequence
  Synthetic
tcagaggtatcttcgcactcaagccatctctaaggggatgaagagattggaactcgagcatgcacagaagttcat

SEQ ID NO: 151982 - DNA, 75 bp, Artificial Sequence
  Synthetic
atctctaaggggatgaagagattggaactcgagcatgcacagaagttcataacacgcctttacagttggttgttc

SEQ ID NO: 151983 - DNA, 75 bp, Artificial Sequence
  Synthetic
attcagtccggcgaagtggatgttatcgttgttccaacgcgtgagctgcgtaactcatggcgtcgccgtgggttc

SEQ ID NO: 151984 - DNA, 75 bp, Artificial Sequence
  Synthetic
tcgttgttccaacgcgtgagctgcgtaactcatggcgtcgccgtgggttcgcagcttacacgcctcatactgcag

SEQ ID NO: 151985 - DNA, 75 bp, Artificial Sequence
  Synthetic
ggttttcatcttgaccctcgtgtacttgtttttgatgaagcggccccctgccgctgtcgtagcttcctccgcaag

SEQ ID NO: 151986 - DNA, 75 bp, Artificial Sequence
  Synthetic
gttcatgaggcccagggtgccacgttcacagagactactattatagctactgccgacgctagaggtcttatccag

SEQ ID NO: 151987 - DNA, 75 bp, Artificial Sequence
  Synthetic
gcagccccggcagcttgttttccggcctgaggtcctgtggaaccacccaatccagcgtgtgatccacaatgagct

SEQ ID NO: 151988 - DNA, 75 bp, Artificial Sequence
  Synthetic
tgcagcgtgctgcatctgtccatcttctgggggaccctaaccaaatccctgccatcgacttcgagcataccggcc

SEQ ID NO: 151989 - DNA, 75 bp, Artificial Sequence
  Synthetic
ccggcgtggccctctactctttgcacgacctttggccggccgatgttgcggaggccatggcccgccacgggatga

SEQ ID NO: 151990 - DNA, 75 bp, Artificial Sequence
  Synthetic
ttgtttttgatgaagcggccccctgccgctgtcgtagcttcctccgcaaggcggctcacaagttctgctgcttta

SEQ ID NO: 151991 - DNA, 75 bp, Artificial Sequence
  Synthetic
tctgggggaccctaaccaaatccctgccatcgacttcgagcataccggccttgtgccagcgattaggcctgagct

SEQ ID NO: 151992 - DNA, 75 bp, Artificial Sequence
  Synthetic
ctgcgtgaggttggtatctctgatataattgttaacaatttctttttggccggcggtgaggtaggccaccaccgc

SEQ ID NO: 151993 - DNA, 75 bp, Artificial Sequence
  Synthetic
taatgtcctgcaccgctgctttcttaaacctgtaggccgcgatgttcagcggtggtataccgctcctacccgtgg

SEQ ID NO: 151994 - DNA, 75 bp, Artificial Sequence
  Synthetic
atgaagcatttgaagggtcagatgttgaccccgccgaggaggctattgtcagcatttctgggtcatatattgttg

SEQ ID NO: 151995 - DNA, 75 bp, Artificial Sequence
  Synthetic
aaagatacaaacatcgagccgggttctccgctcattattctggaatgagccggctaccggccagaaattggtttt

SEQ ID NO: 151996 - DNA, 75 bp, Artificial Sequence
  Synthetic
cagaccagaacttggacactttgcaggcatttcctccatcttgtcaaattagtgcttaccatcagctagctgagg

SEQ ID NO: 151997 - DNA, 75 bp, Artificial Sequence
  Synthetic
tgaccccgccgaggaggctattgtcagcatttctgggtcatatattgttgccggcagccagttacaacctctcta

SEQ ID NO: 151998 - DNA, 75 bp, Artificial Sequence
  Synthetic
aaacctgtaggccgcgatgttcagcggtggtataccgctcctacccgtggccctgcggcgaattgccggcggtct

SEQ ID NO: 151999 - DNA, 75 bp, Artificial Sequence
  Synthetic
ggatggtcgcctgacctgcaagactatcatgggtaataaaaccttttcaacagtgttcaccgacggtgctcagtt

SEQ ID NO: 152000 - DNA, 75 bp, Artificial Sequence
  Synthetic
acgggggttgcactctattcactgcacgacctttggcctgctgatgttgcggaggcaatggcccgccacggcatg

SEQ ID NO: 152001 - DNA, 75 bp, Artificial Sequence
  Synthetic
cgcggccttattcagtcgtcccgtgcccacgccattgtcgctctgactcgtcacaccgagaagtgcgtcgtactt

SEQ ID NO: 152002 - DNA, 75 bp, Artificial Sequence
  Synthetic
atcatgggtaataaaaccttttcaacagtgttcaccgacggtgctcagttagaggccaatgggcctgagcggtat

SEQ ID NO: 152003 - DNA, 75 bp, Artificial Sequence
  Synthetic
ctccgctcattattctggaatgagccggctaccggccagaaattggttttcacacaggctgctaaggccgcccac

SEQ ID NO: 152004 - DNA, 75 bp, Artificial Sequence
  Synthetic
ttgtttccatcagcctgctctacgaaatctacttttcatgctgtcccggttcacatctgggaccggctcatgctc

SEQ ID NO: 152005 - DNA, 75 bp, Artificial Sequence
  Synthetic
cccacgccattgtcgctctgactcgtcacaccgagaagtgcgtcgtacttgatgcgccgggcctcctccgcgaga

SEQ ID NO: 152006 - DNA, 75 bp, Artificial Sequence
  Synthetic
cctggagcaaaaccttttgtgccctatttggcccttggttccgggccattgagaaacagatattaaccttgctcc

SEQ ID NO: 152007 - DNA, 75 bp, Artificial Sequence
  Synthetic
cagtgattacatatgagggggattccagtgccgggtacaatcatgatgtgtccatcttacgtgcttggatccgta

SEQ ID NO: 152008 - DNA, 75 bp, Artificial Sequence
  Synthetic
ggcctcgaggtgcatgttgtctctgccgggcttgactgcaaggccgtctttccacctggggttgcaacccccccc

SEQ ID NO: 152009 - DNA, 75 bp, Artificial Sequence
  Synthetic
tcccccgcggcaccatagaatgtaacgttgacacgcttagcgcttttccaccttcctgccagtttagcgctttcc

SEQ ID NO: 152010 - DNA, 75 bp, Artificial Sequence
  Synthetic
ccgggcttgactgcaaggccgtctttccacctggggttgcaaccccccccgctcccggggaggtgtccgcttttt

SEQ ID NO: 152011 - DNA, 75 bp, Artificial Sequence
  Synthetic
gctggtgattgagcgggttcgggctgtgggatgtcattttgtgctcctcctcacagctgcacctgagccgtcacc

SEQ ID NO: 152012 - DNA, 75 bp, Artificial Sequence
  Synthetic
cgttgacacgcttagcgcttttccaccttcctgccagtttagcgctttccatcagttagccgaggagttgggcca

SEQ ID NO: 152013 - DNA, 75 bp, Artificial Sequence
  Synthetic
ggttagtcggcttgttcccgccattttgccccggtcatagctgggagtccgccaaccccttctgcggggagagca

SEQ ID NO: 152014 - DNA, 75 bp, Artificial Sequence
  Synthetic
ttgccccggtcatagctgggagtccgccaaccccttctgcggggagagcaccctttacacccgtacctggtcggt

SEQ ID NO: 152015 - DNA, 75 bp, Artificial Sequence
  Synthetic
gttgaccaccaccgacagtgtcctggtatttgagcttacggacattgtccactgccgtatggccgcccccaccca

SEQ ID NO: 152016 - DNA, 75 bp, Artificial Sequence
  Synthetic
caagggtatgcgccggctggaggtcgagcatgctcagaaatttatcacaagactttacagctggttattcgagaa

SEQ ID NO: 152017 - DNA, 75 bp, Artificial Sequence
  Synthetic
gtatttgagcttacggacattgtccactgccgtatggccgcccccacccagcgtaaggccgtcctatccaccctt

SEQ ID NO: 152018 - DNA, 75 bp, Artificial Sequence
  Synthetic
acctgtggctgttagtaccccacccccagccgccctagtgcggccccattccgtggctcccgaacaggtagcccc

SEQ ID NO: 152019 - DNA, 75 bp, Artificial Sequence
  Synthetic
ctttggagcgaccctcgatgaccaggctttctgctgctccaggcttatgacatacctccgcggtattagttataa

SEQ ID NO: 152020 - DNA, 75 bp, Artificial Sequence
  Synthetic
atccccaggttggaatctgttagcgtcaccacctgtgagttgtctgagtttgtcgaggctatggtggcgaaaggc

SEQ ID NO: 152021 - DNA, 75 bp, Artificial Sequence
  Synthetic
ccagccgccctagtgcggccccattccgtggctcccgaacaggtagccccctcgccggacttggttgataaagcc

SEQ ID NO: 152022 - DNA, 75 bp, Artificial Sequence
  Synthetic
actaccgtcccgtcgggctctatgccggagttgtggttgcccctggtcttgggacgttgcccgatgtcgtccggt

SEQ ID NO: 152023 - DNA, 75 bp, Artificial Sequence
  Synthetic
tcaccacctgtgagttgtctgagtttgtcgaggctatggtggcgaaaggccaggacggttctgccatccttgagc

SEQ ID NO: 152024 - DNA, 75 bp, Artificial Sequence
  Synthetic
cggcggctgctccacacttaccctgatggctccaaggtgtatgctggctcccttttcgagtctgagtgcacttgg

SEQ ID NO: 152025 - DNA, 75 bp, Artificial Sequence
  Synthetic
atggctccaaggtgtatgctggctcccttttcgagtctgagtgcacttggttggtgaatgcatctaaccctggcc

SEQ ID NO: 152026 - DNA, 75 bp, Artificial Sequence
  Synthetic
ccatagcgcatggcaaagttggccaggggatctcggcatggagcaagaccttctgcgccctctttggcccctggt

SEQ ID NO: 152027 - DNA, 75 bp, Artificial Sequence
  Synthetic
acttcctgagaaagctaacgaatgttgttcaggtgtgtgttgatgttgtgtctcgtgtttatggggtgagtcctg

SEQ ID NO: 152028 - DNA, 75 bp, Artificial Sequence
  Synthetic
ggggatctcggcatggagcaagaccttctgcgccctctttggcccctggttccgggctattgagaaagcggtttt

SEQ ID NO: 152029 - DNA, 75 bp, Artificial Sequence
  Synthetic
tctcgtgtttatggggtgagtcctgggcttgtacataatcttattggtatgctacagacaattgctgacggtaag

SEQ ID NO: 152030 - DNA, 75 bp, Artificial Sequence
  Synthetic
ggcgatcatagcgcactgctacgagtttcgtgacctgagggtggcagcgttcaaaggggatgattcagtggtcct

SEQ ID NO: 152031 - DNA, 75 bp, Artificial Sequence
  Synthetic
tgtctgacgggcttgcggcttacaccttgactccccggcctattatccatgctgttgcccctgactaccgggtcg

SEQ ID NO: 152032 - DNA, 75 bp, Artificial Sequence
  Synthetic
accgtctggagtgccgcaccgtgctcgggaacaagaccttccggacgacggtggttgatggtgcccaccttgagg

SEQ ID NO: 152033 - DNA, 75 bp, Artificial Sequence
  Synthetic
ttctaactgtgaggtctttgagaatgacttctccgagtttgacagtacccagaataacttttccctcggcataga

SEQ ID NO: 152034 - DNA, 75 bp, Artificial Sequence
  Synthetic
ttctaactgtgaggtctttgagaatgacttctccgagtttgacagtacccagaataacttttccctcggcttaga

SEQ ID NO: 152035 - DNA, 75 bp, Artificial Sequence
  Synthetic
ttctaactgtgaggtctttgagaatgacttctccgagtttgacagtacccagaataacttttccctcggcctaga

SEQ ID NO: 152036 - DNA, 75 bp, Artificial Sequence
  Synthetic
ttctaactgtgaggtctttgagaatgacttctccgagtttgacagtacccagaataacttttccctcggcgtaga

SEQ ID NO: 152037 - DNA, 75 bp, Artificial Sequence
  Synthetic
cactcaacattccgcaagatatcgccgctcgtgcagcccgactaacagctactgtcgaactcgctgcaggtccgg

SEQ ID NO: 152038 - DNA, 75 bp, Artificial Sequence
  Synthetic
gtggcttggccaggattgcacctgttttctccagcccattgaggggagagtcggtgagcagggttatgacaatga

SEQ ID NO: 152039 - DNA, 75 bp, Artificial Sequence
  Synthetic
cgggaacaagaccttccggacgacggtggttgatggtgcccaccttgaggcgaacggccctgagcaatgtgtctt

SEQ ID NO: 152040 - DNA, 75 bp, Artificial Sequence
  Synthetic
gttgtggtggctccgggtcttggggcactccctgatgtcgtccggttcgccggcaggctgtcagagaagaactgg

SEQ ID NO: 152041 - DNA, 75 bp, Artificial Sequence
  Synthetic
tgttgggttgagtttcgatgcctgggagcgcaaccaccggcccggggatgagctgtatctgaccgagccagcgat

SEQ ID NO: 152042 - DNA, 75 bp, Artificial Sequence
  Synthetic
gcaggttaggatttcatctaacggcctggactgtactgccgttttcccccctggcggcgcccctagtgctgcacc

SEQ ID NO: 152043 - DNA, 75 bp, Artificial Sequence
  Synthetic
agagggttttggaagaagcactctggcgagccggggaccttgttgtggaatacagtttggaacatggctgtgatt

SEQ ID NO: 152044 - DNA, 75 bp, Artificial Sequence
  Synthetic
tcggtgagcagggttatgacaatgaggcatttgagggatcggacgttgaccccgctgaagaagccgccgttagta

SEQ ID NO: 152045 - DNA, 75 bp, Artificial Sequence
  Synthetic
gggggaagtagcggctttttgcagcgccctctacaggtataacagatttacccagcggcactcgttaaccggcgg

SEQ ID NO: 152046 - DNA, 75 bp, Artificial Sequence
  Synthetic
cggcaggctgtcagagaagaactggggcccgggtcccgagcgcgccgagcagttgcgtctggcagtttgtgattt

SEQ ID NO: 152047 - DNA, 75 bp, Artificial Sequence
  Synthetic
gagcgcaaccaccggcccggggatgagctgtatctgaccgagccagcgatcgcctggttcgaggccaaccggccc

SEQ ID NO: 152048 - DNA, 75 bp, Artificial Sequence
  Synthetic
gaggtcgggcgggcgtgcgccggttgccgtgtcgagcctggcgtaattcactatcagtttacagccggggtcccc

SEQ ID NO: 152049 - DNA, 75 bp, Artificial Sequence
  Synthetic
gccgtgtcgagcctggcgtaattcactatcagtttacagccggggtccccggttccggcaaatctcggtcgatcc

SEQ ID NO: 152050 - DNA, 75 bp, Artificial Sequence
  Synthetic
ctttgattaccggctgcgggctcaagttgaaggtggactttcgaccggtaggtttgtacgccggtgtggttgttg

SEQ ID NO: 152051 - DNA, 75 bp, Artificial Sequence
  Synthetic
ccccttctgcggagaaggtaccttgtacacccgtacctggtccacatctggcttttctagtgatttttcccctcc

SEQ ID NO: 152052 - DNA, 75 bp, Artificial Sequence
  Synthetic
ccttgctgatggcacccagctggaggccaacgggccagaacaatatgttttgtcgtttgacccggtgaaacaggc

SEQ ID NO: 152053 - DNA, 75 bp, Artificial Sequence
  Synthetic
tacacccgtacctggtccacatctggcttttctagtgatttttcccctcctgaggctgccgccccagcaccggtt

SEQ ID NO: 152054 - DNA, 75 bp, Artificial Sequence
  Synthetic
gttgaaggtggactttcgaccggtaggtttgtacgccggtgtggttgttgcccccggccttggtgcgctccctga

SEQ ID NO: 152055 - DNA, 75 bp, Artificial Sequence
  Synthetic
cttatacacctcacactgcggcccgcgtcacccgtggccgtagggttgttattgatgaagccccgtcgctccccc

SEQ ID NO: 152056 - DNA, 75 bp, Artificial Sequence
  Synthetic
gctcgattgcaaggccgtctttccgcccggcgtagcggccccctctgctgctggggaggtgtctgctttctgctc

SEQ ID NO: 152057 - DNA, 75 bp, Artificial Sequence
  Synthetic
tgctgtgtgtgattttcttcggaagcttacgaatgttgcccaagtttgtgtggatgttgtttctagggtttatgg

SEQ ID NO: 152058 - DNA, 75 bp, Artificial Sequence
  Synthetic
caggttgatgcagcgcccgtaccccctgcccccgagcccgttaggtcgcccagccctgctaggcctccgcccccc

SEQ ID NO: 152059 - DNA, 75 bp, Artificial Sequence
  Synthetic
cgtcacccgtggccgtagggttgttattgatgaagccccgtcgctccccccacatctgcttctgttgcatatgca

SEQ ID NO: 152060 - DNA, 75 bp, Artificial Sequence
  Synthetic
gacaatccgttatcgccctttggtgcccaatgcagtcggtggctatgcaatttctatctctttctggccccagac

SEQ ID NO: 152061 - DNA, 75 bp, Artificial Sequence
  Synthetic
cccggcaattcgacctgagcttgttccaacaaagtggtggcacctgacttacagatgcccggcagatgtctgtga

SEQ ID NO: 152062 - DNA, 75 bp, Artificial Sequence
  Synthetic
gacaattaaaccggttttggacttaacggacacaattgtacatcgggtggaatgaataacatgttgtcttgcttg

SEQ ID NO: 152063 - DNA, 75 bp, Artificial Sequence
  Synthetic
gatacagctccagtccctgatgttgattcccgtggtgctattttgcgccgccagtataaactgtctacttctccc

SEQ ID NO: 152064 - DNA, 75 bp, Artificial Sequence
  Synthetic
gatacagctccagtccctgatgttgattcccgtggtgctattttgcgccgccagtataatctgtctacttctccc

SEQ ID NO: 152065 - DNA, 75 bp, Artificial Sequence
  Synthetic
gatacagctccagtccctgatgttgattcccgtggtgctattttgcgccgccagtataacctgtctacttctccc

SEQ ID NO: 152066 - DNA, 75 bp, Artificial Sequence
  Synthetic
gatacagctccagtccctgatgttgattcccgtggtgctattttgcgccgccagtataagctgtctacttctccc

SEQ ID NO: 152067 - DNA, 75 bp, Artificial Sequence
  Synthetic
ccaacaaagtggtggcacctgacttacagatgcccggcagatgtctgtgagctggtccgtggtgcgtacccaaag

SEQ ID NO: 152068 - DNA, 75 bp, Artificial Sequence
  Synthetic
cccggtcatagctgggagtctgctaatcctttctgtggtgaaagcaccctttacacccggacttggtcggtttcg

SEQ ID NO: 152069 - DNA, 75 bp, Artificial Sequence
  Synthetic
caggcggcgaaggctgccaaccctggtgcgataacagttcatgaagcccagggtgctacatttactgaaaccacg

SEQ ID NO: 152070 - DNA, 75 bp, Artificial Sequence
  Synthetic
gtggttgatgtcttaccttcggagattacggagcaggcccagcccccggcttctaagccggcggcacctttatcc

SEQ ID NO: 152071 - DNA, 75 bp, Artificial Sequence
  Synthetic
gtgcgataacagttcatgaagcccagggtgctacatttactgaaaccacgatcattgccacggctgacgcccgcg

SEQ ID NO: 152072 - DNA, 75 bp, Artificial Sequence
  Synthetic
ttacggagcaggcccagcccccggcttctaagccggcggcacctttatccgactcagtcgataacagtgttggtc

SEQ ID NO: 152073 - DNA, 75 bp, Artificial Sequence
  Synthetic
cgggttgactctcagcccttcgccctcccctatattcacccaaccaacccctttgcatccgatgtttccacttcc

SEQ ID NO: 152074 - DNA, 75 bp, Artificial Sequence
  Synthetic
ccccggggctccttcgtgaggttggaatttctgatgctattgttaacaacttcttcctctctggcggccagatcg

SEQ ID NO: 152075 - DNA, 75 bp, Artificial Sequence
  Synthetic
ggttgcttcatacttaccctgacggctcgaaagtgtatgccggctctctttttgagtctgagtgcacttggttgg

SEQ ID NO: 152076 - DNA, 75 bp, Artificial Sequence
  Synthetic
gtcgtggcgccgatgggaccgccgaacttacaactacggcggcaacacggtttatgaaagatcttcatttcaccg

SEQ ID NO: 152077 - DNA, 75 bp, Artificial Sequence
  Synthetic
tccgcctctgcacgtcgtagacctaccccagctggggcttcgccgttgacggcagtggcccctgcaccggacacg

SEQ ID NO: 152078 - DNA, 75 bp, Artificial Sequence
  Synthetic
tttagtccagcccggtatagcctctgagttggtgatcccgagcgagcgcctccactatcgtaaccagggttggcg

SEQ ID NO: 152079 - DNA, 75 bp, Artificial Sequence
  Synthetic
tttgagtctgagtgcacttggttggtcaatgcatctaaccctggtcaccgccctggcggcggtctctgtcacgcc

SEQ ID NO: 152080 - DNA, 75 bp, Artificial Sequence
  Synthetic
aatttctgatgctattgttaacaacttcttcctctctggcggccagatcggccagcatcgcccatcagttgtacc

SEQ ID NO: 152081 - DNA, 75 bp, Artificial Sequence
  Synthetic
gctcgccgaagaacttggccatcgaccggccccaatagctgctgtcctgcccccttgcccggagcttgagcaggg

SEQ ID NO: 152082 - DNA, 75 bp, Artificial Sequence
  Synthetic
gtctgccgacagaattaatttcgtcggccgggggtcaggtattctactcccgccccgtcgtctcagccaatggcg

SEQ ID NO: 152083 - DNA, 75 bp, Artificial Sequence
  Synthetic
ctgtgctggctgcactattagccccggaattgtgcattaccagtttaccgccggggttccgggctcaggtaagtc

SEQ ID NO: 152084 - DNA, 75 bp, Artificial Sequence
  Synthetic
tggtgctttatgcagcccctcttggcccccttctgccattgcaagacggaactaacacccacattatggctactg

SEQ ID NO: 152085 - DNA, 75 bp, Artificial Sequence
  Synthetic
ccggccccaatagctgctgtcctgcccccttgcccggagcttgagcagggcctgctttatatgcctcaagagtta

SEQ ID NO: 152086 - DNA, 75 bp, Artificial Sequence
  Synthetic
ccccagctggggcttcgccgttgacggcagtggcccctgcaccggacacgactccggtccctgatgttgattccc

SEQ ID NO: 152087 - DNA, 75 bp, Artificial Sequence
  Synthetic
cccccttctgccattgcaagacggaactaacacccacattatggctactgaggcttccaactacgcccagtatcg

SEQ ID NO: 152088 - DNA, 75 bp, Artificial Sequence
  Synthetic
aaggcggtcttgtcgactctcgttggcaggtacggtcgtcgtacgaagctgtacgaggctgctcatgcagatgtt

SEQ ID NO: 152089 - DNA, 75 bp, Artificial Sequence
  Synthetic
gcaggtacggtcgtcgtacgaagctgtacgaggctgctcatgcagatgttcgtgggtccttgagccgtttcatcc

SEQ ID NO: 152090 - DNA, 75 bp, Artificial Sequence
  Synthetic
ttggccccagacgaccacgacccccacttctgttgatatgaactcaatcacatccactgatgttcgtatccttgt

SEQ ID NO: 152091 - DNA, 75 bp, Artificial Sequence
  Synthetic
tggtttgaggctaatcggcccaccctccctgccttgactataactgaggatacagcccgtacagcgaatttggcg

SEQ ID NO: 152092 - DNA, 75 bp, Artificial Sequence
  Synthetic
acttctgttgatatgaactcaatcacatccactgatgttcgtatccttgtgcaacctggcctcgcctctgagctt

SEQ ID NO: 152093 - DNA, 75 bp, Artificial Sequence
  Synthetic
aaactacatatggctcgtcaactaaccctatgtatgtttcagacactgtcacatttgtcaatgtcgcaacaggtg

SEQ ID NO: 152094 - DNA, 75 bp, Artificial Sequence
  Synthetic
acggctctgcagtcctggagcttgacctctgtagtcgtgacgtgtctcggataacgtttttccagaaggattgca

SEQ ID NO: 152095 - DNA, 75 bp, Artificial Sequence
  Synthetic
gccggcttagtccccgcaattcgcccagagcttgcaccaacgagctggtggcatgttacacatcgctgcccggcc

SEQ ID NO: 152096 - DNA, 75 bp, Artificial Sequence
  Synthetic
caattcacagcaggtgttcctggctccgggaagtctaggtcgatccaacagggcgatgtggatgtgatagtggtg

SEQ ID NO: 152097 - DNA, 75 bp, Artificial Sequence
  Synthetic
gaggcgacttcaggcctcgttatgttgtgcatccacggttcgcctgttaattcctacaccaacacaccttatacc

SEQ ID NO: 152098 - DNA, 75 bp, Artificial Sequence
  Synthetic
cctctgtagtcgtgacgtgtctcggataacgtttttccagaaggattgcaataagtttacaacaggcgagacaat

SEQ ID NO: 152099 - DNA, 75 bp, Artificial Sequence
  Synthetic
tgtgcatccacggttcgcctgttaattcctacaccaacacaccttataccggggctcttggcctgcttgacttcg

SEQ ID NO: 152100 - DNA, 75 bp, Artificial Sequence
  Synthetic
cgccattgagaaagaaattttagcagtgcttgcgcctaatgtattttatggcgacgcctacgaggacacagtttt

SEQ ID NO: 152101 - DNA, 75 bp, Artificial Sequence
  Synthetic
acccgtggccgccgggtcgtcattgatgaggccccttcacttccaccgcatctgcttctgttacacatgcagcgg

SEQ ID NO: 152102 - DNA, 75 bp, Artificial Sequence
  Synthetic
gccaccgcctgcggcgggggcctgacggcacggctgagttgacaaccaccgcagccacacggttcatgaaggatt

SEQ ID NO: 152103 - DNA, 75 bp, Artificial Sequence
  Synthetic
gtgcttgcgcctaatgtattttatggcgacgcctacgaggacacagttttagctgccgctgttgcgggggcctct

SEQ ID NO: 152104 - DNA, 75 bp, Artificial Sequence
  Synthetic
atgaggccccttcacttccaccgcatctgcttctgttacacatgcagcgggcctcatcggttcacctcctcggtg

SEQ ID NO: 152105 - DNA, 75 bp, Artificial Sequence
  Synthetic
tatacttcactggttcaaacgggctcggcgaggtcgggcgtggtatagctttgaccttgtttaatcttgctgaca

SEQ ID NO: 152106 - DNA, 75 bp, Artificial Sequence
  Synthetic
ggtgtgcttgccccgcattcagttctagctgtccttgaggatactattgattaccccgctcgtgctcacactttt

SEQ ID NO: 152107 - DNA, 75 bp, Artificial Sequence
  Synthetic
gtgatcatggaggagtgcggcatgccacagtggatgatccgtctttaccaccttgtccgttccgcttgggtcctc

SEQ ID NO: 152108 - DNA, 75 bp, Artificial Sequence
  Synthetic
caaagtggtggcatcttacccatagatgcccggcggatgtctgtgagctaatccgcggtgcatacccgaagatcc

SEQ ID NO: 152109 - DNA, 75 bp, Artificial Sequence
  Synthetic
tcaccactattcagcagtattctaagacattctatgtgctcccactccgtgggaagctatccttttgggaggctg

SEQ ID NO: 152110 - DNA, 75 bp, Artificial Sequence
  Synthetic
cacagtggatgatccgtctttaccaccttgtccgttccgcttgggtcctccaggccccgaaggagtccttacggg

SEQ ID NO: 152111 - DNA, 75 bp, Artificial Sequence
  Synthetic
cagccaatggcgagccgacagttaagttgtacacctctgtcgagaatgctcagcaggacaagggtattgctatcc

SEQ ID NO: 152112 - DNA, 75 bp, Artificial Sequence
  Synthetic
taactataaaactactgctagtgatcagattctgatagagaatgcggccggccatcgcgtcgctatctctaccta

SEQ ID NO: 152113 - DNA, 75 bp, Artificial Sequence
  Synthetic
taactataatactactgctagtgatcagattctgatagagaatgcggccggccatcgcgtcgctatctctaccta

SEQ ID NO: 152114 - DNA, 75 bp, Artificial Sequence
  Synthetic
taactataacactactgctagtgatcagattctgatagagaatgcggccggccatcgcgtcgctatctctaccta

SEQ ID NO: 152115 - DNA, 75 bp, Artificial Sequence
  Synthetic
taactataagactactgctagtgatcagattctgatagagaatgcggccggccatcgcgtcgctatctctaccta

SEQ ID NO: 152116 - DNA, 75 bp, Artificial Sequence
  Synthetic
ctcctggcgtcactactgctattgagcaggcagctctagcagcggccaactccgccttggcgaatgctgtggtgg

SEQ ID NO: 152117 - DNA, 75 bp, Artificial Sequence
  Synthetic
actgttatgagttccgtgactttaaagttgcggcgtttaaaggagatgattctgttgtgctttgtagtgattatc

SEQ ID NO: 152118 - DNA, 75 bp, Artificial Sequence
  Synthetic
gattaccgtccacgaagcccagggcgcaacatttactgaggctacaattatcgccacggcagacgctcgtgggct

SEQ ID NO: 152119 - DNA, 75 bp, Artificial Sequence
  Synthetic
caccatcaccggcaccttcgcgcccgttctctgtcctgcgtgtgaatgacgtgctttggctgaccctcaccgctg

SEQ ID NO: 152120 - DNA, 75 bp, Artificial Sequence
  Synthetic
cttcccgccatcttgccagattagtgcttaccaccagttggcagaggagctaggccaccgccctgcccctgtcgc

SEQ ID NO: 152121 - DNA, 75 bp, Artificial Sequence
  Synthetic
gcttgaagatactattgattaccctgctcgcgcccatacttttgatgatttctgccctgagtgccgtaatcttgg

SEQ ID NO: 152122 - DNA, 75 bp, Artificial Sequence
  Synthetic
cgtgttggtttttgaacttacggatatagttcactgccgtatggctgccccaagtcagcggaaggccgttctctc

SEQ ID NO: 152123 - DNA, 75 bp, Artificial Sequence
  Synthetic
tcagcgcgtgatccacaacgagcttgagcagtactgccgggctcgggctggccgctgccttgaggtgggtgctca

SEQ ID NO: 152124 - DNA, 75 bp, Artificial Sequence
  Synthetic
ggggctcctccgtgaggtaggcatttctgatgccattgttaataactttttcctttctggcggtcagatcggcca

SEQ ID NO: 152125 - DNA, 75 bp, Artificial Sequence
  Synthetic
aaggtggattttaggcccgttgggctgtatgctggtgttgttgtggctccgggtcttgggacccttcctgatgtt

SEQ ID NO: 152126 - DNA, 75 bp, Artificial Sequence
  Synthetic
ccgcgcgcttgactggtccaaagtcacttttgacggccgcccgcttaccactgtccaacagtatggcaagtcttt

SEQ ID NO: 152127 - DNA, 75 bp, Artificial Sequence
  Synthetic
attcagatgttcgtgagtctctagccaggtttatccctactattggacctgtccaggccactacgtgtgagttat

SEQ ID NO: 152128 - DNA, 75 bp, Artificial Sequence
  Synthetic
gttctctgtcctgcgtgtgaatgacgtgctttggctgaccctcaccgctgccgagtatgaccagaccacctatgg

SEQ ID NO: 152129 - DNA, 75 bp, Artificial Sequence
  Synthetic
acttttgacggccgcccgcttaccactgtccaacagtatggcaagtctttctttgtcttgcctctccgcggtaag

SEQ ID NO: 152130 - DNA, 75 bp, Artificial Sequence
  Synthetic
cgaatgtggcccaggtttgtgtggatgttgtttcgcaggtttatggtgttagccctggtttagtacataacctga

SEQ ID NO: 152131 - DNA, 75 bp, Artificial Sequence
  Synthetic
ctccaattgctgccgtcctgcccccctgtccggagcttgaacagggtctactttatatgcctcaagaattgacaa

SEQ ID NO: 152132 - DNA, 75 bp, Artificial Sequence
  Synthetic
ttagttgagaatgccccgggccatcgtgtttgcatttcgacctatactactaatttgggctctgggccagtgtcg

SEQ ID NO: 152133 - DNA, 75 bp, Artificial Sequence
  Synthetic
catccgacagcgtgctcacttttgagctcacggacatagtgcattgtcgcatggcagcgcccagtcagcgcaaag

SEQ ID NO: 152134 - DNA, 75 bp, Artificial Sequence
  Synthetic
gtgtttgcatttcgacctatactactaatttgggctctgggccagtgtcgatctcggctgtcggcgtgttggcac

SEQ ID NO: 152135 - DNA, 75 bp, Artificial Sequence
  Synthetic
taagaccttttgtgctctgtttggcccgtggtttcgtgccattgaaaaagaaatactggccctgctcccgcctaa

SEQ ID NO: 152136 - DNA, 75 bp, Artificial Sequence
  Synthetic
gaggcaatggctcgccatggtatgacccggctgtatgcagctctccacctccccccggaggtactgctcccccct

SEQ ID NO: 152137 - DNA, 75 bp, Artificial Sequence
  Synthetic
ctgagtgccgcattctggggcttcagggctgtgcttatcagtctactgctgctgaattgcagcgtcttaagatga

SEQ ID NO: 152138 - DNA, 75 bp, Artificial Sequence
  Synthetic
ttgattctcagcccttcgccatcccctatattcatccaaccaatcccttcgcatccgacatatcagccgcagccg

SEQ ID NO: 152139 - DNA, 75 bp, Artificial Sequence
  Synthetic
aggtaggtaaaagccgggagttttaatctattctttctctacccccttcgtttggctttcttttattttcttttt

SEQ ID NO: 152140 - DNA, 75 bp, Artificial Sequence
  Synthetic
gctgctaattgccggcgttccgcgctgcgcgggctccccgctgctgaccgcacttactgcttcgacgggttttct

SEQ ID NO: 152141 - DNA, 75 bp, Artificial Sequence
  Synthetic
gccttgagtgtgtggttatggaagagtgcggtatgcctcaatggttaatcaggttgtatcatctggtccggtcgg

SEQ ID NO: 152142 - DNA, 75 bp, Artificial Sequence
  Synthetic
ctcccgcccgtcgtcgatctgccccaactggggcttcgccgctaacagctgtggccccagctcctgacacagccc

SEQ ID NO: 152143 - DNA, 75 bp, Artificial Sequence
  Synthetic
ccgcatggagcaagaccttctgcgctttgtttggcccgtggttccgcgctattgagaaagaaattctggcggcac

SEQ ID NO: 152144 - DNA, 75 bp, Artificial Sequence
  Synthetic
tttgtttggcccgtggttccgcgctattgagaaagaaattctggcggcactagcacctaatgtcttttatggtga

SEQ ID NO: 152145 - DNA, 75 bp, Artificial Sequence
  Synthetic
ctattgctactggtaccaatcttgtgctttacgctgccccgttgagccctctgctcccgcttcaggatgggacca

SEQ ID NO: 152146 - DNA, 75 bp, Artificial Sequence
  Synthetic
cgagtttgatagcactcaaaacaatttctcactcgggttagagtgtataatcatggaggagtgtggcatgccgca

SEQ ID NO: 152147 - DNA, 75 bp, Artificial Sequence
  Synthetic
ccttggtgccgaatgctgttggtgggtacgctatatctatctctttctggcctcagacaacaaccaccccgacgt

SEQ ID NO: 152148 - DNA, 75 bp, Artificial Sequence
  Synthetic
gttcgctctgcctgggtcctgcaggccccgaaggaatctctgcgaggcttttggaagaaacactctggtgagccc

SEQ ID NO: 152149 - DNA, 75 bp, Artificial Sequence
  Synthetic
ggtacctccgcacacaggctatctcgaaagggatgaaaagattggagcttgagcatgcacagaagtttataacac

SEQ ID NO: 152150 - DNA, 75 bp, Artificial Sequence
  Synthetic
tcggctgtctgaaaagaactggggccctggcccagagcgtgccgagcagttgcgccttgctgtttgtgatttcct

SEQ ID NO: 152151 - DNA, 75 bp, Artificial Sequence
  Synthetic
ccctcggcctgcttgactttgcgctcgagctcgagttccgcaacctgacgcctggtaatacgaacacacgcgtct

SEQ ID NO: 152152 - DNA, 75 bp, Artificial Sequence
  Synthetic
tgtggctcaggtctgtgtggatgttgtttcgcaggtttacggcgttagtcctggtttggtacataacctgattgg

SEQ ID NO: 152153 - DNA, 75 bp, Artificial Sequence
  Synthetic
ctacccgttttatgaaggaccttcactttaccgggactaatggtgttggagaggttggccgtggtatagcgttaa

SEQ ID NO: 152154 - DNA, 75 bp, Artificial Sequence
  Synthetic
tactgcagcccctgagccgtcaccaatgccttatgttccatacccccggtcgacagaggtgtatgtccgctctat

SEQ ID NO: 152155 - DNA, 75 bp, Artificial Sequence
  Synthetic
caatggcgagccgacagtgaaactctacacctcagttgagaatgcccagcaagataagggtatagctatcccaca

SEQ ID NO: 152156 - DNA, 75 bp, Artificial Sequence
  Synthetic
atggccgccggcccgcatagccttagttacgccttgacacctgcgggtcttgaggtgcgtgttgtttctgccgga

SEQ ID NO: 152157 - DNA, 75 bp, Artificial Sequence
  Synthetic
ttcccctgccccctctcgccctttctctgtccttcgtgctaatgatgtgctttggctctcgcttacagctgccga

SEQ ID NO: 152158 - DNA, 75 bp, Artificial Sequence
  Synthetic
tctgtccttcgtgctaatgatgtgctttggctctcgcttacagctgccgagtacgatcagactacttatggttct

SEQ ID NO: 152159 - DNA, 75 bp, Artificial Sequence
  Synthetic
ggtccagcccggcattgcctccgagctggtcatccccagtgagcgtcttcattatcgtaaccagggctggcgctc

SEQ ID NO: 152160 - DNA, 75 bp, Artificial Sequence
  Synthetic
accagtcccagcgccccgccgcttccacccgtcgtcgacctgccccagctggggcttcgccgttgacggctgtgg

SEQ ID NO: 152161 - DNA, 75 bp, Artificial Sequence
  Synthetic
cacccgtcgtcgacctgccccagctggggcttcgccgttgacggctgtggccccggctcctgacactgcacctgt

SEQ ID NO: 152162 - DNA, 75 bp, Artificial Sequence
  Synthetic
tccttggactggtctaaggtcacccttgatgggcgtccgttgacaactgtccagcaatactccaagacattcttt

SEQ ID NO: 152163 - DNA, 75 bp, Artificial Sequence
  Synthetic
ttgatgggcgtccgttgacaactgtccagcaatactccaagacattctttgtcttgcccctccgtggtaagctct

SEQ ID NO: 152164 - DNA, 75 bp, Artificial Sequence
  Synthetic
caattcttatactaatacaccctatactggtgcattggggcttcttgattttgcgttagagcttgaattcaggaa

SEQ ID NO: 152165 - DNA, 75 bp, Artificial Sequence
  Synthetic
ccacatccccgcttacatctactattgctactggcactaatcttgtgctatatgccgccccacttagtcctctgc

SEQ ID NO: 152166 - DNA, 75 bp, Artificial Sequence
  Synthetic
ttgagaatgcggccggccaccgtgtttgtatttcgacttatactactaaccttggctctggccctgtttccattt

SEQ ID NO: 152167 - DNA, 75 bp, Artificial Sequence
  Synthetic
aattatgcccagtatcgtgttgttcgcgccaccatccgatatcgtcccttggtgccgaatgccgttggtgggtat

SEQ ID NO: 152168 - DNA, 75 bp, Artificial Sequence
  Synthetic
ttgtatttcgacttatactactaaccttggctctggccctgtttccatttccgctgttggtgtcctcgcacccca

SEQ ID NO: 152169 - DNA, 75 bp, Artificial Sequence
  Synthetic
gctatatccatctccttctggccccagactacgaccaccccaacgtccgttgttatgaattcaatcacctccaca

SEQ ID NO: 152170 - DNA, 75 bp, Artificial Sequence
  Synthetic
gtgtcgtgcgctcggtcttcagggctgtgcctttcaatctactgttgctgagttagagcgtcttaagatgaaggt

SEQ ID NO: 152171 - DNA, 75 bp, Artificial Sequence
  Synthetic
agaattgatttcgtcggctgggggtcagttgttctactcccgccccgtcgtctcagccaatggcgagccgactgt

SEQ ID NO: 152172 - DNA, 75 bp, Artificial Sequence
  Synthetic
gggtaaaacccgggagttttgatttattctgcttgtgccttccttcgactttgtctcttttattttctttttctg

SEQ ID NO: 152173 - DNA, 75 bp, Artificial Sequence
  Synthetic
gtggttgatggcgcccaccttgaggcgaacggccccgagcagtatgttctttcgttcgacgcctctcgccagtca

SEQ ID NO: 152174 - DNA, 75 bp, Artificial Sequence
  Synthetic
gataaccagcatgagcaggatcggcccactccttcacctgctccctctcgccctttttcagttcttcgtgctaat

SEQ ID NO: 152175 - DNA, 75 bp, Artificial Sequence
  Synthetic
cgggcggggcccctagcgttgctccgggggaggtagcagccttttgcagtgccctttacaggtacaacaggttca

SEQ ID NO: 152176 - DNA, 75 bp, Artificial Sequence
  Synthetic
acggccaacctagcattagagatcgatgctgccacagaggtgggccgtgcttgtgccggctgcactgttagccct

SEQ ID NO: 152177 - DNA, 75 bp, Artificial Sequence
  Synthetic
attctaattgagaatgcagccggccatcgtgttgctatttctacctacaccactagcctgggtgccggtcccacc

SEQ ID NO: 152178 - DNA, 75 bp, Artificial Sequence
  Synthetic
caagggtatagctattccacatgatattgaccttggtgagtcccgtgtggttattcaggattatgacaaccagca

SEQ ID NO: 152179 - DNA, 75 bp, Artificial Sequence
  Synthetic
gttaccgccaccttctgaagaatttcaggttgatacagcgcccactccccctgcccctgagcccgctcaaccatc

SEQ ID NO: 152180 - DNA, 75 bp, Artificial Sequence
  Synthetic
cgtgcccatacttttgatgatttttgcccggaatgtcgcacccttggtctgcagggctgcgctttccagtctact

SEQ ID NO: 152181 - DNA, 75 bp, Artificial Sequence
  Synthetic
ccgaggttttgtggaatcacccaatccagcgtgtgatccacaatgagcttgagcaatactgccgagcccgggccg

SEQ ID NO: 152182 - DNA, 75 bp, Artificial Sequence
  Synthetic
tggactggtctaaggttactcttgacggtcgcccgctcactaccatccagcagtattctaagactttctacgtct

SEQ ID NO: 152183 - DNA, 75 bp, Artificial Sequence
  Synthetic
aatgcctggcgccgccgcggcttcgctgctttcaccccgcacactgcggctagagtcacccaggggcgccgggtt

SEQ ID NO: 152184 - DNA, 75 bp, Artificial Sequence
  Synthetic
ccggacttactgttttgatggcttttcaggctgcacatttgccgccgagacgggggttgcactttactcattgca

SEQ ID NO: 152185 - DNA, 75 bp, Artificial Sequence
  Synthetic
gcccccacctcctggtggcatgttacccatcgctgccctgcggatgtatgtgagctaatccgcggcgcataccct

SEQ ID NO: 152186 - DNA, 75 bp, Artificial Sequence
  Synthetic
ggcacctaccataccacttcatacctcctaattcatgatggcgaccgtgcggtgattacatatgagggggattct

SEQ ID NO: 152187 - DNA, 75 bp, Artificial Sequence
  Synthetic
aaaacccgggagtactgatttattctgtttgtgccccccttctgctatgttttctttaatttcttttttctgcgt

SEQ ID NO: 152188 - DNA, 75 bp, Artificial Sequence
  Synthetic
tcatgccattgttgccttgacgcgccacactgagaagtgcgtcatcattgacgcaccaggcctgcttcgcgaggt

SEQ ID NO: 152189 - DNA, 75 bp, Artificial Sequence
  Synthetic
aggtacggccgccgtacgaagttgtatgaggctgcccatgcagatgtccgtgggtctctaaaccattttatccct

SEQ ID NO: 152190 - DNA, 75 bp, Artificial Sequence
  Synthetic
ttcagagggttatacacaatgaattagaacagtactgccgggcccgggccggtcgttgcctggagattggggctc

SEQ ID NO: 152191 - DNA, 75 bp, Artificial Sequence
  Synthetic
gtcacggttggtgcccttgttgctaatgaaggttggaatgcttctgaagatgcattgactgctgtaatcactgca

SEQ ID NO: 152192 - DNA, 75 bp, Artificial Sequence
  Synthetic
atgaaggttggaatgcttctgaagatgcattgactgctgtaatcactgcagcctatttaaccatttgtcatcaga

SEQ ID NO: 152193 - DNA, 75 bp, Artificial Sequence
  Synthetic
gctggtattctgcccccacccgcggccctgcagccaactgccgccgctctgcattgcgtggcctcccccctgtcg

SEQ ID NO: 152194 - DNA, 75 bp, Artificial Sequence
  Synthetic
gcctatttaaccatttgtcatcagagataccttcgcacgcaggctatctctaaagggatgaagaggctggagctt

SEQ ID NO: 152195 - DNA, 75 bp, Artificial Sequence
  Synthetic
gataccttcgcacgcaggctatctctaaagggatgaagaggctggagcttgagcatgcacaaaaatttataacac

SEQ ID NO: 152196 - DNA, 75 bp, Artificial Sequence
  Synthetic
ttcatatttgggaccggctcatgctttttggtgccaccctagatgaccaggccttctgctgctcgcggcttatga

SEQ ID NO: 152197 - DNA, 75 bp, Artificial Sequence
  Synthetic
atgacctttggccagctgatgttgcggaggctatggcccgccatggaatgacacgtctttatgctgcactccacc

SEQ ID NO: 152198 - DNA, 75 bp, Artificial Sequence
  Synthetic
gtctgggcgtgattacattcctggccgccagctgcagttttacgcccagtgccgccggtggttatctgccggctt

SEQ ID NO: 152199 - DNA, 75 bp, Artificial Sequence
  Synthetic
tcccggccattggccccgtacaggttacaacctgtgaattgtacgagctagtggaggccatggtcgagaagggcc

SEQ ID NO: 152200 - DNA, 75 bp, Artificial Sequence
  Synthetic
cgccagctgcagttttacgcccagtgccgccggtggttatctgccggcttccaccttgaccctcgggtgcttgtg

SEQ ID NO: 152201 - DNA, 75 bp, Artificial Sequence
  Synthetic
atgcgcttaccgctgtgattactgcagcgtatctgactatctgccatcagcgctacctacgaacacaggccattt

SEQ ID NO: 152202 - DNA, 75 bp, Artificial Sequence
  Synthetic
catcgcccatggtaaagtgggccagggcatttcggcctggagtaagaccttctgtgcccttttcggcccctggtt

SEQ ID NO: 152203 - DNA, 75 bp, Artificial Sequence
  Synthetic
ttctccagcctattgaggggagggtcggcgagcagggttatgacaatgaggcatttgagggatcggatgttgacc

SEQ ID NO: 152204 - DNA, 75 bp, Artificial Sequence
  Synthetic
gcctatcaccagttagctgaggaacttggccaccgcccagctcctgtcgccgccgtcctgcccccttgccctgaa

SEQ ID NO: 152205 - DNA, 75 bp, Artificial Sequence
  Synthetic
ctggcaccttgctttggaatactgtctggaacatggcggtcatagcccattgttatgagttccgcgacttaaaag

SEQ ID NO: 152206 - DNA, 75 bp, Artificial Sequence
  Synthetic
tccacggaggtgtatgtccgatctatatttggccctggtggctccccatccttgtttccgtcagcttgctctaca

SEQ ID NO: 152207 - DNA, 75 bp, Artificial Sequence
  Synthetic
ttttgatgaggcggtcccctgccgctgccggagcttcttaaagaaggctgccggaaaattctgttgtttcatgaa

SEQ ID NO: 152208 - DNA, 75 bp, Artificial Sequence
  Synthetic
cactcggcataccttctgatcttgccgctcgtgcaagccgactcactgctaccgttgaggtctctgatgctgacg

SEQ ID NO: 152209 - DNA, 75 bp, Artificial Sequence
  Synthetic
cgctcgtgcaagccgactcactgctaccgttgaggtctctgatgctgacggccgtcttacctgtaagaccaccat

SEQ ID NO: 152210 - DNA, 75 bp, Artificial Sequence
  Synthetic
tgccggagcttcttaaagaaggctgccggaaaattctgttgtttcatgaaatggttgggacaggagtgcacctgt

SEQ ID NO: 152211 - DNA, 75 bp, Artificial Sequence
  Synthetic
ggtggattttaggcccattgggctgtatgctggtgttgttgtggccccgggtctcgggacccttcctgatgttgt

SEQ ID NO: 152212 - DNA, 75 bp, Artificial Sequence
  Synthetic
tatgctggtgttgttgtggccccgggtctcgggacccttcctgatgttgttaggtttgctgggcggctctcggag

SEQ ID NO: 152213 - DNA, 75 bp, Artificial Sequence
  Synthetic
tttgctgacggcactcagctggaggccaacgggccagaacaatatgttttgtcacttgacctggcgaaacaaact

SEQ ID NO: 152214 - DNA, 75 bp, Artificial Sequence
  Synthetic
cccgccgagcccgcccaccttgatgtttccgggacctatgcggttcacggccgtcagcttgaggctctatataga

SEQ ID NO: 152215 - DNA, 75 bp, Artificial Sequence
  Synthetic
ttttggtgccaccttggacgaccaggcgttttgctgctcacggctcatgacatacctccgtggcattagctacaa

SEQ ID NO: 152216 - DNA, 75 bp, Artificial Sequence
  Synthetic
gctcttaatattcccgacgatattgcggctcgcgcatcacgcctgacggctaccgtggaacttgccgccagcccg

SEQ ID NO: 152217 - DNA, 75 bp, Artificial Sequence
  Synthetic
cccactgttatgatttccgcgatctgcaggtggctgcctttaaaggtgatgattcgatagtgctttgcagtgagt

SEQ ID NO: 152218 - DNA, 75 bp, Artificial Sequence
  Synthetic
ccggcgtagcggccccctctgctgctggggaggtgtccgctttctgctcggccctgtataggtttaaccgctgcg

SEQ ID NO: 152219 - DNA, 75 bp, Artificial Sequence
  Synthetic
ccgtggtttcgtgctattgaaaaagaaatactagccctgctcccgcctaatattttctacggcgacgcatacgag

SEQ ID NO: 152220 - DNA, 75 bp, Artificial Sequence
  Synthetic
ttcaacggcactctcttattggaggcctatggtatcaccctgaggggcttgttggcctgttcccaccattctccc

SEQ ID NO: 152221 - DNA, 75 bp, Artificial Sequence
  Synthetic
cctatggtatcaccctgaggggcttgttggcctgttcccaccattctccccgggtcatagttgggagtctgcgaa

SEQ ID NO: 152222 - DNA, 75 bp, Artificial Sequence
  Synthetic
acgtatgcgcttgtccctgccggcctgcaggttaaaatatcttgtaatggcttggattgtaccgcaacattcccc

SEQ ID NO: 152223 - DNA, 75 bp, Artificial Sequence
  Synthetic
cgggtaaattctgttgcttcatgcggtggttagggcaggagtgtacttgtttcttagaaccagctgagggcttag

SEQ ID NO: 152224 - DNA, 75 bp, Artificial Sequence
  Synthetic
tgaatcctgtgccccgagtgcgttaccccctgcggaggttaatacatctgtggtcatagatgccctacctttaga

SEQ ID NO: 152225 - DNA, 75 bp, Artificial Sequence
  Synthetic
ccccctgcggaggttaatacatctgtggtcatagatgccctacctttagagattactgagcaggtccagcccccg

SEQ ID NO: 152226 - DNA, 75 bp, Artificial Sequence
  Synthetic
ggcttatgagggttctgaggttgaccaggccgagcctgtacaccttgatgtgtcggggacctatgctgtccacgg

SEQ ID NO: 152227 - DNA, 75 bp, Artificial Sequence
  Synthetic
gtacccccggcaccggcgccgcctgtaacccacctatctgggccccgccgacggttgctccatacctatcctgat

SEQ ID NO: 152228 - DNA, 75 bp, Artificial Sequence
  Synthetic
cgcgcgcgcaaaaaaggcgggcggcggtccgggcggcgtgcgcgcgcgcggcgggcgttggggcgggccgcggga

SEQ ID NO: 152229 - DNA, 75 bp, Artificial Sequence
  Synthetic
gcgggcgttggggcgggccgcgggagcgggggaggagcgggggaggagcgggggaggagcggggggaggaggcgg

SEQ ID NO: 152230 - DNA, 75 bp, Artificial Sequence
  Synthetic
tagcgagttagacaggcaagcactactcgcctctgcacgcacatgcttgcctgtcaaactctaccaccccggcac

SEQ ID NO: 152231 - DNA, 75 bp, Artificial Sequence
  Synthetic
cgccatcgcggcccccgccgcccccggccgcccgggcccacgggcgcggtcccaaccgcacagtcccaggtaacc

SEQ ID NO: 152232 - DNA, 75 bp, Artificial Sequence
  Synthetic
cccaaccgcacagtcccaggtaacctccacgcccaactcggaacccgtggtcaggagcgcgcccgcggccgcccc

SEQ ID NO: 152233 - DNA, 75 bp, Artificial Sequence
  Synthetic
tggccggacagccccccgcccgagccggcgccagaggcccggcccaccgccgccgccccccgcccccggtcccca

SEQ ID NO: 152234 - DNA, 75 bp, Artificial Sequence
  Synthetic
agcacctggcgcgcctgcgcctgcgacgcgcgggcggggagggggcgccgaagccccccgcgacccccgcgaccc

SEQ ID NO: 152235 - DNA, 75 bp, Artificial Sequence
  Synthetic
gggctaacccctcccaccccccctcacgccccttccgccttccgccgcgcctcgccctccgcctgcgcgtcaccg

SEQ ID NO: 152236 - DNA, 75 bp, Artificial Sequence
  Synthetic
cccccgcgacccccacgcgggtgcgcttctcgccccacgtccgggtgcgccacctggtggtctgggcctcggccg

SEQ ID NO: 152237 - DNA, 75 bp, Artificial Sequence
  Synthetic
cttctcgccccacgtccgggtgcgccacctggtggtctgggcctcggccgcccgcctggcgcgccgcggctcgtg

SEQ ID NO: 152238 - DNA, 75 bp, Artificial Sequence
  Synthetic
cggttccggcgccgggtggcggaggccgaggcggtcatcgggccgtgcctggggcccgaggcccgtgcccgggcc

SEQ ID NO: 152239 - DNA, 75 bp, Artificial Sequence
  Synthetic
ccgaggcggtcatcgggccgtgcctggggcccgaggcccgtgcccgggccctggcccgcggagccggcccggcga

SEQ ID NO: 152240 - DNA, 75 bp, Artificial Sequence
  Synthetic
gttggcgtgaacgcaacggcgggagctgggttagcgtttagtttagcattcgctctcgcctttccgcccgccccc

SEQ ID NO: 152241 - DNA, 75 bp, Artificial Sequence
  Synthetic
cggcctgggtcttccgcggagctcccgggagctccgcaccaagccgctctccggagagacgatggcaggagccgc

SEQ ID NO: 152242 - DNA, 75 bp, Artificial Sequence
  Synthetic
cgggagctccgcaccaagccgctctccggagagacgatggcaggagccgcgcatatatacgcttggagccggccc

SEQ ID NO: 152243 - DNA, 75 bp, Artificial Sequence
  Synthetic
gcgcttgggggggctgtcggggccacgaggggtgtcctcggccagggcccagggacgcttagtcacggtgcgtcc

SEQ ID NO: 152244 - DNA, 75 bp, Artificial Sequence
  Synthetic
ccggcccactgggcggtaactcccgcccagtgggccgggccgcccacttcccggtatggtaattaaaaacttgca

SEQ ID NO: 152245 - DNA, 75 bp, Artificial Sequence
  Synthetic
gaggccttgttccgcttcccggtatggtaattagaaactcattaatgggcggccccggccgcccttcccgcttcc

SEQ ID NO: 152246 - DNA, 75 bp, Artificial Sequence
  Synthetic
ggtaattagaaactcattaatgggcggccccggccgcccttcccgcttccggcaattcccgcggcccttaatggg

SEQ ID NO: 152247 - DNA, 75 bp, Artificial Sequence
  Synthetic
cgccgcgcgtaaccactcccctggggttccgggttatgttaattgcttttttggcggaacacacggcccctcgcg

SEQ ID NO: 152248 - DNA, 75 bp, Artificial Sequence
  Synthetic
gttccgggttatgttaattgcttttttggcggaacacacggcccctcgcgcattggcccgcgggtcgctcaatga

SEQ ID NO: 152249 - DNA, 75 bp, Artificial Sequence
  Synthetic
gggtatggtaatgagtttcttcgggaaggcgggaagccccggggcaccgacgcaggccaagcccctgttgcgtcg

SEQ ID NO: 152250 - DNA, 75 bp, Artificial Sequence
  Synthetic
aaggcgggaagccccggggcaccgacgcaggccaagcccctgttgcgtcggcgggaggggcatgctaatggggtt

SEQ ID NO: 152251 - DNA, 75 bp, Artificial Sequence
  Synthetic
gtcacgggtacgcccaggctcggggcgacgtacacgctaaccaccaactccagcagcgtctggcccagggcgtac

SEQ ID NO: 152252 - DNA, 75 bp, Artificial Sequence
  Synthetic
ccaaatcgggggccgggccgtgcatgctaatgatattctttgggggcgccgggttggtccccggggacggggccg

SEQ ID NO: 152253 - DNA, 75 bp, Artificial Sequence
  Synthetic
gctaatgatattctttgggggcgccgggttggtccccggggacggggccgccccgcggtgggcctgcctcccctg

SEQ ID NO: 152254 - DNA, 75 bp, Artificial Sequence
  Synthetic
tcactgccgcccctttggggaggggaaaggcgtggggtataagttagccctggcccgacggtctggtcgcatttg

SEQ ID NO: 152255 - DNA, 75 bp, Artificial Sequence
  Synthetic
gcccgaaaacgtctgggtgcccgtggtcacctttctgggggcgggcgcgctcgccgtcaagacggtgcgagaaca

SEQ ID NO: 152256 - DNA, 75 bp, Artificial Sequence
  Synthetic
agcagccaggcagactcgggccgccccctctccgcatcaccacagaagccccgcctacgttgcgacccccaggga

SEQ ID NO: 152257 - DNA, 75 bp, Artificial Sequence
  Synthetic
accctatatatacagggaccggggtcgccctgttaggggtcgccatgtgaccccctgactttatatatacagacc

SEQ ID NO: 152258 - DNA, 75 bp, Artificial Sequence
  Synthetic
catacgacccccatggagccccgccccggagcgagtacccgccggcctgagggccgcccccagcgcgaggtgagg

SEQ ID NO: 152259 - DNA, 75 bp, Artificial Sequence
  Synthetic
gggccgcccccagcgcgaggtgaggggccgggcgccatgtctggggcgccatgtctggggcgccatgtctggggc

SEQ ID NO: 152260 - DNA, 75 bp, Artificial Sequence
  Synthetic
ggaaccggccgccatgttgggggacccccactcatacacgggagccgggcgccatgttggggcgccatgttaggg

SEQ ID NO: 152261 - DNA, 75 bp, Artificial Sequence
  Synthetic
ggcgtggaaccccgtgacactatatatacagggaccgggggcgccatgttagggggcgcggaaccccctgaccct

SEQ ID NO: 152262 - DNA, 75 bp, Artificial Sequence
  Synthetic
tgactttatatatacagacccccaacacctacacatggcccctttgactcagacgcagggcccggggtcgccgtg

SEQ ID NO: 152263 - DNA, 75 bp, Artificial Sequence
  Synthetic
ggaccggggtcgccgtgttagggggcgtggtccccactgactcatacgcagggcccccttactcacacgcatcta

SEQ ID NO: 152264 - DNA, 75 bp, Artificial Sequence
  Synthetic
ggggggtggggaggagccgcccgccatatttgggggacgccgtgggacccccgactccggtgcgtctggagggcg

SEQ ID NO: 152265 - DNA, 75 bp, Artificial Sequence
  Synthetic
atatttgggggacgccgtgggacccccgactccggtgcgtctggagggcgggagaagagggaagaagaggggtcg

SEQ ID NO: 152266 - DNA, 75 bp, Artificial Sequence
  Synthetic
cctttggttgcagacccctttctcccccctcttccgaggccagcaggggggcaggactttgtgaggcgggggggg

SEQ ID NO: 152267 - DNA, 75 bp, Artificial Sequence
  Synthetic
gcaggactttgtgaggcggggggggagggggaactcgtgggcgctgattgacgcgggaaatccccccattcttac

SEQ ID NO: 152268 - DNA, 75 bp, Artificial Sequence
  Synthetic
cgccccggatgtctgggtgtttccctgcgaccgagacctgccggacagcagcgactcggaggcggagaccgaagt

SEQ ID NO: 152269 - DNA, 75 bp, Artificial Sequence
  Synthetic
gcgactcggaggcggagaccgaagtgggggggcggggggacgccgaccaccatgacgacgactccgcctccgagg

SEQ ID NO: 152270 - DNA, 75 bp, Artificial Sequence
  Synthetic
gggggggcggggggacgccgaccaccatgacgacgactccgcctccgaggcggacagcacggacacggaactgtt

SEQ ID NO: 152271 - DNA, 75 bp, Artificial Sequence
  Synthetic
ggcgtggatgggggggcggtctcgggggggagccccccccgcgaggaagaccccggcagttgcgggggcgccccc

SEQ ID NO: 152272 - DNA, 75 bp, Artificial Sequence
  Synthetic
gggggagccccccccgcgaggaagaccccggcagttgcgggggcgccccccctcgagaggacggggggagcgacg

SEQ ID NO: 152273 - DNA, 75 bp, Artificial Sequence
  Synthetic
caccctgagcccaccacggacgaggatgacgacgacctggacgacggtgaggcgggggggcggcgaggaccctgg

SEQ ID NO: 152274 - DNA, 75 bp, Artificial Sequence
  Synthetic
ggaggaataggcgggcgggcgggcgaggaaagggcgggccggggagggggcgtaacctgatcgcgccccccgttg

SEQ ID NO: 152275 - DNA, 75 bp, Artificial Sequence
  Synthetic
ggatgagatcgcgccccacctgcgctgcgacaccttcccgtgcatgcaccgcttctgcatcccgtgcatgaaaac

SEQ ID NO: 152276 - DNA, 75 bp, Artificial Sequence
  Synthetic
tgcgacaccttcccgtgcatgcaccgcttctgcatcccgtgcatgaaaacctggatgcaattgcgcaacacctgc

SEQ ID NO: 152277 - DNA, 75 bp, Artificial Sequence
  Synthetic
acctgatagtgggcgtgacgcccagcgggtcgttcagcaccatcccgatcgtgaacgacccccagacccgcatgg

SEQ ID NO: 152278 - DNA, 75 bp, Artificial Sequence
  Synthetic
cgggtcgttcagcaccatcccgatcgtgaacgacccccagacccgcatggaggccgaggaggccgtcagggcggg

SEQ ID NO: 152279 - DNA, 75 bp, Artificial Sequence
  Synthetic
ggcaatcagcggttcgccccgcggtacctgaccctgggggggcacacggtgagggccctgtcgcccacccaccct

SEQ ID NO: 152280 - DNA, 75 bp, Artificial Sequence
  Synthetic
cccccggcctctccccacaggccccccgcggcgcccatgccaggctccgccccccgccccggtccccccgcgtcc

SEQ ID NO: 152281 - DNA, 75 bp, Artificial Sequence
  Synthetic
acctgatcgcgccccccgttgtctcttgcagcagactacgtaccgcccgccccccgccggacgccccgcgccccc

SEQ ID NO: 152282 - DNA, 75 bp, Artificial Sequence
  Synthetic
ttgcagcagactacgtaccgcccgccccccgccggacgccccgcgcccccccacgcagaggcgccgccgcgcccc

SEQ ID NO: 152283 - DNA, 75 bp, Artificial Sequence
  Synthetic
gcgggcgccgcctccggggcccggcccccgcgccccggcccccggggcggagccggccgcccgccccgcggacgc

SEQ ID NO: 152284 - DNA, 75 bp, Artificial Sequence
  Synthetic
ggacgggcccccttgtcaacagacccgccccccttgcaaacaacagagaccccatagtgatcagcgactcccccc

SEQ ID NO: 152285 - DNA, 75 bp, Artificial Sequence
  Synthetic
cccatagtgatcagcgactcccccccggcctctccccacaggccccccgcggcgcccatgccaggctccgccccc

SEQ ID NO: 152286 - DNA, 75 bp, Artificial Sequence
  Synthetic
ggcgcccatgccaggctccgccccccgccccggtccccccgcgtccgcggccgcgtcgggccccgcgcgcccccg

SEQ ID NO: 152287 - DNA, 75 bp, Artificial Sequence
  Synthetic
cgtgtgccccagtcgcactcgtccctggctcaggccgcgaaccaagaacagagtctgtgccgggcgcgtgcgacg

SEQ ID NO: 152288 - DNA, 75 bp, Artificial Sequence
  Synthetic
gtggcgcgcggctcgggggggccgggcgtggagggtggacacgggccctcccgcggcgccgccccctccggcgcc

SEQ ID NO: 152289 - DNA, 75 bp, Artificial Sequence
  Synthetic
gaggaagggagggaggagggtactgggggtgaagggggggggggagaagcgagaacaggaaaggcgacggagccc

SEQ ID NO: 152290 - DNA, 75 bp, Artificial Sequence
  Synthetic
cctccgccgcctctgtcgagcaggaggcggcggtgcgtccgaggaagaggcgcgggtcgggccaggaaaacccct

SEQ ID NO: 152291 - DNA, 75 bp, Artificial Sequence
  Synthetic
cacagcgcatgcgccgggccgttgtggggccccgggccggggccccttgggtccgccggggccccgggccgggcc

SEQ ID NO: 152292 - DNA, 75 bp, Artificial Sequence
  Synthetic
ggcggcggtgcgtccgaggaagaggcgcgggtcgggccaggaaaacccctccccccagtccacgcgtccccccct

SEQ ID NO: 152293 - DNA, 75 bp, Artificial Sequence
  Synthetic
gcgacgcaccccccctccgactcagggccgggggggcgcggccagggagggcccgggacccccctgacgtcctcg

SEQ ID NO: 152294 - DNA, 75 bp, Artificial Sequence
  Synthetic
gcccgggacccccctgacgtcctcggcggcctccgcctcttcctcctccgcctcttcctcctcggccccgactcc

SEQ ID NO: 152295 - DNA, 75 bp, Artificial Sequence
  Synthetic
ggggccgcgtcctcctccgcttccgcctcctcgggcggggccgtcggtgccctgggagggagacaagaggaaacc

SEQ ID NO: 152296 - DNA, 75 bp, Artificial Sequence
  Synthetic
cctcctcgggcggggccgtcggtgccctgggagggagacaagaggaaacctccctcggcccccgcgctgcttctg

SEQ ID NO: 152297 - DNA, 75 bp, Artificial Sequence
  Synthetic
ccggaagacgcgccacgcggagacttccggggccgtccccgcgggcggcctcacgcgctacctgcccatctcggg

SEQ ID NO: 152298 - DNA, 75 bp, Artificial Sequence
  Synthetic
tccggggccgtccccgcgggcggcctcacgcgctacctgcccatctcgggggtctctagcgtggtcgccctgtcg

SEQ ID NO: 152299 - DNA, 75 bp, Artificial Sequence
  Synthetic
gcgcccctcgaccgactgcccggcgaacaccccgtggcactggctcagggccaggtcctggtacacggcgaggtt

SEQ ID NO: 152300 - DNA, 75 bp, Artificial Sequence
  Synthetic
gggactgcctgcccatcctggacatggagacggggaacatcggggcgtacgtggtcctggtggaccagacgggaa

SEQ ID NO: 152301 - DNA, 75 bp, Artificial Sequence
  Synthetic
ggagacggggaacatcggggcgtacgtggtcctggtggaccagacgggaaacatggcgacccggctgcgggccgc

SEQ ID NO: 152302 - DNA, 75 bp, Artificial Sequence
  Synthetic
ctgctccccgagaccgcgggtaaccacgtgacgccccccgagtacccgacggcccccgcgtcggagtggaacagc

SEQ ID NO: 152303 - DNA, 75 bp, Artificial Sequence
  Synthetic
ggcccccgcgtcggagtggaacagcctctggatgacccccgtggggaacatgctgttcgaccagggcaccctagt

SEQ ID NO: 152304 - DNA, 75 bp, Artificial Sequence
  Synthetic
gggcgccctggacttccgcagcctgcggtctcggcacccgtggtccggggagcagggggcgtcgacccgggacga

SEQ ID NO: 152305 - DNA, 75 bp, Artificial Sequence
  Synthetic
cggtctcggcacccgtggtccggggagcagggggcgtcgacccgggacgagggaaaacaataagggacgcccccg

SEQ ID NO: 152306 - DNA, 75 bp, Artificial Sequence
  Synthetic
gctccccagagacgcgcgccggacgaggagggggcacgtcgccgccggcggtcgcctgtcgggtcccgcgccgtt

SEQ ID NO: 152307 - DNA, 75 bp, Artificial Sequence
  Synthetic
ggtgcgtgggagtgggggtgcgtgggagtgggggtgcgtgggagtgggggtgccatgttgggcaggctctggtgt

SEQ ID NO: 152308 - DNA, 75 bp, Artificial Sequence
  Synthetic
gaccgggctcagtgggggcgtggggtgggtgggagaaggcgaggagactggggtgggggtgtcggtgggtggttg

SEQ ID NO: 152309 - DNA, 75 bp, Artificial Sequence
  Synthetic
gcctgaccaccgatccccgaaagcatcctgccactggcatggagccagaaccacagtgggttgggtgtgggtgtt

SEQ ID NO: 152310 - DNA, 75 bp, Artificial Sequence
  Synthetic
acaggaacatagttagaaaacaagaatgcggtgcagccagagaatcacaggagacgaggggatgggcgtgttggt

SEQ ID NO: 152311 - DNA, 75 bp, Artificial Sequence
  Synthetic
tggccgggccgggccgggccgggccgggtgggcggggtttggaaaaacgaggaggaggaggagaaggcggggggg

SEQ ID NO: 152312 - DNA, 75 bp, Artificial Sequence
  Synthetic
gtttcttagagaccgccgggggacgtggggttggtgtgcaaaggcacgcgcacccgcgccggccaggtgggccgg

SEQ ID NO: 152313 - DNA, 75 bp, Artificial Sequence
  Synthetic
cttcccacccccgcgtgccagagatcaccccggtcccccggcacccgccactcctccatatcctcgctttaggaa

SEQ ID NO: 152314 - DNA, 75 bp, Artificial Sequence
  Synthetic
caccccggtcccccggcacccgccactcctccatatcctcgctttaggaacaactttaggggggggtacacacgc

SEQ ID NO: 152315 - DNA, 75 bp, Artificial Sequence
  Synthetic
gagaggcacagatgcttacggtcaggtgctccgggccgggtgcgtctggtatgcggttggtatatgtacacttta

SEQ ID NO: 152316 - DNA, 75 bp, Artificial Sequence
  Synthetic
aggcagtaagacccaagcatagagagccaggcacaaaaacacaggcggggtgggacacatgccttcttggagtac

SEQ ID NO: 152317 - DNA, 75 bp, Artificial Sequence
  Synthetic
gccaggcacaaaaacacaggcggggtgggacacatgccttcttggagtacgtgggtcattggcgtggggggttac

SEQ ID NO: 152318 - DNA, 75 bp, Artificial Sequence
  Synthetic
gtcttccagccggcccttagataagggggcagttggtggtcggacgggtaagtaacagagtctaactaagggtgg

SEQ ID NO: 152319 - DNA, 75 bp, Artificial Sequence
  Synthetic
gtgctgtaacacgagcccacccgcgagtggcgtggccgaccttagcctctggggcgccccctgtcgtttgggtcc

SEQ ID NO: 152320 - DNA, 75 bp, Artificial Sequence
  Synthetic
ccccccctctattggggagaagcaggtgtctaacctacctggaaacgcggcgtctttgttgaacgacaccggggc

SEQ ID NO: 152321 - DNA, 75 bp, Artificial Sequence
  Synthetic
atctcaggccccgggccgggaacccggaaaagcctccggggggcctttttcgcgtcgcgtgccggcgagcgggtc

SEQ ID NO: 152322 - DNA, 75 bp, Artificial Sequence
  Synthetic
agacgaacgaaacattccggcgacggaacgaaaaacaccccagacgggttaaagaaacagaaaccgcaaccccca

SEQ ID NO: 152323 - DNA, 75 bp, Artificial Sequence
  Synthetic
aaaacagaccagcggccggccggcgcttagggggaggatgtcgccgacgccccttggccgccccggctgcagggg

SEQ ID NO: 152324 - DNA, 75 bp, Artificial Sequence
  Synthetic
ggcccggagagccgcggcacccggacgcgcccggaaagtctttcgcaccaccggcgatcggcacggccgcgcccc

SEQ ID NO: 152325 - DNA, 75 bp, Artificial Sequence
  Synthetic
cagcaaaaacaggccacagcaccacatgggtaggtgatgtaattttattttcctcgtctgcggcctaatggattt

SEQ ID NO: 152326 - DNA, 75 bp, Artificial Sequence
  Synthetic
agcacttaacggattgatatctcgcgggcacgcgcgcccttaatggaccggcgcggggcggggggccggataccc

SEQ ID NO: 152327 - DNA, 75 bp, Artificial Sequence
  Synthetic
aaacaatgactcggggcctttctgcctctgccgcttgtgtgtgcgcgcgccggctctgcggtgtcggcggcggcg

SEQ ID NO: 152328 - DNA, 75 bp, Artificial Sequence
  Synthetic
tcggtagccggccggcgggtggactcgcggggggccggagggtggaaggcaggggggtgtaggatgggtatcagg

SEQ ID NO: 152329 - DNA, 75 bp, Artificial Sequence
  Synthetic
aggggggtgtaggatgggtatcaggacttccacttcccgtccttccatcccccgttcccctcggttgttcctcgc

SEQ ID NO: 152330 - DNA, 75 bp, Artificial Sequence
  Synthetic
cccgtcacccccctccctccgtcccctccgtccccccgtcgcgggtgtttgtgtttgtttattccgacatcggtt

SEQ ID NO: 152331 - DNA, 75 bp, Artificial Sequence
  Synthetic
gcgtgtctgttcttgcgtgtggctgggggcttatatgtggggtcccgggggcgggatggggtttagcggcggggg

SEQ ID NO: 152332 - DNA, 75 bp, Artificial Sequence
  Synthetic
agagccgcgacccggccgccggggagcgttgtcgccgtcggtctgccggcccccgtccctcccttttttgaccaa

SEQ ID NO: 152333 - DNA, 75 bp, Artificial Sequence
  Synthetic
cccaccaccgacacctcccgcgcacccccgcccacatccccccaccccgcaccacgagcacggggtgggggtagc

SEQ ID NO: 152334 - DNA, 75 bp, Artificial Sequence
  Synthetic
ccccgcccacatccccccaccccgcaccacgagcacggggtgggggtagcaggggatcaaaggggggcaaagccg

SEQ ID NO: 152335 - DNA, 75 bp, Artificial Sequence
  Synthetic
cccctcccggcagccacgccccccagcgtcgggtgtcacggggaaagagcaggggagagggggggagaggagagg

SEQ ID NO: 152336 - DNA, 75 bp, Artificial Sequence
  Synthetic
gtgccgaccctaggcgctatggggattttgggttgggtcgggcttattgccgttggggttttgtgtgtgcggggg

SEQ ID NO: 152337 - DNA, 75 bp, Artificial Sequence
  Synthetic
ttttgggttgggtcgggcttattgccgttggggttttgtgtgtgcgggggggcttgtcttcaaccgaatatgtta

SEQ ID NO: 152338 - DNA, 75 bp, Artificial Sequence
  Synthetic
gggggatatattaaaggtgccttgtgtgccgctcccgtctgacgatcttgattggcgttacgagaccccctcggc

SEQ ID NO: 152339 - DNA, 75 bp, Artificial Sequence
  Synthetic
gtgccgctcccgtctgacgatcttgattggcgttacgagaccccctcggctataaactatgctttgatagacggt

SEQ ID NO: 152340 - DNA, 75 bp, Artificial Sequence
  Synthetic
gtttcctgccaacacccaggaaacagaaacgcgcttggccctttataaagagatacgccaggcgctggacagtcg

SEQ ID NO: 152341 - DNA, 75 bp, Artificial Sequence
  Synthetic
gaaacgcgcttggccctttataaagagatacgccaggcgctggacagtcgcaagcaggccgccagccacacacct

SEQ ID NO: 152342 - DNA, 75 bp, Artificial Sequence
  Synthetic
aaacccaacccaaatcccataaacatacgacacacaggcatattttggaatttcttgggtttttatttatttagg

SEQ ID NO: 152343 - DNA, 75 bp, Artificial Sequence
  Synthetic
actattcgcgcacccgccgctgtgtagggcgacaggatttgggacctaccaacggaacgtctggacggaccccgg

SEQ ID NO: 152344 - DNA, 75 bp, Artificial Sequence
  Synthetic
tgacgttttcctcgtccgcgccccccgaccctcccatggatttaacaaacgggggggtgtcgcctgcggcgacct

SEQ ID NO: 152345 - DNA, 75 bp, Artificial Sequence
  Synthetic
gggggggtgtcgcctgcggcgacctcggcgcctctggactggaccacgtttcggcgtgtgtttctgatcgacgac

SEQ ID NO: 152346 - DNA, 75 bp, Artificial Sequence
  Synthetic
agctggcgaaccccttaaccgcccacctcctggccgaatataatcgtcggtgccagaccgaagaggtgctgccgc

SEQ ID NO: 152347 - DNA, 75 bp, Artificial Sequence
  Synthetic
cctcctggccgaatataatcgtcggtgccagaccgaagaggtgctgccgccgcgggaggatgtgttttcgtggac

SEQ ID NO: 152348 - DNA, 75 bp, Artificial Sequence
  Synthetic
cgcgtggttatcatcggccaggacccatatcaccaccccggccaggcgcacggacttgcgtttagcgtgcgcgcg

SEQ ID NO: 152349 - DNA, 75 bp, Artificial Sequence
  Synthetic
tctgtagggcgccacggcgggaggtgtcaggcggactatcgggactcgccatacatgaagacggggtgtagtaca

SEQ ID NO: 152350 - DNA, 75 bp, Artificial Sequence
  Synthetic
catatcaccaccccggccaggcgcacggacttgcgtttagcgtgcgcgcgaacgtgccgcctcccccgagtcttc

SEQ ID NO: 152351 - DNA, 75 bp, Artificial Sequence
  Synthetic
ctgttatcccgaggcacggatgagcggccacggttgcctggaaaagtgggcgcgggacggcgtcctgttactaaa

SEQ ID NO: 152352 - DNA, 75 bp, Artificial Sequence
  Synthetic
cgcgggacggcgtcctgttactaaacacgaccctgaccgtcaagcgcggggcggcggcgtcccactctagaatcg

SEQ ID NO: 152353 - DNA, 75 bp, Artificial Sequence
  Synthetic
tatccgccggttggccgcgcgccgccccggcctggtgtttatgctctggggcgcacacgcccagaatgccatcag

SEQ ID NO: 152354 - DNA, 75 bp, Artificial Sequence
  Synthetic
gccggaccctcgggtccattgcgtcctcaagttttcgcacccgtcgcccctctccaaggttccgttcggaacctg

SEQ ID NO: 152355 - DNA, 75 bp, Artificial Sequence
  Synthetic
gggggcttttgggtatttccgatgaataaagacggttaatggttaaacctctggtctcatacgggtcggtgatgt

SEQ ID NO: 152356 - DNA, 75 bp, Artificial Sequence
  Synthetic
ataaagacggttaatggttaaacctctggtctcatacgggtcggtgatgtcgggcgtcgggggagagggagttcc

SEQ ID NO: 152357 - DNA, 75 bp, Artificial Sequence
  Synthetic
tggggctggacgttcgacacgccaaaccacgagtcggggatatcgccagatacgactcccgcagattccattcgg

SEQ ID NO: 152358 - DNA, 75 bp, Artificial Sequence
  Synthetic
ggaggccacagcgccgtctttctccccaacgcgcgcggatgacggcccgccctgtaccgacgggccctacgtgac

SEQ ID NO: 152359 - DNA, 75 bp, Artificial Sequence
  Synthetic
cctgtaccgacgggccctacgtgacgtttgataccctgtttatggtgtcgtcgatcgacgaattagggcgtcgcc

SEQ ID NO: 152360 - DNA, 75 bp, Artificial Sequence
  Synthetic
cctgcggttgtcgctggccaagtttagcattgcgtgcaccaagacctcctcgttttcgggaaacgccccgcgcca

SEQ ID NO: 152361 - DNA, 75 bp, Artificial Sequence
  Synthetic
cgttttcgggaaacgccccgcgccaccacagacgcggggcgttccagcgcggcacgcgggcgccgcgcagcaaca

SEQ ID NO: 152362 - DNA, 75 bp, Artificial Sequence
  Synthetic
caaacgcgcccacgccgctcgagtgcgagagcagcttcgggtcgttattcagtcccgcaagccgcgcaagtatta

SEQ ID NO: 152363 - DNA, 75 bp, Artificial Sequence
  Synthetic
cgagagcagcttcgggtcgttattcagtcccgcaagccgcgcaagtattacacgcgatcttcggacgggcggctc

SEQ ID NO: 152364 - DNA, 75 bp, Artificial Sequence
  Synthetic
acgagttcgtctcgtccgagccaatgcgcctccaccgagataacgtcatgctggcctcgggggccgagtaaccgc

SEQ ID NO: 152365 - DNA, 75 bp, Artificial Sequence
  Synthetic
ccgtcgcgcgtgtttgatgttaataaataacacataaatttggctggttgtttgttgtctttaatggaccgcccg

SEQ ID NO: 152366 - DNA, 75 bp, Artificial Sequence
  Synthetic
cgggtgacgagcgcgatccggccgggatcctaggaccccaaaagtttgtctgcgtattccagggtggggctcagt

SEQ ID NO: 152367 - DNA, 75 bp, Artificial Sequence
  Synthetic
tgaatctcccgcagcacctctaccagcaggtccgcggtgggctggagaaactcggccgtcccggggcaggcggtt

SEQ ID NO: 152368 - DNA, 75 bp, Artificial Sequence
  Synthetic
ccccgtgtgccgcgcctggcgtctcctctgggggcgacccgtaaatggttgcagtgatgtaaatggtgtccgcgg

SEQ ID NO: 152369 - DNA, 75 bp, Artificial Sequence
  Synthetic
acggatacgcgtacatatgggcgtcccacccgcgttcgagcttctggttgctgtcccggcctataaagcggtagg

SEQ ID NO: 152370 - DNA, 75 bp, Artificial Sequence
  Synthetic
ccacccgcgttcgagcttctggttgctgtcccggcctataaagcggtaggcacaaaattcggcgcgacagtcgat

SEQ ID NO: 152371 - DNA, 75 bp, Artificial Sequence
  Synthetic
tgctggataacaacgcctccgcgcggcaggcggtcctggcgctcccggccccgtaccatgatcgcgcgggtgccg

SEQ ID NO: 152372 - DNA, 75 bp, Artificial Sequence
  Synthetic
tactcaaaaacatgcaccacctgcgcggcgtcgggcagtgcgctggtcagcgaggccctggcgtggcataggcta

SEQ ID NO: 152373 - DNA, 75 bp, Artificial Sequence
  Synthetic
cgaggccctggcgtggcataggctatacgcgatggtcgtctgtggattggacatctcgcggtgggtagtgagtcc

SEQ ID NO: 152374 - DNA, 75 bp, Artificial Sequence
  Synthetic
atgcctgtgggtctatcacacccgcccctccatcccacaaacacagaacacacgggttggatgaaaacacgcatt

SEQ ID NO: 152375 - DNA, 75 bp, Artificial Sequence
  Synthetic
tacgcgatggtcgtctgtggattggacatctcgcggtgggtagtgagtcccccgggccgggttcggtggaactgt

SEQ ID NO: 152376 - DNA, 75 bp, Artificial Sequence
  Synthetic
tgaccacgttcggatcgcgcagagccgatagtatgtgctcactaatgacgtcatcgcgctcgtggcgctcccgga

SEQ ID NO: 152377 - DNA, 75 bp, Artificial Sequence
  Synthetic
cgatagtatgtgctcactaatgacgtcatcgcgctcgtggcgctcccggagcggatttaagttcatgcgaaggaa

SEQ ID NO: 152378 - DNA, 75 bp, Artificial Sequence
  Synthetic
gccacgtacgcgctgttgaggcgcaggttgccgggcgtaaagcagatggcgaccttgtccaggctaaggccctgg

SEQ ID NO: 152379 - DNA, 75 bp, Artificial Sequence
  Synthetic
ggttgccgggcgtaaagcagatggcgaccttgtccaggctaaggccctgggagcgcgtgatggtcatggcaagct

SEQ ID NO: 152380 - DNA, 75 bp, Artificial Sequence
  Synthetic
tatggccatggccagctccgtagagtcaatggactcgacaaactcgctgatgttggtgttgacgacggacatgaa

SEQ ID NO: 152381 - DNA, 75 bp, Artificial Sequence
  Synthetic
tcaatggactcgacaaactcgctgatgttggtgttgacgacggacatgaagccgtgttggtcccgcaagaccacg

SEQ ID NO: 152382 - DNA, 75 bp, Artificial Sequence
  Synthetic
actcggccacgttggccgtcgcgtgccgcctccgcagctcgtccgcaaaggcaaacacccgtgtgtacgtgtatc

SEQ ID NO: 152383 - DNA, 75 bp, Artificial Sequence
  Synthetic
cagggcgacggacatcagccccccgcgcggcgagccggtcagcatctcgcagccccggaagataacgttgtccac

SEQ ID NO: 152384 - DNA, 75 bp, Artificial Sequence
  Synthetic
aatgcctccccgaagagctcttggaggattcggaatctcccgaggaaggcccgcttcagcagcgcaaactgggtg

SEQ ID NO: 152385 - DNA, 75 bp, Artificial Sequence
  Synthetic
ggattcggaatctcccgaggaaggcccgcttcagcagcgcaaactgggtgtgaacggcggcggtggtctccggtt

SEQ ID NO: 152386 - DNA, 75 bp, Artificial Sequence
  Synthetic
cacgtcgagctgttgttcgtccagccccgcgaaaataacgtcgaggtcgtcgtcgggaaaatcgtccgggccccc

SEQ ID NO: 152387 - DNA, 75 bp, Artificial Sequence
  Synthetic
cccgcgaaaataacgtcgaggtcgtcgtcgggaaaatcgtccgggcccccgtcccgcggccccagttgcttaaaa

SEQ ID NO: 152388 - DNA, 75 bp, Artificial Sequence
  Synthetic
ggtcctctgggtcgcatccaggcccgggcgctgcagaaagttgtaaaaggagataagcccgctaaatatgagccg

SEQ ID NO: 152389 - DNA, 75 bp, Artificial Sequence
  Synthetic
gggcgctgcagaaagttgtaaaaggagataagcccgctaaatatgagccgcgacaggaacctgtaggcaaactcc

SEQ ID NO: 152390 - DNA, 75 bp, Artificial Sequence
  Synthetic
caaagctgtcgtcacgcaacactgcctcgaaggcccggaacgtcccactaaacccaaaaaccagttttcgcaggc

SEQ ID NO: 152391 - DNA, 75 bp, Artificial Sequence
  Synthetic
ctcgaaggcccggaacgtcccactaaacccaaaaaccagttttcgcaggcgcgcggtcaccgcgatctggctgtt

SEQ ID NO: 152392 - DNA, 75 bp, Artificial Sequence
  Synthetic
gccacgaccagctgctgtttgctgtgcacctcgcagcgcatgtgccccgcgtcctggtcctggctctgcgagtag

SEQ ID NO: 152393 - DNA, 75 bp, Artificial Sequence
  Synthetic
gcacctcgcagcgcatgtgccccgcgtcctggtcctggctctgcgagtagttggtgatgcggctggcgttggccg

SEQ ID NO: 152394 - DNA, 75 bp, Artificial Sequence
  Synthetic
gggctggtgtgtcagccgtcggtattcgtcaaactccttgaccgacacgaacgtaagcacggggagggtgaacac

SEQ ID NO: 152395 - DNA, 75 bp, Artificial Sequence
  Synthetic
tcgtcaaactccttgaccgacacgaacgtaagcacggggagggtgaacacgacgaactccccctcacgggtcacc

SEQ ID NO: 152396 - DNA, 75 bp, Artificial Sequence
  Synthetic
tgtacgcgctcacctctttgtgggaggagaacagccgcgtccagccggggaggttggcggggttggtgatgtagt

SEQ ID NO: 152397 - DNA, 75 bp, Artificial Sequence
  Synthetic
aggttggcggggttggtgatgtagttttccgggacgacgaagcgatccacgaactgcatgtgctcctcggtgatg

SEQ ID NO: 152398 - DNA, 75 bp, Artificial Sequence
  Synthetic
tgaggttaccgaactcgtgctcgacgcaccgtttgttgttaataaaaatggcccagctatacgagaggcgggcgt

SEQ ID NO: 152399 - DNA, 75 bp, Artificial Sequence
  Synthetic
gcaccgtttgttgttaataaaaatggcccagctatacgagaggcgggcgtactcgcgcagcgtgcggttgcagat

SEQ ID NO: 152400 - DNA, 75 bp, Artificial Sequence
  Synthetic
tggcggacggaacaccgcagtttctggtgctcgaaggtcgactccagggacgccgtctgcgtcggcgagcccaca

SEQ ID NO: 152401 - DNA, 75 bp, Artificial Sequence
  Synthetic
ggtgctcgaaggtcgactccagggacgccgtctgcgtcggcgagcccacacacaccaacacgggccgcaggcggg

SEQ ID NO: 152402 - DNA, 75 bp, Artificial Sequence
  Synthetic
ggcgttaatcatccaccagcaatacaccacggccgtgaggaggtgacgcccaaggagcccggcctcgtcgatgac

SEQ ID NO: 152403 - DNA, 75 bp, Artificial Sequence
  Synthetic
ccacgaccccaaccccgcggccagcacggagcagccctcgcccctgggccgggaggccgtggaacaatttttttg

SEQ ID NO: 152404 - DNA, 75 bp, Artificial Sequence
  Synthetic
accacggccgtgaggaggtgacgcccaaggagcccggcctcgtcgatgacgatcacgttgctgcgggtaaaggcc

SEQ ID NO: 152405 - DNA, 75 bp, Artificial Sequence
  Synthetic
ccaaccgcgtcagggcgccctcggccaaccccagggtccgttccagggcggccagggcgcgaaactcgttccgca

SEQ ID NO: 152406 - DNA, 75 bp, Artificial Sequence
  Synthetic
caaccccagggtccgttccagggcggccagggcgcgaaactcgttccgcaactcctcgcccccggaggcggccag

SEQ ID NO: 152407 - DNA, 75 bp, Artificial Sequence
  Synthetic
acctcccagtagtacgtcagatctcgtcgctgcaggtcctccagcgaggcggggttgctggtcagggtgtacggg

SEQ ID NO: 152408 - DNA, 75 bp, Artificial Sequence
  Synthetic
cgcgtttgcgcccgccagtcccggggaggacacggcgggcggcacgccgcccccacagacctgcggaatcgtcaa

SEQ ID NO: 152409 - DNA, 75 bp, Artificial Sequence
  Synthetic
gattcccgcgaaacccaaattcatgaaagatggtgttgatgggtcggctgagaaaggcgcccgagagtttggcgt

SEQ ID NO: 152410 - DNA, 75 bp, Artificial Sequence
  Synthetic
aaagatggtgttgatgggtcggctgagaaaggcgcccgagagtttggcgtacatgttttgggccgcaatgcgcgt

SEQ ID NO: 152411 - DNA, 75 bp, Artificial Sequence
  Synthetic
agaaaggcgcccgagagtttggcgtacatgttttgggccgcaatgcgcgtggcgcccgtcaccacacagtccaag

SEQ ID NO: 152412 - DNA, 75 bp, Artificial Sequence
  Synthetic
tgctctttccggagccagcgttgccggtgataagatacaccgcgaacggaaactccctgaggggcaggcctgcgg

SEQ ID NO: 152413 - DNA, 75 bp, Artificial Sequence
  Synthetic
ggtgataagatacaccgcgaacggaaactccctgaggggcaggcctgcgggggactctaaggccgccacgtcccg

SEQ ID NO: 152414 - DNA, 75 bp, Artificial Sequence
  Synthetic
gctccgtcgagctgttgttgcgagagctctcggatgcgcttaaggattggctgcaccccgtgcatagacgtaaaa

SEQ ID NO: 152415 - DNA, 75 bp, Artificial Sequence
  Synthetic
gctctcggatgcgcttaaggattggctgcaccccgtgcatagacgtaaaatttaaaaaggcctcggccctccctg

SEQ ID NO: 152416 - DNA, 75 bp, Artificial Sequence
  Synthetic
ctgaaggtgcggcgggccgggtttctgtccgtctagctggcgctccccgccggccgccgccatgaccgcaccacg

SEQ ID NO: 152417 - DNA, 75 bp, Artificial Sequence
  Synthetic
cggggggacacggaagcgctgtgctcccccgaggacggctgggtaaaggttcaccccacccccggtacgatgctg

SEQ ID NO: 152418 - DNA, 75 bp, Artificial Sequence
  Synthetic
ttccgtgagattctccacgggcagctggggtataccgagggccagggggtgtacaacgtcgtccggtccagcgag

SEQ ID NO: 152419 - DNA, 75 bp, Artificial Sequence
  Synthetic
gtacaacgtcgtccggtccagcgaggcgaccacccggcagctgcaggcggcgatctttcacgcgctcctcaacgc

SEQ ID NO: 152420 - DNA, 75 bp, Artificial Sequence
  Synthetic
gactggctcggccacgtggcggcccgcggtctgcagccccaacggctggttcgccggtacaggaacgcccgggag

SEQ ID NO: 152421 - DNA, 75 bp, Artificial Sequence
  Synthetic
gggtgttcgacacgtggcggaacacgcttaggacgacgctgctggactttgcccacgggttggtcgcctgctttg

SEQ ID NO: 152422 - DNA, 75 bp, Artificial Sequence
  Synthetic
aagcttccccaaatatatcgactggctgacgtgcctggggctggtccccatattacgcaagcgacaagaaggggg

SEQ ID NO: 152423 - DNA, 75 bp, Artificial Sequence
  Synthetic
ctgacgtgcctggggctggtccccatattacgcaagcgacaagaagggggtgtgacgcagggtctgagggcgttt

SEQ ID NO: 152424 - DNA, 75 bp, Artificial Sequence
  Synthetic
agctggccacggtcgcggaggccgcggagcgcgccggccccgggttttttgagctggcgctggccttcgactcca

SEQ ID NO: 152425 - DNA, 75 bp, Artificial Sequence
  Synthetic
ggagcgcgccggccccgggttttttgagctggcgctggccttcgactccacgcgcgtggcggactacgaccgcgt

SEQ ID NO: 152426 - DNA, 75 bp, Artificial Sequence
  Synthetic
ggcgactggctcgtgcgagaccccatcagcgggcagcgcggagaatgtctggtgctgtggccccccttgtggacc

SEQ ID NO: 152427 - DNA, 75 bp, Artificial Sequence
  Synthetic
tcagcgggcagcgcggagaatgtctggtgctgtggccccccttgtggaccggggaccgtctggtcttcgattcgc

SEQ ID NO: 152428 - DNA, 75 bp, Artificial Sequence
  Synthetic
cgtcgcgtgtcactccctccgggaacacgcgcacgtctgccggctgcgcaataccgcgtccgtcaaggtgctgct

SEQ ID NO: 152429 - DNA, 75 bp, Artificial Sequence
  Synthetic
cacgcgcacgtctgccggctgcgcaataccgcgtccgtcaaggtgctgctggggcgcaagagcgacagcgagcgc

SEQ ID NO: 152430 - DNA, 75 bp, Artificial Sequence
  Synthetic
ttaacaaggtgttgggggaggacgacgagaccaaggccgggtcggccgcctcgcgcctcgtgcggcttatcatca

SEQ ID NO: 152431 - DNA, 75 bp, Artificial Sequence
  Synthetic
cgagaccaaggccgggtcggccgcctcgcgcctcgtgcggcttatcatcaacatgaagggcatgcgccacgtagg

SEQ ID NO: 152432 - DNA, 75 bp, Artificial Sequence
  Synthetic
tacctcgacgaggccggggggcacctgatagacgccccggccgtcgacggtaccctccctggattcggcaagggc

SEQ ID NO: 152433 - DNA, 75 bp, Artificial Sequence
  Synthetic
ggaaacagccgcgggtctgcgggccaggaccagggggggcgggcgccgcagcttcgccaggccttccgcacggcc

SEQ ID NO: 152434 - DNA, 75 bp, Artificial Sequence
  Synthetic
gcttcgccaggccttccgcacggccgtggttaacaacatcaacggcgtgttggagggctatataaataacctgtt

SEQ ID NO: 152435 - DNA, 75 bp, Artificial Sequence
  Synthetic
gtggttaacaacatcaacggcgtgttggagggctatataaataacctgtttggaaccatcgagcgcctgcgcgag

SEQ ID NO: 152436 - DNA, 75 bp, Artificial Sequence
  Synthetic
tgcaggagcgcgaccgcgagctccggcgcgcaacagcgggggccctggagcgccagcagcgcgcggccgacctgg

SEQ ID NO: 152437 - DNA, 75 bp, Artificial Sequence
  Synthetic
ccacaaaacccggaatttacgcctacgccccaatgcccacgcaagatgaggtaggtaacccccccgtgggtgtga

SEQ ID NO: 152438 - DNA, 75 bp, Artificial Sequence
  Synthetic
cggcagccgccctgcgggggcggacctgctccgggccgactatgacattatcgacgtcagcaagtccatggacga

SEQ ID NO: 152439 - DNA, 75 bp, Artificial Sequence
  Synthetic
cagcacccgtacatcccttcgtacgcccaggacctggagcgcctgtcgcgcctctgggagcacgagctggtgcgc

SEQ ID NO: 152440 - DNA, 75 bp, Artificial Sequence
  Synthetic
cccaggacctggagcgcctgtcgcgcctctgggagcacgagctggtgcgctgttttaaaattctgtgtcaccgca

SEQ ID NO: 152441 - DNA, 75 bp, Artificial Sequence
  Synthetic
ctcgtactccagcggggcgatcgccgcattcgtcgccccctactttgagtcagtgcttcgggccccccgggtagg

SEQ ID NO: 152442 - DNA, 75 bp, Artificial Sequence
  Synthetic
gcattcgtcgccccctactttgagtcagtgcttcgggccccccgggtaggcgcgcccatcacgggctccgatgtc

SEQ ID NO: 152443 - DNA, 75 bp, Artificial Sequence
  Synthetic
atgcggtgtttaagaaaacccgcctgcaaacgtacctgacagacatcgcggccctgttcgtcgcggacgtccagc

SEQ ID NO: 152444 - DNA, 75 bp, Artificial Sequence
  Synthetic
acgcagcgctgcccccgcccccctccccggtcggcgccgatttccggcccggcgcgtccccgcggggccggtcca

SEQ ID NO: 152445 - DNA, 75 bp, Artificial Sequence
  Synthetic
gccaggcgcgccggaccagggcgggggcatcgggcaccgggatggccgccgcgacggccgacgatgaggggtcgg

SEQ ID NO: 152446 - DNA, 75 bp, Artificial Sequence
  Synthetic
ggcatcgggcaccgggatggccgccgcgacggccgacgatgaggggtcggccgccaccatcctcaagcaggccat

SEQ ID NO: 152447 - DNA, 75 bp, Artificial Sequence
  Synthetic
gcggccgaggcgattagccagcagacgctgctccgcctggcctgcgaggtgcgccaggtcggcgaccgccagccg

SEQ ID NO: 152448 - DNA, 75 bp, Artificial Sequence
  Synthetic
cgctgctccgcctggcctgcgaggtgcgccaggtcggcgaccgccagccgcggtttaccgccaccagcatcgcgc

SEQ ID NO: 152449 - DNA, 75 bp, Artificial Sequence
  Synthetic
gttgcggttcgttctggacgggagtcccgaggacgcctatgtgacgtcggaggattactttaagcgctgctgcgg

SEQ ID NO: 152450 - DNA, 75 bp, Artificial Sequence
  Synthetic
tccaggccggcggaaaccggaacggcatatgcaaattggaaactgtcctgtcttggggcccacccacccgacgcg

SEQ ID NO: 152451 - DNA, 75 bp, Artificial Sequence
  Synthetic
ccagtccagttatcgcggcttcgcggtggcggtcctgacggccaacgaggaccacgtgcacagcctggccgtgcc

SEQ ID NO: 152452 - DNA, 75 bp, Artificial Sequence
  Synthetic
accacgtgcacagcctggccgtgccccccctcgttctgctgcaccggttctccctgttcaaccccagggacctcc

SEQ ID NO: 152453 - DNA, 75 bp, Artificial Sequence
  Synthetic
tggactttgagcttgcctgtctgctgatgtacctggagaactgcccccgaagccacgccaccccgtcgacctttg

SEQ ID NO: 152454 - DNA, 75 bp, Artificial Sequence
  Synthetic
agccacgccaccccgtcgacctttgccaaggttctggcgtggctcggggtcgcgggtcgccgcacgtccccattc

SEQ ID NO: 152455 - DNA, 75 bp, Artificial Sequence
  Synthetic
ccaaggttctggcgtggctcggggtcgcgggtcgccgcacgtccccattcgaacgcgttcgctgccttttcctcc

SEQ ID NO: 152456 - DNA, 75 bp, Artificial Sequence
  Synthetic
actcatgttcatggtgcacgtaaaaccgttcgacgacgagttcgtcctgccccactggtacatggcccggtacct

SEQ ID NO: 152457 - DNA, 75 bp, Artificial Sequence
  Synthetic
ccgttcgacgacgagttcgtcctgccccactggtacatggcccggtacctgctggccaacaacccgccccccgtt

SEQ ID NO: 152458 - DNA, 75 bp, Artificial Sequence
  Synthetic
cgacgagctcctcattccggctgccggggccgcccccccgctccgactgcgtggcctataaccccgccgggatca

SEQ ID NO: 152459 - DNA, 75 bp, Artificial Sequence
  Synthetic
tggggagctgctgggcgtcggaggaggtgcgcgcgcctctggtctattggtggctttcggagaccccaaaacgac

SEQ ID NO: 152460 - DNA, 75 bp, Artificial Sequence
  Synthetic
tggctttcggagaccccaaaacgacagacgtcgtcgctgttttatcagttttgttgaattttaggaaataaaccc

SEQ ID NO: 152461 - DNA, 75 bp, Artificial Sequence
  Synthetic
agacgtcgtcgctgttttatcagttttgttgaattttaggaaataaacccggttttgtttctgtggcctcccgac

SEQ ID NO: 152462 - DNA, 75 bp, Artificial Sequence
  Synthetic
tggtgggtgggtgtctgtgtatcgcgtcccatctgtgcggagagggggggcatgtcggcacgtattcggacagac

SEQ ID NO: 152463 - DNA, 75 bp, Artificial Sequence
  Synthetic
tcaagcacacacgggggagcgctcttgtctcagggcaatgtttttattggtcaaactcaggcaaacagaaacgac

SEQ ID NO: 152464 - DNA, 75 bp, Artificial Sequence
  Synthetic
acttccccccctctccccatactcccgccagcaccccggtaaacaccaactcaatctcgcgcaggatttcgcgca

SEQ ID NO: 152465 - DNA, 75 bp, Artificial Sequence
  Synthetic
cgccagcaccccggtaaacaccaactcaatctcgcgcaggatttcgcgcaggtgatgagcgcagtccacgggggg

SEQ ID NO: 152466 - DNA, 75 bp, Artificial Sequence
  Synthetic
tcaatctcgcgcaggatttcgcgcaggtgatgagcgcagtccacgggggggagcacaaggggccgcgggtataga

SEQ ID NO: 152467 - DNA, 75 bp, Artificial Sequence
  Synthetic
cgcctccgggacagacacgcacgacgcgccgccagtagtgctctgcgtccagcaaggcgccgccgcggaaggcag

SEQ ID NO: 152468 - DNA, 75 bp, Artificial Sequence
  Synthetic
gcgccgccagtagtgctctgcgtccagcaaggcgccgccgcggaaggcagtggggggcaaggggtcgctagcctc

SEQ ID NO: 152469 - DNA, 75 bp, Artificial Sequence
  Synthetic
tactccgcgtccaaccgtttattaaacgcgtccacgataaggcggtcgcaggcgtcctccataaggccccgggcc

SEQ ID NO: 152470 - DNA, 75 bp, Artificial Sequence
  Synthetic
acgcgtccacgataaggcggtcgcaggcgtcctccataaggccccgggccgtgagtgcgtcctcctccggcacgc

SEQ ID NO: 152471 - DNA, 75 bp, Artificial Sequence
  Synthetic
tcgcagcgtgtcgcgtacgaccccggccgccgtggtgtacgcgggcccgcggagaggaaatcccccaagatggtc

SEQ ID NO: 152472 - DNA, 75 bp, Artificial Sequence
  Synthetic
ctcccacggccgtctcgatggcccgccgggcgtcctcgatcaccccggaagccgcatccgcgtcttgggggtcca

SEQ ID NO: 152473 - DNA, 75 bp, Artificial Sequence
  Synthetic
ccgggcgtcctcgatcaccccggaagccgcatccgcgtcttgggggtccacgttaaagacaccccagaacgcacc

SEQ ID NO: 152474 - DNA, 75 bp, Artificial Sequence
  Synthetic
cgttaaagacaccccagaacgcacccccatcgcccccgcagaccgcgaacttcaccgagctggccgtctcctcga

SEQ ID NO: 152475 - DNA, 75 bp, Artificial Sequence
  Synthetic
cccacccaggagctgccgcagcgcagggcaggcgtcgcacgtgtccgggaccaggcgctccaagacggccccggc

SEQ ID NO: 152476 - DNA, 75 bp, Artificial Sequence
  Synthetic
gggcaggcgtcgcacgtgtccgggaccaggcgctccaagacggccccggcccagggctctgagggagcggccacc

SEQ ID NO: 152477 - DNA, 75 bp, Artificial Sequence
  Synthetic
ccgtccggccgtgggggtccgccagcccgctccccccgaggtcggccagggccgccaggagctgggcgcgaagtc

SEQ ID NO: 152478 - DNA, 75 bp, Artificial Sequence
  Synthetic
cccgctccccccgaggtcggccagggccgccaggagctgggcgcgaagtccggggaagcaaaaccgcgccgtcca

SEQ ID NO: 152479 - DNA, 75 bp, Artificial Sequence
  Synthetic
tctaacagttggatgattttagtggcgggatgccaccgcgccaccgcctcccgcaccgcgggcaggaggcatccg

SEQ ID NO: 152480 - DNA, 75 bp, Artificial Sequence
  Synthetic
cgggatgccaccgcgccaccgcctcccgcaccgcgggcaggaggcatccggctgccgccgaggccacgccgggcc

SEQ ID NO: 152481 - DNA, 75 bp, Artificial Sequence
  Synthetic
ggcccccaccgcgggccaggcccccaggagcgcggcgtaagcggccgcggccccgcgcaccaggtcccgtgccga

SEQ ID NO: 152482 - DNA, 75 bp, Artificial Sequence
  Synthetic
aggagcgcggcgtaagcggccgcggccccgcgcaccaggtcccgtgccgactcggccgtggccggcacggtgaac

SEQ ID NO: 152483 - DNA, 75 bp, Artificial Sequence
  Synthetic
cggcaaagtacgggacgggtcccccccggacctcaaactcgggccccagaaaggcaaagacgggggccagggccc

SEQ ID NO: 152484 - DNA, 75 bp, Artificial Sequence
  Synthetic
ccggacctcaaactcgggccccagaaaggcaaagacgggggccagggccccgggggcggcgtggaccgtggtatg

SEQ ID NO: 152485 - DNA, 75 bp, Artificial Sequence
  Synthetic
gccggcgcggagaacttctcgccggcgcttacaaagtagtcgtaatcgcggggcagcagcacccgtgccgtgact

SEQ ID NO: 152486 - DNA, 75 bp, Artificial Sequence
  Synthetic
cgcttacaaagtagtcgtaatcgcggggcagcagcacccgtgccgtgactcgttgcgggtgcccgcgtggccgca

SEQ ID NO: 152487 - DNA, 75 bp, Artificial Sequence
  Synthetic
gtccccgaacgcgccctccttcttgatcggcggaaacgcaagagtctggtattcgcgcgcaaatagcgcggttcc

SEQ ID NO: 152488 - DNA, 75 bp, Artificial Sequence
  Synthetic
atcggcggaaacgcaagagtctggtattcgcgcgcaaatagcgcggttccggtggtgatgttaacggtcagcgaa

SEQ ID NO: 152489 - DNA, 75 bp, Artificial Sequence
  Synthetic
cgcgaatggccgccaggcgcgcccacgccagccgcgcgtcgggatgctcggcaacgcgcgccgccagggccatag

SEQ ID NO: 152490 - DNA, 75 bp, Artificial Sequence
  Synthetic
cgccagccgcgcgtcgggatgctcggcaacgcgcgccgccagggccatagggtcgatgtcaatgttggcctccgc

SEQ ID NO: 152491 - DNA, 75 bp, Artificial Sequence
  Synthetic
tctccccggggcccgcgtaaccccgcgcatatccgggggcacgtagaaattaccttcctcttcggactcgatatc

SEQ ID NO: 152492 - DNA, 75 bp, Artificial Sequence
  Synthetic
agcgagacgacctccccgtcgtcggtgatgaggacgttgtttcggcagcagcagggccgggtcccggagaacgag

SEQ ID NO: 152493 - DNA, 75 bp, Artificial Sequence
  Synthetic
gcgggcgggccccacgacgctctctcaactttcaccaccagtcccgtgcgtgggtccgagccgatacgcagcggg

SEQ ID NO: 152494 - DNA, 75 bp, Artificial Sequence
  Synthetic
caactttcaccaccagtcccgtgcgtgggtccgagccgatacgcagcggggcgaacagggccaccggcccggtct

SEQ ID NO: 152495 - DNA, 75 bp, Artificial Sequence
  Synthetic
cgcgtacagcgcccgccacagagtcgggttctccaggggctccagcggggaggcggccggcgtcgtcgcggcgcg

SEQ ID NO: 152496 - DNA, 75 bp, Artificial Sequence
  Synthetic
gggttctccaggggctccagcggggaggcggccggcgtcgtcgcggcgcgggcggccgccacgacggcctggacg

SEQ ID NO: 152497 - DNA, 75 bp, Artificial Sequence
  Synthetic
ggattttgttgggctggcatgcgtcgcccaaccgagggccgcgtccacgggacgcgccttttataaccccggggg

SEQ ID NO: 152498 - DNA, 75 bp, Artificial Sequence
  Synthetic
cccgcagctccgtcgcggtgacggagacctccgcaaagcgcgcgcgaccctcccctgcggcgttgcgacatacaa

SEQ ID NO: 152499 - DNA, 75 bp, Artificial Sequence
  Synthetic
gacctccgcaaagcgcgcgcgaccctcccctgcggcgttgcgacatacaaaatacaccagggcgtggaagtactc

SEQ ID NO: 152500 - DNA, 75 bp, Artificial Sequence
  Synthetic
gcgtaaagggtaatggcgctgacgctctcctccacccacacgatatctgcggtgtccatcgcacggcccctaagg

SEQ ID NO: 152501 - DNA, 75 bp, Artificial Sequence
  Synthetic
atcacgggcggtctgtgggtcccatgctgccgtgcctggccgggcccggtgggtcgcggaaaccggtgacggggg

SEQ ID NO: 152502 - DNA, 75 bp, Artificial Sequence
  Synthetic
gggggcggtttttggggttggggtgggggtgggaaacggcccgggtccgggggccaacttggcccctcggtgcgt

SEQ ID NO: 152503 - DNA, 75 bp, Artificial Sequence
  Synthetic
ggggtgggaaacggcccgggtccgggggccaacttggcccctcggtgcgttccggcaacagcgccgccggtccgc

SEQ ID NO: 152504 - DNA, 75 bp, Artificial Sequence
  Synthetic
tccggcaacagcgccgccggtccgcggacgaccacgtaccgaacgagtgcggtcccgagacttatagggtgctaa

SEQ ID NO: 152505 - DNA, 75 bp, Artificial Sequence
  Synthetic
agttcaccgccccctgcatcatgggccaggcctcggtggggagctccgacagcgccgcctccaggatgatgtcag

SEQ ID NO: 152506 - DNA, 75 bp, Artificial Sequence
  Synthetic
cgtgcgcaaacagcgcccccacgcaggcacgcgtagcttgaagcgcgcgcccgcaaactcccgcttgtgggccat

SEQ ID NO: 152507 - DNA, 75 bp, Artificial Sequence
  Synthetic
ggcacgcgtagcttgaagcgcgcgcccgcaaactcccgcttgtgggccataagcagggcgtacagctgcctgtgg

SEQ ID NO: 152508 - DNA, 75 bp, Artificial Sequence
  Synthetic
ggtgggcgtccaacaaccccacgattgtctgtttggtgaggtttttaacgcgccccgccccgggaaacgtctgcg

SEQ ID NO: 152509 - DNA, 75 bp, Artificial Sequence
  Synthetic
cagttcgccccagattatcttgaacagcgccaccgcgtggtccgtctcgctaacggacccgcgcgggggacagcc

SEQ ID NO: 152510 - DNA, 75 bp, Artificial Sequence
  Synthetic
acggcttcctccgagagcagaagtccgtcggttacgttacagtggcccagttcgaacaccagctgcatgtagcgg

SEQ ID NO: 152511 - DNA, 75 bp, Artificial Sequence
  Synthetic
aaaacaaccacaaaaaacaaccacccaccgacacccccaccccagtctcctcgccttctcccacccaccccacgc

SEQ ID NO: 152512 - DNA, 75 bp, Artificial Sequence
  Synthetic
cgtcggttacgttacagtggcccagttcgaacaccagctgcatgtagcggtcgtagtggggggtcagtaggtcca

SEQ ID NO: 152513 - DNA, 75 bp, Artificial Sequence
  Synthetic
cccagatcccccggccgccgagtcccaatgcaggcgcgcggccatggtgctgcacaggcacaacagctcccagac

SEQ ID NO: 152514 - DNA, 75 bp, Artificial Sequence
  Synthetic
caatgcaggcgcgcggccatggtgctgcacaggcacaacagctcccagacgggggttacgttcagggtggggggc

SEQ ID NO: 152515 - DNA, 75 bp, Artificial Sequence
  Synthetic
gcgtattggccccaatggggtctcggtggggtatcgacagagtgccagccctgggaccgaaccccgcgtttatga

SEQ ID NO: 152516 - DNA, 75 bp, Artificial Sequence
  Synthetic
tgacgttgatcgtggggatgacgcccgtggcgtagtggtcatagatccgccgaaatatggcgctgctgcgggtgg

SEQ ID NO: 152517 - DNA, 75 bp, Artificial Sequence
  Synthetic
cgtggcgtagtggtcatagatccgccgaaatatggcgctgctgcgggtggccatgggaacgcggagacaggcctc

SEQ ID NO: 152518 - DNA, 75 bp, Artificial Sequence
  Synthetic
cctgctctttccccgtgacacccgacgctgggggggcgtggctgccgggaggggccgcggatgggcggggcctac

SEQ ID NO: 152519 - DNA, 75 bp, Artificial Sequence
  Synthetic
cgccccgccggccttgcccccctttgatcccctgctacccccaacccgtgctcgtggtgcgggttgggtgggggg

SEQ ID NO: 152520 - DNA, 75 bp, Artificial Sequence
  Synthetic
gtgcgtcccatcaggctgttgaggttgcgcatgagcgcgacaatttccgccggcgcgacatcggaccggaggtat

SEQ ID NO: 152521 - DNA, 75 bp, Artificial Sequence
  Synthetic
tgcgcatgagcgcgacaatttccgccggcgcgacatcggaccggaggtatttttcgacgaaaagacccacctcct

SEQ ID NO: 152522 - DNA, 75 bp, Artificial Sequence
  Synthetic
ctcgtggtgcgggttgggtggggggggagtgtgggcgggggtgtgcgggaggtgtcggtggtggtggtggtggta

SEQ ID NO: 152523 - DNA, 75 bp, Artificial Sequence
  Synthetic
cgacgcctcgggatcccggcaccgcagctcccgtagatcgcgctgggccctgagggcgtcgaaatgtacgccccg

SEQ ID NO: 152524 - DNA, 75 bp, Artificial Sequence
  Synthetic
agctcccgtagatcgcgctgggccctgagggcgtcgaaatgtacgccccgcaaaaacagacagaagtcctttggg

SEQ ID NO: 152525 - DNA, 75 bp, Artificial Sequence
  Synthetic
cccccccccccgggcccgtgtccttgctttccccccgtctccccccccctccctcctcctccttctcctcctcct

SEQ ID NO: 152526 - DNA, 75 bp, Artificial Sequence
  Synthetic
agcgcacgcgtatgcagtttagggtcagcagcatgtgaaggatgttaaggctgtccgagagacacgccagcgtgc

SEQ ID NO: 152527 - DNA, 75 bp, Artificial Sequence
  Synthetic
cagcagcatgtgaaggatgttaaggctgtccgagagacacgccagcgtgcatctctcaaagtagtgtttgtaacg

SEQ ID NO: 152528 - DNA, 75 bp, Artificial Sequence
  Synthetic
cgccccagcgacgtgtcgcatgccgacgcgtcacagcgccccttgaaccggcgacacagcaggtttgtgacctgg

SEQ ID NO: 152529 - DNA, 75 bp, Artificial Sequence
  Synthetic
acgcgtcacagcgccccttgaaccggcgacacagcaggtttgtgacctgggagaactgcgcgggccactggccgc

SEQ ID NO: 152530 - DNA, 75 bp, Artificial Sequence
  Synthetic
catgggcgtaaagacgggctccgagcgcgccccggagccgtccatgtaaatcagtagctcccccttgcggagggt

SEQ ID NO: 152531 - DNA, 75 bp, Artificial Sequence
  Synthetic
cgcgccccggagccgtccatgtaaatcagtagctcccccttgcggagggtgcgcacccgtcccagggactggtac

SEQ ID NO: 152532 - DNA, 75 bp, Artificial Sequence
  Synthetic
tttttcgttccgtcgccggaatgtttcgttcgtctgtcccctcacggggcgaaggccgcgtacggcccgggacga

SEQ ID NO: 152533 - DNA, 75 bp, Artificial Sequence
  Synthetic
acaaacacaaacacccgcgacggggggacggagggagggggtgatgggggacggaaacagacacaaaaaacaacc

SEQ ID NO: 152534 - DNA, 75 bp, Artificial Sequence
  Synthetic
tcatgggttttacgtaggcgaacatgccatcaaagtgcaggggatcgaagctgaggcccacggttacgaccgtcg

SEQ ID NO: 152535 - DNA, 75 bp, Artificial Sequence
  Synthetic
gccatcaaagtgcaggggatcgaagctgaggcccacggttacgaccgtcgtgtatataaccacgcggtattggcc

SEQ ID NO: 152536 - DNA, 75 bp, Artificial Sequence
  Synthetic
gtgagcgagtgaagcaacagcacgcggtccgtaaactgacggcagaaccgggccacgatctccgcgaaggagacc

SEQ ID NO: 152537 - DNA, 75 bp, Artificial Sequence
  Synthetic
ggtccgtaaactgacggcagaaccgggccacgatctccgcgaaggagaccgtcgacgaaaaaatgcagatgttat

SEQ ID NO: 152538 - DNA, 75 bp, Artificial Sequence
  Synthetic
ctccccaaagaacgtggccccccgggcgtccggagaggcgtccggagacgggccgctcggcggcccgggcgggcg

SEQ ID NO: 152539 - DNA, 75 bp, Artificial Sequence
  Synthetic
gcgtccggagaggcgtccggagacgggccgctcggcggcccgggcgggcgcagggcagcctgcaggagctcggtc

SEQ ID NO: 152540 - DNA, 75 bp, Artificial Sequence
  Synthetic
ggcgcgccgaaaacccgggcatggcgtactcgccgaccaccacatgcacgtttttttcgccccggagaccgcaca

SEQ ID NO: 152541 - DNA, 75 bp, Artificial Sequence
  Synthetic
agccggcgcgcgcacacacaagcggcagaggcagaaaggccccgagtcattgttgtttatgtggccgcgggccag

SEQ ID NO: 152542 - DNA, 75 bp, Artificial Sequence
  Synthetic
tttttttcgccccggagaccgcacaggaagtccaccaactgcgcgttggcggttgcgtccatggcgatgatccga

SEQ ID NO: 152543 - DNA, 75 bp, Artificial Sequence
  Synthetic
ttaacgcatccacgcggcccagttgctgcatcgttggcgaatagagctggcccagcgtcgacataacctcgtcca

SEQ ID NO: 152544 - DNA, 75 bp, Artificial Sequence
  Synthetic
ctgcatcgttggcgaatagagctggcccagcgtcgacataacctcgtccagaacgaggacgtcgtagttgttcag

SEQ ID NO: 152545 - DNA, 75 bp, Artificial Sequence
  Synthetic
ctttccacctggacgataagtcggtggaaggggcggtcgttcataatgtaattggtggatgagaagtaggtgaca

SEQ ID NO: 152546 - DNA, 75 bp, Artificial Sequence
  Synthetic
ggaaggggcggtcgttcataatgtaattggtggatgagaagtaggtgacaaagtcgaccaggcctgactcagcga

SEQ ID NO: 152547 - DNA, 75 bp, Artificial Sequence
  Synthetic
actccgacgacaggagacgacgagcacactcgtgtccggagagtggatcgcttcccgcagccagcggatcagcgc

SEQ ID NO: 152548 - DNA, 75 bp, Artificial Sequence
  Synthetic
ggtagtttttcccgaccccattggcgcgcggaccacagtcacgcacctggccgtcggggcgctcgcgttggggaa

SEQ ID NO: 152549 - DNA, 75 bp, Artificial Sequence
  Synthetic
tcgatcgttgttttcgggtgaacccggggcacccattcggccaaatcccccccgtacaacatccgcgctagcgat

SEQ ID NO: 152550 - DNA, 75 bp, Artificial Sequence
  Synthetic
cccgtacaacatccgcgctagcgatacgctcgacgtgtactgttcgcactcgtcgtccccaatgggacgcccggc

SEQ ID NO: 152551 - DNA, 75 bp, Artificial Sequence
  Synthetic
caacggccggcccccgtggcggcccggcccggggccccggcggacccaaggggccccgggccggggccccacaac

SEQ ID NO: 152552 - DNA, 75 bp, Artificial Sequence
  Synthetic
ccccccacgaaaggcatgaccggggcgcggacggcgtggtgggtctggtgtgtgcaggtggcgacgtttgtggtc

SEQ ID NO: 152553 - DNA, 75 bp, Artificial Sequence
  Synthetic
cgcggacggcgtggtgggtctggtgtgtgcaggtggcgacgtttgtggtctctgcggtctgcgtcacggggctcc

SEQ ID NO: 152554 - DNA, 75 bp, Artificial Sequence
  Synthetic
acggtttccctgcttttacgccacggcgagctcttatgccggggtgaactccacggccgaggtgcgcgggggtgt

SEQ ID NO: 152555 - DNA, 75 bp, Artificial Sequence
  Synthetic
gcgagctcttatgccggggtgaactccacggccgaggtgcgcgggggtgtagccgtgcccctcaggttggacacg

SEQ ID NO: 152556 - DNA, 75 bp, Artificial Sequence
  Synthetic
ccccggtgtcgttcaacaaagacgccgcgtttccaggtaggttagacacctgcttctccccaatagagggggggg

SEQ ID NO: 152557 - DNA, 75 bp, Artificial Sequence
  Synthetic
ggatccggcgggagccacccgacaacagcccccgggttttcccacgccagacgccggtccgctgtgccatcgcgc

SEQ ID NO: 152558 - DNA, 75 bp, Artificial Sequence
  Synthetic
tcacggccgtgttgttgttggccgcggccgtgtatgccgtggtcggcgccgtgacctcccgctacgaccgcgccc

SEQ ID NO: 152559 - DNA, 75 bp, Artificial Sequence
  Synthetic
ggcccgcatggccatgccgcacgccacgctgatcgccggaaacgtctgctcttggttgctgcagatcaccgtcct

SEQ ID NO: 152560 - DNA, 75 bp, Artificial Sequence
  Synthetic
ctggcccacctggtttacgtcctgcactttgcgtgtctggtgtattttgcggcccatttttgcaccaggggggtc

SEQ ID NO: 152561 - DNA, 75 bp, Artificial Sequence
  Synthetic
ggcccatttttgcaccaggggggtcctgagcgggacgtatctgcgtcaggtgcacggcctgatggagccggcccc

SEQ ID NO: 152562 - DNA, 75 bp, Artificial Sequence
  Synthetic
gctcgagccgtgctgacaaacgccttgctgttgggcgtcttcctgtgcacggccgacgccgcggtatccctgaat

SEQ ID NO: 152563 - DNA, 75 bp, Artificial Sequence
  Synthetic
ggccgacgccgcggtatccctgaataccatcgccgcgttcaactttaatttttcggccccgggcatgctcatatg

SEQ ID NO: 152564 - DNA, 75 bp, Artificial Sequence
  Synthetic
gtcgtatcgctgttgttggtggtcgagggggtgttgtgtcactacgtgcgcgtgttggtgggcccccacctgggg

SEQ ID NO: 152565 - DNA, 75 bp, Artificial Sequence
  Synthetic
tccgcgtcgccctcgccctggtcgccgcctttgccctcggcatggccgtgctccgctgcacccgcgcctatctgt

SEQ ID NO: 152566 - DNA, 75 bp, Artificial Sequence
  Synthetic
cgcctttgccctcggcatggccgtgctccgctgcacccgcgcctatctgtatcacaggcggcaccacaccaaatt

SEQ ID NO: 152567 - DNA, 75 bp, Artificial Sequence
  Synthetic
cctcggacgcaccgccgcctcctgctcgacagaggcggcggaggggagcggggcggcgccggagggggcggcgcc

SEQ ID NO: 152568 - DNA, 75 bp, Artificial Sequence
  Synthetic
caccgcgcacattccgccctcaagcgcgtacgcagttccatgcgcggatcgcgagacggccgccacaggcccgca

SEQ ID NO: 152569 - DNA, 75 bp, Artificial Sequence
  Synthetic
gcgtacgcagttccatgcgcggatcgcgagacggccgccacaggcccgcacccggcagcccgcccgggattcccg

SEQ ID NO: 152570 - DNA, 75 bp, Artificial Sequence
  Synthetic
acccccccgccctttgtggcggccagaggccaggtcagtccgggcgggcaggcgctcgcggaaacttaacaccca

SEQ ID NO: 152571 - DNA, 75 bp, Artificial Sequence
  Synthetic
ctcatacggcggccagctcgaccggtacggagattccgacggggagccgatttacgacgaggtggcggacgacca

SEQ ID NO: 152572 - DNA, 75 bp, Artificial Sequence
  Synthetic
tacggagattccgacggggagccgatttacgacgaggtggcggacgaccaaaccgacgtattgtacgccaagata

SEQ ID NO: 152573 - DNA, 75 bp, Artificial Sequence
  Synthetic
acgagcccatctatgacaccgttggggggtacgaccccgagcccgccgaggaccccgtgtacagcaccgtccgcc

SEQ ID NO: 152574 - DNA, 75 bp, Artificial Sequence
  Synthetic
gtccgatcccgttactatcaccgttccccccaaaccccggcgattgtgggtttttttaaaaacgacacgcgtgcg

SEQ ID NO: 152575 - DNA, 75 bp, Artificial Sequence
  Synthetic
gctgttggtggtggtgttggtgttactgctgccgtgtggcccgatgggcgccgaggggggcgctgtccgagccgc

SEQ ID NO: 152576 - DNA, 75 bp, Artificial Sequence
  Synthetic
cccgtgtctttcactttccccctccccgacacggattggctggtgtagtgggcgcggccagagaccacccagcgc

SEQ ID NO: 152577 - DNA, 75 bp, Artificial Sequence
  Synthetic
taaccccgcgcatatccgggggcacgtagaaattaccttcctcttcggactcgatatccacgacgtcaaagtcgt

SEQ ID NO: 152578 - DNA, 75 bp, Artificial Sequence
  Synthetic
tgcttcgctgtatggccttatagatctccggatcgatgcggacgggggtaatgatcagggcgatcggaacggcct

SEQ ID NO: 152579 - DNA, 75 bp, Artificial Sequence
  Synthetic
ctccggatcgatgcggacgggggtaatgatcagggcgatcggaacggcctggttcgggagaatggacgccttgct

SEQ ID NO: 152580 - DNA, 75 bp, Artificial Sequence
  Synthetic
gcgccgtcctccaggcggaacgttacgccctcctccgcgctagtgcggtgcctgccgataaacgtcaccagatgc

SEQ ID NO: 152581 - DNA, 75 bp, Artificial Sequence
  Synthetic
cctgccgataaacgtcaccagatgcgggtggggggggcagtcggggaagtggctgtcgagcacgtagccctgcac

SEQ ID NO: 152582 - DNA, 75 bp, Artificial Sequence
  Synthetic
cgggggttcgcgaagacgggctcgcggcgtaccagatccccggagctccaggacacgggggagatggtgtggcgt

SEQ ID NO: 152583 - DNA, 75 bp, Artificial Sequence
  Synthetic
ggcgtaccagatccccggagctccaggacacgggggagatggtgtggcgtccgaggtcgggggcgccaaacagaa

SEQ ID NO: 152584 - DNA, 75 bp, Artificial Sequence
  Synthetic
taactccaccaaggcccgatccgcggcggagcaccgccttttttcgcccgaggcgtgggcctctgaccaggcctg

SEQ ID NO: 152585 - DNA, 75 bp, Artificial Sequence
  Synthetic
gcggagcaccgccttttttcgcccgaggcgtgggcctctgaccaggcctggtcttgcgtgacgagagcctcctcc

SEQ ID NO: 152586 - DNA, 75 bp, Artificial Sequence
  Synthetic
agtatcgcacgctgggcttcgggatcgaccggataaatgcccggaacgcctccggggaccggtgtgccatcaagt

SEQ ID NO: 152587 - DNA, 75 bp, Artificial Sequence
  Synthetic
cctcgtacgcggaggccgtggggtcgctggggtccatggggtcgaaagcgtacttggcccggcatttgacctcgt

SEQ ID NO: 152588 - DNA, 75 bp, Artificial Sequence
  Synthetic
tctcggtcgcagggaaacacccagacatccggggcgggctaaggggaaaaaaggggggcgggtaagaatgggggg

SEQ ID NO: 152589 - DNA, 75 bp, Artificial Sequence
  Synthetic
tggggccaagtagccgtgaatgtcccgaggacagacgagaatatccagggacgccccgaccatccccgtgtgacc

SEQ ID NO: 152590 - DNA, 75 bp, Artificial Sequence
  Synthetic
cgaggacagacgagaatatccagggacgccccgaccatccccgtgtgaccgtccatgaggaccccacacgtatgc

SEQ ID NO: 152591 - DNA, 75 bp, Artificial Sequence
  Synthetic
gttcgtggaagataaagcgccgcgtgtcggcgccggcctcgccgccgtcgtccgcgcggcccacgcagtagcgaa

SEQ ID NO: 152592 - DNA, 75 bp, Artificial Sequence
  Synthetic
gtcggcgccggcctcgccgccgtcgtccgcgcggcccacgcagtagcgaaacagcaggcttcgggccgtcggctc

SEQ ID NO: 152593 - DNA, 75 bp, Artificial Sequence
  Synthetic
ccggggcgcgggggccgggccccggaggcggcgctcgcacgcacggggccacggccgcgcgggggcgcgcggggc

SEQ ID NO: 152594 - DNA, 75 bp, Artificial Sequence
  Synthetic
gaagactgtacatccggccgcaggctggcgttgtgcttcagccactggggcgagaaacacggaccctgggggccc

SEQ ID NO: 152595 - DNA, 75 bp, Artificial Sequence
  Synthetic
tggcgttgtgcttcagccactggggcgagaaacacggaccctgggggccccagcggagggtggatgcggtcgtga

SEQ ID NO: 152596 - DNA, 75 bp, Artificial Sequence
  Synthetic
ctggcagtcggcctggttttgcgtggccgcctcgtaaaaccccatgaggggccggggcgccacggcgtccgcggc

SEQ ID NO: 152597 - DNA, 75 bp, Artificial Sequence
  Synthetic
aggggggcgggtctgttgacaagggggcccgtccggcccctcggccgccccgcctccgcttcaacaaccccaacc

SEQ ID NO: 152598 - DNA, 75 bp, Artificial Sequence
  Synthetic
cgccataggtgccggccgagtccgcggtccaccatacccgcctcctcgaggaccacggccagggaacacagataa

SEQ ID NO: 152599 - DNA, 75 bp, Artificial Sequence
  Synthetic
ggtccaccatacccgcctcctcgaggaccacggccagggaacacagataatccaggcgggcccagaggggaccga

SEQ ID NO: 152600 - DNA, 75 bp, Artificial Sequence
  Synthetic
gaccacggccagggaacacagataatccaggcgggcccagaggggaccgatggccagaggggcgcggacgccgcg

SEQ ID NO: 152601 - DNA, 75 bp, Artificial Sequence
  Synthetic
aacgtctcggctagtatatgggagggcagcgcgttggggatcaccgacgccgaccacatagagtcaaggtccggg

SEQ ID NO: 152602 - DNA, 75 bp, Artificial Sequence
  Synthetic
cataccgcccggctcgatcgctgccgcgccgcagggtgaccggtgcccaatcgtccgtcagcgcggggtcgcctc

SEQ ID NO: 152603 - DNA, 75 bp, Artificial Sequence
  Synthetic
cgaccacatagagtcaaggtccggggagtcgggatcggcgtccgggtcgcgggcgtgggtgcccccaggagatag

SEQ ID NO: 152604 - DNA, 75 bp, Artificial Sequence
  Synthetic
gtacgtagtctgctgcaagagacaacggggggcgcgatcaggttacgcccccctccccggcccgccctttcctcg

SEQ ID NO: 152605 - DNA, 75 bp, Artificial Sequence
  Synthetic
gaggcgtcagaaagtgccggcgacgcggcccggggcttttcgtctgcggtgtcggtggcgtgctgatcacgtggg

SEQ ID NO: 152606 - DNA, 75 bp, Artificial Sequence
  Synthetic
cggcccggggcttttcgtctgcggtgtcggtggcgtgctgatcacgtggggggttaacgggcgaatgggagctcg

SEQ ID NO: 152607 - DNA, 75 bp, Artificial Sequence
  Synthetic
tggggggggcaggggacggaaggtggttgttagcggaagactgttagggcgggggcgcttgggggggctgtcggg

SEQ ID NO: 152608 - DNA, 75 bp, Artificial Sequence
  Synthetic
cgtggactccatttccgagacgacgtggggggagcggtggttgagcgcgccgccgggtgaacgctgattctcacg

SEQ ID NO: 152609 - DNA, 75 bp, Artificial Sequence
  Synthetic
tggggggagcggtggttgagcgcgccgccgggtgaacgctgattctcacgacagcgcgtgccgcgcgcacgggtt

SEQ ID NO: 152610 - DNA, 75 bp, Artificial Sequence
  Synthetic
accaggagaggcttaagctcgggaggcagcgccaccgacgacagtatcgccttgtgtgtgtgctggtaatttata

SEQ ID NO: 152611 - DNA, 75 bp, Artificial Sequence
  Synthetic
gcagcgccaccgacgacagtatcgccttgtgtgtgtgctggtaatttatacaccgatccgtaaacgcgcgccgaa

SEQ ID NO: 152612 - DNA, 75 bp, Artificial Sequence
  Synthetic
gatgccctctgggacgtcatacgccaggccgtgggtgttggtctcggccgagttgacaaacagggctgggtgcag

SEQ ID NO: 152613 - DNA, 75 bp, Artificial Sequence
  Synthetic
tgttgaaatactggtaaccgggaaaccgggtcacgggtacgcccaggctcggggcgacgtacacgctaaccacca

SEQ ID NO: 152614 - DNA, 75 bp, Artificial Sequence
  Synthetic
tcggtcacagggaaacacccagacgtccggggcgggctgaggggaaaaaaggggggcgggtaagaatggggggtt

SEQ ID NO: 152615 - DNA, 75 bp, Artificial Sequence
  Synthetic
tcgtgcttcaggcggtggttggtaaattcggcccgttcgttgttaaggtatttcaccaacagctccgggggctgg

SEQ ID NO: 152616 - DNA, 75 bp, Artificial Sequence
  Synthetic
attcggcccgttcgttgttaaggtatttcaccaacagctccgggggctggttatacccgtgacccaccagggtgt

SEQ ID NO: 152617 - DNA, 75 bp, Artificial Sequence
  Synthetic
gggcatgccaaacatccggggggacttgaggtccggctcctggaggcaaaactgcccccgggcgatcgtggagtt

SEQ ID NO: 152618 - DNA, 75 bp, Artificial Sequence
  Synthetic
ttgaggtccggctcctggaggcaaaactgcccccgggcgatcgtggagttggagttgagggtgacgaggctaaag

SEQ ID NO: 152619 - DNA, 75 bp, Artificial Sequence
  Synthetic
caaataagacccattggtgtatgttctttttttattgggaggcgcgggtaggcgggtagctttacaatgcaaaag

SEQ ID NO: 152620 - DNA, 75 bp, Artificial Sequence
  Synthetic
agacggcgtccgaccgcagcatgacgaggatgttggcgcacttgatatccaggtggctgatcccgcaggtggtgt

SEQ ID NO: 152621 - DNA, 75 bp, Artificial Sequence
  Synthetic
gaggatgttggcgcacttgatatccaggtggctgatcccgcaggtggtgtttaaaaacacaacggcgcgggccag

SEQ ID NO: 152622 - DNA, 75 bp, Artificial Sequence
  Synthetic
gtcgagaccgaggggtttgttgtgcgcagggacgccagttggccgatatacttaccgaggtccatgtcgtacgcg

SEQ ID NO: 152623 - DNA, 75 bp, Artificial Sequence
  Synthetic
gcagggacgccagttggccgatatacttaccgaggtccatgtcgtacgcggggaacactatctgtcgttgttgca

SEQ ID NO: 152624 - DNA, 75 bp, Artificial Sequence
  Synthetic
tcttcccacacacacaaaaggcgtaccaaacaaacaaaccaaaagatgcacatgcggtttaacacccgtggtttt

SEQ ID NO: 152625 - DNA, 75 bp, Artificial Sequence
  Synthetic
cctgcgtctgagtcaaaggggccatgtgtatgtggtggggggggtctgtatatataaagtcagggggggtcacat

SEQ ID NO: 152626 - DNA, 75 bp, Artificial Sequence
  Synthetic
gccgcggatgttgtgggtgcggccggcgcgtagagcgcactccccgaccaacagggtcgcgatgagctcaacggc

SEQ ID NO: 152627 - DNA, 75 bp, Artificial Sequence
  Synthetic
gcgcgtagagcgcactccccgaccaacagggtcgcgatgagctcaacggcaaaccactccttttcctttatggtc

SEQ ID NO: 152628 - DNA, 75 bp, Artificial Sequence
  Synthetic
tcagttggacgtcgccgtatcccccagaccccccgaagcttcgggccccggggatctcgagggtcgtgtagtgta

SEQ ID NO: 152629 - DNA, 75 bp, Artificial Sequence
  Synthetic
gggatctcgagggtcgtgtagtgtagggcggggttgatggcgaacacggggctgcatagcttgcggatgcgcgtg

SEQ ID NO: 152630 - DNA, 75 bp, Artificial Sequence
  Synthetic
aggggggtgcggttaacgccgcctgggatctgcgcaggggcgggcggttcagtttggccgccgtaccgggcgtct

SEQ ID NO: 152631 - DNA, 75 bp, Artificial Sequence
  Synthetic
gtaggatgcgagccaatccttgaaggactgttggcgtgcaccttgggggctgaggttagctgccacatgaccagc

SEQ ID NO: 152632 - DNA, 75 bp, Artificial Sequence
  Synthetic
gactgttggcgtgcaccttgggggctgaggttagctgccacatgaccagcaggtcgctgtctgcgggactcatcc

SEQ ID NO: 152633 - DNA, 75 bp, Artificial Sequence
  Synthetic
ccacagagaagcgttggtcgctgcttcctcgagttgctcctcctggtccgcaagacgatcgtccacggcgtccag

SEQ ID NO: 152634 - DNA, 75 bp, Artificial Sequence
  Synthetic
tcctcgagttgctcctcctggtccgcaagacgatcgtccacggcgtccaggcgctcaccaagcgccggatcgagg

SEQ ID NO: 152635 - DNA, 75 bp, Artificial Sequence
  Synthetic
cacgacgcgccgcttgctcctccacgcgaattttaacacaggtcgcgcgctgtcgcatcatctctaagcgcgcgc

SEQ ID NO: 152636 - DNA, 75 bp, Artificial Sequence
  Synthetic
gcgaattttaacacaggtcgcgcgctgtcgcatcatctctaagcgcgcgcgggactttagccgcgcctccaattc

SEQ ID NO: 152637 - DNA, 75 bp, Artificial Sequence
  Synthetic
aaggcgccaacaaaccgaggatcttgggtgctgacgccctcccggtgcagctgcagggtctggtccttgtaaatc

SEQ ID NO: 152638 - DNA, 75 bp, Artificial Sequence
  Synthetic
tcggctcggaggtgcgtctcggccaggcgtcggcgcagggccgcgtgggcggcatctcggtccattccgccaccc

SEQ ID NO: 152639 - DNA, 75 bp, Artificial Sequence
  Synthetic
aattaccataccgggaagcggaacaaggcctcttgcaagtttttaattaccataccgggaagtgggcggcccggc

SEQ ID NO: 152640 - DNA, 75 bp, Artificial Sequence
  Synthetic
atagtctcgcgtgcccaaggcccgtgatcggggtacttcgccgccgcgacccgccacccggtgtgcgcgatgttt

SEQ ID NO: 152641 - DNA, 75 bp, Artificial Sequence
  Synthetic
tgggccgggccccgacgactcggcggacgctggttggccgggccccgccgcgctggcggccgccgattggccagt

SEQ ID NO: 152642 - DNA, 75 bp, Artificial Sequence
  Synthetic
gatcggggtacttcgccgccgcgacccgccacccggtgtgcgcgatgtttggtcagcagctggcgtccgacgtcc

SEQ ID NO: 152643 - DNA, 75 bp, Artificial Sequence
  Synthetic
acagaggcaacttaaggtgggcgcggacgaggcgtcggcgggcctcacaatgggcggcgatgccctacgagtgcc

SEQ ID NO: 152644 - DNA, 75 bp, Artificial Sequence
  Synthetic
gacgaggcgtcggcgggcctcacaatgggcggcgatgccctacgagtgccctttttagatttcgcgaccgcgacc

SEQ ID NO: 152645 - DNA, 75 bp, Artificial Sequence
  Synthetic
cgggcgtcgggacgctccacgactgctgcgagcactcgccgctcttctcggccgtggcgcggcggctgctgttta

SEQ ID NO: 152646 - DNA, 75 bp, Artificial Sequence
  Synthetic
ctgcgagcactcgccgctcttctcggccgtggcgcggcggctgctgtttaatagcctggtgccggcgcaactaaa

SEQ ID NO: 152647 - DNA, 75 bp, Artificial Sequence
  Synthetic
ggagtcccggcctgggttttatggggcccggccctcggaatcgcggcttgtcggcggggacaaagggggcggggc

SEQ ID NO: 152648 - DNA, 75 bp, Artificial Sequence
  Synthetic
acggccaagctggaattcctggcccccgagttggtacgggcggtggcgcgactgcggtttaaggagtgcgcgccg

SEQ ID NO: 152649 - DNA, 75 bp, Artificial Sequence
  Synthetic
accaggtggcgcacccggacgtggggcgagaagcgcacccgcgcgggggtcgcgggggtcgcgggggtcgcgggg

SEQ ID NO: 152650 - DNA, 75 bp, Artificial Sequence
  Synthetic
ccgagttggtacgggcggtggcgcgactgcggtttaaggagtgcgcgccggcggacgtggtgcctcagcgtaacg

SEQ ID NO: 152651 - DNA, 75 bp, Artificial Sequence
  Synthetic
tcaggccctccaccgctccgaagcctttcgccagctggtgcactttgtgcgggactttgcccagctgcttaaaac

SEQ ID NO: 152652 - DNA, 75 bp, Artificial Sequence
  Synthetic
tttcgccagctggtgcactttgtgcgggactttgcccagctgcttaaaacctccttccgggcctccagcctcacg

SEQ ID NO: 152653 - DNA, 75 bp, Artificial Sequence
  Synthetic
gggccaaggtggacgtggccacccacggccggacgtacggcacgctggagctgttccaaaaaatgatccttatgc

SEQ ID NO: 152654 - DNA, 75 bp, Artificial Sequence
  Synthetic
cggccggacgtacggcacgctggagctgttccaaaaaatgatccttatgcacgccacctactttctggccgccgt

SEQ ID NO: 152655 - DNA, 75 bp, Artificial Sequence
  Synthetic
gtcaacacgttcctgcgtctcgtgtttgagatccccctgtttagcgacgcggccgtgcgccacttccgccagcgc

SEQ ID NO: 152656 - DNA, 75 bp, Artificial Sequence
  Synthetic
ttgagatccccctgtttagcgacgcggccgtgcgccacttccgccagcgcgccaccgtgtttctcgtcccccggc

SEQ ID NO: 152657 - DNA, 75 bp, Artificial Sequence
  Synthetic
gcccctcatcgcgctgtcgctggcctcctttcgggggatcaagatcggctacacggcgcacatccgcaaggcgac

SEQ ID NO: 152658 - DNA, 75 bp, Artificial Sequence
  Synthetic
tcctttcgggggatcaagatcggctacacggcgcacatccgcaaggcgaccgagccggtgtttgaggagatcgac

SEQ ID NO: 152659 - DNA, 75 bp, Artificial Sequence
  Synthetic
cggcccgagtggaccacgttaaaggggaaaccatctccttctcgtttccggacgggtcgcgcagtaccatcgtgt

SEQ ID NO: 152660 - DNA, 75 bp, Artificial Sequence
  Synthetic
ttgcctccagccacaacacaaacgtaagtcctcttttctttcgcatggctctcccaaggggccccgggtcgaccc

SEQ ID NO: 152661 - DNA, 75 bp, Artificial Sequence
  Synthetic
gggggtgtgttttggggggggcccgttttcggggtctggccgctcctcccccccgctcctcccccccgctcctcc

SEQ ID NO: 152662 - DNA, 75 bp, Artificial Sequence
  Synthetic
atacacacacaaccagacgcgggaggaaagtctgccccgtgggcactgatttttattcgggatcgcttgaggagg

SEQ ID NO: 152663 - DNA, 75 bp, Artificial Sequence
  Synthetic
gaaagtctgccccgtgggcactgatttttattcgggatcgcttgaggaggcccgggcaacggcccgggcaacggt

SEQ ID NO: 152664 - DNA, 75 bp, Artificial Sequence
  Synthetic
cccgccgcgcgcgcgcacgccgcccggaccgccgcccgccttttttgcgcgcgcgcgcgcccgcggggggcccgg

SEQ ID NO: 152665 - DNA, 75 bp, Artificial Sequence
  Synthetic
ctgatgtacgaagagaagacacacaggcgccacccggcgctggtcggggggatgttgtccgcgccgcaccgtccc

SEQ ID NO: 152666 - DNA, 75 bp, Artificial Sequence
  Synthetic
ggcgccacccggcgctggtcggggggatgttgtccgcgccgcaccgtcccccgacgacctcttgcagacggtccg

SEQ ID NO: 152667 - DNA, 75 bp, Artificial Sequence
  Synthetic
cgtccacacgtcatccaccacacctgcccaacaacacaactcacagcgacaactcctgttcctcctgttcctcat

SEQ ID NO: 152668 - DNA, 75 bp, Artificial Sequence
  Synthetic
cagcagggtgaccgtatccacgggatggccaaagagaagcggacacaggctagcatccccctggaccgccagggt

SEQ ID NO: 152669 - DNA, 75 bp, Artificial Sequence
  Synthetic
tggccaaagagaagcggacacaggctagcatccccctggaccgccagggtacactgggccatcttggcccacaga

SEQ ID NO: 152670 - DNA, 75 bp, Artificial Sequence
  Synthetic
ccgttacgacggaggagagccacagtgcgttggcggaatcgatgtggggcggcggggcgcaggactcgcagcccc

SEQ ID NO: 152671 - DNA, 75 bp, Artificial Sequence
  Synthetic
tgcgttggcggaatcgatgtggggcggcggggcgcaggactcgcagccccccgggtggttggtgatcctggccag

SEQ ID NO: 152672 - DNA, 75 bp, Artificial Sequence
  Synthetic
cttcccggtggacagagcgaccccaggtcgctgtccatggcccagcagtagatctggccgctggggaggtgccac

SEQ ID NO: 152673 - DNA, 75 bp, Artificial Sequence
  Synthetic
ggtcgctgtccatggcccagcagtagatctggccgctggggaggtgccaccaggcccccgggcccaaggcgcaac

SEQ ID NO: 152674 - DNA, 75 bp, Artificial Sequence
  Synthetic
ccctcccgcccctcgccccctcccgcccctcgaataaacaacgctactgcaaaacttaatcaggtcgttgccgtt

SEQ ID NO: 152675 - DNA, 75 bp, Artificial Sequence
  Synthetic
cgcggggaccagatacgcgccatccagctcgccgaccactggctcctccgcgagctgttcggtggttgggtcggg

SEQ ID NO: 152676 - DNA, 75 bp, Artificial Sequence
  Synthetic
agctcgccgaccactggctcctccgcgagctgttcggtggttgggtcgggggtttcctccgggggggtggccgcc

SEQ ID NO: 152677 - DNA, 75 bp, Artificial Sequence
  Synthetic
acaggagcggggtcagggggtgcgtcacgctccggaggtggacgatcgcgcagtagcggcgctcgcggttaaaga

SEQ ID NO: 152678 - DNA, 75 bp, Artificial Sequence
  Synthetic
cacgctccggaggtggacgatcgcgcagtagcggcgctcgcggttaaagaaaaagagggcaaagaaggtgttcgg

SEQ ID NO: 152679 - DNA, 75 bp, Artificial Sequence
  Synthetic
gtcagatacagaaaaatctcgcagaagagggcgcgcccggggtctgggttaggaagggccacctgacacagaggc

SEQ ID NO: 152680 - DNA, 75 bp, Artificial Sequence
  Synthetic
agagggcgcgcccggggtctgggttaggaagggccacctgacacagaggctcggtgaggaccgttagacaccgaa

SEQ ID NO: 152681 - DNA, 75 bp, Artificial Sequence
  Synthetic
aacgacgcgccacacaaagacggagttgacaatgcgcgcgatagagtcgacgtccgtccccaggtcgtcgactct

SEQ ID NO: 152682 - DNA, 75 bp, Artificial Sequence
  Synthetic
ttgacaatgcgcgcgatagagtcgacgtccgtccccaggtcgtcgactctgtcgcgcgtgccgcgagctccggcc

SEQ ID NO: 152683 - DNA, 75 bp, Artificial Sequence
  Synthetic
ccgggggaccaggcggcgccaggggccgccggggtcccagctgcgccatgccgggggcggggggagggcaaaccc

SEQ ID NO: 152684 - DNA, 75 bp, Artificial Sequence
  Synthetic
ccgccggggtcccagctgcgccatgccgggggcggggggagggcaaaccccagaggcgggggccaacggcgcggg

SEQ ID NO: 152685 - DNA, 75 bp, Artificial Sequence
  Synthetic
ggggaaggcgcccgctagcgagaacggccgttcccggacgacaccttgcgacaaaacctaaggacagcggcccgc

SEQ ID NO: 152686 - DNA, 75 bp, Artificial Sequence
  Synthetic
ggccgttcccggacgacaccttgcgacaaaacctaaggacagcggcccgcgcgacggggtccgagaggctaaggt

SEQ ID NO: 152687 - DNA, 75 bp, Artificial Sequence
  Synthetic
aaagccgccgggaaagacaactatgccacagaggcggcgattaaaccccaggcagaggtaggcgtagctttcccc

SEQ ID NO: 152688 - DNA, 75 bp, Artificial Sequence
  Synthetic
ccacagaggcggcgattaaaccccaggcagaggtaggcgtagctttccccgggcaggtattgctcgcagaccctg

SEQ ID NO: 152689 - DNA, 75 bp, Artificial Sequence
  Synthetic
ccatgaagcgacatttactctgctcgcgtttactgacgtcaccatccatcgccacggcgattggacgattgttaa

SEQ ID NO: 152690 - DNA, 75 bp, Artificial Sequence
  Synthetic
gcgtttactgacgtcaccatccatcgccacggcgattggacgattgttaagccgcagcgtgtctccgcttgtgct

SEQ ID NO: 152691 - DNA, 75 bp, Artificial Sequence
  Synthetic
tcggagtcggcaaagcgggccgggaggtcgtcgccgagcgggacgacccgccgcccccgaccgccccgtcccccc

SEQ ID NO: 152692 - DNA, 75 bp, Artificial Sequence
  Synthetic
ggtcgtcgccgagcgggacgacccgccgcccccgaccgccccgtccccccaggtgtgccaggacggccagggcat

SEQ ID NO: 152693 - DNA, 75 bp, Artificial Sequence
  Synthetic
ggcggtcccctcgacggcgcgcatcaggttctcgaggagaatggggaagcgcctggtcacctcccccagccacgc

SEQ ID NO: 152694 - DNA, 75 bp, Artificial Sequence
  Synthetic
aggttctcgaggagaatggggaagcgcctggtcacctcccccagccacgcgcgttggtcggggccaaagtcatag

SEQ ID NO: 152695 - DNA, 75 bp, Artificial Sequence
  Synthetic
cgccctgaagcgcggcccggatggcctggcccagggcccggaggcacgccagatgtatgcgcgcagtaaaggcga

SEQ ID NO: 152696 - DNA, 75 bp, Artificial Sequence
  Synthetic
ctggcccagggcccggaggcacgccagatgtatgcgcgcagtaaaggcgacctcggcggcgatgtcaaagggcgg

SEQ ID NO: 152697 - DNA, 75 bp, Artificial Sequence
  Synthetic
ggcacctcgagcgcgggaaagcggagcagcagctccgcctgcccagcgggagacagctggtgggggcgcacgacg

SEQ ID NO: 152698 - DNA, 75 bp, Artificial Sequence
  Synthetic
gcagcagctccgcctgcccagcgggagacagctggtgggggcgcacgacgcgttctgcggcgcaggcctcggtca

SEQ ID NO: 152699 - DNA, 75 bp, Artificial Sequence
  Synthetic
cagcggagggcgggcgcgtcgcccgccccacgccacggagttctcgtaggagacgacgacgaagcgctgcttggt

SEQ ID NO: 152700 - DNA, 75 bp, Artificial Sequence
  Synthetic
ccccacgccacggagttctcgtaggagacgacgacgaagcgctgcttggttccgtagtggtggcgcaggaccacg

SEQ ID NO: 152701 - DNA, 75 bp, Artificial Sequence
  Synthetic
agtccggccggtcgccgccggccagggcttcccatccgcgatccaaccactcgaccagcgaccgcggctttgcgg

SEQ ID NO: 152702 - DNA, 75 bp, Artificial Sequence
  Synthetic
cgccaacaccgcatctgcgtcagccgcccccatggcgcccccgctgacggcctggtgaaccagggcgccctggcg

SEQ ID NO: 152703 - DNA, 75 bp, Artificial Sequence
  Synthetic
gcccccatggcgcccccgctgacggcctggtgaaccagggcgccctggcggagccccgatgcaacgccacaggcc

SEQ ID NO: 152704 - DNA, 75 bp, Artificial Sequence
  Synthetic
ggtggcggcgggtgacgtcctgcactgcccgctgaaccaacgcgaggatctcctcgttctcctgcgcgatggaca

SEQ ID NO: 152705 - DNA, 75 bp, Artificial Sequence
  Synthetic
tgcccgctgaaccaacgcgaggatctcctcgttctcctgcgcgatggacacgtcctgggccgcggtcgtgtcgcc

SEQ ID NO: 152706 - DNA, 75 bp, Artificial Sequence
  Synthetic
ggggagatgggggggtcggacgccccgacgatgggcgggtctgcgggcgcccccgcgtggggccgggccaagggc

SEQ ID NO: 152707 - DNA, 75 bp, Artificial Sequence
  Synthetic
cgacgatgggcgggtctgcgggcgcccccgcgtggggccgggccaagggctgcggacgcggggacgcgctttccc

SEQ ID NO: 152708 - DNA, 75 bp, Artificial Sequence
  Synthetic
agcctccttcgcggccggcggggcggcggcgccaagcagagcgacgtagcggcacaaatgccgacagacgcgcat

SEQ ID NO: 152709 - DNA, 75 bp, Artificial Sequence
  Synthetic
gcggcgccaagcagagcgacgtagcggcacaaatgccgacagacgcgcatgatgcgcgtgctgtcggccgcgtag

SEQ ID NO: 152710 - DNA, 75 bp, Artificial Sequence
  Synthetic
cgtaactaaacagaatcacgcgggcacagctcgcccccgagccccacgcaaggcgcagcgccgccacggcgtacg

SEQ ID NO: 152711 - DNA, 75 bp, Artificial Sequence
  Synthetic
caccacgggcaaggagacgaacaaccccccggcgctggacgcacgcggaaggaggccagggtgtgccggcacgac

SEQ ID NO: 152712 - DNA, 75 bp, Artificial Sequence
  Synthetic
cccccggcgctggacgcacgcggaaggaggccagggtgtgccggcacgacgggggccagaagctcccccaccgca

SEQ ID NO: 152713 - DNA, 75 bp, Artificial Sequence
  Synthetic
atgtgggttgctcgtctgggacctcgggcatgcccatacacgcacaacacggacgccgcaccggatgggacgtcg

SEQ ID NO: 152714 - DNA, 75 bp, Artificial Sequence
  Synthetic
ggaggccagggtgtgccggcacgacgggggccagaagctcccccaccgcatccgcgggcacgtaggcggcaaacg

SEQ ID NO: 152715 - DNA, 75 bp, Artificial Sequence
  Synthetic
ggtggcatgagcccgagtctggatttcgacctggaagtttgcggccgtcccgagtccggggcggccgcgcatcag

SEQ ID NO: 152716 - DNA, 75 bp, Artificial Sequence
  Synthetic
acctcgttggccaagtgcgcgttcatggttcgggggtgggtgtgggtgtgtaggcgatgcgggtcccccgagtcc

SEQ ID NO: 152717 - DNA, 75 bp, Artificial Sequence
  Synthetic
taggcgatgcgggtcccccgagtccgcgggaagggcgcgggtttggcgcgcgtatgcgtattcgccaacggaggc

SEQ ID NO: 152718 - DNA, 75 bp, Artificial Sequence
  Synthetic
gcgggaagggcgcgggtttggcgcgcgtatgcgtattcgccaacggaggcgtgcgtgcttatgcgcggcgcgttt

SEQ ID NO: 152719 - DNA, 75 bp, Artificial Sequence
  Synthetic
caggactttaacctgctctttgtcgacgaggccaactttattcgcccggatgcggtccagacgattatgggcttt

SEQ ID NO: 152720 - DNA, 75 bp, Artificial Sequence
  Synthetic
acgaggccaactttattcgcccggatgcggtccagacgattatgggctttctcaaccaggccaactgcaagatta

SEQ ID NO: 152721 - DNA, 75 bp, Artificial Sequence
  Synthetic
gaaggccagtacgagctttttgtacaacctccgcggggccgccgacgagcttctcaacgtggtgacctatatatg

SEQ ID NO: 152722 - DNA, 75 bp, Artificial Sequence
  Synthetic
ttctcaacgtggtgacctatatatgcgatgatcacatgccgcgggtggtgacgcacacaaacgccacggcctgtt

SEQ ID NO: 152723 - DNA, 75 bp, Artificial Sequence
  Synthetic
cttgttatatcctcaacaagcccgttttcatcacgatggacggggcggttcgccggaccgccgatttgtttctgg

SEQ ID NO: 152724 - DNA, 75 bp, Artificial Sequence
  Synthetic
tttcatcacgatggacggggcggttcgccggaccgccgatttgtttctggccgattccttcatgcaggagatcat

SEQ ID NO: 152725 - DNA, 75 bp, Artificial Sequence
  Synthetic
gacgaccggcccgttctgaccaagtctgcgggggagcggtttctgttgtaccgcccctcgaccaccaccaacagc

SEQ ID NO: 152726 - DNA, 75 bp, Artificial Sequence
  Synthetic
ctgcgggggagcggtttctgttgtaccgcccctcgaccaccaccaacagcggcctcatggcccccgatttgtacg

SEQ ID NO: 152727 - DNA, 75 bp, Artificial Sequence
  Synthetic
caacacccgagcctccgggaccggcgtcgctgtcgtcgggcggtaccgcgacgattatatcatcttcgccctgga

SEQ ID NO: 152728 - DNA, 75 bp, Artificial Sequence
  Synthetic
gtcgctgtcgtcgggcggtaccgcgacgattatatcatcttcgccctggagcacttttttctccgcgcgctcacg

SEQ ID NO: 152729 - DNA, 75 bp, Artificial Sequence
  Synthetic
gctgcgtcgtccacagtctgacgcaggtcctggccctgcatcccggggcgtttcgcggcgtccgggtggcggtcg

SEQ ID NO: 152730 - DNA, 75 bp, Artificial Sequence
  Synthetic
ggtcctggccctgcatcccggggcgtttcgcggcgtccgggtggcggtcgagggaaatagcagccaggactcggc

SEQ ID NO: 152731 - DNA, 75 bp, Artificial Sequence
  Synthetic
acagagatgcaccgcctactggcctcggagggggccgacgcgggctcgggccccgagcttctcttctaccactgc

SEQ ID NO: 152732 - DNA, 75 bp, Artificial Sequence
  Synthetic
cggagggggccgacgcgggctcgggccccgagcttctcttctaccactgcgagcctcccgggagcgcggtgctgt

SEQ ID NO: 152733 - DNA, 75 bp, Artificial Sequence
  Synthetic
gaagacgcccgcctttgaacactttattaaaaagtttaactccgggggcgtcatggcctcccaggagatcgtttc

SEQ ID NO: 152734 - DNA, 75 bp, Artificial Sequence
  Synthetic
tcatggcctcccaggagatcgtttccgcgacggtgcgcctgcagaccgacccggtcgagtatctgctcgagcagc

SEQ ID NO: 152735 - DNA, 75 bp, Artificial Sequence
  Synthetic
ccccaacacggacgtccgtacgtattccggaaaacggaacggcgcctcggatgaccttatggtcgccgtcattat

SEQ ID NO: 152736 - DNA, 75 bp, Artificial Sequence
  Synthetic
ggacctccgcacacattcgctcccatcacacgcgtttcgtgagcgcccaataaacacacccaggtatgctacgca

SEQ ID NO: 152737 - DNA, 75 bp, Artificial Sequence
  Synthetic
ggggggaagggggtgttggcgggaagcgtgggaacacgggggattctctcacgaccggcaccagtaccacccccc

SEQ ID NO: 152738 - DNA, 75 bp, Artificial Sequence
  Synthetic
atcccataaacatacgacacacaggcatattttggaatttcttaggtttttatttatttaggtatgctggggttt

SEQ ID NO: 152739 - DNA, 75 bp, Artificial Sequence
  Synthetic
cccccgtgggtctagccgggccttagggatagcgtataacgggggccatgtctccggaccgcacaacggccgcgc

SEQ ID NO: 152740 - DNA, 75 bp, Artificial Sequence
  Synthetic
cgtcaaaggtgcacacccgaaccacgggagccagggccaaggtgtctcctagttggcccgcgtgggtcagccagg

SEQ ID NO: 152741 - DNA, 75 bp, Artificial Sequence
  Synthetic
ccttcgctctccatcctgcatcagggccggggcttcggggtgaatgagctgggcggcctcccgcgtgacactctg

SEQ ID NO: 152742 - DNA, 75 bp, Artificial Sequence
  Synthetic
gccggggcttcggggtgaatgagctgggcggcctcccgcgtgacactctgcatctgcaggagagcgttcacgtac

SEQ ID NO: 152743 - DNA, 75 bp, Artificial Sequence
  Synthetic
gccgggggattagcgtaaggatgatggtggttccctccgtgatcgagtaaaccatgttaaggaccagcgatcgca

SEQ ID NO: 152744 - DNA, 75 bp, Artificial Sequence
  Synthetic
ggtggttccctccgtgatcgagtaaaccatgttaaggaccagcgatcgcagctcggcgtttacggggccgagttg

SEQ ID NO: 152745 - DNA, 75 bp, Artificial Sequence
  Synthetic
cgactcccgttgtagtacagcacgttgaggtctggcagccctccggggtttctggggctggggttcaggtcccgg

SEQ ID NO: 152746 - DNA, 75 bp, Artificial Sequence
  Synthetic
tgaggtctggcagccctccggggtttctggggctggggttcaggtcccggatgcccctggccacgagccgcgcca

SEQ ID NO: 152747 - DNA, 75 bp, Artificial Sequence
  Synthetic
aagcggaacgggaaaccgcaacgtgaggtccagcgaatccaggcgcacgtccgtcgcttggccctcgaacacggg

SEQ ID NO: 152748 - DNA, 75 bp, Artificial Sequence
  Synthetic
aggtccagcgaatccaggcgcacgtccgtcgcttggccctcgaacacgggcgggacgaggctgatggggtccccg

SEQ ID NO: 152749 - DNA, 75 bp, Artificial Sequence
  Synthetic
tgcgaaggttaacggtgccggcgtgggtgaggcccacgtccagggggcaggcgacgattcgcgtgggaagcaccc

SEQ ID NO: 152750 - DNA, 75 bp, Artificial Sequence
  Synthetic
ggtgaggcccacgtccagggggcaggcgacgattcgcgtgggaagcacccgggtgatgaccgcggggaagcgcct

SEQ ID NO: 152751 - DNA, 75 bp, Artificial Sequence
  Synthetic
gtgtcgggactgacgcctccggagacgaaggattcgtgcgccacgtcggccagcgtcagttgccggcggatggtc

SEQ ID NO: 152752 - DNA, 75 bp, Artificial Sequence
  Synthetic
cgaaggattcgtgcgccacgtcggccagcgtcagttgccggcggatggtcggcaggaataccacccgcccttcgc

SEQ ID NO: 152753 - DNA, 75 bp, Artificial Sequence
  Synthetic
gggcggaggaggaggggggacgcgggggcggaggaggaggggggacgcgggggcggaggaggagggggacgcggg

SEQ ID NO: 152754 - DNA, 75 bp, Artificial Sequence
  Synthetic
gcgcgagatgcccgagggtatcgcgatgtcagtttcaaagccgtccgccagcatggcgccgatccacgcggcagg

SEQ ID NO: 152755 - DNA, 75 bp, Artificial Sequence
  Synthetic
atgtcagtttcaaagccgtccgccagcatggcgccgatccacgcggcagggagtgcagtggtggttcgggtggcg

SEQ ID NO: 152756 - DNA, 75 bp, Artificial Sequence
  Synthetic
cgtagcagagacgggcgaccaacctcgcataggacggggggtgggtcttagggggttgggaggcgacagggaccc

SEQ ID NO: 152757 - DNA, 75 bp, Artificial Sequence
  Synthetic
cgcataggacggggggtgggtcttagggggttgggaggcgacagggaccccagagcatgcgcggggaggtctgtc

SEQ ID NO: 152758 - DNA, 75 bp, Artificial Sequence
  Synthetic
gaccggcgggcggggtccgggcggcgaccgttgcgtggaccgcttccttcgcgtcggggggagccattgtggtcc

SEQ ID NO: 152759 - DNA, 75 bp, Artificial Sequence
  Synthetic
cagaagacgtgtgggataaaagaatcgcactaccccaaggaagggcggggcggtttattacagagccagtccctt

SEQ ID NO: 152760 - DNA, 75 bp, Artificial Sequence
  Synthetic
cgcactaccccaaggaagggcggggcggtttattacagagccagtcccttgagcggggatgcgtcatagacgaga

SEQ ID NO: 152761 - DNA, 75 bp, Artificial Sequence
  Synthetic
cgtgggcttccccgttgcgggcgctgcggaggagggcggggtcgctggcgcaggtgagcgggtaggcctcctgaa

SEQ ID NO: 152762 - DNA, 75 bp, Artificial Sequence
  Synthetic
gcggaggagggcggggtcgctggcgcaggtgagcgggtaggcctcctgaaacaggccacacgggtcctccacgag

SEQ ID NO: 152763 - DNA, 75 bp, Artificial Sequence
  Synthetic
aactgtacgtcgctggcggcggtggccgtggacaccgccgaacccgtctccacgatcaggcgctccaggcagcga

SEQ ID NO: 152764 - DNA, 75 bp, Artificial Sequence
  Synthetic
ccgtggacaccgccgaacccgtctccacgatcaggcgctccaggcagcgatgtttggcggcgatgtcggccgacg

SEQ ID NO: 152765 - DNA, 75 bp, Artificial Sequence
  Synthetic
acatgcccgggacccatgaagcatgcgcgacttccgggcctcagaacccacccgaaacggccaacggacgtctga

SEQ ID NO: 152766 - DNA, 75 bp, Artificial Sequence
  Synthetic
caccggcgaggccccgttgaggtggtaggccccgttatagagcaggtccccgtacgaaaatcgctgcgacgccca

SEQ ID NO: 152767 - DNA, 75 bp, Artificial Sequence
  Synthetic
taggccccgttatagagcaggtccccgtacgaaaatcgctgcgacgcccacgggttggccgtggccgcgaaggcc

SEQ ID NO: 152768 - DNA, 75 bp, Artificial Sequence
  Synthetic
cgtacatgagggcggtgacatccccctccttgtcccccgcgtaaacgcccccggcggcgcgtccccgggggttgc

SEQ ID NO: 152769 - DNA, 75 bp, Artificial Sequence
  Synthetic
ctgtcaatcggtccgcgaacggaggtaatcccggcacgacgacggacgcccgacaaggtatgtctcccgagcgtc

SEQ ID NO: 152770 - DNA, 75 bp, Artificial Sequence
  Synthetic
ctccttgtcccccgcgtaaacgcccccggcggcgcgtccccgggggttgcagggccggcggaagtagttgacgtc

SEQ ID NO: 152771 - DNA, 75 bp, Artificial Sequence
  Synthetic
tcacacacggcgtcctggccgtggtccatccctgcgcgccgcggcacctgggcgcacccgaacacggggacgggc

SEQ ID NO: 152772 - DNA, 75 bp, Artificial Sequence
  Synthetic
ccatccctgcgcgccgcggcacctgggcgcacccgaacacggggacgggctgggccggccccaggcggtttcccg

SEQ ID NO: 152773 - DNA, 75 bp, Artificial Sequence
  Synthetic
ggcaacgcggggtccctgcgagaggcacagatgcttacggtcaggtgctccgggtcgggtgcgtctggtatgcgg

SEQ ID NO: 152774 - DNA, 75 bp, Artificial Sequence
  Synthetic
ggctgccgcgttgtccagtagagggggagccccgcggcccaggtaaaagttttggggaaggttgcccatgtcggt

SEQ ID NO: 152775 - DNA, 75 bp, Artificial Sequence
  Synthetic
tttggggaaggttgcccatgtcggtgacggggttgcggacggttgccgtggccacgacggcggtgtagcccacgc

SEQ ID NO: 152776 - DNA, 75 bp, Artificial Sequence
  Synthetic
ttggtatatgtacactttacctgggggcgtgcctggccgccccagcccctcccacgccctgcgcgtcatcagccg

SEQ ID NO: 152777 - DNA, 75 bp, Artificial Sequence
  Synthetic
ggtgagcgtgaagtttacccccccgccagtttcatgccgggccacctggagctggcccaggaagtacgcctccga

SEQ ID NO: 152778 - DNA, 75 bp, Artificial Sequence
  Synthetic
aagtgagaacgcgaagcgttcgcactttgtcctaataatatatatattattaggacaaagtgcgaacgcttcgcg

SEQ ID NO: 152779 - DNA, 75 bp, Artificial Sequence
  Synthetic
gctggcccaggaagtacgcctccgacgcgcgctccgagaacagcacgttctcagtcacaaagcggtcctgtcgga

SEQ ID NO: 152780 - DNA, 75 bp, Artificial Sequence
  Synthetic
cgacggtgaacccaaacccgggatggaggcccgtcttgagctgatgatgcaaggccacgggactgatcttgaagt

SEQ ID NO: 152781 - DNA, 75 bp, Artificial Sequence
  Synthetic
gaggcccgtcttgagctgatgatgcaaggccacgggactgatcttgaagtaccccgccatgagcgcgtaggtcag

SEQ ID NO: 152782 - DNA, 75 bp, Artificial Sequence
  Synthetic
cggacgtgctgcacgacgggctgtcggatcgacgaaaagtagttggcccccagagccggggggaccagggggacc

SEQ ID NO: 152783 - DNA, 75 bp, Artificial Sequence
  Synthetic
tgccgcgacaggtcgcgcagggccggggggaaattgggcgcgttcgccacgtggtcggccccggcgaacagcgcg

SEQ ID NO: 152784 - DNA, 75 bp, Artificial Sequence
  Synthetic
cgccattttggatggtatggtccagatgctggggggccatcagcaggattccggcgtgcaacgccccgtcgaata

SEQ ID NO: 152785 - DNA, 75 bp, Artificial Sequence
  Synthetic
atgctggggggccatcagcaggattccggcgtgcaacgccccgtcgaatatgcgcatgttggtggtggacgcggt

SEQ ID NO: 152786 - DNA, 75 bp, Artificial Sequence
  Synthetic
gagcagagcagcgccgttgtgcgttcggccatgttgtgggccagcacctgcagcgtgagcatggcgggcccgtcc

SEQ ID NO: 152787 - DNA, 75 bp, Artificial Sequence
  Synthetic
tggcgttgaccgtgttggccaccagattggccgggtgcagggggtgcgcggggtccgtcacggggtcgctggggc

SEQ ID NO: 152788 - DNA, 75 bp, Artificial Sequence
  Synthetic
gaccaccatgttctgcagggtggcgtatacgcggtcgaagcgaacccccgcggtgcagcagcggccccgcgagaa

SEQ ID NO: 152789 - DNA, 75 bp, Artificial Sequence
  Synthetic
tatacgcggtcgaagcgaacccccgcggtgcagcagcggccccgcgagaaggcgggcaccatcacgtagtagtaa

SEQ ID NO: 152790 - DNA, 75 bp, Artificial Sequence
  Synthetic
ccccccggtgcggccggtcgtccgcggcgtccgcggctcgggcctgggtgttgtgcagcagctggccgtcgttgc

SEQ ID NO: 152791 - DNA, 75 bp, Artificial Sequence
  Synthetic
ggcgtccgcggctcgggcctgggtgttgtgcagcagctggccgtcgttgcggttgaagtccgcggtcgccacgtt

SEQ ID NO: 152792 - DNA, 75 bp, Artificial Sequence
  Synthetic
tggccccccgcgctaacccggcagtcgcgatggcggtccagggccgcgcgccgcatcagggcgtcgcagtcccac

SEQ ID NO: 152793 - DNA, 75 bp, Artificial Sequence
  Synthetic
cgcgatggcggtccagggccgcgcgccgcatcagggcgtcgcagtcccacacgaggggtggcagcagcgccgggt

SEQ ID NO: 152794 - DNA, 75 bp, Artificial Sequence
  Synthetic
ttgcgcctgcccgcccagttccgggccggtcagggtaaagtcatcaaccagctgggccagggcctcgacgtgcgc

SEQ ID NO: 152795 - DNA, 75 bp, Artificial Sequence
  Synthetic
ccggtcagggtaaagtcatcaaccagctgggccagggcctcgacgtgcgccaccaggtcccggtacacggccatg

SEQ ID NO: 152796 - DNA, 75 bp, Artificial Sequence
  Synthetic
ggtaggtcacgacgtacgagaccagcgagtagtcgttcacgaacgccgcgcaccgcgtgttgttccagtagctgg

SEQ ID NO: 152797 - DNA, 75 bp, Artificial Sequence
  Synthetic
cgagtagtcgttcacgaacgccgcgcaccgcgtgttgttccagtagctggtgatgcactggaccacgagccgggc

SEQ ID NO: 152798 - DNA, 75 bp, Artificial Sequence
  Synthetic
aaagccccaaagcgcatacgcctcccccacatccgggaagacgaccagccgtcctcgcaccagcccttgttttac

SEQ ID NO: 152799 - DNA, 75 bp, Artificial Sequence
  Synthetic
ccgtgtatggcggcctgcagcaggtaaaacaccgccgggtagttgcggtcttcgaacgccccgcgaacggcggcg

SEQ ID NO: 152800 - DNA, 75 bp, Artificial Sequence
  Synthetic
aaaacaccgccgggtagttgcggtcttcgaacgccccgcgaacggcggcgatggtggcgggggccatggcgtggc

SEQ ID NO: 152801 - DNA, 75 bp, Artificial Sequence
  Synthetic
ggcgtcccggaacgccgccggacatagcgccaggggcaagttgccgttcaccacgcgccaggtggcctggatctc

SEQ ID NO: 152802 - DNA, 75 bp, Artificial Sequence
  Synthetic
agcgccaggggcaagttgccgttcaccacgcgccaggtggcctggatctcccccgggccggccgggggaacgtcc

SEQ ID NO: 152803 - DNA, 75 bp, Artificial Sequence
  Synthetic
cccccacgaagaagtcgaacgcggggtgcagctcaagagccaggttggcgttgtcgggctgcataaactgctccg

SEQ ID NO: 152804 - DNA, 75 bp, Artificial Sequence
  Synthetic
gtgcagctcaagagccaggttggcgttgtcgggctgcataaactgctccggggtcatctggccttccgcgaccca

SEQ ID NO: 152805 - DNA, 75 bp, Artificial Sequence
  Synthetic
tgcccccaggcgttcaaaaacagctgctgcatgtctgcggcggggccggccggggccgccacgtacgccccgtac

SEQ ID NO: 152806 - DNA, 75 bp, Artificial Sequence
  Synthetic
gctgcatgtctgcggcggggccggccggggccgccacgtacgccccgtacggattggcggcttcgacggggtcgc

SEQ ID NO: 152807 - DNA, 75 bp, Artificial Sequence
  Synthetic
aacgttcatcagcgaagggtggcacacggtcccgatcgcgtgttccagagacaggcgcagcacctggcggtcctt

SEQ ID NO: 152808 - DNA, 75 bp, Artificial Sequence
  Synthetic
acggtcccgatcgcgtgttccagagacaggcgcagcacctggcggtccttcccccaaaaaaacagctggcggggc

SEQ ID NO: 152809 - DNA, 75 bp, Artificial Sequence
  Synthetic
cgggggcggggactaggtccccggcgtgcgcggcaaaccgttccatgaccggattgaacaggcccaggggcagga

SEQ ID NO: 152810 - DNA, 75 bp, Artificial Sequence
  Synthetic
cgaacgtcaggtccatggcgcccaccagggggtagggaacgttggtggcggcgtagatgcgcttctccagggcct

SEQ ID NO: 152811 - DNA, 75 bp, Artificial Sequence
  Synthetic
ggacaccagatccgcgcgcacgcgcgtcgtctggggggcgctctcgagctcgtccagcgtctgccggttcaggtc

SEQ ID NO: 152812 - DNA, 75 bp, Artificial Sequence
  Synthetic
gtcgtctggggggcgctctcgagctcgtccagcgtctgccggttcaggtcgagctgctcctcctgcatctccagc

SEQ ID NO: 152813 - DNA, 75 bp, Artificial Sequence
  Synthetic
ttcgcacggccttgcccatcacgagcgccgtgaccaggttggccccgttcaggaccatctcgccgtacgtcaccg

SEQ ID NO: 152814 - DNA, 75 bp, Artificial Sequence
  Synthetic
aggaccatctcgccgtacgtcaccggcacgtcggcttcggtgtcctccactttcaggaaggactgcaggaggcgc

SEQ ID NO: 152815 - DNA, 75 bp, Artificial Sequence
  Synthetic
gcaccccgtcgaccggacgcccgcgcgtgtcggcatgcgtcagacggggcacggccacggagggctgcgtggccg

SEQ ID NO: 152816 - DNA, 75 bp, Artificial Sequence
  Synthetic
cgtgtcggcatgcgtcagacggggcacggccacggagggctgcgtggccgtggtgaggtccacgagccaggcctc

SEQ ID NO: 152817 - DNA, 75 bp, Artificial Sequence
  Synthetic
ttgcccaggaaaaagctcgtctcgcagaagcttcgctttagctcggcgaccagggtcgcccgggccaccctggtg

SEQ ID NO: 152818 - DNA, 75 bp, Artificial Sequence
  Synthetic
agaagcttcgctttagctcggcgaccagggtcgcccgggccaccctggtggccaggcggccgttgtccaggtatc

SEQ ID NO: 152819 - DNA, 75 bp, Artificial Sequence
  Synthetic
gggcggcgccttttccagcagcacgtgcagcatctggtcggccgtgccgcgctcaaacgccccgaggacggcctg

SEQ ID NO: 152820 - DNA, 75 bp, Artificial Sequence
  Synthetic
tgcagcatctggtcggccgtgccgcgctcaaacgccccgaggacggcctggacgttgcgagcgagctgttggatg

SEQ ID NO: 152821 - DNA, 75 bp, Artificial Sequence
  Synthetic
tacccgtcccgtccagggcctcccccgtgagcagggcgatggcctcggtggccaggctgaaggcggcgttcaggg

SEQ ID NO: 152822 - DNA, 75 bp, Artificial Sequence
  Synthetic
cgtgagcagggcgatggcctcggtggccaggctgaaggcggcgttcagggcccggcggtcgataatcttggtcat

SEQ ID NO: 152823 - DNA, 75 bp, Artificial Sequence
  Synthetic
gggtgcgggccgtcgcgggcaatcagcggctggtggacctcgaactgtacgcgcccctcgttcatgtaggccagc

SEQ ID NO: 152824 - DNA, 75 bp, Artificial Sequence
  Synthetic
ccaccgacaacccgagctccagaaagcgcacgagcgacagggtgttgcaatacgaccccaacagggcgtcgaact

SEQ ID NO: 152825 - DNA, 75 bp, Artificial Sequence
  Synthetic
ggagcgcacgcgggaaaaaaaatcgaacaggcgtcgatgcgacgccacctcgatcgtgctaaggagggacccggt

SEQ ID NO: 152826 - DNA, 75 bp, Artificial Sequence
  Synthetic
aacaggcgtcgatgcgacgccacctcgatcgtgctaaggagggacccggtcggcaccatggccgcggcataccgg

SEQ ID NO: 152827 - DNA, 75 bp, Artificial Sequence
  Synthetic
cggccatggggtcgcgtggagatcggctgtctctagcgatattggcccggggaggctaagatccaccccaacgcc

SEQ ID NO: 152828 - DNA, 75 bp, Artificial Sequence
  Synthetic
ggaggctaagatccaccccaacgcccggccacccgtgtacgtgcccgacggcccaaggtccaccgaaagacacga

SEQ ID NO: 152829 - DNA, 75 bp, Artificial Sequence
  Synthetic
aggaggaggaagaggaggagggggccggggatggcgaacatcttgaggggggagatgggacccgtgacaccctac

SEQ ID NO: 152830 - DNA, 75 bp, Artificial Sequence
  Synthetic
gatgctgtgtgagaggccgggtgtcggtcgggggggaaaggcaccgggagaaggctgcggcctcgttccaggaga

SEQ ID NO: 152831 - DNA, 75 bp, Artificial Sequence
  Synthetic
ggtcgggggggaaaggcaccgggagaaggctgcggcctcgttccaggagaacccagtgtccccaacagacccggg

SEQ ID NO: 152832 - DNA, 75 bp, Artificial Sequence
  Synthetic
cggaaactgcctccaccgggcccacgatcaccgcgggagcggtaatgaacgcgagcgaggcccccacatcggggt

SEQ ID NO: 152833 - DNA, 75 bp, Artificial Sequence
  Synthetic
ccccccccgccccacccccgttagaacgcgacgggtgcattcaagatggccctggtccaaaagcgtgccaggaag

SEQ ID NO: 152834 - DNA, 75 bp, Artificial Sequence
  Synthetic
cctggtccaaaagcgtgccaggaagaaattggcagaggcggcaaagctgtccgccgccgccacccacatcgaggc

SEQ ID NO: 152835 - DNA, 75 bp, Artificial Sequence
  Synthetic
gcccgtgtgcgcaggggatcggtgggcggcagcatttggttggtggcgataaagtggaaaagcccgtccggactg

SEQ ID NO: 152836 - DNA, 75 bp, Artificial Sequence
  Synthetic
gcggcagcatttggttggtggcgataaagtggaaaagcccgtccggactgaaggtctcgtgggcggcggcgaaca

SEQ ID NO: 152837 - DNA, 75 bp, Artificial Sequence
  Synthetic
aaacacggacatcccccaaaacacgggcgccgacaacggcagacgatccctcttgatgttaacgtacaggaggag

SEQ ID NO: 152838 - DNA, 75 bp, Artificial Sequence
  Synthetic
ggcgccgacaacggcagacgatccctcttgatgttaacgtacaggaggagcgcccgcaccgcccacgtaacgtag

SEQ ID NO: 152839 - DNA, 75 bp, Artificial Sequence
  Synthetic
aggccggcgccaccacccttccggtcagcccgtaatacatgcccgctgccaccatctccaacggcttcaggacca

SEQ ID NO: 152840 - DNA, 75 bp, Artificial Sequence
  Synthetic
cagcccgtaatacatgcccgctgccaccatctccaacggcttcaggaccaaaaacgaccaaaggaacagaatcac

SEQ ID NO: 152841 - DNA, 75 bp, Artificial Sequence
  Synthetic
tggggcggaagacgcgagtatgccgaactgacaaaaaagtcagaggtgccgtacgaggacaatgaaaactgttcc

SEQ ID NO: 152842 - DNA, 75 bp, Artificial Sequence
  Synthetic
ccccaaaggcggcctcgtcgaccagatctcgatccaccagaggaaggtcatcccgcatggtcatggggtgtgcgg

SEQ ID NO: 152843 - DNA, 75 bp, Artificial Sequence
  Synthetic
atctcgatccaccagaggaaggtcatcccgcatggtcatggggtgtgcggtggaggtggggagaccgaaaccgca

SEQ ID NO: 152844 - DNA, 75 bp, Artificial Sequence
  Synthetic
tcccgcatggtcatggggtgtgcggtggaggtggggagaccgaaaccgcaaagggtcgcttacgtcagcaggatc

SEQ ID NO: 152845 - DNA, 75 bp, Artificial Sequence
  Synthetic
tgcacaaacaccacccgggttgcatccgcggaggcgagtgttttgataaggccgttccgcgccttgatataacct

SEQ ID NO: 152846 - DNA, 75 bp, Artificial Sequence
  Synthetic
tttacgcctacgccccaatgcccacgcaagatgaggtaggtaaccccccccccgtgggtgtgacgttgcgtttag

SEQ ID NO: 152847 - DNA, 75 bp, Artificial Sequence
  Synthetic
gggtggggaggaaacggaaaacccagtaggccgtgttgggaacacgcccggggttgtcctcaaaaggcagggtcc

SEQ ID NO: 152848 - DNA, 75 bp, Artificial Sequence
  Synthetic
gggttgtcctcaaaaggcagggtccatactacggaagccgtcgttgtattcgagacctgcctgtgcgacgcacgt

SEQ ID NO: 152849 - DNA, 75 bp, Artificial Sequence
  Synthetic
cccaccgcgtgcggcacgcacgaggacgagtccgcgtgctttattggcgttccaagcgttgccctccagtttctg

SEQ ID NO: 152850 - DNA, 75 bp, Artificial Sequence
  Synthetic
acgagtccgcgtgctttattggcgttccaagcgttgccctccagtttctgttgtcggtgttcccccatacccacg

SEQ ID NO: 152851 - DNA, 75 bp, Artificial Sequence
  Synthetic
gggccgtgtcacgtcgccgcccgcgatggagcttagctacgccaccaccatgcactaccgggacgttgtgtttta

SEQ ID NO: 152852 - DNA, 75 bp, Artificial Sequence
  Synthetic
atggagcttagctacgccaccaccatgcactaccgggacgttgtgttttacgtcacaacggaccgaaaccgggcc

SEQ ID NO: 152853 - DNA, 75 bp, Artificial Sequence
  Synthetic
attccgtggggcggccgtgtgcctcgcagcccggggagattgccaagtttggtctggtcgttcgagggacaggcc

SEQ ID NO: 152854 - DNA, 75 bp, Artificial Sequence
  Synthetic
gcagcccggggagattgccaagtttggtctggtcgttcgagggacaggcccagacgaccgcgtggtcgccaacta

SEQ ID NO: 152855 - DNA, 75 bp, Artificial Sequence
  Synthetic
ggcctgcaggacgtgcgtcccattggggaggacgaggtgtttctggacagcgtgtgtcttctaaacccgaacgtg

SEQ ID NO: 152856 - DNA, 75 bp, Artificial Sequence
  Synthetic
gggaggacgaggtgtttctggacagcgtgtgtcttctaaacccgaacgtgagctccgagctggatgtgattaaca

SEQ ID NO: 152857 - DNA, 75 bp, Artificial Sequence
  Synthetic
atgtctggccgagtactgcacctcgctgcgaaccagcccgggtgtgctaatatccgggctgcgcgtgcgggcgca

SEQ ID NO: 152858 - DNA, 75 bp, Artificial Sequence
  Synthetic
ctgcgaaccagcccgggtgtgctaatatccgggctgcgcgtgcgggcgcaggacagaatcatcgagttgtttgaa

SEQ ID NO: 152859 - DNA, 75 bp, Artificial Sequence
  Synthetic
cgcactttgtgtataccccgtccccatacgtgttcgccctggcccaggcgcacctcccccggctcccgagctcgc

SEQ ID NO: 152860 - DNA, 75 bp, Artificial Sequence
  Synthetic
atacgtgttcgccctggcccaggcgcacctcccccggctcccgagctcgctggaggccctggtgagcggcctgtt

SEQ ID NO: 152861 - DNA, 75 bp, Artificial Sequence
  Synthetic
cgcgcgtccttcttgtcgtctctcttcccccccatcaccccgcaatttgcacccagcctttaactacattaaatt

SEQ ID NO: 152862 - DNA, 75 bp, Artificial Sequence
  Synthetic
ccacttgacgcccacaacccgcgcacggatgtggttatcacgggccgccgcgccccacgacccatcgccgggtcg

SEQ ID NO: 152863 - DNA, 75 bp, Artificial Sequence
  Synthetic
cggatgtggttatcacgggccgccgcgccccacgacccatcgccgggtcgggggcggggtcggggggcgcgggcg

SEQ ID NO: 152864 - DNA, 75 bp, Artificial Sequence
  Synthetic
cgtgcaagtcaaacacattgaccgcgtgggccccgctggcgtttcgccggcgcctccgccaaacaacaccgactc

SEQ ID NO: 152865 - DNA, 75 bp, Artificial Sequence
  Synthetic
gtgggccccgctggcgtttcgccggcgcctccgccaaacaacaccgactcaagttccctggtgcccggggcccag

SEQ ID NO: 152866 - DNA, 75 bp, Artificial Sequence
  Synthetic
taagggagctgtggtgggtgttttatgccgcagaccgggcgctggaggagccccgcgccgactctggcctcaccc

SEQ ID NO: 152867 - DNA, 75 bp, Artificial Sequence
  Synthetic
tgccgcagaccgggcgctggaggagccccgcgccgactctggcctcacccgcgaggaggtacgtgccgtacgtgg

SEQ ID NO: 152868 - DNA, 75 bp, Artificial Sequence
  Synthetic
tttggctccgcgggggccccgcgggcgtttatcggggccgcgttgggcctgagccccctccaaaagctagccgtt

SEQ ID NO: 152869 - DNA, 75 bp, Artificial Sequence
  Synthetic
cgtttatcggggccgcgttgggcctgagccccctccaaaagctagccgtttactactatatcatccaccgagaga

SEQ ID NO: 152870 - DNA, 75 bp, Artificial Sequence
  Synthetic
agtccggctcgtaggccggtacacacagcgccacggcctgtacgtccctcggcccgacgacccagtcttggccga

SEQ ID NO: 152871 - DNA, 75 bp, Artificial Sequence
  Synthetic
gcgctggcggccggaaccacagccgagcagctcctcatgttcgaccttctccccccaaaggacgtgccggtggga

SEQ ID NO: 152872 - DNA, 75 bp, Artificial Sequence
  Synthetic
agcagctcctcatgttcgaccttctccccccaaaggacgtgccggtgggaagcgacgtgcaggccgacagcaccg

SEQ ID NO: 152873 - DNA, 75 bp, Artificial Sequence
  Synthetic
ccccccaaaggacgtgccggtgggaagcgacgtgcaggccgacagcaccgctctgctgcgctttatagaatcgca

SEQ ID NO: 152874 - DNA, 75 bp, Artificial Sequence
  Synthetic
atctcccccgagcacgtcgcgtaccttggtgcgttcctgagcgtgctgtacgctggccgcgggcgcatgtccgca

SEQ ID NO: 152875 - DNA, 75 bp, Artificial Sequence
  Synthetic
ttggtgcgttcctgagcgtgctgtacgctggccgcgggcgcatgtccgcagccacgcacaccgcgcggctgacag

SEQ ID NO: 152876 - DNA, 75 bp, Artificial Sequence
  Synthetic
gggtgacgtggaccgtctttccgcgtttgaccgcggagcggcgggcgcggccagccgcacgcgggccgccgggta

SEQ ID NO: 152877 - DNA, 75 bp, Artificial Sequence
  Synthetic
tttgaccgcggagcggcgggcgcggccagccgcacgcgggccgccgggtacctggatgtgcttcttaccgttcgt

SEQ ID NO: 152878 - DNA, 75 bp, Artificial Sequence
  Synthetic
ctgtgtaacagaccccaataaacgtatgtcgctaccacacccttgtgtgtcaatggacgcctctccgggggggaa

SEQ ID NO: 152879 - DNA, 75 bp, Artificial Sequence
  Synthetic
atgtcgctaccacacccttgtgtgtcaatggacgcctctccgggggggaagggaaaacaaagaggggctggggga

SEQ ID NO: 152880 - DNA, 75 bp, Artificial Sequence
  Synthetic
gtcgcgcgaccgacagcactcacagccccgcatatcccaccctggagctgaatctggcccaacagccgcttttgc

SEQ ID NO: 152881 - DNA, 75 bp, Artificial Sequence
  Synthetic
cttgcccgggctatacagacccgcgagccgtacgtggttcgcggggggtgcgtggggtccggggctcccggggag

SEQ ID NO: 152882 - DNA, 75 bp, Artificial Sequence
  Synthetic
gggaaaacaaagaggggctgggggagcggcaccaccggggcctgaacaaacaaaccacagacacggttacagttt

SEQ ID NO: 152883 - DNA, 75 bp, Artificial Sequence
  Synthetic
caaaccacagacacggttacagtttattcggtcgggcggagaaacggccgaagccacgccccctttattcgcgtc

SEQ ID NO: 152884 - DNA, 75 bp, Artificial Sequence
  Synthetic
attcggtcgggcggagaaacggccgaagccacgccccctttattcgcgtctccaaaaaaacgggacacttgtccg

SEQ ID NO: 152885 - DNA, 75 bp, Artificial Sequence
  Synthetic
gggccccgcgccgtccgcgcggcgcctccggaaccgccgggtggacgcgggggtcgagtgtaggcgaggtcgggg

SEQ ID NO: 152886 - DNA, 75 bp, Artificial Sequence
  Synthetic
ctccggaaccgccgggtggacgcgggggtcgagtgtaggcgaggtcgggggaggggcgggggctcgttgtcgcgc

SEQ ID NO: 152887 - DNA, 75 bp, Artificial Sequence
  Synthetic
gcggcggtaatcataaccacgcccagcgcagaggcggccagaaacccgggcgcaattgcggccacgggctgcgtg

SEQ ID NO: 152888 - DNA, 75 bp, Artificial Sequence
  Synthetic
gcgcagaggcggccagaaacccgggcgcaattgcggccacgggctgcgtgtcaaaggctagcaaatgaatgacgg

SEQ ID NO: 152889 - DNA, 75 bp, Artificial Sequence
  Synthetic
tggggttggggctggggttggggctggggttggggctggggttggggctggggttggggctggggttggggttgg

SEQ ID NO: 152890 - DNA, 75 bp, Artificial Sequence
  Synthetic
cgtggacggcacgtcgctcgaaaacacgcttggggcgccctccgtcggcccggcggcgatttgctgctgtgtgtt

SEQ ID NO: 152891 - DNA, 75 bp, Artificial Sequence
  Synthetic
acgcttggggcgccctccgtcggcccggcggcgatttgctgctgtgtgttgtccgtatccaccagcaacacagac

SEQ ID NO: 152892 - DNA, 75 bp, Artificial Sequence
  Synthetic
gcataaacacggcccccacgagccccaggtcgcgctggttttgggtgcgcaccagccgcttggactcgatatccc

SEQ ID NO: 152893 - DNA, 75 bp, Artificial Sequence
  Synthetic
caggtcgcgctggttttgggtgcgcaccagccgcttggactcgatatcccgggtggagccttcgcatgtcgcggt

SEQ ID NO: 152894 - DNA, 75 bp, Artificial Sequence
  Synthetic
cggacgtcgacgccggtgagcttgtagccgatcccccggggcagaggggagtgggtgacgacgtagctggcgttg

SEQ ID NO: 152895 - DNA, 75 bp, Artificial Sequence
  Synthetic
agccgatcccccggggcagaggggagtgggtgacgacgtagctggcgttgtgggtgatgggtaccaggatccgtg

SEQ ID NO: 152896 - DNA, 75 bp, Artificial Sequence
  Synthetic
gcaccgatgtgaggcctcagggacgaaggcgcggatcagggcgttgtagtgtgcccagcgcgtcagggtcgaggc

SEQ ID NO: 152897 - DNA, 75 bp, Artificial Sequence
  Synthetic
aaggcgcggatcagggcgttgtagtgtgcccagcgcgtcagggtcgaggcgaggccgtgggtctgctgggccagg

SEQ ID NO: 152898 - DNA, 75 bp, Artificial Sequence
  Synthetic
tggcttgagccagcgcgtccaggataaacacgctctcgtctagatcaaagcgcagggaggccgcgcatggcgaaa

SEQ ID NO: 152899 - DNA, 75 bp, Artificial Sequence
  Synthetic
aaacacgctctcgtctagatcaaagcgcagggaggccgcgcatggcgaaaagtggtccggaagccaaaagagggt

SEQ ID NO: 152900 - DNA, 75 bp, Artificial Sequence
  Synthetic
cggtccacgcaacggtcgccgccggtcgcctcgacgaggacgttcctcctgcgggaaggcacgaacgcgggtgag

SEQ ID NO: 152901 - DNA, 75 bp, Artificial Sequence
  Synthetic
ccccctcctccgcccccgcgtcccccctcctccgcccccgcgtcccccctcctccgcccccgcgtcccccctcct

SEQ ID NO: 152902 - DNA, 75 bp, Artificial Sequence
  Synthetic
gcggtccggaggtcggcgttggtcgctgcggcgacgtcggacgtacacagggccgaggctatcagaaggctccgg

SEQ ID NO: 152903 - DNA, 75 bp, Artificial Sequence
  Synthetic
ctgcggcgacgtcggacgtacacagggccgaggctatcagaaggctccggcgggcgcgttcccgctgcaccgccg

SEQ ID NO: 152904 - DNA, 75 bp, Artificial Sequence
  Synthetic
ccggaggacagccgaggcgtaaaatagcgcccggtggacgaccggggtggtcagcacgcggccccctagaaactc

SEQ ID NO: 152905 - DNA, 75 bp, Artificial Sequence
  Synthetic
agcgcccggtggacgaccggggtggtcagcacgcggccccctagaaactcggcatacagggcgtcgatgagatgg

SEQ ID NO: 152906 - DNA, 75 bp, Artificial Sequence
  Synthetic
aggtgcttacccgtgcaaaaaaggcggaccggtgggtttctgtcgtcggaggcccccggggtgcgtcccctgtgt

SEQ ID NO: 152907 - DNA, 75 bp, Artificial Sequence
  Synthetic
ggaccggtgggtttctgtcgtcggaggcccccggggtgcgtcccctgtgtttcgtgggtggggtgggcgggtctt

SEQ ID NO: 152908 - DNA, 75 bp, Artificial Sequence
  Synthetic
acgccgaggggctatccagcacgaaggccagctgatagcccagcgcgtgtaatgccaagctctgttcgcgctcca

SEQ ID NO: 152909 - DNA, 75 bp, Artificial Sequence
  Synthetic
ggccagctgatagcccagcgcgtgtaatgccaagctctgttcgcgctccagaatctcggccaccaggtgctggag

SEQ ID NO: 152910 - DNA, 75 bp, Artificial Sequence
  Synthetic
gtgggatccaagactgacacattaaaaaacacagaatccgcggcacagcccgcggccccgcgggcggccaacccg

SEQ ID NO: 152911 - DNA, 75 bp, Artificial Sequence
  Synthetic
aaaacacagaatccgcggcacagcccgcggccccgcgggcggccaacccggcaagcgcgcgcgagtgggccaaaa

SEQ ID NO: 152912 - DNA, 75 bp, Artificial Sequence
  Synthetic
cgcgccgtttgcgtgggcggcgttcacgaaagcaaaacccgacgtcgcgagcagccccgttaggcgccagaagag

SEQ ID NO: 152913 - DNA, 75 bp, Artificial Sequence
  Synthetic
ccccgaagtctcacacgtgcgtggggtgaccgtgcgtatggagactccggaagctatcctgttttcccccgggga

SEQ ID NO: 152914 - DNA, 75 bp, Artificial Sequence
  Synthetic
agggggacgcgggccctgctcggcgcccgcgtcccccgagaaaaactccgcgtatgcccgcgacaggaactgggc

SEQ ID NO: 152915 - DNA, 75 bp, Artificial Sequence
  Synthetic
cttttacccggcggccccgcccccttggggcggtcccgcccgccggccaatgggggggcggcaaggcgggcggcc

SEQ ID NO: 152916 - DNA, 75 bp, Artificial Sequence
  Synthetic
cgtatgcccgcgacaggaactgggcgtagttcgtgccctcctccgggtagccgcccacgcggcggagggcgtcca

SEQ ID NO: 152917 - DNA, 75 bp, Artificial Sequence
  Synthetic
gtagttcgtgccctcctccgggtagccgcccacgcggcggagggcgtccagcgcggagccgttgtcggcccgcgt

SEQ ID NO: 152918 - DNA, 75 bp, Artificial Sequence
  Synthetic
taccgggggccgcccgggggcccgggaagagcccccggggggttttcgtccgcggggtccccgacccgatctagc

SEQ ID NO: 152919 - DNA, 75 bp, Artificial Sequence
  Synthetic
gaagagcccccggggggttttcgtccgcggggtccccgacccgatctagcgtctggcccgcggggaccaccatca

SEQ ID NO: 152920 - DNA, 75 bp, Artificial Sequence
  Synthetic
ggatatcacgagccccatgaattcccgcccgtagcgcgcgcgcaccagcgcggcatcgcacccgagcaccagctc

SEQ ID NO: 152921 - DNA, 75 bp, Artificial Sequence
  Synthetic
cgcccgtagcgcgcgcgcaccagcgcggcatcgcacccgagcaccagctcccccgtcgtccagatgcccacgggc

SEQ ID NO: 152922 - DNA, 75 bp, Artificial Sequence
  Synthetic
acacgtacctacctggggatctcaacaggccccgggtggccaaccaggtcgtggacgcgttgtgcaggtgcgtga

SEQ ID NO: 152923 - DNA, 75 bp, Artificial Sequence
  Synthetic
caggccccgggtggccaaccaggtcgtggacgcgttgtgcaggtgcgtgatgtccagctccgtcgtcgggtgccg

SEQ ID NO: 152924 - DNA, 75 bp, Artificial Sequence
  Synthetic
ggcggtgtatcacgcggcccgctcgggtggctcgccgtcgccacgttgtctccccgcgggaacgtcagggcctcg

SEQ ID NO: 152925 - DNA, 75 bp, Artificial Sequence
  Synthetic
ggtagctttacaatgcaaaagcctttgacgtggaggaaggcgtgggggggaggaaatcggcactgaccaaggggg

SEQ ID NO: 152926 - DNA, 75 bp, Artificial Sequence
  Synthetic
gggggccggccgagcaggtaggtcttcgagatgtaaagcagctggccggggtcccgcggaaactcggccgtggtg

SEQ ID NO: 152927 - DNA, 75 bp, Artificial Sequence
  Synthetic
tcgagatgtaaagcagctggccggggtcccgcggaaactcggccgtggtgaccaatacaaaacaaaagcgctcct

SEQ ID NO: 152928 - DNA, 75 bp, Artificial Sequence
  Synthetic
tgccgtagtcaggtttagttcgtccggcggcgccagaaatccgcgcggtggtttttgggggtcgggggtgtttgg

SEQ ID NO: 152929 - DNA, 75 bp, Artificial Sequence
  Synthetic
ggcggcgccagaaatccgcgcggtggtttttgggggtcgggggtgtttggcagccacagacgcccggtgttcgtg

SEQ ID NO: 152930 - DNA, 75 bp, Artificial Sequence
  Synthetic
ccaggccatccaaaaaccatgggtctgtctgctcagtccagtcgtggacctgaccccacgcaacgcccaaaagaa

SEQ ID NO: 152931 - DNA, 75 bp, Artificial Sequence
  Synthetic
taacccccacgaaccataaaccattccccatgggggaccccgtccctaacccacggggcccgtggctatggcagg

SEQ ID NO: 152932 - DNA, 75 bp, Artificial Sequence
  Synthetic
ccacggggcccgtggctatggcagggcttgccgccccgacgttggctgcgagccctgggccttcacccgaacttg

SEQ ID NO: 152933 - DNA, 75 bp, Artificial Sequence
  Synthetic
ggtctcggtggggtatcgacagagtgccagccctgggaccgaaccccgcgtttatgaacaaacgacccaacaccc

SEQ ID NO: 152934 - DNA, 75 bp, Artificial Sequence
  Synthetic
gccagccctgggaccgaaccccgcgtttatgaacaaacgacccaacacccgtgcgttttattctgtctttttatt

SEQ ID NO: 152935 - DNA, 75 bp, Artificial Sequence
  Synthetic
gtattgtctccttccgtgtttcagttagcctcccccatctcccgggcaaacgtgcgcgccaggtcgcagatcgtc

SEQ ID NO: 152936 - DNA, 75 bp, Artificial Sequence
  Synthetic
tagcctcccccatctcccgggcaaacgtgcgcgccaggtcgcagatcgtcggtatggagcctggggtggtgacgt

SEQ ID NO: 152937 - DNA, 75 bp, Artificial Sequence
  Synthetic
ttgcagcagggcgtcccggcagccggcgggcgattggtcgtaatccaggataaagacgtgcatgggacggaggcg

SEQ ID NO: 152938 - DNA, 75 bp, Artificial Sequence
  Synthetic
gcaaacacgttatacaggtcgccgttgggggccagcaactcgggggcccgaaacagggtaaataacgtgtccccg

SEQ ID NO: 152939 - DNA, 75 bp, Artificial Sequence
  Synthetic
tgggggccagcaactcgggggcccgaaacagggtaaataacgtgtccccgatatggggtcgtgggcccgcgttgc

SEQ ID NO: 152940 - DNA, 75 bp, Artificial Sequence
  Synthetic
aaacagggtaaataacgtgtccccgatatggggtcgtgggcccgcgttgctctggggctcggcaccctggggcgg

SEQ ID NO: 152941 - DNA, 75 bp, Artificial Sequence
  Synthetic
caatcctcccgccacgacccgccgccctgcagataccgcaccgtattggcaagcagcccgtaaacgcggcgaatc

SEQ ID NO: 152942 - DNA, 75 bp, Artificial Sequence
  Synthetic
gcggccaacatagccaggtcaagccgctcgccggggcgctggcgtttggccaggcggtcgatgtgtctgtcctcc

SEQ ID NO: 152943 - DNA, 75 bp, Artificial Sequence
  Synthetic
caggcggtcgatgtgtctgtcctccggaagggcccccaacacgatgtttgtgccgggcaaggtcggcgggatgag

SEQ ID NO: 152944 - DNA, 75 bp, Artificial Sequence
  Synthetic
ggaagggcccccaacacgatgtttgtgccgggcaaggtcggcgggatgagggccacgaacgccagcacggcctgg

SEQ ID NO: 152945 - DNA, 75 bp, Artificial Sequence
  Synthetic
gcgcggccgggtagcacaggagggcggcgatgggatggcggtcgaagatgagggtgagggccgggggcggggcat

SEQ ID NO: 152946 - DNA, 75 bp, Artificial Sequence
  Synthetic
ggcgatgggatggcggtcgaagatgagggtgagggccgggggcggggcatgtgagctcccagcctcccccccgat

SEQ ID NO: 152947 - DNA, 75 bp, Artificial Sequence
  Synthetic
acggcataaggcatgcccattgttatctgggcgcttgtcattaccaccgccgcgtccccggccgatatctcaccc

SEQ ID NO: 152948 - DNA, 75 bp, Artificial Sequence
  Synthetic
cgcgtccccggccgatatctcaccctggtcgaggcggtgttgtgtggtgtagatgttcgcgattgtctcggaagc

SEQ ID NO: 152949 - DNA, 75 bp, Artificial Sequence
  Synthetic
ggctcgggtacgtagacgatatcgtcgcgcgaacccagggccaccagcagttgcgtggtggtggttttccccatc

SEQ ID NO: 152950 - DNA, 75 bp, Artificial Sequence
  Synthetic
ttgcgtggtggtggttttccccatcccgtgaggaccgtctatataaacccgcagtagcgtgggcattttctgctc

SEQ ID NO: 152951 - DNA, 75 bp, Artificial Sequence
  Synthetic
tgccggcgagggcgcaacgccgtacgtcggttgctatggccgcgagaacgcgcagcctggtcgaacgcagacgcg

SEQ ID NO: 152952 - DNA, 75 bp, Artificial Sequence
  Synthetic
gtcggttgctatggccgcgagaacgcgcagcctggtcgaacgcagacgcgtgttgatggcaggggtacgaagcca

SEQ ID NO: 152953 - DNA, 75 bp, Artificial Sequence
  Synthetic
aaagaggtgcgggagtttcacgccaccaagatctgcggcacgctgttgacgctgttaagcgggtcgctgcagggt

SEQ ID NO: 152954 - DNA, 75 bp, Artificial Sequence
  Synthetic
ccaagatctgcggcacgctgttgacgctgttaagcgggtcgctgcagggtcgctcggtgttcgaggccacacgcg

SEQ ID NO: 152955 - DNA, 75 bp, Artificial Sequence
  Synthetic
gggaccgcgccgccccgactgcatctgcgtgttcgaattcgccaatgacaagacgctgggcggggtttgtgtcat

SEQ ID NO: 152956 - DNA, 75 bp, Artificial Sequence
  Synthetic
tgcgtgttcgaattcgccaatgacaagacgctgggcggggtttgtgtcatcatagaactaaagacatgcaaatat

SEQ ID NO: 152957 - DNA, 75 bp, Artificial Sequence
  Synthetic
gcggcccgcgacccccgaagacgaagaagagcggcgcggacgcccccggctcggacgcccgcgcccccctccccg

SEQ ID NO: 152958 - DNA, 75 bp, Artificial Sequence
  Synthetic
tcggtaaacatctgctcaaactcgaagtcggccatatccaaagcgccgtagggggtggagtcgtggggggtaaat

SEQ ID NO: 152959 - DNA, 75 bp, Artificial Sequence
  Synthetic
aacgcgagcaacgggccacggggatgaagcagctgcgccactccctgaagctcctgcagtccctcgcgcctccgg

SEQ ID NO: 152960 - DNA, 75 bp, Artificial Sequence
  Synthetic
gaagcagctgcgccactccctgaagctcctgcagtccctcgcgcctccgggtgacaagatagtgtacctgtgccc

SEQ ID NO: 152961 - DNA, 75 bp, Artificial Sequence
  Synthetic
acgctccgcgtcagccgcgtgacccggctcgtcccgcagaaggtctccggtaatatcaccgcagtcgtgcggatg

SEQ ID NO: 152962 - DNA, 75 bp, Artificial Sequence
  Synthetic
taatatcaccgcagtcgtgcggatgctccagagcctgtccacgtatacggtccccatggagcctaggacccagcg

SEQ ID NO: 152963 - DNA, 75 bp, Artificial Sequence
  Synthetic
gcccgggggtctgcgagcagaccgaaaaggtcacactctggggcgcgcgacccgcccgagccagcggcccgccag

SEQ ID NO: 152964 - DNA, 75 bp, Artificial Sequence
  Synthetic
cctccacggagggcgggggggtgcttaagaggatcgcggcgctcttctgcgtgcccgtggccaccaagaccaaac

SEQ ID NO: 152965 - DNA, 75 bp, Artificial Sequence
  Synthetic
taagaggatcgcggcgctcttctgcgtgcccgtggccaccaagaccaaaccccgagctgcctccgaatgagagtg

SEQ ID NO: 152966 - DNA, 75 bp, Artificial Sequence
  Synthetic
ctcatttggatccggcgggagccacctgacaacagcccccgggtttccccacgccagacgccggtccgctgtgcc

SEQ ID NO: 152967 - DNA, 75 bp, Artificial Sequence
  Synthetic
tcttgtccccaaataaaacaaggtctggtagttaggacaacgaccgcagttctcgtgtgttattgtcgctctccg

SEQ ID NO: 152968 - DNA, 75 bp, Artificial Sequence
  Synthetic
cctctcgcagatggacccgtattgcccatttgacgctctggacgtctgggaacacaggcgcttcatagtcgccga

SEQ ID NO: 152969 - DNA, 75 bp, Artificial Sequence
  Synthetic
aacacaggcgcttcatagtcgccgattcccgaaacttcatcacccccgagttcccccgggacttttggatgtcgc

SEQ ID NO: 152970 - DNA, 75 bp, Artificial Sequence
  Synthetic
ttcccgaaacttcatcacccccgagttcccccgggacttttggatgtcgcccgtctttaacctcccccgggagac

SEQ ID NO: 152971 - DNA, 75 bp, Artificial Sequence
  Synthetic
tttggatctctgacctgagattggcggcactgaggtagagatgcccgaacccccccgagggagcgcgggacgcgc

SEQ ID NO: 152972 - DNA, 75 bp, Artificial Sequence
  Synthetic
gtccaggaaggtgtccgccatttccagggcccacgacatgctccccccgacgcgaaggaagcggtccacgcaacg

SEQ ID NO: 152973 - DNA, 75 bp, Artificial Sequence
  Synthetic
caggcccagcgcacagcggctgccgctgccctggagaacgccgccatgcaggcggccgagctccccgtcgatatc

SEQ ID NO: 152974 - DNA, 75 bp, Artificial Sequence
  Synthetic
ctgccctggagaacgccgccatgcaggcggccgagctccccgtcgatatcgagcgccggttacgcccgatcgaac

SEQ ID NO: 152975 - DNA, 75 bp, Artificial Sequence
  Synthetic
cctggaggcgctggagacggcggcggccgccgccgaagaggcggatgccgcgcgcggggatgagccggcgggtgg

SEQ ID NO: 152976 - DNA, 75 bp, Artificial Sequence
  Synthetic
cctccgccccgcgtccccctcctccgcccccgcgtccccctcctcctccgcccccgcgtcccccctcctcctccg

SEQ ID NO: 152977 - DNA, 75 bp, Artificial Sequence
  Synthetic
gccgccgccgaagaggcggatgccgcgcgcggggatgagccggcgggtgggggcgacgggggggcgcccccgggt

SEQ ID NO: 152978 - DNA, 75 bp, Artificial Sequence
  Synthetic
gcccccgcgtccccctcctcctccgcccccgcgtcccccctcctcctccgcccccgcgtcccccctcctcctccg

SEQ ID NO: 152979 - DNA, 75 bp, Artificial Sequence
  Synthetic
agatcgtgcgcaacgacccgccgctacgatacgacaccaacctccccgtggatctgctacatatggtgtacgcgg

SEQ ID NO: 152980 - DNA, 75 bp, Artificial Sequence
  Synthetic
gccgcggggcgaccggctcgtcgggggtggtgttcgggacctggtaccgcactatccaggaccgcaccatcacgg

SEQ ID NO: 152981 - DNA, 75 bp, Artificial Sequence
  Synthetic
actatccaggaccgcaccatcacggactttcccctgaccacccgcagtgccgactttcgggacggccggatgtcc

SEQ ID NO: 152982 - DNA, 75 bp, Artificial Sequence
  Synthetic
gtatgtgggccagcgccactattccgccttcgagtgcgccgtgttgtgtctctacctgctgtaccgaaacacgca

SEQ ID NO: 152983 - DNA, 75 bp, Artificial Sequence
  Synthetic
ggagcggccagacgccgaaaacgggccccccccaaaacacaccccccgggggtcgcgcgcggccctttaaagcgg

SEQ ID NO: 152984 - DNA, 75 bp, Artificial Sequence
  Synthetic
gccttcgagtgcgccgtgttgtgtctctacctgctgtaccgaaacacgcacggggccgccgacgatagcgaccgc

SEQ ID NO: 152985 - DNA, 75 bp, Artificial Sequence
  Synthetic
tgggccggctgccccgctacctggcgtgcctggccgcggtgatcgggaccgagggcggccggccacagtaccgct

SEQ ID NO: 152986 - DNA, 75 bp, Artificial Sequence
  Synthetic
gtgcctggccgcggtgatcgggaccgagggcggccggccacagtaccgctaccgcgacgacaagctccccaagac

SEQ ID NO: 152987 - DNA, 75 bp, Artificial Sequence
  Synthetic
tacgaacacggagcgctggcgtcgcacatcgtgatcgccacgctgatgcaccacggggtgctcccggcggccccg

SEQ ID NO: 152988 - DNA, 75 bp, Artificial Sequence
  Synthetic
acatcgtgatcgccacgctgatgcaccacggggtgctcccggcggccccgggggacgtcccccgggacgcgagca

SEQ ID NO: 152989 - DNA, 75 bp, Artificial Sequence
  Synthetic
gcaccacgacgacataaaccgcgccgccgccgcgttcctcagccggggccacaacctattcctgtgggaggacca

SEQ ID NO: 152990 - DNA, 75 bp, Artificial Sequence
  Synthetic
gccgccgcgttcctcagccggggccacaacctattcctgtgggaggaccagactctgctgcgggcaaccgcgaac

SEQ ID NO: 152991 - DNA, 75 bp, Artificial Sequence
  Synthetic
gaacggaagcggaaaccgccggatcgggcggtaatgagatgccatgcggggcggggcgcgggcccacccgccctc

SEQ ID NO: 152992 - DNA, 75 bp, Artificial Sequence
  Synthetic
agcggctcctcgcgaacggcaacgtgtacgcggaccgcctcaacaaccgcctgcagctgggcatgctgatccccg

SEQ ID NO: 152993 - DNA, 75 bp, Artificial Sequence
  Synthetic
gtacgcggaccgcctcaacaaccgcctgcagctgggcatgctgatccccggagccgtcccttcggaggccatcgc

SEQ ID NO: 152994 - DNA, 75 bp, Artificial Sequence
  Synthetic
ggggccatcaagagcggagacaacaatctggaggcgctatgtgccaattacgtgcttccgctgtaccgggccgac

SEQ ID NO: 152995 - DNA, 75 bp, Artificial Sequence
  Synthetic
atctggaggcgctatgtgccaattacgtgcttccgctgtaccgggccgacccggcggtcgagctgacccagctgt

SEQ ID NO: 152996 - DNA, 75 bp, Artificial Sequence
  Synthetic
tgacgcccaggcggggcggccggtcgggtcgacgcggcgggtggtggatatgtcatcgggggcccgccaggcggc

SEQ ID NO: 152997 - DNA, 75 bp, Artificial Sequence
  Synthetic
gctggtgcgcctcaccgccctggaactcatcaaccgcacccgcacaaaccccacccccgtgggggaggttatcca

SEQ ID NO: 152998 - DNA, 75 bp, Artificial Sequence
  Synthetic
tacgaacaggggcttggcctgctggcgcagcaggcacgcattggcttgggctccaacaccaagcgtttctccgcg

SEQ ID NO: 152999 - DNA, 75 bp, Artificial Sequence
  Synthetic
ttcaacgttagcagcgactacgacatgttgtactttttatgtctggggttcattccacagtacctgtcggcggtt

SEQ ID NO: 153000 - DNA, 75 bp, Artificial Sequence
  Synthetic
ggggcattagggagaaagaacaagagcctccgttgggttttctttgtgcctgtactcaaaaggtcataccccgta

SEQ ID NO: 153001 - DNA, 75 bp, Artificial Sequence
  Synthetic
gagctgggttagcgtttagtttagcattcgctctcgcctttccgcccgcccccgaccgttgagtccttttttttt

SEQ ID NO: 153002 - DNA, 75 bp, Artificial Sequence
  Synthetic
gtctctgtgggtgcgcgcatggcagccgatgccccgggagaccggatggaggagcccctgccagacagggccgtg

SEQ ID NO: 153003 - DNA, 75 bp, Artificial Sequence
  Synthetic
ccgatgccccgggagaccggatggaggagcccctgccagacagggccgtgcccatttacgtggctgggtttttgg

SEQ ID NO: 153004 - DNA, 75 bp, Artificial Sequence
  Synthetic
cgagttggcattggatccggatacggtgcgggcggccctgcctccggataacccactcccgattaacgtggacca

SEQ ID NO: 153005 - DNA, 75 bp, Artificial Sequence
  Synthetic
acccactcccgattaacgtggaccaccgcgctggctgcgaggtggggcgggtgctggccgtggtcgacgaccccc

SEQ ID NO: 153006 - DNA, 75 bp, Artificial Sequence
  Synthetic
cgcctgcgtgcaactggagcgcgtcctcgagacggccgccagcgctgcgattttcgagcgccgcgggccgccgct

SEQ ID NO: 153007 - DNA, 75 bp, Artificial Sequence
  Synthetic
ctcgagacggccgccagcgctgcgattttcgagcgccgcgggccgccgctctcccgggaggagcgcctgttgtac

SEQ ID NO: 153008 - DNA, 75 bp, Artificial Sequence
  Synthetic
tctccctggccacaaaacgcctggggggcgaggcgcaccccgatcgcacgctgttcgcgcacgtagcgctgtgcg

SEQ ID NO: 153009 - DNA, 75 bp, Artificial Sequence
  Synthetic
cgtcacctacgacaccggtctcgacgccgccatcgcgccctttcgccacctgtcgccggcgtctcgcgagggggc

SEQ ID NO: 153010 - DNA, 75 bp, Artificial Sequence
  Synthetic
gccgccatcgcgccctttcgccacctgtcgccggcgtctcgcgagggggcgcggcgactggccgccgaggccgag

SEQ ID NO: 153011 - DNA, 75 bp, Artificial Sequence
  Synthetic
cgcccggcgtggaggcgctgacccacacgctgctttccaccgccgttaacaacatgatgctgcgggaccgctgga

SEQ ID NO: 153012 - DNA, 75 bp, Artificial Sequence
  Synthetic
cacgctgctttccaccgccgttaacaacatgatgctgcgggaccgctggagcctggtggccgagcggcggcggca

SEQ ID NO: 153013 - DNA, 75 bp, Artificial Sequence
  Synthetic
aacatgatgctgcgggaccgctggagcctggtggccgagcggcggcggcaggccgggatcgccggacacacctac

SEQ ID NO: 153014 - DNA, 75 bp, Artificial Sequence
  Synthetic
tgtggggggcggagcctgtttccgcgccggcgcgcgggtataagaacggggccccggagtccacggacataccgc

SEQ ID NO: 153015 - DNA, 75 bp, Artificial Sequence
  Synthetic
ccgcccggcgacgggagctacctgtggatcccggcctcccattacaaccagctcgtcgccggccacgccgcgccc

SEQ ID NO: 153016 - DNA, 75 bp, Artificial Sequence
  Synthetic
gggtcggcggaggggggatccgtgggtggggtacccttcagggccaccgcccatacatcgtcgggcgcccgattc

SEQ ID NO: 153017 - DNA, 75 bp, Artificial Sequence
  Synthetic
ggatcccggcctcccattacaaccagctcgtcgccggccacgccgcgccccaaccccagccgcattccgcgtttg

SEQ ID NO: 153018 - DNA, 75 bp, Artificial Sequence
  Synthetic
ggcctatgggcctcacggcgcgggtctttcccagcattaccctccccacgtcgcccatcagtatcccggggtgct

SEQ ID NO: 153019 - DNA, 75 bp, Artificial Sequence
  Synthetic
ctttcccagcattaccctccccacgtcgcccatcagtatcccggggtgctgttctcgggacccagcccactcgag

SEQ ID NO: 153020 - DNA, 75 bp, Artificial Sequence
  Synthetic
ccatagccgcggaccgccaggcgggcggtcagccggccgcgggagaccctggggtccgggggtcgggaaagcgtc

SEQ ID NO: 153021 - DNA, 75 bp, Artificial Sequence
  Synthetic
gtcctactgcgaccaggacgaaccggacgcggactacccgtactaccccggggaggctcgaggcgggccgcgcgg

SEQ ID NO: 153022 - DNA, 75 bp, Artificial Sequence
  Synthetic
cagtctcccgggaccaacgagaccatcacggcgctgatgggggcggtgacgtctctgcagcaggaactggcgcac

SEQ ID NO: 153023 - DNA, 75 bp, Artificial Sequence
  Synthetic
gcggcggcggctcccgccagtcgcgagccgcggcgccgcggggggcgtctggcccctccgggggggttggggttg

SEQ ID NO: 153024 - DNA, 75 bp, Artificial Sequence
  Synthetic
tcacggcgctgatgggggcggtgacgtctctgcagcaggaactggcgcacatgcgggctcggaccagcgccccct

SEQ ID NO: 153025 - DNA, 75 bp, Artificial Sequence
  Synthetic
ctatcgccctcaggtgggggagccggaaccaacaacgacccacccggccctttgtcccccggaggccgtgtatcg

SEQ ID NO: 153026 - DNA, 75 bp, Artificial Sequence
  Synthetic
gaaccaacaacgacccacccggccctttgtcccccggaggccgtgtatcgccccccaccacacagcgccccctac

SEQ ID NO: 153027 - DNA, 75 bp, Artificial Sequence
  Synthetic
atgcccccactcccccgtatgccccagctgcctgcccgccaggcccgccaccgcccccatgtccttccacccaga

SEQ ID NO: 153028 - DNA, 75 bp, Artificial Sequence
  Synthetic
agctgcctgcccgccaggcccgccaccgcccccatgtccttccacccagacgcgcgcccctctaccgacggagcc

SEQ ID NO: 153029 - DNA, 75 bp, Artificial Sequence
  Synthetic
tcccaaccggaggcatccaacgcggaggccggggcccttgtcaacgccagcagcgcagcacacgtggacgttgac

SEQ ID NO: 153030 - DNA, 75 bp, Artificial Sequence
  Synthetic
aggccggggcccttgtcaacgccagcagcgcagcacacgtggacgttgacacggcccgcgccgccgatttgttcg

SEQ ID NO: 153031 - DNA, 75 bp, Artificial Sequence
  Synthetic
attcgccccggtctttggtaccatgggatgtcttactgtatatctttttaaataaaccaggtaataccaaataag

SEQ ID NO: 153032 - DNA, 75 bp, Artificial Sequence
  Synthetic
ggatgtcttactgtatatctttttaaataaaccaggtaataccaaataagacccattggtgtatgttcttttttt

SEQ ID NO: 153033 - DNA, 75 bp, Artificial Sequence
  Synthetic
aaatcggcactgaccaagggggtccgttttgtcacgggaaaggaaagaggaaacaggccgcggacacccggggga

SEQ ID NO: 153034 - DNA, 75 bp, Artificial Sequence
  Synthetic
cccacacacacacaaaaggcgtaccaaacaaaaaaaccaaaagatgcgcatgcggtttaacacccgtggttttta

SEQ ID NO: 153035 - DNA, 75 bp, Artificial Sequence
  Synthetic
tcgtcctcgtcggcgtcaccgtctttgttgggaacttgggtgtagttggtgttgcggcgcttgcgcatgaccatg

SEQ ID NO: 153036 - DNA, 75 bp, Artificial Sequence
  Synthetic
gttgcggcgcttgcgcatgaccatgtcggtgaccttggcgctgagcagcgcgctcgtgcccttcttcttggcctt

SEQ ID NO: 153037 - DNA, 75 bp, Artificial Sequence
  Synthetic
accagggccatgtaccgtatcatctccctggcctcggctagcttggcctcgtcaaagtcgccgccctcctcgccc

SEQ ID NO: 153038 - DNA, 75 bp, Artificial Sequence
  Synthetic
tccccggacgcgtccgggttggtggggttcttgagctccttggtggttagagggtacagggccttcatggggttg

SEQ ID NO: 153039 - DNA, 75 bp, Artificial Sequence
  Synthetic
aggcgaagaaggccgccgccaggccggccaggaccaacagacccacggccagcgccccaaaggggttggacatga

SEQ ID NO: 153040 - DNA, 75 bp, Artificial Sequence
  Synthetic
taccacgccgcccacgatgcccatcaccaccttgccgaccgcgcgccccaggtcgcccatcccctcgaagaacgc

SEQ ID NO: 153041 - DNA, 75 bp, Artificial Sequence
  Synthetic
ttggcgtcggcgtggatgaccgtgtcgatgtcggcgaagcgcaggtcgtgcagctggttgcggcgctggacctcc

SEQ ID NO: 153042 - DNA, 75 bp, Artificial Sequence
  Synthetic
cgatgtcggcgaagcgcaggtcgtgcagctggttgcggcgctggacctccgtgtagtccagcaggccgctgtcct

SEQ ID NO: 153043 - DNA, 75 bp, Artificial Sequence
  Synthetic
cagggggacaaactcgtgatcctccagcatggtgatgttgaggtcgatgaaggtgctgacggtggtgatgtcggc

SEQ ID NO: 153044 - DNA, 75 bp, Artificial Sequence
  Synthetic
agcatggtgatgttgaggtcgatgaaggtgctgacggtggtgatgtcggcgcggctcagctggtgggagtacgcg

SEQ ID NO: 153045 - DNA, 75 bp, Artificial Sequence
  Synthetic
caccgaaggtgaagtagcgccggtgtcccacggtgcacggctcgatcgcatcgcgcgtcagccgcagctcgttgt

SEQ ID NO: 153046 - DNA, 75 bp, Artificial Sequence
  Synthetic
tcccacggtgcacggctcgatcgcatcgcgcgtcagccgcagctcgttgttctcccccagctgcccctcgaccaa

SEQ ID NO: 153047 - DNA, 75 bp, Artificial Sequence
  Synthetic
ctgaccagggggcggctgtagcaggccccgggccgcgagctgatgcgcatcgagttttggacgatcacgttgtcc

SEQ ID NO: 153048 - DNA, 75 bp, Artificial Sequence
  Synthetic
tcgctctcgaaccgacactcgaaaaaggcggagagcgtgcgcatgtgcagccgcagcagcacgatggcgtcctcc

SEQ ID NO: 153049 - DNA, 75 bp, Artificial Sequence
  Synthetic
gcggcgaccggcacgcacgtggagacggccatcacgtcgccgagcatccgcgcgctcacccgccggcccacggtg

SEQ ID NO: 153050 - DNA, 75 bp, Artificial Sequence
  Synthetic
ccgggattcgctgggcctcggccacgggccgcagcggcaccgtgctggcggcggcgggggccgtggaggtgctgg

SEQ ID NO: 153051 - DNA, 75 bp, Artificial Sequence
  Synthetic
gcttgcgggcctcgttccacagggtcagctcgtgattctgtagctcgcaccacgcgatggcaacgcggcccaaca

SEQ ID NO: 153052 - DNA, 75 bp, Artificial Sequence
  Synthetic
cagctcgtgattctgtagctcgcaccacgcgatggcaacgcggcccaacatatcgttgacatggcgctgtatgtg

SEQ ID NO: 153053 - DNA, 75 bp, Artificial Sequence
  Synthetic
aactcgatggaggaggtggtcttgatgcgctccacggacgcgttggcgctggccccgggcggcgggggcgtgggg

SEQ ID NO: 153054 - DNA, 75 bp, Artificial Sequence
  Synthetic
tgcgctccacggacgcgttggcgctggccccgggcggcgggggcgtggggtttgggggcttgcggctctgctctc

SEQ ID NO: 153055 - DNA, 75 bp, Artificial Sequence
  Synthetic
cgcgagcgtgttgctgagaaggggctggtacgcgatcagaaagcccccattggccaggtagtactgcggctggcc

SEQ ID NO: 153056 - DNA, 75 bp, Artificial Sequence
  Synthetic
tggtacgcgatcagaaagcccccattggccaggtagtactgcggctggcccaccttgatgtgcgtcgcgttgtac

SEQ ID NO: 153057 - DNA, 75 bp, Artificial Sequence
  Synthetic
cgtcgcgggcgtccttgccgatgcagtcccccaggtccacgcgcgagagcgggtactcggtcaggttggtggtga

SEQ ID NO: 153058 - DNA, 75 bp, Artificial Sequence
  Synthetic
gtcccccaggtccacgcgcgagagcgggtactcggtcaggttggtggtgaaggtggtggatatggcgtcggagga

SEQ ID NO: 153059 - DNA, 75 bp, Artificial Sequence
  Synthetic
gagcgcagcatctcgtccacttcctgccacttggtcatggtgcagaccgacgggcgctttggcacccagtcccag

SEQ ID NO: 153060 - DNA, 75 bp, Artificial Sequence
  Synthetic
gtgatgaggaacaggaggaacaggagttgtcgctgtgagttgtgttgttgggcaggtgtggtggatgacgtgtgg

SEQ ID NO: 153061 - DNA, 75 bp, Artificial Sequence
  Synthetic
gccacttggtcatggtgcagaccgacgggcgctttggcacccagtcccaggccacggtgaacttgggggtcgtga

SEQ ID NO: 153062 - DNA, 75 bp, Artificial Sequence
  Synthetic
gttgtcgctgtgagttgtgttgttgggcaggtgtggtggatgacgtgtggacgaggaaccggagtgcgccgtgct

SEQ ID NO: 153063 - DNA, 75 bp, Artificial Sequence
  Synthetic
ggcccgggccttggtggtgaggtcgcgcgcgtagaagccgtcgacctgcttgaagcggtcggcggcgtagctggt

SEQ ID NO: 153064 - DNA, 75 bp, Artificial Sequence
  Synthetic
cgcgcgtagaagccgtcgacctgcttgaagcggtcggcggcgtagctggtgtgttcggtgtgcgacccctcccgg

SEQ ID NO: 153065 - DNA, 75 bp, Artificial Sequence
  Synthetic
gaggagcggccagaccccgaaaacgggccccccccaaaacacacccccgggggtcgcgcgcggccctttaaagcg

SEQ ID NO: 153066 - DNA, 75 bp, Artificial Sequence
  Synthetic
caaagtcgccagtcgccagcacaaactcgtcgtacgggtacaccgagcgcgcgtccacctcctcgacgatgcagt

SEQ ID NO: 153067 - DNA, 75 bp, Artificial Sequence
  Synthetic
ctcgtcgtacgggtacaccgagcgcgcgtccacctcctcgacgatgcagtttaccgtcgtcccgtaccggtggaa

SEQ ID NO: 153068 - DNA, 75 bp, Artificial Sequence
  Synthetic
ttgaggtcggtggtgtgccagccccggctcgtgcgggtcgcggcgttggccggtttcagctccatgtcggtctcg

SEQ ID NO: 153069 - DNA, 75 bp, Artificial Sequence
  Synthetic
ggctcgtgcgggtcgcggcgttggccggtttcagctccatgtcggtctcgtggtcgtcccggtgaaacgcggtgg

SEQ ID NO: 153070 - DNA, 75 bp, Artificial Sequence
  Synthetic
ggccgtggaccgacagacccccttggcgttgatcttgtcgatcacctcctcgaaggggacgggggcgcggtcctc

SEQ ID NO: 153071 - DNA, 75 bp, Artificial Sequence
  Synthetic
gcgttgatcttgtcgatcacctcctcgaaggggacgggggcgcggtcctcaaagatccccataaactgggagtag

SEQ ID NO: 153072 - DNA, 75 bp, Artificial Sequence
  Synthetic
cggtgacgtctttgtagtacatggtggccttgaacttgtacggggcgatgttctccttgaagaccaccgcgatgc

SEQ ID NO: 153073 - DNA, 75 bp, Artificial Sequence
  Synthetic
ggccttgaacttgtacggggcgatgttctccttgaagaccaccgcgatgccctccgtgtagttctgaccctcggg

SEQ ID NO: 153074 - DNA, 75 bp, Artificial Sequence
  Synthetic
tcgaactgcaccaccgtggcgcccgtggggggtgggcacacgtaaaagtttgcatcggtgttctccgccttgatg

SEQ ID NO: 153075 - DNA, 75 bp, Artificial Sequence
  Synthetic
gacgacgactggccggacagccccccgcccgagccggcgccagaggcccggcccaccgccgccgccccccggccc

SEQ ID NO: 153076 - DNA, 75 bp, Artificial Sequence
  Synthetic
cgcccgagccggcgccagaggcccggcccaccgccgccgccccccggccccggcccccaccgcccggcgtgggcc

SEQ ID NO: 153077 - DNA, 75 bp, Artificial Sequence
  Synthetic
gggtttttcggttttttgttcttcttcggtttcgggtcccccgttggggcggcgccaagggcgggcggcgccgga

SEQ ID NO: 153078 - DNA, 75 bp, Artificial Sequence
  Synthetic
gggtcgcggccgcgaccccaggcgtgccgggggaactcggagccgccgacgccaccaggacccccagcgtcaacc

SEQ ID NO: 153079 - DNA, 75 bp, Artificial Sequence
  Synthetic
gccgggggaactcggagccgccgacgccaccaggacccccagcgtcaaccccaagagcgcccatacgacgaacca

SEQ ID NO: 153080 - DNA, 75 bp, Artificial Sequence
  Synthetic
tggtgcatggcgggactacgggggcccgtcgtgccccccgtcaggtagcctgggggcgaggtgctggaggaccga

SEQ ID NO: 153081 - DNA, 75 bp, Artificial Sequence
  Synthetic
ccgtcgtgccccccgtcaggtagcctgggggcgaggtgctggaggaccgagtagaggatcgagaaaacgtcgcgg

SEQ ID NO: 153082 - DNA, 75 bp, Artificial Sequence
  Synthetic
cgatacagccgtcgggggcgctctcgacgatggccaccagcggacagtcggagtcgtacgtgagatatacgccgg

SEQ ID NO: 153083 - DNA, 75 bp, Artificial Sequence
  Synthetic
gacgatggccaccagcggacagtcggagtcgtacgtgagatatacgccgggcgggtaacggtaacgaccttcgga

SEQ ID NO: 153084 - DNA, 75 bp, Artificial Sequence
  Synthetic
cgcaactcgagctccccgcaccggtagaccgaggcaaagagtgtggtggcgataatcagctcgcgaatatatcgc

SEQ ID NO: 153085 - DNA, 75 bp, Artificial Sequence
  Synthetic
agaccgaggcaaagagtgtggtggcgataatcagctcgcgaatatatcgccaggcggcgcgctgagtgggcgtta

SEQ ID NO: 153086 - DNA, 75 bp, Artificial Sequence
  Synthetic
aaacctctgaaattcgctgacggcccaatcagcacccgagccccccgcccccatgatgaaccgggcgagctcctc

SEQ ID NO: 153087 - DNA, 75 bp, Artificial Sequence
  Synthetic
caatcagcacccgagccccccgcccccatgatgaaccgggcgagctcctccttcaggtgcggcaggagccccacg

SEQ ID NO: 153088 - DNA, 75 bp, Artificial Sequence
  Synthetic
tgttggggggctgggcgaagctgtgggtggagtgatcaaagaggggcccgttgacgagctcgaagaagcgatggg

SEQ ID NO: 153089 - DNA, 75 bp, Artificial Sequence
  Synthetic
ggtggagtgatcaaagaggggcccgttgacgagctcgaagaagcgatgggtgatgctggggagcagggccgggtc

SEQ ID NO: 153090 - DNA, 75 bp, Artificial Sequence
  Synthetic
cgcatgaaccggtgcgcgtcgaacacgcccggcgccgagcggttgtcgatgaccgtgcccgcgcccgccgtcagg

SEQ ID NO: 153091 - DNA, 75 bp, Artificial Sequence
  Synthetic
cgcccggcgccgagcggttgtcgatgaccgtgcccgcgcccgccgtcagggcgcagaagcgcgcgcgcgccgcaa

SEQ ID NO: 153092 - DNA, 75 bp, Artificial Sequence
  Synthetic
cgcgggcagcacctcgccgtggacgctgacccgcagcatcttctcgagctccccgcgctgctcgcggacgcagcg

SEQ ID NO: 153093 - DNA, 75 bp, Artificial Sequence
  Synthetic
ctgacccgcagcatcttctcgagctccccgcgctgctcgcggacgcagcgccccaggctggccaacgaccgcttc

SEQ ID NO: 153094 - DNA, 75 bp, Artificial Sequence
  Synthetic
gtcgctcccgtacgtccgcggccgcttgcgtggcgatgtccccccacgtctcgggcccctgccccccgggcccgc

SEQ ID NO: 153095 - DNA, 75 bp, Artificial Sequence
  Synthetic
ttgcgtggcgatgtccccccacgtctcgggcccctgccccccgggcccgcggcgacggtcttcgtcctcgccccc

SEQ ID NO: 153096 - DNA, 75 bp, Artificial Sequence
  Synthetic
gccccttcctctacggcgacacggtccccgtcgtcgtcggggcccgcgccgcccttgggcgcgtccgccgcgccc

SEQ ID NO: 153097 - DNA, 75 bp, Artificial Sequence
  Synthetic
ccccgtcgtcgtcggggcccgcgccgcccttgggcgcgtccgccgcgccccccgcccccatgcgcgccagcacgc

SEQ ID NO: 153098 - DNA, 75 bp, Artificial Sequence
  Synthetic
ttcggggctgacgaggcgccgcaagagcggcgtcgtcaggtggtggtcgtagcacgcgcggatgagcgcctcgat

SEQ ID NO: 153099 - DNA, 75 bp, Artificial Sequence
  Synthetic
agcggcgtcgtcaggtggtggtcgtagcacgcgcggatgagcgcctcgatctgatcgtcgggtgacgtggcctga

SEQ ID NO: 153100 - DNA, 75 bp, Artificial Sequence
  Synthetic
tatccagcgccgccaggtggctcccgaacgcgcgatcgaaatgctccgcccgccgcccgaacagcgccagttcca

SEQ ID NO: 153101 - DNA, 75 bp, Artificial Sequence
  Synthetic
gaacgcgcgatcgaaatgctccgcccgccgcccgaacagcgccagttccacggccaccgcggcggtctcctgctg

SEQ ID NO: 153102 - DNA, 75 bp, Artificial Sequence
  Synthetic
aggttgctggcaaacgcgtccatggtggtctggccggcgcggtcgccggacgcgagccagaatcgcaattcgctg

SEQ ID NO: 153103 - DNA, 75 bp, Artificial Sequence
  Synthetic
atggcgtacaggccgggcgtggtggcctgaaacacgtcgtgcgcctccagcagggcgtcggcctccttgcggacc

SEQ ID NO: 153104 - DNA, 75 bp, Artificial Sequence
  Synthetic
gctgcccgtcgccccccgcggtccgggccagcgcatggtccaacacggagagcgcccgcgcgcggtcggcgtccg

SEQ ID NO: 153105 - DNA, 75 bp, Artificial Sequence
  Synthetic
ggccagcgcatggtccaacacggagagcgcccgcgcgcggtcggcgtccgacagcccggcggcgtggggcaggta

SEQ ID NO: 153106 - DNA, 75 bp, Artificial Sequence
  Synthetic
atacacagagacacgcccccacaacaaacacacagggaccggggtcgccgtgttgggggcgtggtccccactgac

SEQ ID NO: 153107 - DNA, 75 bp, Artificial Sequence
  Synthetic
cgcacctgcgcctgctgggtgacgtggttacagatacggtccgccaggcggcgggcgatcgtcgccccctggttc

SEQ ID NO: 153108 - DNA, 75 bp, Artificial Sequence
  Synthetic
ggttacagatacggtccgccaggcggcgggcgatcgtcgccccctggttcgccgtcacacacagttcctcgaaac

SEQ ID NO: 153109 - DNA, 75 bp, Artificial Sequence
  Synthetic
gctaagctccggggggacgataaggcccgaccccaccgcccccaccataaactcccgaacgcgctccagcgcggc

SEQ ID NO: 153110 - DNA, 75 bp, Artificial Sequence
  Synthetic
cccgaccccaccgcccccaccataaactcccgaacgcgctccagcgcggcggtggcgccgcgcgagggggtgatg

SEQ ID NO: 153111 - DNA, 75 bp, Artificial Sequence
  Synthetic
cccagaccacctttggttgcagacccctttctcccccctcttccgaggccagcaggggggcaggactttgtgagg

SEQ ID NO: 153112 - DNA, 75 bp, Artificial Sequence
  Synthetic
cctttctcccccctcttccgaggccagcaggggggcaggactttgtgaggcgggggggggagagggggaactcgt

SEQ ID NO: 153113 - DNA, 75 bp, Artificial Sequence
  Synthetic
gaaagttctcgacgtcgtgcaggaaacacagctccatatggacggtcccgccatacgtatccagcctgacccgtt

SEQ ID NO: 153114 - DNA, 75 bp, Artificial Sequence
  Synthetic
acacagctccatatggacggtcccgccatacgtatccagcctgacccgttggtgatacggacagggtcgggccag

SEQ ID NO: 153115 - DNA, 75 bp, Artificial Sequence
  Synthetic
ccccccattcttacccgccccccttttttccccttagcccgccccggatgtctgggtgtttccctgcgaccgaga

SEQ ID NO: 153116 - DNA, 75 bp, Artificial Sequence
  Synthetic
gcgacgtctcccgcggtcgcgaacgtctccaggctgcccaggagccgctcgccctcgcgccacgcgtactctagc

SEQ ID NO: 153117 - DNA, 75 bp, Artificial Sequence
  Synthetic
tctccaggctgcccaggagccgctcgccctcgcgccacgcgtactctagcagcaactccagggtgaccgacagcg

SEQ ID NO: 153118 - DNA, 75 bp, Artificial Sequence
  Synthetic
ctccaggcccggcctcagacgacgccgcagcgcccgcacctgaagcgcgttcagcttcagttgggggagcttccc

SEQ ID NO: 153119 - DNA, 75 bp, Artificial Sequence
  Synthetic
cgcagcgcccgcacctgaagcgcgttcagcttcagttgggggagcttcccccgtccgatgtgggggtcgcaccgc

SEQ ID NO: 153120 - DNA, 75 bp, Artificial Sequence
  Synthetic
aggtctgcacctgcccgagcagggctaacaacttttgacgggccacggtgggctcggacaccggggcggccatct

SEQ ID NO: 153121 - DNA, 75 bp, Artificial Sequence
  Synthetic
ggctcggacaccggggcggccatctcgcggcgccgatctgtaccgcggccggagtatgcggtggaccgaggcggt

SEQ ID NO: 153122 - DNA, 75 bp, Artificial Sequence
  Synthetic
agccccggggtccccctcttcggggcggcctcccgcgggcccgccgaccggcaagccgggagtcggcggcgcgtg

SEQ ID NO: 153123 - DNA, 75 bp, Artificial Sequence
  Synthetic
cggcctcccgcgggcccgccgaccggcaagccgggagtcggcggcgcgtgcgtttctgttctattcccagacacc

SEQ ID NO: 153124 - DNA, 75 bp, Artificial Sequence
  Synthetic
gagatatagacacggaacacaaacaagcacggatgtcgtagcaataatttattttacacacattccccgccccgc

SEQ ID NO: 153125 - DNA, 75 bp, Artificial Sequence
  Synthetic
agcacggatgtcgtagcaataatttattttacacacattccccgccccgccctaggttcccccaccccccaaccc

SEQ ID NO: 153126 - DNA, 75 bp, Artificial Sequence
  Synthetic
ggacgaggatgacgacgacctggacgacggtgaggcggggggcggcaaggaccctgggggaggaggaggaggagg

SEQ ID NO: 153127 - DNA, 75 bp, Artificial Sequence
  Synthetic
tccctttttgtcggggggcccctccccaaacgggtcatccccgtggaacgcccgtttgcggccggcaaatgccgg

SEQ ID NO: 153128 - DNA, 75 bp, Artificial Sequence
  Synthetic
ccaaacgggtcatccccgtggaacgcccgtttgcggccggcaaatgccggtcccggggcccccgggccgccgaac

SEQ ID NO: 153129 - DNA, 75 bp, Artificial Sequence
  Synthetic
gggcgaggaaagggcgggccggggagggggcgtaacctgatcgcgccccccgttgtctcttgcagcagactacgt

SEQ ID NO: 153130 - DNA, 75 bp, Artificial Sequence
  Synthetic
caaaatccccaaagttaaacacctccccggcgttgccgagttggctgactagggcctcggcctcgtgcgccacct

SEQ ID NO: 153131 - DNA, 75 bp, Artificial Sequence
  Synthetic
gccgttgccgcgctccagggcacgcgcggtcagctccatcatctcctcgcttaggtactcgtcctccaggagcgc

SEQ ID NO: 153132 - DNA, 75 bp, Artificial Sequence
  Synthetic
tgggtgcggggccccaggcttttcacggtcgccacgaacacgctactggcgacggccgccccgccctcggagata

SEQ ID NO: 153133 - DNA, 75 bp, Artificial Sequence
  Synthetic
gacggccgccccgccctcggagataatgccccggagctgctcgcacagcgagctttcgtgcgctccgccgccgag

SEQ ID NO: 153134 - DNA, 75 bp, Artificial Sequence
  Synthetic
gcccggggacaggccaggacgaacttgcgggtgcggtcaaaaataaggagcgggcacgcgtttttgccgcccatc

SEQ ID NO: 153135 - DNA, 75 bp, Artificial Sequence
  Synthetic
tgcgggtgcggtcaaaaataaggagcgggcacgcgtttttgccgcccatcaggctggcccagttcccggcctgaa

SEQ ID NO: 153136 - DNA, 75 bp, Artificial Sequence
  Synthetic
gtagtatttgctgatgctcaaccccaacacgaccatggggcgcgccgccatgacgggccgcagcaggttgcagct

SEQ ID NO: 153137 - DNA, 75 bp, Artificial Sequence
  Synthetic
gcagcgacggcgggaccgccgtcgttgcattcgggggaaccccacgtcgctcggcggggacgtctaccggtaccc

SEQ ID NO: 153138 - DNA, 75 bp, Artificial Sequence
  Synthetic
tgacgggccgcagcaggttgcagctggcgaacatggacgtccacgcgcccggatgcgcgtccacggcgtccatca

SEQ ID NO: 153139 - DNA, 75 bp, Artificial Sequence
  Synthetic
gcgcgcgggccccggcctccaggcccgccccgccctgcgcggaccacgcggccgccgcctgcacgctggggggac

SEQ ID NO: 153140 - DNA, 75 bp, Artificial Sequence
  Synthetic
cgccccgccctgcgcggaccacgcggccgccgcctgcacgctggggggacggcgggaccccgcgatgatggccgt

SEQ ID NO: 153141 - DNA, 75 bp, Artificial Sequence
  Synthetic
tgatcgcagtaccgcagaatctggtttgccatgtagtacatcgccagctcgctcacgttgttgggggccaggtta

SEQ ID NO: 153142 - DNA, 75 bp, Artificial Sequence
  Synthetic
ttgccatgtagtacatcgccagctcgctcacgttgttgggggccaggttaataaagtttatcgcgccgtagtcca

SEQ ID NO: 153143 - DNA, 75 bp, Artificial Sequence
  Synthetic
ggtctcgatgtcctcgcgcgacaggagccgggcgggaagctggttgcgttggagggccgtccagaaccactgcgg

SEQ ID NO: 153144 - DNA, 75 bp, Artificial Sequence
  Synthetic
agccgggcgggaagctggttgcgttggagggccgtccagaaccactgcgggttcggctggttggaccccgggggc

SEQ ID NO: 153145 - DNA, 75 bp, Artificial Sequence
  Synthetic
gagcaatgacaccgcgcccctggatgtttgccccgggacccccggcccgggcgccgacgccggtggtccctcagc

SEQ ID NO: 153146 - DNA, 75 bp, Artificial Sequence
  Synthetic
ggaactgcttcagcagaaagcccagcggtccgaggaggatgtccacgcgcttgtcgggcttctggtaggcgctct

SEQ ID NO: 153147 - DNA, 75 bp, Artificial Sequence
  Synthetic
cggtccgaggaggatgtccacgcgcttgtcgggcttctggtaggcgctctggaggctggcgacccgcgccttggc

SEQ ID NO: 153148 - DNA, 75 bp, Artificial Sequence
  Synthetic
cccgcgaacaacacgcggctcttgacgcgcagctccttgggaaaccccagggtcacgcgggcaacgtcgccctcg

SEQ ID NO: 153149 - DNA, 75 bp, Artificial Sequence
  Synthetic
cgcgcagctccttgggaaaccccagggtcacgcgggcaacgtcgccctcgaagctgctctcggcgggggccgtct

SEQ ID NO: 153150 - DNA, 75 bp, Artificial Sequence
  Synthetic
gatagccgccccctccgagagcgcgaccgtcagcgttttggccgacagaaacccgttgttaaacatgtccatcac

SEQ ID NO: 153151 - DNA, 75 bp, Artificial Sequence
  Synthetic
cccgcacgcgtacgggtccagcgtcagggacatggcgtggttggcctcgcccagaccgtcgcgaaacttgaagtt

SEQ ID NO: 153152 - DNA, 75 bp, Artificial Sequence
  Synthetic
agggacatggcgtggttggcctcgcccagaccgtcgcgaaacttgaagttcctcccctccaccaggttgcgcatc

SEQ ID NO: 153153 - DNA, 75 bp, Artificial Sequence
  Synthetic
cctgcctgacgttgttcaccaccgtatgcagggcctcgcggttggtgatgatggtctccagccgccccatggccg

SEQ ID NO: 153154 - DNA, 75 bp, Artificial Sequence
  Synthetic
atgcagggcctcgcggttggtgatgatggtctccagccgccccatggccgtggggaccgcctggtccacgtactg

SEQ ID NO: 153155 - DNA, 75 bp, Artificial Sequence
  Synthetic
cgctcggtcgccgcgcggtacgtctcctgcatgatggtccgggcggtctcggatccgtccgcgcgcttcagggcc

SEQ ID NO: 153156 - DNA, 75 bp, Artificial Sequence
  Synthetic
cctgcatgatggtccgggcggtctcggatccgtccgcgcgcttcagggccgagaaggcggcgtagtttcccagca

SEQ ID NO: 153157 - DNA, 75 bp, Artificial Sequence
  Synthetic
catggtcccgaagacgccgatggctccgcgggcggcgctggcgaacttgggatggcgcgcccggaggcgcatgag

SEQ ID NO: 153158 - DNA, 75 bp, Artificial Sequence
  Synthetic
ccgcgggcggcgctggcgaacttgggatggcgcgcccggaggcgcatgagcgtcgtgtgtacgcaggcgtggcgc

SEQ ID NO: 153159 - DNA, 75 bp, Artificial Sequence
  Synthetic
gcacgtcggtctggttggagtccgcgacgtatcgaaacacgtccatctcctggcgcccgacgatcacgccgccgt

SEQ ID NO: 153160 - DNA, 75 bp, Artificial Sequence
  Synthetic
gccatcctcgcccgcaacgggggcatcgggctatgcgtgcaggcgtttaacgactccggccccgggaccgccagc

SEQ ID NO: 153161 - DNA, 75 bp, Artificial Sequence
  Synthetic
gacgtatcgaaacacgtccatctcctggcgcccgacgatcacgccgccgtcgcagcgctccaggtaaaacagcat

SEQ ID NO: 153162 - DNA, 75 bp, Artificial Sequence
  Synthetic
ccacacagcatggccaggtgctcgccggcaaattcctgggttccgccgacgaggggcgcggtgggccgaccctcg

SEQ ID NO: 153163 - DNA, 75 bp, Artificial Sequence
  Synthetic
cggcaaattcctgggttccgccgacgaggggcgcggtgggccgaccctcgaacccgggcaccacgtgtccctcgc

SEQ ID NO: 153164 - DNA, 75 bp, Artificial Sequence
  Synthetic
gtgggtcccgggcacgaggaagaagcggtaaaaggagggtttgctgtggtcctttgggtccgccggaccggcgtc

SEQ ID NO: 153165 - DNA, 75 bp, Artificial Sequence
  Synthetic
ggaggggtggcggggcgggacggggcgcccaaaagggggtcggccacaccacagacgtgggtgttggggggtggg

SEQ ID NO: 153166 - DNA, 75 bp, Artificial Sequence
  Synthetic
cggtaaaaggagggtttgctgtggtcctttgggtccgccggaccggcgtcgtccacctcggtgagatggagggcc

SEQ ID NO: 153167 - DNA, 75 bp, Artificial Sequence
  Synthetic
ccacgagtcccgcggcgcgcgccaggtacgccccgacggcgttggcgcgggccgcggccgtgtcctggccctcgc

SEQ ID NO: 153168 - DNA, 75 bp, Artificial Sequence
  Synthetic
gtacgccccgacggcgttggcgcgggccgcggccgtgtcctggccctcgcacagcggccacgcggagatgtcggt

SEQ ID NO: 153169 - DNA, 75 bp, Artificial Sequence
  Synthetic
gacacgatagactcgagggccagggcggcgtctccggccatgacggaggccaggcgctgttcgaacccgcccgcc

SEQ ID NO: 153170 - DNA, 75 bp, Artificial Sequence
  Synthetic
cggcgtctccggccatgacggaggccaggcgctgttcgaacccgcccgccgggcccttgccgccgccgtcgcgcc

SEQ ID NO: 153171 - DNA, 75 bp, Artificial Sequence
  Synthetic
ccccctcccccgcactccccccccccaggcagtaagacccaagcatagagagccaggcacaaaaacacaggcggg

SEQ ID NO: 153172 - DNA, 75 bp, Artificial Sequence
  Synthetic
ggcttcgaaggccgtgaacgtaatgtcggcggggagggcggcgccctcgtggttttcgtcaaacgccaggtgggc

SEQ ID NO: 153173 - DNA, 75 bp, Artificial Sequence
  Synthetic
tcggcggggagggcggcgccctcgtggttttcgtcaaacgccaggtgggcggccgcgcgggccacggcgtccacg

SEQ ID NO: 153174 - DNA, 75 bp, Artificial Sequence
  Synthetic
gcgcttcccccccccccggccgtgtccttgctttccccccgtctcccccccccctcctcctcctcctcctcctcc

SEQ ID NO: 153175 - DNA, 75 bp, Artificial Sequence
  Synthetic
cgggtcccacgaccgcctcgaacaggaggcggttgagggggcggttaaaaaacggaagcgggtaggtaaaattct

SEQ ID NO: 153176 - DNA, 75 bp, Artificial Sequence
  Synthetic
gaggcggttgagggggcggttaaaaaacggaagcgggtaggtaaaattctccccgatcgatcggtggttggcgtt

SEQ ID NO: 153177 - DNA, 75 bp, Artificial Sequence
  Synthetic
aaatccggcatgaacagctgcaacggatacacgggtatgcggtgcacctccgccccgcctatggttaccttgtcc

SEQ ID NO: 153178 - DNA, 75 bp, Artificial Sequence
  Synthetic
gatacacgggtatgcggtgcacctccgccccgcctatggttaccttgtccgagcctcccaggtgcagaaaggtgt

SEQ ID NO: 153179 - DNA, 75 bp, Artificial Sequence
  Synthetic
gccctcggtaacgaccagatacaggagggcgcggtccgggtccaggccgaggcgctcacacagcgcctcccccgt

SEQ ID NO: 153180 - DNA, 75 bp, Artificial Sequence
  Synthetic
ggcgctcacacagcgcctcccccgtcgtctcgtgtttgaggtcgccgggccggggggtgtagtccgaaaagccaa

SEQ ID NO: 153181 - DNA, 75 bp, Artificial Sequence
  Synthetic
agcgagaacaggaaaggcgatggagcccggcagaacaccgaggaaaaaaaaaccacagcgcatgcgccgggccgt

SEQ ID NO: 153182 - DNA, 75 bp, Artificial Sequence
  Synthetic
cctcgccttttcccacccaccccacgcccccactgagcccggtcgatcgacgagcacccccgcccacgcccccgc

SEQ ID NO: 153183 - DNA, 75 bp, Artificial Sequence
  Synthetic
tcgcgtcaggtttggggcctgggtgctggggtccaggtgccggccgccgtgaaagacgtacacggacgagctgta

SEQ ID NO: 153184 - DNA, 75 bp, Artificial Sequence
  Synthetic
ctggggtccaggtgccggccgccgtgaaagacgtacacggacgagctgtagtgcgatggcgtcagtttcagggac

SEQ ID NO: 153185 - DNA, 75 bp, Artificial Sequence
  Synthetic
tgcgagaacccacgaccacggctacgttggcctcaaagccgctctccacggtcaggcccacgaccaggggcgcca

SEQ ID NO: 153186 - DNA, 75 bp, Artificial Sequence
  Synthetic
gttggcctcaaagccgctctccacggtcaggcccacgaccaggggcgccacggcgacgtcggcatcgccgctgcg

SEQ ID NO: 153187 - DNA, 75 bp, Artificial Sequence
  Synthetic
atgccttcggacggacacgcgcgagcgtacacgtatcccaggggcccgggggggaccttgatggtggttgccgtc

SEQ ID NO: 153188 - DNA, 75 bp, Artificial Sequence
  Synthetic
ggcaatcggtccgcaaacggaggtaatcccggcacgacgacggacgcccgacgaggtatgtctcccgagcgtcaa

SEQ ID NO: 153189 - DNA, 75 bp, Artificial Sequence
  Synthetic
atcccggcacgacgacggacgcccgacgaggtatgtctcccgagcgtcaaaatccgggggggggggcggcgacgg

SEQ ID NO: 153190 - DNA, 75 bp, Artificial Sequence
  Synthetic
tcaaggggagggtgggagaccggggttggggaatgaatccctacccttcacagacaacccccgggtaaccacggg

SEQ ID NO: 153191 - DNA, 75 bp, Artificial Sequence
  Synthetic
aacgcggggtccctgcgagaggcacagatgcttacggtcaggtgctccgggccgggtgcgtctgatatgcggttg

SEQ ID NO: 153192 - DNA, 75 bp, Artificial Sequence
  Synthetic
gtatatgtacactttacctgggggcgtgccggaccgccccagcccctcccacaccccgcgcgtcatcagccggtg

SEQ ID NO: 153193 - DNA, 75 bp, Artificial Sequence
  Synthetic
acaccccgcgcgtcatcagccggtgggcgtggccgctattataaaaaaagtgagaacgcgaagcgttcgcacttt

SEQ ID NO: 153194 - DNA, 75 bp, Artificial Sequence
  Synthetic
atcctccccctaagcgccggccggccgctggtctgttttttgttttccccgtttcgggggggggggggttgcggt

SEQ ID NO: 153195 - DNA, 75 bp, Artificial Sequence
  Synthetic
cccaccggctacgtcacgctcctgtcggccgccggcggtccataagcccggccggccgggccgacgcgaataaac

SEQ ID NO: 153196 - DNA, 75 bp, Artificial Sequence
  Synthetic
cggccgccggcggtccataagcccggccggccgggccgacgcgaataaaccgggccgccggccggggcgccgcgc

SEQ ID NO: 153197 - DNA, 75 bp, Artificial Sequence
  Synthetic
gaggagactggggtgggggtgtcggtgggtggttgttttttgtggttgtttttgtgtctgttcccgtcccccgtc

SEQ ID NO: 153198 - DNA, 75 bp, Artificial Sequence
  Synthetic
gacaaacaaggcccttgcacatgccggcccgggcgagcctgggggtccggtaattttgccatcccacccaagcgg

SEQ ID NO: 153199 - DNA, 75 bp, Artificial Sequence
  Synthetic
ccaaggggccccgggccggggccccacaacggcccggcgcatgcgctgtgttttttttttctcggtgttctgccg

SEQ ID NO: 153200 - DNA, 75 bp, Artificial Sequence
  Synthetic
gttcgggtgggaacaaccgcgatgttttccggtggcggcggcccgctgtcccccggaggaaagtcggcggccagg

SEQ ID NO: 153201 - DNA, 75 bp, Artificial Sequence
  Synthetic
tttccggtggcggcggcccgctgtcccccggaggaaagtcggcggccagggcggcgtccgggttttttgcgcccg

SEQ ID NO: 153202 - DNA, 75 bp, Artificial Sequence
  Synthetic
acccccgccttgtttgaggcaaaacttttacaacccctacctcgccccagtcgggacgcaacagaagccgaccgg

SEQ ID NO: 153203 - DNA, 75 bp, Artificial Sequence
  Synthetic
ttttacaacccctacctcgccccagtcgggacgcaacagaagccgaccgggccaacccagcgccatacgtactat

SEQ ID NO: 153204 - DNA, 75 bp, Artificial Sequence
  Synthetic
tcgccccgcgggtgctggacgaggatgcccccccggagaagcgcgccggggtgcacgacggtcacctcaagcgcg

SEQ ID NO: 153205 - DNA, 75 bp, Artificial Sequence
  Synthetic
tgcccccccggagaagcgcgccggggtgcacgacggtcacctcaagcgcgcccccaaggtgtactgcggggggga

SEQ ID NO: 153206 - DNA, 75 bp, Artificial Sequence
  Synthetic
tcgggcggcttctggccgcggcgctcgcgcctgtggggcggcgtggaccacgccccggcggggttcaaccccacc

SEQ ID NO: 153207 - DNA, 75 bp, Artificial Sequence
  Synthetic
cgcgcctgtggggcggcgtggaccacgccccggcggggttcaaccccaccgtcaccgtctttcacgtgtacgaca

SEQ ID NO: 153208 - DNA, 75 bp, Artificial Sequence
  Synthetic
accaccgacacctcccgcgcacccccgcccacatccccccccaacccgcaccaccagcacgggttgggggtagca

SEQ ID NO: 153209 - DNA, 75 bp, Artificial Sequence
  Synthetic
cgcccacatccccccccaacccgcaccaccagcacgggttgggggtagcaggggatcaaaggggggcaaagccgg

SEQ ID NO: 153210 - DNA, 75 bp, Artificial Sequence
  Synthetic
cggcatgcgcgcggcccagttccacgcgcggtttatggacgccatcacaccgacggggaccgtcatcacgctcct

SEQ ID NO: 153211 - DNA, 75 bp, Artificial Sequence
  Synthetic
gggcctgactccggaaggccaccgggtggccgttcacgtttacggcacgcggcagtacttttacatgaacaagga

SEQ ID NO: 153212 - DNA, 75 bp, Artificial Sequence
  Synthetic
gcgggagaccaagtaggcccgcccatccgcggcccctcccggcagccacgcccccagcgtcgggtgtcacgggga

SEQ ID NO: 153213 - DNA, 75 bp, Artificial Sequence
  Synthetic
cgcgccccacgagatctctgcgagcgcatggccgcggccctgcgcgagtccccgggcgcgtcgttccgcggcatc

SEQ ID NO: 153214 - DNA, 75 bp, Artificial Sequence
  Synthetic
gcatggccgcggccctgcgcgagtccccgggcgcgtcgttccgcggcatctccgcggaccacttcgaggcggagg

SEQ ID NO: 153215 - DNA, 75 bp, Artificial Sequence
  Synthetic
ctacgagacgcgccccgctctgttttaccgcgtctacgtccgaagcgggcgcgtgctgtcgtacctgtgcgacaa

SEQ ID NO: 153216 - DNA, 75 bp, Artificial Sequence
  Synthetic
taccgcgtctacgtccgaagcgggcgcgtgctgtcgtacctgtgcgacaacttctgcccggccatcaagaagtac

SEQ ID NO: 153217 - DNA, 75 bp, Artificial Sequence
  Synthetic
ggttcatcctggacaaccccgggttcgtcaccttcggctggtaccgtctcaaaccgggccggaacaacacgctag

SEQ ID NO: 153218 - DNA, 75 bp, Artificial Sequence
  Synthetic
cgggacatccagcgacgtcgagtttaactgtacggcggacaacctggccatcgaggggggcatgagcgacctacc

SEQ ID NO: 153219 - DNA, 75 bp, Artificial Sequence
  Synthetic
aactgtacggcggacaacctggccatcgaggggggcatgagcgacctaccggcatacaagctcatgtgcttcgat

SEQ ID NO: 153220 - DNA, 75 bp, Artificial Sequence
  Synthetic
ggcatacaagctcatgtgcttcgatatcgaatgcaaggcggggggggaggacgagctggcctttccggtggccgg

SEQ ID NO: 153221 - DNA, 75 bp, Artificial Sequence
  Synthetic
atatcctgtctgctctacgacctgtccaccaccgccctggagcacgtcctcctgttttcgctcggttcctgcgac

SEQ ID NO: 153222 - DNA, 75 bp, Artificial Sequence
  Synthetic
ctccccgaatcccacctgaacgagctggcggccaggggcctgcccacgcccgtggttctggaattcgacagcgaa

SEQ ID NO: 153223 - DNA, 75 bp, Artificial Sequence
  Synthetic
cgtggttctggaattcgacagcgaattcgagatgctgttggccttcatgacccttgtgaaacagtacggccccga

SEQ ID NO: 153224 - DNA, 75 bp, Artificial Sequence
  Synthetic
ttcgagatgctgttggccttcatgacccttgtgaaacagtacggccccgagttcgtgaccgggtacaacatcatc

SEQ ID NO: 153225 - DNA, 75 bp, Artificial Sequence
  Synthetic
ccaagctgacggacatttacaaggtccccctggacgggtacggccgcatgaacggccggggcgtgtttcgcgtgt

SEQ ID NO: 153226 - DNA, 75 bp, Artificial Sequence
  Synthetic
ccccctggacgggtacggccgcatgaacggccggggcgtgtttcgcgtgtgggacataggccagagccacttcca

SEQ ID NO: 153227 - DNA, 75 bp, Artificial Sequence
  Synthetic
cgcccatcatcgccacgtcggaccccaccccgcgacgggacgccgccacaaaaagcagacgccgacgaccccact

SEQ ID NO: 153228 - DNA, 75 bp, Artificial Sequence
  Synthetic
ggcatggtgaacatcgacatgtacgggatcataaccgacaagatcaagctctcgagctacaagctcaacgccgtg

SEQ ID NO: 153229 - DNA, 75 bp, Artificial Sequence
  Synthetic
ggatcataaccgacaagatcaagctctcgagctacaagctcaacgccgtggccgaagccgtcctgaaggacaaga

SEQ ID NO: 153230 - DNA, 75 bp, Artificial Sequence
  Synthetic
ccccgcctactacgccaccgggcccgcgcaacgcggggtgatcggcgagtactgcatacaggattccctgctggt

SEQ ID NO: 153231 - DNA, 75 bp, Artificial Sequence
  Synthetic
gcgcaacgcggggtgatcggcgagtactgcatacaggattccctgctggtgggccagctgttttttaagtttttg

SEQ ID NO: 153232 - DNA, 75 bp, Artificial Sequence
  Synthetic
cgcgggagtcggggccgaggaggaagaggcagaggaggaagaggcggaggccgccgaggacgtcaggggggtccc

SEQ ID NO: 153233 - DNA, 75 bp, Artificial Sequence
  Synthetic
cgcgcttggcgggtattaacatcacccgcaccatctacgacggccagcagatccgcgtctttacgtgcctgctgc

SEQ ID NO: 153234 - DNA, 75 bp, Artificial Sequence
  Synthetic
ccgcaccatctacgacggccagcagatccgcgtctttacgtgcctgctgcgcctggccgaccagaagggctttat

SEQ ID NO: 153235 - DNA, 75 bp, Artificial Sequence
  Synthetic
aggggcgccgggggggaggcgcccaagcgtccggccgcagcccgggaggacgaggagcggccagaggaggagggg

SEQ ID NO: 153236 - DNA, 75 bp, Artificial Sequence
  Synthetic
agcgtccggccgcagcccgggaggacgaggagcggccagaggaggagggggaggacgaggacgaacgcgaggagg

SEQ ID NO: 153237 - DNA, 75 bp, Artificial Sequence
  Synthetic
cgcgcgggagaccgccggccggcacgtggggtaccagggggccagggtccttgaccccacttccgggtttcacgt

SEQ ID NO: 153238 - DNA, 75 bp, Artificial Sequence
  Synthetic
gtggggtaccagggggccagggtccttgaccccacttccgggtttcacgtgaaccccgtggtggtgttcgacttt

SEQ ID NO: 153239 - DNA, 75 bp, Artificial Sequence
  Synthetic
aggcccacaacctgtgcttcagcacgctctccctgagggccgacgcagtggcgcacctggaggcgggcaaggact

SEQ ID NO: 153240 - DNA, 75 bp, Artificial Sequence
  Synthetic
gctctccctgagggccgacgcagtggcgcacctggaggcgggcaaggactacctggagatcgaggtgggggggcg

SEQ ID NO: 153241 - DNA, 75 bp, Artificial Sequence
  Synthetic
gacaataatccgttaggggacgctctttataatttcgatggcccaactccacgcggattggtgcagcaccctgca

SEQ ID NO: 153242 - DNA, 75 bp, Artificial Sequence
  Synthetic
gtgcgagagagcctcctcagcatcctcctgcgggactggctcgccatgcgaaagcagatccgctcgcggattccc

SEQ ID NO: 153243 - DNA, 75 bp, Artificial Sequence
  Synthetic
tcctgcgggactggctcgccatgcgaaagcagatccgctcgcggattccccagagcagccccgaggaggccgtgc

SEQ ID NO: 153244 - DNA, 75 bp, Artificial Sequence
  Synthetic
caaggtcgtgtgtaactcggtgtacgggttcacgggagtgcagcacggactcctgccgtgcctgcacgttgccgc

SEQ ID NO: 153245 - DNA, 75 bp, Artificial Sequence
  Synthetic
gggttcacgggagtgcagcacggactcctgccgtgcctgcacgttgccgcgacggtgacgaccatcggccgcgag

SEQ ID NO: 153246 - DNA, 75 bp, Artificial Sequence
  Synthetic
tccacgcgcgctgggcggccttcgaacagctcctggccgatttcccggaggcggccgacatgcgcgcccccgggc

SEQ ID NO: 153247 - DNA, 75 bp, Artificial Sequence
  Synthetic
acagctcctggccgatttcccggaggcggccgacatgcgcgcccccgggccctattccatgcgcatcatctacgg

SEQ ID NO: 153248 - DNA, 75 bp, Artificial Sequence
  Synthetic
tctgctgcaagagacaacggggggcgcgatcaggttacgccccctccccggcccgccctttcctcgcccccccgc

SEQ ID NO: 153249 - DNA, 75 bp, Artificial Sequence
  Synthetic
tgccgcggcctcacggccgccgggctgacggccatgggcgacaagatggcgagccacatctcgcgcgcgctgttt

SEQ ID NO: 153250 - DNA, 75 bp, Artificial Sequence
  Synthetic
gagccacatctcgcgcgcgctgtttctgccccccatcaaactcgagtgcgaaaagacgttcaccaagctgctgct

SEQ ID NO: 153251 - DNA, 75 bp, Artificial Sequence
  Synthetic
tcctcctcccccagggtcctcgccgccccccgcctcaccgtcgtccaggtcgtcgtcatcctcgtccgtggtggg

SEQ ID NO: 153252 - DNA, 75 bp, Artificial Sequence
  Synthetic
gatcgccaagaaaaagtacatcggcgtcatctacgggggtaagatgctcatcaagggcgtggatctggtgcgcaa

SEQ ID NO: 153253 - DNA, 75 bp, Artificial Sequence
  Synthetic
tcaagggcgtggatctggtgcgcaaaaacaactgcgcgtttatcaaccgcacctccagggccctggtcgacctgc

SEQ ID NO: 153254 - DNA, 75 bp, Artificial Sequence
  Synthetic
agcggccgccgcgttagccgagcgccccgcagaggagtggctggcgcgacccctgcccgagggactgcaggcgtt

SEQ ID NO: 153255 - DNA, 75 bp, Artificial Sequence
  Synthetic
cccgcagaggagtggctggcgcgacccctgcccgagggactgcaggcgttcggggccgtcctcgtagacgcccat

SEQ ID NO: 153256 - DNA, 75 bp, Artificial Sequence
  Synthetic
acatccaggactttgtcctcaccgccgaactgagcagacacccgcgcgcgtacaccaacaagcgcctggcccacc

SEQ ID NO: 153257 - DNA, 75 bp, Artificial Sequence
  Synthetic
cgaactgagcagacacccgcgcgcgtacaccaacaagcgcctggcccacctgacggtgtattacaagctcatggc

SEQ ID NO: 153258 - DNA, 75 bp, Artificial Sequence
  Synthetic
aaggaccggatcccgtacgtgatcgtggcccagacccgcgaggtagaggagacggtcgcgcggctggccgccctc

SEQ ID NO: 153259 - DNA, 75 bp, Artificial Sequence
  Synthetic
tggcccagacccgcgaggtagaggagacggtcgcgcggctggccgccctccgcgagctagacgccgccgccccag

SEQ ID NO: 153260 - DNA, 75 bp, Artificial Sequence
  Synthetic
cctgccctccccggccaagcgcccccgggagacgccgtcgcatgccgaccccccgggaggcgcgtccaagccccg

SEQ ID NO: 153261 - DNA, 75 bp, Artificial Sequence
  Synthetic
cgggagacgccgtcgcatgccgaccccccgggaggcgcgtccaagccccgcaagctgctggtgtccgagctggcc

SEQ ID NO: 153262 - DNA, 75 bp, Artificial Sequence
  Synthetic
cgctgtccggcaggtctcggtcgcagggaaacacccagacgtccggggcgggctgaggggaaaaaaggggggggt

SEQ ID NO: 153263 - DNA, 75 bp, Artificial Sequence
  Synthetic
gggaaacacccagacgtccggggcgggctgaggggaaaaaaggggggggtgggtaagaatgggggggatttcccg

SEQ ID NO: 153264 - DNA, 75 bp, Artificial Sequence
  Synthetic
acggcgtcgccctgaacacggactattacttctcccacctgttgggggcggcgtgcgtgacattcaaggccctgt

SEQ ID NO: 153265 - DNA, 75 bp, Artificial Sequence
  Synthetic
ttacttctcccacctgttgggggcggcgtgcgtgacattcaaggccctgtttgggaataacgccaagatcaccga

SEQ ID NO: 153266 - DNA, 75 bp, Artificial Sequence
  Synthetic
gaagtgtggcaccccccggacgacgtggccgcgcggctccgggccgcagggttcggggcggtgggtgccggcgct

SEQ ID NO: 153267 - DNA, 75 bp, Artificial Sequence
  Synthetic
tggccgcgcggctccgggccgcagggttcggggcggtgggtgccggcgctacggcggaggaaactcgtcgaatgt

SEQ ID NO: 153268 - DNA, 75 bp, Artificial Sequence
  Synthetic
atgagccccccgtcgaagctgatgtccctcattttacaataaatgtctgcggccgacacggtcggaatctccgcg

SEQ ID NO: 153269 - DNA, 75 bp, Artificial Sequence
  Synthetic
ccctcattttacaataaatgtctgcggccgacacggtcggaatctccgcgtccgtgggtttctctgcgttgcgcc

SEQ ID NO: 153270 - DNA, 75 bp, Artificial Sequence
  Synthetic
ccacacgtgggcgacgaaccggtaccccgggcacgcggtgagcatccggtctatgagccggtagtgcaggtgggc

SEQ ID NO: 153271 - DNA, 75 bp, Artificial Sequence
  Synthetic
cccgggcacgcggtgagcatccggtctatgagccggtagtgcaggtgggcggacgtgccgggaaagatgacgtac

SEQ ID NO: 153272 - DNA, 75 bp, Artificial Sequence
  Synthetic
ccgggtaaaacaacagccgcgggtcgcacgccccgcctccgcgcaggatcgtgtggacgaaaaaaagctcgggtt

SEQ ID NO: 153273 - DNA, 75 bp, Artificial Sequence
  Synthetic
gcacgccccgcctccgcgcaggatcgtgtggacgaaaaaaagctcgggttggccaagaatcccggccaagaggtc

SEQ ID NO: 153274 - DNA, 75 bp, Artificial Sequence
  Synthetic
gccaacacgaccaaggaggccaggaaggcgcgatgctcgaatatcgtgttgatctgctgcacgaaggccaggatt

SEQ ID NO: 153275 - DNA, 75 bp, Artificial Sequence
  Synthetic
gcgcccggctcccgtgtatgagtgggggtcccccaacatgggggccggttccagggtaagggtcgggggtccccc

SEQ ID NO: 153276 - DNA, 75 bp, Artificial Sequence
  Synthetic
aggcgcgatgctcgaatatcgtgttgatctgctgcacgaaggccaggattagggcctcgcggctggtggcggcga

SEQ ID NO: 153277 - DNA, 75 bp, Artificial Sequence
  Synthetic
actctcccgcgtgtcgcgtgtggttcatgtgtgtgcctggcgcccccaccctcgggttcgtgtatttcctttccc

SEQ ID NO: 153278 - DNA, 75 bp, Artificial Sequence
  Synthetic
gggacagcaacccccgatgcctaggtagtagcccatcccggagagggtcaggcagttgtcggccacggtctggtc

SEQ ID NO: 153279 - DNA, 75 bp, Artificial Sequence
  Synthetic
tagtagcccatcccggagagggtcaggcagttgtcggccacggtctggtccagacagaagggcagcgacacggga

SEQ ID NO: 153280 - DNA, 75 bp, Artificial Sequence
  Synthetic
acgagcgcacgatggcgatctcctcggagggcgtctgggcgagggcggcgaaaaggccccgatagcgctggcgct

SEQ ID NO: 153281 - DNA, 75 bp, Artificial Sequence
  Synthetic
aaaaggccccgatagcgctggcgctcgtgtaaacacagctcctgtttgcgggcgtgaggcggcaggctcttccgg

SEQ ID NO: 153282 - DNA, 75 bp, Artificial Sequence
  Synthetic
tcccgccggccgcagaggagcacgaccgccggcgctccttgccgtgatagggcccgggccgggagccgcggcgat

SEQ ID NO: 153283 - DNA, 75 bp, Artificial Sequence
  Synthetic
ccgccggcgctccttgccgtgatagggcccgggccgggagccgcggcgatgggggtcggtatcatacataggtac

SEQ ID NO: 153284 - DNA, 75 bp, Artificial Sequence
  Synthetic
cgagatcgagtggcgtctaagcagcgcgcccgcctcacggacaaatgtggcgagcgcggtgggctttggtacaaa

SEQ ID NO: 153285 - DNA, 75 bp, Artificial Sequence
  Synthetic
gcgcccgcctcacggacaaatgtggcgagcgcggtgggctttggtacaaatacctgatacgtcttgaaggtgtag

SEQ ID NO: 153286 - DNA, 75 bp, Artificial Sequence
  Synthetic
cacgcccctcgaactcgttcccgcaggccagcttggccttgtggagcagcagctcgtcgggatgggtggcggggg

SEQ ID NO: 153287 - DNA, 75 bp, Artificial Sequence
  Synthetic
ggccagcttggccttgtggagcagcagctcgtcgggatgggtggcggggggatggccgaacagaacccaggggtc

SEQ ID NO: 153288 - DNA, 75 bp, Artificial Sequence
  Synthetic
atggggtcacagaacatgtgcttaaagatggcctcgggccccgcggcccgcagcaggctcacaaaccggcccccg

SEQ ID NO: 153289 - DNA, 75 bp, Artificial Sequence
  Synthetic
tccccgggctgcgtctcggggtccgcctcgagctggtcgacgacgggtacgatacagtcgaagaggctcgtgttg

SEQ ID NO: 153290 - DNA, 75 bp, Artificial Sequence
  Synthetic
gatacagtcgaagaggctcgtgttgttttccgagtagcggaccacggaggcccggagtctgcgcagggccagcca

SEQ ID NO: 153291 - DNA, 75 bp, Artificial Sequence
  Synthetic
ttttccgagtagcggaccacggaggcccggagtctgcgcagggccagccagtaagcccgcaccagtaacaggtta

SEQ ID NO: 153292 - DNA, 75 bp, Artificial Sequence
  Synthetic
gcccgcgcccccggccgtgtttcagcacggtggccatcagagggcccaggtcgaggtcgggctgggcatcgggtt

SEQ ID NO: 153293 - DNA, 75 bp, Artificial Sequence
  Synthetic
cacggtggccatcagagggcccaggtcgaggtcgggctgggcatcgggttcggtaaactgcgcaaagcgcggagc

SEQ ID NO: 153294 - DNA, 75 bp, Artificial Sequence
  Synthetic
tgcgcttcccaggactggcggaccgtggcgcgacgggcctccgcggcagcgcgcagctggggccccgactcccag

SEQ ID NO: 153295 - DNA, 75 bp, Artificial Sequence
  Synthetic
tggcgcgacgggcctccgcggcagcgcgcagctggggccccgactcccagacggcgggggtgccggcgaggagca

SEQ ID NO: 153296 - DNA, 75 bp, Artificial Sequence
  Synthetic
cgtatccggcgactcctccggctcgcggtccccggcgaccgtctcgaattccccgttgcgagcggcggcgcgcgt

SEQ ID NO: 153297 - DNA, 75 bp, Artificial Sequence
  Synthetic
cgaccctccgtgcagtccaggagacgggcgcaatccttccagttcatcagcgcggtggtgagcgacggctgcgtg

SEQ ID NO: 153298 - DNA, 75 bp, Artificial Sequence
  Synthetic
cctcctcgcccccggaggccaaggttccgatgagggcccgggtggcagactgcgccaggaacgagtagttggagt

SEQ ID NO: 153299 - DNA, 75 bp, Artificial Sequence
  Synthetic
tccgatgagggcccgggtggcagactgcgccaggaacgagtagttggagtactgcaccttggcggctcccgggga

SEQ ID NO: 153300 - DNA, 75 bp, Artificial Sequence
  Synthetic
gcatgccgcccgggcaccccgccgtcggtacggaagcagcagtggagaaaaaagtgccggtggatgtcgtttatg

SEQ ID NO: 153301 - DNA, 75 bp, Artificial Sequence
  Synthetic
cggtacggaagcagcagtggagaaaaaagtgccggtggatgtcgtttatggtgagggcaaagcgtgcgaaggagc

SEQ ID NO: 153302 - DNA, 75 bp, Artificial Sequence
  Synthetic
cagaaagtggcggtccatgacgtacacaaactcgaacgcggccacgaagatgctagcggcgcagtggggcgcccc

SEQ ID NO: 153303 - DNA, 75 bp, Artificial Sequence
  Synthetic
tgctagcggcgcagtggggcgcccccaggcatttggcacagagaaacgcgtaatcggccacccactggggcgaga

SEQ ID NO: 153304 - DNA, 75 bp, Artificial Sequence
  Synthetic
ccgcggggggcccgggctgcgccgccgcgctttaaagggccgcgcgcgacccccggggggtgtgtttcggggggg

SEQ ID NO: 153305 - DNA, 75 bp, Artificial Sequence
  Synthetic
ggcggtaggtttgcttgtacagctcgatggtgcggcagaccagacagggccggtccagcgcgaaggtgtcgatgg

SEQ ID NO: 153306 - DNA, 75 bp, Artificial Sequence
  Synthetic
gatggtgcggcagaccagacagggccggtccagcgcgaaggtgtcgatggccgccgcggaaaagggcccggtgtc

SEQ ID NO: 153307 - DNA, 75 bp, Artificial Sequence
  Synthetic
gggggcgggttgcggggtcctccgcgcccgcccgaaccccctccgtcgcccgcccccccgcgggcccttgagggg

SEQ ID NO: 153308 - DNA, 75 bp, Artificial Sequence
  Synthetic
gccgccggccgccttttttgcgcgccgccccgcccgcggggggcccgggctgccacaggtggaacagcaccaaca

SEQ ID NO: 153309 - DNA, 75 bp, Artificial Sequence
  Synthetic
cgcccccccgcgggcccttgagggggcggtgaccacgtcggcggcgacgtcctcgtcgagcgtaccgacgggcgg

SEQ ID NO: 153310 - DNA, 75 bp, Artificial Sequence
  Synthetic
cggccagccccccaacaacccccaagcccacctccacacccaaaagcccccccacgtccacccccgaccccaaac

SEQ ID NO: 153311 - DNA, 75 bp, Artificial Sequence
  Synthetic
acgccacacgtcacgtcatccaccacccactccaacaacacaactcacagcgacaactcaccgcgcaacacctcc

SEQ ID NO: 153312 - DNA, 75 bp, Artificial Sequence
  Synthetic
aggagctcggcgcagagagcctcgttaagagccaggaggctgggatcgaaggccacatacgcgcgctcgaacgcc

SEQ ID NO: 153313 - DNA, 75 bp, Artificial Sequence
  Synthetic
taagagccaggaggctgggatcgaaggccacatacgcgcgctcgaacgcccccgccttccagctgctgccggggg

SEQ ID NO: 153314 - DNA, 75 bp, Artificial Sequence
  Synthetic
caggaccccggggggcgaagttgccatggctgggcgggaggggcgcacgcgccagcgaactttacgggacacaat

SEQ ID NO: 153315 - DNA, 75 bp, Artificial Sequence
  Synthetic
atggctgggcgggaggggcgcacgcgccagcgaactttacgggacacaatccccgactgcgcgctgcggtcccag

SEQ ID NO: 153316 - DNA, 75 bp, Artificial Sequence
  Synthetic
acgtctcgcgagacggcgcgcatgacgcggccgtctggttcgaggatatgacccccgccgagctggaggttgtct

SEQ ID NO: 153317 - DNA, 75 bp, Artificial Sequence
  Synthetic
cgcggccgtctggttcgaggatatgacccccgccgagctggaggttgtcttcccgactacggacgccaagctgaa

SEQ ID NO: 153318 - DNA, 75 bp, Artificial Sequence
  Synthetic
gcctccctcctgacgtacgccgggcctataaaagcgcccgacgacgccgccgccccgcagaccccggacaccgcg

SEQ ID NO: 153319 - DNA, 75 bp, Artificial Sequence
  Synthetic
ctataaaagcgcccgacgacgccgccgccccgcagaccccggacaccgcgtgtgtgcacggcgagctgctcgccc

SEQ ID NO: 153320 - DNA, 75 bp, Artificial Sequence
  Synthetic
cattaaccggttcctggacctgcaccagattctgcggggctgacgcgcgcgctgttgggcgggacggttcgcgaa

SEQ ID NO: 153321 - DNA, 75 bp, Artificial Sequence
  Synthetic
cagattctgcggggctgacgcgcgcgctgttgggcgggacggttcgcgaaccctttggtgggtttacgcgggcac

SEQ ID NO: 153322 - DNA, 75 bp, Artificial Sequence
  Synthetic
gcgggactgggcaagccctaccccggccacccaggtgacgccttcgagggtctcgttcagcgaattcggcttatc

SEQ ID NO: 153323 - DNA, 75 bp, Artificial Sequence
  Synthetic
gccacccaggtgacgccttcgagggtctcgttcagcgaattcggcttatcgtcccatctacgttgcggggcgggg

SEQ ID NO: 153324 - DNA, 75 bp, Artificial Sequence
  Synthetic
ctccagcctcccctccaggtgcgcctttcagtttcatggccatgacgggtccgacgagtcgtttcccatcgagta

SEQ ID NO: 153325 - DNA, 75 bp, Artificial Sequence
  Synthetic
tttcagtttcatggccatgacgggtccgacgagtcgtttcccatcgagtatgtactgcggcttatgaacgactgg

SEQ ID NO: 153326 - DNA, 75 bp, Artificial Sequence
  Synthetic
tgcgcatacagaacaccggcgtgtcggtgctgtttcaggggttttttcatcgcccacacaacgcccccgggggcg

SEQ ID NO: 153327 - DNA, 75 bp, Artificial Sequence
  Synthetic
ggtgctgtttcaggggttttttcatcgcccacacaacgcccccgggggcgcgattacgccagagcggaccaatgt

SEQ ID NO: 153328 - DNA, 75 bp, Artificial Sequence
  Synthetic
gggctgtccctcggcgacctggacaccatcaaggggcggctcggcctggatgcccggccgatgatggccagcatg

SEQ ID NO: 153329 - DNA, 75 bp, Artificial Sequence
  Synthetic
ccatcaaggggcggctcggcctggatgcccggccgatgatggccagcatgtggatcagctgctttgtgcgcatgc

SEQ ID NO: 153330 - DNA, 75 bp, Artificial Sequence
  Synthetic
catgggccccgaagatgccggacggacgagacggatcctgtgccgcgccgccgagcaggctattacccgtcgccg

SEQ ID NO: 153331 - DNA, 75 bp, Artificial Sequence
  Synthetic
acgagacggatcctgtgccgcgccgccgagcaggctattacccgtcgccgccgaacccggcggtcccgggaggcg

SEQ ID NO: 153332 - DNA, 75 bp, Artificial Sequence
  Synthetic
tggctggaacgggtttccgggccaggggggacggttttggcccgctccccttgttaacccaagggccctcccgcc

SEQ ID NO: 153333 - DNA, 75 bp, Artificial Sequence
  Synthetic
gggggacggttttggcccgctccccttgttaacccaagggccctcccgcccgtggcaccaggccctgcggggtct

SEQ ID NO: 153334 - DNA, 75 bp, Artificial Sequence
  Synthetic
gcgctcgttttggcggcgggactcgtcctgggggccgctatttggtgggtggttggtgctggcgcgcgcctataa

SEQ ID NO: 153335 - DNA, 75 bp, Artificial Sequence
  Synthetic
ggttggtgctggcgcgcgcctataaaaaaggacgcaccgccgccctaatcgccagtgcgttccggacgccttcgc

SEQ ID NO: 153336 - DNA, 75 bp, Artificial Sequence
  Synthetic
ccccatatcgcttcccgacctccggtcccgatggccgtcccgcaatttcaccgccccagcaccgttaccaccgat

SEQ ID NO: 153337 - DNA, 75 bp, Artificial Sequence
  Synthetic
tcccgatggccgtcccgcaatttcaccgccccagcaccgttaccaccgatagcgtccgggcgcttggcatgcgcg

SEQ ID NO: 153338 - DNA, 75 bp, Artificial Sequence
  Synthetic
tggggctggtcgcgatcgggggcggggcgggaatggcggcgcgctgcgcgatgtcccgcgtgtgctggtcgaaga

SEQ ID NO: 153339 - DNA, 75 bp, Artificial Sequence
  Synthetic
tcagtttatcatggataacaaccacccgcacccccagggcacccaaggggccgtgcgggagtttctccgcggtca

SEQ ID NO: 153340 - DNA, 75 bp, Artificial Sequence
  Synthetic
ccgtgcgggagtttctccgcggtcaggcggcggcgctgacggaccttggtctggcccacgcaaacaacacgttta

SEQ ID NO: 153341 - DNA, 75 bp, Artificial Sequence
  Synthetic
ccccgcagcctatgttcgcgggcgacgccccggccgcctggttgcggcccgcgtttggcctgcggcgcacctatt

SEQ ID NO: 153342 - DNA, 75 bp, Artificial Sequence
  Synthetic
gacgcccgggaccccgtgaggcccggggagttccttctggggtgttttaatcaataaaagaccacaccaacgcac

SEQ ID NO: 153343 - DNA, 75 bp, Artificial Sequence
  Synthetic
gggagttccttctggggtgttttaatcaataaaagaccacaccaacgcacgagccttgcgtttaatgtcgtgttt

SEQ ID NO: 153344 - DNA, 75 bp, Artificial Sequence
  Synthetic
tcaataaaagaccacaccaacgcacgagccttgcgtttaatgtcgtgtttattcaagggagtgggatagggttcg

SEQ ID NO: 153345 - DNA, 75 bp, Artificial Sequence
  Synthetic
taatcgagcgcgtctagcccagtaacatgcgcacgtgatgtaggctggtcagcacggcgtcgctgtgatgaagca

SEQ ID NO: 153346 - DNA, 75 bp, Artificial Sequence
  Synthetic
catgcgcacgtgatgtaggctggtcagcacggcgtcgctgtgatgaagcagcgcccggcgggtccgctgtaactg

SEQ ID NO: 153347 - DNA, 75 bp, Artificial Sequence
  Synthetic
atcagcaccgccagggcgctacgaccggtgcgttgcacgtagcgtcgcgacagaactgcgtttgccgatacgggc

SEQ ID NO: 153348 - DNA, 75 bp, Artificial Sequence
  Synthetic
cggtgcgttgcacgtagcgtcgcgacagaactgcgtttgccgatacgggcggggggccgaattgtaagcgcgtca

SEQ ID NO: 153349 - DNA, 75 bp, Artificial Sequence
  Synthetic
cgcactgaatggttcgttggttatgggggagtgtggttcccgagggagtgggtcgagcgcctcggcctcggaatc

SEQ ID NO: 153350 - DNA, 75 bp, Artificial Sequence
  Synthetic
ggtcgagcgcctcggcctcggaatccgagaggaacaacgaggtggtgtcggagtcttcgtcgtcagagacataca

SEQ ID NO: 153351 - DNA, 75 bp, Artificial Sequence
  Synthetic
gggggtagcgtcaatgtgtagcgcgagggaggatgcccacgaagacaccccagacaaggagctgcccgtgcgtgg

SEQ ID NO: 153352 - DNA, 75 bp, Artificial Sequence
  Synthetic
acggatgggcggttttgcggtgcccggaaccgaaccgccggatactccccgggtgctacatgcccgttttggggc

SEQ ID NO: 153353 - DNA, 75 bp, Artificial Sequence
  Synthetic
aggagggggcacgtcgccgccggcggtcgcctgtcgggtcccgcgacgttacgggccgggaggcgcgggggcacc

SEQ ID NO: 153354 - DNA, 75 bp, Artificial Sequence
  Synthetic
tgcccccgggggcgcgcagatgtggtgggcgtggccaccggctgccgtgtagtggggcggcgggaaaccgggcct

SEQ ID NO: 153355 - DNA, 75 bp, Artificial Sequence
  Synthetic
agtggggcggcgggaaaccgggcctccgggcgtaacaccgccctccagcgtcaagtatgtggggggcgggcctga

SEQ ID NO: 153356 - DNA, 75 bp, Artificial Sequence
  Synthetic
tcaagtatgtggggggcgggcctgacgtcgggggcggggtgacgggttggaccgcgggaggcgggggagagggac

SEQ ID NO: 153357 - DNA, 75 bp, Artificial Sequence
  Synthetic
ctgcgggagaggatgaggtcggctcggccgggttgcggcctaaaacaggggccgtggggtcggcggggtcccagg

SEQ ID NO: 153358 - DNA, 75 bp, Artificial Sequence
  Synthetic
ggccgggttgcggcctaaaacaggggccgtggggtcggcggggtcccagggtgaagggagggattcccgcgattc

SEQ ID NO: 153359 - DNA, 75 bp, Artificial Sequence
  Synthetic
gtaaggcgccgctgcggcccgcctacgggaaccctggggggggttggcgcgggacccgaggttagcggggggcgg

SEQ ID NO: 153360 - DNA, 75 bp, Artificial Sequence
  Synthetic
ttgggaggggccggggggcgcgcgaaatcggtaaccggggcgaccgtgtcggggagggcaggcggccgccaaccc

SEQ ID NO: 153361 - DNA, 75 bp, Artificial Sequence
  Synthetic
aatcggtaaccggggcgaccgtgtcggggagggcaggcggccgccaaccctgggtggtcgcggaagcctgggtgg

SEQ ID NO: 153362 - DNA, 75 bp, Artificial Sequence
  Synthetic
gtgtcggcgcgcgcgcgacccggacgaagaagcggcagaagcgcgggaggaggcgggggggcggggggcggtggc

SEQ ID NO: 153363 - DNA, 75 bp, Artificial Sequence
  Synthetic
gaagaagcggcagaagcgcgggaggaggcgggggggcggggggcggtggcatcggggggcgccggggaactttgg

SEQ ID NO: 153364 - DNA, 75 bp, Artificial Sequence
  Synthetic
cgcgggggcccacgggcgccggccgcgtgctttcggccgggacgcccggtcgtgcttcgcgagccgtgactgccg

SEQ ID NO: 153365 - DNA, 75 bp, Artificial Sequence
  Synthetic
cgtgctttcggccgggacgcccggtcgtgcttcgcgagccgtgactgccggcccagggggccgcggtgcacactg

SEQ ID NO: 153366 - DNA, 75 bp, Artificial Sequence
  Synthetic
gtgggcgaaagggggtccggggcaaggaggggcgcggggccgccggagtcgtcagacgcgagctcctccaggccg

SEQ ID NO: 153367 - DNA, 75 bp, Artificial Sequence
  Synthetic
ggacgggctcgccgggggtggcgtcggtgaatagcgtgggggccaggcttccgggccccaacgagccctccgtcc

SEQ ID NO: 153368 - DNA, 75 bp, Artificial Sequence
  Synthetic
cgggttcgggaccgaggggctctggtcgtcgggggcgcgctggtacaccggatgccccgggaatagctcccccga

SEQ ID NO: 153369 - DNA, 75 bp, Artificial Sequence
  Synthetic
tcgtcgggggcgcgctggtacaccggatgccccgggaatagctcccccgacaggagggaggcgtcgaacggccgc

SEQ ID NO: 153370 - DNA, 75 bp, Artificial Sequence
  Synthetic
ggtcctcgtcggtggcgctggcggcgaggacgtcctcgccgcccgccacaaacgggagctcctcggtggcctcgc

SEQ ID NO: 153371 - DNA, 75 bp, Artificial Sequence
  Synthetic
gaggacgtcctcgccgcccgccacaaacgggagctcctcggtggcctcgctgccaacaaaccgcacgtcgggggg

SEQ ID NO: 153372 - DNA, 75 bp, Artificial Sequence
  Synthetic
aacaccgcgaccggggtcatggagatgtccacgagcaccagacacggcgggccccgggcgaggggccgctcggcg

SEQ ID NO: 153373 - DNA, 75 bp, Artificial Sequence
  Synthetic
tgtccacgagcaccagacacggcgggccccgggcgaggggccgctcggcgatgagcgcggacaggcgcgggagct

SEQ ID NO: 153374 - DNA, 75 bp, Artificial Sequence
  Synthetic
cccgcctggctccaggcgactgcgtgggtgtagacgccctcgagggccaggcacagtgggtgccgcagccggagg

SEQ ID NO: 153375 - DNA, 75 bp, Artificial Sequence
  Synthetic
cgggttcaggtcggcgtgcaggaggcggacggcccacgtctcgatgtcggacgacacggcatcgcgcaaggcggc

SEQ ID NO: 153376 - DNA, 75 bp, Artificial Sequence
  Synthetic
cggacggcccacgtctcgatgtcggacgacacggcatcgcgcaaggcggcgtccggcccgcgagcgcgtgagtca

SEQ ID NO: 153377 - DNA, 75 bp, Artificial Sequence
  Synthetic
ccgactcgcgggaaaaggccgtggtgttgcggagcgccacgacgacgggcgcgcccaggagcactgccgccagca

SEQ ID NO: 153378 - DNA, 75 bp, Artificial Sequence
  Synthetic
gttgcggagcgccacgacgacgggcgcgcccaggagcactgccgccagcaccaggtccatggccgtaacgcgcgc

SEQ ID NO: 153379 - DNA, 75 bp, Artificial Sequence
  Synthetic
gccggcacggcgacgtgctggcccgtgggccggtagagggcgttggggggagcggggggtgacgcctcgcgcccc

SEQ ID NO: 153380 - DNA, 75 bp, Artificial Sequence
  Synthetic
tgggccggtagagggcgttggggggagcggggggtgacgcctcgcgcccccccgaggggctcagcgtctgcccag

SEQ ID NO: 153381 - DNA, 75 bp, Artificial Sequence
  Synthetic
gtcgaaactgtcatactctgtgtagtcgtccggaaacatgcaggtccaaagagcggccagagcggtgcttgggag

SEQ ID NO: 153382 - DNA, 75 bp, Artificial Sequence
  Synthetic
tcgtccggaaacatgcaggtccaaagagcggccagagcggtgcttgggagacacatgcgcccgaggacgctcacc

SEQ ID NO: 153383 - DNA, 75 bp, Artificial Sequence
  Synthetic
gctttcccagcgcggcgccgcgctcggttcccagctcggggaccgagcgccagggcgccagggggtcggtttcgg

SEQ ID NO: 153384 - DNA, 75 bp, Artificial Sequence
  Synthetic
cagggcgccagggggtcggtttcggacaacttgccgcggcgccagtctgccagccgcgtgccgaacatgaggccc

SEQ ID NO: 153385 - DNA, 75 bp, Artificial Sequence
  Synthetic
acactggcagcacgcggatgcgggcgtctggatgcggggtcaggcgctgcacgaatagcatggaatctgctgcgt

SEQ ID NO: 153386 - DNA, 75 bp, Artificial Sequence
  Synthetic
gtctggatgcggggtcaggcgctgcacgaatagcatggaatctgctgcgttctgaaacgcacgggggagggtgag

SEQ ID NO: 153387 - DNA, 75 bp, Artificial Sequence
  Synthetic
agatccaggcgccaaaaggtgtaaatgtgttccggggagctggccaccagcgccaccagcacgtcgttctcgtta

SEQ ID NO: 153388 - DNA, 75 bp, Artificial Sequence
  Synthetic
tgtgttccggggagctggccaccagcgccaccagcacgtcgttctcgttaaaggaaacgcggtgcctagtggagc

SEQ ID NO: 153389 - DNA, 75 bp, Artificial Sequence
  Synthetic
gccttcccgcaggaggaacgccctcgtcgaggcgaccggcggcgaccgttgcgtggaccgcttcctgctcgtcgg

SEQ ID NO: 153390 - DNA, 75 bp, Artificial Sequence
  Synthetic
gtcgaggcgaccggcggcgaccgttgcgtggaccgcttcctgctcgtcggggcgaccggcggcgaccgttgcgtg

SEQ ID NO: 153391 - DNA, 75 bp, Artificial Sequence
  Synthetic
ggccgccgcgtcacccccccattccagctgggcccagcgacacccaaactcgcgcgtgagagtggtcgcgacgag

SEQ ID NO: 153392 - DNA, 75 bp, Artificial Sequence
  Synthetic
agctgggcccagcgacacccaaactcgcgcgtgagagtggtcgcgacgagggcgacgtagagctcggccgccgca

SEQ ID NO: 153393 - DNA, 75 bp, Artificial Sequence
  Synthetic
ggcggtggcgcacaaagcgtccgaagagctgaaagttggcggcctgggcgtcgctgagggccagctgaagccggt

SEQ ID NO: 153394 - DNA, 75 bp, Artificial Sequence
  Synthetic
gagctgaaagttggcggcctgggcgtcgctgagggccagctgaagccggttgatgacggtgatgacgtacatggc

SEQ ID NO: 153395 - DNA, 75 bp, Artificial Sequence
  Synthetic
gtgtccgtcggaagcggggggcgaatgcatgccgcctcgggacacatcagcagcgcgccgagcttgtcggtcacg

SEQ ID NO: 153396 - DNA, 75 bp, Artificial Sequence
  Synthetic
tgcatgccgcctcgggacacatcagcagcgcgccgagcttgtcggtcacggccgggaagcagagcgcgtactgca

SEQ ID NO: 153397 - DNA, 75 bp, Artificial Sequence
  Synthetic
gctgggggcgaacggccgatccagcgtactggtggcctcgcgcagcaccaggggccccgggcctccgctcactcg

SEQ ID NO: 153398 - DNA, 75 bp, Artificial Sequence
  Synthetic
gtactggtggcctcgcgcagcaccaggggccccgggcctccgctcactcgcaggtacgcctcgccccggcggcgc

SEQ ID NO: 153399 - DNA, 75 bp, Artificial Sequence
  Synthetic
cgggtggggcggacgcccgggcgcgggcgtctagggcgcgaagatccacgagcaggggcgcgggcgcggcggccg

SEQ ID NO: 153400 - DNA, 75 bp, Artificial Sequence
  Synthetic
ggcgtctagggcgcgaagatccacgagcaggggcgcgggcgcggcggccgcgcccgcgcccgtctggcctgtggc

SEQ ID NO: 153401 - DNA, 75 bp, Artificial Sequence
  Synthetic
atgcggcgttggatgagctcccgcgcgccccggaactcctccaccgcccatggggccaggtccccggccaccgcg

SEQ ID NO: 153402 - DNA, 75 bp, Artificial Sequence
  Synthetic
cgccccggaactcctccaccgcccatggggccaggtccccggccaccgcgtcgaattccgccaacaggcccccca

SEQ ID NO: 153403 - DNA, 75 bp, Artificial Sequence
  Synthetic
cacccttggcaccacctcgtcccgcagccgggcgctcaggtcggcgtgttgggccacgcgccccccgagctcctc

SEQ ID NO: 153404 - DNA, 75 bp, Artificial Sequence
  Synthetic
agccgggcgctcaggtcggcgtgttgggccacgcgccccccgagctcctccacggccccggcccgctcggcgctc

SEQ ID NO: 153405 - DNA, 75 bp, Artificial Sequence
  Synthetic
tggcgggaaggcgctcgtagtcccgctgggctcgcagccccgacacagtgttggtggtgtcctgcagggcgcgaa

SEQ ID NO: 153406 - DNA, 75 bp, Artificial Sequence
  Synthetic
ctgggctcgcagccccgacacagtgttggtggtgtcctgcagggcgcgaagctgctcgcatgccgcgcgaaatcc

SEQ ID NO: 153407 - DNA, 75 bp, Artificial Sequence
  Synthetic
cgaacgcggccgaagcgaccccatacctcgtcccactccgcctcggcctcctcgagagacctccgcagggcctcg

SEQ ID NO: 153408 - DNA, 75 bp, Artificial Sequence
  Synthetic
ggcgaccgcctgcacgtcgagctcgcgcgccttctccgtctggtccaacagaatttcgacctgatccgcgatctc

SEQ ID NO: 153409 - DNA, 75 bp, Artificial Sequence
  Synthetic
cgcgccttctccgtctggtccaacagaatttcgacctgatccgcgatctcctccgccgagcgcgcctggtccagc

SEQ ID NO: 153410 - DNA, 75 bp, Artificial Sequence
  Synthetic
cgaccaccttcagcagggtcttcagattggccagaccctcggcctcgagctgggcccggcgctcgcgcgcggcca

SEQ ID NO: 153411 - DNA, 75 bp, Artificial Sequence
  Synthetic
ccgctcggtggcttcggcgcgctgctgtttggcgcgcaccacggcgtccttggtatcggccaggtcctgtcgggt

SEQ ID NO: 153412 - DNA, 75 bp, Artificial Sequence
  Synthetic
gccgtgtccttcacggggctctggtccacgcgctccagcgccgccacgcacgccaccagcgcgtcctcgctcggg

SEQ ID NO: 153413 - DNA, 75 bp, Artificial Sequence
  Synthetic
ccacgcgctccagcgccgccacgcacgccaccagcgcgtcctcgctcgggcagggcagggtgacccctgcccgga

SEQ ID NO: 153414 - DNA, 75 bp, Artificial Sequence
  Synthetic
gttgcgcaccgcggatatctcctccgcggcggcggccaggtccagcgccacgcttccgatcgcgcgccgcgcgtc

SEQ ID NO: 153415 - DNA, 75 bp, Artificial Sequence
  Synthetic
gcggcggcggccaggtccagcgccacgcttccgatcgcgcgccgcgcgtcggcccggagggcgtccaggcgatcg

SEQ ID NO: 153416 - DNA, 75 bp, Artificial Sequence
  Synthetic
ccttttgaaaaaacggcacgtactggcgcagggccggcacgccccccaagtcttccgacaggtgtaggacggcct

SEQ ID NO: 153417 - DNA, 75 bp, Artificial Sequence
  Synthetic
agggcatcggtaaacatctgctcaaactcgaagtcggccatatccagagcgccgtagggggcggagtcgtggggg

SEQ ID NO: 153418 - DNA, 75 bp, Artificial Sequence
  Synthetic
tcttccgacaggtgtaggacggcctcgtggtagtcgataaacccgtcgttcgcctgggcccgctccagcagcccc

SEQ ID NO: 153419 - DNA, 75 bp, Artificial Sequence
  Synthetic
ggggctcggtgtccacccgaaacatgtcggcgtacgtgtcggccgcggccccgaaggccgcgctccagtcgatgc

SEQ ID NO: 153420 - DNA, 75 bp, Artificial Sequence
  Synthetic
gtcggcgtacgtgtcggccgcggccccgaaggccgcgctccagtcgatgcggtgaatggctgcgagcggggggag

SEQ ID NO: 153421 - DNA, 75 bp, Artificial Sequence
  Synthetic
gtgtatgggttaaacgcaagggccgtctccagggcaagggtcaccgccttggcgttggttcccagcgcctgttcg

SEQ ID NO: 153422 - DNA, 75 bp, Artificial Sequence
  Synthetic
tctccagggcaagggtcaccgccttggcgttggttcccagcgcctgttcggcccgctttcggaagtcccgggggt

SEQ ID NO: 153423 - DNA, 75 bp, Artificial Sequence
  Synthetic
ctgcaggcgacggagctcgaccacgtcaaactcggcaccgctttccacgcggtccagcacggcctccacgtcggc

SEQ ID NO: 153424 - DNA, 75 bp, Artificial Sequence
  Synthetic
ggtccagcacggcctccacgtcggcggcccagcgctcgtggctactgcgggcgcgctgggccgccatcttctctc

SEQ ID NO: 153425 - DNA, 75 bp, Artificial Sequence
  Synthetic
ttcgtcggcgcggcgtcgcgtggcgccgatgacctttcccagctcctgcagggcgcgcccgctgggggagtggtc

SEQ ID NO: 153426 - DNA, 75 bp, Artificial Sequence
  Synthetic
ccgatgacctttcccagctcctgcagggcgcgcccgctgggggagtggtccccggccgtcccttcggcgtgcaac

SEQ ID NO: 153427 - DNA, 75 bp, Artificial Sequence
  Synthetic
ccgcgaggctttcccgcgcgccggtggtcgcgcgcgtcgcggcctggatcagggaggcatgctctccctccggtt

SEQ ID NO: 153428 - DNA, 75 bp, Artificial Sequence
  Synthetic
ggtcgcgcgcgtcgcggcctggatcagggaggcatgctctccctccggttggttggcggcccggcgcacctggac

SEQ ID NO: 153429 - DNA, 75 bp, Artificial Sequence
  Synthetic
aaggtcgtgagctgggcgatggccccccgcgcgtccagggccaaccgagtcgccttgacgtatcccgcggcgctg

SEQ ID NO: 153430 - DNA, 75 bp, Artificial Sequence
  Synthetic
cccgcgcgtccagggccaaccgagtcgccttgacgtatcccgcggcgctgtcggccatggccgctaggaaggcca

SEQ ID NO: 153431 - DNA, 75 bp, Artificial Sequence
  Synthetic
cgcgcccagggccgtcaccgcgtcgaccaggacgcggtgcgcccgcacggccgcatccaccgtcgacgcggggtc

SEQ ID NO: 153432 - DNA, 75 bp, Artificial Sequence
  Synthetic
gcgttgatggcgttcgagacggcgtgggctatgatcggggcgtgatcggcgaagaactgcaagagaaacggagtc

SEQ ID NO: 153433 - DNA, 75 bp, Artificial Sequence
  Synthetic
tcagcaccaccacgaagctgggatgcaagccagacagagccgtcgccgtgtccggagtcgggtgctccagggcat

SEQ ID NO: 153434 - DNA, 75 bp, Artificial Sequence
  Synthetic
tccggagtcgggtgctccagggcatctcggtactgccccagcagcccccacatgtccgcccgcagcgccgccgta

SEQ ID NO: 153435 - DNA, 75 bp, Artificial Sequence
  Synthetic
cctcggggaggtccgaccagcccgccggcagggaggcccgcagggtcgccaggacggccggacaggcctttagcc

SEQ ID NO: 153436 - DNA, 75 bp, Artificial Sequence
  Synthetic
aggacggccggacaggcctttagccccacaaagtcagggagggggcgcaggaccccctggagtttgtgcaagaac

SEQ ID NO: 153437 - DNA, 75 bp, Artificial Sequence
  Synthetic
ttctcccgggcgtcgcgggccaccttcgcccgctcccgcgctccctcgagcattgcctccagggagcgcgcgcgc

SEQ ID NO: 153438 - DNA, 75 bp, Artificial Sequence
  Synthetic
tcgcccgctcccgcgctccctcgagcattgcctccagggagcgcgcgcgctcccgcaaacgggcacgcgcatcgg

SEQ ID NO: 153439 - DNA, 75 bp, Artificial Sequence
  Synthetic
ggcatccatggcccgcgcctgccgcagcgcttcctcggccatgcgcgtggcctctggcgacagcccgccgtcgtc

SEQ ID NO: 153440 - DNA, 75 bp, Artificial Sequence
  Synthetic
agcgcttcctcggccatgcgcgtggcctctggcgacagcccgccgtcgtcggggtagggcgacgcgccgggcgca

SEQ ID NO: 153441 - DNA, 75 bp, Artificial Sequence
  Synthetic
gctgctggcccagggccgcatctagggcgtcgaagcgccgcagctcggccagacccgagctgcggcgcgcctgct

SEQ ID NO: 153442 - DNA, 75 bp, Artificial Sequence
  Synthetic
atgacagcccgtggtcgccaccccgcatttaagcaacccgcacgggccgccccgtacctcgtgacttccccccac

SEQ ID NO: 153443 - DNA, 75 bp, Artificial Sequence
  Synthetic
ggcgtcgaagcgccgcagctcggccagacccgagctgcggcgcgcctgctggtcgttaatgtcgcggatgctgcg

SEQ ID NO: 153444 - DNA, 75 bp, Artificial Sequence
  Synthetic
tctatcagcccttggttggcggcgtccgtcaggacggagagccaggccgccaggtcctcgggggcgtccagcgtc

SEQ ID NO: 153445 - DNA, 75 bp, Artificial Sequence
  Synthetic
gcggccgaagccacgtgaaaccggcggtcgttgttgtcgctggcctgtagagccttggcgctgtatacggccccc

SEQ ID NO: 153446 - DNA, 75 bp, Artificial Sequence
  Synthetic
ggtcgttgttgtcgctggcctgtagagccttggcgctgtatacggccccccggtaaaagtactccttaaccgcgc

SEQ ID NO: 153447 - DNA, 75 bp, Artificial Sequence
  Synthetic
ccgcacctcctccagccgaacctgaacggcctcggggcccagggggggtgggcgcggagccccctgcggggccgc

SEQ ID NO: 153448 - DNA, 75 bp, Artificial Sequence
  Synthetic
acggcctcggggcccagggggggtgggcgcggagccccctgcggggccgccccggccggggcgggcattacgccg

SEQ ID NO: 153449 - DNA, 75 bp, Artificial Sequence
  Synthetic
cgtcgaccccgcgagcgagggcgtcgagggcctcgcgcatctggcgatcctccgcctccaccctaatctcttcgc

SEQ ID NO: 153450 - DNA, 75 bp, Artificial Sequence
  Synthetic
gagggcctcgcgcatctggcgatcctccgcctccaccctaatctcttcgccacgggcaaatttggccagagcctg

SEQ ID NO: 153451 - DNA, 75 bp, Artificial Sequence
  Synthetic
tgcgtcggggtggcgggggcaaaaagggtgtccgggtgggcctgcgagcgctccagaagccactcgccgaggcgt

SEQ ID NO: 153452 - DNA, 75 bp, Artificial Sequence
  Synthetic
gggtgtccgggtgggcctgcgagcgctccagaagccactcgccgaggcgtgtatacagattggccggcggggccg

SEQ ID NO: 153453 - DNA, 75 bp, Artificial Sequence
  Synthetic
gagttccccgtaaaaggcgtccgtctcccgaatgacatccctagccacaaggatcagcttcgccagcgccaggcg

SEQ ID NO: 153454 - DNA, 75 bp, Artificial Sequence
  Synthetic
acgtgctggacgaggggcagatgggcggccacgtcggccaggctcaggcgcgtggaggccagaaagtcccccacg

SEQ ID NO: 153455 - DNA, 75 bp, Artificial Sequence
  Synthetic
gggtaaactccagcagggcggcggccgggccggccaccccggcctgggtgtgcgtccgggccccgttctcgatga

SEQ ID NO: 153456 - DNA, 75 bp, Artificial Sequence
  Synthetic
cgggccggccaccccggcctgggtgtgcgtccgggccccgttctcgatgagaaaggcgaggacgcgttcaaagaa

SEQ ID NO: 153457 - DNA, 75 bp, Artificial Sequence
  Synthetic
cccggagaagccggatacggcgaccgtaaggcgctgatggtgagccgcgaacacgcggcgacctcgcgggccagg

SEQ ID NO: 153458 - DNA, 75 bp, Artificial Sequence
  Synthetic
gtaaggcgctgatggtgagccgcgaacacgcggcgacctcgcgggccagggtggcggagcacgcggtgaacttaa

SEQ ID NO: 153459 - DNA, 75 bp, Artificial Sequence
  Synthetic
ggcctcgaacagctgggcgaggtctgcgcccgggggctcgggtgagcggcgagtcttcagcgcctcgagggcctg

SEQ ID NO: 153460 - DNA, 75 bp, Artificial Sequence
  Synthetic
tcgtcctcgcccgcctcggcgaccggcggcccggccgggtcggggggtgccgaggcgaggacaggctccggaacg

SEQ ID NO: 153461 - DNA, 75 bp, Artificial Sequence
  Synthetic
gcggcccggccgggtcggggggtgccgaggcgaggacaggctccggaacggaggcggggaccgcggccccgacgg

SEQ ID NO: 153462 - DNA, 75 bp, Artificial Sequence
  Synthetic
cgaggcgaggacaggctccggaacggaggcggggaccgcggccccgacgggggttttgcctttgggggtggattt

SEQ ID NO: 153463 - DNA, 75 bp, Artificial Sequence
  Synthetic
ccgtttgtgtttaacccgaccgtggtgtatgtctggtgtgtggcgtccgatcccgttactatcaccgtccccccc

SEQ ID NO: 153464 - DNA, 75 bp, Artificial Sequence
  Synthetic
gagcgtttcgttttctcccccgaagtcaggtcttcgacgctggaaggcggagtccaggtgggtcggcggcgcttg

SEQ ID NO: 153465 - DNA, 75 bp, Artificial Sequence
  Synthetic
catctccaggacccgcatgtcgtcgtcatcttcttcggccgcctctgcggcgggggtcttgggggcggagggagg

SEQ ID NO: 153466 - DNA, 75 bp, Artificial Sequence
  Synthetic
aggcgacgtgcacggccgccgcctactacccgcgtaaccccgtggagtttgtctggttcgaggacgaccgccagg

SEQ ID NO: 153467 - DNA, 75 bp, Artificial Sequence
  Synthetic
tacatcgtcgggcgcccgattcgggcgcttggcctctggttttgccgacggaccggccgtcccccgggatgtctc

SEQ ID NO: 153468 - DNA, 75 bp, Artificial Sequence
  Synthetic
gaccggccgtcccccgggatgtctcggaggccctgtcgtcgcgacgggcccgggtcggtggcggcgactgggcgg

SEQ ID NO: 153469 - DNA, 75 bp, Artificial Sequence
  Synthetic
ccctcccccctcccgggggcccacgccgacgcagggctcccccaggcccgcgatctcgccccgcagggggtgcgt

SEQ ID NO: 153470 - DNA, 75 bp, Artificial Sequence
  Synthetic
ccgacgcagggctcccccaggcccgcgatctcgccccgcagggggtgcgtgatggccacgcgccgttcgctgaac

SEQ ID NO: 153471 - DNA, 75 bp, Artificial Sequence
  Synthetic
tggccccgtaaagatgcagagccgcggccgtcaagtccgcaggagccgcgggttccgggcccgacggcacgaaaa

SEQ ID NO: 153472 - DNA, 75 bp, Artificial Sequence
  Synthetic
ggccgtcaagtccgcaggagccgcgggttccgggcccgacggcacgaaaaacaccatggctcccgcccaccgtac

SEQ ID NO: 153473 - DNA, 75 bp, Artificial Sequence
  Synthetic
gtcaggtatggatacatgtcccccgcccgcactttggcgatgaacgcgggggtgccctccggaaggccatgcggg

SEQ ID NO: 153474 - DNA, 75 bp, Artificial Sequence
  Synthetic
cccgcactttggcgatgaacgcgggggtgccctccggaaggccatgcgggtcaaaaaggtatgcggtgtcgccgt

SEQ ID NO: 153475 - DNA, 75 bp, Artificial Sequence
  Synthetic
gccaatggttaggagcgtgtacgacagggggcgcagggcccacgggccggcgaagaacgtgtgtgcggggcattg

SEQ ID NO: 153476 - DNA, 75 bp, Artificial Sequence
  Synthetic
tgtctccagcaggcctgccgcgggctccccgaagaagcccacctcgccgtatacgcgcgagaagacacagcgcag

SEQ ID NO: 153477 - DNA, 75 bp, Artificial Sequence
  Synthetic
atacgcgcgagaagacacagcgcagtccgccgcgcgcccctgggtactcgaggaagttggggagctcgacgatcg

SEQ ID NO: 153478 - DNA, 75 bp, Artificial Sequence
  Synthetic
tccgccgcgcgcccctgggtactcgaggaagttggggagctcgacgatcgaacacatgcgcggcggcccagggcc

SEQ ID NO: 153479 - DNA, 75 bp, Artificial Sequence
  Synthetic
ccctcgaccaaacatccctcgatggcctccgcggacagaacgtcgcgagggcccacatcaaatatgaggctgaga

SEQ ID NO: 153480 - DNA, 75 bp, Artificial Sequence
  Synthetic
cctccgcggacagaacgtcgcgagggcccacatcaaatatgaggctgagaaaggacagcgacgagcgcatgcacg

SEQ ID NO: 153481 - DNA, 75 bp, Artificial Sequence
  Synthetic
gggcgcgaactggttccgagcaccggtgaccacgatgtcgcgatcccccccgcgttccatcgtggagtgcggtgg

SEQ ID NO: 153482 - DNA, 75 bp, Artificial Sequence
  Synthetic
gtgaccacgatgtcgcgatcccccccgcgttccatcgtggagtgcggtggggtgcccgcgatcatatgtgccctg

SEQ ID NO: 153483 - DNA, 75 bp, Artificial Sequence
  Synthetic
ggaccggacccccggggttagtgttgtttccgccacccacgcccccgtaccatggccccggttcccctgattagg

SEQ ID NO: 153484 - DNA, 75 bp, Artificial Sequence
  Synthetic
catggccccggttcccctgattaggctacgagtcgcggtgatcgcttcccaaaaaccgagctgcgtttgtctgtc

SEQ ID NO: 153485 - DNA, 75 bp, Artificial Sequence
  Synthetic
acaccataacaccgagaacaacacacgggggtgggcggaacataataaagctttattggtaactagttaacggca

SEQ ID NO: 153486 - DNA, 75 bp, Artificial Sequence
  Synthetic
gtgcccataggcctccggcttctgtgcgtccatgggcgtaggcgcggggagactgtttccggcgtcgcggacctc

SEQ ID NO: 153487 - DNA, 75 bp, Artificial Sequence
  Synthetic
gactgtttccggcgtcgcggacctccaggtccctgggagcctccggtccggctaacggacgaaacgcggaagcgc

SEQ ID NO: 153488 - DNA, 75 bp, Artificial Sequence
  Synthetic
gaaacacgccgtcggtgacccgcaggagctcgttcatcagtaaccaatccatactcagcgtaacggccagcccct

SEQ ID NO: 153489 - DNA, 75 bp, Artificial Sequence
  Synthetic
gagctcgttcatcagtaaccaatccatactcagcgtaacggccagcccctggcgagacagatccacggagtccgg

SEQ ID NO: 153490 - DNA, 75 bp, Artificial Sequence
  Synthetic
ccgaggctgtagtccccccaggcccctaggtcgcgacggctcgtaagcacgacgcggtcggccgcggggctttgc

SEQ ID NO: 153491 - DNA, 75 bp, Artificial Sequence
  Synthetic
ctaggtcgcgacggctcgtaagcacgacgcggtcggccgcggggctttgcgggggggcgtcctcgggcgcatgcg

SEQ ID NO: 153492 - DNA, 75 bp, Artificial Sequence
  Synthetic
gcgctggtcggccgagctgaccaagggcgccacgaccacggcgcgctccgtctgcaggcccttccacgtgtcgtg

SEQ ID NO: 153493 - DNA, 75 bp, Artificial Sequence
  Synthetic
tctgcaggcccttccacgtgtcgtggagttcctggacaaactcggccacgggctcgggtcccgcggccgcgcgcg

SEQ ID NO: 153494 - DNA, 75 bp, Artificial Sequence
  Synthetic
ccgccagcgcgctagaaactgacccatgaaacaaaacccggggacctggtctcccgacagcagcttcgacgcccg

SEQ ID NO: 153495 - DNA, 75 bp, Artificial Sequence
  Synthetic
atgaaacaaaacccggggacctggtctcccgacagcagcttcgacgcccgggcgtgaatgccggacacgacggac

SEQ ID NO: 153496 - DNA, 75 bp, Artificial Sequence
  Synthetic
ccacggccagcacgttgtcctcgtgcgacacctgggccgccagctcgtcgcacacccccaggtgcgccgtggttt

SEQ ID NO: 153497 - DNA, 75 bp, Artificial Sequence
  Synthetic
cgacacctgggccgccagctcgtcgcacacccccaggtgcgccgtggtttcggtgatgacggaacgcaggctcgc

SEQ ID NO: 153498 - DNA, 75 bp, Artificial Sequence
  Synthetic
gcgtcgtgatacatgctgcagtactgactcaccgcgtcccccatggcctcggggggccagggccccaggcggtcg

SEQ ID NO: 153499 - DNA, 75 bp, Artificial Sequence
  Synthetic
tgcagcaccccccgggcagccagggcgtacatgctaatcaacaggaggctggtgcccacctcggggggcgggggg

SEQ ID NO: 153500 - DNA, 75 bp, Artificial Sequence
  Synthetic
cgtacatgctaatcaacaggaggctggtgcccacctcggggggcggggggggctgcagttggaccaggggccgca

SEQ ID NO: 153501 - DNA, 75 bp, Artificial Sequence
  Synthetic
cacgtacagctcccggagcagctgctctatgttgtcggccatctgcatagtggggccgaggccgccccgggcggc

SEQ ID NO: 153502 - DNA, 75 bp, Artificial Sequence
  Synthetic
cccagtttggtgcgatggccctcgaccgtggggagatagcccagcccaaagtcccgggcccaggccaacacacgc

SEQ ID NO: 153503 - DNA, 75 bp, Artificial Sequence
  Synthetic
ccgtggggagatagcccagcccaaagtcccgggcccaggccaacacacgcagggcgaactcgaccgggcggggaa

SEQ ID NO: 153504 - DNA, 75 bp, Artificial Sequence
  Synthetic
gtcccgggcccaggccaacacacgcagggcgaactcgaccgggcggggaaggtaggccgcgctacacgtggccct

SEQ ID NO: 153505 - DNA, 75 bp, Artificial Sequence
  Synthetic
agaacgtaggggacgaagcccgggtcggcgaggacgttggggtgaatgccctcgagggcggggaagcggatctgg

SEQ ID NO: 153506 - DNA, 75 bp, Artificial Sequence
  Synthetic
cggcgaggacgttggggtgaatgccctcgagggcggggaagcggatctgggtcgccgcggccaggtggacagagg

SEQ ID NO: 153507 - DNA, 75 bp, Artificial Sequence
  Synthetic
gagaagcgcggacagcggcgtggccggggtggtgggggtgatgtcccagtgggtctgaccatacacgtcgatcca

SEQ ID NO: 153508 - DNA, 75 bp, Artificial Sequence
  Synthetic
ggggtggtgggggtgatgtcccagtgggtctgaccatacacgtcgatccagatgagcgccgtctcgcggagaagg

SEQ ID NO: 153509 - DNA, 75 bp, Artificial Sequence
  Synthetic
gctcggccgtctcaaactcccccacgagcgcccgccgcaggctcgccagatgttccgtcggcacggccggcccca

SEQ ID NO: 153510 - DNA, 75 bp, Artificial Sequence
  Synthetic
aacgccccccgacaggccgaccgcctcacagagccgcccgtgcgtgtgctcgctggcgccctggacccgcctgaa

SEQ ID NO: 153511 - DNA, 75 bp, Artificial Sequence
  Synthetic
tcacagagccgcccgtgcgtgtgctcgctggcgccctggacccgcctgaaagtttttacgtagttggcatagtac

SEQ ID NO: 153512 - DNA, 75 bp, Artificial Sequence
  Synthetic
cacgcatcttcgggccgtgacgacccacgaccccaaccccgcggccaacacggagcagccctcgcccctgggcag

SEQ ID NO: 153513 - DNA, 75 bp, Artificial Sequence
  Synthetic
cgttcgaccccgcgagggcaatgcacccaaagagctgctggacttcgccgagtccgtggccggcgggcgtccgcg

SEQ ID NO: 153514 - DNA, 75 bp, Artificial Sequence
  Synthetic
cccaaagagctgctggacttcgccgagtccgtggccggcgggcgtccgcgcggggacgcccgccgccagaaaccc

SEQ ID NO: 153515 - DNA, 75 bp, Artificial Sequence
  Synthetic
agtccgtggccggcgggcgtccgcgcggggacgcccgccgccagaaacccctccagggccgaaaggtagtgcgtg

SEQ ID NO: 153516 - DNA, 75 bp, Artificial Sequence
  Synthetic
cgatcagggtgttgatcaccacggagggcgaattggtattctggatcaacgtccacgtctgctgcagcagagcca

SEQ ID NO: 153517 - DNA, 75 bp, Artificial Sequence
  Synthetic
gggcgaattggtattctggatcaacgtccacgtctgctgcagcagagccagcagccgctgctgggcgccggcgga

SEQ ID NO: 153518 - DNA, 75 bp, Artificial Sequence
  Synthetic
ctggagacggcaggctggaagactgccagtgccgacgaactcaggaacggcacgtcgggatcaaacacggccacg

SEQ ID NO: 153519 - DNA, 75 bp, Artificial Sequence
  Synthetic
tccccgggggcgcacaggccgagcgcgggctgacgcggctgagggccgtcgacacgcgcacctcctcgcggctgc

SEQ ID NO: 153520 - DNA, 75 bp, Artificial Sequence
  Synthetic
cggaatcattatggccgggtcgatctcccgcacggtgtgctgaaactgcgccaacaggggcggcgggaccacagc

SEQ ID NO: 153521 - DNA, 75 bp, Artificial Sequence
  Synthetic
tcccgcacggtgtgctgaaactgcgccaacaggggcggcgggaccacagccccccgctcgggggtcgtcaggtac

SEQ ID NO: 153522 - DNA, 75 bp, Artificial Sequence
  Synthetic
gggcccgtgtgaggggagtgagggtcgcgtcgtctatgcgctggaggtgcgccgagaacagcgtcacccgattac

SEQ ID NO: 153523 - DNA, 75 bp, Artificial Sequence
  Synthetic
ctcttgcacgaacggggcggggaagagcaggctgtacgccggggtggtaaggttcgcgctgggctgccccaacgg

SEQ ID NO: 153524 - DNA, 75 bp, Artificial Sequence
  Synthetic
tccccaagggcctcgatggaggtccgcgggctcatggccaagcagctcttggtgacggtttgccagcggtctatc

SEQ ID NO: 153525 - DNA, 75 bp, Artificial Sequence
  Synthetic
gcgggctcatggccaagcagctcttggtgacggtttgccagcggtctatccactccacggcgcactggcggacgc

SEQ ID NO: 153526 - DNA, 75 bp, Artificial Sequence
  Synthetic
gcgcaggccggcggactccagcgcatgggacgtgtcggagccggtgaccgcgaggatggtgtccttgatgacctc

SEQ ID NO: 153527 - DNA, 75 bp, Artificial Sequence
  Synthetic
tgggacgtgtcggagccggtgaccgcgaggatggtgtccttgatgacctccatctcccggaaggcctggtcgggg

SEQ ID NO: 153528 - DNA, 75 bp, Artificial Sequence
  Synthetic
ggtgtacgagcaacccggggaggttctcggccaagagcgccgtctccggaagcccgtgggcccggtggagcgcgc

SEQ ID NO: 153529 - DNA, 75 bp, Artificial Sequence
  Synthetic
ctcggccaagagcgccgtctccggaagcccgtgggcccggtggagcgcgcacaggtgttccagcagcggccgcca

SEQ ID NO: 153530 - DNA, 75 bp, Artificial Sequence
  Synthetic
atggccgttcccgacaacagaaacgccgccatggcggcgcgcagcttggccgtggccagaaacgccgggtcgtcc

SEQ ID NO: 153531 - DNA, 75 bp, Artificial Sequence
  Synthetic
ccgccatggcggcgcgcagcttggccgtggccagaaacgccgggtcgtccgccccgtttgccgtctcggccgtgg

SEQ ID NO: 153532 - DNA, 75 bp, Artificial Sequence
  Synthetic
taggctcgccaataggcgctgcataggtccgtccgagggcggaccggcgggtgaggtcgtgacgacgggggcctc

SEQ ID NO: 153533 - DNA, 75 bp, Artificial Sequence
  Synthetic
ggtccgtccgagggcggaccggcgggtgaggtcgtgacgacgggggcctcggacgggagaccgcggtctgccatg

SEQ ID NO: 153534 - DNA, 75 bp, Artificial Sequence
  Synthetic
cagcgtagaccaacgacgagaccgggcgggaatgactgtcgtgcgctgtagggagcggcgaattatcgatccccc

SEQ ID NO: 153535 - DNA, 75 bp, Artificial Sequence
  Synthetic
gggagcggcgaattatcgatcccccgcggccctccaggaaccccgcaggcgttgcgagtaccccgcgtcttcgcg

SEQ ID NO: 153536 - DNA, 75 bp, Artificial Sequence
  Synthetic
gggtgttatacggccacttaagtcccggcatcccgttcgcggacccaggcccgggggattgtccggatgtgcggg

SEQ ID NO: 153537 - DNA, 75 bp, Artificial Sequence
  Synthetic
cggcatcccgttcgcggacccaggcccgggggattgtccggatgtgcgggcagcccggacggcgtgggttgcgga

SEQ ID NO: 153538 - DNA, 75 bp, Artificial Sequence
  Synthetic
cctttaaacgtgtgtatacggacgcgccgggccagtcggccaacacaacccaccggaggcggtagccgcgtttgg

SEQ ID NO: 153539 - DNA, 75 bp, Artificial Sequence
  Synthetic
gccgggccagtcggccaacacaacccaccggaggcggtagccgcgtttggctgtggggtgggtggttccgccttg

SEQ ID NO: 153540 - DNA, 75 bp, Artificial Sequence
  Synthetic
tcccccgggtcttgctaggtcgcgatctgtggtcgcaatgaagaccaatccgctacccgcaaccccttccgtgtg

SEQ ID NO: 153541 - DNA, 75 bp, Artificial Sequence
  Synthetic
tctgtggtcgcaatgaagaccaatccgctacccgcaaccccttccgtgtggggcgggagtaccgtggaactcccc

SEQ ID NO: 153542 - DNA, 75 bp, Artificial Sequence
  Synthetic
agggcctgcttcggcgcgtcctgcgccccccgatctctcgccgcgacggcccagtgctccccagggggtcgggac

SEQ ID NO: 153543 - DNA, 75 bp, Artificial Sequence
  Synthetic
ccccccgatctctcgccgcgacggcccagtgctccccagggggtcgggaccccggagggcggccagcacgctgtg

SEQ ID NO: 153544 - DNA, 75 bp, Artificial Sequence
  Synthetic
gcgccccctggggcgctgacccccaacgacgataccgaacaggccctggacaagatcctgcggggcaccatgcgc

SEQ ID NO: 153545 - DNA, 75 bp, Artificial Sequence
  Synthetic
acgacgataccgaacaggccctggacaagatcctgcggggcaccatgcgcgggggggcggccctgatcggctccc

SEQ ID NO: 153546 - DNA, 75 bp, Artificial Sequence
  Synthetic
gatcctgacggatctgtgccaacccaacgcggatcgtgccgggacgctgcttctggcgctgcggcaccccgccga

SEQ ID NO: 153547 - DNA, 75 bp, Artificial Sequence
  Synthetic
aacgcggatcgtgccgggacgctgcttctggcgctgcggcaccccgccgacctgcctcacctggcccaccagcgc

SEQ ID NO: 153548 - DNA, 75 bp, Artificial Sequence
  Synthetic
ggctgggcgaggcctggggccagctgatggaggcgaccgccctggggtcggggcgagccgagagcgggtgcacgc

SEQ ID NO: 153549 - DNA, 75 bp, Artificial Sequence
  Synthetic
gatggaggcgaccgccctggggtcggggcgagccgagagcgggtgcacgcgcgcgggcctcgtgtcgtttaactt

SEQ ID NO: 153550 - DNA, 75 bp, Artificial Sequence
  Synthetic
tacgacgcgcgcgacgccgccgatgcggtacgggcccacgtcacggccaactaccgcgggacgcgggtgggggcg

SEQ ID NO: 153551 - DNA, 75 bp, Artificial Sequence
  Synthetic
cggtacgggcccacgtcacggccaactaccgcgggacgcgggtgggggcgcgcctggatcgtttttccgagtgtc

SEQ ID NO: 153552 - DNA, 75 bp, Artificial Sequence
  Synthetic
cttcccccacgaggtcatgcggtttttcggggggctggtgtcgtgggtcacccaggacgagctagcgagcgtcac

SEQ ID NO: 153553 - DNA, 75 bp, Artificial Sequence
  Synthetic
ttcggggggctggtgtcgtgggtcacccaggacgagctagcgagcgtcaccgccgtgtgcgccgggccccaggag

SEQ ID NO: 153554 - DNA, 75 bp, Artificial Sequence
  Synthetic
ggccccgctcggccgtgatcctcccggcgtgtgcgttcgtggacctggacgccgagctggggctggggggcccgg

SEQ ID NO: 153555 - DNA, 75 bp, Artificial Sequence
  Synthetic
ggcgtgtgcgttcgtggacctggacgccgagctggggctggggggcccgggcgcggcgtttctgtacctggtatt

SEQ ID NO: 153556 - DNA, 75 bp, Artificial Sequence
  Synthetic
gagctgtgttgtgtgtacgtgatcaagagccagctccccccgcgcgggttggagccggccctggagcggctgttt

SEQ ID NO: 153557 - DNA, 75 bp, Artificial Sequence
  Synthetic
agagccagctccccccgcgcgggttggagccggccctggagcggctgtttgggcgcctccggatcaccaacacga

SEQ ID NO: 153558 - DNA, 75 bp, Artificial Sequence
  Synthetic
cccggccccaaaccgaaaccccgacttccccctcgcgggcctggccgccaatccccaaaccccgcgttgctctgc

SEQ ID NO: 153559 - DNA, 75 bp, Artificial Sequence
  Synthetic
ttccccctcgcgggcctggccgccaatccccaaaccccgcgttgctctgctggccaggtcacgaacccccagttc

SEQ ID NO: 153560 - DNA, 75 bp, Artificial Sequence
  Synthetic
cggacctgcgggggcgccccaccgcacgcacctgtacgtacgccgcctttgcagagctcggcatgatgcccgagg

SEQ ID NO: 153561 - DNA, 75 bp, Artificial Sequence
  Synthetic
cgcccacacaacgctccgcccccaaccccttccccgctgtcactcgttgttcgttgacccggacgtccgccaaat

SEQ ID NO: 153562 - DNA, 75 bp, Artificial Sequence
  Synthetic
ccccttccccgctgtcactcgttgttcgttgacccggacgtccgccaaataaagccactgaaacccgaaacgcga

SEQ ID NO: 153563 - DNA, 75 bp, Artificial Sequence
  Synthetic
ggaagccacaaaatgcaaatgggatacatggaaggaacacacccccgtgactcaggacatcggcgtgtccttttg

SEQ ID NO: 153564 - DNA, 75 bp, Artificial Sequence
  Synthetic
ggacctccgcacacattcgctcctatcacacgcgtctcgtgagcgcccaataaacacacccaggtatgctacgca

SEQ ID NO: 153565 - DNA, 75 bp, Artificial Sequence
  Synthetic
acatggaaggaacacacccccgtgactcaggacatcggcgtgtccttttgggtttcactgaaactggcccgcgcc

SEQ ID NO: 153566 - DNA, 75 bp, Artificial Sequence
  Synthetic
agccagcgcgggtggtttagggtaccacaggtgggtgctttggaaacttgtcggtcgccgtgctcctgtgagctt

SEQ ID NO: 153567 - DNA, 75 bp, Artificial Sequence
  Synthetic
gcgtccctccccggtttcctttgcgctcccgccttccggacctgctctcgcctatcttctttggctctcggtgcg

SEQ ID NO: 153568 - DNA, 75 bp, Artificial Sequence
  Synthetic
atctcgaccccaccactcgccggacccgccgacgtcccctctcgagcccgccgaaacccgccgcgtctgttgaaa

SEQ ID NO: 153569 - DNA, 75 bp, Artificial Sequence
  Synthetic
ccgaaacccgccgcgtctgttgaaatggccagccgccccgccgcatcctctcccgtcgaagcgcgggccccggtt

SEQ ID NO: 153570 - DNA, 75 bp, Artificial Sequence
  Synthetic
gggggacaggaggccggcggccccagcgcagccacccagggggaggccgccggggcccctctcgcccgcggccac

SEQ ID NO: 153571 - DNA, 75 bp, Artificial Sequence
  Synthetic
gcgtgatggtgctttccgacaagacgcccgggtccgcgtcctaccgcatcagcgatagcaactttgtccaatgtg

SEQ ID NO: 153572 - DNA, 75 bp, Artificial Sequence
  Synthetic
cggagacgtggtgcgcgggcgcccccaggacccgggggccgcggcatcccccgctcccttcgttgcggtgacaaa

SEQ ID NO: 153573 - DNA, 75 bp, Artificial Sequence
  Synthetic
ctcctcctccccgcttcaccctgggtggcggctgttgttcctgtcgcgacacacggcgccgctctgcggtattcg

SEQ ID NO: 153574 - DNA, 75 bp, Artificial Sequence
  Synthetic
gtcacacgcctcctcggacgtgtccggcggggccacgtacgacgacgcccttgactccgattcgtcatcggatga

SEQ ID NO: 153575 - DNA, 75 bp, Artificial Sequence
  Synthetic
tcttgcggccgatcccgccgtggcccgggacgacgcggaggggctttcggacccccggccacgtctgggaacggg

SEQ ID NO: 153576 - DNA, 75 bp, Artificial Sequence
  Synthetic
cgggacgacgcggaggggctttcggacccccggccacgtctgggaacgggcacggcctaccccgtccccctggaa

SEQ ID NO: 153577 - DNA, 75 bp, Artificial Sequence
  Synthetic
tggcgcgctttctgggagatgccgtgaaccgcgaacccgcgctcatgctggagtacttttgccggtgcgcccgcg

SEQ ID NO: 153578 - DNA, 75 bp, Artificial Sequence
  Synthetic
gaaccgcgaacccgcgctcatgctggagtacttttgccggtgcgcccgcgaggaaaccaagcgtgtcccccccag

SEQ ID NO: 153579 - DNA, 75 bp, Artificial Sequence
  Synthetic
acggaggacgactttgggcttctcaactacgcgctcgtggagatgcagcgcctgtgtctggacgttcctccggtc

SEQ ID NO: 153580 - DNA, 75 bp, Artificial Sequence
  Synthetic
actacgcgctcgtggagatgcagcgcctgtgtctggacgttcctccggtcctgccgaacgcatacatgccctatt

SEQ ID NO: 153581 - DNA, 75 bp, Artificial Sequence
  Synthetic
ggtcaacgggttcaagccgctggtgagccggtccgctcgcctttaccgcatcctgggggttctggtgcacctgcg

SEQ ID NO: 153582 - DNA, 75 bp, Artificial Sequence
  Synthetic
agccggtccgctcgcctttaccgcatcctgggggttctggtgcacctgcggatccggacccgggaggcctccttt

SEQ ID NO: 153583 - DNA, 75 bp, Artificial Sequence
  Synthetic
tggccctggactttggcctgacggaaaggcttcgcgagcacgaagcccagctggtgatcctggcccaggctctgg

SEQ ID NO: 153584 - DNA, 75 bp, Artificial Sequence
  Synthetic
aaggcttcgcgagcacgaagcccagctggtgatcctggcccaggctctggaccattacgactgtctgatccacag

SEQ ID NO: 153585 - DNA, 75 bp, Artificial Sequence
  Synthetic
gggctgcaatcggccctgaagtatgaggagttttacctaaagcgctttggcgggcactacatggagtccgtcttc

SEQ ID NO: 153586 - DNA, 75 bp, Artificial Sequence
  Synthetic
aggagttttacctaaagcgctttggcgggcactacatggagtccgtcttccagatgtacacccgcatcgccggct

SEQ ID NO: 153587 - DNA, 75 bp, Artificial Sequence
  Synthetic
catgcgccacatcgccctggggcgagaggggtcgtggtgggaaatgttcaagttctttttccaccgcctctacga

SEQ ID NO: 153588 - DNA, 75 bp, Artificial Sequence
  Synthetic
gaggggtcgtggtgggaaatgttcaagttctttttccaccgcctctacgaccaccagatcgtaccgtcgaccccc

SEQ ID NO: 153589 - DNA, 75 bp, Artificial Sequence
  Synthetic
actactacacctccagctgctacctggtaaacccccaggccaccacaaacaaggcgaccctgcgggccatcacca

SEQ ID NO: 153590 - DNA, 75 bp, Artificial Sequence
  Synthetic
gcgcacaacaaagagagcgcgcgtccaaccggcgcgtgcgtgtacctggagccgtggcacaccgacgtgcgggcc

SEQ ID NO: 153591 - DNA, 75 bp, Artificial Sequence
  Synthetic
caaccggcgcgtgcgtgtacctggagccgtggcacaccgacgtgcgggccgtgctccggatgaagggggtcctcg

SEQ ID NO: 153592 - DNA, 75 bp, Artificial Sequence
  Synthetic
caatatcttcagcgccctctggatgccagacctgtttttcaagcgcctgattcgccacctggacggcgagaagaa

SEQ ID NO: 153593 - DNA, 75 bp, Artificial Sequence
  Synthetic
ccagacctgtttttcaagcgcctgattcgccacctggacggcgagaagaacgtcacatggaccctgttcgaccgg

SEQ ID NO: 153594 - DNA, 75 bp, Artificial Sequence
  Synthetic
ttcacggggaggagttcgagaagctctaccagcacctcgaggtcatggggttcggcgagcagatacccatccagg

SEQ ID NO: 153595 - DNA, 75 bp, Artificial Sequence
  Synthetic
gcgcggtgagttgtcgctgtgagttgtgttgttggagtgggtggtggatgacgtgacgtgtggcgttgctgttgc

SEQ ID NO: 153596 - DNA, 75 bp, Artificial Sequence
  Synthetic
ctaccagcacctcgaggtcatggggttcggcgagcagatacccatccaggagctggcctatggcattgtgcgcag

SEQ ID NO: 153597 - DNA, 75 bp, Artificial Sequence
  Synthetic
gtcatgttcaaagacgcggtgaaccgccactacatctacgacacccagggggcggccatcgccggctccaacctc

SEQ ID NO: 153598 - DNA, 75 bp, Artificial Sequence
  Synthetic
gccactacatctacgacacccagggggcggccatcgccggctccaacctctgcaccgagatcgtccatccggcct

SEQ ID NO: 153599 - DNA, 75 bp, Artificial Sequence
  Synthetic
tctgggaagcgtgaatctggcccgatgcgtctccaggcagacgtttgactttgggcggctccgcgacgccgtgca

SEQ ID NO: 153600 - DNA, 75 bp, Artificial Sequence
  Synthetic
tgcgtctccaggcagacgtttgactttgggcggctccgcgacgccgtgcaggcgtgcgtgctgatggtgaacatc

SEQ ID NO: 153601 - DNA, 75 bp, Artificial Sequence
  Synthetic
cgccccagtgcacccgcggcaacgacaacctgcggtccatgggaatcggcatgcagggcctgcacacggcctgcc

SEQ ID NO: 153602 - DNA, 75 bp, Artificial Sequence
  Synthetic
caacctgcggtccatgggaatcggcatgcagggcctgcacacggcctgcctgaagctggggctggatctggagtc

SEQ ID NO: 153603 - DNA, 75 bp, Artificial Sequence
  Synthetic
cacatcgccgaggtgatgctgctgtcggcgatgaagaccagcaacgcgctgtgcgttcgcggggcccgtcccttc

SEQ ID NO: 153604 - DNA, 75 bp, Artificial Sequence
  Synthetic
cggcgatgaagaccagcaacgcgctgtgcgttcgcggggcccgtcccttcaaccactttaagcgcagcatgtatc

SEQ ID NO: 153605 - DNA, 75 bp, Artificial Sequence
  Synthetic
ctttccggacgcccggccgcggtacgagggcgagtgggagatgctacgccagagcatgatgaaacacggcctgcg

SEQ ID NO: 153606 - DNA, 75 bp, Artificial Sequence
  Synthetic
gagggcgagtgggagatgctacgccagagcatgatgaaacacggcctgcgcaacagccagtttgtcgcgctgatg

SEQ ID NO: 153607 - DNA, 75 bp, Artificial Sequence
  Synthetic
cggacgtcagcgagggctttgcccccctgttcaccaacctgttcagcaaggtgacccgggacggcgagacgctgc

SEQ ID NO: 153608 - DNA, 75 bp, Artificial Sequence
  Synthetic
cctgttcaccaacctgttcagcaaggtgacccgggacggcgagacgctgcgccccaacacgctcctgctaaagga

SEQ ID NO: 153609 - DNA, 75 bp, Artificial Sequence
  Synthetic
cgcctcctggaggtgatggacagtctcgacgccaagcagtggtccgtggcgcaggcgctcccgtgcctggagccc

SEQ ID NO: 153610 - DNA, 75 bp, Artificial Sequence
  Synthetic
tcgacgccaagcagtggtccgtggcgcaggcgctcccgtgcctggagcccacccaccccctccggcgattcaaga

SEQ ID NO: 153611 - DNA, 75 bp, Artificial Sequence
  Synthetic
gatcacatgcaatctaactggctcccctctccccccctctcccctctccccccctctcccctctccccccctctc

SEQ ID NO: 153612 - DNA, 75 bp, Artificial Sequence
  Synthetic
gctgatcgacctgtgtgcggaccgcgccccctacgtcgaccatagccaatccatgaccctgtatgtcacggagaa

SEQ ID NO: 153613 - DNA, 75 bp, Artificial Sequence
  Synthetic
gccccctacgtcgaccatagccaatccatgaccctgtatgtcacggagaaggcggacgggaccctcccagcctcc

SEQ ID NO: 153614 - DNA, 75 bp, Artificial Sequence
  Synthetic
catataagcgcggactaaaaacagggatgtactactgcaaggttcgcaaggcgaccaacagcggggtctttggcg

SEQ ID NO: 153615 - DNA, 75 bp, Artificial Sequence
  Synthetic
ccccccctgctctttccccgtgacacccgacgctggggggcgtggctgccgggaggggccgcggatgggcggggc

SEQ ID NO: 153616 - DNA, 75 bp, Artificial Sequence
  Synthetic
ccgtgctcgtggtgcgggttgggtggggggggggagtgtgggcgggggtgtgcgggaggtgtcggtggtggtggt

SEQ ID NO: 153617 - DNA, 75 bp, Artificial Sequence
  Synthetic
ctggcgatccagattccaaagtgccccgaccccgagaggtacttctacacctcccagtgtcccgacattaaccac

SEQ ID NO: 153618 - DNA, 75 bp, Artificial Sequence
  Synthetic
ccgaccccgagaggtacttctacacctcccagtgtcccgacattaaccacctgcgctccctcagcatccttaacc

SEQ ID NO: 153619 - DNA, 75 bp, Artificial Sequence
  Synthetic
gtcgcggctcttacgagcggcccggcccgcgctcccaccccccgggccgtgtccttgctttccccccgtctcccc

SEQ ID NO: 153620 - DNA, 75 bp, Artificial Sequence
  Synthetic
cgtgggggacgaggaggacgtctccaagctttccgagggcgagctcagcttttaccgcttcctcttcgctttcct

SEQ ID NO: 153621 - DNA, 75 bp, Artificial Sequence
  Synthetic
aagctttccgagggcgagctcagcttttaccgcttcctcttcgctttcctgtcggccgccgacgacctggttacg

SEQ ID NO: 153622 - DNA, 75 bp, Artificial Sequence
  Synthetic
cccgcgctcccaccccccgggccgtgtccttgctttccccccgtctccccccccctccttctcctcctcctcctc

SEQ ID NO: 153623 - DNA, 75 bp, Artificial Sequence
  Synthetic
cggcccggcccggcccggccaccgccgcccacccacccacctcgggagacccagccccggtcccccgttccccgg

SEQ ID NO: 153624 - DNA, 75 bp, Artificial Sequence
  Synthetic
tgtttgagcagaaggacattctccactactacgtggagcaggaatgcatcgaagtcgtacactcgcgcgtgtaca

SEQ ID NO: 153625 - DNA, 75 bp, Artificial Sequence
  Synthetic
caacaacgaccaggcgcgccgcgagtacgtggccggcaccatcaaccacccggccatccgcgccaaggtggactg

SEQ ID NO: 153626 - DNA, 75 bp, Artificial Sequence
  Synthetic
gcctccgttccggaaaagttcatcctcatgatcctcatcgagggcatcttttttgccgcctcgtttgccgccatc

SEQ ID NO: 153627 - DNA, 75 bp, Artificial Sequence
  Synthetic
tcatgatcctcatcgagggcatcttttttgccgcctcgtttgccgccatcgcctaccttcgcaccaacaaccttc

SEQ ID NO: 153628 - DNA, 75 bp, Artificial Sequence
  Synthetic
cccacaaaaaaaaacagccacccccgacacccccccccacccccagtctcttcgccttttcccccccaccccacg

SEQ ID NO: 153629 - DNA, 75 bp, Artificial Sequence
  Synthetic
cctcatcagccgggacgaggccgtgcacacgacggcctcgtgttacatctacaacaactacctcggcgggcacgc

SEQ ID NO: 153630 - DNA, 75 bp, Artificial Sequence
  Synthetic
cacacgacggcctcgtgttacatctacaacaactacctcggcgggcacgccaagcccccgcccgaccgcgtgtac

SEQ ID NO: 153631 - DNA, 75 bp, Artificial Sequence
  Synthetic
tcgagatcggatttatccgatcccaggcgccgacggacagccatatcctgagcccggcggcgctggcggccatcg

SEQ ID NO: 153632 - DNA, 75 bp, Artificial Sequence
  Synthetic
ggcgccgacggacagccatatcctgagcccggcggcgctggcggccatcgaaaactacgtgcgattcagcgcgga

SEQ ID NO: 153633 - DNA, 75 bp, Artificial Sequence
  Synthetic
cttccaccctccggccccccgcgagtccacccgccggccggctaccgagaccgaacacggcggccgccgcagccg

SEQ ID NO: 153634 - DNA, 75 bp, Artificial Sequence
  Synthetic
aagccactgttttccgccccaccccccgacgccagctttccgctgagcctcatgtccaccgacaaacacaccaat

SEQ ID NO: 153635 - DNA, 75 bp, Artificial Sequence
  Synthetic
catgtccaccgacaaacacaccaattttttcgagtgtcgcagcacctcctacgccggggcggtcgtcaacgatct

SEQ ID NO: 153636 - DNA, 75 bp, Artificial Sequence
  Synthetic
gccggcgcgcgcacacacaagcggcagaggcagaaaggcccagagtcattgtttatgtggccgcgggccagcaga

SEQ ID NO: 153637 - DNA, 75 bp, Artificial Sequence
  Synthetic
cgtgtttgcccataataaacctctgaaccaaactttgggtctcattgtgattcttgtcagggacgcgggggtggg

SEQ ID NO: 153638 - DNA, 75 bp, Artificial Sequence
  Synthetic
aaccaaactttgggtctcattgtgattcttgtcagggacgcgggggtgggagaggataaaaggcggcgcaaaaag

SEQ ID NO: 153639 - DNA, 75 bp, Artificial Sequence
  Synthetic
gagggcataggataccataattttattggtgggtcgtttgttcggggacaagcgcgctcgtctgacgtttgggct

SEQ ID NO: 153640 - DNA, 75 bp, Artificial Sequence
  Synthetic
gtccttgtagaacgcgggtgggggggcctgggtccgcagctgctccagaaacctgtcggcgatatcaggggccgt

SEQ ID NO: 153641 - DNA, 75 bp, Artificial Sequence
  Synthetic
gccaggttttcgtcgcggatgtcctggtagataggcaggcgtttcagaagagtccacggcccccgctccttgggg

SEQ ID NO: 153642 - DNA, 75 bp, Artificial Sequence
  Synthetic
tgtagcggtgttccaccagctcggtgatggtcatgggatcggggagccagtccagggactctggggcgtcgtgga

SEQ ID NO: 153643 - DNA, 75 bp, Artificial Sequence
  Synthetic
ataactgcggtgctcttccagcagctgcgcgttcgggacctggacgagctcgggcggggtgagtatctccgagga

SEQ ID NO: 153644 - DNA, 75 bp, Artificial Sequence
  Synthetic
tgcgcgttcgggacctggacgagctcgggcggggtgagtatctccgaggaggacgacctggggccggggtggccc

SEQ ID NO: 153645 - DNA, 75 bp, Artificial Sequence
  Synthetic
ggaggtcctcgtcgtcttcgtatccgccggcgatctgttgggttagaatttcggtccacgagacgcgcatctcgg

SEQ ID NO: 153646 - DNA, 75 bp, Artificial Sequence
  Synthetic
gggccccggcccggggccccacaacggcccggcgcatgcgctgtggtttttttttctcggtgttttgtcgggctc

SEQ ID NO: 153647 - DNA, 75 bp, Artificial Sequence
  Synthetic
gggcctggtttccgtggagcgcgagctggtgtgttcccggcggatggcccgccgggtctgagagcgactcggggg

SEQ ID NO: 153648 - DNA, 75 bp, Artificial Sequence
  Synthetic
ctggtgtgttcccggcggatggcccgccgggtctgagagcgactcgggggggtccagtgacattcgcgcagcaca

SEQ ID NO: 153649 - DNA, 75 bp, Artificial Sequence
  Synthetic
gccgggtctgagagcgactcgggggggtccagtgacattcgcgcagcacatcctccacggaggcgtaggtgttat

SEQ ID NO: 153650 - DNA, 75 bp, Artificial Sequence
  Synthetic
gacaaagagggccaggaactgggggtagctcatcttaaagtactttagtatatcgcgacagttgatcgtgggaat

SEQ ID NO: 153651 - DNA, 75 bp, Artificial Sequence
  Synthetic
tatcgcgacagttgatcgtgggaatgtagcaggcgctaatatccaacacaatatcacagcccatcaacaggaggt

SEQ ID NO: 153652 - DNA, 75 bp, Artificial Sequence
  Synthetic
gaccgtgttggtgtgatagaggttggcgcaggcatcgtccgcctccagctgacccgagttaatgtaggcgtaccc

SEQ ID NO: 153653 - DNA, 75 bp, Artificial Sequence
  Synthetic
gcgcaggcatcgtccgcctccagctgacccgagttaatgtaggcgtaccccagggcccggagaacgcgaatacag

SEQ ID NO: 153654 - DNA, 75 bp, Artificial Sequence
  Synthetic
gcttcgagggcgcggcggacggcagcgcggctccggacccggccgtcccccgggtccccgaggccagagaggtgc

SEQ ID NO: 153655 - DNA, 75 bp, Artificial Sequence
  Synthetic
cgcggctccggacccggccgtcccccgggtccccgaggccagagaggtgccgcgccggcgcatgttggaaaaggc

SEQ ID NO: 153656 - DNA, 75 bp, Artificial Sequence
  Synthetic
cgcctgtgtttttgtgcctggctctctatgcttgggtcttactgccgggggggggggagtgcgggggaggggggg

SEQ ID NO: 153657 - DNA, 75 bp, Artificial Sequence
  Synthetic
gggggggagtgcgggggagggggggtgtggaaggaaatgcacggcgcgtgtgtaccccccctaaagttgttccta

SEQ ID NO: 153658 - DNA, 75 bp, Artificial Sequence
  Synthetic
ggggaaggcggtggagaggcgtccacgtcactggcctcctcgtccgtccggcattgggccgtcgtgcgggccagg

SEQ ID NO: 153659 - DNA, 75 bp, Artificial Sequence
  Synthetic
cgtcactggcctcctcgtccgtccggcattgggccgtcgtgcgggccaggatggccttggctccaaacacaaccg

SEQ ID NO: 153660 - DNA, 75 bp, Artificial Sequence
  Synthetic
ggtaacgaagatggggaaaagggacttttgggtaaacacctttaataagcgacagaggcagtgtagcgtaatggc

SEQ ID NO: 153661 - DNA, 75 bp, Artificial Sequence
  Synthetic
ctcgcggtcgtaactggggtatcggcgctgatatttgaccaccaacgtgtacatgacgttccacaggtccacggc

SEQ ID NO: 153662 - DNA, 75 bp, Artificial Sequence
  Synthetic
gccccaaggccctggcgcttgaccagatggtgtgtgtgggcaaacttcatcatcccgaacaaacccatgtcaggt

SEQ ID NO: 153663 - DNA, 75 bp, Artificial Sequence
  Synthetic
gatggtgtgtgtgggcaaacttcatcatcccgaacaaacccatgtcaggtcgattgtaactgcggatcggcctaa

SEQ ID NO: 153664 - DNA, 75 bp, Artificial Sequence
  Synthetic
cgggacacccgagcctgtctctctgtgtatggtgacccagacaacaacaccgacacaagaggacaataatccgtt

SEQ ID NO: 153665 - DNA, 75 bp, Artificial Sequence
  Synthetic
cttccaaaagggtgtggcctaacgagctgggggcgtatttaatcaggctagcgcggcgggcctgccgtagtttct

SEQ ID NO: 153666 - DNA, 75 bp, Artificial Sequence
  Synthetic
gctgggggcgtatttaatcaggctagcgcggcgggcctgccgtagtttctggctcggtgagcgacggtccggttg

SEQ ID NO: 153667 - DNA, 75 bp, Artificial Sequence
  Synthetic
accccaccctcgcagcggcatacgccccctccgcgtcccgcacccgagaccccggcccggctgccctcaccaccg

SEQ ID NO: 153668 - DNA, 75 bp, Artificial Sequence
  Synthetic
cccctccgcgtcccgcacccgagaccccggcccggctgccctcaccaccgaagcccacctcgtcactgtggggtg

SEQ ID NO: 153669 - DNA, 75 bp, Artificial Sequence
  Synthetic
caacacagacagggaaaagatacaaaagtaaacctttatttcccaatagacagcaaaaatcccctgagtttttta

SEQ ID NO: 153670 - DNA, 75 bp, Artificial Sequence
  Synthetic
attcccctggcggtgtggcccccgcctcccccgtggaggacgcgtcggacgcgtccctcgggcagccggaggagg

SEQ ID NO: 153671 - DNA, 75 bp, Artificial Sequence
  Synthetic
ctcccccgtggaggacgcgtcggacgcgtccctcgggcagccggaggagggggcgccctgccaggtggtcctgca

SEQ ID NO: 153672 - DNA, 75 bp, Artificial Sequence
  Synthetic
caggcgtttgccccgctgcgcacgagccttctggactcgcttctggttatgggcgaccggggcatccttatccat

SEQ ID NO: 153673 - DNA, 75 bp, Artificial Sequence
  Synthetic
gccttctggactcgcttctggttatgggcgaccggggcatccttatccataacacgatctttggggagcaggtgt

SEQ ID NO: 153674 - DNA, 75 bp, Artificial Sequence
  Synthetic
cagtcggtatcgctggcgcggacccacggcggcgttcctgtctctcgtggaccagaagcgctccctcctgagcgt

SEQ ID NO: 153675 - DNA, 75 bp, Artificial Sequence
  Synthetic
acggcggcgttcctgtctctcgtggaccagaagcgctccctcctgagcgtgtttcgcgccaaccagtacccggac

SEQ ID NO: 153676 - DNA, 75 bp, Artificial Sequence
  Synthetic
cgggccaggccccgtttcgcacgctggttcagcgcatatggacgacgacgtccgacggcgaggccgttgagctag

SEQ ID NO: 153677 - DNA, 75 bp, Artificial Sequence
  Synthetic
ggttcagcgcatatggacgacgacgtccgacggcgaggccgttgagctagccagcgagacgctgatgaagcgcga

SEQ ID NO: 153678 - DNA, 75 bp, Artificial Sequence
  Synthetic
ccccagggaacccccgacgttcagttgcgcctgacgaggccgcagctcaccaaggtccttaacgcgaccggggcc

SEQ ID NO: 153679 - DNA, 75 bp, Artificial Sequence
  Synthetic
tgcgcctgacgaggccgcagctcaccaaggtccttaacgcgaccggggccgatagtgccacgcccaccacgttcg

SEQ ID NO: 153680 - DNA, 75 bp, Artificial Sequence
  Synthetic
cgtgttcaccacgagtacctgcgtcacatttgctgcccgcgaggagggcgtgtcgtccagcaccagcacccaggt

SEQ ID NO: 153681 - DNA, 75 bp, Artificial Sequence
  Synthetic
acatttgctgcccgcgaggagggcgtgtcgtccagcaccagcacccaggtccagatcctgtccaacgcgctcacc

SEQ ID NO: 153682 - DNA, 75 bp, Artificial Sequence
  Synthetic
ccaagacggtgtacggggaaaatacccatcgcaccttctctgtggtcgtcgacgattgcagcatgcgggcggtgc

SEQ ID NO: 153683 - DNA, 75 bp, Artificial Sequence
  Synthetic
ccatcgcaccttctctgtggtcgtcgacgattgcagcatgcgggcggtgctccggcgactgcaggtcgccggggg

SEQ ID NO: 153684 - DNA, 75 bp, Artificial Sequence
  Synthetic
cccgtccccagtctgtgcgtcaccgccaccggtcccaacgcggtatcggcggtatttctcctgaaaccccagaag

SEQ ID NO: 153685 - DNA, 75 bp, Artificial Sequence
  Synthetic
ccaccggtcccaacgcggtatcggcggtatttctcctgaaaccccagaagatttgcctggactggctgggtcata

SEQ ID NO: 153686 - DNA, 75 bp, Artificial Sequence
  Synthetic
ctcggcctcccgggcctctgggagcgagccaacagacagccaggactccgcgtcggacgcggtcagccacggcga

SEQ ID NO: 153687 - DNA, 75 bp, Artificial Sequence
  Synthetic
gagccaacagacagccaggactccgcgtcggacgcggtcagccacggcgatccggaagacctcgatggcgctgcc

SEQ ID NO: 153688 - DNA, 75 bp, Artificial Sequence
  Synthetic
acgcctgtccgatgccgtcgtcgaccacgcgggtcactcccacgaccaagcgggggcgctcggggggcgaggatg

SEQ ID NO: 153689 - DNA, 75 bp, Artificial Sequence
  Synthetic
cacgcgggtcactcccacgaccaagcgggggcgctcggggggcgaggatgcgcgcgcggacacggccctaaagaa

SEQ ID NO: 153690 - DNA, 75 bp, Artificial Sequence
  Synthetic
cccccgcccacagatccagtccccctggacacggaggacgactccgatgcggcggacgggacggcggcccgtccc

SEQ ID NO: 153691 - DNA, 75 bp, Artificial Sequence
  Synthetic
tggacacggaggacgactccgatgcggcggacgggacggcggcccgtcccgccgctccagacgcccggagcggaa

SEQ ID NO: 153692 - DNA, 75 bp, Artificial Sequence
  Synthetic
cctcccgaccggagaagcaagccccggcgccttctccgccttccgggggggcccccaaaccccgtatggttttgg

SEQ ID NO: 153693 - DNA, 75 bp, Artificial Sequence
  Synthetic
ccgggttaatgtaaataaacttggtattgcccaacactctcccgcgtgtcgcgtgtggttcatgtgtgtgcctgg

SEQ ID NO: 153694 - DNA, 75 bp, Artificial Sequence
  Synthetic
tttcctttccctgtccttataaaagccgtatgtggggcgctgacggaaccaccccgcgtgccatcacggccaagg

SEQ ID NO: 153695 - DNA, 75 bp, Artificial Sequence
  Synthetic
accccgcgtgccatcacggccaaggcgcgggatgctccgcaacgacagccaccgggccgcgtccccggaggacgg

SEQ ID NO: 153696 - DNA, 75 bp, Artificial Sequence
  Synthetic
cccgcccccgggaccccacatataagcccccagccacacgcaagaacagacacgcagaacggctgtgtttatttt

SEQ ID NO: 153697 - DNA, 75 bp, Artificial Sequence
  Synthetic
cgcgggatgctccgcaacgacagccaccgggccgcgtccccggaggacggccagggacgggtcgacgacggacgg

SEQ ID NO: 153698 - DNA, 75 bp, Artificial Sequence
  Synthetic
gcgcgatcaggttacgccccctcccaggccctccctttccgcgcccgccctttcctcgcccccccgcccgcctat

SEQ ID NO: 153699 - DNA, 75 bp, Artificial Sequence
  Synthetic
tggcgcgggggttcatgcatatctggcttcaggccgccacgctgggttttgcgggatcggtcgttatgtcgcgcg

SEQ ID NO: 153700 - DNA, 75 bp, Artificial Sequence
  Synthetic
gcttcaggccgccacgctgggttttgcgggatcggtcgttatgtcgcgcgggccgtacgcgaatgccgcgtctgg

SEQ ID NO: 153701 - DNA, 75 bp, Artificial Sequence
  Synthetic
gtctgtgtaaaagaccccaataaacgtatatcgctactacacccttgtgtgtcaatggacgcctctccggggggg

SEQ ID NO: 153702 - DNA, 75 bp, Artificial Sequence
  Synthetic
ctgggctttatgcgcgcaccccctcccctcgcgcggcccaccgcgcggatatacgcctggctcaaactggcggcc

SEQ ID NO: 153703 - DNA, 75 bp, Artificial Sequence
  Synthetic
atacgcctggctcaaactggcggccggtggagcggcccttgttctgtggagtctcggggagcccggaacgcagcc

SEQ ID NO: 153704 - DNA, 75 bp, Artificial Sequence
  Synthetic
tgcctggcgctgggcgccgcctatgcggcgctcctggtgctcgccgatgacgtctatccgctctttctcctcgcc

SEQ ID NO: 153705 - DNA, 75 bp, Artificial Sequence
  Synthetic
cggcgctcctggtgctcgccgatgacgtctatccgctctttctcctcgccccggggcccctgttcgtcggcaccc

SEQ ID NO: 153706 - DNA, 75 bp, Artificial Sequence
  Synthetic
gatcggaggcagcgcgcgctactggtggatcggtgggcccgccgcggccgccttggccgcggcggtgttggcggg

SEQ ID NO: 153707 - DNA, 75 bp, Artificial Sequence
  Synthetic
tggatcggtgggcccgccgcggccgccttggccgcggcggtgttggcgggcccgggggcgaccaccgccagggac

SEQ ID NO: 153708 - DNA, 75 bp, Artificial Sequence
  Synthetic
accgccgcgtctgcgtcatcgtcgcaggcgagtctgtttcccgccgccccccggaggacccagagcgacccgggg

SEQ ID NO: 153709 - DNA, 75 bp, Artificial Sequence
  Synthetic
ccggaggacccagagcgacccggggaccccgggccaccgtcccccccgacaccccaacgatcccaggggccgccg

SEQ ID NO: 153710 - DNA, 75 bp, Artificial Sequence
  Synthetic
cttcggtctccgcctcagagtcgctgctgtccggcaggtctcggtcgcagggaaacacccagacatccggggcgg

SEQ ID NO: 153711 - DNA, 75 bp, Artificial Sequence
  Synthetic
gagaacatgcccgggaaacgccgggcccgggcctgccgctgtggccccaggtgtttctcggaggccatgtggcgg

SEQ ID NO: 153712 - DNA, 75 bp, Artificial Sequence
  Synthetic
cccgggcctgccgctgtggccccaggtgtttctcggaggccatgtggcggtggccctgacggagctgtgtcaggc

SEQ ID NO: 153713 - DNA, 75 bp, Artificial Sequence
  Synthetic
ggaaacacccagacatccggggcgggctaaggggaaaaaaaggggggcgggtaagaatggggggatttcccgcgt

SEQ ID NO: 153714 - DNA, 75 bp, Artificial Sequence
  Synthetic
ccgctgctgtttgttcacgccggactgcaggtcatcaacctcgggttggtgtttcggttttccgaggttgtcgtg

SEQ ID NO: 153715 - DNA, 75 bp, Artificial Sequence
  Synthetic
tgcaggtcatcaacctcgggttggtgtttcggttttccgaggttgtcgtgtatgcggcgctagggggtgccgtgt

SEQ ID NO: 153716 - DNA, 75 bp, Artificial Sequence
  Synthetic
ctcccgccctccagacgcaccggagtcgggggtcccacggcgtcccccaaatatggcgggcggctcctccccacc

SEQ ID NO: 153717 - DNA, 75 bp, Artificial Sequence
  Synthetic
gctccggcgtcgcctgcacaggaaggaccccggggacggggcccggttggcggcgacgcttcggggcctcttctt

SEQ ID NO: 153718 - DNA, 75 bp, Artificial Sequence
  Synthetic
gaccccggggacggggcccggttggcggcgacgcttcggggcctcttcttctccgtgtacgcgctggggtttggg

SEQ ID NO: 153719 - DNA, 75 bp, Artificial Sequence
  Synthetic
cacgccccctaacacggcgaccccggtccctgtgtgtttgttgtgggggcgtgtctctgtgtatgagtcaggggg

SEQ ID NO: 153720 - DNA, 75 bp, Artificial Sequence
  Synthetic
ggtcaacgggcgggtggtcgggcgattgatatatttttcaataaaaggcattagtcccgaagaccgccggtgtgt

SEQ ID NO: 153721 - DNA, 75 bp, Artificial Sequence
  Synthetic
ttagtcccgaagaccgccggtgtgtgatgatttcgccataacacccaaaccccggatggggcccgggtataaatt

SEQ ID NO: 153722 - DNA, 75 bp, Artificial Sequence
  Synthetic
tcccacggcgaccccgggccctgcgtctgagtcaaaggggccatgtgtatgtgttggggggtctgtatatataaa

SEQ ID NO: 153723 - DNA, 75 bp, Artificial Sequence
  Synthetic
actaccgagggcgcttggtcgggaggccgcatcgaacgcacacccccatccggtggtccgtgtggaggtcgtttt

SEQ ID NO: 153724 - DNA, 75 bp, Artificial Sequence
  Synthetic
gaacgctagccgatccctcgcgagggggaggcgtcgggcatggccccggggcgggtgggccttgccgtggtcctg

SEQ ID NO: 153725 - DNA, 75 bp, Artificial Sequence
  Synthetic
gggaggcgtcgggcatggccccggggcgggtgggccttgccgtggtcctgtggagcctgttgtggctcggggcgg

SEQ ID NO: 153726 - DNA, 75 bp, Artificial Sequence
  Synthetic
ctccaccgggcccacgatcaccgcgggagcggtgacgaacgcgagcgaggcccccacatcggggtcccccgggtc

SEQ ID NO: 153727 - DNA, 75 bp, Artificial Sequence
  Synthetic
gcgccccagacatggcgcccggcccctcacctcgcgctgggggcggccctcaggccggcgggtactcgctccggg

SEQ ID NO: 153728 - DNA, 75 bp, Artificial Sequence
  Synthetic
ccccccctaaagttgttcctaaagcgaggatatggaggagtggcgggtgccgggggaccggggtgatctctggca

SEQ ID NO: 153729 - DNA, 75 bp, Artificial Sequence
  Synthetic
acatcgaccccaaaccccaacaatgtcacacaaaacaaaaccacccccaccgagccggccagccccccaacaacc

SEQ ID NO: 153730 - DNA, 75 bp, Artificial Sequence
  Synthetic
caaacccaagaacaacaccacccccgccaagtcgggccgccccactaaaccccccgggcccgtgtggtgcgaccg

SEQ ID NO: 153731 - DNA, 75 bp, Artificial Sequence
  Synthetic
tcgcgggtgcagatccgatgccggtttcggaattccacccgcatggagttccgcctccagatatggcgttactcc

SEQ ID NO: 153732 - DNA, 75 bp, Artificial Sequence
  Synthetic
ttcggaattccacccgcatggagttccgcctccagatatggcgttactccatgggtccgtcccccccaatcgctc

SEQ ID NO: 153733 - DNA, 75 bp, Artificial Sequence
  Synthetic
ccgcctccagatatggcgttactccatgggtccgtcccccccaatcgctccggctcccgacctagaggaggtcct

SEQ ID NO: 153734 - DNA, 75 bp, Artificial Sequence
  Synthetic
ggactcctggtgtacgacagcgcccccaacctgacggacccccacgtgctctgggcggagggggccggcccgggc

SEQ ID NO: 153735 - DNA, 75 bp, Artificial Sequence
  Synthetic
ccaacctgacggacccccacgtgctctgggcggagggggccggcccgggcgccgaccctccgttgtattctgtca

SEQ ID NO: 153736 - DNA, 75 bp, Artificial Sequence
  Synthetic
gattatcggcgaggtgacgcccgcgacccagggaatgtattacttggcctggggccggatggacagcccgcacga

SEQ ID NO: 153737 - DNA, 75 bp, Artificial Sequence
  Synthetic
acccagggaatgtattacttggcctggggccggatggacagcccgcacgagtacgggacgtgggtgcgcgtccgc

SEQ ID NO: 153738 - DNA, 75 bp, Artificial Sequence
  Synthetic
cgcacccccactcccacgcacccccactcccacgcacccccactcccacgcacccccactcccacgcacccccac

SEQ ID NO: 153739 - DNA, 75 bp, Artificial Sequence
  Synthetic
tccagccccacgcggtgatggagggtcagccgttcaaggcgacgtgcacggccgccgcctactacccgcgtaacc

SEQ ID NO: 153740 - DNA, 75 bp, Artificial Sequence
  Synthetic
gaagcgggaagggcggccggggccgcccattaatgagtttctaattaccataccgggaagcggaacaaggcctct

SEQ ID NO: 153741 - DNA, 75 bp, Artificial Sequence
  Synthetic
aaaacgttacccaggcccgggaacgcagcaacacggaggcggctggattgtgcaagagacccttaaggggggcga

SEQ ID NO: 153742 - DNA, 75 bp, Artificial Sequence
  Synthetic
aacacagacagggaaaagatacaaaagtaaacctttatttcccaacagacagcaaaaatcccctgagtttttttt

SEQ ID NO: 153743 - DNA, 75 bp, Artificial Sequence
  Synthetic
accccgacgggttcaccacagtctctaccgtgacctccgaggctgtcggcggccaggtccccccgcggaccttca

SEQ ID NO: 153744 - DNA, 75 bp, Artificial Sequence
  Synthetic
ctccgtgatgttctcgcgacgcaatgccaccgggctggccctggtgctgccgcggccaaccatcaccatggaatt

SEQ ID NO: 153745 - DNA, 75 bp, Artificial Sequence
  Synthetic
gccggctgcgtccccgagggcgtgacgtttgcctggttcctgggggacgacccctcaccggcggctaagtcggcc

SEQ ID NO: 153746 - DNA, 75 bp, Artificial Sequence
  Synthetic
cgtttgcctggttcctgggggacgacccctcaccggcggctaagtcggccgttacggcccaggagtcgtgcgacc

SEQ ID NO: 153747 - DNA, 75 bp, Artificial Sequence
  Synthetic
caccctgcccatttcgtacgactacagcgagtacatctgtcggttgaccggatatccggccgggattcccgttct

SEQ ID NO: 153748 - DNA, 75 bp, Artificial Sequence
  Synthetic
agcgagtacatctgtcggttgaccggatatccggccgggattcccgttctagagcaccacggcagtcaccagccc

SEQ ID NO: 153749 - DNA, 75 bp, Artificial Sequence
  Synthetic
aggtgatcgaggcgatcgagtgggtggggattggaatcggggttctcgcggcgggggtcctggtcgtaacggcaa

SEQ ID NO: 153750 - DNA, 75 bp, Artificial Sequence
  Synthetic
tcgcgggggtcgcgggggtcgcgggggtcgcggggggctccggcgccccctccccgcccgcgcgtcgcaggcgca

SEQ ID NO: 153751 - DNA, 75 bp, Artificial Sequence
  Synthetic
ctatcccgcccaccgctgggcgctataaagccgccaccctctcttccctcaggtcatccttggtcgatcccgaac

SEQ ID NO: 153752 - DNA, 75 bp, Artificial Sequence
  Synthetic
aggtcatccttggtcgatcccgaacgacacacggcgtggagcaaaacgcctccccctgagccgctttcctaccaa

SEQ ID NO: 153753 - DNA, 75 bp, Artificial Sequence
  Synthetic
cggaacacgcctaccggcccctgggccccgggacaccccccatgcgggctcggctccccgccgcggcctgggttg

SEQ ID NO: 153754 - DNA, 75 bp, Artificial Sequence
  Synthetic
ccccgggacaccccccatgcgggctcggctccccgccgcggcctgggttggcgtcgggaccatcatcgggggagt

SEQ ID NO: 153755 - DNA, 75 bp, Artificial Sequence
  Synthetic
gtgccctcgcgggcctcgtgggcactttccccatgcgacagcggatggcacgagttcaacctcgggtgcatatcc

SEQ ID NO: 153756 - DNA, 75 bp, Artificial Sequence
  Synthetic
tttccccatgcgacagcggatggcacgagttcaacctcgggtgcatatcctgggatccgacccccatggagcacg

SEQ ID NO: 153757 - DNA, 75 bp, Artificial Sequence
  Synthetic
tgccggggtggtagagtttgacaggcaagcatgtgcgtgcagaggcgagtagtgcttgcctgtctaactcgctcg

SEQ ID NO: 153758 - DNA, 75 bp, Artificial Sequence
  Synthetic
cccggcgaccctgatcccccgcgcggctgccaaacagctggccgccgtcgcacgcgtccagtcggcaagatcctc

SEQ ID NO: 153759 - DNA, 75 bp, Artificial Sequence
  Synthetic
gctgccaaacagctggccgccgtcgcacgcgtccagtcggcaagatcctcgggctactggtgggtgagcggagac

SEQ ID NO: 153760 - DNA, 75 bp, Artificial Sequence
  Synthetic
tcgacggcgtcggcggtattgaccagttttgcgaggagcccgcccttcgcatatgctactatccccgcagtcccg

SEQ ID NO: 153761 - DNA, 75 bp, Artificial Sequence
  Synthetic
cccgctcctccccccgctcctccccccgctcctccccccgctcctccccccgctcctccccccgctcctcccccc

SEQ ID NO: 153762 - DNA, 75 bp, Artificial Sequence
  Synthetic
gttttgcgaggagcccgcccttcgcatatgctactatccccgcagtcccgggggctttgttcagtttgtaacttc

SEQ ID NO: 153763 - DNA, 75 bp, Artificial Sequence
  Synthetic
cgctcctccccccgctcctccccccgctcctccccccgctcctccccccgctcctccccccgctcctccccccgc

SEQ ID NO: 153764 - DNA, 75 bp, Artificial Sequence
  Synthetic
tgaggcgcgtgtactgcggtctgtctcgtctcctcttctccccttccctccccctccgcatcccaggatcacacc

SEQ ID NO: 153765 - DNA, 75 bp, Artificial Sequence
  Synthetic
gcacggacccaaaataataaacacacaatcacgtgcgataaaaagaacacgcggtcccctgtggtgtttttggtt

SEQ ID NO: 153766 - DNA, 75 bp, Artificial Sequence
  Synthetic
caatcacgtgcgataaaaagaacacgcggtcccctgtggtgtttttggttatttttattaaatctcgtcgacaaa

SEQ ID NO: 153767 - DNA, 75 bp, Artificial Sequence
  Synthetic
ccgcccgccttttttgcgcgccgccccgcccgcggggggcccgggctgccacaggtgtaacaacaccaacagaac

SEQ ID NO: 153768 - DNA, 75 bp, Artificial Sequence
  Synthetic
gcggtcccctgtggtgtttttggttatttttattaaatctcgtcgacaaacagggggaaaggggcgtggtctagc

SEQ ID NO: 153769 - DNA, 75 bp, Artificial Sequence
  Synthetic
ccgcccgcggggggcccgggctgccacaggtgtaacaacaccaacagaacaccaacagcacggcgcaccggcgac

SEQ ID NO: 153770 - DNA, 75 bp, Artificial Sequence
  Synthetic
accggctccggcgtccttcgcgtttaagcttggtcaggagggcgctcagggcggcgacgttggtcgggccgtcgt

SEQ ID NO: 153771 - DNA, 75 bp, Artificial Sequence
  Synthetic
aagcttggtcaggagggcgctcagggcggcgacgttggtcgggccgtcgttggtcagggcgttggctcgatggcg

SEQ ID NO: 153772 - DNA, 75 bp, Artificial Sequence
  Synthetic
tcaccgcgcaacaactcctgttcctcatccacacgtcaccgcgcaccccccgctcctccagacgtcccccagcgc

SEQ ID NO: 153773 - DNA, 75 bp, Artificial Sequence
  Synthetic
ggcgggggcgggggtccggtgcggcccgggggggaaaatagggcggatcccccccagtcgtacaggggattttcc

SEQ ID NO: 153774 - DNA, 75 bp, Artificial Sequence
  Synthetic
ccgggggggaaaatagggcggatcccccccagtcgtacaggggattttccgcctcaatgtacggggaggccggcg

SEQ ID NO: 153775 - DNA, 75 bp, Artificial Sequence
  Synthetic
ccctccccagccccagccctccccggccccagccctccccggccccagccctccccggccccagccctccccggc

SEQ ID NO: 153776 - DNA, 75 bp, Artificial Sequence
  Synthetic
gttttcgtagacccgcatccatggtatttcctcgtagacacgccccccgtcctcgctcacggtctcgtatattga

SEQ ID NO: 153777 - DNA, 75 bp, Artificial Sequence
  Synthetic
ctcgtcgtcctcgtagggggcgtgccgttcgcgggccgaggcggcgtgggtggctttgcggcgggcgtcgtcgtc

SEQ ID NO: 153778 - DNA, 75 bp, Artificial Sequence
  Synthetic
cgcccctcgccccctcccgcccctcgccccctcccgcccctcgccccctcccgcccctcgccccctcccgcccct

SEQ ID NO: 153779 - DNA, 75 bp, Artificial Sequence
  Synthetic
gtcgtcgtcggccgtcagatacgtggcttccatctggtcgggttctccctccggggcgggtccccacacccgtgg

SEQ ID NO: 153780 - DNA, 75 bp, Artificial Sequence
  Synthetic
gggggcacctcccccatgtgcgtgtaatacgtggccggctgtgcggccgcagcggggggctcggcgaccgggtcg

SEQ ID NO: 153781 - DNA, 75 bp, Artificial Sequence
  Synthetic
aatacgtggccggctgtgcggccgcagcggggggctcggcgaccgggtcgtccgcatccggaagcgggggccccg

SEQ ID NO: 153782 - DNA, 75 bp, Artificial Sequence
  Synthetic
agcggggggctcggcgaccgggtcgtccgcatccggaagcgggggccccgcgccgtccgcacggcgcctccggaa

SEQ ID NO: 153783 - DNA, 75 bp, Artificial Sequence
  Synthetic
ccctcgccccctcccgcccctcgccccctcccgcccctcgccccctcccgcccctcgaaataaacaacgctactg

SEQ ID NO: 153784 - DNA, 75 bp, Artificial Sequence
  Synthetic
gagtgtaggcgaggtcgggggaggggcgggggctcgttgtcgcgccgcgcccgctgaatcttttcccgacaggtc

SEQ ID NO: 153785 - DNA, 75 bp, Artificial Sequence
  Synthetic
ggccggttccagtgtaagggtcgggggtcccccaacatggcgccccccaacatggcgccccccaacatggcgccc

SEQ ID NO: 153786 - DNA, 75 bp, Artificial Sequence
  Synthetic
gcgggggctcgttgtcgcgccgcgcccgctgaatcttttcccgacaggtcccaccccccgcgcgatgcccccccg

SEQ ID NO: 153787 - DNA, 75 bp, Artificial Sequence
  Synthetic
aggccccgcggaccacgtcgtccggcgagacgccacgagccgcaggatggactcgtagtggagcgacggcgcccc

SEQ ID NO: 153788 - DNA, 75 bp, Artificial Sequence
  Synthetic
cgagacgccacgagccgcaggatggactcgtagtggagcgacggcgccccgctgcggagcagatccgcggccagg

SEQ ID NO: 153789 - DNA, 75 bp, Artificial Sequence
  Synthetic
ccgccgccagcacggtgccgctgcggcccgtggccgaggcccagcgaatcccgggcaacgccggcggcagggccc

SEQ ID NO: 153790 - DNA, 75 bp, Artificial Sequence
  Synthetic
tcaactccatccgggcccagctgggggcggtcatcgtggggaacaggggggcggtggtccgacagaaacgctcct

SEQ ID NO: 153791 - DNA, 75 bp, Artificial Sequence
  Synthetic
ggcggtcatcgtggggaacaggggggcggtggtccgacagaaacgctcctggctgtccaccgcggcccgcagata

SEQ ID NO: 153792 - DNA, 75 bp, Artificial Sequence
  Synthetic
cagacgccgtacccggtgagggtcgcgttgatgatatactgggcgtggtgatggacgatcgacagaacctccacc

SEQ ID NO: 153793 - DNA, 75 bp, Artificial Sequence
  Synthetic
accaccgcttaagcggcccccgcgaggtccgaagactcatttggatccggcgggagccacccgacaacagccccc

SEQ ID NO: 153794 - DNA, 75 bp, Artificial Sequence
  Synthetic
cgttgatgatatactgggcgtggtgatggacgatcgacagaacctccaccgtggataccacggtatccacggtcc

SEQ ID NO: 153795 - DNA, 75 bp, Artificial Sequence
  Synthetic
ggtctgccacaggttggctaggcacgtcaggtggcccaggacgtcgctgaccgccgccctgagcgccatgcactg

SEQ ID NO: 153796 - DNA, 75 bp, Artificial Sequence
  Synthetic
gtcaggtggcccaggacgtcgctgaccgccgccctgagcgccatgcactgcatggagccggtcgtgccgctggga

SEQ ID NO: 153797 - DNA, 75 bp, Artificial Sequence
  Synthetic
tttccgcgggcgcctccgggctgccgccgagcgggaggaaccggcgattggagggactcagccggtgacatacgt

SEQ ID NO: 153798 - DNA, 75 bp, Artificial Sequence
  Synthetic
gcttgtccgtcgtccacagcatccaggacgcccaccggtacagcacggagacgtaggccaggagctcgttgagcc

SEQ ID NO: 153799 - DNA, 75 bp, Artificial Sequence
  Synthetic
acgtaggccaggagctcgttgagccgcagtgcggtgtcggtgctggggcggcttgggtccgccgggcgcataaag

SEQ ID NO: 153800 - DNA, 75 bp, Artificial Sequence
  Synthetic
gcagtgcggtgtcggtgctggggcggcttgggtccgccgggcgcataaagaacatgtactgctgaatccgatgga

SEQ ID NO: 153801 - DNA, 75 bp, Artificial Sequence
  Synthetic
ggcggcgtacttggccgccgcggccccgctcttgaacggggtgcgcgccagcagctttggcgccagggtgggccg

SEQ ID NO: 153802 - DNA, 75 bp, Artificial Sequence
  Synthetic
ttttaattaccataccgggaagtgggcggcccggcccactgggcgggagttaccgcccagtgggccgggccccga

SEQ ID NO: 153803 - DNA, 75 bp, Artificial Sequence
  Synthetic
ccgctcttgaacggggtgcgcgccagcagctttggcgccagggtgggccgcagcagcacgtgaaggctggggtcg

SEQ ID NO: 153804 - DNA, 75 bp, Artificial Sequence
  Synthetic
cgtccaggccgctgggcaccaccgtctgcaggtacttccagtactgcgtgaggatggcgcggctcaactggccgc

SEQ ID NO: 153805 - DNA, 75 bp, Artificial Sequence
  Synthetic
ctgggtggcggccgaagcgtagtgccggatgtactcgtagtgcgggtcgctggcgagcccgtccacgatcaaact

SEQ ID NO: 153806 - DNA, 75 bp, Artificial Sequence
  Synthetic
cggatgtactcgtagtgcgggtcgctggcgagcccgtccacgatcaaactctcgggaaccgtgttgtgttgccgc

SEQ ID NO: 153807 - DNA, 75 bp, Artificial Sequence
  Synthetic
tggcgagcccgtccacgatcaaactctcgggaaccgtgttgtgttgccgcgcggccaaccggacgctgcgatcgg

SEQ ID NO: 153808 - DNA, 75 bp, Artificial Sequence
  Synthetic
gtcgtcggagcgctgccgcaaggcgcccacggccgcgctaaggagcccctccggggtggggagcagacacccgcc

SEQ ID NO: 153809 - DNA, 75 bp, Artificial Sequence
  Synthetic
cccacggccgcgctaaggagcccctccggggtggggagcagacacccgccgaagatgcgccgctcgggaacgccc

SEQ ID NO: 153810 - DNA, 75 bp, Artificial Sequence
  Synthetic
caggcgtcaggcaccgcgccagccgcagggagctcgcgccgcgcgtccggcgctgcatggtgacgcccgttcggt

SEQ ID NO: 153811 - DNA, 75 bp, Artificial Sequence
  Synthetic
cagggagctcgcgccgcgcgtccggcgctgcatggtgacgcccgttcggtcgggacccgccggtcggagttatgc

SEQ ID NO: 153812 - DNA, 75 bp, Artificial Sequence
  Synthetic
tttatcgggaggagcttatgggcgtggcgggcctcccagcccggtcgcgcgcctccccgacacgtgcgcccgcag

SEQ ID NO: 153813 - DNA, 75 bp, Artificial Sequence
  Synthetic
ggcgggcctcccagcccggtcgcgcgcctccccgacacgtgcgcccgcagggcggcggccccctcgtctcccatc

SEQ ID NO: 153814 - DNA, 75 bp, Artificial Sequence
  Synthetic
tgtccaccacgcggacccgcgggcccaacacggacccgccgcttacgggggcgggggggaagggctccaggtcct

SEQ ID NO: 153815 - DNA, 75 bp, Artificial Sequence
  Synthetic
gcctgcgccgcggcggcccggggcgccgcgggctgggcgggggcgggctcgggccccgggggcgtggaggggggc

SEQ ID NO: 153816 - DNA, 75 bp, Artificial Sequence
  Synthetic
cccggacacgggggcccggggcgcggaggaggcggggcgcagatccacgtgctccgcggccgcgcggacgtccgc

SEQ ID NO: 153817 - DNA, 75 bp, Artificial Sequence
  Synthetic
gaggaggcggggcgcagatccacgtgctccgcggccgcgcggacgtccgcccagaacttggcgggggtggtgcgc

SEQ ID NO: 153818 - DNA, 75 bp, Artificial Sequence
  Synthetic
gctccgcggccgcgcggacgtccgcccagaacttggcgggggtggtgcgcgcgtacaggggctgggtcgctcgga

SEQ ID NO: 153819 - DNA, 75 bp, Artificial Sequence
  Synthetic
ccgcggcgcggcggaggcggcggcggccgccagcgcgtcggcggcgtccggtgcgctggcggccgccgccagcag

SEQ ID NO: 153820 - DNA, 75 bp, Artificial Sequence
  Synthetic
gtacgtgcccacctcgggggccgtgaatcccccgtcaaacgcggccagtgtcacgcacgccaccacggtgtcggc

SEQ ID NO: 153821 - DNA, 75 bp, Artificial Sequence
  Synthetic
tcacgcacgccaccacggtgtcggcaaagcccagcagccgctgcaggacgagcccggcggccagaatggcgcgcg

SEQ ID NO: 153822 - DNA, 75 bp, Artificial Sequence
  Synthetic
gtgcgcgtccccgcacgcccgggcgtactttaaggtcactgtcgccagggccgtgtgcagcgcgtacaccgcagc

SEQ ID NO: 153823 - DNA, 75 bp, Artificial Sequence
  Synthetic
tactttaaggtcactgtcgccagggccgtgtgcagcgcgtacaccgcagcgcccagcacggcgttgagcccgctg

SEQ ID NO: 153824 - DNA, 75 bp, Artificial Sequence
  Synthetic
tgtcgcccagcgcctcgtgctcggcccccacgaccgcggggcttcccaggggcagggcgcgaaacagctcctccc

SEQ ID NO: 153825 - DNA, 75 bp, Artificial Sequence
  Synthetic
tcacagcgacaactcaccgcgcaacaactcctgttcctcatccacacgtcaccgcgcacctcccgctcctccaga

SEQ ID NO: 153826 - DNA, 75 bp, Artificial Sequence
  Synthetic
ccccacgaccgcggggcttcccaggggcagggcgcgaaacagctcctcccgcgccacgtccgcaaaggcggggtg

SEQ ID NO: 153827 - DNA, 75 bp, Artificial Sequence
  Synthetic
cccacgaccaccgagagccactggaccgtctgctccgccatcaccgccaacacatccagcacgcgccccaggaag

SEQ ID NO: 153828 - DNA, 75 bp, Artificial Sequence
  Synthetic
ccgtctgctccgccatcaccgccaacacatccagcacgcgccccaggaaggcggcctcccgcgtcaaaacgcacc

SEQ ID NO: 153829 - DNA, 75 bp, Artificial Sequence
  Synthetic
gagcagggccccggtggccaggtacgtcatgcggccggcatagcgggcggccacgcgacagtcgcggtccagcag

SEQ ID NO: 153830 - DNA, 75 bp, Artificial Sequence
  Synthetic
gtcatgcggccggcatagcgggcggccacgcgacagtcgcggtccagcagcgcgcgcaccccgggccagtacagc

SEQ ID NO: 153831 - DNA, 75 bp, Artificial Sequence
  Synthetic
ccgcggcgtcggggccggattggggggacactaacccccccgcgctcagtaacggcacggccgcggccccgacgg

SEQ ID NO: 153832 - DNA, 75 bp, Artificial Sequence
  Synthetic
aacggcacggccgcggccccgacgggacgcaacgccgtgaggctcgcgaactgccgcctcagctcggcagccctg

SEQ ID NO: 153833 - DNA, 75 bp, Artificial Sequence
  Synthetic
ctgcgtgaaggcgcgtcccgcacacccacccgttgatggccagccgcacgacggcatccgccaaaaagctcatcg

SEQ ID NO: 153834 - DNA, 75 bp, Artificial Sequence
  Synthetic
ccacccgttgatggccagccgcacgacggcatccgccaaaaagctcatcgcctgggcggggctggtttttgttcg

SEQ ID NO: 153835 - DNA, 75 bp, Artificial Sequence
  Synthetic
tcgcccgtgatataccaggccaacgcctcgccctgctgcagggtttggcggaaaaacaccgcggggttgtcgggg

SEQ ID NO: 153836 - DNA, 75 bp, Artificial Sequence
  Synthetic
cctcgccctgctgcagggtttggcggaaaaacaccgcggggttgtcgggggaggcgaagtgcatgacccccacgc

SEQ ID NO: 153837 - DNA, 75 bp, Artificial Sequence
  Synthetic
acacgggtaaaacccggccggatgccccagggctagggcggagcgcacggactcgtcccacacggcaacctgagg

SEQ ID NO: 153838 - DNA, 75 bp, Artificial Sequence
  Synthetic
cccagggctagggcggagcgcacggactcgtcccacacggcaacctgaggggccagtcgatccaacgggaatgcc

SEQ ID NO: 153839 - DNA, 75 bp, Artificial Sequence
  Synthetic
gtccctccagaacctccaccttgggcggggaacgggccccgccgccgtcctccggcccgacgtcttccgggtagt

SEQ ID NO: 153840 - DNA, 75 bp, Artificial Sequence
  Synthetic
cgtcctcctcgtactgcagttcctctaggaacagcggcgacggcgccacccgcgaaccgccgacccgccccaaaa

SEQ ID NO: 153841 - DNA, 75 bp, Artificial Sequence
  Synthetic
cgcgaaccgccgacccgccccaaaatagcccgcgcgtcgacgggacccaggtatcccccctgccgggcctgcgga

SEQ ID NO: 153842 - DNA, 75 bp, Artificial Sequence
  Synthetic
tagcccgcgcgtcgacgggacccaggtatcccccctgccgggcctgcggaggaccgcggggaacctcatcatcat

SEQ ID NO: 153843 - DNA, 75 bp, Artificial Sequence
  Synthetic
gctacgggccgcatcgggcccggggcgctgccgggacgctcggcgatgggatgagggcggggcttccgacgcgcg

SEQ ID NO: 153844 - DNA, 75 bp, Artificial Sequence
  Synthetic
cgctgccgggacgctcggcgatgggatgagggcggggcttccgacgcgcgccgtcgtcgggctcgcgggccttcc

SEQ ID NO: 153845 - DNA, 75 bp, Artificial Sequence
  Synthetic
cgcccgccatctcctccagagcctctagctcgctgtcgtcatccccgcggaacaccgcacgcaggtaccccatga

SEQ ID NO: 153846 - DNA, 75 bp, Artificial Sequence
  Synthetic
tagctcgctgtcgtcatccccgcggaacaccgcacgcaggtaccccatgaaccccaccccatcgcccgctggctc

SEQ ID NO: 153847 - DNA, 75 bp, Artificial Sequence
  Synthetic
cgggtggatgcgcgcctcctgcgccccgcgggttcgcgagccgacatggtggcgatagacgcgggttatcggatg

SEQ ID NO: 153848 - DNA, 75 bp, Artificial Sequence
  Synthetic
cccgcgaaggctacccgccgccccagcccccggccaaatgcggaaacggtcccgcgctctcgcctttatacgcgg

SEQ ID NO: 153849 - DNA, 75 bp, Artificial Sequence
  Synthetic
gcccccggccaaatgcggaaacggtcccgcgctctcgcctttatacgcgggccgccctgcgacacaatcacccgt

SEQ ID NO: 153850 - DNA, 75 bp, Artificial Sequence
  Synthetic
gcccgcagacgcggctaacacacacgccggcaacccagaccccagtgggttggttgcgcggtcccgtctcctggc

SEQ ID NO: 153851 - DNA, 75 bp, Artificial Sequence
  Synthetic
taatgtatgtgctcgtgtttattgtggatacgaaccggggacgggaggggaaaacccagacgggggatgcgggtc

SEQ ID NO: 153852 - DNA, 75 bp, Artificial Sequence
  Synthetic
ggatacgaaccggggacgggaggggaaaacccagacgggggatgcgggtccggtcgcgccccctacccaccgtac

SEQ ID NO: 153853 - DNA, 75 bp, Artificial Sequence
  Synthetic
gtccagatcgaaatcgtctagcgcgtcggcatgcgccatcgccacgtcctcgccgtctaagtggagctcgtcccc

SEQ ID NO: 153854 - DNA, 75 bp, Artificial Sequence
  Synthetic
tcggcatgcgccatcgccacgtcctcgccgtctaagtggagctcgtcccccaggctgacatcggtcgggggggcc

SEQ ID NO: 153855 - DNA, 75 bp, Artificial Sequence
  Synthetic
cggggagaaaggacaggcgcggagccgccagccccgcctcttcgggggcgtcgtcgtccgggagatcgagcaggc

SEQ ID NO: 153856 - DNA, 75 bp, Artificial Sequence
  Synthetic
cgccagccccgcctcttcgggggcgtcgtcgtccgggagatcgagcaggccctcgatggtagacccgtaattgtt

SEQ ID NO: 153857 - DNA, 75 bp, Artificial Sequence
  Synthetic
tgttcccgcatgaccgcctcggagggcgaggtcgtgaagctggaatacgagtccaacttcgcccgaatcaacacc

SEQ ID NO: 153858 - DNA, 75 bp, Artificial Sequence
  Synthetic
gcgaggtcgtgaagctggaatacgagtccaacttcgcccgaatcaacaccataaagtacccagaggcgcgggcct

SEQ ID NO: 153859 - DNA, 75 bp, Artificial Sequence
  Synthetic
cgtcaacggcgcccctggctcctccgtagccgcgctgcgcaccagcgggaggttaaggtgctcgcgaatgtggtt

SEQ ID NO: 153860 - DNA, 75 bp, Artificial Sequence
  Synthetic
gtagccgcgctgcgcaccagcgggaggttaaggtgctcgcgaatgtggtttagctcccgcagccggcgggcctcg

SEQ ID NO: 153861 - DNA, 75 bp, Artificial Sequence
  Synthetic
ctccgttgacgaacatgaagggctggaacagacccgccaactgacgccagctctccaggtcgcaacagaggcagt

SEQ ID NO: 153862 - DNA, 75 bp, Artificial Sequence
  Synthetic
ctctccaggtcgcaacagaggcagtcaaacaggtcgggccgcatcatctgctcggcgtacgcggcccataggatc

SEQ ID NO: 153863 - DNA, 75 bp, Artificial Sequence
  Synthetic
gcaaaaacagaacacgcgccagacgagcggtctctcggtagtacctgtccgcgatcgtggcgcgcagcatttctc

SEQ ID NO: 153864 - DNA, 75 bp, Artificial Sequence
  Synthetic
agcggtctctcggtagtacctgtccgcgatcgtggcgcgcagcatttctcccaggtcgcgatcgcgtccgcgcat

SEQ ID NO: 153865 - DNA, 75 bp, Artificial Sequence
  Synthetic
acgctggcgcgcaggtaccggtacagggccgagcagaagttggccaacacggttcgatagctctcctcccgcgcc

SEQ ID NO: 153866 - DNA, 75 bp, Artificial Sequence
  Synthetic
cccacccaccccacccacgaaacacaggggacgcaccccgggggcctccgacgacagaaacccaccggtccgcct

SEQ ID NO: 153867 - DNA, 75 bp, Artificial Sequence
  Synthetic
ggttcgatagctctcctcccgcgcccgtagctcggcgtggaagaaacgagagagcgcttcgtagtagagcccgag

SEQ ID NO: 153868 - DNA, 75 bp, Artificial Sequence
  Synthetic
gggcggaggagggggggacgcgggggcggaggaggggggacgcgggggcggaggaggggggacgcgggggcggag

SEQ ID NO: 153869 - DNA, 75 bp, Artificial Sequence
  Synthetic
gggaaggccacgtcgccgtgggcgcgaatgtcgatttgggcgcgttcggggacgtacgcgtccccccattccacc

SEQ ID NO: 153870 - DNA, 75 bp, Artificial Sequence
  Synthetic
gacgtacgcgtccccccattccaccacatcgctgggcagcgttgataggaatttacactcccggtacaggtcggc

SEQ ID NO: 153871 - DNA, 75 bp, Artificial Sequence
  Synthetic
tcctcgttccaggtatcgagcatggtacatagcgcggggcccgcgctaaagcccaagtcgtcgaggagacggtta

SEQ ID NO: 153872 - DNA, 75 bp, Artificial Sequence
  Synthetic
tacatagcgcggggcccgcgctaaagcccaagtcgtcgaggagacggttaaagagggcggcgggggggacgggca

SEQ ID NO: 153873 - DNA, 75 bp, Artificial Sequence
  Synthetic
ctggctcaggcgccccgttgcgtacagcggaggggccgccggggtgtttttgggacccccggccgggcggggggg

SEQ ID NO: 153874 - DNA, 75 bp, Artificial Sequence
  Synthetic
atgtcggcaaacagctcgtcgaccaagaggtccattgggtggggttgatacgggaaagacgatatcgggcttttg

SEQ ID NO: 153875 - DNA, 75 bp, Artificial Sequence
  Synthetic
agaggtccattgggtggggttgatacgggaaagacgatatcgggcttttgatgcgatcgtccccgcccgcccaga

SEQ ID NO: 153876 - DNA, 75 bp, Artificial Sequence
  Synthetic
cgggaaagacgatatcgggcttttgatgcgatcgtccccgcccgcccagagagtgtgggacgcccgacggcgcgg

SEQ ID NO: 153877 - DNA, 75 bp, Artificial Sequence
  Synthetic
agaggaccggacggaccttatggggggaagtgggcagcgggaaccccgtccgttcccgaggaatgacagcccgtg

SEQ ID NO: 153878 - DNA, 75 bp, Artificial Sequence
  Synthetic
gtccaacccaccccccgccacccagtcacggtccccgtcggattgggaaacaaaggcacgcaacgccaacaccga

SEQ ID NO: 153879 - DNA, 75 bp, Artificial Sequence
  Synthetic
tcacggtccccgtcggattgggaaacaaaggcacgcaacgccaacaccgaatgaacccctgttggtgctttattg

SEQ ID NO: 153880 - DNA, 75 bp, Artificial Sequence
  Synthetic
acgggccgtctggggcgagaagcggagcgggctggggctcgaggtcgctcggtggggcgcgacgccgcagaacgc

SEQ ID NO: 153881 - DNA, 75 bp, Artificial Sequence
  Synthetic
agcgggctggggctcgaggtcgctcggtggggcgcgacgccgcagaacgccctcgagtcgccgtggccgcgtcga

SEQ ID NO: 153882 - DNA, 75 bp, Artificial Sequence
  Synthetic
caactcgttggcgcgctgaatcaggtttttgccctcgcagaccgtcacgcggatggtggtgatgccaaggagttc

SEQ ID NO: 153883 - DNA, 75 bp, Artificial Sequence
  Synthetic
tttttgccctcgcagaccgtcacgcggatggtggtgatgccaaggagttcgttgaggtcttcgtctgtgcgcgga

SEQ ID NO: 153884 - DNA, 75 bp, Artificial Sequence
  Synthetic
cccgcggcgacggtcgcgttgtcgccggcggggcgcggcggctttgggggtttcggttttttgttcttcttcggt

SEQ ID NO: 153885 - DNA, 75 bp, Artificial Sequence
  Synthetic
caggggcgggcggcgccggagtggcagggcccccgttcgccgcctgggtcgcggccgcgaccccaggcgtgccgg

SEQ ID NO: 153886 - DNA, 75 bp, Artificial Sequence
  Synthetic
ccgccatccgggcatgcatggccgccaggcgcccaaccgcggcgcagaagacgcgcttgttaaagccggccaccc

SEQ ID NO: 153887 - DNA, 75 bp, Artificial Sequence
  Synthetic
caggcgcccaaccgcggcgcagaagacgcgcttgttaaagccggccacccggggggtccatggcgcgtcggggtt

SEQ ID NO: 153888 - DNA, 75 bp, Artificial Sequence
  Synthetic
tttctggccagcccctgcgcgggtgtcttggatcgggttggcgccgtcgacgcgggggcgtctgggagtgcggcg

SEQ ID NO: 153889 - DNA, 75 bp, Artificial Sequence
  Synthetic
tcttggatcgggttggcgccgtcgacgcgggggcgtctgggagtgcggcggattctggctgggccgatttcctgc

SEQ ID NO: 153890 - DNA, 75 bp, Artificial Sequence
  Synthetic
cgcgggggccttagtcgccacccgctgggttcggggggcccggggggcggtggtgggtgtgcgtccggcccctcc

SEQ ID NO: 153891 - DNA, 75 bp, Artificial Sequence
  Synthetic
tgggttcggggggcccggggggcggtggtgggtgtgcgtccggcccctccggacccagcgggcggcggaggcgcc

SEQ ID NO: 153892 - DNA, 75 bp, Artificial Sequence
  Synthetic
ccgccccggaaacgggacgccgcgtccgggggacctccgggtgttcgtcgtcttcggatgacgagcccccgtaga

SEQ ID NO: 153893 - DNA, 75 bp, Artificial Sequence
  Synthetic
ccgggggacctccgggtgttcgtcgtcttcggatgacgagcccccgtagagggcataatccgactcgtcgtactg

SEQ ID NO: 153894 - DNA, 75 bp, Artificial Sequence
  Synthetic
ggggcgagacccacggaccccgacgacccccgccgtcgacgcggaactagcgcggaccggtcgatgcttgggtgg

SEQ ID NO: 153895 - DNA, 75 bp, Artificial Sequence
  Synthetic
gtgtagtacagatcctcgtactcatcgcgcggaacctcccgcggacccgacttcacggagcggcgagaggtcatg

SEQ ID NO: 153896 - DNA, 75 bp, Artificial Sequence
  Synthetic
cttcacggagcggcgagaggtcatggttccacgaacacgctagggtcggatgcgcggacaattaggcctgggttc

SEQ ID NO: 153897 - DNA, 75 bp, Artificial Sequence
  Synthetic
gagaggtcgagcgataggggcggcccgggagagaagagagggtccgcaaaacccactggggatgcgtgagtggcc

SEQ ID NO: 153898 - DNA, 75 bp, Artificial Sequence
  Synthetic
cgggagagaagagagggtccgcaaaacccactggggatgcgtgagtggccctctgtgggcggtgggggagagtct

SEQ ID NO: 153899 - DNA, 75 bp, Artificial Sequence
  Synthetic
ccatgggtctaaccaatccccaggggccaagaaacagacacgccccaaacggtctcggtttccgcgaggaagggg

SEQ ID NO: 153900 - DNA, 75 bp, Artificial Sequence
  Synthetic
gccaagaaacagacacgccccaaacggtctcggtttccgcgaggaaggggaagtcctgggacaccctccaccccc

SEQ ID NO: 153901 - DNA, 75 bp, Artificial Sequence
  Synthetic
tcaggcgtgcccggcagccagtagcctctggcagatctgacagacgtgtgcgataatacacacgcccatcgaggc

SEQ ID NO: 153902 - DNA, 75 bp, Artificial Sequence
  Synthetic
cgataatacacacgcccatcgaggccatgcctacataaaagggcaccagggcccccggggcagacatttggccag

SEQ ID NO: 153903 - DNA, 75 bp, Artificial Sequence
  Synthetic
cccgatcccatcgcgcccgccctcctcgccgggcggctccccgtgcgggcccgcgtctcccgccgctaaggcgac

SEQ ID NO: 153904 - DNA, 75 bp, Artificial Sequence
  Synthetic
tcgccgggcggctccccgtgcgggcccgcgtctcccgccgctaaggcgacgagcaagacaaacaacaggcccgcc

SEQ ID NO: 153905 - DNA, 75 bp, Artificial Sequence
  Synthetic
tcgtccctaacaggaagatgagtcagtggggatccggggcgatccttgtccagccggacagcttgggtcgggggt

SEQ ID NO: 153906 - DNA, 75 bp, Artificial Sequence
  Synthetic
gtggggatccggggcgatccttgtccagccggacagcttgggtcgggggtacgatggcgactggcacacggccgt

SEQ ID NO: 153907 - DNA, 75 bp, Artificial Sequence
  Synthetic
caactgaacctggtcaacaggcgcgcggtggcttttatgccgaaggtcagcggggactccggatgggccgtcggg

SEQ ID NO: 153908 - DNA, 75 bp, Artificial Sequence
  Synthetic
cggggactccggatgggccgtcgggcgcgtctctctggacctgcgaatggctatgccggctgacttttgtgcgat

SEQ ID NO: 153909 - DNA, 75 bp, Artificial Sequence
  Synthetic
ccagggcaccacgtaatactgggtcttatcgactcggggtaccgcggaaccgttatggccgtggtcgtagcgcct

SEQ ID NO: 153910 - DNA, 75 bp, Artificial Sequence
  Synthetic
cgttatggccgtggtcgtagcgcctaaaaggacgcgggaatttgcccccgggaccctgcgggtcgacgtgacgtt

SEQ ID NO: 153911 - DNA, 75 bp, Artificial Sequence
  Synthetic
gccctcaccgagccgatttccctgcggcagttcccgcaactggcgcccccccctccaaccggggccgggatacgc

SEQ ID NO: 153912 - DNA, 75 bp, Artificial Sequence
  Synthetic
ggcagttcccgcaactggcgcccccccctccaaccggggccgggatacgcgcagatccttggttggagggggcgc

SEQ ID NO: 153913 - DNA, 75 bp, Artificial Sequence
  Synthetic
cctaccggcgcgacgccgagggcggtccctcgtctatgccggcgagctgacgccggttcagacggaacacgggga

SEQ ID NO: 153914 - DNA, 75 bp, Artificial Sequence
  Synthetic
tccctcgtctatgccggcgagctgacgccggttcagacggaacacggggacggcgtacgagaagccatcgccttc

SEQ ID NO: 153915 - DNA, 75 bp, Artificial Sequence
  Synthetic
gtttcgacattgtcgtccgtcgcccggtcaccgtcccggcaaacggcaccacggtcgtgcagccatccctccgca

SEQ ID NO: 153916 - DNA, 75 bp, Artificial Sequence
  Synthetic
ggtcaccgtcccggcaaacggcaccacggtcgtgcagccatccctccgcatgctccacgcggacgccgggcccgc

SEQ ID NO: 153917 - DNA, 75 bp, Artificial Sequence
  Synthetic
tcgctcaacgcccgcggcctcctggtcgttcctacgcgctggctccccgggcacgtatgtgcgtttgttgtttac

SEQ ID NO: 153918 - DNA, 75 bp, Artificial Sequence
  Synthetic
tcgttcctacgcgctggctccccgggcacgtatgtgcgtttgttgtttacaaccttacgggggttcctgtgaccc

SEQ ID NO: 153919 - DNA, 75 bp, Artificial Sequence
  Synthetic
gctcctggttgcgggggcggacgctcttccttggatccccccggacaactttcacgggaccaaagcgcttcgaaa

SEQ ID NO: 153920 - DNA, 75 bp, Artificial Sequence
  Synthetic
cttccttggatccccccggacaactttcacgggaccaaagcgcttcgaaactaccccaggggtgttccggactca

SEQ ID NO: 153921 - DNA, 75 bp, Artificial Sequence
  Synthetic
tcctggtgtttacgaacgagtttgacgcggaggcccccccgagcgagcgcgggaccgggggttttggctctaccg

SEQ ID NO: 153922 - DNA, 75 bp, Artificial Sequence
  Synthetic
tcacacccgcccctccatcccacaaacacagaacacacgggttggatgaaaacacgcatttattgacccaaaaca

SEQ ID NO: 153923 - DNA, 75 bp, Artificial Sequence
  Synthetic
acacagaacacacgggttggatgaaaacacgcatttattgacccaaaacacacggagctgctcgagatgggccag

SEQ ID NO: 153924 - DNA, 75 bp, Artificial Sequence
  Synthetic
aggtctgggaacggacacgcggggacacgattccggtttggggtccgggagggcgtcgccgtttcgggcggcagg

SEQ ID NO: 153925 - DNA, 75 bp, Artificial Sequence
  Synthetic
gggcgtcgccgtttcgggcggcaggcgccagcgtaacctccgggggcggcgtgtgggggtgccccaaggagggcg

SEQ ID NO: 153926 - DNA, 75 bp, Artificial Sequence
  Synthetic
gcgggttcccccggcaaccccgaaggcggagaggccaagggcccgttcggcgatggccacatcctccatgaccac

SEQ ID NO: 153927 - DNA, 75 bp, Artificial Sequence
  Synthetic
gcggagaggccaagggcccgttcggcgatggccacatcctccatgaccacgtcgctctcggccatgctccgaata

SEQ ID NO: 153928 - DNA, 75 bp, Artificial Sequence
  Synthetic
acttgtcagccgcccccacggacatgtacatctgcaggatggtggccatacacgtgtccgccaggcgccgcatct

SEQ ID NO: 153929 - DNA, 75 bp, Artificial Sequence
  Synthetic
gtacatctgcaggatggtggccatacacgtgtccgccaggcgccgcatcttgtcctgatgggccgccacggcccc

SEQ ID NO: 153930 - DNA, 75 bp, Artificial Sequence
  Synthetic
gggtggtggcgcgccagtcgttctaggttcaccatgcaggcgtggtacgtgcgggccaaggcgcgggccttcacg

SEQ ID NO: 153931 - DNA, 75 bp, Artificial Sequence
  Synthetic
ggttcaccatgcaggcgtggtacgtgcgggccaaggcgcgggccttcacgaggcgtcgggtgtcgtccagggacc

SEQ ID NO: 153932 - DNA, 75 bp, Artificial Sequence
  Synthetic
ggcgggaagtagcgcgttaacgaccaccagggcctcctgcagccgcggctccgcctccgagggcggaacggccgc

SEQ ID NO: 153933 - DNA, 75 bp, Artificial Sequence
  Synthetic
accagggcctcctgcagccgcggctccgcctccgagggcggaacggccgcgcggatcatctcatattgttcctcg

SEQ ID NO: 153934 - DNA, 75 bp, Artificial Sequence
  Synthetic
ccccgagaagagaagccatcgcgggcgggtactggcccttgggcgcgcggacgcaatggggcaggaagacgggaa

SEQ ID NO: 153935 - DNA, 75 bp, Artificial Sequence
  Synthetic
cgggtactggcccttgggcgcgcggacgcaatggggcaggaagacgggaaccgcggggagaggcgggcggccggg

SEQ ID NO: 153936 - DNA, 75 bp, Artificial Sequence
  Synthetic
atgcgaccgacgggtgcgttattacctcttcgatcgccctcctcacaaactctctactgggggccgagccggttt

SEQ ID NO: 153937 - DNA, 75 bp, Artificial Sequence
  Synthetic
ctcttcgatcgccctcctcacaaactctctactgggggccgagccggtttatatattcagctacgacgcatacac

SEQ ID NO: 153938 - DNA, 75 bp, Artificial Sequence
  Synthetic
acggagcaagacaggttcgaagagagtcgggcgctctaccaagcgtcgggcgggctaaatggcgactccttccga

SEQ ID NO: 153939 - DNA, 75 bp, Artificial Sequence
  Synthetic
aacatcttgaggggggagatgggacccgtgacaccctaccccagtccccgggcccagccttcccgttggctgagg

SEQ ID NO: 153940 - DNA, 75 bp, Artificial Sequence
  Synthetic
gtcgggcgctctaccaagcgtcgggcgggctaaatggcgactccttccgagtaaccttttgtttattggggacgg

SEQ ID NO: 153941 - DNA, 75 bp, Artificial Sequence
  Synthetic
tcccgtagtcccatcccccgatcccaacaactcccccgcgcgccccgagaccagtcgcccgaagacaccccccac

SEQ ID NO: 153942 - DNA, 75 bp, Artificial Sequence
  Synthetic
cgggcgaacccgacccatgttcgtctgtcgcttcgagcgagcggacgacgtcgccgcgctacaggacgccctggc

SEQ ID NO: 153943 - DNA, 75 bp, Artificial Sequence
  Synthetic
tgtcgcttcgagcgagcggacgacgtcgccgcgctacaggacgccctggcgcacgggaccccgctacaaccggac

SEQ ID NO: 153944 - DNA, 75 bp, Artificial Sequence
  Synthetic
aacaactcccccgcgcgccccgagaccagtcgcccgaagacaccccccaccattatcgggccgctggcaactcgc

SEQ ID NO: 153945 - DNA, 75 bp, Artificial Sequence
  Synthetic
aggccacgttcgcgctgcatgcgaacatgatcctggctctcaccgtggccgtcaacaacgccagcccccgcaccg

SEQ ID NO: 153946 - DNA, 75 bp, Artificial Sequence
  Synthetic
tgatcagggcgcgtccctacgctcgctcgtggggcgcacgtccctgggacaacgcggccttaccacgctatacgt

SEQ ID NO: 153947 - DNA, 75 bp, Artificial Sequence
  Synthetic
gcgtaccgcagggcgtattatggaagcgcgcagagtcccttctggtttcttagcaaattcgggcctgacgaaaaa

SEQ ID NO: 153948 - DNA, 75 bp, Artificial Sequence
  Synthetic
cacgcggaaagcaagaacaataaaggcggtggtatctagttgatatgcatctctgggtgtttttggggtgtggcg

SEQ ID NO: 153949 - DNA, 75 bp, Artificial Sequence
  Synthetic
gcgcgcagagtcccttctggtttcttagcaaattcgggcctgacgaaaaaagcctggtgctcaccactcggtact

SEQ ID NO: 153950 - DNA, 75 bp, Artificial Sequence
  Synthetic
gggcgcgggggccacgtacgacctgcaggccatcaaggacatctgcgccacctacgcgattccccacgccccccg

SEQ ID NO: 153951 - DNA, 75 bp, Artificial Sequence
  Synthetic
caggccatcaaggacatctgcgccacctacgcgattccccacgccccccgccccgacaccgtcagcgccgcgtcc

SEQ ID NO: 153952 - DNA, 75 bp, Artificial Sequence
  Synthetic
ggttctgttgcacgagccagtacgcccgcggggccgcggcggccgggtttccgctttacgtggagcgccgtattg

SEQ ID NO: 153953 - DNA, 75 bp, Artificial Sequence
  Synthetic
ccgcggggccgcggcggccgggtttccgctttacgtggagcgccgtattgcggccgacgtccgcgagaccagtgc

SEQ ID NO: 153954 - DNA, 75 bp, Artificial Sequence
  Synthetic
cgcagttgcctgcgcgtgtccgaccgtgaattcattacgtacatttacctggcccattttgagtgtttcagcccc

SEQ ID NO: 153955 - DNA, 75 bp, Artificial Sequence
  Synthetic
actgaatatcggggagtacgtcaaacacaacgtgaccccccgggagaccgtcctggatggcgatacggccaaggc

SEQ ID NO: 153956 - DNA, 75 bp, Artificial Sequence
  Synthetic
tcctggatggcgatacggccaaggcctacctgcgcgctcgcacgtacgcgcccggggccctgacgcccgcccccg

SEQ ID NO: 153957 - DNA, 75 bp, Artificial Sequence
  Synthetic
cgtattgcggggccgtggactccgccaccaaaatgatggggcgtttggcggacgccgaaaagctcctggtccccc

SEQ ID NO: 153958 - DNA, 75 bp, Artificial Sequence
  Synthetic
acgcccccggcgatcgcggcgcttatccgtaatgcggcggtgcagactcccctgcccgtctaccggatatccatg

SEQ ID NO: 153959 - DNA, 75 bp, Artificial Sequence
  Synthetic
tccgtaatgcggcggtgcagactcccctgcccgtctaccggatatccatggtccccacgggacaggcatttgccg

SEQ ID NO: 153960 - DNA, 75 bp, Artificial Sequence
  Synthetic
cataacgcgggacgctcgcctggccgaagcggtcgtgtccgccgaagcggcggcgcaccccgaccacggcgcgct

SEQ ID NO: 153961 - DNA, 75 bp, Artificial Sequence
  Synthetic
cggcgcaccccgaccacggcgcgctgggcaggcggctcacggatcgcatccgcgcccagggccccgtgatgcccc

SEQ ID NO: 153962 - DNA, 75 bp, Artificial Sequence
  Synthetic
gatgtacgtgaatcgcaacgagatatttaacggcgcgctggcaatcacaaacatcatcctggatctcgacatcgc

SEQ ID NO: 153963 - DNA, 75 bp, Artificial Sequence
  Synthetic
acatcatcctggatctcgacatcgccctgaaggagcccgtcccctttcgccggctccacgaggccctgggccact

SEQ ID NO: 153964 - DNA, 75 bp, Artificial Sequence
  Synthetic
tcagctcctgtttcccgcggcccgcgtggaccccgacgcatatccctgttattttttcaaaagcgcatgtcggcc

SEQ ID NO: 153965 - DNA, 75 bp, Artificial Sequence
  Synthetic
gtggaccccgacgcatatccctgttattttttcaaaagcgcatgtcggcccggcccggcgtccgtgggttccggc

SEQ ID NO: 153966 - DNA, 75 bp, Artificial Sequence
  Synthetic
gggactggtttccctgctacgacgacgccggtgatgaggagtgggcggaggacccgggcgccatggacacatccc

SEQ ID NO: 153967 - DNA, 75 bp, Artificial Sequence
  Synthetic
gacccgggcgccatggacacatcccacgatcccccggacgacgaggttgcctactttgacctgtgccacgaagtc

SEQ ID NO: 153968 - DNA, 75 bp, Artificial Sequence
  Synthetic
cggattcgcccgtgtgttcctgcaccgacaagatcggactgcgggtgtgcatgcccgtccccgccccgtacgtcg

SEQ ID NO: 153969 - DNA, 75 bp, Artificial Sequence
  Synthetic
cgacaagatcggactgcgggtgtgcatgcccgtccccgccccgtacgtcgtccacggttctctaacgatgcgggg

SEQ ID NO: 153970 - DNA, 75 bp, Artificial Sequence
  Synthetic
gtgctgttggaccgagattttgtggaggccatcgggagctacgtaaaaaacttcctgttgatcgatacgggggtg

SEQ ID NO: 153971 - DNA, 75 bp, Artificial Sequence
  Synthetic
aggccatcgggagctacgtaaaaaacttcctgttgatcgatacgggggtgtacgcccacggccacagcctgcgct

SEQ ID NO: 153972 - DNA, 75 bp, Artificial Sequence
  Synthetic
cgacgggcctgcgtgcggaaggctgctgccagtgtttgtgatcccccccgcctgcaaagacgttccggcgtttgt

SEQ ID NO: 153973 - DNA, 75 bp, Artificial Sequence
  Synthetic
ctgccagtgtttgtgatcccccccgcctgcaaagacgttccggcgtttgtcgccgcgcacgccgacccgcggcgc

SEQ ID NO: 153974 - DNA, 75 bp, Artificial Sequence
  Synthetic
atctcgcttccccccgggagatccgtgtcctgcacagcctgggtggggactatgtgagcttctttgaaaggaagg

SEQ ID NO: 153975 - DNA, 75 bp, Artificial Sequence
  Synthetic
tgtcctgcacagcctgggtggggactatgtgagcttctttgaaaggaaggcgtcccgcaacgcgctggaacactt

SEQ ID NO: 153976 - DNA, 75 bp, Artificial Sequence
  Synthetic
gtcctgggtcggtacaacgtacagccggatgcgggggggaccgtcgaggggttcgcatcggaactgctggggcgg

SEQ ID NO: 153977 - DNA, 75 bp, Artificial Sequence
  Synthetic
cggatgcgggggggaccgtcgaggggttcgcatcggaactgctggggcggatagtcgcgtgcatcgaaacccact

SEQ ID NO: 153978 - DNA, 75 bp, Artificial Sequence
  Synthetic
ggccgtatccgtccggcgggccgtcagtaaggacgactgggtcctcctacagctagtccccgttcgcggtaccct

SEQ ID NO: 153979 - DNA, 75 bp, Artificial Sequence
  Synthetic
agtaaggacgactgggtcctcctacagctagtccccgttcgcggtaccctgcagcaaagcctgtcgtgtctgcgc

SEQ ID NO: 153980 - DNA, 75 bp, Artificial Sequence
  Synthetic
ccacggcgcggacattcgtcgcgctgagcgtcggggccaacaaccgcctgtgcgtgtccttgtgtcagcagtgct

SEQ ID NO: 153981 - DNA, 75 bp, Artificial Sequence
  Synthetic
gagcgtcggggccaacaaccgcctgtgcgtgtccttgtgtcagcagtgctttgccgccaaatgcgacagcaaccg

SEQ ID NO: 153982 - DNA, 75 bp, Artificial Sequence
  Synthetic
gccggcacgccatgctcgccgtccgttccctgcagcacctctcaaccgtcgtcttgataacggcgtacggcctcg

SEQ ID NO: 153983 - DNA, 75 bp, Artificial Sequence
  Synthetic
ttccctgcagcacctctcaaccgtcgtcttgataacggcgtacggcctcgtgctcgtgtggtacaccgtcttcgg

SEQ ID NO: 153984 - DNA, 75 bp, Artificial Sequence
  Synthetic
tacgcggtacgccccaccggcaccaacaacgacaccgccctcgtgtggatgaaaatgaaccagaccctattgttt

SEQ ID NO: 153985 - DNA, 75 bp, Artificial Sequence
  Synthetic
acgggggctggcgcaaccacgcccatatctgctacgccaatcttatcgcgggtagggtcgtgcccttccaggtcc

SEQ ID NO: 153986 - DNA, 75 bp, Artificial Sequence
  Synthetic
catgaacgtccacgaggcagttaactgtctggagaccctatggtacacacgggtgcgtctggtggtcgtagggtg

SEQ ID NO: 153987 - DNA, 75 bp, Artificial Sequence
  Synthetic
tgtctggagaccctatggtacacacgggtgcgtctggtggtcgtagggtggttcctgtatctggcgttcgtcgcc

SEQ ID NO: 153988 - DNA, 75 bp, Artificial Sequence
  Synthetic
gtgtcgtgagtcccgcccacaagatggtggccccggccacctacctcttgaactacgcaggccgcatcgtatcga

SEQ ID NO: 153989 - DNA, 75 bp, Artificial Sequence
  Synthetic
aactacgcaggccgcatcgtatcgagcgtgttcctgcagtacccctacacgaaaattacccgcctgctctgcgag

SEQ ID NO: 153990 - DNA, 75 bp, Artificial Sequence
  Synthetic
acgaacccccatcgaatgccacgcgagcgacccgcgactcgcgatacgcgctaacggtgacccagataatccaga

SEQ ID NO: 153991 - DNA, 75 bp, Artificial Sequence
  Synthetic
ttcagttgtttgagacggacccggtcaccttcttgtaccaccgccccgccatcggggtcatcgtaggctgcgagt

SEQ ID NO: 153992 - DNA, 75 bp, Artificial Sequence
  Synthetic
caccttcttgtaccaccgccccgccatcggggtcatcgtaggctgcgagttgatgctacgctttgtggccgtggg

SEQ ID NO: 153993 - DNA, 75 bp, Artificial Sequence
  Synthetic
tcccggggggcatgtgcgatcacataccccctgtttctgaccatcaccacctggtgttttgtctccaccatcggc

SEQ ID NO: 153994 - DNA, 75 bp, Artificial Sequence
  Synthetic
ggcggggcccggcccccaagaacgcagacaaggccgccgccccggggcgatccaaggggctgtcgggcgtctgcg

SEQ ID NO: 153995 - DNA, 75 bp, Artificial Sequence
  Synthetic
gggcatcgcaatgcgattgtgttatatcgccgtggtggccggggtggtgctcgtggcgcttcactacgagcagga

SEQ ID NO: 153996 - DNA, 75 bp, Artificial Sequence
  Synthetic
gcctggatcccaacgaccccgcccatgggtcccaattggccgtcccgttaccaagaccaacccagccagcgtatc

SEQ ID NO: 153997 - DNA, 75 bp, Artificial Sequence
  Synthetic
tgggtcccaattggccgtcccgttaccaagaccaacccagccagcgtatccacccccgcccgggtccccgcggaa

SEQ ID NO: 153998 - DNA, 75 bp, Artificial Sequence
  Synthetic
attaaatacatgccacgtacttatggtgtctgattggtccttgtctgtgccggaggtggggcgggggccccgccc

SEQ ID NO: 153999 - DNA, 75 bp, Artificial Sequence
  Synthetic
ggggggcggaactaggaggggtttgggagagccggccccggcaccacgggtataaggacatccaccacccggccg

SEQ ID NO: 154000 - DNA, 75 bp, Artificial Sequence
  Synthetic
tataaggacatccaccacccggccggtggtggtgtgcagccgtgttccaaccacggtcacgcttcggtgcctctc

SEQ ID NO: 154001 - DNA, 75 bp, Artificial Sequence
  Synthetic
gacattgatatgctaattgacctcggcctggacctctccgacagcgatctggacgaggacccccccgagccggcg

SEQ ID NO: 154002 - DNA, 75 bp, Artificial Sequence
  Synthetic
gcctggacctctccgacagcgatctggacgaggacccccccgagccggcggagagccgccgcgacgacctggaat

SEQ ID NO: 154003 - DNA, 75 bp, Artificial Sequence
  Synthetic
gtcggacgaggacatggaagacccccacggagaggacggaccggagccgatactcgacgccgctcgcccggcggt

SEQ ID NO: 154004 - DNA, 75 bp, Artificial Sequence
  Synthetic
cacggagaggacggaccggagccgatactcgacgccgctcgcccggcggtccgcccgtctcgtccagaagacccc

SEQ ID NO: 154005 - DNA, 75 bp, Artificial Sequence
  Synthetic
gtccgacggagcggcagggccccaacgatcctcaaccagcgccccacagtgtgtggtcgcgcctcggggcccggc

SEQ ID NO: 154006 - DNA, 75 bp, Artificial Sequence
  Synthetic
cgatcctcaaccagcgccccacagtgtgtggtcgcgcctcggggcccggcgaccgtcttgctcccccgagcggca

SEQ ID NO: 154007 - DNA, 75 bp, Artificial Sequence
  Synthetic
cccccaccgaccaaagcccagcctgcccgcggcggacgccgtgggcgtcgcaggggtcggggtcgcggtggtccc

SEQ ID NO: 154008 - DNA, 75 bp, Artificial Sequence
  Synthetic
cccgcggcggacgccgtgggcgtcgcaggggtcggggtcgcggtggtcccggggccgccgatggtttgtcggacc

SEQ ID NO: 154009 - DNA, 75 bp, Artificial Sequence
  Synthetic
tcgcaacccggggggaccccgccccggggcggggtggacggacggccccggcgccccccatggcgaggcgtggcg

SEQ ID NO: 154010 - DNA, 75 bp, Artificial Sequence
  Synthetic
ggggcggggtggacggacggccccggcgccccccatggcgaggcgtggcgcggaagtgagcagcccgacccaccc

SEQ ID NO: 154011 - DNA, 75 bp, Artificial Sequence
  Synthetic
gccaagcaccccccccgctaatgacgctggcgattgcccccccgcccgcggacccccgcgccccggccccggagc

SEQ ID NO: 154012 - DNA, 75 bp, Artificial Sequence
  Synthetic
gctggcgattgcccccccgcccgcggacccccgcgccccggccccggagcgaaaggcgcccgccgccgacaccat

SEQ ID NO: 154013 - DNA, 75 bp, Artificial Sequence
  Synthetic
cgctccatctccgagcgcgcggcggtcgaccgcatcagcgagagcttcggccgcagcgcacaggtcatgcacgac

SEQ ID NO: 154014 - DNA, 75 bp, Artificial Sequence
  Synthetic
tcgaccgcatcagcgagagcttcggccgcagcgcacaggtcatgcacgacccctttggggggcagccgtttcccg

SEQ ID NO: 154015 - DNA, 75 bp, Artificial Sequence
  Synthetic
gctggcgggccaaggagggccctttgacgccgagaccagacgggtctcctgggaaaccttggtcgcccacggccc

SEQ ID NO: 154016 - DNA, 75 bp, Artificial Sequence
  Synthetic
gacgccgagaccagacgggtctcctgggaaaccttggtcgcccacggcccgagcctctatcgcacttttgccggc

SEQ ID NO: 154017 - DNA, 75 bp, Artificial Sequence
  Synthetic
aggccatgcgcgactgcgtgctgcgccaagaaaatttcatcgaggcgctggcctccgccgacgagacgctggcgt

SEQ ID NO: 154018 - DNA, 75 bp, Artificial Sequence
  Synthetic
gcctccgccgacgagacgctggcgtggtgcaagatgtgcatccaccacaacctgccgctgcgcccccaggacccc

SEQ ID NO: 154019 - DNA, 75 bp, Artificial Sequence
  Synthetic
tggataacctcgccacgcgcctgcggccctttctccagtgctacctgaaggcgcgaggcctgtgcggcctggacg

SEQ ID NO: 154020 - DNA, 75 bp, Artificial Sequence
  Synthetic
gccctttctccagtgctacctgaaggcgcgaggcctgtgcggcctggacgaactgtgttcgcggcggcgtctggc

SEQ ID NO: 154021 - DNA, 75 bp, Artificial Sequence
  Synthetic
gtgtttgtcattctggccaggctcgccaaccgcgtcgagcgtggcgtcgcggagatcgactacgcgacccttggt

SEQ ID NO: 154022 - DNA, 75 bp, Artificial Sequence
  Synthetic
ccaaccgcgtcgagcgtggcgtcgcggagatcgactacgcgacccttggtgtcggggtcggagagaagatgcatt

SEQ ID NO: 154023 - DNA, 75 bp, Artificial Sequence
  Synthetic
gggcctgatcgaaatcctagacacgcaccgccaggagtgttcgagtcgtgtctgcgagttgacggccagtcacat

SEQ ID NO: 154024 - DNA, 75 bp, Artificial Sequence
  Synthetic
caccgccaggagtgttcgagtcgtgtctgcgagttgacggccagtcacatcgtcgcccccccgtacgtgcacggc

SEQ ID NO: 154025 - DNA, 75 bp, Artificial Sequence
  Synthetic
tttaggtacaataaaaacaaaacatttcaaacaaatcgccccacgtgttgtccttctttgctcatggccggcggg

SEQ ID NO: 154026 - DNA, 75 bp, Artificial Sequence
  Synthetic
ttcaaacaaatcgccccacgtgttgtccttctttgctcatggccggcggggcgtgggtcacggcagatggcgggg

SEQ ID NO: 154027 - DNA, 75 bp, Artificial Sequence
  Synthetic
ggcggagggaactaacccaacgtataaatccgtccccgctccaaggccggtgtcatagtgcccttaggagcttcc

SEQ ID NO: 154028 - DNA, 75 bp, Artificial Sequence
  Synthetic
aaatccgtccccgctccaaggccggtgtcatagtgcccttaggagcttcccgcccgggcgcatccccccttttgc

SEQ ID NO: 154029 - DNA, 75 bp, Artificial Sequence
  Synthetic
acctgttcttacgggccccggacataacccacgtggcccccccttactgcctcaacgccacctggcaggccgaaa

SEQ ID NO: 154030 - DNA, 75 bp, Artificial Sequence
  Synthetic
aacccacgtggcccccccttactgcctcaacgccacctggcaggccgaaacggccatgcacaccagcaaaacgga

SEQ ID NO: 154031 - DNA, 75 bp, Artificial Sequence
  Synthetic
tacctggtccgcgcctcctgtgagaccagcggcacaatccactgctttttctttgcggtatacaaggacacccac

SEQ ID NO: 154032 - DNA, 75 bp, Artificial Sequence
  Synthetic
ccagcggcacaatccactgctttttctttgcggtatacaaggacacccaccatacccctccgctgattaccgagc

SEQ ID NO: 154033 - DNA, 75 bp, Artificial Sequence
  Synthetic
ccacccgccggtcctacgcgaactggaggataagcgcggggtgcggctgcggtgtgcgcggccgtttagcgtcgg

SEQ ID NO: 154034 - DNA, 75 bp, Artificial Sequence
  Synthetic
gaggataagcgcggggtgcggctgcggtgtgcgcggccgtttagcgtcgggacgattaaggacgtctctgggtcc

SEQ ID NO: 154035 - DNA, 75 bp, Artificial Sequence
  Synthetic
cgataaacgggatcgtgtaccactgccactgtcggtatccgttctcaaaaacatgctggatgggggcctccgcgg

SEQ ID NO: 154036 - DNA, 75 bp, Artificial Sequence
  Synthetic
ctccagcggcatggccgcccgcgcggcagagcatcgacgcgtcaagattaaaattaaggcgtgatctccaacccc

SEQ ID NO: 154037 - DNA, 75 bp, Artificial Sequence
  Synthetic
ccaaaaaaataaagagccgtaacccaaccaaaccaggcgtggtgtgagtttgtggacccaaagccctcagagaca

SEQ ID NO: 154038 - DNA, 75 bp, Artificial Sequence
  Synthetic
atacttttatttattaactcacaggggcgcttaccgccacaggaataccagaataatgaccaccacaatcgcgac

SEQ ID NO: 154039 - DNA, 75 bp, Artificial Sequence
  Synthetic
accacgccacaacagccctgtcgccggtatggggcatgatcagacgagccgcgcgccgcgcgttgggccctgtac

SEQ ID NO: 154040 - DNA, 75 bp, Artificial Sequence
  Synthetic
ggtatggggcatgatcagacgagccgcgcgccgcgcgttgggccctgtacagctcgcgcgaattgaccctaggag

SEQ ID NO: 154041 - DNA, 75 bp, Artificial Sequence
  Synthetic
agctcgcgcgaattgaccctaggaggccgccacgcgcccgagttttgcgttcgtcgctggtcgtcgggcgccaaa

SEQ ID NO: 154042 - DNA, 75 bp, Artificial Sequence
  Synthetic
gccccggacggctgttcggtcgaacgaacggccacgacagtggcataggttggggggtggtccgacatagcctcg

SEQ ID NO: 154043 - DNA, 75 bp, Artificial Sequence
  Synthetic
gaacggccacgacagtggcataggttggggggtggtccgacatagcctcggcgtacgtcgggaggcccgacaaga

SEQ ID NO: 154044 - DNA, 75 bp, Artificial Sequence
  Synthetic
cacaagcctggtttccggaagaaacaggggggttgccaataacccgccagggccaaaactccggcgctgcgcacg

SEQ ID NO: 154045 - DNA, 75 bp, Artificial Sequence
  Synthetic
aggggggttgccaataacccgccagggccaaaactccggcgctgcgcacgtcgttcggcgcggcgccgggcgcgc

SEQ ID NO: 154046 - DNA, 75 bp, Artificial Sequence
  Synthetic
gtgagcggccccgctccgacgcctcgccctctccggaggaggttggcggaattggcacggacgacaggggcccag

SEQ ID NO: 154047 - DNA, 75 bp, Artificial Sequence
  Synthetic
gccctctccggaggaggttggcggaattggcacggacgacaggggcccagcagagtacggtggaggtgggtccgt

SEQ ID NO: 154048 - DNA, 75 bp, Artificial Sequence
  Synthetic
aacggcccctcgttcctaccagacaagctatcgtaggggggcgggggatcagcaaacgcgttccccgcgctccat

SEQ ID NO: 154049 - DNA, 75 bp, Artificial Sequence
  Synthetic
agctatcgtaggggggcgggggatcagcaaacgcgttccccgcgctccatagacccgcgtcgggttgcgccgcct

SEQ ID NO: 154050 - DNA, 75 bp, Artificial Sequence
  Synthetic
ccacgactcccgcgcgctaggtccttggggtaagggaaaaggccctactccccatccaagccagccaagttaacg

SEQ ID NO: 154051 - DNA, 75 bp, Artificial Sequence
  Synthetic
cccatccaagccagccaagttaacgggctacgccttcggggatgggactggcaccccggcggattttgttgggct

SEQ ID NO: 154052 - DNA, 75 bp, Artificial Sequence
  Synthetic
gcaccccggcggattttgttgggctggtacgcgtcgcccaaccgagggccgcgtccacgggacgcgccttttata

SEQ ID NO: 154053 - DNA, 75 bp, Artificial Sequence
  Synthetic
gcgtccacgggacgcgccttttataaccccggggtcattcccaacgatcacatgcaatctaactggctccccctc

SEQ ID NO: 154054 - DNA, 75 bp, Artificial Sequence
  Synthetic
accccggggtcattcccaacgatcacatgcaatctaactggctccccctctcccctctccccccctctcccctcc

SEQ ID NO: 154055 - DNA, 75 bp, Artificial Sequence
  Synthetic
gcgtggctgccgggaggggccgcgtatgggcgggcctactcggtctcccgcccccccgaaccgccccgccggctt

SEQ ID NO: 154056 - DNA, 75 bp, Artificial Sequence
  Synthetic
cccaccccgtgctcgtggtgcggggtggggggatgtgggcgggggtgcgcgggaggtgtcggtggtgggggtggt

SEQ ID NO: 154057 - DNA, 75 bp, Artificial Sequence
  Synthetic
tgttgtccaggaaggtgtccgccatttccagggcccacgacatgctcccccgcccgacgagcaggaagcggtcca

SEQ ID NO: 154058 - DNA, 75 bp, Artificial Sequence
  Synthetic
aaaaaagggagggacgggggccggcagaccgacggcgacaacgctccccggcggccgggtcgcggctcttacgag

SEQ ID NO: 154059 - DNA, 75 bp, Artificial Sequence
  Synthetic
ctcctcgtttttccaaaccccgcccacccggcccggcccggcccggcccggccaccgccgcccacccacccacct

SEQ ID NO: 154060 - DNA, 75 bp, Artificial Sequence
  Synthetic
cgtcccccctcctccgcccccgcgtcccccctcctccgcccccgcgtcccccctcctccgcccccgcgtcccccc

SEQ ID NO: 154061 - DNA, 75 bp, Artificial Sequence
  Synthetic
cgggatacccagccccggtcccccgttccccgggggccgttatctccagcgccccgtccggcgcgccgccccccg

SEQ ID NO: 154062 - DNA, 75 bp, Artificial Sequence
  Synthetic
ccgcgacggggggacggaggggacggagggaggggggtgacgggggacggaaacagacacaaaaaacaaccacaa

SEQ ID NO: 154063 - DNA, 75 bp, Artificial Sequence
  Synthetic
ccccaccccagtctcctcgccttctcccacccaccccacgcccccactgagcccggtcgatcgacgagcaccccc

SEQ ID NO: 154064 - DNA, 75 bp, Artificial Sequence
  Synthetic
cccacccaccccacgcccccactgagcccggtcgatcgacgagcacccccgcccacgcccccgcccctgccccgg

SEQ ID NO: 154065 - DNA, 75 bp, Artificial Sequence
  Synthetic
aacaaccgaggggaacgggggatggaaggacgggaagtggaagtcctgatacccatcctacacccccctgccttc

SEQ ID NO: 154066 - DNA, 75 bp, Artificial Sequence
  Synthetic
ttggggcggtcccgcccgccggccaatgggggggcggcaaggcgggcggcccttgggccgcccgccgtcccgttg

SEQ ID NO: 154067 - DNA, 75 bp, Artificial Sequence
  Synthetic
ccggccccccgccccgcgccggtccattaagggcgcgcgtgcccgcgagatatcaatccgttaagtgctctgcag

SEQ ID NO: 154068 - DNA, 75 bp, Artificial Sequence
  Synthetic
attaggccgcagacgaggaaaataaaattacatcacctacccatgtggtgctgtggcctgtttttgctgcgtcat

SEQ ID NO: 154069 - DNA, 75 bp, Artificial Sequence
  Synthetic
ggttcgaccaacgggccgcggccacgggcccccggcgtgccggcgtcggggcggggtcgtgcataatggaattcc

SEQ ID NO: 154070 - DNA, 75 bp, Artificial Sequence
  Synthetic
cggccgtgccgatcgccggtggtgcgaaagactttccgggcgcgtccgggtgccgcggctctccgggcccccctg

SEQ ID NO: 154071 - DNA, 75 bp, Artificial Sequence
  Synthetic
ttccccgtttcgggggtggtgggggttgcggtttctgtttctttaacccgtctggggtgtttttcgttccgtcgc

SEQ ID NO: 154072 - DNA, 75 bp, Artificial Sequence
  Synthetic
agcatcgaccggtccgcgctagttccgcgtcgacggcgggggtcgtcggggtccgtgggtctcgccccctcccca

SEQ ID NO: 154073 - DNA, 75 bp, Artificial Sequence
  Synthetic
gcggtccgggccccgtccggacccgctcgccggcacgcgacgcgaaaaaggccccccggaggcttttccgggttc

SEQ ID NO: 154074 - DNA, 75 bp, Artificial Sequence
  Synthetic
cggcggacccaaggggccccggcccggggccccacaacggcccggcgcatgcgctgcgttttttttttttttttt

SEQ ID NO: 154075 - DNA, 75 bp, Artificial Sequence
  Synthetic
cgtcgcctttcctgttctcgcttcttccccccccccttcacccccagtaccctcctccctcccttcctcccccgt

SEQ ID NO: 154076 - DNA, 75 bp, Artificial Sequence
  Synthetic
cctcctccctcccttcctcccccgttatcccactcgtcgagggcgccccggtgtcgttcaacaaagacgccgcgt

SEQ ID NO: 154077 - DNA, 75 bp, Artificial Sequence
  Synthetic
aaacgacagggggcgccccagaggctaaggtcggccacgccactcgcgggtgggctcgtgttacagcacaccagc

SEQ ID NO: 154078 - DNA, 75 bp, Artificial Sequence
  Synthetic
ttagttagactctgttacttacccgtccgaccaccaactgcccccttatctaagggccggctggaagaccgccag

SEQ ID NO: 154079 - DNA, 75 bp, Artificial Sequence
  Synthetic
tccgaccaccaactgcccccttatctaagggccggctggaagaccgccagggggtcggccggtgtcgctgtaacc

SEQ ID NO: 154080 - DNA, 75 bp, Artificial Sequence
  Synthetic
aagcgaggatatggaggagtggcgggtgccgggggaccggggtgatctctggcacgcgggggtgggaagggtcgg

SEQ ID NO: 154081 - DNA, 75 bp, Artificial Sequence
  Synthetic
ccggcggtctctaagaaacaccgccccccctccttcataccaccgagcatgcctgggtgtgggttggtaaccaac

SEQ ID NO: 154082 - DNA, 75 bp, Artificial Sequence
  Synthetic
gcctgggtgtgggttggtaaccaacacgcccatcccctcgtctcctgtgattctctggctgcaccgcattcttgt

SEQ ID NO: 154083 - DNA, 75 bp, Artificial Sequence
  Synthetic
ctcatcgcgtacgtcggcgtacgtcctgggcccaacccgcatgttgtccaggaaggtgtccgccatttccagggc

SEQ ID NO: 154084 - DNA, 75 bp, Artificial Sequence
  Synthetic
cagaggccaggtcagtccgggcgggcaggcgctcgcggaaacttaacacccacacccaacccactgtggttctgg

SEQ ID NO: 154085 - DNA, 75 bp, Artificial Sequence
  Synthetic
ggccgcggctctgtggttaacaccagagcctgcccaacatggcacccccactcccacgcacccccactcccacgc

SEQ ID NO: 154086 - DNA, 75 bp, Artificial Sequence
  Synthetic
cgtcccttattgttttccctcgtcccgggtcgacgccccctgctccccggaccacgggtgccgagaccgcaggct

SEQ ID NO: 154087 - DNA, 75 bp, Artificial Sequence
  Synthetic
accacgggtgccgagaccgcaggctgcggaagtccagggcgcccactagggtgccctggtcgaacagcatgttcc

SEQ ID NO: 154088 - DNA, 75 bp, Artificial Sequence
  Synthetic
ccactccgacgcgggggccgtcgggtactcggggggcgtcacgtggttacccgcggtctcggggagcagggtgcg

SEQ ID NO: 154089 - DNA, 75 bp, Artificial Sequence
  Synthetic
tactcggggggcgtcacgtggttacccgcggtctcggggagcagggtgcggcggctccagccggggaccgcggcc

SEQ ID NO: 154090 - DNA, 75 bp, Artificial Sequence
  Synthetic
tctggtccaccaggaccacgtacgccccgatgttccccgtctccatgtccaggatgggcaggcagtcccccgtga

SEQ ID NO: 154091 - DNA, 75 bp, Artificial Sequence
  Synthetic
cccgatgttccccgtctccatgtccaggatgggcaggcagtcccccgtgatcgtcttgttcacgtaaggcgacag

SEQ ID NO: 154092 - DNA, 75 bp, Artificial Sequence
  Synthetic
atgggcaggtagcgcgtgaggccgcccgcggggacggccccggaagtctccgcgtggcgcgtcttccgggcacac

SEQ ID NO: 154093 - DNA, 75 bp, Artificial Sequence
  Synthetic
ccgcggggacggccccggaagtctccgcgtggcgcgtcttccgggcacacttcctcggcccccgcggcccagaag

SEQ ID NO: 154094 - DNA, 75 bp, Artificial Sequence
  Synthetic
ctcttgtctccctcccagggcaccgacggccccgcccgaggaggcggaagcggaggaggacgcggccccggtggc

SEQ ID NO: 154095 - DNA, 75 bp, Artificial Sequence
  Synthetic
aggaagaggcggaggccgccgaggacgtcaggggggtcccgggccctccctggccgcgcccccccggccctgagt

SEQ ID NO: 154096 - DNA, 75 bp, Artificial Sequence
  Synthetic
cgtcaggggggtcccgggccctccctggccgcgcccccccggccctgagtcggagggggggtgcgtcgccgccct

SEQ ID NO: 154097 - DNA, 75 bp, Artificial Sequence
  Synthetic
ggacgcgtggactggggggaggggttttcctggcccgacccgcgcctcttcctcggacgcaccgccgcctcctgc

SEQ ID NO: 154098 - DNA, 75 bp, Artificial Sequence
  Synthetic
ccgtgtccaccctccacgcccggcccccccgagccgcgcgccaccgtcgcacgcgcccggcacagactctgttct

SEQ ID NO: 154099 - DNA, 75 bp, Artificial Sequence
  Synthetic
cccccgagccgcgcgccaccgtcgcacgcgcccggcacagactctgttcttggttcgcggcctgagccagggacg

SEQ ID NO: 154100 - DNA, 75 bp, Artificial Sequence
  Synthetic
gtccgcggggcgggcggccggctccgccccgggggccggggcgcgggggccgggccccggaggcggcgcccgcac

SEQ ID NO: 154101 - DNA, 75 bp, Artificial Sequence
  Synthetic
gggctggggctggggctggggctggggctggggctggggctggggctggggctggggctggggctggggttgggg

SEQ ID NO: 154102 - DNA, 75 bp, Artificial Sequence
  Synthetic
cgggccccggaggcggcgcccgcacacacggggccacggccgcgcgggggcgcgcggggcccgacgcggccgcgg

SEQ ID NO: 154103 - DNA, 75 bp, Artificial Sequence
  Synthetic
ggagcctggcatgggcgccgcggggggcctgtggggagaggccgggggggagtcgctgatcactatggggtctct

SEQ ID NO: 154104 - DNA, 75 bp, Artificial Sequence
  Synthetic
gacgccccgcccgtcacggggggcgcggcggcgcctctgcgtgggggggcgcggggcgtccggcggggggcgggc

SEQ ID NO: 154105 - DNA, 75 bp, Artificial Sequence
  Synthetic
acggggggcgcgatcaggttacgccccctccccggcccgccctttcctcgcccgcccgcccgcctattcctccct

SEQ ID NO: 154106 - DNA, 75 bp, Artificial Sequence
  Synthetic
ccagggtcctcgccgcccccccgcctcaccgtcgtccaggtcgtcgtcatcctcgtccgtggtgggctcagggtg

SEQ ID NO: 154107 - DNA, 75 bp, Artificial Sequence
  Synthetic
tcaccgtcgtccaggtcgtcgtcatcctcgtccgtggtgggctcagggtgggtgggcgacagggccctcaccgtg

SEQ ID NO: 154108 - DNA, 75 bp, Artificial Sequence
  Synthetic
cctcgtccgtggtgggctcagggtgggtgggcgacagggccctcaccgtgtgcccccccagggtcaggtaccgcg

SEQ ID NO: 154109 - DNA, 75 bp, Artificial Sequence
  Synthetic
gataaagtccacggccgtgcccgccctgacggcctcctcggcctccatgcgggtctgggggtcgttcacgatcgg

SEQ ID NO: 154110 - DNA, 75 bp, Artificial Sequence
  Synthetic
ctgacggcctcctcggcctccatgcgggtctgggggtcgttcacgatcgggatggtgctgaacgacccgctgggc

SEQ ID NO: 154111 - DNA, 75 bp, Artificial Sequence
  Synthetic
gcttggcgttgcacagcgggcaggtgttgcgcaattgcatccaggttttcatgcacgggatgcagaagcggtgca

SEQ ID NO: 154112 - DNA, 75 bp, Artificial Sequence
  Synthetic
gttgcgcaattgcatccaggttttcatgcacgggatgcagaagcggtgcatgcacgggaaggtgtcgcagcgcag

SEQ ID NO: 154113 - DNA, 75 bp, Artificial Sequence
  Synthetic
acggcgcacacgtcgccctcgtcgctccccccgtcctctcgagggggggcgcccccgcaactgccggggtcttcc

SEQ ID NO: 154114 - DNA, 75 bp, Artificial Sequence
  Synthetic
tccccccgtcctctcgagggggggcgcccccgcaactgccggggtcttcctcgcggggggggctcccccccgaga

SEQ ID NO: 154115 - DNA, 75 bp, Artificial Sequence
  Synthetic
ccccagcagccccgtctcgaacagttccgtgtccgtgctgtccgcctcggaggcggagtcgtcgtcatggtggtc

SEQ ID NO: 154116 - DNA, 75 bp, Artificial Sequence
  Synthetic
tccgtgtccgtgctgtccgcctcggaggcggagtcgtcgtcatggtggtcggcgtccccccgcccccccacttcg

SEQ ID NO: 154117 - DNA, 75 bp, Artificial Sequence
  Synthetic
tcgaggggcgggagggggcgaggggcgggagggggcgaggggcgggagggggcgaggggcgggagggggcgaggg

SEQ ID NO: 154118 - DNA, 75 bp, Artificial Sequence
  Synthetic
atggggggatttcccgcgtcaatcagcgcccacgagttccccctccccccccgcctcacaaagtcctgcccccct

SEQ ID NO: 154119 - DNA, 75 bp, Artificial Sequence
  Synthetic
ccgcctcacaaagtcctgcccccctgctggcctcggaagaggggggagaaaggggtctgcaaccaaaggtggtct

SEQ ID NO: 154120 - DNA, 75 bp, Artificial Sequence
  Synthetic
ggccggggagggctggggccggggagggctggggccggggagggctggggccggggagggctggggccggggagg

SEQ ID NO: 154121 - DNA, 75 bp, Artificial Sequence
  Synthetic
tgagtcagtggggaccacgccccctaacacggcgaccccggtccctgtgtgtttgttgtgggggcgtgtctctgt

SEQ ID NO: 154122 - DNA, 75 bp, Artificial Sequence
  Synthetic
gggctggggccggggagggctggggccggggagggctggggccggggagggctggggccggggagggctggggct

SEQ ID NO: 154123 - DNA, 75 bp, Artificial Sequence
  Synthetic
ggggagggctggggctggggagggctggggcggtggtgtgtgacaggagcggcgtgttgcgctgggggacgtctg

SEQ ID NO: 154124 - DNA, 75 bp, Artificial Sequence
  Synthetic
ccccggtccctgtatatatagggtcagggggttccgcgccccctaacatggcgcccccggtccctgtatatatag

SEQ ID NO: 154125 - DNA, 75 bp, Artificial Sequence
  Synthetic
tgttggtgggcaggtgtggtggatgacgtgacgtgtgacgtgtggatgaggaaccggagtcgccggtgcgccgtg

SEQ ID NO: 154126 - DNA, 75 bp, Artificial Sequence
  Synthetic
agggggttccgcgccccctaacatggcgcccccggtccctgtatatatagtgtcacggggttccacgccccctaa

SEQ ID NO: 154127 - DNA, 75 bp, Artificial Sequence
  Synthetic
ccagacatggcgcccggcccctcacctcgcgctgggggcggccctcaggccggcgggtactcgctccggggcggg

SEQ ID NO: 154128 - DNA, 75 bp, Artificial Sequence
  Synthetic
ctcgcgctgggggcggccctcaggccggcgggtactcgctccggggcggggctccatgggggtcgtatgcggctg

SEQ ID NO: 154129 - DNA, 75 bp, Artificial Sequence
  Synthetic
agcccgggccccccgcgggcgcgcgcgcgcgcaaaaaaggcgggcggcggtccgggcggcgtgcgcgcgcgcggc

SEQ ID NO: 154130 - DNA, 75 bp, Artificial Sequence
  Synthetic
ggagcggggggaggagcggaaaacgggccccccccgaaacacaccccccgggggtcgcgcgcggccctttaaagc

SEQ ID NO: 154131 - DNA, 75 bp, Artificial Sequence
  Synthetic
ggggtcgcaacgtaggcggggcttctgtggtgatgcggagagggggcggcccgagtctgcctggctgctgcgtct

SEQ ID NO: 154132 - DNA, 75 bp, Artificial Sequence
  Synthetic
tgtggtgatgcggagagggggcggcccgagtctgcctggctgctgcgtctcgctccgagtgccgaggtgcaaatg

SEQ ID NO: 154133 - DNA, 75 bp, Artificial Sequence
  Synthetic
gggggaggagcgggggggaggagcgggggggaggagcggccagaccccgaaaacgggccccccccaaaacacacc

SEQ ID NO: 154134 - DNA, 75 bp, Artificial Sequence
  Synthetic
acttataccccacgcctttcccctccccaaaggggcggcagtgacgattcccccaatggccgcgcgtcccagggg

SEQ ID NO: 154135 - DNA, 75 bp, Artificial Sequence
  Synthetic
cccaaaggggcggcagtgacgattcccccaatggccgcgcgtcccaggggaggcaggcccaccgcggggcggccc

SEQ ID NO: 154136 - DNA, 75 bp, Artificial Sequence
  Synthetic
cccaaagaatatcattagcatgcacggcccggcccccgatttgggggaccaacccggtgtcccccaaagaacccc

SEQ ID NO: 154137 - DNA, 75 bp, Artificial Sequence
  Synthetic
ggcccggcccccgatttgggggaccaacccggtgtcccccaaagaaccccattagcatgcccctcccgccgacgc

SEQ ID NO: 154138 - DNA, 75 bp, Artificial Sequence
  Synthetic
ccccggggcttcccgccttcccgaagaaactcattaccatacccggaaccccaggggaccaatgcgggttcattg

SEQ ID NO: 154139 - DNA, 75 bp, Artificial Sequence
  Synthetic
gaaactcattaccatacccggaaccccaggggaccaatgcgggttcattgagcgacccgcgggccaatgcgcgag

SEQ ID NO: 154140 - DNA, 75 bp, Artificial Sequence
  Synthetic
aattaacataacccggaaccccaggggagtggttacgcgcggcgcgggaggcggggaataccggggttgcccatt

SEQ ID NO: 154141 - DNA, 75 bp, Artificial Sequence
  Synthetic
acgccccttccgccttccgccgcgcctcgccctccgcctgcgcgtcaccgcggagcacctggcgcgcctgcgcct

SEQ ID NO: 154142 - DNA, 75 bp, Artificial Sequence
  Synthetic
gggccccgccgcgctggcggccgccgattggccagtcccgccctccgagggcgggcccgcctcgggggcgggccg

SEQ ID NO: 154143 - DNA, 75 bp, Artificial Sequence
  Synthetic
gctccaagcgtatatatgcgcggctcctgccatcgtctctccggagagcggcttggtgcggagctcccgggagct

SEQ ID NO: 154144 - DNA, 75 bp, Artificial Sequence
  Synthetic
cctgccatcgtctctccggagagcggcttggtgcggagctcccgggagctccgcggaagacccaggccgcctcgg

SEQ ID NO: 154145 - DNA, 75 bp, Artificial Sequence
  Synthetic
ggaggagcggccagaccccggaaacgggccccccccaaaacacaccccccgggggtcgcgcgcggccctttaaag

SEQ ID NO: 154146 - DNA, 75 bp, Artificial Sequence
  Synthetic
ggccggctccgcgggccagggcccgggcacgggcctcgggccccaggcacggcccgatgaccgcctcggcctccg

SEQ ID NO: 154147 - DNA, 75 bp, Artificial Sequence
  Synthetic
ggcacgggcctcgggccccaggcacggcccgatgaccgcctcggcctccgccacccggcgccggaaccgagcccg

SEQ ID NO: 154148 - DNA, 75 bp, Artificial Sequence
  Synthetic
ccgcggcgcgccaggcgggcggccgaggcccagaccaccaggtggcgcacccggacgtggggcgagaagcgcacc

SEQ ID NO: 154149 - DNA, 75 bp, Artificial Sequence
  Synthetic
ctccccgcccgcgcgtcgcaggcgcaggcgcgccaggtgctctgcggtgacgcgcaggcggagggcgaggcgcgg

SEQ ID NO: 154150 - DNA, 75 bp, Artificial Sequence
  Synthetic
aggcgcgccaggtgctctgcggtgacgcgcaggcggagggcgaggcgcggcggaaggcggaaggggcgtgagggg

SEQ ID NO: 154151 - DNA, 75 bp, Artificial Sequence
  Synthetic
cgcgcaggcggagggcgaggcgcggcggaaggcggaaggggcgtgagggggggtgggaggggttagccccgcccc

SEQ ID NO: 154152 - DNA, 75 bp, Artificial Sequence
  Synthetic
tgggccgggccgcccacttcccggtatggtaattaaaaacttgcaagaggccttgttccgcttcccggtatggta

SEQ ID NO: 154153 - DNA, 75 bp, Artificial Sequence
  Synthetic
ccgggggcggggggcggcggcggtgggccgggcctctggcgccggctcgggcggggggctgtccggccagtcgtc

SEQ ID NO: 154154 - DNA, 75 bp, Artificial Sequence
  Synthetic
gttccgagttgggcgtggaggttacctgggactgtgcggttgggaccgcgcccgtgggcccgggcggccgggggc

SEQ ID NO: 154155 - DNA, 75 bp, Artificial Sequence
  Synthetic
ctgggactgtgcggttgggaccgcgcccgtgggcccgggcggccgggggcggcgggggccgcgatggcggcggcg

SEQ ID NO: 154156 - DNA, 75 bp, Artificial Sequence
  Synthetic
gacccccggggggtgtgttttggggggggcccgtttccggggtctggccgctcctcccccgctcctccccccgct

SEQ ID NO: 154157 - DNA, 75 bp, Artificial Sequence
  Synthetic
cctccccccgctcctccccccgcctcctccccccgctcctcccccgctcctcccccgctcctcccccgctcccgc

SEQ ID NO: 154158 - DNA, 75 bp, Artificial Sequence
  Synthetic
ggcccgccccaacgcccgccgcgcgcgcgcacgccgcccggaccgccgcccgccttttttgcgcgcgcgcgcgcc

SEQ ID NO: 154159 - DNA, 75 bp, Artificial Sequence
  Synthetic
cgcgcacgccgcccggaccgccgcccgccttttttgcgcgcgcgcgcgcccgcggggggcccgggctgccacagg

SEQ ID NO: 154160 - DNA, 75 bp, Artificial Sequence
  Synthetic
agcgagtacccgccggcctgagggccgcccccagcgcgaggtgaggggccgggcgccatgtctggggcgccatat

SEQ ID NO: 154161 - DNA, 75 bp, Artificial Sequence
  Synthetic
tggggggcgccatgttgggggacccccgacccttacactggaaccggccgccatgttgggggacccccactcata

SEQ ID NO: 154162 - DNA, 75 bp, Artificial Sequence
  Synthetic
catccaccacacctgcccaacaacacaactcacagcgacaactcaccgcgcaacaactcctgttcctcatccaca

SEQ ID NO: 154163 - DNA, 75 bp, Artificial Sequence
  Synthetic
caacaactcctgttcctcatccacacgtcaccgcgcacctcccgctcctccagacgtaccccggcgcaacacacc

SEQ ID NO: 154164 - DNA, 75 bp, Artificial Sequence
  Synthetic
agccctccccagccccagccctccccagccccagccctccccagccccagccctccccagccccagccctcccca

SEQ ID NO: 154165 - DNA, 75 bp, Artificial Sequence
  Synthetic
cagccccagccctccccagccccagccctccccagccccagccctccccagccccagccctccccagccccagcc

SEQ ID NO: 154166 - DNA, 75 bp, Artificial Sequence
  Synthetic
gccatgtgaccccccctgactttatatatacagaccccccccaccacatacacatggcccctttgactcagacgc

SEQ ID NO: 154167 - DNA, 75 bp, Artificial Sequence
  Synthetic
ctcgccccctcccgcccctcgccccctcccgcccctcgccccctccgcccctcgaataaacaacgctactgcaaa

SEQ ID NO: 154168 - DNA, 75 bp, Artificial Sequence
  Synthetic
tgcgtcttcgggtttcacaagcgccccgccccgtcccggcccgttacagcaccccgtccccctcgaacgcgccgc

SEQ ID NO: 154169 - DNA, 75 bp, Artificial Sequence
  Synthetic
ccgccccgtcccggcccgttacagcaccccgtccccctcgaacgcgccgccgtcgtcttcgtcccaggcgccttc

SEQ ID NO: 154170 - DNA, 75 bp, Artificial Sequence
  Synthetic
ggcgtggccaagcccgcctccgcccccagcacctccacggcccccgccgccgccagcacggtgccgctgcggccc

SEQ ID NO: 154171 - DNA, 75 bp, Artificial Sequence
  Synthetic
ggaaaccccccattcttacccgccccccttttttcccctcagcccgccccggacgtctgggtgtttccctgtgac

SEQ ID NO: 154172 - DNA, 75 bp, Artificial Sequence
  Synthetic
cgccagcacggtgccgctgcggcccgtggccgaggcccagcgaatcccgggcggcgccggcggcagggcccccgg

SEQ ID NO: 154173 - DNA, 75 bp, Artificial Sequence
  Synthetic
accagcgggggggcgtcgtcgtcgggctccagcagggcgcgggcgcaaaagtccctccgcggcccgcgccaccgg

SEQ ID NO: 154174 - DNA, 75 bp, Artificial Sequence
  Synthetic
gccgggccggcgcgcaccgcctcgcgccccagcgccacgtacacgggccgcagcggcgcgcccaggccccagcgc

SEQ ID NO: 154175 - DNA, 75 bp, Artificial Sequence
  Synthetic
cctcctcgcagaagtccggcgcgccgggcgccatggcgtcggtggtccccgaggccgccgcccggccgtccagcg

SEQ ID NO: 154176 - DNA, 75 bp, Artificial Sequence
  Synthetic
gggcgccatggcgtcggtggtccccgaggccgccgcccggccgtccagcgccggcagcacggcccggcggtactc

SEQ ID NO: 154177 - DNA, 75 bp, Artificial Sequence
  Synthetic
tccgggccgaagcgcgtgcgcacgcggtagcgcacgttgccgccgcggcacaggcgcagcggcggcgcgtcgggg

SEQ ID NO: 154178 - DNA, 75 bp, Artificial Sequence
  Synthetic
ggtagcgcacgttgccgccgcggcacaggcgcagcggcggcgcgtcggggtacaggcgcgcgtgcgcggcctcca

SEQ ID NO: 154179 - DNA, 75 bp, Artificial Sequence
  Synthetic
cacgcggcccgaggccagcaccgtgcggcgcaggtcccgcgccgccggccagcgcacggcgcactgcacggcggg

SEQ ID NO: 154180 - DNA, 75 bp, Artificial Sequence
  Synthetic
cggcgcaggtcccgcgccgccggccagcgcacggcgcactgcacggcgggcagcaggtcgcacgccaggtaggcg

SEQ ID NO: 154181 - DNA, 75 bp, Artificial Sequence
  Synthetic
cggcgggccagtcgcaggcgcgcacggtgttgaccacgatgagccgccggtcgccggcgctggcgagcagcccca

SEQ ID NO: 154182 - DNA, 75 bp, Artificial Sequence
  Synthetic
tggacgacggtgaggcggggggcggcgaggaccctgggggaggaggaggggggggggagggaggaataggcgggc

SEQ ID NO: 154183 - DNA, 75 bp, Artificial Sequence
  Synthetic
tcgccggcgctggcgagcagccccagaaactccacggccccggcgaaggccaggtcccgcgtggacagcagcagc

SEQ ID NO: 154184 - DNA, 75 bp, Artificial Sequence
  Synthetic
cgtcgggggcgccggtccagttgcccgcccaggcggccgtgtccggcccgcacagccggttggccagggccgcca

SEQ ID NO: 154185 - DNA, 75 bp, Artificial Sequence
  Synthetic
cgcccaggcggccgtgtccggcccgcacagccggttggccagggccgccagcaggcaggacagcccgccgcgctc

SEQ ID NO: 154186 - DNA, 75 bp, Artificial Sequence
  Synthetic
gaggccccgccgccggccaggtcctcgcccggcagcggcgagtacagcaccaccacgcgcacgtcctcggggtcg

SEQ ID NO: 154187 - DNA, 75 bp, Artificial Sequence
  Synthetic
tgcggcgcagcgggcccgaggcgcgcagggggccaaagaggcggcccccggcggccccgtgggggtgggggttct

SEQ ID NO: 154188 - DNA, 75 bp, Artificial Sequence
  Synthetic
ctgggcggcgggggcgggcccggcgcaccgcgcggcgatcgaggccagggcccgcgggtcaaacatgagggccgg

SEQ ID NO: 154189 - DNA, 75 bp, Artificial Sequence
  Synthetic
caccgcgcggcgatcgaggccagggcccgcgggtcaaacatgagggccggtcgccaggggacggggaacagcggg

SEQ ID NO: 154190 - DNA, 75 bp, Artificial Sequence
  Synthetic
gcggggagcagtaggcctccagggcggcggccgcgggcgccgccgtgtggctgggcccccggggctgccgccgcc

SEQ ID NO: 154191 - DNA, 75 bp, Artificial Sequence
  Synthetic
ggcggccgcgggcgccgccgtgtggctgggcccccggggctgccgccgccagccgcccagggggtcggggccctc

SEQ ID NO: 154192 - DNA, 75 bp, Artificial Sequence
  Synthetic
gggcgcgggcgggcctgcgccgcggcgccccgggccgccgcgggctgggcgggggtgggctcgggccccgggggc

SEQ ID NO: 154193 - DNA, 75 bp, Artificial Sequence
  Synthetic
cgcgggcgtccgagccgggggcgtccgcgccgctcttcttcgtcttcgggggtcgcgggccgccgcctccgggcg

SEQ ID NO: 154194 - DNA, 75 bp, Artificial Sequence
  Synthetic
cgcgccgctcttcttcgtcttcgggggtcgcgggccgccgcctccgggcggccgggccgggccgggactcttgcg

SEQ ID NO: 154195 - DNA, 75 bp, Artificial Sequence
  Synthetic
cggcggcggccgcggagctcggcaggcgcgggtcccgcggcagcgcggggcccagggccccggcgaccaggctca

SEQ ID NO: 154196 - DNA, 75 bp, Artificial Sequence
  Synthetic
gcgcgggtcccgcggcagcgcggggcccagggccccggcgaccaggctcacggcgcgcacggcggccacggcggc

SEQ ID NO: 154197 - DNA, 75 bp, Artificial Sequence
  Synthetic
tccccgcgcaggcgcatgagcaccagcgcgtcgcgcacgaaccgcagctcgcgcagccacgcgcgcaggcggggc

SEQ ID NO: 154198 - DNA, 75 bp, Artificial Sequence
  Synthetic
gcgcgtcgcgcacgaaccgcagctcgcgcagccacgcgcgcaggcggggcgcgtcggcgtgcggcggcggcgggg

SEQ ID NO: 154199 - DNA, 75 bp, Artificial Sequence
  Synthetic
ccgcggggggctggcgggccgggccccggccagccccgggacggccgccaggtcgccgtcgaagccctcggccag

SEQ ID NO: 154200 - DNA, 75 bp, Artificial Sequence
  Synthetic
cgcctccaggatcccgcggcaggcggccaggcactcgacggccacgcggccggcctgggcgcggcgcccggcgtc

SEQ ID NO: 154201 - DNA, 75 bp, Artificial Sequence
  Synthetic
gggtcgtcgccccccacgggggaggcgggcgcggcggacagccgccccagggcggcgaggatccccgcggcgccg

SEQ ID NO: 154202 - DNA, 75 bp, Artificial Sequence
  Synthetic
cgggcgcggcggacagccgccccagggcggcgaggatccccgcggcgccgtacccggcgggcaccgcgcgctcgc

SEQ ID NO: 154203 - DNA, 75 bp, Artificial Sequence
  Synthetic
gaccccctcgtcatctgcgccggcgccggggctccccgcggcccccgtcagcgccgcgttctcgcgcgccaacag

SEQ ID NO: 154204 - DNA, 75 bp, Artificial Sequence
  Synthetic
ccggggctccccgcggcccccgtcagcgccgcgttctcgcgcgccaacaggggcgcgtaggcgcggcgcaggctg

SEQ ID NO: 154205 - DNA, 75 bp, Artificial Sequence
  Synthetic
ggtcgtatcggcggctcatggccacggcggccgccgcgtgcgccaggccccagccgaagcggccggccgccatgg

SEQ ID NO: 154206 - DNA, 75 bp, Artificial Sequence
  Synthetic
ggcggccgccgcgtgcgccaggccccagccgaagcggccggccgccatggcgtagcccaggtggggcacggcccg

SEQ ID NO: 154207 - DNA, 75 bp, Artificial Sequence
  Synthetic
cgggcgctgggtggtctctggccgcgcccactacaccagccaatccgtgtcggggagggggaaagtgaaagacac

SEQ ID NO: 154208 - DNA, 75 bp, Artificial Sequence
  Synthetic
gcccactacaccagccaatccgtgtcggggagggggaaagtgaaagacacgggcaccacacaccagcgggtcttt

SEQ ID NO: 154209 - DNA, 75 bp, Artificial Sequence
  Synthetic
ctgctgttgcgcgcggcgcccgagatccggaagcaggcctggtccagcgccacgtccccggggaccacgcgcggg

SEQ ID NO: 154210 - DNA, 75 bp, Artificial Sequence
  Synthetic
tccggaagcaggcctggtccagcgccacgtccccggggaccacgcgcgggttctggagccaccccatggcctccg

SEQ ID NO: 154211 - DNA, 75 bp, Artificial Sequence
  Synthetic
gatcagggcgtactgctgcgcggcgtcgcccagctcgggcgcccacacggccgccggggcgcccgaggcctcgaa

SEQ ID NO: 154212 - DNA, 75 bp, Artificial Sequence
  Synthetic
tcgcccagctcgggcgcccacacggccgccggggcgcccgaggcctcgaaccggcgtcgcgcctcctccgcctcg

SEQ ID NO: 154213 - DNA, 75 bp, Artificial Sequence
  Synthetic
gcaccgcaccgagcgctttggggcggtcagcgtccccgttgtcattctggaaggcgtggtgtggcgccccggcga

SEQ ID NO: 154214 - DNA, 75 bp, Artificial Sequence
  Synthetic
tgtcgcccaggccgccgtacagcacccgccccgggggcgggggcccggcgccgggccacggctccccgctgacgt

SEQ ID NO: 154215 - DNA, 75 bp, Artificial Sequence
  Synthetic
ccgccccgggggcgggggcccggcgccgggccacggctccccgctgacgtacccgtcgcgatagcgcgcgtagaa

SEQ ID NO: 154216 - DNA, 75 bp, Artificial Sequence
  Synthetic
agctcgacccgccggggctgcccggccgtgaagcggcccgtggcgtcgcggccggccaccgccgcgcgggcccgg

SEQ ID NO: 154217 - DNA, 75 bp, Artificial Sequence
  Synthetic
ccgtgaagcggcccgtggcgtcgcggccggccaccgccgcgcgggcccggcggcgctcgatgcggcccgcggagg

SEQ ID NO: 154218 - DNA, 75 bp, Artificial Sequence
  Synthetic
gggcttgggcgcggcctcggagagggggggtggcccgggcgggggcggcgtccgcccgggggcttccggcgccgc

SEQ ID NO: 154219 - DNA, 75 bp, Artificial Sequence
  Synthetic
gtgtgggtgttaagtttccgcgagcgcctgcccgcccggactgacctggcctctggccgccacaaagggcggggg

SEQ ID NO: 154220 - DNA, 75 bp, Artificial Sequence
  Synthetic
gctcgacggaccccgcccgacggcccgcgcctcgcgtgcgtggtcggccgcgtcgttgccgtcgtcgtcctcgtc

SEQ ID NO: 154221 - DNA, 75 bp, Artificial Sequence
  Synthetic
gatgcggacgacgaggacgaggacccggagtccgacgaggtcgatgacgccgatggccgccgccggccgtgacga

SEQ ID NO: 154222 - DNA, 75 bp, Artificial Sequence
  Synthetic
cggagtccgacgaggtcgatgacgccgatggccgccgccggccgtgacgacgtctccgcggcggctgggccggcg

SEQ ID NO: 154223 - DNA, 75 bp, Artificial Sequence
  Synthetic
gtccggatacgcgccgcgtagcggggcctcccgttcgcggccccgggccggggcccggtcgccggcggcgtcggc

SEQ ID NO: 154224 - DNA, 75 bp, Artificial Sequence
  Synthetic
gtggtatgaaggagggggggcggtgcttcttagagaccgccgggggacgtggggttggtgtgcaaaggcacgcgc

SEQ ID NO: 154225 - DNA, 75 bp, Artificial Sequence
  Synthetic
gcctcccgttcgcggccccgggccggggcccggtcgccggcggcgtcggctgcgtcgtcgtactcgtccccgtca

SEQ ID NO: 154226 - DNA, 75 bp, Artificial Sequence
  Synthetic
tccggggcggcgaggccgcggggtcgggcgtcgggatcgtccggacggcctcctctaccatggaggccagcagag

SEQ ID NO: 154227 - DNA, 75 bp, Artificial Sequence
  Synthetic
gggcgtcgggatcgtccggacggcctcctctaccatggaggccagcagagccagctgtcgcggcgagacggcgtc

SEQ ID NO: 154228 - DNA, 75 bp, Artificial Sequence
  Synthetic
ccccgacccttcccacccccgcgtgccagagatcaccccggtcccccggcacccgccactcctccatatcctcgc

SEQ ID NO: 154229 - DNA, 75 bp, Artificial Sequence
  Synthetic
cccgccgcgggggccctcccgtcccgccgggcgtcgtcgaggtcgtgggggtggtcggggtcgtggtcggggtcg

SEQ ID NO: 154230 - DNA, 75 bp, Artificial Sequence
  Synthetic
gccgggcgtcgtcgaggtcgtgggggtggtcggggtcgtggtcggggtcgtccccgccctcctccgtctccgcgc

SEQ ID NO: 154231 - DNA, 75 bp, Artificial Sequence
  Synthetic
gcggtctgggctcggggtgggcggcggcccgtcggtggggcccggggagccggggcgctgcttgttctccgacgc

SEQ ID NO: 154232 - DNA, 75 bp, Artificial Sequence
  Synthetic
cggggcgctgcttgttctccgacgccatcgccgatgcggggcgatcctccggggatacggctgcgacggcggacg

SEQ ID NO: 154233 - DNA, 75 bp, Artificial Sequence
  Synthetic
cggtattcgggggggagggggatccagtcggccccgcggagttcgtctcggacgaccggtcgtccgattccgact

SEQ ID NO: 154234 - DNA, 75 bp, Artificial Sequence
  Synthetic
agggacggccgatccccctcccgcgcttcgtccgcgtatcggcgtcccggcgcggcgagcgtctgacggtctgtc

SEQ ID NO: 154235 - DNA, 75 bp, Artificial Sequence
  Synthetic
tgttgaacgacaccggggcgccctcgacgagtgggataacgggggaggaagggagggaggagggtactgggggtg

SEQ ID NO: 154236 - DNA, 75 bp, Artificial Sequence
  Synthetic
cttcgtccgcgtatcggcgtcccggcgcggcgagcgtctgacggtctgtctctggcggtcccgcgtcgggtcgtg

SEQ ID NO: 154237 - DNA, 75 bp, Artificial Sequence
  Synthetic
gggggaggaagggagggaggagggtactgggggggaagaaggggggggggagaagcgagaacaggaaaggcgacg

SEQ ID NO: 154238 - DNA, 75 bp, Artificial Sequence
  Synthetic
tgtggacgatcggggcgtcctcgggctcatatagtcccaggggccggcgggaaggaggagcagcggaggccgccg

SEQ ID NO: 154239 - DNA, 75 bp, Artificial Sequence
  Synthetic
ccgaacggaattccattatgcacgaccccgccccgacgccggcacgccgggggcccgtggccgcggcccgttggt

SEQ ID NO: 154240 - DNA, 75 bp, Artificial Sequence
  Synthetic
ccccgccccgacgccggcacgccgggggcccgtggccgcggcccgttggtcgaacccccggccccgcccatccgc

SEQ ID NO: 154241 - DNA, 75 bp, Artificial Sequence
  Synthetic
catgctaacgaggaacgggcagggggcggggcccgggccccgacttcccggttcggcggtaatgagatacgagcc

SEQ ID NO: 154242 - DNA, 75 bp, Artificial Sequence
  Synthetic
gttcggcggtaatgagatacgagccccgcgcgcccgttggccgtccccgggcccccggtcccgcccgccggacgc

SEQ ID NO: 154243 - DNA, 75 bp, Artificial Sequence
  Synthetic
ccccattggccggcgggcgggaccgccccaagggggcggggccgccgggtaaaagaagtgagaacgcgaagcgtt

SEQ ID NO: 154244 - DNA, 75 bp, Artificial Sequence
  Synthetic
ccccaagggggcggggccgccgggtaaaagaagtgagaacgcgaagcgttcgcacttcgtcccaatatatatata

SEQ ID NO: 154245 - DNA, 75 bp, Artificial Sequence
  Synthetic
gcgccgtgcccgactccgcgccggccccgggggcggacccgggcggcggggggcgggtctctccggcgcacataa

SEQ ID NO: 154246 - DNA, 75 bp, Artificial Sequence
  Synthetic
cccgggggcggacccgggcggcggggggcgggtctctccggcgcacataaaggcccggcgcgaccgacgcccgca

SEQ ID NO: 154247 - DNA, 75 bp, Artificial Sequence
  Synthetic
agcggctgcggagcacgcggaccgggagcgggagtcgcagagggccgtcggagcggacggcgtcggcatcgcgac

SEQ ID NO: 154248 - DNA, 75 bp, Artificial Sequence
  Synthetic
gagcgggagtcgcagagggccgtcggagcggacggcgtcggcatcgcgacgccccggctcgggatcgggatcgca

SEQ ID NO: 154249 - DNA, 75 bp, Artificial Sequence
  Synthetic
ctgctggcccgcggccacataaacaacaatgactcggggcctttctgcctctgccgcttgtgtgtgcgcgcgccg

SEQ ID NO: 154250 - DNA, 75 bp, Artificial Sequence
  Synthetic
caccttgggtgggcagaggaggggggacgcgggggcggaggaggggggacgcgggggcggaggaggggggacgcg

SEQ ID NO: 154251 - DNA, 75 bp, Artificial Sequence
  Synthetic
gacgcgggggcggaggaggggggacgcgggggcggaggaggggggacgcggggcggaggagggggacgcggggcg

SEQ ID NO: 154252 - DNA, 75 bp, Artificial Sequence
  Synthetic
cgctttccgttggggttgttattgttgtcgggatcgtgcgggccgggggtcgccggggcaggggcgggggcgtgg

SEQ ID NO: 154253 - DNA, 75 bp, Artificial Sequence
  Synthetic
cgcgggggcggaggaggggggacgcgggggcggaggagggggctcacccgcgttcgtgccttcccgcaggaggaa

SEQ ID NO: 154254 - DNA, 75 bp, Artificial Sequence
  Synthetic
gctcagtggggacgtggggtgggtgggaaaaggcgaggagactggggtggggggtgtcgggggtggctgtttttt

SEQ ID NO: 154255 - DNA, 75 bp, Artificial Sequence
  Synthetic
tgtggttgttttttgtgtctgtttccgtcccccatcaccccctccctccgtccccccgtcgcgggtgtttgtgtt

SEQ ID NO: 154256 - DNA, 75 bp, Artificial Sequence
  Synthetic
tccccccgtcgcgggtgtttgtgtttgtttattccgacatcggtttatttaaataaacacagccgttctgcgtgt

SEQ ID NO: 154257 - DNA, 75 bp, Artificial Sequence
  Synthetic
tggccgacatttccccaggcgcttttgtgccttgtgtaaaagcgcggcgtcccgctctccgatccccgcccctgg

SEQ ID NO: 154258 - DNA, 75 bp, Artificial Sequence
  Synthetic
gtggtcctccgggacgttttctggatggccgacatttccccaggcgcttttgtgccttgtgtaaaagcgcggcgt

SEQ ID NO: 154259 - DNA, 75 bp, Artificial Sequence
  Synthetic
cccgctctccgatccccgcccctgggcacgcgcaagcgcaagcgccctgcccgccccctctcatcggagtctgag

SEQ ID NO: 154260 - DNA, 75 bp, Artificial Sequence
  Synthetic
ctgaggtcgaatccgagacagcatcggattcgaccgagtctggggaccaggaggaagccccccgcatcggtggcc

SEQ ID NO: 154261 - DNA, 75 bp, Artificial Sequence
  Synthetic
gggggggggagacggggggaaagcaaggacacggcccggggggtgggagcgcgggccgggccgctcgtaagagcc

SEQ ID NO: 154262 - DNA, 75 bp, Artificial Sequence
  Synthetic
ggattcgaccgagtctggggaccaggaggaagccccccgcatcggtggccgtagggccccccggaggcttggggg

SEQ ID NO: 154263 - DNA, 75 bp, Artificial Sequence
  Synthetic
acgaggaggaggagaaggaggaggagggagggggggggagacggggggaaagcaaggacacgggcccgggggggg

SEQ ID NO: 154264 - DNA, 75 bp, Artificial Sequence
  Synthetic
gaatccaccacggggacggaaacggatgcgtcggtgtcggacgaccccgacgacacgtccgactggtcttgtgac

SEQ ID NO: 154265 - DNA, 75 bp, Artificial Sequence
  Synthetic
atgcgtcggtgtcggacgaccccgacgacacgtccgactggtcttgtgacgacattcccccacgacccaagcggg

SEQ ID NO: 154266 - DNA, 75 bp, Artificial Sequence
  Synthetic
ctctcccgatcggcgggatggggttatttttcctaagatggggcgggtccggtctacccgggaaacgcagccccg

SEQ ID NO: 154267 - DNA, 75 bp, Artificial Sequence
  Synthetic
atttttcctaagatggggcgggtccggtctacccgggaaacgcagccccgggcccccaccccgtcggccccaagc

SEQ ID NO: 154268 - DNA, 75 bp, Artificial Sequence
  Synthetic
ggttcggggggggggggggggggcgggaaaccaagtaggcccgcccatccgcggcccctcccggcagccacgccc

SEQ ID NO: 154269 - DNA, 75 bp, Artificial Sequence
  Synthetic
tccccccccacccaacccgcaccacgagcacgggttgggggtagcaggggatcaaaggggggcaaggccggcggg

SEQ ID NO: 154270 - DNA, 75 bp, Artificial Sequence
  Synthetic
tgcgccaggcccagaggcggagcagcgcacgatggacccccgacctgggctacatgcgccagtgtatcaatcagc

SEQ ID NO: 154271 - DNA, 75 bp, Artificial Sequence
  Synthetic
cgcacgatggacccccgacctgggctacatgcgccagtgtatcaatcagctgtttcgggtcctgcgggtcgcccg

SEQ ID NO: 154272 - DNA, 75 bp, Artificial Sequence
  Synthetic
ccctcccggcagccacgcccccccagcgtcgggtgtcacggggaaagagcaggggagagggggggagaggggaga

SEQ ID NO: 154273 - DNA, 75 bp, Artificial Sequence
  Synthetic
ctgcgccacctgatacgcgactgttacctgatgggatactgccgagcccgtctggccccgcgcacgtggtgccgc

SEQ ID NO: 154274 - DNA, 75 bp, Artificial Sequence
  Synthetic
ttgctgcaggtgtccggcggaacctggggcatgcacctgcgcaacaccatacgggaggtggaggctcgattcgac

SEQ ID NO: 154275 - DNA, 75 bp, Artificial Sequence
  Synthetic
ttccttgtttggaggccagacggtacggcccggagtgtgatcttagtaatctcgagattcatctcagcgcgacaa

SEQ ID NO: 154276 - DNA, 75 bp, Artificial Sequence
  Synthetic
cggcccggagtgtgatcttagtaatctcgagattcatctcagcgcgacaagcgatgatgaaatctccgatgccac

SEQ ID NO: 154277 - DNA, 75 bp, Artificial Sequence
  Synthetic
cacacgctcgcgtcccagtccgacacggaggatgccccctcccccgttacgctggaaaccccagaaccccgcggg

SEQ ID NO: 154278 - DNA, 75 bp, Artificial Sequence
  Synthetic
cggaggatgccccctcccccgttacgctggaaaccccagaaccccgcgggtccctcgctgtgcgtctggaggatg

SEQ ID NO: 154279 - DNA, 75 bp, Artificial Sequence
  Synthetic
ccaggagggctcccagccctggctgtctgcggtcgtggccgataccagctccgtggaacgcccgggcccatccga

SEQ ID NO: 154280 - DNA, 75 bp, Artificial Sequence
  Synthetic
atcactgtcccggattggacacggtcttgtgggataggcatgcccagaaggcatattgggttaacccctttttat

SEQ ID NO: 154281 - DNA, 75 bp, Artificial Sequence
  Synthetic
gacccccttgtatgtccccaaaataaaagaccaaaatcaaagcgtttgtcccagcgtcttaatggcgggaagggc

SEQ ID NO: 154282 - DNA, 75 bp, Artificial Sequence
  Synthetic
aaagaccaaaatcaaagcgtttgtcccagcgtcttaatggcgggaagggcggagagaaacagaccacgcgtacat

SEQ ID NO: 154283 - DNA, 75 bp, Artificial Sequence
  Synthetic
ccagcgtcttaatggcgggaagggcggagagaaacagaccacgcgtacatggggggtgtttgggggtttattgac

SEQ ID NO: 154284 - DNA, 75 bp, Artificial Sequence
  Synthetic
atagcagatgtgaggaagtctgggccgttcgccgcgaacggcgatcagagggtccgtttcttgcggaccacggcc

SEQ ID NO: 154285 - DNA, 75 bp, Artificial Sequence
  Synthetic
atctcgggcatacccatacacgcacaacacggacgccgcaccgaatgggacgtcgtaagggggtgggaggtagct

SEQ ID NO: 154286 - DNA, 75 bp, Artificial Sequence
  Synthetic
tctaacgatgcctcgacggaaacccgtccgggttcggggggcgaaccggccgcctgtcgctcgtcagggccggcg

SEQ ID NO: 154287 - DNA, 75 bp, Artificial Sequence
  Synthetic
gggtggggtttgtgcagagcaatcagggaccgcagccagcgcatacaatcgcgctcccgtccgttggtcccgggc

SEQ ID NO: 154288 - DNA, 75 bp, Artificial Sequence
  Synthetic
accggctgagcagggtctccagggggtggttgggtgccgcggggaacggggtccacgccacggtccactcgggca

SEQ ID NO: 154289 - DNA, 75 bp, Artificial Sequence
  Synthetic
gtggttgggtgccgcggggaacggggtccacgccacggtccactcgggcaaaaaccgagtcggcacggcccacgg

SEQ ID NO: 154290 - DNA, 75 bp, Artificial Sequence
  Synthetic
gtccacgccacggtccactcgggcaaaaaccgagtcggcacggcccacggttctcccacccacgcgtctggggtc

SEQ ID NO: 154291 - DNA, 75 bp, Artificial Sequence
  Synthetic
gccggattttttgggcgtattcgagaaacggcacacacagatccgccgcgcctaccacccacaagtggtagaggc

SEQ ID NO: 154292 - DNA, 75 bp, Artificial Sequence
  Synthetic
aaacggcacacacagatccgccgcgcctaccacccacaagtggtagaggcgaggggggctgggttggtctcggtg

SEQ ID NO: 154293 - DNA, 75 bp, Artificial Sequence
  Synthetic
tccacgacctcggtgctctccaaggggctgtcctccgcaaacaggcccgtggtggtgtttggggggcagcgacag

SEQ ID NO: 154294 - DNA, 75 bp, Artificial Sequence
  Synthetic
ggctgtcctccgcaaacaggcccgtggtggtgtttggggggcagcgacaggacctagtgcgcacgatcgggcggg

SEQ ID NO: 154295 - DNA, 75 bp, Artificial Sequence
  Synthetic
ctcggccaaccgtcgaaggttggccgggcgaacgacgaccggggtacccaggggttctgatgccaaaatgcggca

SEQ ID NO: 154296 - DNA, 75 bp, Artificial Sequence
  Synthetic
gggcgaacgacgaccggggtacccaggggttctgatgccaaaatgcggcactgcctaagcaggaagctccacagg

SEQ ID NO: 154297 - DNA, 75 bp, Artificial Sequence
  Synthetic
ggggcagggcgttgttctggtcaaggagggtcattacgttgacgacaacaacgcccatgttggtatattacaggc

SEQ ID NO: 154298 - DNA, 75 bp, Artificial Sequence
  Synthetic
acgcccatgttggtatattacaggcccgtgtccggtttggggcacttgcagatttgtaaggccacgcacggcggg

SEQ ID NO: 154299 - DNA, 75 bp, Artificial Sequence
  Synthetic
gagacaggccgacgcgggggctgctctaaaaatttaagggccctacggtccacagacccgccttcccgggggggc

SEQ ID NO: 154300 - DNA, 75 bp, Artificial Sequence
  Synthetic
ggtcgatttcacccatcgactggtcggtttgaaaggcatcgacgtccggggttttcgtcggtgggggcttttggg

SEQ ID NO: 154301 - DNA, 75 bp, Artificial Sequence
  Synthetic
ctaaaaatttaagggccctacggtccacagacccgccttcccgggggggcccttggagcgaccggcagcggaggc

SEQ ID NO: 154302 - DNA, 75 bp, Artificial Sequence
  Synthetic
cgggggggtaggtcagggggtgggtcgtcaaactgccgctccttaaaaccccggggcccgtcgttcggggtgctc

SEQ ID NO: 154303 - DNA, 75 bp, Artificial Sequence
  Synthetic
cgtcaaactgccgctccttaaaaccccggggcccgtcgttcggggtgctcgttggttggcactcacggtgcggcg

SEQ ID NO: 154304 - DNA, 75 bp, Artificial Sequence
  Synthetic
gtttacgggggacagggcaggaggaaggaggaggccgtcccgccggagacaaagccgtcccgggtgtttcctcat

SEQ ID NO: 154305 - DNA, 75 bp, Artificial Sequence
  Synthetic
ggccccttttataccccagccgaggacgcgtgcctggactccccgcccccggagacccccaaaccttcccacacc

SEQ ID NO: 154306 - DNA, 75 bp, Artificial Sequence
  Synthetic
tgtgtcatctgcaggagatcctggcccagatgtacggaaaccaggactaccccatagaggacgaccccagcgcgg

SEQ ID NO: 154307 - DNA, 75 bp, Artificial Sequence
  Synthetic
ccagatgtacggaaaccaggactaccccatagaggacgaccccagcgcggatgccgcggacgatgtcgacgagga

SEQ ID NO: 154308 - DNA, 75 bp, Artificial Sequence
  Synthetic
gaggaatacgcagaggagctttttctgcccggggacgcgaccggtccccttatcggggccaacgaccacatccct

SEQ ID NO: 154309 - DNA, 75 bp, Artificial Sequence
  Synthetic
aggcggctcgagccatcagccgcggcggcaagcccccctcgaccatggccaagctggtgactggcatgggcttta

SEQ ID NO: 154310 - DNA, 75 bp, Artificial Sequence
  Synthetic
cggcaagcccccctcgaccatggccaagctggtgactggcatgggctttacgatccacggagcgctcaccccagg

SEQ ID NO: 154311 - DNA, 75 bp, Artificial Sequence
  Synthetic
agccacccagattacccccaacgggtaatcgtgaaggcggggtggtacacgagcacgagccacgaggcgcgactg

SEQ ID NO: 154312 - DNA, 75 bp, Artificial Sequence
  Synthetic
taatcgtgaaggcggggtggtacacgagcacgagccacgaggcgcgactgctgaggcgactggaccacccggcga

SEQ ID NO: 154313 - DNA, 75 bp, Artificial Sequence
  Synthetic
cgtctccggggtcacgtgtctggtcctccccaagtaccaggccgacctgtatacctatctgagtaggcgcctgaa

SEQ ID NO: 154314 - DNA, 75 bp, Artificial Sequence
  Synthetic
atacctatctgagtaggcgcctgaacccactgggacgcccgcagatcgcagcggtctcccggcagctcctaagcg

SEQ ID NO: 154315 - DNA, 75 bp, Artificial Sequence
  Synthetic
ccgttgactacattcaccgccagggcattatccaccgcgacattaagaccgaaaatatttttattaacacccccg

SEQ ID NO: 154316 - DNA, 75 bp, Artificial Sequence
  Synthetic
cattatccaccgcgacattaagaccgaaaatatttttattaacacccccgaggacatttgcctgggggactttgg

SEQ ID NO: 154317 - DNA, 75 bp, Artificial Sequence
  Synthetic
tggtgtccgcggtccagaccacggtcaaaatgccggccgtggcgcttcgggcgctttcgccgcgcgaggagctga

SEQ ID NO: 154318 - DNA, 75 bp, Artificial Sequence
  Synthetic
cgatcaagccccttcccctacggaatcgccggaaccatcgacaccaacgcccccgaggtcctggccggggatccg

SEQ ID NO: 154319 - DNA, 75 bp, Artificial Sequence
  Synthetic
tataccacgaccgtcgacatttggagcgccggtctggtgatcttcgagactgccgtccacaacgcgtccttgttc

SEQ ID NO: 154320 - DNA, 75 bp, Artificial Sequence
  Synthetic
tgccgtccacaacgcgtccttgttctcggccccccgcggccccaaaaggggcccgtgcgacagtcagatcacccg

SEQ ID NO: 154321 - DNA, 75 bp, Artificial Sequence
  Synthetic
tcggccccccgcggccccaaaaggggcccgtgcgacagtcagatcacccgcatcatccgacaggcccaggtccac

SEQ ID NO: 154322 - DNA, 75 bp, Artificial Sequence
  Synthetic
aatcgcgcctcacctcgcgctaccgctcccgcgcggccgggaacaatcgcccgccttacacccgaccggcctgga

SEQ ID NO: 154323 - DNA, 75 bp, Artificial Sequence
  Synthetic
ctcccgcgcggccgggaacaatcgcccgccttacacccgaccggcctggacccgctactacaagatggacataga

SEQ ID NO: 154324 - DNA, 75 bp, Artificial Sequence
  Synthetic
ctcaccttcgacggcgcgcttcgccccagcgccgcagagctgctttgtttgccgctgtttcaacagaaatgaccg

SEQ ID NO: 154325 - DNA, 75 bp, Artificial Sequence
  Synthetic
ccagcgccgcagagctgctttgtttgccgctgtttcaacagaaatgaccgcccccggggggcggtgctgtttgcg

SEQ ID NO: 154326 - DNA, 75 bp, Artificial Sequence
  Synthetic
gcgtctgtggtgtttttggcatcatgtcgccgggcgccatgcgtgccgttgttcccattatcccattccttttgg

SEQ ID NO: 154327 - DNA, 75 bp, Artificial Sequence
  Synthetic
gtcgccgggcgccatgcgtgccgttgttcccattatcccattccttttggttcttgtcggtgtatcgggggttcc

SEQ ID NO: 154328 - DNA, 75 bp, Artificial Sequence
  Synthetic
ccccaactccagaccaccggtcgtccctcgcatgaagcccccaacatgacccagaccggcaccaccgactctccc

SEQ ID NO: 154329 - DNA, 75 bp, Artificial Sequence
  Synthetic
cctcgcatgaagcccccaacatgacccagaccggcaccaccgactctcccaccgccatcagccttaccacgcccg

SEQ ID NO: 154330 - DNA, 75 bp, Artificial Sequence
  Synthetic
atcttaaggggggagatgggacccgtgacaccctaccccagtccccgggtccagccgtcccgttggccggggatg

SEQ ID NO: 154331 - DNA, 75 bp, Artificial Sequence
  Synthetic
cgtagtcccaccccccggtcccaacaactcccccgcgcgccccgagaccagtcgaccgaagacaccccccaccag

SEQ ID NO: 154332 - DNA, 75 bp, Artificial Sequence
  Synthetic
aactcccccgcgcgccccgagaccagtcgaccgaagacaccccccaccagtatcgggccgctggcaactcgaccc

SEQ ID NO: 154333 - DNA, 75 bp, Artificial Sequence
  Synthetic
gacccttggttccgacgcctcaacataccccgctgttctcgttcctcactgcctcccccgccctggacaccctct

SEQ ID NO: 154334 - DNA, 75 bp, Artificial Sequence
  Synthetic
taccccgctgttctcgttcctcactgcctcccccgccctggacaccctcttcgtcgtcagcaccgtcatccacac

SEQ ID NO: 154335 - DNA, 75 bp, Artificial Sequence
  Synthetic
atggcgacacacctgtgtggtggttggtccagacgcgggcgacgcacacaccctagcgtgcgttacgtgtgcctg

SEQ ID NO: 154336 - DNA, 75 bp, Artificial Sequence
  Synthetic
ggtccagacgcgggcgacgcacacaccctagcgtgcgttacgtgtgcctgccgcccgaacgcgggtagggtatgg

SEQ ID NO: 154337 - DNA, 75 bp, Artificial Sequence
  Synthetic
taccgacgcctgcgtcggcgcccccgaagatttggggcgcagagacagaatctccgccgttagttctcccatgcg

SEQ ID NO: 154338 - DNA, 75 bp, Artificial Sequence
  Synthetic
cggaaagcaagaacaataaaggcggcgggatctagttgatatgcgtctctgggtgtttttggggtgtggtgggcg

SEQ ID NO: 154339 - DNA, 75 bp, Artificial Sequence
  Synthetic
cggggcggtcattggacgggggtgcagttaaatacatgcccgggacccatgaagcatgcgcgacttccgggcctc

SEQ ID NO: 154340 - DNA, 75 bp, Artificial Sequence
  Synthetic
ggaacccacccgaaacggccaacggacgtctgagccaggcctggctatccggagaaacagcacacgacttggcgt

SEQ ID NO: 154341 - DNA, 75 bp, Artificial Sequence
  Synthetic
acgtctgagccaggcctggctatccggagaaacagcacacgacttggcgttctgtgtgtcgcgatgtctctgcgc

SEQ ID NO: 154342 - DNA, 75 bp, Artificial Sequence
  Synthetic
gaagcctcgtgggggctgttcttgccgccacccatctgggacctgcggccaacacaacggaccccttaacgcacg

SEQ ID NO: 154343 - DNA, 75 bp, Artificial Sequence
  Synthetic
aacacaacggaccccttaacgcacgccccagtgtcccctcaccccagccccctggggggctttgccgtccccctc

SEQ ID NO: 154344 - DNA, 75 bp, Artificial Sequence
  Synthetic
tcctgggggcggcgtgtctgcttgagctcctgcgtcgtacgtgccgcgggtgggggcgttaccatccctacatgg

SEQ ID NO: 154345 - DNA, 75 bp, Artificial Sequence
  Synthetic
cccccccccttctccgcatgggtgatgtcgggtccaaactcccgacaccaccagctggcatggtataaatcaccg

SEQ ID NO: 154346 - DNA, 75 bp, Artificial Sequence
  Synthetic
tgtcgggtccaaactcccgacaccaccagctggcatggtataaatcaccggtgcgccccccaaaccatgtccggc

SEQ ID NO: 154347 - DNA, 75 bp, Artificial Sequence
  Synthetic
ggcacccaacaacaccgggctaaccaggaaatccgtggccccggcccccaacaaagatcgcggtagcccggccgt

SEQ ID NO: 154348 - DNA, 75 bp, Artificial Sequence
  Synthetic
caccgacgaatcccctaagggggaggggccattttacgaggaggaggggtataacaaagtctgtctttaaaaagc

SEQ ID NO: 154349 - DNA, 75 bp, Artificial Sequence
  Synthetic
gggccattttacgaggaggaggggtataacaaagtctgtctttaaaaagcaggggttagggagttgttcggtcat

SEQ ID NO: 154350 - DNA, 75 bp, Artificial Sequence
  Synthetic
ccccgatcatcagttatccttaaggtctcttttgtgtggtgcgttccggtatggggggggctgccgccaggttgg

SEQ ID NO: 154351 - DNA, 75 bp, Artificial Sequence
  Synthetic
tctcttttgtgtggtgcgttccggtatggggggggctgccgccaggttgggggccgtgattttgtttgtcgtcat

SEQ ID NO: 154352 - DNA, 75 bp, Artificial Sequence
  Synthetic
aaatatgccttggcggatgcctctctcaagatggccgaccccaatcgctttcgcggcaaagaccttccggtcctg

SEQ ID NO: 154353 - DNA, 75 bp, Artificial Sequence
  Synthetic
tcaagatggccgaccccaatcgctttcgcggcaaagaccttccggtcctggaccagctgaccgaccctccggggg

SEQ ID NO: 154354 - DNA, 75 bp, Artificial Sequence
  Synthetic
gggcctaccggacccgttccagccccccagcctcccgatcacggtttactacgccgtgttggagcgcgcctgccg

SEQ ID NO: 154355 - DNA, 75 bp, Artificial Sequence
  Synthetic
cccagcctcccgatcacggtttactacgccgtgttggagcgcgcctgccgcagcgtgctcctaaacgcaccgtcg

SEQ ID NO: 154356 - DNA, 75 bp, Artificial Sequence
  Synthetic
gcaagccccggcgccttctccgccttccgggggggcccccaaaccccgtatggttttggattcccctgacggggc

SEQ ID NO: 154357 - DNA, 75 bp, Artificial Sequence
  Synthetic
cctccgaagacgtccggaaacaaccctacaacctgaccatcgcttggtttcggatgggaggcaactgtgctatcc

SEQ ID NO: 154358 - DNA, 75 bp, Artificial Sequence
  Synthetic
ctacaacctgaccatcgcttggtttcggatgggaggcaactgtgctatccccatcacggtcatggagtacaccga

SEQ ID NO: 154359 - DNA, 75 bp, Artificial Sequence
  Synthetic
gcctgtcccatccgaacgcagccccgctggaactactatgacagcttcagcgccgtcagcgaggataacctgggg

SEQ ID NO: 154360 - DNA, 75 bp, Artificial Sequence
  Synthetic
gctggaactactatgacagcttcagcgccgtcagcgaggataacctggggttcctgatgcacgcccccgcgtttg

SEQ ID NO: 154361 - DNA, 75 bp, Artificial Sequence
  Synthetic
cgtgaagataaacgactggacggagattacacagtttatcctggagcaccgagccaagggctcctgtaagtacgc

SEQ ID NO: 154362 - DNA, 75 bp, Artificial Sequence
  Synthetic
attacacagtttatcctggagcaccgagccaagggctcctgtaagtacgccctcccgctgcgcatccccccgtca

SEQ ID NO: 154363 - DNA, 75 bp, Artificial Sequence
  Synthetic
agcagggggtgacggtggacagcatcgggatgctgccccgcttcatccccgagaaccagcgcaccgtcgccgtat

SEQ ID NO: 154364 - DNA, 75 bp, Artificial Sequence
  Synthetic
cgggatgctgccccgcttcatccccgagaaccagcgcaccgtcgccgtatacagcttgaagatcgccgggtggca

SEQ ID NO: 154365 - DNA, 75 bp, Artificial Sequence
  Synthetic
accctgctgcccccggagctgtccgagacccccaacgccacgcagccagaactcgccccggaagaccccgaggat

SEQ ID NO: 154366 - DNA, 75 bp, Artificial Sequence
  Synthetic
agacccccaacgccacgcagccagaactcgccccggaagaccccgaggattcggccctcttggaggaccccgtgg

SEQ ID NO: 154367 - DNA, 75 bp, Artificial Sequence
  Synthetic
aaactggcacatcccgtcgatccaggacgccgcgacgccttaccatcccccggccaccccgaacaacatgggcct

SEQ ID NO: 154368 - DNA, 75 bp, Artificial Sequence
  Synthetic
cggccaccccgaacaacatgggcctgatcgccggcgcggtgggcggcagtctcctggcagccctggtcatttgcg

SEQ ID NO: 154369 - DNA, 75 bp, Artificial Sequence
  Synthetic
atgggtgcgggggggtcaggtctgcggggttgggatgggaccttaactccatataaagcgagtctggaagggggg

SEQ ID NO: 154370 - DNA, 75 bp, Artificial Sequence
  Synthetic
tgtgtcatcaccgcaggcgagtctctttcccgccgccccccggaggacccagagcgacccggggttcccgggccc

SEQ ID NO: 154371 - DNA, 75 bp, Artificial Sequence
  Synthetic
atataaagcgagtctggaaggggggaaaggcggacagtcgataagtcggtagcgggggacgcgcacctgttccgc

SEQ ID NO: 154372 - DNA, 75 bp, Artificial Sequence
  Synthetic
agagcgacccggggttcccgggcccccgtcccccccgaccccccaacgatcccacgggccgccggccgatgaggt

SEQ ID NO: 154373 - DNA, 75 bp, Artificial Sequence
  Synthetic
aaccgtcccgtttcgggatgccgtgccgcccgttgcagggcctggtgctcgtgggcctctgggtctgtgccacca

SEQ ID NO: 154374 - DNA, 75 bp, Artificial Sequence
  Synthetic
ccgcccgttgcagggcctggtgctcgtgggcctctgggtctgtgccaccagcctggttgtccgtggccccacggt

SEQ ID NO: 154375 - DNA, 75 bp, Artificial Sequence
  Synthetic
gacgccggggccttggggcccgacggcgtagtggaggaagacctgcttattctcggggagcttcgctttgtgggg

SEQ ID NO: 154376 - DNA, 75 bp, Artificial Sequence
  Synthetic
gcgtagtggaggaagacctgcttattctcggggagcttcgctttgtgggggaccaggtcccccacaccacctact

SEQ ID NO: 154377 - DNA, 75 bp, Artificial Sequence
  Synthetic
ctaccccatgggacacaaatgcccacgggtcgtgcatgtcgtcacggtgaccgcgtgcccacgtcgccccgccgt

SEQ ID NO: 154378 - DNA, 75 bp, Artificial Sequence
  Synthetic
acgtgttacgcgtatgggtcggggacgcaccaaacgccagcctgtttgtcctggggatggccatagccgccgaag

SEQ ID NO: 154379 - DNA, 75 bp, Artificial Sequence
  Synthetic
ccatggctcctgcgacccgaaactgcttccgtcttcggccccgcgtctggccccggcgagcgtataccaacccgc

SEQ ID NO: 154380 - DNA, 75 bp, Artificial Sequence
  Synthetic
ccccggcgagcgtataccaacccgcccctaacccggcctccaccccctcgaccaccacctccaccccctcgacca

SEQ ID NO: 154381 - DNA, 75 bp, Artificial Sequence
  Synthetic
accaccacctccaccccctcgaccaccatccccgctccccaagcatcgaccacacccttccccacgggagaccca

SEQ ID NO: 154382 - DNA, 75 bp, Artificial Sequence
  Synthetic
ccatccccgctccccaagcatcgaccacacccttccccacgggagacccaaaaccccaacctcacggggtcaacc

SEQ ID NO: 154383 - DNA, 75 bp, Artificial Sequence
  Synthetic
ctaacggtgacccagataatccagatagccatccccgcgtccattatagccctggtgtttctggggagctgtatt

SEQ ID NO: 154384 - DNA, 75 bp, Artificial Sequence
  Synthetic
cctggtgtttctggggagctgtatttgctttatacacagatgtcaacgccgctaccgacgctcccgccgcccgat

SEQ ID NO: 154385 - DNA, 75 bp, Artificial Sequence
  Synthetic
atctcatgcgcggtgaacgaagcggccatggcccgcctcggagccgagctcaaatcgcatccgagcacccccccc

SEQ ID NO: 154386 - DNA, 75 bp, Artificial Sequence
  Synthetic
caaatcgcatccgagcaccccccccaaatcccggcgccggtcgtcacgcacgccaatgccctccctgacggccat

SEQ ID NO: 154387 - DNA, 75 bp, Artificial Sequence
  Synthetic
gcggctgggcttccgacgccccccgtggaccccacgacatccaccccaacgcctcccctgttggtataggtccac

SEQ ID NO: 154388 - DNA, 75 bp, Artificial Sequence
  Synthetic
ggccactggccgggggcaccacataaccgaccgcagtcactgagttgggaataaaccggtattatttacctatat

SEQ ID NO: 154389 - DNA, 75 bp, Artificial Sequence
  Synthetic
cccccccccggaaaccaaagaaggaagcaaagaatggatgggaggagttcaggaagccggggagagggcccgcgg

SEQ ID NO: 154390 - DNA, 75 bp, Artificial Sequence
  Synthetic
agcaaagaatggatgggaggagttcaggaagccggggagagggcccgcggcgcatttaaggcgttgttgtgttga

SEQ ID NO: 154391 - DNA, 75 bp, Artificial Sequence
  Synthetic
cggtgctgtttgttgggctcccattttacccgaagatcggctgctatccccgggacatggatcgcggggcggtgg

SEQ ID NO: 154392 - DNA, 75 bp, Artificial Sequence
  Synthetic
ttacccgaagatcggctgctatccccgggacatggatcgcggggcggtggtggggtttcttctcggtgtttgtgt

SEQ ID NO: 154393 - DNA, 75 bp, Artificial Sequence
  Synthetic
aaaacgtcctggagacgggtgagtgtcggcgaggacgtttcgttgcttccagctccggggcctacggggcgcggc

SEQ ID NO: 154394 - DNA, 75 bp, Artificial Sequence
  Synthetic
tcggcgaggacgtttcgttgcttccagctccggggcctacggggcgcggcccgacccagaaactactatgggccg

SEQ ID NO: 154395 - DNA, 75 bp, Artificial Sequence
  Synthetic
ggcccggcccggggccccggcggacccaaggggccccggcccggggccccacaacggcccggcgcatgcgctgtg

SEQ ID NO: 154396 - DNA, 75 bp, Artificial Sequence
  Synthetic
cttacacccgtcgtgggtctcgctgatgccccccaagcaggtgcccgagacggtcgtggatgcggcgtgcatgcg

SEQ ID NO: 154397 - DNA, 75 bp, Artificial Sequence
  Synthetic
cggtcgtggatgcggcgtgcatgcgcgctccggtcccgctggcgatggcgtacgcccccccggccccatctgcga

SEQ ID NO: 154398 - DNA, 75 bp, Artificial Sequence
  Synthetic
gtggcaggagcgcgcggccgtggttaaccggagtctggttattcacggggtccgagagacggacagcggcctgta

SEQ ID NO: 154399 - DNA, 75 bp, Artificial Sequence
  Synthetic
tccgagagacggacagcggcctgtataccctgtccgtgggcgacataaaggacccggctcgccaagtggcctcgg

SEQ ID NO: 154400 - DNA, 75 bp, Artificial Sequence
  Synthetic
tggtcctggtggtgcaaccggccccagttccgaccccacccccgaccccagccgattacgacgaggatgacaatg

SEQ ID NO: 154401 - DNA, 75 bp, Artificial Sequence
  Synthetic
cggcactcccgccagcgggaccccccggctcccgcctccccccgcccccccgaggtcttggcccagcgcccccga

SEQ ID NO: 154402 - DNA, 75 bp, Artificial Sequence
  Synthetic
cggctcccgcctccccccgcccccccgaggtcttggcccagcgcccccgaagtctcacatgtgcgtggggtgacc

SEQ ID NO: 154403 - DNA, 75 bp, Artificial Sequence
  Synthetic
atcgcccacgacgaccagacctactccatggacgtcgtctggttgaggttcgacgtgccgacctcgtgtgccgag

SEQ ID NO: 154404 - DNA, 75 bp, Artificial Sequence
  Synthetic
gtcgtaacggcaatcgtgtacgtcgtccgcacatcacagtcgcggcagcgtcatcggcggtaacgcaagaccccc

SEQ ID NO: 154405 - DNA, 75 bp, Artificial Sequence
  Synthetic
ccatggacgtcgtctggttgaggttcgacgtgccgacctcgtgtgccgagatgcgaatatacgaatcgtgtctgt

SEQ ID NO: 154406 - DNA, 75 bp, Artificial Sequence
  Synthetic
gtccccggccgacgcgccgtgcgccgcgagtacgtggacgtctcgcctggccgtccgcagctacgcggggtgttc

SEQ ID NO: 154407 - DNA, 75 bp, Artificial Sequence
  Synthetic
gcgagtacgtggacgtctcgcctggccgtccgcagctacgcggggtgttccagaacaaaccccccaccgcgctgt

SEQ ID NO: 154408 - DNA, 75 bp, Artificial Sequence
  Synthetic
cgtgcctttgcacaccaaccccacgtcccccggcggtctctaagaagcaccgccccccctccttcataccaccga

SEQ ID NO: 154409 - DNA, 75 bp, Artificial Sequence
  Synthetic
tcccggggctggcgtggcaggcggcctccgtcaatctggagttccgggacgcgtccccacaacactccggcctgt

SEQ ID NO: 154410 - DNA, 75 bp, Artificial Sequence
  Synthetic
ctccgtcaatctggagttccgggacgcgtccccacaacactccggcctgtatctgtgtgtggtgtacgtcaacga

SEQ ID NO: 154411 - DNA, 75 bp, Artificial Sequence
  Synthetic
accatcagcaccgcggcgcagtaccggaacgcggtggtggaacagcccctcccacagcgcggcgcggatttggcc

SEQ ID NO: 154412 - DNA, 75 bp, Artificial Sequence
  Synthetic
ggaacgcggtggtggaacagcccctcccacagcgcggcgcggatttggccgagcccacccacccgcacgtcgggg

SEQ ID NO: 154413 - DNA, 75 bp, Artificial Sequence
  Synthetic
cggcgccctgcggttaggggcggtgatgggggccgccctgctgctgtctgcgctggggttgtcggtgtgggcgtg

SEQ ID NO: 154414 - DNA, 75 bp, Artificial Sequence
  Synthetic
atgggggccgccctgctgctgtctgcgctggggttgtcggtgtgggcgtgtatgacctgttggcgcaggcgtgcc

SEQ ID NO: 154415 - DNA, 75 bp, Artificial Sequence
  Synthetic
cgggtaaggggcccacgtacattcgcgtggccgacagcgagctgtacgcggactggagctcggacagcgagggag

SEQ ID NO: 154416 - DNA, 75 bp, Artificial Sequence
  Synthetic
cgtggccgacagcgagctgtacgcggactggagctcggacagcgagggagaacgcgaccaggtcccgtggctggc

SEQ ID NO: 154417 - DNA, 75 bp, Artificial Sequence
  Synthetic
tccaccaatggatccggctttgagatcttatcaccaacggctccgtctgtatacccccgtagcgacgggcatcaa

SEQ ID NO: 154418 - DNA, 75 bp, Artificial Sequence
  Synthetic
tcttatcaccaacggctccgtctgtatacccccgtagcgacgggcatcaatctcgccgccagctcacaacctttg

SEQ ID NO: 154419 - DNA, 75 bp, Artificial Sequence
  Synthetic
ctcccaggcctccgattcgtccgtcttctggtaaggcgccccatcccgaggccccacgtcggtcgccgaactggg

SEQ ID NO: 154420 - DNA, 75 bp, Artificial Sequence
  Synthetic
ttctggtaaggcgccccatcccgaggccccacgtcggtcgccgaactgggcgaccgccggcgaggtggacgtcgg

SEQ ID NO: 154421 - DNA, 75 bp, Artificial Sequence
  Synthetic
ggctccaggcgacggcgtgggtgtagacgccctcgagcgccaggcacagtgggtgccgcagccggaggccgttgg

SEQ ID NO: 154422 - DNA, 75 bp, Artificial Sequence
  Synthetic
gaacgcggacccccccgacatgaccgcccgcccctcgccacgtcgaccgcgccctcgccacacccgcgacccccg

SEQ ID NO: 154423 - DNA, 75 bp, Artificial Sequence
  Synthetic
gcccgcccctcgccacgtcgaccgcgccctcgccacacccgcgacccccgggctacacggccgttgtctccccga

SEQ ID NO: 154424 - DNA, 75 bp, Artificial Sequence
  Synthetic
ctccctgtttgtcgcctggctggccgctcggtggctccggggggcttccggcctgggggccgtcctgtgtgggat

SEQ ID NO: 154425 - DNA, 75 bp, Artificial Sequence
  Synthetic
gctcggtggctccggggggcttccggcctgggggccgtcctgtgtgggattgcgtggtatgtgacgtcaattgcc

SEQ ID NO: 154426 - DNA, 75 bp, Artificial Sequence
  Synthetic
cgcctagccgcagcaaattaaaaatcgtgagtcacagcgaccgcaacttcccacccggagctttcttccggcctc

SEQ ID NO: 154427 - DNA, 75 bp, Artificial Sequence
  Synthetic
cgtgagtcacagcgaccgcaacttcccacccggagctttcttccggcctcgatgacgtcccggctctccgatccc

SEQ ID NO: 154428 - DNA, 75 bp, Artificial Sequence
  Synthetic
ccgtgccgctttatcccacggcctcgccagtttcggtcgaagcctactactcggaaagcgaagacgaggcggcca

SEQ ID NO: 154429 - DNA, 75 bp, Artificial Sequence
  Synthetic
gccagtttcggtcgaagcctactactcggaaagcgaagacgaggcggccaacgacttcctcgtacgcatgggccg

SEQ ID NO: 154430 - DNA, 75 bp, Artificial Sequence
  Synthetic
cgcagacgcacccgctgcgtcggcatggtgatcgcctgtctcctcgtggccgttctgtcgggcggatttggggcg

SEQ ID NO: 154431 - DNA, 75 bp, Artificial Sequence
  Synthetic
tgggtgggtggggagtgggtgggtggggagtgggtgggtggggagtgggtgggtggggagtgggtgggtggggag

SEQ ID NO: 154432 - DNA, 75 bp, Artificial Sequence
  Synthetic
aaatgtaaccatacccaaaccgactctgggggctgtttgtggggtcggaaccataggatgaacaaaccaccccgt

SEQ ID NO: 154433 - DNA, 75 bp, Artificial Sequence
  Synthetic
ggctcatcggcatctgtccggtatgggttgttccccacccactcgcgttcggacgtcttagaatcatggcggttt

SEQ ID NO: 154434 - DNA, 75 bp, Artificial Sequence
  Synthetic
ggttgttccccacccactcgcgttcggacgtcttagaatcatggcggttttctatgccgacatcggttttctccc

SEQ ID NO: 154435 - DNA, 75 bp, Artificial Sequence
  Synthetic
atctgtttgtaaaatttattaagggtacaaattgccctagcacaggggtggggttagggccgggtccccacaccc

SEQ ID NO: 154436 - DNA, 75 bp, Artificial Sequence
  Synthetic
tacaaattgccctagcacaggggtggggttagggccgggtccccacacccaaacgcaccaaacagatgcaggcag

SEQ ID NO: 154437 - DNA, 75 bp, Artificial Sequence
  Synthetic
aacacgtcgatgcgtgtgtcagacagcaccagaaagcacaggccatcaacaggtcgtgcatgtgtcggtgggttt

SEQ ID NO: 154438 - DNA, 75 bp, Artificial Sequence
  Synthetic
gcaccagaaagcacaggccatcaacaggtcgtgcatgtgtcggtgggtttggacgcggggggccatggtggtgat

SEQ ID NO: 154439 - DNA, 75 bp, Artificial Sequence
  Synthetic
accccaacccccccggaggggccagacgccccccgcggcgccgcggctcgcgactggcgggagccgccgccgccg

SEQ ID NO: 154440 - DNA, 75 bp, Artificial Sequence
  Synthetic
ggccacaggggcgacgtctcttggttggcccggagccactgggtgtggaccagccgcgcgtggcggcccaacatg

SEQ ID NO: 154441 - DNA, 75 bp, Artificial Sequence
  Synthetic
tggcccggagccactgggtgtggaccagccgcgcgtggcggcccaacatggcccctgtagccgggggcgggggat

SEQ ID NO: 154442 - DNA, 75 bp, Artificial Sequence
  Synthetic
agacacctcgaccacggttcgaaagaaggcccggtggtccgcgggcaacatcaccaggtgcgcaagcgcccgggc

SEQ ID NO: 154443 - DNA, 75 bp, Artificial Sequence
  Synthetic
tccgaggttggctcatcgcccgggtcttgccgcaagtgcgtgtgggttgggcttccggtgggcgggacgcgaacc

SEQ ID NO: 154444 - DNA, 75 bp, Artificial Sequence
  Synthetic
gagcgtatgctccatcttgtggggagaaggggtctgggctcgccaggggggcatacttgcccgggctatacagac

SEQ ID NO: 154445 - DNA, 75 bp, Artificial Sequence
  Synthetic
gggagaccggggttgtcgtggatccctggggtcacgcggtaccctggggtctctgggagctcgcggtactctggg

SEQ ID NO: 154446 - DNA, 75 bp, Artificial Sequence
  Synthetic
ctggggtcacgcggtaccctggggtctctgggagctcgcggtactctgggttccctaggttctcggggtggtcgc

SEQ ID NO: 154447 - DNA, 75 bp, Artificial Sequence
  Synthetic
ctctgggagctcgcggtactctgggttccctaggttctcggggtggtcgcggaacccggggctcccggggaacac

SEQ ID NO: 154448 - DNA, 75 bp, Artificial Sequence
  Synthetic
tcggacggcttcagatggcttcgagatcgtagtgtccgcaccgactcgtagtagacccgaatctccacattgccc

SEQ ID NO: 154449 - DNA, 75 bp, Artificial Sequence
  Synthetic
atcgtagtgtccgcaccgactcgtagtagacccgaatctccacattgccccgccgcttgatcattatcaccccgt

SEQ ID NO: 154450 - DNA, 75 bp, Artificial Sequence
  Synthetic
ggtgtcctcgaggtgcgtgaacacctctggggtgcatgccggcggacggcacgccttttaagtaaacatctgggt

SEQ ID NO: 154451 - DNA, 75 bp, Artificial Sequence
  Synthetic
ttgggtctggctcatctcgagagacacgggggggaaccaccctccgcccagagactcgggtgatggtcgtacccg

SEQ ID NO: 154452 - DNA, 75 bp, Artificial Sequence
  Synthetic
ggactcaacgggttaccggattacggggactgtcggtcacggtcccgccggttcttcgatgtgccacacccaagg

SEQ ID NO: 154453 - DNA, 75 bp, Artificial Sequence
  Synthetic
gggactgtcggtcacggtcccgccggttcttcgatgtgccacacccaaggatgcgttgggggcgatttcgggcag

SEQ ID NO: 154454 - DNA, 75 bp, Artificial Sequence
  Synthetic
cgctccgggtcgtgcacggcggttctggccgcctcccggtcctcacgcccccttttattgatctcatcgcgtacg

SEQ ID NO: 154455 - DNA, 75 bp, Artificial Sequence
  Synthetic
gacgagggcgttcctcctgcgggaaggcacgaacgcgggtgagccccctcctccgcccccgcgtcccccctcctc

SEQ ID NO: 154456 - DNA, 75 bp, Artificial Sequence
  Synthetic
ctccgcccccgcgtcccccctcctccgcccccgcgtcccccctcctccgcccccgcgtcccccctcctccgcccc

SEQ ID NO: 154457 - DNA, 75 bp, Artificial Sequence
  Synthetic
gccccgcgtccccctcctccgccccgcgtccccctcctccgccccgcgtcccccctcctccgcccccgcgtcccc

SEQ ID NO: 154458 - DNA, 75 bp, Artificial Sequence
  Synthetic
tccgcgtgtccctttccgatgcgatcccgatcccgagccggggcgtcgcgatgccgacgccgtccgctccgacgg

SEQ ID NO: 154459 - DNA, 75 bp, Artificial Sequence
  Synthetic
cccgatcccgagccggggcgtcgcgatgccgacgccgtccgctccgacggccctctgcgactcccgctcccggtc

SEQ ID NO: 154460 - DNA, 75 bp, Artificial Sequence
  Synthetic
gttcgtggccggcgccgtctgcgggcgtcggtcgcgccgggcctttatgtgcgccggagagacccgccccccgcc

SEQ ID NO: 154461 - DNA, 75 bp, Artificial Sequence
  Synthetic
cgtcggtcgcgccgggcctttatgtgcgccggagagacccgccccccgccgcccgggtccgcccccggggccggc

SEQ ID NO: 154462 - DNA, 75 bp, Artificial Sequence
  Synthetic
tcgcacttcgccctaataatatatatatattgggacgaagtgcgaacgcttcgcgttctcacttcttttacccgg

SEQ ID NO: 154463 - DNA, 75 bp, Artificial Sequence
  Synthetic
ggcgggcgggaccgggggcccggggacggccaacgggcgcgcggggctcgtatctcattaccgccgaaccgggaa

SEQ ID NO: 154464 - DNA, 75 bp, Artificial Sequence
  Synthetic
acggccaacgggcgcgcggggctcgtatctcattaccgccgaaccgggaagtcggggcccgggccccgccccctg

SEQ ID NO: 154465 - DNA, 75 bp, Artificial Sequence
  Synthetic
gggcggggccgggggttcgaccaacgggccgcggccacgggcccccggcgtgccggcgtcggggcggggtcgtgc

SEQ ID NO: 154466 - DNA, 75 bp, Artificial Sequence
  Synthetic
caagcatgtgcgtgcagaggcgagtagtgcttgcctgtctaactcgctagtctcggccgcggggggcccgggctg

SEQ ID NO: 154467 - DNA, 75 bp, Artificial Sequence
  Synthetic
cctccgctgctcctccttcccgccggcccctgggactatatgagcccgaggacgccccgatcgtccacacggagc

SEQ ID NO: 154468 - DNA, 75 bp, Artificial Sequence
  Synthetic
gcccctgggactatatgagcccgaggacgccccgatcgtccacacggagcgcggctgccgacacggatccacgac

SEQ ID NO: 154469 - DNA, 75 bp, Artificial Sequence
  Synthetic
ccgtcagacgctcgccgcgccgggacgccgatacgcggacgaagcgcgggagggggatcggccgtccctgtcctt

SEQ ID NO: 154470 - DNA, 75 bp, Artificial Sequence
  Synthetic
taggtgacctaccgtgctacgtccgccgtcgcagccgtatccccggaggatcgccccgcatcggcgatggcgtcg

SEQ ID NO: 154471 - DNA, 75 bp, Artificial Sequence
  Synthetic
ccgtcgcagccgtatccccggaggatcgccccgcatcggcgatggcgtcggagaacaagcagcgccccggctccc

SEQ ID NO: 154472 - DNA, 75 bp, Artificial Sequence
  Synthetic
caccccgagcccagaccgcgacgagcggggggccctcgggtggggcgcggagacggaggagggcggggacgaccc

SEQ ID NO: 154473 - DNA, 75 bp, Artificial Sequence
  Synthetic
cggggggccctcgggtggggcgcggagacggaggagggcggggacgaccccgaccacgaccccgaccacccccac

SEQ ID NO: 154474 - DNA, 75 bp, Artificial Sequence
  Synthetic
ggagggcccccgcggcgggcaccgacgccggcgaggacgccggggacgccgtctcgccgcgacagctggctctgc

SEQ ID NO: 154475 - DNA, 75 bp, Artificial Sequence
  Synthetic
cgccggcgaggacgccggggacgccgtctcgccgcgacagctggctctgctggcctccatggtagaggaggccgt

SEQ ID NO: 154476 - DNA, 75 bp, Artificial Sequence
  Synthetic
gcggcctcgccgccccggacccccgcctttctagccgacgacgatgacggggacgagtacgacgacgcagccgac

SEQ ID NO: 154477 - DNA, 75 bp, Artificial Sequence
  Synthetic
cctttctagccgacgacgatgacggggacgagtacgacgacgcagccgacgccgccggcgaccgggccccggccc

SEQ ID NO: 154478 - DNA, 75 bp, Artificial Sequence
  Synthetic
ccagcgaccgcggctttgcggtaccaggggtaagggttagaacgtcgttcaggatgtcctcgcccccgggcccgt

SEQ ID NO: 154479 - DNA, 75 bp, Artificial Sequence
  Synthetic
acgcggcgcgtatccggaccccacggaccgcctgtcgccgcgcccgccggcccagccgccgcggagacgtcgtca

SEQ ID NO: 154480 - DNA, 75 bp, Artificial Sequence
  Synthetic
gctaacacacacgccggcaacccagaccccagtgggttggttgcgcggtcccgtctcctggctagttctttcccc

SEQ ID NO: 154481 - DNA, 75 bp, Artificial Sequence
  Synthetic
cggccggcggcggccatcggcgtcatcgacctcgtcggactccgggtcctcgtcctcgtcgtccgcatcctcttc

SEQ ID NO: 154482 - DNA, 75 bp, Artificial Sequence
  Synthetic
gacgacgacggcaacgacgcggccgaccacgcacgcgaggcgcgggccgtcgggcggggtccgtcgagcgcggcg

SEQ ID NO: 154483 - DNA, 75 bp, Artificial Sequence
  Synthetic
accacgcacgcgaggcgcgggccgtcgggcggggtccgtcgagcgcggcgccggaagcccccgggcggacgccgc

SEQ ID NO: 154484 - DNA, 75 bp, Artificial Sequence
  Synthetic
cgaggccgcgcccaagccccgggcggcggcgaggacccccgcggcctccgcgggccgcatcgagcgccgccgggc

SEQ ID NO: 154485 - DNA, 75 bp, Artificial Sequence
  Synthetic
gcggcgaggacccccgcggcctccgcgggccgcatcgagcgccgccgggcccgcgcggcggtggccggccgcgac

SEQ ID NO: 154486 - DNA, 75 bp, Artificial Sequence
  Synthetic
agccccggcgggtcgagctggacgccgacgcggcctccggcgccttctacgcgcgctatcgcgacgggtacgtca

SEQ ID NO: 154487 - DNA, 75 bp, Artificial Sequence
  Synthetic
cgacgcggcctccggcgccttctacgcgcgctatcgcgacgggtacgtcagcggggagccgtggcccggcgccgg

SEQ ID NO: 154488 - DNA, 75 bp, Artificial Sequence
  Synthetic
tacggcggcctgggcgacagccgcccgggcctctggggggcgcccgaggcggaggaggcgcgacgccggttcgag

SEQ ID NO: 154489 - DNA, 75 bp, Artificial Sequence
  Synthetic
cgggcctctggggggcgcccgaggcggaggaggcgcgacgccggttcgaggcctcgggcgccccggcggccgtgt

SEQ ID NO: 154490 - DNA, 75 bp, Artificial Sequence
  Synthetic
cccccacctgggggccgtggccgccacgggcatcgtcggcctggcctgcgagcactattacaccaacggctacta

SEQ ID NO: 154491 - DNA, 75 bp, Artificial Sequence
  Synthetic
gcagcagtacgccctgatcacgcggctgctgtacaccccggacgcggaggccatggggtggctccagaacccgcg

SEQ ID NO: 154492 - DNA, 75 bp, Artificial Sequence
  Synthetic
ctgctgtacaccccggacgcggaggccatggggtggctccagaacccgcgcgtggtccccggggacgtggcgctg

SEQ ID NO: 154493 - DNA, 75 bp, Artificial Sequence
  Synthetic
gcgccgcgcgcaacagcagctccttcatcaccggcagcgtggcgcgggccgtgccccacctgggctacgccatgg

SEQ ID NO: 154494 - DNA, 75 bp, Artificial Sequence
  Synthetic
catcaccggcagcgtggcgcgggccgtgccccacctgggctacgccatggcggccggccgcttcggctggggcct

SEQ ID NO: 154495 - DNA, 75 bp, Artificial Sequence
  Synthetic
atgagccgccgatacgaccgcgcgcagaagggcttcctgctgaccagcctgcgccgcgcctacgcgcccctgttg

SEQ ID NO: 154496 - DNA, 75 bp, Artificial Sequence
  Synthetic
ggcactcgctggatatgatgacgtgaaccaaagaccgagggccgacccgggccgtggccgagatcgtctggacct

SEQ ID NO: 154497 - DNA, 75 bp, Artificial Sequence
  Synthetic
gcgccgcgcctacgcgcccctgttggcgcgcgagaacgcggcgctgacgggggccgcggggagccccggcgccgg

SEQ ID NO: 154498 - DNA, 75 bp, Artificial Sequence
  Synthetic
gtcgccgccgccgcaccgggcgagcgcgcggtgcccgccgggtacggcgccgcggggatcctcgccgccctgggg

SEQ ID NO: 154499 - DNA, 75 bp, Artificial Sequence
  Synthetic
cgcggggatcctcgccgccctggggcggctgtccgccgcgcccgcctcccccgtggggggcgacgaccccgacgc

SEQ ID NO: 154500 - DNA, 75 bp, Artificial Sequence
  Synthetic
gggcgccgcgcccaggccggccgcgtggccgtcgagtgcctggccgcctgccgcgggatcctggaggcgctggcc

SEQ ID NO: 154501 - DNA, 75 bp, Artificial Sequence
  Synthetic
tggccgtcgagtgcctggccgcctgccgcgggatcctggaggcgctggccgagggcttcgacggcgacctggcgg

SEQ ID NO: 154502 - DNA, 75 bp, Artificial Sequence
  Synthetic
gcccgccagccccccgcggccggagggacccgcgggccccgcttccccgccgccgccgcacgccgacgcgccccg

SEQ ID NO: 154503 - DNA, 75 bp, Artificial Sequence
  Synthetic
ggacccgcgggccccgcttccccgccgccgccgcacgccgacgcgccccgcctgcgcgcgtggctgcgcgagctg

SEQ ID NO: 154504 - DNA, 75 bp, Artificial Sequence
  Synthetic
tcatgcgcctgcgcggggacctgcgcgtggccggcggcagcgaggccgccgtggccgccgtgcgcgccgtgagcc

SEQ ID NO: 154505 - DNA, 75 bp, Artificial Sequence
  Synthetic
gctgccgcgggacccgcgcctgccgagctccgcggccgccgccgccgcggacctgctgtttgagaaccagagcct

SEQ ID NO: 154506 - DNA, 75 bp, Artificial Sequence
  Synthetic
agcgcaccggacgccgccgacgcgctggcggccgccgccgcctccgccgcgccgcgggaggggcgcaagcgcaag

SEQ ID NO: 154507 - DNA, 75 bp, Artificial Sequence
  Synthetic
agtcccggcccggcccggccgcccggaggcggcggcccgcgacccccgaagacgaagaagagcggcgcggacgcc

SEQ ID NO: 154508 - DNA, 75 bp, Artificial Sequence
  Synthetic
ggggcccgagcccacccccgcccagcccgcggcggcccggggcgccgcggcgcaggcccgcccgcgccccgtggc

SEQ ID NO: 154509 - DNA, 75 bp, Artificial Sequence
  Synthetic
cccgaccccctgggcggctggcggcggcagccccgggggcccagccacacggcggcgcccgcggccgccgccctg

SEQ ID NO: 154510 - DNA, 75 bp, Artificial Sequence
  Synthetic
ggcagccccgggggcccagccacacggcggcgcccgcggccgccgccctggaggcctactgctccccgcgcgccg

SEQ ID NO: 154511 - DNA, 75 bp, Artificial Sequence
  Synthetic
gttccccgtcccctggcgaccggccctcatgtttgacccgcgggccctggcctcgatcgccgcgcggtgcgccgg

SEQ ID NO: 154512 - DNA, 75 bp, Artificial Sequence
  Synthetic
ctcatgtttgacccgcgggccctggcctcgatcgccgcgcggtgcgccgggcccgcccccgccgcccaggccgcg

SEQ ID NO: 154513 - DNA, 75 bp, Artificial Sequence
  Synthetic
cccacccccacggggccgccgggggccgcctctttggccccctgcgcgcctcgggcccgctgcgccgcatggcgg

SEQ ID NO: 154514 - DNA, 75 bp, Artificial Sequence
  Synthetic
ccgcctctttggccccctgcgcgcctcgggcccgctgcgccgcatggcggcctggatgcgccagatccccgaccc

SEQ ID NO: 154515 - DNA, 75 bp, Artificial Sequence
  Synthetic
tactcgccgctgccgggcgaggacctggccggcggcggggcctcgggggggccgccggagtggtccgccgagcgc

SEQ ID NO: 154516 - DNA, 75 bp, Artificial Sequence
  Synthetic
gccgccggagtggtccgccgagcgcggcgggctgtcctgcctgctggcggccctggccaaccggctgtgcgggcc

SEQ ID NO: 154517 - DNA, 75 bp, Artificial Sequence
  Synthetic
tggaccggcgcccccgacgtgtcggcgctgggcgcgcagggcgtgctgctgctgtccacgcgggacctggccttc

SEQ ID NO: 154518 - DNA, 75 bp, Artificial Sequence
  Synthetic
cgctgggcgcgcagggcgtgctgctgctgtccacgcgggacctggccttcgccggggccgtggagtttctggggc

SEQ ID NO: 154519 - DNA, 75 bp, Artificial Sequence
  Synthetic
gctcatcgtggtcaacaccgtgcgcgcctgcgactggcccgccgacgggcccgcggtgtcgcggcagcacgccta

SEQ ID NO: 154520 - DNA, 75 bp, Artificial Sequence
  Synthetic
gcctgcgactggcccgccgacgggcccgcggtgtcgcggcagcacgcctacctggcgtgcgacctgctgcccgcc

SEQ ID NO: 154521 - DNA, 75 bp, Artificial Sequence
  Synthetic
cggcgcgggacctgcgccgcacggtgctggcctcgggccgcgtgttcggcccgggggtcttcgcgcgcgtggagg

SEQ ID NO: 154522 - DNA, 75 bp, Artificial Sequence
  Synthetic
gctggcctcgggccgcgtgttcggcccgggggtcttcgcgcgcgtggaggccgcgcacgcgcgcctgtaccccga

SEQ ID NO: 154523 - DNA, 75 bp, Artificial Sequence
  Synthetic
ggcggcaacgtgcgctaccgcgtgcgcacgcgcttcggcccggacacgccggtgcccatgtccccgcgcgagtac

SEQ ID NO: 154524 - DNA, 75 bp, Artificial Sequence
  Synthetic
acggccgggcggcggcctcggggaccaccgacgccatggcgcccggcgcgccggacttctgcgaggaggaggccc

SEQ ID NO: 154525 - DNA, 75 bp, Artificial Sequence
  Synthetic
gggcctgggcgcgccgctgcggcccgtgtacgtggcgctggggcgcgaggcggtgcgcgccggcccggcccggtg

SEQ ID NO: 154526 - DNA, 75 bp, Artificial Sequence
  Synthetic
ttcgctgggcctcggccacgggccgcagcggcaccgtgctggcggcggcgggggccgtggaggtgctgggggcgg

SEQ ID NO: 154527 - DNA, 75 bp, Artificial Sequence
  Synthetic
cagcggcaccgtgctggcggcggcgggggccgtggaggtgctgggggcggaggcgggcttggccacgcccccgcg

SEQ ID NO: 154528 - DNA, 75 bp, Artificial Sequence
  Synthetic
gcctgggacgaagacgacggcggcgcgttcgagggggacggggtgctgtaacgggccgggacggggcggggcgct

SEQ ID NO: 154529 - DNA, 75 bp, Artificial Sequence
  Synthetic
cgttcgagggggacggggtgctgtaacgggccgggacggggcggggcgcttgtgaaacccgaagacgcaataaac

SEQ ID NO: 154530 - DNA, 75 bp, Artificial Sequence
  Synthetic
tgtgaaacccgaagacgcaataaacggcaacgacctgattaagttttgcagtagcgttgtttattcgaggggcgg

SEQ ID NO: 154531 - DNA, 75 bp, Artificial Sequence
  Synthetic
gagggggcgaggggcgggagggggcgaggggcggtggtggtgcgcgggcgcccccggagggtttggatctctgac

SEQ ID NO: 154532 - DNA, 75 bp, Artificial Sequence
  Synthetic
ctggggagggctggggctggggagggctggggctggggagggctggggctggggagggctggggctggggagggc

SEQ ID NO: 154533 - DNA, 75 bp, Artificial Sequence
  Synthetic
ggtggtgtgtagcaggagcggtgtgttgcgccggggtacgtctggaggagcgggaggtgcgcggtgacgtgtgga

SEQ ID NO: 154534 - DNA, 75 bp, Artificial Sequence
  Synthetic
tgaggaacaggagttgttgcgcggtgagttgtcgctgtgagttgtgttgttgggcaggtgtggtggatgacgtga

SEQ ID NO: 154535 - DNA, 75 bp, Artificial Sequence
  Synthetic
gagttgtcgctgtgagttgtgttgttgggcaggtgtggtggatgacgtgacgtgtgacgtgcggattgcgccgtg

SEQ ID NO: 154536 - DNA, 75 bp, Artificial Sequence
  Synthetic
ttcgccatcgggatagtcccgcgcgaagccgctcgcggaggccggatcggtggcgggacccgtgggaggagcggg

SEQ ID NO: 154537 - DNA, 75 bp, Artificial Sequence
  Synthetic
accgagtaggcccgcccatccgcggcccctcccggcagccacgccccccagcgtcgggtgtcacggggaaagagc

SEQ ID NO: 154538 - DNA, 75 bp, Artificial Sequence
  Synthetic
cctgcagccgaagcccctcaccacgccgccgcccatcatcgccacgtcggaccccaccccgcgacgggacgccgc

SEQ ID NO: 154539 - DNA, 75 bp, Artificial Sequence
  Synthetic
gggctccagacccgccagcaccgcatctgcgtcagccgcccccatggcgcccccgctgacggcctggtgaaccag

SEQ ID NO: 154540 - DNA, 75 bp, Artificial Sequence
  Synthetic
tgatgttgaccacaaaacccggaatttacgcctacgccccaatgcccacgcaagatgaggtaggtaacccccccg

SEQ ID NO: 154541 - DNA, 75 bp, Artificial Sequence
  Synthetic
aggccgtgggtgttggtctcggccgagttgacaaacagggctgggtgcagcacgcagcgataggcgagcagggcc

SEQ ID NO: 154542 - DNA, 75 bp, Artificial Sequence
  Synthetic
tggatatgatgacgtgaaccaaagacgagggccgacccgggacgtggccgagatcgtactggacctcgttggcca

SEQ ID NO: 154543 - DNA, 75 bp, Artificial Sequence
  Synthetic
cccttaaggggggcgaccgcggggggaggctgggcggtcggctcgaccgtggtgggggcgggcaggctcgcgttc

SEQ ID NO: 154544 - DNA, 75 bp, Artificial Sequence
  Synthetic
gtaacccaaccaaaccaggcgtggtgtgagtttgtggacccaaagccctcagagacaacgcgacaggccagtatg

SEQ ID NO: 154545 - DNA, 75 bp, Artificial Sequence
  Synthetic
tactgccccccatgaaccccgttccgacatcgggcaccccggcccccgcgccgcccggcgacgggagctacctgt

SEQ ID NO: 154546 - DNA, 75 bp, Artificial Sequence
  Synthetic
tcccctctccccccctctcccctctccccccctctcccctctccccccctctcccctctccccccctctcccctc

SEQ ID NO: 154547 - DNA, 75 bp, Artificial Sequence
  Synthetic
tctcccctctgctctttccccgtgacacccgacgctgggggcgtggctgccgggaggggccgcggatgggcgggc

SEQ ID NO: 154548 - DNA, 75 bp, Artificial Sequence
  Synthetic
cccccgaaccgccccgccggctttgcccccctttgatcccctgctacccccaacccgtgctggtggtgcgggttg

SEQ ID NO: 154549 - DNA, 75 bp, Artificial Sequence
  Synthetic
gggggggatgtgggcgggggtgcgcgggaggtgtcggtggtggtggtggtggtggtagtaggaatggtggtgagg

SEQ ID NO: 154550 - DNA, 75 bp, Artificial Sequence
  Synthetic
gggggggggcgctggttggtcaaaaaagggagggacgggggccggcagaccgacggcgacaacgctccccggcgg

SEQ ID NO: 154551 - DNA, 75 bp, Artificial Sequence
  Synthetic
ccggcccgcgctcccaccccccgggccgtgtccttgctttccccccgtctcccccccccccgccttctcctcctc

SEQ ID NO: 154552 - DNA, 75 bp, Artificial Sequence
  Synthetic
cgtggcccgcggcgacggtcgcgttgtcgccggcggggcgcggcggcggtgggtttttcggttttttgttcttct

SEQ ID NO: 154553 - DNA, 75 bp, Artificial Sequence
  Synthetic
gaacggctgtgtttatttaaataaaccaatgtcggaataaacaaacacaaacacccgcgacggggggacggaggg

SEQ ID NO: 154554 - DNA, 75 bp, Artificial Sequence
  Synthetic
ccacgcccccgcccctgccccggcgacccccggcccgcacgatcccgacaacaataacaaccccaacggaaagcg

SEQ ID NO: 154555 - DNA, 75 bp, Artificial Sequence
  Synthetic
ccatcctacacccccctgccttccaccctccggccccccgcgagtccacccgccggccggctaccgagaccgaac

SEQ ID NO: 154556 - DNA, 75 bp, Artificial Sequence
  Synthetic
ccctgcagccggggcggccaaggggcgtcggcgacatcctccccctaagcgccggccggccgctggtctgttttt

SEQ ID NO: 154557 - DNA, 75 bp, Artificial Sequence
  Synthetic
ccccaataaacgtatgtcgctaccacacccttgtgtgtcaatggacgcctctccggggggggaagggaaaacaaa

SEQ ID NO: 154558 - DNA, 75 bp, Artificial Sequence
  Synthetic
ctttcctgttctcgcttctccccccccccttcttcacccccagtaccctcctccctcccttcctcccccgttatc

SEQ ID NO: 154559 - DNA, 75 bp, Artificial Sequence
  Synthetic
ccccttcttcacccccagtaccctcctccctcccttcctcccccgttatcccactcgtcgagggcgccccggtgt

SEQ ID NO: 154560 - DNA, 75 bp, Artificial Sequence
  Synthetic
aaggcatgtgtcccaccccgcctgtgtttttgtgcctggctctctatgcttgggtcttactgcctgggggggggg

SEQ ID NO: 154561 - DNA, 75 bp, Artificial Sequence
  Synthetic
gatacggaggagtggcgggtgccgggggaccggggtgatctctggcacgcgggggtgggaagggtcgggggaggg

SEQ ID NO: 154562 - DNA, 75 bp, Artificial Sequence
  Synthetic
ccccccacccctccgccccaccccccaacacccacgtctgtggtgtggccgacccccttttgggcgccccgtccc

SEQ ID NO: 154563 - DNA, 75 bp, Artificial Sequence
  Synthetic
gacccccttttgggcgccccgtcccgccccgccacccctcccatcctttgttgccctatagtgtagttaaccccc

SEQ ID NO: 154564 - DNA, 75 bp, Artificial Sequence
  Synthetic
ccagtggcaggatgctttcggggatcggtggtcaggcagcccgggccgcggctctgtggttaacaccagagcctg

SEQ ID NO: 154565 - DNA, 75 bp, Artificial Sequence
  Synthetic
gcgggaggggcacaccagacaccaaagcgtggggcgctggctctgggggtttgggaggggccggggggcgcgcga

SEQ ID NO: 154566 - DNA, 75 bp, Artificial Sequence
  Synthetic
gaacgcagcaacacggaggcgactggattgtgcaagagacccttaaggggggcgaccgaggggggaggctgggcg

SEQ ID NO: 154567 - DNA, 75 bp, Artificial Sequence
  Synthetic
cctgcaggcgcgcgccctgtcgcgtcaggaggcccgggccgtcgccgctggccgcgcttagcgggtgcgtctcaa

SEQ ID NO: 154568 - DNA, 75 bp, Artificial Sequence
  Synthetic
catctccaggacccgcatgtcgtcgtcatcttcttcgaccgcctctccggcggggggcttgggggcggagggagg

SEQ ID NO: 154569 - DNA, 75 bp, Artificial Sequence
  Synthetic
tccacgcccccggggcccgagcccgcccccgcccagcccgcggcgccccgggccgccgcggcgcaggcccgcccg

SEQ ID NO: 154570 - DNA, 75 bp, Artificial Sequence
  Synthetic
agtccgtgggtggcgcgacggtgtcctccgggatcatctcgtcgtcctcgacgggggtgttggaatgaggcgccc

SEQ ID NO: 154571 - DNA, 75 bp, Artificial Sequence
  Synthetic
cagggaaacacccagacatccggggcgggctaaggggaaaaaaggggggcgggtaagaatggggggggatttccc

SEQ ID NO: 154572 - DNA, 75 bp, Artificial Sequence
  Synthetic
gggggcctgcgtatgagtcagtggggaccacgcccccaacacggcgaccccggtccctgtgtgtttgttgtgggg

SEQ ID NO: 154573 - DNA, 75 bp, Artificial Sequence
  Synthetic
ggtcccacggcgaccccgggccctgcgtctgagtcaaaggggccatgtgtatgtgttgggggtctgtatatataa

SEQ ID NO: 154574 - DNA, 75 bp, Artificial Sequence
  Synthetic
atggcgcccggctcccgtgtatgagtgggggtcccccaacatggcggccggttccagtgtaagggtcgggggtcc

SEQ ID NO: 154575 - DNA, 75 bp, Artificial Sequence
  Synthetic
ggagggacttttgcgcccgcgccctgctggagcccgacgacgacgcccccccgctggtgctgcgcggcgacgacg

SEQ ID NO: 154576 - DNA, 75 bp, Artificial Sequence
  Synthetic
accgcaccatcacggactttcccctgaccacccgcagtgccgactttcgggacggccgtatgtccaagaccttca

SEQ ID NO: 154577 - DNA, 75 bp, Artificial Sequence
  Synthetic
agcccgggccccccgcgggcggggcggcgcgcaaaaaaggcggccggcggcccgggcggcgggcgcgcgcacggc

SEQ ID NO: 154578 - DNA, 75 bp, Artificial Sequence
  Synthetic
cccaaaaacgggccccccccgaaacacaccccccgggggtcgcgcgcggccctttaaagcgcggcggcgcagccc

SEQ ID NO: 154579 - DNA, 75 bp, Artificial Sequence
  Synthetic
tgctccgcggtgacgcgcaggcggagggcgaggcgcggcggaaggcggaaggggcgcgagggggggtgggagggg

SEQ ID NO: 154580 - DNA, 75 bp, Artificial Sequence
  Synthetic
agccactggcgcagcagcagcgaacaagaaggcgggggcccaccggcggggggcggcggcggggcggccgcgggc

SEQ ID NO: 154581 - DNA, 75 bp, Artificial Sequence
  Synthetic
cgccctccgcctgcgcgtcaccgcagagcacctggcgcgcctgcgacgcgcgggcggggagggggcgccggagcc

SEQ ID NO: 154582 - DNA, 75 bp, Artificial Sequence
  Synthetic
ccctctcccccgctctgacggcccatacgggccagagcgcgacggcggacctggcgatccagattccaaagtgcc

SEQ ID NO: 154583 - DNA, 75 bp, Artificial Sequence
  Synthetic
ccccggggggtgtgttttggggggggcccgttttcggggtctggccgctcctccccccgctcctccccccgctcc

SEQ ID NO: 154584 - DNA, 75 bp, Artificial Sequence
  Synthetic
ccgctcctccccccgctcctccccccgctcctccccccgctcctccccccgctcctccccccgctcccgcggccc

SEQ ID NO: 154585 - DNA, 75 bp, Artificial Sequence
  Synthetic
ggcgggcccgccctcggagggcgggactggccaatcggcggccgccagcgcggcggggcccggccaaccagcgtt

SEQ ID NO: 154586 - DNA, 75 bp, Artificial Sequence
  Synthetic
cacgtcacacgtcacgtcatccaccacacctgcccaacaacacaactcacagcgacaactcaccgcgcaacaact

SEQ ID NO: 154587 - DNA, 75 bp, Artificial Sequence
  Synthetic
ccgccttgatgtcccgcaggtgctcgcgcagggtggcgtggcccgcggcgacggtcgcgttgtcgccggcggggc

SEQ ID NO: 154588 - DNA, 75 bp, Artificial Sequence
  Synthetic
gccgcgtcccgcgctccctcgggggggttcgggcatctctacctcagtgccgccaatctcaggtcagagatccaa

SEQ ID NO: 154589 - DNA, 75 bp, Artificial Sequence
  Synthetic
gcgctgattgacgcgggaaatcccccccattcttacccaccccccccttttttcccctcagcccgccccggacgt

SEQ ID NO: 154590 - DNA, 75 bp, Artificial Sequence
  Synthetic
gaccccacagcgcggatggaggccggggtaggtgccgccggaccccctcgcgatgggaatggacgggagcgacgg

SEQ ID NO: 154591 - DNA, 75 bp, Artificial Sequence
  Synthetic
cgccacggggcgcgggcgggcctgcgccgcggcggcccggggcgccgcgggctgggcgggggcgggctcgggccc

SEQ ID NO: 154592 - DNA, 75 bp, Artificial Sequence
  Synthetic
gggaccgggggttttggctctaccggtatttagcccacagcttggggttcgttccgggcaataaaaaacgtttgt

SEQ ID NO: 154593 - DNA, 75 bp, Artificial Sequence
  Synthetic
gtatttagcccacagcttggggttcgttccgggcaataaaaaacgtttgtatcgcatctttcctgtgtgtagttg

SEQ ID NO: 154594 - DNA, 75 bp, Artificial Sequence
  Synthetic
tgggaggggtggcggggcggggcgcccaaaagggggtcggccacaccacagacgtgggtgttggggggtggggcg

SEQ ID NO: 154595 - DNA, 75 bp, Artificial Sequence
  Synthetic
ttgttgaaccacaccggggcgcccttgacgagtgggataacgggggaggaagggagggaggagggtactgggggt

SEQ ID NO: 154596 - DNA, 75 bp, Artificial Sequence
  Synthetic
agggagggaggagggtactgggggtgaagaagggggggggggagaagcgagaacaggaaaggcgacggagcccgg

SEQ ID NO: 154597 - DNA, 75 bp, Artificial Sequence
  Synthetic
ccggtcccgcccgccggacgccgggaccaacgggacggcgggcggcccaagggccgcccgccttgccgccccccc

SEQ ID NO: 154598 - DNA, 75 bp, Artificial Sequence
  Synthetic
gggccgcccgccttgccgcccccccattggccggcgggcgggaccgccccaagggggcggggccgccgggtaaaa

SEQ ID NO: 154599 - DNA, 75 bp, Artificial Sequence
  Synthetic
cgtgaggggacagacgaacgaaacattccggcgacggaacgaaaacaccccagacgggttaaagaaacagaaacc

SEQ ID NO: 154600 - DNA, 75 bp, Artificial Sequence
  Synthetic
cccgattcgggcccggtcgctcgctaccggtgcgccaccaccagaggccatatccgacaccccagccccgacggc

SEQ ID NO: 154601 - DNA, 75 bp, Artificial Sequence
  Synthetic
gggggaagccactgtggtcctccgggacgttttctggatggccgacatttccccaggcgcttttgcgccttgtgt

SEQ ID NO: 154602 - DNA, 75 bp, Artificial Sequence
  Synthetic
cctccctccgtccccccgtcgcgggtgtttgtgtttgtttattccgacatcggtttatttaaataaacacagccg

SEQ ID NO: 154603 - DNA, 75 bp, Artificial Sequence
  Synthetic
tccccgtgacacccgacgctggggggcgtggctgccgggaggggccgcggatgggcgggcctactcggtctcccg

SEQ ID NO: 154604 - DNA, 75 bp, Artificial Sequence
  Synthetic
gcggggtatggaaaaacgaggaggaggaggaggaggaggaggaggggggggggagacggggggaaagcaaggaca

SEQ ID NO: 154605 - DNA, 75 bp, Artificial Sequence
  Synthetic
accaccaccaccaccgacacctcccgcacacccccgcccacactccccccccacccaacccgcaccacgagcacg

SEQ ID NO: 154606 - DNA, 75 bp, Artificial Sequence
  Synthetic
tatataaaccaacgaaaagcgcgggaacggggatacggggcttgtgtggcacgacgtcgtggttgtgttactggg

SEQ ID NO: 154607 - DNA, 75 bp, Artificial Sequence
  Synthetic
ctggacggctgccggaaaatgcgcttctccaccgcctgcccctatccgtgcagcgacacgtttctccggccgtga

SEQ ID NO: 154608 - DNA, 75 bp, Artificial Sequence
  Synthetic
cggcgacggtcaaggggagggttggagaccggggttggggaatgaatccctccccttcaccgacaaccccccggg

SEQ ID NO: 154609 - DNA, 75 bp, Artificial Sequence
  Synthetic
tctccaccgcctgcccctatccgtgcagcgacacgtttctccggccgtgaataacttcgtataatgtatgctata

SEQ ID NO: 154610 - DNA, 75 bp, Artificial Sequence
  Synthetic
tggatctgatatcatcgatgaattcgagctcggtacagcttggctgtggaatgtgtgtcagttagggtgtggaaa

SEQ ID NO: 154611 - DNA, 75 bp, Artificial Sequence
  Synthetic
gagctcggtacagcttggctgtggaatgtgtgtcagttagggtgtggaaagtccccaggctccccagcaggcaga

SEQ ID NO: 154612 - DNA, 75 bp, Artificial Sequence
  Synthetic
agtcagcaaccaggtgtggaaagtccccaggctccccagcaggcagaagtatgcaaagcatgcatctcaattagt

SEQ ID NO: 154613 - DNA, 75 bp, Artificial Sequence
  Synthetic
cccaggctccccagcaggcagaagtatgcaaagcatgcatctcaattagtcagcaaccatagtcccgcccctaac

SEQ ID NO: 154614 - DNA, 75 bp, Artificial Sequence
  Synthetic
cccggattggacacggtcttgtgggataggcacgcccagagggcgtattgggttaacccctttttgtttggggcg

SEQ ID NO: 154615 - DNA, 75 bp, Artificial Sequence
  Synthetic
cccagttccgcccattctccgccccatggctgactaattttttttatttatgcagaggccgaggccgcctcggcc

SEQ ID NO: 154616 - DNA, 75 bp, Artificial Sequence
  Synthetic
atggctgactaattttttttatttatgcagaggccgaggccgcctcggcctctgagctattccagaagtagtgag

SEQ ID NO: 154617 - DNA, 75 bp, Artificial Sequence
  Synthetic
ttgcaaaaagctccggggatcgaaagagcctgctaaagcaaaaaagaagtcaccatgtcgtttactttgaccaac

SEQ ID NO: 154618 - DNA, 75 bp, Artificial Sequence
  Synthetic
gagcctgctaaagcaaaaaagaagtcaccatgtcgtttactttgaccaacaagaacgtgattttcgttgccggtc

SEQ ID NO: 154619 - DNA, 75 bp, Artificial Sequence
  Synthetic
cttgcacatgccggcccgggcgagcctgggggtccggtaattttgccatcccacccaagcggctttttgggtttt

SEQ ID NO: 154620 - DNA, 75 bp, Artificial Sequence
  Synthetic
caaggagctgctcaagcgcgatcccgtcgttttacaacgtcgtgactgggaaaaccctggcgttacccaacttaa

SEQ ID NO: 154621 - DNA, 75 bp, Artificial Sequence
  Synthetic
gtcgttttacaacgtcgtgactgggaaaaccctggcgttacccaacttaatcgccttgcagcacatccccctttc

SEQ ID NO: 154622 - DNA, 75 bp, Artificial Sequence
  Synthetic
cccgcaccgatcgcccttcccaacagttgcgcagcctgaatggcgaatggcgctttgcctggtttccggcaccag

SEQ ID NO: 154623 - DNA, 75 bp, Artificial Sequence
  Synthetic
tgccgcgacggaaacccgtccgggttcggggggcgaaccggccgcctgtcgctcgtcagggccggcgggcgctcc

SEQ ID NO: 154624 - DNA, 75 bp, Artificial Sequence
  Synthetic
gttgcgcagcctgaatggcgaatggcgctttgcctggtttccggcaccagaagcggtgccggaaagctggctgga

SEQ ID NO: 154625 - DNA, 75 bp, Artificial Sequence
  Synthetic
gtcgtcgtcccctcaaactggcagatgcacggttacgatgcgcccatctacaccaacgtgacctatcccattacg

SEQ ID NO: 154626 - DNA, 75 bp, Artificial Sequence
  Synthetic
tgcacggttacgatgcgcccatctacaccaacgtgacctatcccattacggtcaatccgccgtttgttcccacgg

SEQ ID NO: 154627 - DNA, 75 bp, Artificial Sequence
  Synthetic
cacatttaatgttgatgaaagctggctacaggaaggccagacgcgaattatttttgatggcgttaactcggcgtt

SEQ ID NO: 154628 - DNA, 75 bp, Artificial Sequence
  Synthetic
ctacaggaaggccagacgcgaattatttttgatggcgttaactcggcgtttcatctgtggtgcaacgggcgctgg

SEQ ID NO: 154629 - DNA, 75 bp, Artificial Sequence
  Synthetic
tgccgtctgaatttgacctgagcgcatttttacgcgccggagaaaaccgcctcgcggtgatggtgctgcgctgga

SEQ ID NO: 154630 - DNA, 75 bp, Artificial Sequence
  Synthetic
gccatctgccatgggcggggcgcgagggcgggtgggtccgcgccccgccccgcatggcatctcattaccgcccga

SEQ ID NO: 154631 - DNA, 75 bp, Artificial Sequence
  Synthetic
atttttacgcgccggagaaaaccgcctcgcggtgatggtgctgcgctggagtgacggcagttatctggaagatca

SEQ ID NO: 154632 - DNA, 75 bp, Artificial Sequence
  Synthetic
ttccgtgacgtctcgttgctgcataaaccgactacacaaatcagcgatttccatgttgccactcgctttaatgat

SEQ ID NO: 154633 - DNA, 75 bp, Artificial Sequence
  Synthetic
aaccgactacacaaatcagcgatttccatgttgccactcgctttaatgatgatttcagccgcgctgtactggagg

SEQ ID NO: 154634 - DNA, 75 bp, Artificial Sequence
  Synthetic
gcgtgactacctacgggtaacagtttctttatggcagggtgaaacgcaggtcgccagcggcaccgcgcctttcgg

SEQ ID NO: 154635 - DNA, 75 bp, Artificial Sequence
  Synthetic
cccccgcgtggcgcatctccccccggtatacgacgacgcagccgggatgagattggggccacgggatttaccgcg

SEQ ID NO: 154636 - DNA, 75 bp, Artificial Sequence
  Synthetic
tctttatggcagggtgaaacgcaggtcgccagcggcaccgcgcctttcggcggtgaaattatcgatgagcgtggt

SEQ ID NO: 154637 - DNA, 75 bp, Artificial Sequence
  Synthetic
gtctgaacgtcgaaaacccgaaactgtggagcgccgaaatcccgaatctctatcgtgcggtggttgaactgcaca

SEQ ID NO: 154638 - DNA, 75 bp, Artificial Sequence
  Synthetic
cgtcctcaagttttcgcacccgtcgcccctctccaaggttccgttcggaacatgccagcatttcctcgtggcgaa

SEQ ID NO: 154639 - DNA, 75 bp, Artificial Sequence
  Synthetic
gtggagcgccgaaatcccgaatctctatcgtgcggtggttgaactgcacaccgccgacggcacgctgattgaagc

SEQ ID NO: 154640 - DNA, 75 bp, Artificial Sequence
  Synthetic
gaggtgcggattgaaaatggtctgctgctgctgaacggcaagccgttgctgattcgaggcgttaaccgtcacgag

SEQ ID NO: 154641 - DNA, 75 bp, Artificial Sequence
  Synthetic
tgctgctgaacggcaagccgttgctgattcgaggcgttaaccgtcacgagcatcatcctctgcatggtcaggtca

SEQ ID NO: 154642 - DNA, 75 bp, Artificial Sequence
  Synthetic
tatcctgctgatgaagcagaacaactttaacgccgtgcgctgttcgcattatccgaaccatccgctgtggtacac

SEQ ID NO: 154643 - DNA, 75 bp, Artificial Sequence
  Synthetic
tttaacgccgtgcgctgttcgcattatccgaaccatccgctgtggtacacgctgtgcgaccgctacggcctgtat

SEQ ID NO: 154644 - DNA, 75 bp, Artificial Sequence
  Synthetic
ccaaaccacgagtcggggatatcgccagatacgactcccgcagattccattcggggggccgctgtggcctcacct

SEQ ID NO: 154645 - DNA, 75 bp, Artificial Sequence
  Synthetic
cccacggcatggtgccaatgaatcgtctgaccgatgatccgcgctggctaccggcgatgagcgaacgcgtaacgc

SEQ ID NO: 154646 - DNA, 75 bp, Artificial Sequence
  Synthetic
tctgaccgatgatccgcgctggctaccggcgatgagcgaacgcgtaacgcgaatggtgcagcgcgatcgtaatca

SEQ ID NO: 154647 - DNA, 75 bp, Artificial Sequence
  Synthetic
gggaatgaatcaggccacggcgctaatcacgacgcgctgtatcgctggatcaaatctgtcgatccttcccgcccg

SEQ ID NO: 154648 - DNA, 75 bp, Artificial Sequence
  Synthetic
atcacgacgcgctgtatcgctggatcaaatctgtcgatccttcccgcccggtgcagtatgaaggcggcggagccg

SEQ ID NO: 154649 - DNA, 75 bp, Artificial Sequence
  Synthetic
cccgatgtacgcgcgcgtggatgaagaccagcccttcccggctgtgccgaaatggtccatcaaaaaatggctttc

SEQ ID NO: 154650 - DNA, 75 bp, Artificial Sequence
  Synthetic
gaccagcccttcccggctgtgccgaaatggtccatcaaaaaatggctttcgctacctggagagacgcgcccgctg

SEQ ID NO: 154651 - DNA, 75 bp, Artificial Sequence
  Synthetic
tgggtaacagtcttggcggtttcgctaaatactggcaggcgtttcgtcagtatccccgtttacagggcggcttcg

SEQ ID NO: 154652 - DNA, 75 bp, Artificial Sequence
  Synthetic
taaatactggcaggcgtttcgtcagtatccccgtttacagggcggcttcgtctgggactgggtggatcagtcgct

SEQ ID NO: 154653 - DNA, 75 bp, Artificial Sequence
  Synthetic
ccgtggtcggcttacggcggtgattttggcgatacgccgaacgatcgccagttctgtatgaacggtctggtcttt

SEQ ID NO: 154654 - DNA, 75 bp, Artificial Sequence
  Synthetic
ttggcgatacgccgaacgatcgccagttctgtatgaacggtctggtctttgccgaccgcacgccgcatccagcgc

SEQ ID NO: 154655 - DNA, 75 bp, Artificial Sequence
  Synthetic
gtttttccagttccgtttatccgggcaaaccatcgaagtgaccagcgaatacctgttccgtcatagcgataacga

SEQ ID NO: 154656 - DNA, 75 bp, Artificial Sequence
  Synthetic
caaaccatcgaagtgaccagcgaatacctgttccgtcatagcgataacgagctcctgcactggatggtggcgctg

SEQ ID NO: 154657 - DNA, 75 bp, Artificial Sequence
  Synthetic
aagtgcctctggatgtcgctccacaaggtaaacagttgattgaactgcctgaactaccgcagccggagagcgccg

SEQ ID NO: 154658 - DNA, 75 bp, Artificial Sequence
  Synthetic
aggtaaacagttgattgaactgcctgaactaccgcagccggagagcgccgggcaactctggctcacagtacgcgt

SEQ ID NO: 154659 - DNA, 75 bp, Artificial Sequence
  Synthetic
tcagaagccgggcacatcagcgcctggcagcagtggcgtctggcggaaaacctcagtgtgacgctccccgccgcg

SEQ ID NO: 154660 - DNA, 75 bp, Artificial Sequence
  Synthetic
ggcagcagtggcgtctggcggaaaacctcagtgtgacgctccccgccgcgtcccacgccatcccgcatctgacca

SEQ ID NO: 154661 - DNA, 75 bp, Artificial Sequence
  Synthetic
gctgggtaataagcgttggcaatttaaccgccagtcaggctttctttcacagatgtggattggcgataaaaaaca

SEQ ID NO: 154662 - DNA, 75 bp, Artificial Sequence
  Synthetic
aaccgccagtcaggctttctttcacagatgtggattggcgataaaaaacaactgctgacgccgctgcgcgatcag

SEQ ID NO: 154663 - DNA, 75 bp, Artificial Sequence
  Synthetic
acattggcgtaagtgaagcgacccgcattgaccctaacgcctgggtcgaacgctggaaggcggcgggccattacc

SEQ ID NO: 154664 - DNA, 75 bp, Artificial Sequence
  Synthetic
cattgaccctaacgcctgggtcgaacgctggaaggcggcgggccattaccaggccgaagcagcgttgttgcagtg

SEQ ID NO: 154665 - DNA, 75 bp, Artificial Sequence
  Synthetic
gtgctgattacgaccgctcacgcgtggcagcatcaggggaaaaccttatttatcagccggaaaacctaccggatt

SEQ ID NO: 154666 - DNA, 75 bp, Artificial Sequence
  Synthetic
ggcagcatcaggggaaaaccttatttatcagccggaaaacctaccggattgatggtagtggtcaaatggcgatta

SEQ ID NO: 154667 - DNA, 75 bp, Artificial Sequence
  Synthetic
tacaccgcatccggcgcggattggcctgaactgccagctggcgcaggtagcagagcgggtaaactggctcggatt

SEQ ID NO: 154668 - DNA, 75 bp, Artificial Sequence
  Synthetic
ctgaactgccagctggcgcaggtagcagagcgggtaaactggctcggattagggccgcaagaaaactatcccgac

SEQ ID NO: 154669 - DNA, 75 bp, Artificial Sequence
  Synthetic
agcccgggccccccgcgggcggggcggcgcgcaaaaaaggcgggcggcggtccgggcggcgtgcgcgcgcgcggc

SEQ ID NO: 154670 - DNA, 75 bp, Artificial Sequence
  Synthetic
gctgggatctgccattgtcagacatgtataccccgtacgtcttcccgagcgaaaacggtctgcgctgcgggacgc

SEQ ID NO: 154671 - DNA, 75 bp, Artificial Sequence
  Synthetic
gtataccccgtacgtcttcccgagcgaaaacggtctgcgctgcgggacgcgcgaattgaattatggcccacacca

SEQ ID NO: 154672 - DNA, 75 bp, Artificial Sequence
  Synthetic
ggggggaggagcggggggaggagcggggggaggagcggggggaggagcggggggaggagcggggggaggagcggg

SEQ ID NO: 154673 - DNA, 75 bp, Artificial Sequence
  Synthetic
atcagccgctacagtcaacagcaactgatggaaaccagccatcgccatctgctgcacgcggaagaaggcacatgg

SEQ ID NO: 154674 - DNA, 75 bp, Artificial Sequence
  Synthetic
tgatggaaaccagccatcgccatctgctgcacgcggaagaaggcacatggctgaatatcgacggtttccatatgg

SEQ ID NO: 154675 - DNA, 75 bp, Artificial Sequence
  Synthetic
cccgtcagtatcggcggaattacagctgagcgccggtcgctaccattaccagttggtctggtgtcaaaaataata

SEQ ID NO: 154676 - DNA, 75 bp, Artificial Sequence
  Synthetic
ctgagcgccggtcgctaccattaccagttggtctggtgtcaaaaataataataaccgggcaggccatgtctgccc

SEQ ID NO: 154677 - DNA, 75 bp, Artificial Sequence
  Synthetic
tgtactatttaaaaaacacaaacttttggatgttcggtttattctttttcttttacttttttatcatgggagcct

SEQ ID NO: 154678 - DNA, 75 bp, Artificial Sequence
  Synthetic
ttggatgttcggtttattctttttcttttacttttttatcatgggagcctacttcccgtttttcccgatttggct

SEQ ID NO: 154679 - DNA, 75 bp, Artificial Sequence
  Synthetic
agtgatacgggtattatttttgccgctatttctctgttctcgctattattccaaccgctgtttggtctgctttct

SEQ ID NO: 154680 - DNA, 75 bp, Artificial Sequence
  Synthetic
ctatttctctgttctcgctattattccaaccgctgtttggtctgctttctgacaaactcggcctcgactctaggc

SEQ ID NO: 154681 - DNA, 75 bp, Artificial Sequence
  Synthetic
cccgccttcttgttcgctgctgctgcgccagtggctccacgttcccgagtccgcgtccgacgacgacgatgacga

SEQ ID NO: 154682 - DNA, 75 bp, Artificial Sequence
  Synthetic
gatacattgatgagtttggacaaaccacaactagaatgcagtgaaaaaaatgctttatttgtgaaatttgtgatg

SEQ ID NO: 154683 - DNA, 75 bp, Artificial Sequence
  Synthetic
cacaactagaatgcagtgaaaaaaatgctttatttgtgaaatttgtgatgctattgctttatttgtaaccattat

SEQ ID NO: 154684 - DNA, 75 bp, Artificial Sequence
  Synthetic
aacaattgcattcattttatgtttcaggttcagggggaggtgtgggaggttttttcggatcctctagagtcgacc

SEQ ID NO: 154685 - DNA, 75 bp, Artificial Sequence
  Synthetic
aggttcagggggaggtgtgggaggttttttcggatcctctagagtcgaccggccagcctcgcagagcaggattcc

SEQ ID NO: 154686 - DNA, 75 bp, Artificial Sequence
  Synthetic
gcctgcgacgcgcgggcggggagggggcgccggagccccccgcgacccccgcgacccccgcgacccccgcgaccc

SEQ ID NO: 154687 - DNA, 75 bp, Artificial Sequence
  Synthetic
agggacagtgaagaaggaacacccgctcgcgggtgggcctacttcacctatcctgcccggaattcttaattaata

SEQ ID NO: 154688 - DNA, 75 bp, Artificial Sequence
  Synthetic
ctcgcgggtgggcctacttcacctatcctgcccggaattcttaattaatacgactcactatagggcgaattggag

SEQ ID NO: 154689 - DNA, 75 bp, Artificial Sequence
  Synthetic
gaaagtgatggtggtgggggaaggattcgaaccttcgaagtcgatgacggcagatttagagtctgctccctgctt

SEQ ID NO: 154690 - DNA, 75 bp, Artificial Sequence
  Synthetic
ttcgaaccttcgaagtcgatgacggcagatttagagtctgctccctgcttgtgtgttggaggtcgctgagtagtg

SEQ ID NO: 154691 - DNA, 75 bp, Artificial Sequence
  Synthetic
aggcaaggcttgaccgacaattgcatgaagaatctgcttagggttaggcgttttgcgctgcttcgcgatgtacgg

SEQ ID NO: 154692 - DNA, 75 bp, Artificial Sequence
  Synthetic
tgaagaatctgcttagggttaggcgttttgcgctgcttcgcgatgtacgggccagatatacgcgttgacattgat

SEQ ID NO: 154693 - DNA, 75 bp, Artificial Sequence
  Synthetic
aattacggggtcattagttcatagcccatatatggagttccgcgttacataacttacggtaaatggcccgcctgg

SEQ ID NO: 154694 - DNA, 75 bp, Artificial Sequence
  Synthetic
ccatatatggagttccgcgttacataacttacggtaaatggcccgcctggctgaccgcccaacgacccccgccca

SEQ ID NO: 154695 - DNA, 75 bp, Artificial Sequence
  Synthetic
gcgggactggccaatcggcggccgccagcgcggcggggcccggccaaccagcgtccgccgagtcttcggggcccg

SEQ ID NO: 154696 - DNA, 75 bp, Artificial Sequence
  Synthetic
ccatagtaacgccaatagggactttccattgacgtcaatgggtggagtatttacggtaaactgcccacttggcag

SEQ ID NO: 154697 - DNA, 75 bp, Artificial Sequence
  Synthetic
ccattgacgtcaatgggtggagtatttacggtaaactgcccacttggcagtacatcaagtgtatcatatgccaag

SEQ ID NO: 154698 - DNA, 75 bp, Artificial Sequence
  Synthetic
ggtaaatggcccgcctggcattatgcccagtacatgaccttatgggactttcctacttggcagtacatctacgta

SEQ ID NO: 154699 - DNA, 75 bp, Artificial Sequence
  Synthetic
cccagtacatgaccttatgggactttcctacttggcagtacatctacgtattagtcatcgctattaccatggtga

SEQ ID NO: 154700 - DNA, 75 bp, Artificial Sequence
  Synthetic
gcgtggatagcggtttgactcacggggatttccaagtctccaccccattgacgtcaatgggagtttgttttggca

SEQ ID NO: 154701 - DNA, 75 bp, Artificial Sequence
  Synthetic
ggatttccaagtctccaccccattgacgtcaatgggagtttgttttggcaccaaaatcaacgggactttccaaaa

SEQ ID NO: 154702 - DNA, 75 bp, Artificial Sequence
  Synthetic
cgcaaatgggcggtaggcgtgtacggtgggaggtctatataagcagagctctctggctaactagagaacccactg

SEQ ID NO: 154703 - DNA, 75 bp, Artificial Sequence
  Synthetic
gtgggaggtctatataagcagagctctctggctaactagagaacccactgcttactggcttatcgaaattaatac

SEQ ID NO: 154704 - DNA, 75 bp, Artificial Sequence
  Synthetic
tctaggaagatcggggccatgcccaagaagaagaggaaggtgtccaatttactgaccgtacaccaaaatttgcct

SEQ ID NO: 154705 - DNA, 75 bp, Artificial Sequence
  Synthetic
agaagaagaggaaggtgtccaatttactgaccgtacaccaaaatttgcctgcattaccggtcgatgcaacgagtg

SEQ ID NO: 154706 - DNA, 75 bp, Artificial Sequence
  Synthetic
catgttcagggatcgccaggcgttttctgagcatacctggaaaatgcttctgtccgtttgccggtcgtgggcggc

SEQ ID NO: 154707 - DNA, 75 bp, Artificial Sequence
  Synthetic
tctgagcatacctggaaaatgcttctgtccgtttgccggtcgtgggcggcatggtgcaagttgaataaccggaaa

SEQ ID NO: 154708 - DNA, 75 bp, Artificial Sequence
  Synthetic
ttcgcgattatcttctttatcttcaggcgcgcggtctggcagtaaaagctatccagcaacatttgggccagctaa

SEQ ID NO: 154709 - DNA, 75 bp, Artificial Sequence
  Synthetic
ggcgcgcggtctggcagtaaaagctatccagcaacatttgggccagctaaacatgcttcatcgtcggtccgggct

SEQ ID NO: 154710 - DNA, 75 bp, Artificial Sequence
  Synthetic
gtttcactggttatgcggcggatccgaaaagaaaacgttgatgccggtgaacgtgcaaaacaggctctagcgttc

SEQ ID NO: 154711 - DNA, 75 bp, Artificial Sequence
  Synthetic
gaaaagaaaacgttgatgccggtgaacgtgcaaaacaggctctagcgttcgaacgcactgatttcgaccaggttc

SEQ ID NO: 154712 - DNA, 75 bp, Artificial Sequence
  Synthetic
ctgccaggatatacgtaatctggcatttctggggattgcttataacaccctgttacgtatagccgaaattgccag

SEQ ID NO: 154713 - DNA, 75 bp, Artificial Sequence
  Synthetic
tttctggggattgcttataacaccctgttacgtatagccgaaattgccaggatcagggttaaagatgtaagtatc

SEQ ID NO: 154714 - DNA, 75 bp, Artificial Sequence
  Synthetic
ggtcgccatgtgaccccctgactttatatatacagaccccccaacacatacacatggcccctttgactcagacgc

SEQ ID NO: 154715 - DNA, 75 bp, Artificial Sequence
  Synthetic
accaatagaaactgggcttgtcgagacagagaagactcttgcgtttctgataggcacctattggtcttactgaca

SEQ ID NO: 154716 - DNA, 75 bp, Artificial Sequence
  Synthetic
acagagaagactcttgcgtttctgataggcacctattggtcttactgacatccactttgcctttctctccacaga

SEQ ID NO: 154717 - DNA, 75 bp, Artificial Sequence
  Synthetic
cctgactcatacacagagacacgcccccacaacaaacacacagggaccggggtcgccgtgttagggggcgtggtc

SEQ ID NO: 154718 - DNA, 75 bp, Artificial Sequence
  Synthetic
gttaatccatattggcagaacgaaaacgctggttagcaccgcaggtgtagagaaggcacttagcctgggggtaac

SEQ ID NO: 154719 - DNA, 75 bp, Artificial Sequence
  Synthetic
acgctggttagcaccgcaggtgtagagaaggcacttagcctgggggtaactaaactggtcgagcgatggatttcc

SEQ ID NO: 154720 - DNA, 75 bp, Artificial Sequence
  Synthetic
ataactacctgttttgccgggtcagaaaaaatggtgttgccgcgccatctgccaccagccagctatcaactcgcg

SEQ ID NO: 154721 - DNA, 75 bp, Artificial Sequence
  Synthetic
aaaaaatggtgttgccgcgccatctgccaccagccagctatcaactcgcgccctggaagggatttttgaagcaac

SEQ ID NO: 154722 - DNA, 75 bp, Artificial Sequence
  Synthetic
gatgactctggtcagagatacctggcctggtctggacacagtgcccgtgtcggagccgcgcgagatatggcccgc

SEQ ID NO: 154723 - DNA, 75 bp, Artificial Sequence
  Synthetic
tttgtgaggcggggggggggagagggggaactcgtgggcgctgattgacgcgggaaatccccccattcttacccg

SEQ ID NO: 154724 - DNA, 75 bp, Artificial Sequence
  Synthetic
cctggtctggacacagtgcccgtgtcggagccgcgcgagatatggcccgcgctggagtttcaataccggagatca

SEQ ID NO: 154725 - DNA, 75 bp, Artificial Sequence
  Synthetic
aaatattgtcatgaactatatccgtaacctggatagtgaaacaggggcaatggtgcgcctgctggaagatggcga

SEQ ID NO: 154726 - DNA, 75 bp, Artificial Sequence
  Synthetic
aacctggatagtgaaacaggggcaatggtgcgcctgctggaagatggcgattagccattaacgcgtaaatgattg

SEQ ID NO: 154727 - DNA, 75 bp, Artificial Sequence
  Synthetic
acatatgagaaaggatttcaacatcgacggaaaatatgtagtgctgtctgtaagcactaatattcagtcgccagc

SEQ ID NO: 154728 - DNA, 75 bp, Artificial Sequence
  Synthetic
gacggaaaatatgtagtgctgtctgtaagcactaatattcagtcgccagccgtcattgtcactgtaaagctgagc

SEQ ID NO: 154729 - DNA, 75 bp, Artificial Sequence
  Synthetic
tatccgttgcgtttcctgtcaaaagtatgcgtagtgctgaacatttcgtgatgaatgccaccgaggaagaagcac

SEQ ID NO: 154730 - DNA, 75 bp, Artificial Sequence
  Synthetic
tatgcgtagtgctgaacatttcgtgatgaatgccaccgaggaagaagcacggcgcggttttgctaaagtgatgtc

SEQ ID NO: 154731 - DNA, 75 bp, Artificial Sequence
  Synthetic
tgacggtcaaatgcccccgggggcgcgcagatgtggcggtagtggccaccggctgccgtgtagtggggcggcggg

SEQ ID NO: 154732 - DNA, 75 bp, Artificial Sequence
  Synthetic
gttggaattgtcgaggctgggtgtggcggaccgctatcaggacatagcgttggctacccgtgatattgctgaaga

SEQ ID NO: 154733 - DNA, 75 bp, Artificial Sequence
  Synthetic
gcggaccgctatcaggacatagcgttggctacccgtgatattgctgaagagcttggcggcgaatgggctgaccgc

SEQ ID NO: 154734 - DNA, 75 bp, Artificial Sequence
  Synthetic
ctcccgattcgcagcgcatcgccttctatcgccttcttgacgagttcttctgaggggatcggcaataaaaagaca

SEQ ID NO: 154735 - DNA, 75 bp, Artificial Sequence
  Synthetic
ctatcgccttcttgacgagttcttctgaggggatcggcaataaaaagacagaataaaacgcacgggtgttgggtc

SEQ ID NO: 154736 - DNA, 75 bp, Artificial Sequence
  Synthetic
gggccctgtcgcccacccaccctgagcccaccacggacgaggatgacgacgacctggacgacggtgaggcggggg

SEQ ID NO: 154737 - DNA, 75 bp, Artificial Sequence
  Synthetic
tcgagggggggcccggtacccagcttttgttccctttagtgagggttaattaagaattcgtcgacagcgacacac

SEQ ID NO: 154738 - DNA, 75 bp, Artificial Sequence
  Synthetic
ggcggcgaggaccctgggggaggaggaggaggaggggggagggaggaataggcgggcgggggggcgaggaaaggg

SEQ ID NO: 154739 - DNA, 75 bp, Artificial Sequence
  Synthetic
tttgttccctttagtgagggttaattaagaattcgtcgacagcgacacacttgcatcggatgcagcccggttaac

SEQ ID NO: 154740 - DNA, 75 bp, Artificial Sequence
  Synthetic
gggcaaaaccgtgccggttgcgaccgggggcggaacgggatcgatagggagagcgggagaagcctggccggcgga

SEQ ID NO: 154741 - DNA, 75 bp, Artificial Sequence
  Synthetic
gtattttgtccacataaccgtgcgcaaaatgttgtggataagcaggacacagcagcaatccacagcaggcataca

SEQ ID NO: 154742 - DNA, 75 bp, Artificial Sequence
  Synthetic
aaaatgttgtggataagcaggacacagcagcaatccacagcaggcatacaaccgcacaccgaggttactccgttc

SEQ ID NO: 154743 - DNA, 75 bp, Artificial Sequence
  Synthetic
cttgcccttgacaggcattgatggaatcgtagtctcacgctgatagtctgatcgacaatacaagtgggaccgtgg

SEQ ID NO: 154744 - DNA, 75 bp, Artificial Sequence
  Synthetic
cgcggctcggacagcgcccccctcggcgcccatcgggccacacggcagcagtaacaccaacaccaccaccaacag

SEQ ID NO: 154745 - DNA, 75 bp, Artificial Sequence
  Synthetic
atcgtagtctcacgctgatagtctgatcgacaatacaagtgggaccgtggtcccagaccgataatcagaccgaca

SEQ ID NO: 154746 - DNA, 75 bp, Artificial Sequence
  Synthetic
tggggttggggttggggttgttgaagcggaggcggggcggccgaggggccggacgggcccccttgtcaacagacc

SEQ ID NO: 154747 - DNA, 75 bp, Artificial Sequence
  Synthetic
ccgcgtcgggacccgcgcgcccccgcgcggccgtggccccgtgcgtgcgagcgccgcctccggggcccggccccc

SEQ ID NO: 154748 - DNA, 75 bp, Artificial Sequence
  Synthetic
gaccgacgatacgagtgggaccgtggtcccagactaataatcagaccgacgatacgagtgggaccgtggtcccag

SEQ ID NO: 154749 - DNA, 75 bp, Artificial Sequence
  Synthetic
actaataatcagaccgacgatacgagtgggaccgtggtcccagtctgattatcagaccgacgatacaagtggaac

SEQ ID NO: 154750 - DNA, 75 bp, Artificial Sequence
  Synthetic
ccagttatgctttctggcctgtaacaaaggacattaagtaaagacagataaacgtagactaaaacgtggtcgcat

SEQ ID NO: 154751 - DNA, 75 bp, Artificial Sequence
  Synthetic
aaaggacattaagtaaagacagataaacgtagactaaaacgtggtcgcatcagggtgctggcttttcaagttcct

SEQ ID NO: 154752 - DNA, 75 bp, Artificial Sequence
  Synthetic
acactcagttggaacacgagacctgtccaggttaagcaccattttatcgcccttatacaatactgtcgctccagg

SEQ ID NO: 154753 - DNA, 75 bp, Artificial Sequence
  Synthetic
tccaggttaagcaccattttatcgcccttatacaatactgtcgctccaggagcaaactgatgtcgtgagcttaaa

SEQ ID NO: 154754 - DNA, 75 bp, Artificial Sequence
  Synthetic
tgacgtcctcggcggcctccgcctcttcctcctctgcctcttcctcctcggccccgactcccgcgggggccgcct

SEQ ID NO: 154755 - DNA, 75 bp, Artificial Sequence
  Synthetic
taagcacagaagttaaaagagtgataacttcttcagcttcaaatatcaccccagcttttttctgctcatgaaggt

SEQ ID NO: 154756 - DNA, 75 bp, Artificial Sequence
  Synthetic
aacttcttcagcttcaaatatcaccccagcttttttctgctcatgaaggttagatgcctgctgcttaagtaattc

SEQ ID NO: 154757 - DNA, 75 bp, Artificial Sequence
  Synthetic
agtgcatcacctgaccgggcagatagttcaccggggtgagaaaaaagagcaacaactgatttaggcaatttggcg

SEQ ID NO: 154758 - DNA, 75 bp, Artificial Sequence
  Synthetic
gttcaccggggtgagaaaaaagagcaacaactgatttaggcaatttggcggtgttgatacagcgggtaataatct

SEQ ID NO: 154759 - DNA, 75 bp, Artificial Sequence
  Synthetic
cagcgcagaaatatttccagcaaattcattctgcaatcggcttgcataacgctgaccacgttcataagcacttgt

SEQ ID NO: 154760 - DNA, 75 bp, Artificial Sequence
  Synthetic
tcattctgcaatcggcttgcataacgctgaccacgttcataagcacttgttgggcgataatcgttacccaatctg

SEQ ID NO: 154761 - DNA, 75 bp, Artificial Sequence
  Synthetic
ccagctcgccaaccagaacacgataatcactttcggtaagtgcagcagctttacgacggcgactcccatcggcaa

SEQ ID NO: 154762 - DNA, 75 bp, Artificial Sequence
  Synthetic
atcactttcggtaagtgcagcagctttacgacggcgactcccatcggcaatttctatgacaccagatactcttcg

SEQ ID NO: 154763 - DNA, 75 bp, Artificial Sequence
  Synthetic
gtcagtagaaaagaagggatgagatcatccagtgcgtcctcagtaagcagctcctggtcacgttcattacctgac

SEQ ID NO: 154764 - DNA, 75 bp, Artificial Sequence
  Synthetic
catccagtgcgtcctcagtaagcagctcctggtcacgttcattacctgaccatacccgagaggtcttctcaacac

SEQ ID NO: 154765 - DNA, 75 bp, Artificial Sequence
  Synthetic
aaacttcacatcccgaccacatacaggcaaagtaatggcattaccgcgagccattactcctacgcgcgcaattaa

SEQ ID NO: 154766 - DNA, 75 bp, Artificial Sequence
  Synthetic
ggcaaagtaatggcattaccgcgagccattactcctacgcgcgcaattaacgaatccaccatcggggcagctggt

SEQ ID NO: 154767 - DNA, 75 bp, Artificial Sequence
  Synthetic
gttgagtattgagcgtatgttttggaataacaggcgcacgcttcattatctaatctcccagcgtggtttaatcag

SEQ ID NO: 154768 - DNA, 75 bp, Artificial Sequence
  Synthetic
aaaactcaggggatttttgctgtctattgggaaataaaggtttacttttgtatcttttccctgtctgtgttggat

SEQ ID NO: 154769 - DNA, 75 bp, Artificial Sequence
  Synthetic
gacggatgcgcgtgtccttactccgttttggtgggtgggtggctgtgtatggcgtcccatctgtgcggggagggg

SEQ ID NO: 154770 - DNA, 75 bp, Artificial Sequence
  Synthetic
aataacaggcgcacgcttcattatctaatctcccagcgtggtttaatcagacgatcgaaaatttcattgcagaca

SEQ ID NO: 154771 - DNA, 75 bp, Artificial Sequence
  Synthetic
gggtgcgtgggagtgggggtgcgtgggagtgggggtgcgtgggagtgggggtgcgtgggagtgggggtgcgtggg

SEQ ID NO: 154772 - DNA, 75 bp, Artificial Sequence
  Synthetic
tccaggcaccagttgaagagcgttgatcaatggcctgttcaaaaacagttctcatccggatctgacctttaccaa

SEQ ID NO: 154773 - DNA, 75 bp, Artificial Sequence
  Synthetic
atcaatggcctgttcaaaaacagttctcatccggatctgacctttaccaacttcatccgtttcacgtacaacatt

SEQ ID NO: 154774 - DNA, 75 bp, Artificial Sequence
  Synthetic
tcccgaatttgctcctccatccacggggactgagagccattactattgctgtatttggtaagcaaaatacgtaca

SEQ ID NO: 154775 - DNA, 75 bp, Artificial Sequence
  Synthetic
gggactgagagccattactattgctgtatttggtaagcaaaatacgtacatcaggctcgaaccctttaagatcaa

SEQ ID NO: 154776 - DNA, 75 bp, Artificial Sequence
  Synthetic
atcgaaaaactgcagtgcggaggtgtagtcaaacaactcagcaggcgtgggaacaatcagcacatcagcagcaca

SEQ ID NO: 154777 - DNA, 75 bp, Artificial Sequence
  Synthetic
tagtcaaacaactcagcaggcgtgggaacaatcagcacatcagcagcacatacgacattaatcgtgccgataccc

SEQ ID NO: 154778 - DNA, 75 bp, Artificial Sequence
  Synthetic
tgacatcatagtcatgagcaacagtttcaatggccagtcggagcatcaggtgtggatcggtgggcagtttacctt

SEQ ID NO: 154779 - DNA, 75 bp, Artificial Sequence
  Synthetic
ttcaatggccagtcggagcatcaggtgtggatcggtgggcagtttaccttcatcaaatttgcccattaactcagt

SEQ ID NO: 154780 - DNA, 75 bp, Artificial Sequence
  Synthetic
gaaggaataatgtcaagccccggccagcaagtgggctttattgcataagtgacatcgtccttttccccaagatag

SEQ ID NO: 154781 - DNA, 75 bp, Artificial Sequence
  Synthetic
agcaagtgggctttattgcataagtgacatcgtccttttccccaagatagaaaggcaggagagtgtcttctgcat

SEQ ID NO: 154782 - DNA, 75 bp, Artificial Sequence
  Synthetic
gtgatacattgaggctgttccctgggggtcgttaccttccacgagcaaaacacgtagccccttcagagccagatc

SEQ ID NO: 154783 - DNA, 75 bp, Artificial Sequence
  Synthetic
gggtcgttaccttccacgagcaaaacacgtagccccttcagagccagatcctgagcaagatgaacagaaactgag

SEQ ID NO: 154784 - DNA, 75 bp, Artificial Sequence
  Synthetic
ccactcctccatatcctcgctttaggaacaactttagggggggtacacacgcgccgtgcatttccttccacaccc

SEQ ID NO: 154785 - DNA, 75 bp, Artificial Sequence
  Synthetic
cagcaaccccgatcaccggtggaaatacgtcttcagcacgtcgcaatcgcgtaccaaacacatcacgcatatgat

SEQ ID NO: 154786 - DNA, 75 bp, Artificial Sequence
  Synthetic
tacgtcttcagcacgtcgcaatcgcgtaccaaacacatcacgcatatgattaatttgttcaattgtataaccaac

SEQ ID NO: 154787 - DNA, 75 bp, Artificial Sequence
  Synthetic
tccatatccgggtgcggtagtcgccctgctttctcggcatctctgatagcctgagaagaaaccccaactaaatcc

SEQ ID NO: 154788 - DNA, 75 bp, Artificial Sequence
  Synthetic
ctgctttctcggcatctctgatagcctgagaagaaaccccaactaaatccgctgcttcacctattctccagcgcc

SEQ ID NO: 154789 - DNA, 75 bp, Artificial Sequence
  Synthetic
gtcatcattaaactgtgcaatggcgatagccttcgtcatttcatgaccagcgtttatgcactggttaagtgtttc

SEQ ID NO: 154790 - DNA, 75 bp, Artificial Sequence
  Synthetic
atagccttcgtcatttcatgaccagcgtttatgcactggttaagtgtttccatgagtttcattctgaacatcctt

SEQ ID NO: 154791 - DNA, 75 bp, Artificial Sequence
  Synthetic
aggaagggagggaggagggtactgggggtgaagaaggggggggggggagaagcgagaacaggaaaggcgacggag

SEQ ID NO: 154792 - DNA, 75 bp, Artificial Sequence
  Synthetic
taaatcttgcaatttactgcaaagcaacaacaaaatcgcaaagtcatcaaaaaaccgcaaagttgtttaaaataa

SEQ ID NO: 154793 - DNA, 75 bp, Artificial Sequence
  Synthetic
aacaacaaaatcgcaaagtcatcaaaaaaccgcaaagttgtttaaaataagagcaacactacaaaaggagataag

SEQ ID NO: 154794 - DNA, 75 bp, Artificial Sequence
  Synthetic
tatcactagcgctcgccgcagccgtgtaaccgagcatagcgagcgaactggcgaggaagcaaagaagaactgttc

SEQ ID NO: 154795 - DNA, 75 bp, Artificial Sequence
  Synthetic
gtaaccgagcatagcgagcgaactggcgaggaagcaaagaagaactgttctgtcagatagctcttacgctcagcg

SEQ ID NO: 154796 - DNA, 75 bp, Artificial Sequence
  Synthetic
aaactccaggtagaggtacacacgcggatagccaattcagagtaataaactgtgataatcaaccctcatcaatga

SEQ ID NO: 154797 - DNA, 75 bp, Artificial Sequence
  Synthetic
cctcgtcccgggccgtacgcggccttcgccccgtgaggggacagacgaacgaaacattccggcgacggaacgaaa

SEQ ID NO: 154798 - DNA, 75 bp, Artificial Sequence
  Synthetic
ggatagccaattcagagtaataaactgtgataatcaaccctcatcaatgatgacgaactaacccccgatatcagg

SEQ ID NO: 154799 - DNA, 75 bp, Artificial Sequence
  Synthetic
aaatcaactgtgacaaactgccctcaaatttggcttccttaaaaattacagttcaaaaagtatgagaaaatccat

SEQ ID NO: 154800 - DNA, 75 bp, Artificial Sequence
  Synthetic
aaatttggcttccttaaaaattacagttcaaaaagtatgagaaaatccatgcaggctgaaggaaacagcaaaact

SEQ ID NO: 154801 - DNA, 75 bp, Artificial Sequence
  Synthetic
gaacaaatgtgacgaaccaccctcaaatctgtgacagataaccctcagactatcctgtcgtcatggaagtgatat

SEQ ID NO: 154802 - DNA, 75 bp, Artificial Sequence
  Synthetic
aatctgtgacagataaccctcagactatcctgtcgtcatggaagtgatatcgcggaaggaaaatacgatatgagt

SEQ ID NO: 154803 - DNA, 75 bp, Artificial Sequence
  Synthetic
atgtatgagaggcgcattggagttctgctgttgatctcattaacacagacctgcaggaagcggcggcggaagtca

SEQ ID NO: 154804 - DNA, 75 bp, Artificial Sequence
  Synthetic
tgctgttgatctcattaacacagacctgcaggaagcggcggcggaagtcaggcatacgctggtaactttgaggca

SEQ ID NO: 154805 - DNA, 75 bp, Artificial Sequence
  Synthetic
gattttcagagagacgatgcctgagccatccggcttacgatactgacacagggattcgtataaacgcatggcata

SEQ ID NO: 154806 - DNA, 75 bp, Artificial Sequence
  Synthetic
ccatccggcttacgatactgacacagggattcgtataaacgcatggcatacggattggtgatttcttttgtttca

SEQ ID NO: 154807 - DNA, 75 bp, Artificial Sequence
  Synthetic
gctggcccgcggccacataaacaatgactctgggcctttctgcctctgccgcttgtgtgtgcgcgcgccggctct

SEQ ID NO: 154808 - DNA, 75 bp, Artificial Sequence
  Synthetic
gactctgggcctttctgcctctgccgcttgtgtgtgcgcgcgccggctctgcggtgtcggcggcggctgcggcgg

SEQ ID NO: 154809 - DNA, 75 bp, Artificial Sequence
  Synthetic
tctgtaacccgataaagaagggaatgagatatgggttgatatgtacactgtaaagccctctggatggactgtgcg

SEQ ID NO: 154810 - DNA, 75 bp, Artificial Sequence
  Synthetic
gagatatgggttgatatgtacactgtaaagccctctggatggactgtgcgcacgtttgataaaccaaggaaaaga

SEQ ID NO: 154811 - DNA, 75 bp, Artificial Sequence
  Synthetic
tcctcttcagggcgataaaaaaccacttccttccccgcgaaactcttcaatgcctgccgtatatccttactggct

SEQ ID NO: 154812 - DNA, 75 bp, Artificial Sequence
  Synthetic
cttccttccccgcgaaactcttcaatgcctgccgtatatccttactggcttccgcagaggtcaatccgaatattt

SEQ ID NO: 154813 - DNA, 75 bp, Artificial Sequence
  Synthetic
gcagataccgtcatgttcctgtagggtgccatcagattttctgatctggtcaacgaacagatacagcatacgttt

SEQ ID NO: 154814 - DNA, 75 bp, Artificial Sequence
  Synthetic
gtgccatcagattttctgatctggtcaacgaacagatacagcatacgtttttgatcccgggagagactatatgcc

SEQ ID NO: 154815 - DNA, 75 bp, Artificial Sequence
  Synthetic
ggggtgggggggaaaaggcgaagagactgggggtgggggggggtgtcgggggtggctgtttttttttgtgggtgt

SEQ ID NO: 154816 - DNA, 75 bp, Artificial Sequence
  Synthetic
cgattcgcgggctatttttacgtttcttgtgattgataaccgctgtttccgccatgacagatccatgtgaagtgt

SEQ ID NO: 154817 - DNA, 75 bp, Artificial Sequence
  Synthetic
cttgtgattgataaccgctgtttccgccatgacagatccatgtgaagtgtgacaagtttttagattgtcacacta

SEQ ID NO: 154818 - DNA, 75 bp, Artificial Sequence
  Synthetic
ataactttgtgaaaaaacagcttcttctgagggcaatttgtcacagggttaagggcaatttgtcacagacaggac

SEQ ID NO: 154819 - DNA, 75 bp, Artificial Sequence
  Synthetic
tctgagggcaatttgtcacagggttaagggcaatttgtcacagacaggactgtcatttgagggtgatttgtcaca

SEQ ID NO: 154820 - DNA, 75 bp, Artificial Sequence
  Synthetic
ggggcgctggagataacggcccccggggaacgggggaccggggctgggtctcccgaggtgggtgggtgggcggcg

SEQ ID NO: 154821 - DNA, 75 bp, Artificial Sequence
  Synthetic
cttctctagaaccagcatggataaaggcctacaaggcgctctaaaaaagaagatctaaaaactataaaaaaaata

SEQ ID NO: 154822 - DNA, 75 bp, Artificial Sequence
  Synthetic
tcccgaggtgggtgggtgggcggcggtggccgggccgggccgggccgggtgggcggggtttggaaaaacgaggag

SEQ ID NO: 154823 - DNA, 75 bp, Artificial Sequence
  Synthetic
ggcctacaaggcgctctaaaaaagaagatctaaaaactataaaaaaaataattataaaaatatccccgtggataa

SEQ ID NO: 154824 - DNA, 75 bp, Artificial Sequence
  Synthetic
tcaggcatcgtgtgtaagcagaatatataagtgctgttccctggtgcttcctcgctcactcgagggcttcgccct

SEQ ID NO: 154825 - DNA, 75 bp, Artificial Sequence
  Synthetic
tataagtgctgttccctggtgcttcctcgctcactcgagggcttcgccctgtcgctcgactgcggcgagcactac

SEQ ID NO: 154826 - DNA, 75 bp, Artificial Sequence
  Synthetic
gccgccggggagcgttgtcgccgtcggtctgccggcccccgtccctcccttttttgaccaaccagcgcccccccc

SEQ ID NO: 154827 - DNA, 75 bp, Artificial Sequence
  Synthetic
ggtctgccggcccccgtccctcccttttttgaccaaccagcgcccccccccctcaccaccattcctaccaccacc

SEQ ID NO: 154828 - DNA, 75 bp, Artificial Sequence
  Synthetic
atggttctgtgttcattaggttgttctgtccattgctgacataatccgctccacttcaacgtaacaccgcacgaa

SEQ ID NO: 154829 - DNA, 75 bp, Artificial Sequence
  Synthetic
ctgtccattgctgacataatccgctccacttcaacgtaacaccgcacgaagatttctattgttcctgaaggcata

SEQ ID NO: 154830 - DNA, 75 bp, Artificial Sequence
  Synthetic
ccaacccgcaccacgagcacgggttgggggtagcaggggatcaaaggggggcaaggccggcggggcggttcgggg

SEQ ID NO: 154831 - DNA, 75 bp, Artificial Sequence
  Synthetic
caggcatcatgacagaacactacttcctataaacgctacacaggctcctgagattaataatgcggatctctacga

SEQ ID NO: 154832 - DNA, 75 bp, Artificial Sequence
  Synthetic
gcgggggcgggagaccgagtaggccccgcccatccgcggcccctcccggcagccacgccccccagcgtcgggtgt

SEQ ID NO: 154833 - DNA, 75 bp, Artificial Sequence
  Synthetic
cctataaacgctacacaggctcctgagattaataatgcggatctctacgataatgggagattttcccgactgttt

SEQ ID NO: 154834 - DNA, 75 bp, Artificial Sequence
  Synthetic
cagcttctctgtttaacagacaaaaacagcatatccactcagttccacatttccatataaaggccaaggcattta

SEQ ID NO: 154835 - DNA, 75 bp, Artificial Sequence
  Synthetic
ggggagaggggagagggggggagaggggagagggggggagaggggagagggggggagaggggagagggggggaga

SEQ ID NO: 154836 - DNA, 75 bp, Artificial Sequence
  Synthetic
acagcatatccactcagttccacatttccatataaaggccaaggcatttattctcaggataattgtttcagcatc

SEQ ID NO: 154837 - DNA, 75 bp, Artificial Sequence
  Synthetic
caaactgcacccggtgccgggcagccacatccagcgcaaaaaccttcgtgtagacttccgttgaactgatggact

SEQ ID NO: 154838 - DNA, 75 bp, Artificial Sequence
  Synthetic
cacatccagcgcaaaaaccttcgtgtagacttccgttgaactgatggacttatgtcccatcaggctttgcagaac

SEQ ID NO: 154839 - DNA, 75 bp, Artificial Sequence
  Synthetic
atgtgcatcgcataggaatggcggaacgtatgtggtgtgaccggaacagagaacgtcacaccgtcagcagcagcg

SEQ ID NO: 154840 - DNA, 75 bp, Artificial Sequence
  Synthetic
acgtatgtggtgtgaccggaacagagaacgtcacaccgtcagcagcagcggcggcaaccgcctccccaatccagg

SEQ ID NO: 154841 - DNA, 75 bp, Artificial Sequence
  Synthetic
ccagatccgcgctttctctgtccttcctgtgcgacggttacgccgctccatgagcttatcgcgaataaatacctg

SEQ ID NO: 154842 - DNA, 75 bp, Artificial Sequence
  Synthetic
cctgtgcgacggttacgccgctccatgagcttatcgcgaataaatacctgtgacggaagatcacttcgcagaata

SEQ ID NO: 154843 - DNA, 75 bp, Artificial Sequence
  Synthetic
accgggaagccctgggccaacttttggcgaaaatgagacgttgatcggcacgtaagaggttccaactttcaccat

SEQ ID NO: 154844 - DNA, 75 bp, Artificial Sequence
  Synthetic
ggcgaaaatgagacgttgatcggcacgtaagaggttccaactttcaccataatgaaataagatcactaccgggcg

SEQ ID NO: 154845 - DNA, 75 bp, Artificial Sequence
  Synthetic
aggagctaaggaagctaaaatggagaaaaaaatcactggatataccaccgttgatatatcccaatggcatcgtaa

SEQ ID NO: 154846 - DNA, 75 bp, Artificial Sequence
  Synthetic
aaaaaaatcactggatataccaccgttgatatatcccaatggcatcgtaaagaacattttgaggcatttcagtca

SEQ ID NO: 154847 - DNA, 75 bp, Artificial Sequence
  Synthetic
ccgttcagctggatattacggcctttttaaagaccgtaaagaaaaataagcacaagttttatccggcctttattc

SEQ ID NO: 154848 - DNA, 75 bp, Artificial Sequence
  Synthetic
tttaaagaccgtaaagaaaaataagcacaagttttatccggcctttattcacattcttgcccgcctgatgaatgc

SEQ ID NO: 154849 - DNA, 75 bp, Artificial Sequence
  Synthetic
aaagacggtgagctggtgatatgggatagtgttcacccttgttacaccgttttccatgagcaaactgaaacgttt

SEQ ID NO: 154850 - DNA, 75 bp, Artificial Sequence
  Synthetic
atagtgttcacccttgttacaccgttttccatgagcaaactgaaacgttttcatcgctctggagtgaataccacg

SEQ ID NO: 154851 - DNA, 75 bp, Artificial Sequence
  Synthetic
acgccgccgcccatcatcgccacgttggaccccaccccgcgacgggacgccgccgcaaaaagcagacgccgacga

SEQ ID NO: 154852 - DNA, 75 bp, Artificial Sequence
  Synthetic
atattcgcaagatgtggcgtgttacggtgaaaacctggcctatttccctaaagggtttattgagaatatgttttt

SEQ ID NO: 154853 - DNA, 75 bp, Artificial Sequence
  Synthetic
ggtgaaaacctggcctatttccctaaagggtttattgagaatatgtttttcgtctcagccaatccctgggtgagt

SEQ ID NO: 154854 - DNA, 75 bp, Artificial Sequence
  Synthetic
ccaatatggacaacttcttcgcccccgttttcaccatgggcaaatattatacgcaaggcgacaaggtgctgatgc

SEQ ID NO: 154855 - DNA, 75 bp, Artificial Sequence
  Synthetic
cgttttcaccatgggcaaatattatacgcaaggcgacaaggtgctgatgccgctggcgattcaggttcatcatgc

SEQ ID NO: 154856 - DNA, 75 bp, Artificial Sequence
  Synthetic
agaatgcttaatgaattacaacagtactgcgatgagtggcagggcggggcgtaatttttttaaggcagttattgg

SEQ ID NO: 154857 - DNA, 75 bp, Artificial Sequence
  Synthetic
actgcgatgagtggcagggcggggcgtaatttttttaaggcagttattggtgcccttaaacgcctggttgctacg

SEQ ID NO: 154858 - DNA, 75 bp, Artificial Sequence
  Synthetic
gaatggcagaaattcgatgataagctgtcaaacatgagaattggtcgagctagcatgcataacttcgtataatgt

SEQ ID NO: 154859 - DNA, 75 bp, Artificial Sequence
  Synthetic
ttggcaccgggggctaaagggtggtaaccggatagcagatgtgaggaagtcggggccgttcgccgcgaacggcga

SEQ ID NO: 154860 - DNA, 75 bp, Artificial Sequence
  Synthetic
gtagcgtgcccggtgccgaccaaccgggacgacgcccatctccaggacccgcatgtcgtcgtcatcttcttcgac

SEQ ID NO: 154861 - DNA, 75 bp, Artificial Sequence
  Synthetic
ctggagagaggggccgctggggcgcccggaggccccgtgggggttggagtgtatgtaggatgcgagccaatcctt

SEQ ID NO: 154862 - DNA, 75 bp, Artificial Sequence
  Synthetic
tacgtgttacgcgtatgggtcggtgacgcgccaaacgccagcctgtttgtcctggggatggccatagccgccgaa

SEQ ID NO: 154863 - DNA, 75 bp, Artificial Sequence
  Synthetic
accatccccgctccctcgaccaccatccccgctccccaagcatcgaccacgcccttccccacgggagatccaaaa

SEQ ID NO: 154864 - DNA, 75 bp, Artificial Sequence
  Synthetic
tccccggtttcctttgcgctcccgccttccggacctgctctcgcctactcttctttggctctcggtgcgattcgt

SEQ ID NO: 154865 - DNA, 75 bp, Artificial Sequence
  Synthetic
cactggccgggagcaccacataaccgaccgcagtccctgagttgggaataaaccggtattatttacctatatccg

SEQ ID NO: 154866 - DNA, 75 bp, Artificial Sequence
  Synthetic
aagtaaacatctgggtcgcccggcccaactggggccgggggttgggtctggctcatctcgagagccacggggggg

SEQ ID NO: 154867 - DNA, 75 bp, Artificial Sequence
  Synthetic
tgtctgcacgagctgcgcgctgtgaccgacaaaccccctccgcgccaggcccgccgccactgtcgtcgccgtccc

SEQ ID NO: 154868 - DNA, 75 bp, Artificial Sequence
  Synthetic
ccgccgccactgtcgtcgccgtcccacgctctcccctgctgccatggattccgcggccccagccctctcccccgc

SEQ ID NO: 154869 - DNA, 75 bp, Artificial Sequence
  Synthetic
tcaaccccggcgattgtgggttttttaaaaacgacacgcgtgcgaccgtatacagaacattattttggtttttat

SEQ ID NO: 154870 - DNA, 75 bp, Artificial Sequence
  Synthetic
tcgctatcggacatggggggtggaaactgggtggcggggcaggcgcctccgggggtccgccggtgagtgtggcgc

SEQ ID NO: 154871 - DNA, 75 bp, Artificial Sequence
  Synthetic
cgagaggcccatagctcggcgagcgtgtcgtcgaacgccaggcggctgcttcgctggatggccttatagatctcc

SEQ ID NO: 154872 - DNA, 75 bp, Artificial Sequence
  Synthetic
aaaacacccccccgggggttgactccccgggggaaaagaggcggggcgggagtccccgtcctgccgccgcccctt

SEQ ID NO: 154873 - DNA, 75 bp, Artificial Sequence
  Synthetic
cccgggggaaaagaggcggggcgggagtccccgtcctgccgccgccccttaagagggcccgcaacacggcccggg

SEQ ID NO: 154874 - DNA, 75 bp, Artificial Sequence
  Synthetic
aagagggcccgcaacacggcccgggctgcgcacgccagccgggacgggtgagttcgctaggcaagcacggactgg

SEQ ID NO: 154875 - DNA, 75 bp, Artificial Sequence
  Synthetic
ccccggcgctccagccgtgccgcgccccggcgcgctcccaaccgcagactcccaaatggtccctgcgtacgactc

SEQ ID NO: 154876 - DNA, 75 bp, Artificial Sequence
  Synthetic
cccaaatggtccctgcgtacgactcgggaaccgcggtcgagagcgcgccggccgcgtcctcgctcctgcggcgct

SEQ ID NO: 154877 - DNA, 75 bp, Artificial Sequence
  Synthetic
aacgacgacgcagagtgggcgaacagccccccgagcgagggcggggggaaggcgccggaggccccgcacgccgcg

SEQ ID NO: 154878 - DNA, 75 bp, Artificial Sequence
  Synthetic
cccctttctcccccccttccgaacaaaaagcagcgggcggggggccggggtgagggagggacacgggggacacgg

SEQ ID NO: 154879 - DNA, 75 bp, Artificial Sequence
  Synthetic
atagccccaggggttgctaattaacgcacgcatgcagacgcaatttattttgctcccccgcgtcctcccctcccc

SEQ ID NO: 154880 - DNA, 75 bp, Artificial Sequence
  Synthetic
gacgcgccgcgcgggaaggtgcgcctcccctccgaccccccgacccgacccctcccctccgaccccccgacccga

SEQ ID NO: 154881 - DNA, 75 bp, Artificial Sequence
  Synthetic
gcagacacggagacccccgcccaaccaccccgctaccccgccgaggccgtctatctgccgccgccgcacatcgcc

SEQ ID NO: 154882 - DNA, 75 bp, Artificial Sequence
  Synthetic
cccgcaggtgtgcttctcgccgcgcgtgcaggtgcgccatctggtggcctgggagacggccgcgcgcctggcccg

SEQ ID NO: 154883 - DNA, 75 bp, Artificial Sequence
  Synthetic
cgcgggtcctccgccgccgcgggcccgggccgtcgggcggtctagggttgaaccggcgagggcggcctcggccgg

SEQ ID NO: 154884 - DNA, 75 bp, Artificial Sequence
  Synthetic
gcgcgaggccgctctccgaagagacgatgggagccccgcgtatatatccgcgagggcccggcgccgccccgccgc

SEQ ID NO: 154885 - DNA, 75 bp, Artificial Sequence
  Synthetic
cgagggcccggcgccgccccgccgctccgcccgccccagggggcggcgccggccaaccgcgcgccgccgcgcggg

SEQ ID NO: 154886 - DNA, 75 bp, Artificial Sequence
  Synthetic
cccggactccgccccggcgaccgccccgcgccggcttcccggtatggtaattagaaacttttaataggcggtccc

SEQ ID NO: 154887 - DNA, 75 bp, Artificial Sequence
  Synthetic
cccgctcgcggtaattagcagcttttaacgggccgccattcccgcttatggtaattaaaaacgttcggacggccc

SEQ ID NO: 154888 - DNA, 75 bp, Artificial Sequence
  Synthetic
taacgggccgccattcccgcttatggtaattaaaaacgttcggacggcccctcgctccccgcgtaattactccct

SEQ ID NO: 154889 - DNA, 75 bp, Artificial Sequence
  Synthetic
cgcgcgccgccgggtgggtgggctgatcggcccctattggtcccctgggcttcctagtatgctaatgaatttctc

SEQ ID NO: 154890 - DNA, 75 bp, Artificial Sequence
  Synthetic
tcccatctgcgtcggcggggggcggcgcatgctaatggggttcttggagtacacccggttggtccccggggacgg

SEQ ID NO: 154891 - DNA, 75 bp, Artificial Sequence
  Synthetic
ctccctccgcccccgccggggcgcgcggctattgggggaatcgtaaatgccgcccctttgggggagtggataggc

SEQ ID NO: 154892 - DNA, 75 bp, Artificial Sequence
  Synthetic
tgcctcccccacccaccacacagccggtccccacgccgaccactagaccgcagacgtcgcccaaccgaggtcccc

SEQ ID NO: 154893 - DNA, 75 bp, Artificial Sequence
  Synthetic
acggtcgggccgcattcgcaccccggcactgcgagcgacggagcggcggcccggcgggaggaggagacccggaga

SEQ ID NO: 154894 - DNA, 75 bp, Artificial Sequence
  Synthetic
agagaccgcgggccgccgtctcgagtctaccctaccccggctcatggaaccccggcccggcacgagctcccgggc

SEQ ID NO: 154895 - DNA, 75 bp, Artificial Sequence
  Synthetic
tctaccctaccccggctcatggaaccccggcccggcacgagctcccgggcggaccccggccccgagcggccgccg

SEQ ID NO: 154896 - DNA, 75 bp, Artificial Sequence
  Synthetic
cccggcccggcacgagctcccgggcggaccccggccccgagcggccgccgcggcagacccccggcacggtgagag

SEQ ID NO: 154897 - DNA, 75 bp, Artificial Sequence
  Synthetic
gggttgggggtggtcgcgggcggtgggctcgggggcggggacgcttgacggggccgacccccggcccgcttaagc

SEQ ID NO: 154898 - DNA, 75 bp, Artificial Sequence
  Synthetic
cccccccccccaccctgtacgtaccgcgaggacccatccacccactgcagccttatcgcaggtacggtgacccgg

SEQ ID NO: 154899 - DNA, 75 bp, Artificial Sequence
  Synthetic
tattttaaataaacaaacaaccggacaaaagtatacccacttcgtgtgcttgtgtttttgtttgagagggggggg

SEQ ID NO: 154900 - DNA, 75 bp, Artificial Sequence
  Synthetic
acgaggggtcggaatccaaaggacgcagaccacctttggttacggacccctttctcccccccttccgaacaaaaa

SEQ ID NO: 154901 - DNA, 75 bp, Artificial Sequence
  Synthetic
ctgcacgcgcggcgagaagcacacctgcgggcggggagacacgggggtcggaggggggtcagggggtcggagggg

SEQ ID NO: 154902 - DNA, 75 bp, Artificial Sequence
  Synthetic
tgcgggcggggagacacgggggtcggaggggggtcagggggtcggaggggggtcagggggtcggagggggtcagg

SEQ ID NO: 154903 - DNA, 75 bp, Artificial Sequence
  Synthetic
ttgtcaagcagcccgccgccccgcacgcctgggggatgctcaacgacatgcagtggctcgccagcagcgactcgg

SEQ ID NO: 154904 - DNA, 75 bp, Artificial Sequence
  Synthetic
cgcctgggggatgctcaacgacatgcagtggctcgccagcagcgactcggaggaggagaccgaggtgggaatctc

SEQ ID NO: 154905 - DNA, 75 bp, Artificial Sequence
  Synthetic
ggacggggggacggggggacggggggacggggggacggggggacggggggacggggggacggggggacgggggga

SEQ ID NO: 154906 - DNA, 75 bp, Artificial Sequence
  Synthetic
cggagatgttcgaggcgggcctgatggacgcggccacgcccccggcccggcccccggccgagcgccagggcagcc

SEQ ID NO: 154907 - DNA, 75 bp, Artificial Sequence
  Synthetic
ggacgcggccacgcccccggcccggcccccggccgagcgccagggcagccccacgcccgccgacgcgcagggatc

SEQ ID NO: 154908 - DNA, 75 bp, Artificial Sequence
  Synthetic
gggggcgcgaaggcgggcggcggcggcgggcgggcggcagggcagccgcgcccgcccccttccccggccctcccc

SEQ ID NO: 154909 - DNA, 75 bp, Artificial Sequence
  Synthetic
gatcctcctcctgcatcccctcgccttccattctccggccctccgcgagtcccgacgcccccccccccgccgccc

SEQ ID NO: 154910 - DNA, 75 bp, Artificial Sequence
  Synthetic
gcgacgtgtgcgccgtgtgcacggacgagatcgccccgcccctgcgctgccagagttttccctgcctgcacccct

SEQ ID NO: 154911 - DNA, 75 bp, Artificial Sequence
  Synthetic
cgagatcgccccgcccctgcgctgccagagttttccctgcctgcaccccttctgcatcccgtgcatgaagacctg

SEQ ID NO: 154912 - DNA, 75 bp, Artificial Sequence
  Synthetic
tgatagtgggcgtgaccgccagcgggtcgttcagcaccatcccgatagtgaacgacccccggacccgcgtggagg

SEQ ID NO: 154913 - DNA, 75 bp, Artificial Sequence
  Synthetic
gtcgttcagcaccatcccgatagtgaacgacccccggacccgcgtggaggccgaggcggccgtgcggtccggcac

SEQ ID NO: 154914 - DNA, 75 bp, Artificial Sequence
  Synthetic
tgtcgctggggggacacacggtccgcgccctgtcgcccacccccccgtggcccggcacggacgacgaggacgatg

SEQ ID NO: 154915 - DNA, 75 bp, Artificial Sequence
  Synthetic
cgtcccgcccgccccccgaagagcgccccggcgcgggggcggcggtgcgggggcgacccgcggaacctcccagcc

SEQ ID NO: 154916 - DNA, 75 bp, Artificial Sequence
  Synthetic
ccccggcgcgggggcggcggtgcgggggcgacccgcggaacctcccagcccgccgcgacccgaccggcgccccct

SEQ ID NO: 154917 - DNA, 75 bp, Artificial Sequence
  Synthetic
gggatctgggtctgggggcggccctgccgtcgcggccgtcgtgccgagagtggcctctcttccccctgcggccgg

SEQ ID NO: 154918 - DNA, 75 bp, Artificial Sequence
  Synthetic
gccgtcgcggccgtcgtgccgagagtggcctctcttccccctgcggccggcggggggcgcgcgcaggcgcggcgg

SEQ ID NO: 154919 - DNA, 75 bp, Artificial Sequence
  Synthetic
gccccgcgcggcccaggagccccccatagtcatcagcgactctcccccgccgtctccgcgccgccccgcgggccc

SEQ ID NO: 154920 - DNA, 75 bp, Artificial Sequence
  Synthetic
ccggggggggaggtctgccacagtcgtcggggcgcgcggcgcgcccccgcgcggccgtcgccccgcgcgtccgga

SEQ ID NO: 154921 - DNA, 75 bp, Artificial Sequence
  Synthetic
gtcggggcgcgcggcgcgcccccgcgcggccgtcgccccgcgcgtccggagtccgccccgcgccgccgccgcccc

SEQ ID NO: 154922 - DNA, 75 bp, Artificial Sequence
  Synthetic
gcggccgtcgccccgcgcgtccggagtccgccccgcgccgccgccgcccccgtggtgtctgcgagcgcggacgcg

SEQ ID NO: 154923 - DNA, 75 bp, Artificial Sequence
  Synthetic
gtcgcgcatgacccaggctcagaccgacacccaagcacagagtctgggccgggcaggcgcgaccgacgcgcgcgg

SEQ ID NO: 154924 - DNA, 75 bp, Artificial Sequence
  Synthetic
taaacgccctacaagaaagcttttgtgtctgagtgtctggtttttctgggggtggaggaaggaacgacaaaaaaa

SEQ ID NO: 154925 - DNA, 75 bp, Artificial Sequence
  Synthetic
cgccgccctctgcccgcgtcccaccgagacgccgcgccgcgtgagccgtccgccgggggacccaggctccggggg

SEQ ID NO: 154926 - DNA, 75 bp, Artificial Sequence
  Synthetic
gaaactaaaaacacatcaagcccacaacccatcccacaatgggggttatggcggacccaccgcaccaccatactc

SEQ ID NO: 154927 - DNA, 75 bp, Artificial Sequence
  Synthetic
ttcctccgccgccccgcgctcgcccctcgccccccagggggtgggggccaagagggcggcgccgcgccgggcccc

SEQ ID NO: 154928 - DNA, 75 bp, Artificial Sequence
  Synthetic
tcaagaaacacgaggcgggggtcccagaaagggcaggcaggtcagccgcaccgcccgcgagccaacccgtatcct

SEQ ID NO: 154929 - DNA, 75 bp, Artificial Sequence
  Synthetic
cctcttccgcctcctcctcctcctcctccgcctcttcctctgcgggcggggctggtgggagcgtcgcgtccgcgt

SEQ ID NO: 154930 - DNA, 75 bp, Artificial Sequence
  Synthetic
ctccgcctcttcctctgcgggcggggctggtgggagcgtcgcgtccgcgtccggcgctggggagagacgagaaac

SEQ ID NO: 154931 - DNA, 75 bp, Artificial Sequence
  Synthetic
tgacgcccctccgaccccctgacccccctccgaccccctgacgcccctccgaccccctgacgcccctccgacccc

SEQ ID NO: 154932 - DNA, 75 bp, Artificial Sequence
  Synthetic
gctggtgggagcgtcgcgtccgcgtccggcgctggggagagacgagaaacctccctcggcccccgcgctgctgcg

SEQ ID NO: 154933 - DNA, 75 bp, Artificial Sequence
  Synthetic
gtcgttcccagggggggcaggcgcgggtcgggcccatacgcccaccgcccccacgcgccggtcacccccccccca

SEQ ID NO: 154934 - DNA, 75 bp, Artificial Sequence
  Synthetic
ccccgagcccggggcccgcgacccggcgcccggcctcacgcgctacctgcccatcgcgggggtctcgagcgtcgt

SEQ ID NO: 154935 - DNA, 75 bp, Artificial Sequence
  Synthetic
gcgcccggcctcacgcgctacctgcccatcgcgggggtctcgagcgtcgtggccctggcgccttacgtgaacaag

SEQ ID NO: 154936 - DNA, 75 bp, Artificial Sequence
  Synthetic
gacagagacgggaacccccggttagtgcccgacccccgcccgacccccgcccagtgcccgacccccgcccagacc

SEQ ID NO: 154937 - DNA, 75 bp, Artificial Sequence
  Synthetic
aggggcctacgtggtcctcgtggaccagacggggaacgtggcggacctgctgcgggccgcggcccccgcgtggag

SEQ ID NO: 154938 - DNA, 75 bp, Artificial Sequence
  Synthetic
cagacggggaacgtggcggacctgctgcgggccgcggcccccgcgtggagccgccgcaccctgctccccgagcac

SEQ ID NO: 154939 - DNA, 75 bp, Artificial Sequence
  Synthetic
gccgcgacccacgtccgtatgttaattgcaataaagtggttgattgtcattacggtctactaggttgtctttttt

SEQ ID NO: 154940 - DNA, 75 bp, Artificial Sequence
  Synthetic
gtggaacagcctctggatgaccccggtgggcaacatgctctttgaccagggcaccctggtgggcgcgctggactt

SEQ ID NO: 154941 - DNA, 75 bp, Artificial Sequence
  Synthetic
ctcggcttgctgcccgaagggaagccgccccccaccggaccaccggccgaggcgcctcgggggcagggggaggtg

SEQ ID NO: 154942 - DNA, 75 bp, Artificial Sequence
  Synthetic
aaaattttacaataaagttttgtgatgcttttgacacactttgttgttggcctttgatgcagctcccccgcgcag

SEQ ID NO: 154943 - DNA, 75 bp, Artificial Sequence
  Synthetic
atgcaggaggaggatcgggactccccatcttctgcccttccatcctccgtttttccgctttccaccgccgccgcc

SEQ ID NO: 154944 - DNA, 75 bp, Artificial Sequence
  Synthetic
ctgttggtctttatcatagaacagagccggggcccggcctgcgttctggctccctgtcttggtgggtgggcgggc

SEQ ID NO: 154945 - DNA, 75 bp, Artificial Sequence
  Synthetic
cgtccccccgtccccccggcccgtccccccgtccccccggcccgtccccccgtccccccgtccccccgtcccccc

SEQ ID NO: 154946 - DNA, 75 bp, Artificial Sequence
  Synthetic
cgcaccaccggcgcgaagccaggggccagggaactttgatagagaggggggaaagtggggcgggggcgagggcgg

SEQ ID NO: 154947 - DNA, 75 bp, Artificial Sequence
  Synthetic
gaaagtggggcgggggcgagggcggttgaatcacaacgcatgcacgccctctgcccccggggacgggtgggagga

SEQ ID NO: 154948 - DNA, 75 bp, Artificial Sequence
  Synthetic
tgcacgcgcggcgagaagcacacctgcgggcggggagacacggaggggaggggtcggaggggaggggtcggaggg

SEQ ID NO: 154949 - DNA, 75 bp, Artificial Sequence
  Synthetic
cccgcccgcacacctgcccgccacgcccgcccctcctcaccctggctgggagaaaggaggaggagcaggaagagg

SEQ ID NO: 154950 - DNA, 75 bp, Artificial Sequence
  Synthetic
accatacctgcgataaggctgcagtgggtggatgggtccttgcggtccgtacagggtggggggggggggggaggg

SEQ ID NO: 154951 - DNA, 75 bp, Artificial Sequence
  Synthetic
cgccacgcccgcccctccttaccctggctgcggggagactcccatcggggcgagggggctcgcgcgttcgcaaca

SEQ ID NO: 154952 - DNA, 75 bp, Artificial Sequence
  Synthetic
ggctgtggctgggcacgcgcctttggggttgttggggggggggtgaccggcgcgtgggggcggtgggcgtatggg

SEQ ID NO: 154953 - DNA, 75 bp, Artificial Sequence
  Synthetic
gccgttcgcacgatcccgtcgccccccccggagcgcgacggcgcggaagaagcagcccgctcgccttctccgccg

SEQ ID NO: 154954 - DNA, 75 bp, Artificial Sequence
  Synthetic
acctgtacgaccctaaacctacctgcgagaacgcgcggcgttcgaggggcgcgctctctcacacgagacacacgc

SEQ ID NO: 154955 - DNA, 75 bp, Artificial Sequence
  Synthetic
cgtcgcccgcccgcccgccccgccggtgtgccgtgattcgcggagtcggggccttgtgtttctttctttcccccc

SEQ ID NO: 154956 - DNA, 75 bp, Artificial Sequence
  Synthetic
accccgacccccgcccgaccccgacccccgcccgaccccgacccccgaataaaccacacaaggcggtacgttttc

SEQ ID NO: 154957 - DNA, 75 bp, Artificial Sequence
  Synthetic
aaacggaacgcggaaacgccgccggcgcggcccggggccccggggcccccgcgctccgccgggggcccgggccgg

SEQ ID NO: 154958 - DNA, 75 bp, Artificial Sequence
  Synthetic
gcgctccgccgggggcccgggccggaccgccgggcgggggacgccttccgaccggcgccgggcggctacccggga

SEQ ID NO: 154959 - DNA, 75 bp, Artificial Sequence
  Synthetic
accggcgccgggcggctacccgggacccccggccgggaatcgaaaaaagcctccgggggcccctttcgcgccttt

SEQ ID NO: 154960 - DNA, 75 bp, Artificial Sequence
  Synthetic
cccgtggtgtcgtccggggggtgtcgtggtgtcgtccgggggcgtcgttcccgggggggggcaggcgcgggtcgg

SEQ ID NO: 154961 - DNA, 75 bp, Artificial Sequence
  Synthetic
cggccgccgaggtgcgggggcccctccggccggggcgcacctcggcggccaagccccggcccgcccgggggtccc

SEQ ID NO: 154962 - DNA, 75 bp, Artificial Sequence
  Synthetic
aaaaaagggggaagagagggggaggtagggaggggagaggagaagggcgcgccggtgcgcggagcagccttcctt

SEQ ID NO: 154963 - DNA, 75 bp, Artificial Sequence
  Synthetic
tagggaggggagaggagaagggcgcgccggtgcgcggagcagccttccttctccggagtccctctcgatcggcgg

SEQ ID NO: 154964 - DNA, 75 bp, Artificial Sequence
  Synthetic
atgacgcagcagaaatgcccacagcaacacgcgggcggggctcgggctctccggcggcttaatggatctccgggc

SEQ ID NO: 154965 - DNA, 75 bp, Artificial Sequence
  Synthetic
aacacgcgggcggggctcgggctctccggcggcttaatggatctccgggcacggcgcccgcaaccgcagagcact

SEQ ID NO: 154966 - DNA, 75 bp, Artificial Sequence
  Synthetic
gcccgcggcccgtctgctggcccgcggccacgtaaacaatgacacaggggttctctccgccgcggccggcgcggg

SEQ ID NO: 154967 - DNA, 75 bp, Artificial Sequence
  Synthetic
ggccacgtaaacaatgacacaggggttctctccgccgcggccggcgcggggcgttgccggcccggcccggccccg

SEQ ID NO: 154968 - DNA, 75 bp, Artificial Sequence
  Synthetic
ttctctccgccgcggccggcgcggggcgttgccggcccggcccggccccggagcccgcggcgctgctcggctgcg

SEQ ID NO: 154969 - DNA, 75 bp, Artificial Sequence
  Synthetic
gggtgcttggtgctactgtgtggtctgcgagggcgagcggtggtgcgactgtcgtctttaggggggcggggagct

SEQ ID NO: 154970 - DNA, 75 bp, Artificial Sequence
  Synthetic
tcgcggagggccggagaatggaaggcgaggggatgcaggaggaggatcgggactccccatcttctgcccttccat

SEQ ID NO: 154971 - DNA, 75 bp, Artificial Sequence
  Synthetic
ccgcccgcctcgccccggacccctcccccccgtgtttcccccatcgttcaccaccacgccccccaccgcgccttg

SEQ ID NO: 154972 - DNA, 75 bp, Artificial Sequence
  Synthetic
ccccccgtgtttcccccatcgttcaccaccacgccccccaccgcgccttggctgtttggggggtggcggcggtgg

SEQ ID NO: 154973 - DNA, 75 bp, Artificial Sequence
  Synthetic
gctgtttggggggtggcggcggtggtcggcgtgctgccggaggctgcgggcgcggggtaggtgggtgggcgggtg

SEQ ID NO: 154974 - DNA, 75 bp, Artificial Sequence
  Synthetic
gcggtagaggaaggggacgggcgccacacccacggctgtggccgggcacgcgcctttggggttgttggggggggg

SEQ ID NO: 154975 - DNA, 75 bp, Artificial Sequence
  Synthetic
ggcggcggtcggggtggggggagagtgtcgtgggtgtgttttcgtgtcccccaccaccactcccaccccgaccgc

SEQ ID NO: 154976 - DNA, 75 bp, Artificial Sequence
  Synthetic
ccaccaccactcccaccccgaccgccgccgcgcccgcgtttctgccgcccgcgcgctcctgtgtggaccccgggg

SEQ ID NO: 154977 - DNA, 75 bp, Artificial Sequence
  Synthetic
ggaggaggaagaggaggcggcggcggcgaccgcggcctgggacgacggagacgccgacgggggcgcggcgcccgc

SEQ ID NO: 154978 - DNA, 75 bp, Artificial Sequence
  Synthetic
ggtgtggcggcggggcgcgggccggggccggggctcgctggtctgccgaagtaaagaaaagatcgccaccgtgtg

SEQ ID NO: 154979 - DNA, 75 bp, Artificial Sequence
  Synthetic
gcggccgggcgggggcgcgcggcggccgggcgggggcgcgcggcggccgggcgggggcgcgcggcggccgggcgg

SEQ ID NO: 154980 - DNA, 75 bp, Artificial Sequence
  Synthetic
tttccccgcgtcgcccctcgggttcccaagacctatcacgtttgcgcaggggaggggaggacgcgggggagggga

SEQ ID NO: 154981 - DNA, 75 bp, Artificial Sequence
  Synthetic
ccctgcgtcgtcgtcgtcgtcttcttcttcttccgctgctccgccgacatcgcctccgaccggggtgtgcggggg

SEQ ID NO: 154982 - DNA, 75 bp, Artificial Sequence
  Synthetic
ccccccccccaaaaaaaaaacaacaaccaactcccagatggatgggtgcgataataaagctttattattgtttaa

SEQ ID NO: 154983 - DNA, 75 bp, Artificial Sequence
  Synthetic
cgggaatgggcatattggacccgcgtgattcggttgctcgcggttgtcttgtttggacgttttttatgcgggaac

SEQ ID NO: 154984 - DNA, 75 bp, Artificial Sequence
  Synthetic
cttcggggggcgggcgggacgtagtccactgcagagggagacagagacgggaacccccggttagtgcccgacccc

SEQ ID NO: 154985 - DNA, 75 bp, Artificial Sequence
  Synthetic
gccggcgcaggctcaggcgcgccaggtactccgtcgtggtgcgcagccgtagggccaggtggggcggaagggggc

SEQ ID NO: 154986 - DNA, 75 bp, Artificial Sequence
  Synthetic
ctaagagtgccttgcatgcggacccccgcggacgatgtttcttggcgctacgaggccccgtccgttattgactat

SEQ ID NO: 154987 - DNA, 75 bp, Artificial Sequence
  Synthetic
ccgcggacgatgtttcttggcgctacgaggccccgtccgttattgactatgcccgcatagacggaatatttcttc

SEQ ID NO: 154988 - DNA, 75 bp, Artificial Sequence
  Synthetic
agggcgtatcttgttaacccctttctctttgcggcgggatttttggaggacttgagtcactctgtgtttccggcc

SEQ ID NO: 154989 - DNA, 75 bp, Artificial Sequence
  Synthetic
tctttgcggcgggatttttggaggacttgagtcactctgtgtttccggccgacacccaggaaacaacgacgcgcc

SEQ ID NO: 154990 - DNA, 75 bp, Artificial Sequence
  Synthetic
ggccggggggacgggccggggggacgggccggggggacgggccggggggacgggccggggggacgggccgggggg

SEQ ID NO: 154991 - DNA, 75 bp, Artificial Sequence
  Synthetic
gtcagccacgcacccgtcagggccgggtgtgtaaactttgactactcacgcactcgccgctgcgtcgggcgacgc

SEQ ID NO: 154992 - DNA, 75 bp, Artificial Sequence
  Synthetic
ggtgtgtaaactttgactactcacgcactcgccgctgcgtcgggcgacgcgatttacggcctgccaacaccacgt

SEQ ID NO: 154993 - DNA, 75 bp, Artificial Sequence
  Synthetic
tgacggtcgggccgcattcgcaccccggcactgcgagcgacggagcgacggagcggcggcccggcgggaggagga

SEQ ID NO: 154994 - DNA, 75 bp, Artificial Sequence
  Synthetic
aagcccctcgccacccagccgcccgtcctcgccctttcgaacgcccccccacggcgggtctccccgacgcgaggt

SEQ ID NO: 154995 - DNA, 75 bp, Artificial Sequence
  Synthetic
tcctcgccctttcgaacgcccccccacggcgggtctccccgacgcgaggtcggcgccggcatactcgcctccgac

SEQ ID NO: 154996 - DNA, 75 bp, Artificial Sequence
  Synthetic
tccgacccgtctagcggccgggtcggctgtccagcgtcgtcgccctagaggctgtccgccgggcgtgatgttttc

SEQ ID NO: 154997 - DNA, 75 bp, Artificial Sequence
  Synthetic
gctgtccagcgtcgtcgccctagaggctgtccgccgggcgtgatgttttccgcatctacgacccccgaacagccc

SEQ ID NO: 154998 - DNA, 75 bp, Artificial Sequence
  Synthetic
ggtcgggtcggggggtcagggggtcgggtcgggggtcggggggggtcagggggtcgggtcggggggtcagggggt

SEQ ID NO: 154999 - DNA, 75 bp, Artificial Sequence
  Synthetic
ggcgcgctttccccgcgtcgcccctcgggttcccaagacctatcacgtgtgcgcaggggaggggaggacgcgggg

SEQ ID NO: 155000 - DNA, 75 bp, Artificial Sequence
  Synthetic
ccgaccccgacccccgcccgacccccgaataaaccacacaaggcggtacgttttcgtctgtctcgttctttattt

SEQ ID NO: 155001 - DNA, 75 bp, Artificial Sequence
  Synthetic
ggggcgcaccttcccgcgcggcgcgtccgcgggcggggacgcggggggccgccggcgcaggctcaggcgcgccag

SEQ ID NO: 155002 - DNA, 75 bp, Artificial Sequence
  Synthetic
ggactgggccgcgtttcggcgcgcgtttctgatcgacgacgcctggcggcccctgttggagccggagctcgcgaa

SEQ ID NO: 155003 - DNA, 75 bp, Artificial Sequence
  Synthetic
tttctgatcgacgacgcctggcggcccctgttggagccggagctcgcgaaccccctaaccgcgcgcctcctcgcg

SEQ ID NO: 155004 - DNA, 75 bp, Artificial Sequence
  Synthetic
tgtgttctcctggacgcggtattgtacccccgacgacgtgcgcgtggttatcatcgggcaggacccgtaccacca

SEQ ID NO: 155005 - DNA, 75 bp, Artificial Sequence
  Synthetic
acccccgacgacgtgcgcgtggttatcatcgggcaggacccgtaccaccatcccggccaggcgcacggcctggcg

SEQ ID NO: 155006 - DNA, 75 bp, Artificial Sequence
  Synthetic
ggcggcggttaaaaattgttaccccgacgcgcgcatgagcggccgcggctgcctggaaaagtgggctcgcgacgg

SEQ ID NO: 155007 - DNA, 75 bp, Artificial Sequence
  Synthetic
gctcgcagagccgcgtcaggttgggggcctgggtgctgggggccaggtggcggccgccgtgaaagacgtagacgg

SEQ ID NO: 155008 - DNA, 75 bp, Artificial Sequence
  Synthetic
gcctggaaaagtgggctcgcgacggcgtgctgttgttgaacacgaccctgaccgtcaagcgcggggcggcggcgt

SEQ ID NO: 155009 - DNA, 75 bp, Artificial Sequence
  Synthetic
ctggccgcgcgccgcccgggcctggtctttatgctctggggcgcccatgcccagaacgcgatcaggcccgaccct

SEQ ID NO: 155010 - DNA, 75 bp, Artificial Sequence
  Synthetic
gcgcccccttccccggccctcccccggaaccggccgctcccccgcgggcgccgcccctccccccgcgcgccgcgg

SEQ ID NO: 155011 - DNA, 75 bp, Artificial Sequence
  Synthetic
tctttatgctctggggcgcccatgcccagaacgcgatcaggcccgaccctcgccaacactacgtcctcaagtttt

SEQ ID NO: 155012 - DNA, 75 bp, Artificial Sequence
  Synthetic
ccgcccctccccccgcgcgccgcggggctgccttcccgcgggcgcccccgcgcggcttttttcccgcgcccgccc

SEQ ID NO: 155013 - DNA, 75 bp, Artificial Sequence
  Synthetic
ctcgccgcgaatcgctacctcgaaacccgggacattatgcctatcgactggtcggtataagatgccgacatccgg

SEQ ID NO: 155014 - DNA, 75 bp, Artificial Sequence
  Synthetic
ccgcgcggcaggacggggactagcaggctgtgccgcagaccagcccgaccccgacccccgcccgacccccacccc

SEQ ID NO: 155015 - DNA, 75 bp, Artificial Sequence
  Synthetic
gtcggtataagatgccgacatccggggtcttgatttacgagggggcaattaataaagactgttgatggttaaatc

SEQ ID NO: 155016 - DNA, 75 bp, Artificial Sequence
  Synthetic
cctctgcgtttactatccttgcctcgtggggctggacgtttgcaccccagaaccatgatcctggcgcgtcgccga

SEQ ID NO: 155017 - DNA, 75 bp, Artificial Sequence
  Synthetic
gtggggctggacgtttgcaccccagaaccatgatcctggcgcgtcgccgaatacgacgcccatagagtcgattgc

SEQ ID NO: 155018 - DNA, 75 bp, Artificial Sequence
  Synthetic
gggatgcgatctccccgcttacgtcgagcgtggccggcgacccgccgggggcggacggcccctacgtcacctttg

SEQ ID NO: 155019 - DNA, 75 bp, Artificial Sequence
  Synthetic
gagcgtggccggcgacccgccgggggcggacggcccctacgtcacctttgatactctgtttatggtatcttcgat

SEQ ID NO: 155020 - DNA, 75 bp, Artificial Sequence
  Synthetic
ccgtccccccggcccgtccccccggcccgtccccccgtcccgtccccccggcccgtccccccggcccgtcccccc

SEQ ID NO: 155021 - DNA, 75 bp, Artificial Sequence
  Synthetic
ggctgtcgctggccaagttcagcatcgcgtgtaccaagacctcgtcgttttcggggacggccgcgcgccagcgca

SEQ ID NO: 155022 - DNA, 75 bp, Artificial Sequence
  Synthetic
cgcgtgtaccaagacctcgtcgttttcggggacggccgcgcgccagcgcaagcgcggagcaccgccgcaacgcac

SEQ ID NO: 155023 - DNA, 75 bp, Artificial Sequence
  Synthetic
gcgccaacgccgcgcaggtgcgcgagcagctgcgggcggttattcggtcgcgcaagccgcgcaagtattacacgc

SEQ ID NO: 155024 - DNA, 75 bp, Artificial Sequence
  Synthetic
gcagctgcgggcggttattcggtcgcgcaagccgcgcaagtattacacgcggtcctcggatgggcggctctgccc

SEQ ID NO: 155025 - DNA, 75 bp, Artificial Sequence
  Synthetic
tccatcgagataacgtcatgctgtctacggaaccagactaagcacccccgccgtcccctttcttttccccctacc

SEQ ID NO: 155026 - DNA, 75 bp, Artificial Sequence
  Synthetic
gggctggtgaggcggtggtgggagggggcggcgtatagcaggacaacgaccggcggcgatgttttgtgccgcggg

SEQ ID NO: 155027 - DNA, 75 bp, Artificial Sequence
  Synthetic
tgccgccggaaccgcagacccggcggtcgcggcgacccggcgccgcgaccgccagaccgcaaaggcccccctccc

SEQ ID NO: 155028 - DNA, 75 bp, Artificial Sequence
  Synthetic
ccccgtccccccgtcccgtccccccgtccccccgtccccccgtccccggccccccggcccggccccccggcccgt

SEQ ID NO: 155029 - DNA, 75 bp, Artificial Sequence
  Synthetic
gacgtttcaataaataacacgtagcttattttgttggatgatggattgattgattttattgaccgttcgttcgcc

SEQ ID NO: 155030 - DNA, 75 bp, Artificial Sequence
  Synthetic
tgattttattgaccgttcgttcgcccggcggtgccgtcgccgcgcgcagagggaatatgcaagcgggcggggtgg

SEQ ID NO: 155031 - DNA, 75 bp, Artificial Sequence
  Synthetic
tccccccgtcccgtccccccgtcccggccccccggcccgtccccccgtcccggccccccggcccgtccccccggc

SEQ ID NO: 155032 - DNA, 75 bp, Artificial Sequence
  Synthetic
gcggcccggagacgtcccccgtcctcgtccgccatcgcgacctcggccccgcggccctgcgtcgtcgtcgtcgtc

SEQ ID NO: 155033 - DNA, 75 bp, Artificial Sequence
  Synthetic
tcgcacccccgcgccgcctcgggggccgtcccgtagatcgttgcggtgatgtagatggtgtccggggtccacacc

SEQ ID NO: 155034 - DNA, 75 bp, Artificial Sequence
  Synthetic
ccgtcccgtagatcgttgcggtgatgtagatggtgtccggggtccacaccaccgtcaggatgccggccgtcgcac

SEQ ID NO: 155035 - DNA, 75 bp, Artificial Sequence
  Synthetic
gcgtacatatgggcgtcccaccagcgctccagcctctgggtactagcgcgtcctataaagcggtatgcgcaaaat

SEQ ID NO: 155036 - DNA, 75 bp, Artificial Sequence
  Synthetic
tcctataaagcggtatgcgcaaaattcggcacgacagtcgataatcaccagcagcccgatgggggtgtgttgtat

SEQ ID NO: 155037 - DNA, 75 bp, Artificial Sequence
  Synthetic
gagcgagcccgcccgcgacgagggtctcattagcatcgcgggcggaagcggatgccgcccgcgccgggcgctaat

SEQ ID NO: 155038 - DNA, 75 bp, Artificial Sequence
  Synthetic
ggatcccgcggcaggcggccaggcactccacggccacgcggcccgcctccgcgcgccggccgccgccaccaccgc

SEQ ID NO: 155039 - DNA, 75 bp, Artificial Sequence
  Synthetic
gaaccgcgcgcgtccctgactcaaacacgtgcaccacctgtgccgcgtccggcagcgcgctcgttagcgacgccc

SEQ ID NO: 155040 - DNA, 75 bp, Artificial Sequence
  Synthetic
cacgtgcaccacctgtgccgcgtccggcagcgcgctcgttagcgacgccctggggtgatgtaggctgtacgcgat

SEQ ID NO: 155041 - DNA, 75 bp, Artificial Sequence
  Synthetic
ctgcagccttatcgcaggtacggtgacccggggggccggggcggggggccggggcggggggccggggcgggcggc

SEQ ID NO: 155042 - DNA, 75 bp, Artificial Sequence
  Synthetic
acccggggggccggggcggggggccggggcggggggccggggcgggcggccggggggacgggacggggggacggg

SEQ ID NO: 155043 - DNA, 75 bp, Artificial Sequence
  Synthetic
cggcccgggtgcggtgggaacgcgagggaatggagggttaatagacaatgaccacattcggatcgcgtagagcag

SEQ ID NO: 155044 - DNA, 75 bp, Artificial Sequence
  Synthetic
gggaatggagggttaatagacaatgaccacattcggatcgcgtagagcagatagtatgtgctcgctaatgacgtc

SEQ ID NO: 155045 - DNA, 75 bp, Artificial Sequence
  Synthetic
cccgcgggcgtcgtcgccgtcgtggcggttggcgtcgccgccgtcgtcgggggttcgcgccccggtcagcgccgc

SEQ ID NO: 155046 - DNA, 75 bp, Artificial Sequence
  Synthetic
cggggggccggggcggggggccggggcggggggccggggagccggggggccggggcgccggggggacggggggac

SEQ ID NO: 155047 - DNA, 75 bp, Artificial Sequence
  Synthetic
cggggggccggggcggggggccggggcggggggccggggtgccggggggccggggcgccggggggacggggggac

SEQ ID NO: 155048 - DNA, 75 bp, Artificial Sequence
  Synthetic
cggggggccggggcggggggccggggcggggggccggggcgccggggggccggggcgccggggggacggggggac

SEQ ID NO: 155049 - DNA, 75 bp, Artificial Sequence
  Synthetic
cggggggccggggcggggggccggggcggggggccggggggccggggggccggggcgccggggggacggggggac

SEQ ID NO: 155050 - DNA, 75 bp, Artificial Sequence
  Synthetic
cggatgaggtggtgcgggacatggctacgtacgcgctgtttaggcgcaggtttccgggcgtgaagcatatggcga

SEQ ID NO: 155051 - DNA, 75 bp, Artificial Sequence
  Synthetic
tacgtacgcgctgtttaggcgcaggtttccgggcgtgaagcatatggcgaccttgtccagactgagcccctggga

SEQ ID NO: 155052 - DNA, 75 bp, Artificial Sequence
  Synthetic
cggggcgccggggggacggggggacggggggacggggggacggggggacggggggggggggacggggggacgggg

SEQ ID NO: 155053 - DNA, 75 bp, Artificial Sequence
  Synthetic
cggggcgccggggggacggggggacggggggacggggggacggggggacggggggggggggacggggggtcgggg

SEQ ID NO: 155054 - DNA, 75 bp, Artificial Sequence
  Synthetic
cggggcgccggggggacggggggacggggggacggggggacggggggacggggggggggggacggggggccgggg

SEQ ID NO: 155055 - DNA, 75 bp, Artificial Sequence
  Synthetic
cggggcgccggggggacggggggacggggggacggggggacggggggacggggggggggggacgggggggcgggg

SEQ ID NO: 155056 - DNA, 75 bp, Artificial Sequence
  Synthetic
tggccatggccagctccgtggagtcgatcgactcgacaaactcactgatgttggtattgacgacagacatgaagc

SEQ ID NO: 155057 - DNA, 75 bp, Artificial Sequence
  Synthetic
gccgccgcagctcctccgcgaacgcgaacacccgggtgtacgtgtaccccatcagcgtgtagttgtccgtctgca

SEQ ID NO: 155058 - DNA, 75 bp, Artificial Sequence
  Synthetic
gaacacccgggtgtacgtgtaccccatcagcgtgtagttgtccgtctgcagggccacggacatcagccccccgcg

SEQ ID NO: 155059 - DNA, 75 bp, Artificial Sequence
  Synthetic
cgggatcgccggacacacgtaccttcaggcgagcgaaaaatttaaaatatggggggcggagtctgcccctgcgcc

SEQ ID NO: 155060 - DNA, 75 bp, Artificial Sequence
  Synthetic
aggtgctgaagggggcgctctcaaacacctccccgaagagctcccgtaggataaggtatcgccccagaaaggccc

SEQ ID NO: 155061 - DNA, 75 bp, Artificial Sequence
  Synthetic
cacctccccgaagagctcccgtaggataaggtatcgccccagaaaggccctcttcaggagcccaaactgggcgtg

SEQ ID NO: 155062 - DNA, 75 bp, Artificial Sequence
  Synthetic
cgtccagctgctgttcgtccagcccggcgaagataacgtcaaggtcgtcgtcggggaagtcgtccgggcccccgt

SEQ ID NO: 155063 - DNA, 75 bp, Artificial Sequence
  Synthetic
ggcgaagataacgtcaaggtcgtcgtcggggaagtcgtccgggcccccgtcccgcgggcccaggtgcttaaaatt

SEQ ID NO: 155064 - DNA, 75 bp, Artificial Sequence
  Synthetic
ccgatgcgccggcggcgtcccggcgtagcgacaggagttctgccgtcagctcccctaggcggccgtaggccaggg

SEQ ID NO: 155065 - DNA, 75 bp, Artificial Sequence
  Synthetic
tagcgacaggagttctgccgtcagctcccctaggcggccgtaggccagggtcctctgggtcgcgtccaggccggg

SEQ ID NO: 155066 - DNA, 75 bp, Artificial Sequence
  Synthetic
acaggaaccggtaggcgaactccaccgaggtctccccctgggtcttcacgaagctgtcgtcgcgcagcacagcct

SEQ ID NO: 155067 - DNA, 75 bp, Artificial Sequence
  Synthetic
cgaggtctccccctgggtcttcacgaagctgtcgtcgcgcagcacagcctcgaaggtccgaaacgtcccgtcgaa

SEQ ID NO: 155068 - DNA, 75 bp, Artificial Sequence
  Synthetic
ggacgtacgtgatgtcgttccgggccacgactagctgttgcttgctgtgcacctcacagcgcacgtgccccgcgt

SEQ ID NO: 155069 - DNA, 75 bp, Artificial Sequence
  Synthetic
cacgactagctgttgcttgctgtgcacctcacagcgcacgtgccccgcgtcctggtcctgactctgggagtagtt

SEQ ID NO: 155070 - DNA, 75 bp, Artificial Sequence
  Synthetic
gttgctgcgtgagccgtcgatactcgtcaaactctttgaccgacacaaacgtgagcacggggagggtaaacacaa

SEQ ID NO: 155071 - DNA, 75 bp, Artificial Sequence
  Synthetic
caaactccccctcgcgagtcacctttaggtaggcgtggagcttggccatgtacgcgctgacctccttgtgggacg

SEQ ID NO: 155072 - DNA, 75 bp, Artificial Sequence
  Synthetic
agaacagccgcgtccaccccggaaggttggccgggttggtgatgtaactttccgggacgacaaagcggtccacaa

SEQ ID NO: 155073 - DNA, 75 bp, Artificial Sequence
  Synthetic
gttggccgggttggtgatgtaactttccgggacgacaaagcggtccacaaactgcatgtgctcctcggtgatggg

SEQ ID NO: 155074 - DNA, 75 bp, Artificial Sequence
  Synthetic
atcgcttgttgttaatgaaaatggcccagctgtgcgagaggcgcgtgtactcgcgtagggtgcggttgcagatga

SEQ ID NO: 155075 - DNA, 75 bp, Artificial Sequence
  Synthetic
ccagctgtgcgagaggcgcgtgtactcgcgtagggtgcggttgcagatgaggtacgtgagcacgttttcgctctg

SEQ ID NO: 155076 - DNA, 75 bp, Artificial Sequence
  Synthetic
ccgtctgggtcggcgaccccacgcacaccagcaccggccgcaggcggcccgcgtactggggggtgtggtacaggg

SEQ ID NO: 155077 - DNA, 75 bp, Artificial Sequence
  Synthetic
cacggtcgtgagtaggtgccgccccaggagcccggcctcgtcgatgacgataatgttgctgcgggtgaaagccgg

SEQ ID NO: 155078 - DNA, 75 bp, Artificial Sequence
  Synthetic
gggcgggcgggggtcgggcgggcggcacgtctcccgcgcccgcggggggtctggggctctgacctgagtgcaggt

SEQ ID NO: 155079 - DNA, 75 bp, Artificial Sequence
  Synthetic
gggggggctaggagccgaaccgatggcccccacacgcgacggaaggcccggaagactaccacggggagggggtgt

SEQ ID NO: 155080 - DNA, 75 bp, Artificial Sequence
  Synthetic
gccccaaagtctgctctagggcggtgagggcgtggaactcgtttcgcgcgtcttcgcccccgtgcgccgccaggg

SEQ ID NO: 155081 - DNA, 75 bp, Artificial Sequence
  Synthetic
gagggcgtggaactcgtttcgcgcgtcttcgcccccgtgcgccgccagggcccgcttggtgatgtcgaggatcac

SEQ ID NO: 155082 - DNA, 75 bp, Artificial Sequence
  Synthetic
cggggggggggcaagtgcagtaacccagttcctcagtgtttgggaaatctattgacctctcccggctcctccggt

SEQ ID NO: 155083 - DNA, 75 bp, Artificial Sequence
  Synthetic
ggctgctggccagggtgtacgggtgctgccccagctgggcctggacgtgattcccgcgaaacccgaactcgtgaa

SEQ ID NO: 155084 - DNA, 75 bp, Artificial Sequence
  Synthetic
ctgccccagctgggcctggacgtgattcccgcgaaacccgaactcgtgaaagatggtgttgatgggtcgactcag

SEQ ID NO: 155085 - DNA, 75 bp, Artificial Sequence
  Synthetic
cagttcctcagtgtttgggaaatctattgacctctcccggctcctccggtgttagggaagtctcttggggaaatc

SEQ ID NO: 155086 - DNA, 75 bp, Artificial Sequence
  Synthetic
cgcccgtgaccacgcagtccaggacctcgttgagggtctgcacgcacgtactctttccggatccggcgttgccgg

SEQ ID NO: 155087 - DNA, 75 bp, Artificial Sequence
  Synthetic
ctcgttgagggtctgcacgcacgtactctttccggatccggcgttgccggtgatgagatacgccgcgaacggaaa

SEQ ID NO: 155088 - DNA, 75 bp, Artificial Sequence
  Synthetic
tcccgtccacgaaggcggcgcccggcctgcgagaaagcgcggatgttgggatcggcgccccggccccccgccccg

SEQ ID NO: 155089 - DNA, 75 bp, Artificial Sequence
  Synthetic
accactgcaggcgcggcacctgcgtgacgtcgagctgctgctgcgagagctctcggatgcgtgcgatgattggtt

SEQ ID NO: 155090 - DNA, 75 bp, Artificial Sequence
  Synthetic
gacgtcgagctgctgctgcgagagctctcggatgcgtgcgatgattggttggaccccgtgcatggacgtaaaatt

SEQ ID NO: 155091 - DNA, 75 bp, Artificial Sequence
  Synthetic
gtgggggcggacctggtgcccggacgtcccgcgagccctccccgccggacgccgccatggccgcacagcgcgcgc

SEQ ID NO: 155092 - DNA, 75 bp, Artificial Sequence
  Synthetic
gtcccgcgagccctccccgccggacgccgccatggccgcacagcgcgcgcgggcgccggcgatgcggacgcgggg

SEQ ID NO: 155093 - DNA, 75 bp, Artificial Sequence
  Synthetic
ccacccccgggacgatgttgttccgcgagattctcctcgggcagatggggtacaccgagggtcagggggtgtaca

SEQ ID NO: 155094 - DNA, 75 bp, Artificial Sequence
  Synthetic
cgagattctcctcgggcagatggggtacaccgagggtcagggggtgtacaacgtcgtccggtccagcgaggccgc

SEQ ID NO: 155095 - DNA, 75 bp, Artificial Sequence
  Synthetic
cgtaccgcgaggacccatccacccactgcagccttatcgcaggtacggtgacccggggggacgggccggggggac

SEQ ID NO: 155096 - DNA, 75 bp, Artificial Sequence
  Synthetic
cgtaccgggacctggaggaggactggcgccgccacgtggtggcccgcggcctccagccgcagcggctggttcgca

SEQ ID NO: 155097 - DNA, 75 bp, Artificial Sequence
  Synthetic
gcgccgccacgtggtggcccgcggcctccagccgcagcggctggttcgcaggtaccggaacgcccgggagggcga

SEQ ID NO: 155098 - DNA, 75 bp, Artificial Sequence
  Synthetic
gtgtggtaactggcgacaaggcgttgccactatggcagacatccccccggacccgcccgcgctcaacacgacgcc

SEQ ID NO: 155099 - DNA, 75 bp, Artificial Sequence
  Synthetic
ggacgacgctgctggactttgcccacggggtggtagactgctttgcgccgggcggcccaagcggaccgaccagct

SEQ ID NO: 155100 - DNA, 75 bp, Artificial Sequence
  Synthetic
cggggtggtagactgctttgcgccgggcggcccaagcggaccgaccagcttccccaaatatatcgactggctgac

SEQ ID NO: 155101 - DNA, 75 bp, Artificial Sequence
  Synthetic
cgcagcgcctgggggcgtttctcaggcagcacacgctgccccggcagctggccacggtcgccggggccgcggagc

SEQ ID NO: 155102 - DNA, 75 bp, Artificial Sequence
  Synthetic
gcagcacacgctgccccggcagctggccacggtcgccggggccgcggagcgcgccggcccggggcttctggagct

SEQ ID NO: 155103 - DNA, 75 bp, Artificial Sequence
  Synthetic
tctactacaaccatcgccggggggagtggctggtgcgcgacccggtcagcgggcagcgcggcgagtgcctggtgc

SEQ ID NO: 155104 - DNA, 75 bp, Artificial Sequence
  Synthetic
gtggctggtgcgcgacccggtcagcgggcagcgcggcgagtgcctggtgctgtgcccccccctgtggaccggcga

SEQ ID NO: 155105 - DNA, 75 bp, Artificial Sequence
  Synthetic
cgtgccacgccctccgggaacacgcgcacatctgccgtctgcgcaacaccgcgtccgtcaaggtgctgttggggc

SEQ ID NO: 155106 - DNA, 75 bp, Artificial Sequence
  Synthetic
gcacatctgccgtctgcgcaacaccgcgtccgtcaaggtgctgttggggcgcaagagcgacagcgagcgcggggt

SEQ ID NO: 155107 - DNA, 75 bp, Artificial Sequence
  Synthetic
gaacgagacagacgaaaacgtaccgccttgtgtggtttattcgggggtcgggcgggggtcggggtcgggcggggg

SEQ ID NO: 155108 - DNA, 75 bp, Artificial Sequence
  Synthetic
ccttgtgtggtttattcgggggtcgggcgggggtcggggtcgggcgggggtcggggtcgggcgggggtcggggtc

SEQ ID NO: 155109 - DNA, 75 bp, Artificial Sequence
  Synthetic
gccccggcgtccgcgggcgccgcgcccccgtcggcgtctccgtcgtcccaggccgcggtcgccgccgccgcctcc

SEQ ID NO: 155110 - DNA, 75 bp, Artificial Sequence
  Synthetic
cgaaggccggctcggccgcctcgcgtctcgtgcggctcatcatcaacatgaagggcatgcgccacgtgggcgaca

SEQ ID NO: 155111 - DNA, 75 bp, Artificial Sequence
  Synthetic
tcaacgacacggtacgcgcctacttggacgaggcgggggggcacctgatcgacacccccgccgtcgaccacaccc

SEQ ID NO: 155112 - DNA, 75 bp, Artificial Sequence
  Synthetic
cctcctcctcctcctcctcctcctccgcctcttcctctgcgggcggggctggtgggagcgtcgcgtccgcgtccg

SEQ ID NO: 155113 - DNA, 75 bp, Artificial Sequence
  Synthetic
aggggctgctgcgagctcggggccgcgggcgcggggggaggggcgggggaagcccccggggcggggcgcgggggg

SEQ ID NO: 155114 - DNA, 75 bp, Artificial Sequence
  Synthetic
ccgggggcgcgaccgcagcagcttcgccaggcgtttcagacggccgtggtcaacaacatcaacggcatgctggag

SEQ ID NO: 155115 - DNA, 75 bp, Artificial Sequence
  Synthetic
gccaggcgtttcagacggccgtggtcaacaacatcaacggcatgctggagggctatatcaataatctctttggaa

SEQ ID NO: 155116 - DNA, 75 bp, Artificial Sequence
  Synthetic
ggaaagcagccctgcggcgcgcgggggggaggggctgctgcgagctcggcgggatggaggggagggtagggaggg

SEQ ID NO: 155117 - DNA, 75 bp, Artificial Sequence
  Synthetic
gcgcgcgaccgcgagctgcggcgcgcccaggcgggggcgctggagcgggagcagcgcgcggcggaccgggcggcc

SEQ ID NO: 155118 - DNA, 75 bp, Artificial Sequence
  Synthetic
cccaggcgggggcgctggagcgggagcagcgcgcggcggaccgggcggccgggggaggcgcgggccgcccggcgg

SEQ ID NO: 155119 - DNA, 75 bp, Artificial Sequence
  Synthetic
actgtcgtctttagggggcggggagctcgggagtttttggtggtccgcgaggtagccgagtgaggagggggcctg

SEQ ID NO: 155120 - DNA, 75 bp, Artificial Sequence
  Synthetic
atggacgacgacacgtacgtggccaacagtttccagcaccagtacatccccgcgtacggccaggacctcgagcgc

SEQ ID NO: 155121 - DNA, 75 bp, Artificial Sequence
  Synthetic
acagtttccagcaccagtacatccccgcgtacggccaggacctcgagcgcctgtcgcgcctctgggagcacgagc

SEQ ID NO: 155122 - DNA, 75 bp, Artificial Sequence
  Synthetic
acgtcgatctcgtactctagcggggcgatcgcctccttcgtggccccgtatttcgagtacgtgcttcgcgccccc

SEQ ID NO: 155123 - DNA, 75 bp, Artificial Sequence
  Synthetic
cgatcgcctccttcgtggccccgtatttcgagtacgtgcttcgcgccccccgagcgggcgcgctcatcaccggct

SEQ ID NO: 155124 - DNA, 75 bp, Artificial Sequence
  Synthetic
ccgatcccaacatccgcgctttctcgcaggccgggcgccgccttcgtggacgggacaccggtgtggtaactggcg

SEQ ID NO: 155125 - DNA, 75 bp, Artificial Sequence
  Synthetic
acccgcctgcagacgtacctgacagacgtcgcggccctgttcgtggcggacgtacagcacgcggctctgccccgg

SEQ ID NO: 155126 - DNA, 75 bp, Artificial Sequence
  Synthetic
ggccgccctgccgcccgcccgccgccgccgcccgccttcgcgccccccccccaaaaacacccccccgggggttga

SEQ ID NO: 155127 - DNA, 75 bp, Artificial Sequence
  Synthetic
taccgccttgtgtggtttattcgggggtcgggcgggggtcgggcgggcgggggtcgggcgggcgggggtcggggt

SEQ ID NO: 155128 - DNA, 75 bp, Artificial Sequence
  Synthetic
gggcgtcgaacgcagggatggccgaccccacgcccgccgatgagggaacggccgccgccatcctcaaacaggcca

SEQ ID NO: 155129 - DNA, 75 bp, Artificial Sequence
  Synthetic
ccccacgcccgccgatgagggaacggccgccgccatcctcaaacaggccattgccggggaccgcagtctggtcga

SEQ ID NO: 155130 - DNA, 75 bp, Artificial Sequence
  Synthetic
ctccggctccgggcctacgccgagcccagccgccggcgtccccgccgccggggtccccggcgccggccgcgcccc

SEQ ID NO: 155131 - DNA, 75 bp, Artificial Sequence
  Synthetic
tgcgccaggtcagcgatcgccagccgcggtttaccgcgaccagcgtcctgcgcgttgacgtcacccccagggggc

SEQ ID NO: 155132 - DNA, 75 bp, Artificial Sequence
  Synthetic
gcggtttaccgcgaccagcgtcctgcgcgttgacgtcacccccagggggcggttgcggttcgttctggacgggag

SEQ ID NO: 155133 - DNA, 75 bp, Artificial Sequence
  Synthetic
accagccgacgtatcgcggttttgcggtcgtcgtcctcacggccaacgaggaccacgtgcacagcctggccgtgc

SEQ ID NO: 155134 - DNA, 75 bp, Artificial Sequence
  Synthetic
ggtcgtcgtcctcacggccaacgaggaccacgtgcacagcctggccgtgccccccctcgttctgctgcaccggct

SEQ ID NO: 155135 - DNA, 75 bp, Artificial Sequence
  Synthetic
tgatgtacctggagaactgtccccggagccacgccacgccctcgctgttcgtcaaggtgtcggcgtggttggggg

SEQ ID NO: 155136 - DNA, 75 bp, Artificial Sequence
  Synthetic
gagccacgccacgccctcgctgttcgtcaaggtgtcggcgtggttgggggtcgtggcccgccacgcgtctccctt

SEQ ID NO: 155137 - DNA, 75 bp, Artificial Sequence
  Synthetic
cgcccgccttcgcgcccccccccaaaaaacaccccccccgggggttgactccccgggggaaaagaggcggggcgg

SEQ ID NO: 155138 - DNA, 75 bp, Artificial Sequence
  Synthetic
cgctaatgtgcatggcgggcgtgaagcccttcgacgacgagctagtcctgccccactggtacatggcccactacc

SEQ ID NO: 155139 - DNA, 75 bp, Artificial Sequence
  Synthetic
gcccttcgacgacgagctagtcctgccccactggtacatggcccactacctgctggccaacaatccgccccccgt

SEQ ID NO: 155140 - DNA, 75 bp, Artificial Sequence
  Synthetic
ccccgaccccctgacccgaccccctgacccgaccccctgacccgaccccctgacccgaccccctgacccccgtgt

SEQ ID NO: 155141 - DNA, 75 bp, Artificial Sequence
  Synthetic
ccgggcccgtcccccgcacggactgtgtggcctataacccggccggcgtcatgggaagctgctggaaatccaagg

SEQ ID NO: 155142 - DNA, 75 bp, Artificial Sequence
  Synthetic
tgtggcctataacccggccggcgtcatgggaagctgctggaaatccaaggacctgcgttcggctctggtgtattg

SEQ ID NO: 155143 - DNA, 75 bp, Artificial Sequence
  Synthetic
aaaaccacaaccggcgcgtgccagtaaatacggacgcgcgcacacgcggggggtaagttggagcacggggccccg

SEQ ID NO: 155144 - DNA, 75 bp, Artificial Sequence
  Synthetic
ccgcgaccggttccggcgccgcgtggcggcggccgaggcggtcatcggaccgtgcctggagcccgaggcccgagc

SEQ ID NO: 155145 - DNA, 75 bp, Artificial Sequence
  Synthetic
gggtaagttggagcacggggccccggtttattgaccaaattcagggaaacagaaaccgcatcttttcctcgaaag

SEQ ID NO: 155146 - DNA, 75 bp, Artificial Sequence
  Synthetic
ggtacacaaagctcccgccctcgccccacacgccttccagaacccccgtaaacaccagttgaatctcgcgcagga

SEQ ID NO: 155147 - DNA, 75 bp, Artificial Sequence
  Synthetic
tctcgcgcaggtgatgggcgcagtccacgggggggagcaccaagggccgcgggtacagatccacggggacgccga

SEQ ID NO: 155148 - DNA, 75 bp, Artificial Sequence
  Synthetic
tccgcgtccagcagggcgcctccgcggaaggccgtttggggcagggggtcgtcggcctcgcccgggggggtcaga

SEQ ID NO: 155149 - DNA, 75 bp, Artificial Sequence
  Synthetic
ggaaggccgtttggggcagggggtcgtcggcctcgcccgggggggtcagaacgctccagtactccgcgtccagac

SEQ ID NO: 155150 - DNA, 75 bp, Artificial Sequence
  Synthetic
ccccgggccgcgcacacggcctcctccggcgggccggcggccggccgccggaggattcgtctcagcgcgtcgcgc

SEQ ID NO: 155151 - DNA, 75 bp, Artificial Sequence
  Synthetic
ccggcgggccggcggccggccgccggaggattcgtctcagcgcgtcgcgcataacctcggccgccgcggcgtacg

SEQ ID NO: 155152 - DNA, 75 bp, Artificial Sequence
  Synthetic
ttccagaaccacgccccggtctggctccaggtgacgacgtgggtgtagacgccctctagcgccagggagggggcg

SEQ ID NO: 155153 - DNA, 75 bp, Artificial Sequence
  Synthetic
tccaggtgacgacgtgggtgtagacgccctctagcgccagggagggggcgaggcgcgggcgtatgccgttggccg

SEQ ID NO: 155154 - DNA, 75 bp, Artificial Sequence
  Synthetic
gcgccgtgcgcggcgtccgcgtccccggggtccacgttgaacagcccccagaacgcagccccggtgccgccgcag

SEQ ID NO: 155155 - DNA, 75 bp, Artificial Sequence
  Synthetic
cggggtccacgttgaacagcccccagaacgcagccccggtgccgccgcagaccgcaaacttcaccgagctggccg

SEQ ID NO: 155156 - DNA, 75 bp, Artificial Sequence
  Synthetic
cggagcgcggggcaggcgtcgcacgcgtccggcaccaggcgctccagcacggcccgggcccagggctccgagggg

SEQ ID NO: 155157 - DNA, 75 bp, Artificial Sequence
  Synthetic
cgtccggcaccaggcgctccagcacggcccgggcccagggctccgagggggcggccgccaccagcgcgtccagcc

SEQ ID NO: 155158 - DNA, 75 bp, Artificial Sequence
  Synthetic
cccgcgagggcggccaggagctgggcctggagcccggagaaacaaaaccgcgccgtccagaccggcccgacggcc

SEQ ID NO: 155159 - DNA, 75 bp, Artificial Sequence
  Synthetic
cctggagcccggagaaacaaaaccgcgccgtccagaccggcccgacggccgccggggggtcgagtagttggatgg

SEQ ID NO: 155160 - DNA, 75 bp, Artificial Sequence
  Synthetic
aggcggccggccgcctccgaggccacggccggccatgcccgcgggggcaggacgaccctggcgcccaccgcgggc

SEQ ID NO: 155161 - DNA, 75 bp, Artificial Sequence
  Synthetic
cggccggccatgcccgcgggggcaggacgaccctggcgcccaccgcgggccaggcccccaggcacgcggcatggg

SEQ ID NO: 155162 - DNA, 75 bp, Artificial Sequence
  Synthetic
gccggcacggtaaacgtgggccagcccggaaatcccagcacggcaaagtattggacgggccctccccggacctca

SEQ ID NO: 155163 - DNA, 75 bp, Artificial Sequence
  Synthetic
ccggaaatcccagcacggcaaagtattggacgggccctccccggacctcaaacccgggccccagaaaagcgaaga

SEQ ID NO: 155164 - DNA, 75 bp, Artificial Sequence
  Synthetic
aagagggcgaccagcgccggggcggagaacccgtcgccggcgctcacgaagtagtcgtagccgcgcggcagcagc

SEQ ID NO: 155165 - DNA, 75 bp, Artificial Sequence
  Synthetic
gcacacctcgaccaggtccgcgaaggcgccctccttcctggtcggcggaaacgccagggtggtgtattcgcgcgc

SEQ ID NO: 155166 - DNA, 75 bp, Artificial Sequence
  Synthetic
gtgacggcgagcgaggcggaggacgcgcactgggggctgtcgcgaatggcggccaggcgcgcccacgccaaccgc

SEQ ID NO: 155167 - DNA, 75 bp, Artificial Sequence
  Synthetic
cgcactgggggctgtcgcgaatggcggccaggcgcgcccacgccaaccgcgcgccggggtgctcggcgacgcgcg

SEQ ID NO: 155168 - DNA, 75 bp, Artificial Sequence
  Synthetic
gcggcgcgaggagcggccggcgggccccacgacgccctttcgaccctcacgaccagacccgtctgcgggtcccag

SEQ ID NO: 155169 - DNA, 75 bp, Artificial Sequence
  Synthetic
cccacgacgccctttcgaccctcacgaccagacccgtctgcgggtcccagcccaggcgcagcgggacgaagaggg

SEQ ID NO: 155170 - DNA, 75 bp, Artificial Sequence
  Synthetic
gcccgccacagggtcgggtcccccaggggctccagcggggaggcggccggggccgtcgcggcgcgggcggccgcg

SEQ ID NO: 155171 - DNA, 75 bp, Artificial Sequence
  Synthetic
ggggctccagcggggaggcggccggggccgtcgcggcgcgggcggccgcgacggccccggcggccgagacgtcgg

SEQ ID NO: 155172 - DNA, 75 bp, Artificial Sequence
  Synthetic
cgcgcccccgtcggcgtctccgtcgtcccaggccgcggtcgccgccgccgcctcctcttcctcctcctcctcctc

SEQ ID NO: 155173 - DNA, 75 bp, Artificial Sequence
  Synthetic
ggcgcggagtcgacgtgaagcgcgagagaggaagcccacgaagtcacagcggacactgggaggtgggtgtttgta

SEQ ID NO: 155174 - DNA, 75 bp, Artificial Sequence
  Synthetic
aagcgcgcgcgcgcctcccccgcggcgtcgcgacagaccagatacagcagggcgtggaggcagtcgcgcgtgcgc

SEQ ID NO: 155175 - DNA, 75 bp, Artificial Sequence
  Synthetic
cgtcgcgacagaccagatacagcagggcgtggaggcagtcgcgcgtgcgcgggggcagccataccgcgtataggg

SEQ ID NO: 155176 - DNA, 75 bp, Artificial Sequence
  Synthetic
ccacgacgcccgggggttgccgtgtatcgaacgagcgcggccccagacttatagggtgctaaagttcaccgcccc

SEQ ID NO: 155177 - DNA, 75 bp, Artificial Sequence
  Synthetic
atcgaacgagcgcggccccagacttatagggtgctaaagttcaccgccccctgcatcatgggccaggcctcggtg

SEQ ID NO: 155178 - DNA, 75 bp, Artificial Sequence
  Synthetic
gccggaggcgtgcgtgcgcaagcagcgcccccacgcgggcgcgcgcagcttgaagcgcgcgcccgcaaactcccg

SEQ ID NO: 155179 - DNA, 75 bp, Artificial Sequence
  Synthetic
agctgtctgtgcgtccggcaggcgctgtggtcgatgcggtgggcgtccagcagctccacgatggctcgcttggtg

SEQ ID NO: 155180 - DNA, 75 bp, Artificial Sequence
  Synthetic
cagctccacgatggctcgcttggtgaggtttttaacgcgccccgccccgggaaacgtctgcgtgctcttggccag

SEQ ID NO: 155181 - DNA, 75 bp, Artificial Sequence
  Synthetic
aggtttttaacgcgccccgccccgggaaacgtctgcgtgctcttggccagctgcaccccgaacagttcgccccag

SEQ ID NO: 155182 - DNA, 75 bp, Artificial Sequence
  Synthetic
cggggggcagccgctcagggcgtcggccacgcgcttaaccgcgtcctccgacagcaaggggccgtcggtcacgtt

SEQ ID NO: 155183 - DNA, 75 bp, Artificial Sequence
  Synthetic
gccacgcgcttaaccgcgtcctccgacagcaaggggccgtcggtcacgttacagtggcccagttcgaacaccagc

SEQ ID NO: 155184 - DNA, 75 bp, Artificial Sequence
  Synthetic
gctaaaggttcgccccgaccccccggccatcgagtcccactgcaggcacgcggccatggtgctgcacagacggaa

SEQ ID NO: 155185 - DNA, 75 bp, Artificial Sequence
  Synthetic
gccatcgagtcccactgcaggcacgcggccatggtgctgcacagacggaacagctcccagacgggggcgacgttt

SEQ ID NO: 155186 - DNA, 75 bp, Artificial Sequence
  Synthetic
ggggatgacgcccgtggcgtagtggtcgtaaagccgccggaagatggcgctgctatgggcggccatggggacgcg

SEQ ID NO: 155187 - DNA, 75 bp, Artificial Sequence
  Synthetic
ccaaatgtcacgataagaacaataaacctgtgacgtcaatcggatatgtgagtttggttgtgttttgtgggactg

SEQ ID NO: 155188 - DNA, 75 bp, Artificial Sequence
  Synthetic
tcgtaaagccgccggaagatggcgctgctatgggcggccatggggacgcgaagacaggcctccagcagcaccagg

SEQ ID NO: 155189 - DNA, 75 bp, Artificial Sequence
  Synthetic
gttttgttgaggcgggacactcggtcgtgtttcgcgagccgtagctgccggcccgatgggccgcggtgcgtactg

SEQ ID NO: 155190 - DNA, 75 bp, Artificial Sequence
  Synthetic
gaccacctcggccggcgcgacgtccggccggaggtacttttcgacgaaaaggcccacctcctccgtctcggcggc

SEQ ID NO: 155191 - DNA, 75 bp, Artificial Sequence
  Synthetic
cccgccccccgtccccccggcccgtccccccgtccccccgtccccccgcccgtccccccggcccgtccccccggc

SEQ ID NO: 155192 - DNA, 75 bp, Artificial Sequence
  Synthetic
tcctggcagcgcagctcccgcagatcccgctgggccctcagggcatcaaaatgtatcccccgcaaaaacagacaa

SEQ ID NO: 155193 - DNA, 75 bp, Artificial Sequence
  Synthetic
cgtggccccagaaccgcacgtgcatgcagttgagggtcagaagcatgtggaggatgttaagactgtccgcgaggc

SEQ ID NO: 155194 - DNA, 75 bp, Artificial Sequence
  Synthetic
gcagttgagggtcagaagcatgtggaggatgttaagactgtccgcgaggcacgccagcgtgcacctctcgaagta

SEQ ID NO: 155195 - DNA, 75 bp, Artificial Sequence
  Synthetic
ccccgggtcaccgtacctgcgataaggctgcagtgggtggatgggtcctcgcggtacgtacagggtggggggggg

SEQ ID NO: 155196 - DNA, 75 bp, Artificial Sequence
  Synthetic
cgtcggcgtgcgacgcgtcgcagcgccctttgaaccggcggcacaacaggttcgtcacctgggaaaactgtgccg

SEQ ID NO: 155197 - DNA, 75 bp, Artificial Sequence
  Synthetic
ccctttgaaccggcggcacaacaggttcgtcacctgggaaaactgtgccggccactgcccgctggcgctcaccac

SEQ ID NO: 155198 - DNA, 75 bp, Artificial Sequence
  Synthetic
cgtccatgtagatcagcagctcccccttgcggagagtccgtacccgccccagcgactggtacacggacaccatgt

SEQ ID NO: 155199 - DNA, 75 bp, Artificial Sequence
  Synthetic
cttgcggagagtccgtacccgccccagcgactggtacacggacaccatgtccggcccgtagttcatgggtttcac

SEQ ID NO: 155200 - DNA, 75 bp, Artificial Sequence
  Synthetic
tcacgaccgttgtgtagatgaccacccggtaccggccccatgtggtcacgtcgccgggcggggtgagcgagtgga

SEQ ID NO: 155201 - DNA, 75 bp, Artificial Sequence
  Synthetic
ccggtaccggccccatgtggtcacgtcgccgggcggggtgagcgagtggagcagcagcacgcggtccgtaaactg

SEQ ID NO: 155202 - DNA, 75 bp, Artificial Sequence
  Synthetic
tgcagacgttatctccgccggccaggcgcgcctccagctccccgaagaaggtggcgtccgggggggcgtccgggg

SEQ ID NO: 155203 - DNA, 75 bp, Artificial Sequence
  Synthetic
ccaccccgaacccggaccgtcgccccgccgcgcggcccgggttcgggtggcacggtgggccggaggagaacgaag

SEQ ID NO: 155204 - DNA, 75 bp, Artificial Sequence
  Synthetic
caggctgttttcgtcggagcgcacggcggcgaaaaaatcaaagagtctgcggtgggacgccacctcgatcgtact

SEQ ID NO: 155205 - DNA, 75 bp, Artificial Sequence
  Synthetic
tcgggccccaggcgcgggagaaacagacaacggcgcgccgaaaatccgggcatggcgtactccccgatgaccacg

SEQ ID NO: 155206 - DNA, 75 bp, Artificial Sequence
  Synthetic
gacaacggcgcgccgaaaatccgggcatggcgtactccccgatgaccacgtgaacgttcttttcgccccggaggc

SEQ ID NO: 155207 - DNA, 75 bp, Artificial Sequence
  Synthetic
catggcgtactccccgatgaccacgtgaacgttcttttcgccccggaggctgcacagaaagtccaccagctgcgc

SEQ ID NO: 155208 - DNA, 75 bp, Artificial Sequence
  Synthetic
gcagcatcaacgcgtcgacgcggcccagctgctgcatcgtcggcgagtacagttggcccaacgtcgacatgactt

SEQ ID NO: 155209 - DNA, 75 bp, Artificial Sequence
  Synthetic
cagctgctgcatcgtcggcgagtacagttggcccaacgtcgacatgacttcgtccaggacaagcacgtcgtagtt

SEQ ID NO: 155210 - DNA, 75 bp, Artificial Sequence
  Synthetic
gacggtggaaggggcggtcgttcatgatgtaattggtggatgagaagtaggtgacgaagtcgggcaaccctgact

SEQ ID NO: 155211 - DNA, 75 bp, Artificial Sequence
  Synthetic
gatgtaattggtggatgagaagtaggtgacgaagtcgggcaaccctgactcagcgaaccgcgtcgccagggtctg

SEQ ID NO: 155212 - DNA, 75 bp, Artificial Sequence
  Synthetic
cccaccccgcccgcacacctgcccgccacgcccgcccctcctcaccctggctgcgggaaaggaggaggagcagga

SEQ ID NO: 155213 - DNA, 75 bp, Artificial Sequence
  Synthetic
ggatcgcttcccccaaccagcggatcagcgcggtagtttttcccgagcccattggcgcgcggaccacagttacgc

SEQ ID NO: 155214 - DNA, 75 bp, Artificial Sequence
  Synthetic
cagcgcggtagtttttcccgagcccattggcgcgcggaccacagttacgcaccgggccgtcggggcgctcgcgtc

SEQ ID NO: 155215 - DNA, 75 bp, Artificial Sequence
  Synthetic
ggacccggggaacccactcggccaaatcccccccgtaaagcatccgcgccagcgatacactcgacgtgtactgct

SEQ ID NO: 155216 - DNA, 75 bp, Artificial Sequence
  Synthetic
atcccccccgtaaagcatccgcgccagcgatacactcgacgtgtactgctcgcactcgtcatccccgatgggacg

SEQ ID NO: 155217 - DNA, 75 bp, Artificial Sequence
  Synthetic
ccggggcgcgggcggcgtggtgggtctggtgtgtgcaggtggcgacgttcatcgtctcggccatctgcgtcgtgg

SEQ ID NO: 155218 - DNA, 75 bp, Artificial Sequence
  Synthetic
ctggtgtgtgcaggtggcgacgttcatcgtctcggccatctgcgtcgtggggctcctggtgctggcctctgtgtt

SEQ ID NO: 155219 - DNA, 75 bp, Artificial Sequence
  Synthetic
cgaacgccacggtcgaggtgcgcgggggtgtagccgtccccctccggttggacacgcagagcctgctggccacgt

SEQ ID NO: 155220 - DNA, 75 bp, Artificial Sequence
  Synthetic
ggcggcggccgtgtacgccgcggtgggcgcggtgacctcgcgctacgagcgcgcgctggatgcggcccgtcgcct

SEQ ID NO: 155221 - DNA, 75 bp, Artificial Sequence
  Synthetic
tctgcgcgtggctgttgcagatcacagtcctgctgctggcccatcgcatcagccagctggcccaccttatctacg

SEQ ID NO: 155222 - DNA, 75 bp, Artificial Sequence
  Synthetic
agccagctggcccaccttatctacgtcctgcactttgcgtgcctcgtgtatctcgcggcccatttttgcaccagg

SEQ ID NO: 155223 - DNA, 75 bp, Artificial Sequence
  Synthetic
gtcaggttcacggcctgattgacccggcgccgacgcaccatcgtatcgtcggtccggtgcgggcagtaatgacaa

SEQ ID NO: 155224 - DNA, 75 bp, Artificial Sequence
  Synthetic
ggcgccgacgcaccatcgtatcgtcggtccggtgcgggcagtaatgacaaacgccttattactgggcaccctcct

SEQ ID NO: 155225 - DNA, 75 bp, Artificial Sequence
  Synthetic
gggtcccccggcggacggctcacgcggcgcggcgtctcggtgggacgcgggcagagggcggcggcggcggggggg

SEQ ID NO: 155226 - DNA, 75 bp, Artificial Sequence
  Synthetic
tcaacttttccgccccgagcatgctcatctgcctgacgacgctgttcgccctgcttgtcgtgtcgctgttgttgg

SEQ ID NO: 155227 - DNA, 75 bp, Artificial Sequence
  Synthetic
catctgcctgacgacgctgttcgccctgcttgtcgtgtcgctgttgttggtggtcgagggggtgctgtgtcacta

SEQ ID NO: 155228 - DNA, 75 bp, Artificial Sequence
  Synthetic
tcgtcggcctggcctgcgagcactaccacaccggtggctactacgtggtggagcagcagtggccgggggcccaga

SEQ ID NO: 155229 - DNA, 75 bp, Artificial Sequence
  Synthetic
ccacaccggtggctactacgtggtggagcagcagtggccgggggcccagacgggagtccgcgtcgccctggcgct

SEQ ID NO: 155230 - DNA, 75 bp, Artificial Sequence
  Synthetic
acctgtatcaccggcgacaccacactaaatttttcgtgcgcatgcgcgacacccggcaccgcgcccattcggcgc

SEQ ID NO: 155231 - DNA, 75 bp, Artificial Sequence
  Synthetic
taaatttttcgtgcgcatgcgcgacacccggcaccgcgcccattcggcgcttcgacgcgtacgcagctccatgcg

SEQ ID NO: 155232 - DNA, 75 bp, Artificial Sequence
  Synthetic
cctacgcgagcgtgtcccaccacgccgagatcgaccggtatggggattccgacggggacccgatctacgacgaag

SEQ ID NO: 155233 - DNA, 75 bp, Artificial Sequence
  Synthetic
cgagatcgaccggtatggggattccgacggggacccgatctacgacgaagtggcccccgaccacgaggccgagct

SEQ ID NO: 155234 - DNA, 75 bp, Artificial Sequence
  Synthetic
acgacaccgtggaggggtatgcgccaaggtccgcgggggagccggtgtacagcaccgttcggcgatggtagccgt

SEQ ID NO: 155235 - DNA, 75 bp, Artificial Sequence
  Synthetic
agcaccgttcggcgatggtagccgtttcgttcgttttaataaaccgacgttgtgcgtttcaccatacttcggcgc

SEQ ID NO: 155236 - DNA, 75 bp, Artificial Sequence
  Synthetic
cttttctttcggccaccacccccctcctcccccgtactatacaacaaaaaataccacacatacgaccaaatacgg

SEQ ID NO: 155237 - DNA, 75 bp, Artificial Sequence
  Synthetic
cctcccccgtactatacaacaaaaaataccacacatacgaccaaatacggacaatcatttctgtctttattcgct

SEQ ID NO: 155238 - DNA, 75 bp, Artificial Sequence
  Synthetic
cccgccgtctggtgtgacgcgatggggggtccgatgcgcgccggtactggggccccggcgcccgggtgaccacgc

SEQ ID NO: 155239 - DNA, 75 bp, Artificial Sequence
  Synthetic
ggggtccgatgcgcgccggtactggggccccggcgcccgggtgaccacgcgcatgtcggggggcacgtagaagtt

SEQ ID NO: 155240 - DNA, 75 bp, Artificial Sequence
  Synthetic
gcgagacgacctccccgccgtcggtgatgatgacgttgtgtcggcagcagcagggccgcgccccggagaacgcga

SEQ ID NO: 155241 - DNA, 75 bp, Artificial Sequence
  Synthetic
gatgatgacgttgtgtcggcagcagcagggccgcgccccggagaacgcgaggcccataacttggcgagcgtatcg

SEQ ID NO: 155242 - DNA, 75 bp, Artificial Sequence
  Synthetic
gacgcggacgggggtgatgatcagggcgatcggaacggcctggtccgggaggatcgatgccttggcgggtccggg

SEQ ID NO: 155243 - DNA, 75 bp, Artificial Sequence
  Synthetic
ggccccgccacgcccggcgggcgctccgcggccgtcctccaggcggaacgtcacgccctcctccgcgcccgcgcg

SEQ ID NO: 155244 - DNA, 75 bp, Artificial Sequence
  Synthetic
gtgcctgccgaggaacgtcaccaggtgcggttgcagggggcagtcgggaaagtggctgtcgaggacgtatccctg

SEQ ID NO: 155245 - DNA, 75 bp, Artificial Sequence
  Synthetic
tgcggttgcagggggcagtcgggaaagtggctgtcgaggacgtatccctgcaccaagatctgtttgaagttcggg

SEQ ID NO: 155246 - DNA, 75 bp, Artificial Sequence
  Synthetic
taccgccttgtgtggtttattcgggggtcggggtcgggcgggggtcggggtcgggcgggggtcggggtcgggcgg

SEQ ID NO: 155247 - DNA, 75 bp, Artificial Sequence
  Synthetic
ccaggccacgggagagatggtgcgacgctcgaggtcggggacgccaaacagaagcacctccgagacaacgccgct

SEQ ID NO: 155248 - DNA, 75 bp, Artificial Sequence
  Synthetic
cgctcgaggtcggggacgccaaacagaagcacctccgagacaacgccgctatttaactccaccagcgcccgatcc

SEQ ID NO: 155249 - DNA, 75 bp, Artificial Sequence
  Synthetic
ggtcgggccggggtcgggcgggggtcggggtcgggcgggggtcggggtcgggcgggggtcggggtcgggcggggg

SEQ ID NO: 155250 - DNA, 75 bp, Artificial Sequence
  Synthetic
ccggtcttgggtgacgagcgcctcctccgggcccgggacgcgcccgggcgcgaagtagcgcacgccggggttggg

SEQ ID NO: 155251 - DNA, 75 bp, Artificial Sequence
  Synthetic
tccgggcccgggacgcgcccgggcgcgaagtagcgcacgccggggttggggatggaccggatgaacgcccggaac

SEQ ID NO: 155252 - DNA, 75 bp, Artificial Sequence
  Synthetic
aggggggcagtgcagtaccccagttcctccgtgctggggaaatctctctgccgggtacgggctccagacgaagga

SEQ ID NO: 155253 - DNA, 75 bp, Artificial Sequence
  Synthetic
gggtcggggtcgggcgggggtcggggtcgggcggcggcacgtctcccgcgcccgcggggggtctggggctctgac

SEQ ID NO: 155254 - DNA, 75 bp, Artificial Sequence
  Synthetic
gggcggggcggtggggcggggccggggtcgcggcggggaaggaaggaaaggccccggaagcgccgggagggggcg

SEQ ID NO: 155255 - DNA, 75 bp, Artificial Sequence
  Synthetic
ggcgccggggtccgcggggtcgaacgcgtacttggctcggcacttaacctcgtagaaggccaggggggtctgggg

SEQ ID NO: 155256 - DNA, 75 bp, Artificial Sequence
  Synthetic
gcgtacttggctcggcacttaacctcgtagaaggccaggggggtctggggggcgggggccaggtagccgtgaggg

SEQ ID NO: 155257 - DNA, 75 bp, Artificial Sequence
  Synthetic
gccgtccatgaggaccccgcacgcgtgcacgttctcctcggcgaggtccccgggttggtgaaagacgaagcgccc

SEQ ID NO: 155258 - DNA, 75 bp, Artificial Sequence
  Synthetic
gcgtccgcgcggcccacgcagtagcgaaacagcaggtttcgggccgtcggctcgttcacccgcccgaacatcacc

SEQ ID NO: 155259 - DNA, 75 bp, Artificial Sequence
  Synthetic
ctcgttcacccgcccgaacatcaccgccgacgactgggcgtccagccgcaggctggcgttgtgggtgagccactg

SEQ ID NO: 155260 - DNA, 75 bp, Artificial Sequence
  Synthetic
gccgacgactgggcgtccagccgcaggctggcgttgtgggtgagccactgggacgagaagcacggaccctgcgcg

SEQ ID NO: 155261 - DNA, 75 bp, Artificial Sequence
  Synthetic
gagctggcagtcggcctggttttgcgtcgccgcctcgtaaaatcccataagcgggcggggggcgacggcttcggc

SEQ ID NO: 155262 - DNA, 75 bp, Artificial Sequence
  Synthetic
gtcgccgcctcgtaaaatcccataagcgggcggggggcgacggcttcggcggcggacgggggggcgcggcgcgtc

SEQ ID NO: 155263 - DNA, 75 bp, Artificial Sequence
  Synthetic
gatcggggccccggccccccgtcccggccccccggcccgtccccccggcccgtccccccgtccccccggcccgtc

SEQ ID NO: 155264 - DNA, 75 bp, Artificial Sequence
  Synthetic
cccccgggggttgactccccgggggaaaggaggcggggcggagtccccgtcctgccgccgccccttaagagggcc

SEQ ID NO: 155265 - DNA, 75 bp, Artificial Sequence
  Synthetic
cagcgacacgacgagggagcacagatagtccaggcgagcccacaggggcccgatggccagaggggagcggacgcc

SEQ ID NO: 155266 - DNA, 75 bp, Artificial Sequence
  Synthetic
gcgcagcaggccgcgcaggtggcgctcgaacgtttccgccaagatatgggggggcagtgcgttggggatcgccga

SEQ ID NO: 155267 - DNA, 75 bp, Artificial Sequence
  Synthetic
cgatggcgtgtgcgccccccggcgagaggggaatgtcgggggttggcgggccggatgaggcctcagagagggccg

SEQ ID NO: 155268 - DNA, 75 bp, Artificial Sequence
  Synthetic
cggggccccgccgtcgggttgcccacgtggggggctctggggccaatgggaacccggggcccccggtgacgtggg

SEQ ID NO: 155269 - DNA, 75 bp, Artificial Sequence
  Synthetic
tgggtcggggccgcttcgggggactatcggggtcgcgggcggggtccgcggggcgcttggcgccgggtgttgcgg

SEQ ID NO: 155270 - DNA, 75 bp, Artificial Sequence
  Synthetic
atcggggtcgcgggcggggtccgcggggcgcttggcgccgggtgttgcggcggccgccatttttacgagcagccg

SEQ ID NO: 155271 - DNA, 75 bp, Artificial Sequence
  Synthetic
gggttggcgtgacagaggcgggagaccagcaccagcagcggcctcagctcgggcggcagcgacaccgacgacagg

SEQ ID NO: 155272 - DNA, 75 bp, Artificial Sequence
  Synthetic
ccagcaccagcagcggcctcagctcgggcggcagcgacaccgacgacaggacggccttgtgcgtgcgctggtaat

SEQ ID NO: 155273 - DNA, 75 bp, Artificial Sequence
  Synthetic
cgccggatgccctccggcacgtcatacgccaggccgtgggtgttggtctcggccgagttgacaaagagggcgggg

SEQ ID NO: 155274 - DNA, 75 bp, Artificial Sequence
  Synthetic
acgccaggccgtgggtgttggtctcggccgagttgacaaagagggcggggtgcagaacgcagcgataggcgagga

SEQ ID NO: 155275 - DNA, 75 bp, Artificial Sequence
  Synthetic
gggacgcgggtcacggggacgcccaggctcggggccacgtacacgctaaccagcagctccagcagcgtctgcccc

SEQ ID NO: 155276 - DNA, 75 bp, Artificial Sequence
  Synthetic
cagcagctccagcagcgtctgccccagggcgtagagatcgaccgccagcccgacgtcgtgcttcagggggcggtt

SEQ ID NO: 155277 - DNA, 75 bp, Artificial Sequence
  Synthetic
gctggttgtacccgtgccccaccagagtgtgaaagttggccgtggtcagggcggcgggcatcccaaacccccggg

SEQ ID NO: 155278 - DNA, 75 bp, Artificial Sequence
  Synthetic
agtgtgaaagttggccgtggtcagggcggcgggcatcccaaacccccggggggactcgaggtccggctcctggag

SEQ ID NO: 155279 - DNA, 75 bp, Artificial Sequence
  Synthetic
taaagtcggccaggacggcccgccggagcgacaccgcgtccgatcgcagcatcacgaggacgttggcgcacttga

SEQ ID NO: 155280 - DNA, 75 bp, Artificial Sequence
  Synthetic
gagcgacaccgcgtccgatcgcagcatcacgaggacgttggcgcacttgatgtccaggtggctgatcccgcacct

SEQ ID NO: 155281 - DNA, 75 bp, Artificial Sequence
  Synthetic
gggccgtcgcgacggagggggtggtcgcgcgcagggacgccagctggccgatgtacttgccgaggtccatgtcgt

SEQ ID NO: 155282 - DNA, 75 bp, Artificial Sequence
  Synthetic
ataaagccgcggatgtcgtgggtgcggccgccgcgaagagcgcactcccccacgagcagggtcgcgacgagctcc

SEQ ID NO: 155283 - DNA, 75 bp, Artificial Sequence
  Synthetic
tggtcttcacggcgagcttgtgttcgcgaatcaactgcacctcgccgtacccccccgagcccccgaagctgcggg

SEQ ID NO: 155284 - DNA, 75 bp, Artificial Sequence
  Synthetic
gcgaatcaactgcacctcgccgtacccccccgagcccccgaagctgcgggccccggggatctccagggtcgtgta

SEQ ID NO: 155285 - DNA, 75 bp, Artificial Sequence
  Synthetic
gcgcgagggacaggatgtgcgaggggggcgacgggggcgaggtcatggccgtctcggacctgcgcaggggcgggc

SEQ ID NO: 155286 - DNA, 75 bp, Artificial Sequence
  Synthetic
gggcgacgggggcgaggtcatggccgtctcggacctgcgcaggggcgggcgcctcagcttggccgcagggccggg

SEQ ID NO: 155287 - DNA, 75 bp, Artificial Sequence
  Synthetic
acagtcccgcgcgaagccgctcccggaagctggatcggcggcgggacccggggcgggctccggagacggcgccgt

SEQ ID NO: 155288 - DNA, 75 bp, Artificial Sequence
  Synthetic
gaagctggatcggcggcgggacccggggcgggctccggagacggcgccgtctcggggggaggggccgcttgggcg

SEQ ID NO: 155289 - DNA, 75 bp, Artificial Sequence
  Synthetic
tgaaggagcgtcggtgtgcaccttgggggctgatgtcagctgccacatgactagcaggtcgctgtcgcccggact

SEQ ID NO: 155290 - DNA, 75 bp, Artificial Sequence
  Synthetic
ggggctgatgtcagctgccacatgactagcaggtcgctgtcgcccggactcatccatccgtccgccaggtcgccg

SEQ ID NO: 155291 - DNA, 75 bp, Artificial Sequence
  Synthetic
gtccgcaagacgatcgtccgccgcgtccaggcgctcgctaagcgcgggatcgaggtaccgtcggtgtgcggttag

SEQ ID NO: 155292 - DNA, 75 bp, Artificial Sequence
  Synthetic
tccaggcgctcgctaagcgcgggatcgaggtaccgtcggtgtgcggttagaaaatcacgtcgcgccgcttgctct

SEQ ID NO: 155293 - DNA, 75 bp, Artificial Sequence
  Synthetic
cgcgcgggactttagccgcgcctccaattccaagtgggccgccttggcggccataaaggcgccaacaaacctagg

SEQ ID NO: 155294 - DNA, 75 bp, Artificial Sequence
  Synthetic
tgtagctgcagggtctggtccctgtacacctcggcccggaggtgcgtctcggccaaacgtcggcgcagggccgcg

SEQ ID NO: 155295 - DNA, 75 bp, Artificial Sequence
  Synthetic
actccttcgccccgacccccctgacctcagccgcccccgcctcgcccgcgatgtttggccagcagctggcgtccg

SEQ ID NO: 155296 - DNA, 75 bp, Artificial Sequence
  Synthetic
ctcagccgcccccgcctcgcccgcgatgtttggccagcagctggcgtccgacgtgcagcagtacctggagcgcct

SEQ ID NO: 155297 - DNA, 75 bp, Artificial Sequence
  Synthetic
ctggccgacggtgagggcgggcgggggtcgggcactgggcgggggtcgggcactgggcgggggtcgggcactggg

SEQ ID NO: 155298 - DNA, 75 bp, Artificial Sequence
  Synthetic
tgacgctcggcggcgatgcgctgcgcgtcccttttttggattttgccaccgcgacgcccaagcgccaccagaccg

SEQ ID NO: 155299 - DNA, 75 bp, Artificial Sequence
  Synthetic
cgtcccttttttggattttgccaccgcgacgcccaagcgccaccagaccgtggtcccgggcgtcgggacgctcca

SEQ ID NO: 155300 - DNA, 75 bp, Artificial Sequence
  Synthetic
ccccgcatttaagtatcaccccagtgccgccccaaacctcgtgacttccccaccgctccgggcggcccgtccccc

SEQ ID NO: 155301 - DNA, 75 bp, Artificial Sequence
  Synthetic
tgtttaatagcctggtgccggcgcaactcagggggcgtgactttgggggcgaccacacggccaagctggagttcc

SEQ ID NO: 155302 - DNA, 75 bp, Artificial Sequence
  Synthetic
actcagggggcgtgactttgggggcgaccacacggccaagctggagttcctggcccccgagctggtgcgggcggt

SEQ ID NO: 155303 - DNA, 75 bp, Artificial Sequence
  Synthetic
ggccgacgagcgcgcggtgcccgccggctacggcgccgcgggggtgctcgccgccctggggcgcctgagcgccgc

SEQ ID NO: 155304 - DNA, 75 bp, Artificial Sequence
  Synthetic
gcaacgcctactacagcgtcctgaacacgtttcaggccctgcaccgctccgaagcctttcggcagttggttcact

SEQ ID NO: 155305 - DNA, 75 bp, Artificial Sequence
  Synthetic
cgcgcccgccacgagcggggcctgtttatgggccgggcgtcccgatgagtactgttgtttccgccgcccgaaccc

SEQ ID NO: 155306 - DNA, 75 bp, Artificial Sequence
  Synthetic
cacgtttcaggccctgcaccgctccgaagcctttcggcagttggttcacttcgtgcgggacttcgcccagttgtt

SEQ ID NO: 155307 - DNA, 75 bp, Artificial Sequence
  Synthetic
ccggcggtggtggcggcggccggcgcgcggaggcgggccgcgtggccgtggagtgcctggccgcctgccgcggga

SEQ ID NO: 155308 - DNA, 75 bp, Artificial Sequence
  Synthetic
agaaacgggccaaggtggacgtggccacccacgggcagacgtacggcaccttggagctcttccagaaaatgatac

SEQ ID NO: 155309 - DNA, 75 bp, Artificial Sequence
  Synthetic
cgtgtgtgtggtttcccgggaagccacatcccaccccatgaagttttgccctttttttccgtcccgcactacgcc

SEQ ID NO: 155310 - DNA, 75 bp, Artificial Sequence
  Synthetic
cacccacgggcagacgtacggcaccttggagctcttccagaaaatgatactaatgcacgcgacctactttctggc

SEQ ID NO: 155311 - DNA, 75 bp, Artificial Sequence
  Synthetic
tcgtgttcgagatccccctgtttagcgacacggccgtgcggcacttccgccagcgcgccaccgtgtttctagtcc

SEQ ID NO: 155312 - DNA, 75 bp, Artificial Sequence
  Synthetic
cgacacggccgtgcggcacttccgccagcgcgccaccgtgtttctagtccccaggcgccacggaaagacctggtt

SEQ ID NO: 155313 - DNA, 75 bp, Artificial Sequence
  Synthetic
taggctacacggcccacatccgcaaggcgaccgagcccgtgtttgatgagatcgacgcctgcctgcggggctggt

SEQ ID NO: 155314 - DNA, 75 bp, Artificial Sequence
  Synthetic
ggcgaccgagcccgtgtttgatgagatcgacgcctgcctgcggggctggtttggctcgtcccgggtggaccacgt

SEQ ID NO: 155315 - DNA, 75 bp, Artificial Sequence
  Synthetic
tcgtgtttgcctccagccacaacacgaacgtaagtacgccttcctcccgcggtgcctgtttccccggtgccgccc

SEQ ID NO: 155316 - DNA, 75 bp, Artificial Sequence
  Synthetic
ggtgcctgtttccccggtgccgccctccccgagatcgaccgacagacaaacacagccagacgcgagtgtgggacg

SEQ ID NO: 155317 - DNA, 75 bp, Artificial Sequence
  Synthetic
tttgtaatcggacgatgaggctctggccacggcccgcgcgaccgcggggcagctcgttgcaaacaggcggctggt

SEQ ID NO: 155318 - DNA, 75 bp, Artificial Sequence
  Synthetic
gccacggcccgcgcgaccgcggggcagctcgttgcaaacaggcggctggtatacgatgacagaacgcagaggcgc

SEQ ID NO: 155319 - DNA, 75 bp, Artificial Sequence
  Synthetic
gacgacctcgtgcaggtgggccgtgatgcgcgggcggcgggtcgcctgccgcaggataaccgcgtccacggggtg

SEQ ID NO: 155320 - DNA, 75 bp, Artificial Sequence
  Synthetic
atgcgcgggcggcgggtcgcctgccgcaggataaccgcgtccacggggtgcccgaagaggagctgacacaggctc

SEQ ID NO: 155321 - DNA, 75 bp, Artificial Sequence
  Synthetic
cggggcgacgcagggacaggcctccgccacggcgggggcgcgccacagcgcgttggcggaatcgatgtgggccgt

SEQ ID NO: 155322 - DNA, 75 bp, Artificial Sequence
  Synthetic
gccacggcgggggcgcgccacagcgcgttggcggaatcgatgtgggccgtcggggcgcaggcgccgcctcctccc

SEQ ID NO: 155323 - DNA, 75 bp, Artificial Sequence
  Synthetic
gcccgggggacagagcgaccccaggtcatcatccatggcccagcagtatatgcggccgccggggaggtgccacca

SEQ ID NO: 155324 - DNA, 75 bp, Artificial Sequence
  Synthetic
tcatcatccatggcccagcagtatatgcggccgccggggaggtgccaccaggcccccggacccagggcacagcac

SEQ ID NO: 155325 - DNA, 75 bp, Artificial Sequence
  Synthetic
ccccctgacccccctccgaccccctgacccccctccgacccccgtgtctccccgcccgcaggtgtgcttctcgcc

SEQ ID NO: 155326 - DNA, 75 bp, Artificial Sequence
  Synthetic
ctcgtgggccacgggctcgtccgcgagctgttcggcggcggggtcgggggtttcctccgggggggaggcagcttc

SEQ ID NO: 155327 - DNA, 75 bp, Artificial Sequence
  Synthetic
agctgttcggcggcggggtcgggggtttcctccgggggggaggcagcttccaggtggccgaaggctagggtgcac

SEQ ID NO: 155328 - DNA, 75 bp, Artificial Sequence
  Synthetic
gtagcggcgctcgcggttaaagaagaaaatggcaaagaacgtgttcgaaggcaggcgcagcgccttgggccgcgt

SEQ ID NO: 155329 - DNA, 75 bp, Artificial Sequence
  Synthetic
aaaatggcaaagaacgtgttcgaaggcaggcgcagcgccttgggccgcgtcaggtacaggaagatctcgcagaaa

SEQ ID NO: 155330 - DNA, 75 bp, Artificial Sequence
  Synthetic
ggtgaggaccgtgaggcaccgaaaaatcttaagccgctcgtccccccgaacgacgcgccacacgaagacagagtt

SEQ ID NO: 155331 - DNA, 75 bp, Artificial Sequence
  Synthetic
atcttaagccgctcgtccccccgaacgacgcgccacacgaagacagagttggcgatgcgcgcgacgaggtcggct

SEQ ID NO: 155332 - DNA, 75 bp, Artificial Sequence
  Synthetic
aggggcgcggcgggacgggggaagacgaggagaagggaaggggcgagggtcgggcccgggagcggggcggccggg

SEQ ID NO: 155333 - DNA, 75 bp, Artificial Sequence
  Synthetic
cggcggggccgcggctcccggggggcctggcgtcgcctggggacgccagagtgcccgctgtgccaggttggtggt

SEQ ID NO: 155334 - DNA, 75 bp, Artificial Sequence
  Synthetic
cctggcgtcgcctggggacgccagagtgcccgctgtgccaggttggtggtggggaagggaccggagacgcaccaa

SEQ ID NO: 155335 - DNA, 75 bp, Artificial Sequence
  Synthetic
ggaacaaaagcacgcgtcagcggacaaggccgggtcccgtagccgccccgcgacagaaccggagtccgacggcac

SEQ ID NO: 155336 - DNA, 75 bp, Artificial Sequence
  Synthetic
aaggccgggtcccgtagccgccccgcgacagaaccggagtccgacggcacgcgcgacggggtctgcgaggctgag

SEQ ID NO: 155337 - DNA, 75 bp, Artificial Sequence
  Synthetic
gcccgcagaggcggcgattgaacccaaggcagaggtacgcgtagctctctcccggaaggtattgctcgcagaccc

SEQ ID NO: 155338 - DNA, 75 bp, Artificial Sequence
  Synthetic
aaggcagaggtacgcgtagctctctcccggaaggtattgctcgcagaccctgtgcggggcagtggaggggctgcc

SEQ ID NO: 155339 - DNA, 75 bp, Artificial Sequence
  Synthetic
tcaccactgcgattggacggttggtgaggcgcagcgtgtctccgctggtgctgtagtagtcaaacgcgtagtggg

SEQ ID NO: 155340 - DNA, 75 bp, Artificial Sequence
  Synthetic
gaggcgcagcgtgtctccgctggtgctgtagtagtcaaacgcgtagtgggcgtcggagtcggcgaagcgggcggg

SEQ ID NO: 155341 - DNA, 75 bp, Artificial Sequence
  Synthetic
ggccgcccagatgcgccagcacggccagggcgtacgcggtgtgaaagaacgcgtcgggggcggtcccctcgaggg

SEQ ID NO: 155342 - DNA, 75 bp, Artificial Sequence
  Synthetic
cagggcgtacgcggtgtgaaagaacgcgtcgggggcggtcccctcgagggcgcgcatcaggttctccaggagcac

SEQ ID NO: 155343 - DNA, 75 bp, Artificial Sequence
  Synthetic
agtcgtagcgcaggcgctggaagatgcgcgggccgccttggagcgcggcccggatagagtggcccagggcccgca

SEQ ID NO: 155344 - DNA, 75 bp, Artificial Sequence
  Synthetic
gcgcgggccgccttggagcgcggcccggatagagtggcccagggcccgcagacacgcgatctggatgcgcgcgac

SEQ ID NO: 155345 - DNA, 75 bp, Artificial Sequence
  Synthetic
ggcgcaggggtccctcgagcgcgggaaagcgacgcagcagcgccgtctgggccgcgggggacagctggtgggggc

SEQ ID NO: 155346 - DNA, 75 bp, Artificial Sequence
  Synthetic
gccgcgggggacagctggtgggggcgcacgacgcgctcggcggcacaggcctccgtcagggccgtggccagctcg

SEQ ID NO: 155347 - DNA, 75 bp, Artificial Sequence
  Synthetic
ctcgtaggagacgacgacgaagcgctgcttggtcccgtagtgatggcgcaggaccacggagatggagcgacggct

SEQ ID NO: 155348 - DNA, 75 bp, Artificial Sequence
  Synthetic
ccggccagagcttcccacccgcggtccagccactcgaccagcgatcgcggcttggcggtccccggcacgagggtg

SEQ ID NO: 155349 - DNA, 75 bp, Artificial Sequence
  Synthetic
ggcaaagcgccccccgccgggcggctccaggcccgccagcaccgcctccgcgtccgacgcgcccagggctccccc

SEQ ID NO: 155350 - DNA, 75 bp, Artificial Sequence
  Synthetic
tccaggcccgccagcaccgcctccgcgtccgacgcgcccagggctcccccgctgacggcctggtggaccagggcg

SEQ ID NO: 155351 - DNA, 75 bp, Artificial Sequence
  Synthetic
gcggaccgggtggcggcgggtgacgtcctgcacggcccgctggaccagcgcgaggatctcctcgttctcttgcgt

SEQ ID NO: 155352 - DNA, 75 bp, Artificial Sequence
  Synthetic
tcctgcacggcccgctggaccagcgcgaggatctcctcgttctcttgcgtgatggacacgtcctccgcggtggcc

SEQ ID NO: 155353 - DNA, 75 bp, Artificial Sequence
  Synthetic
tggggtgccgacaacggccggcccggccccgcccgagaccgaggacgcctggggagtgggggtgccgctttcccc

SEQ ID NO: 155354 - DNA, 75 bp, Artificial Sequence
  Synthetic
gccccgcccgagaccgaggacgcctggggagtgggggtgccgctttcccccatccccagggacaggtgggccgcc

SEQ ID NO: 155355 - DNA, 75 bp, Artificial Sequence
  Synthetic
acaaaagtggcgacagaggcgcatgaggcgcgcgccgtcggccgcgtatcgcgtgtttggcgggacgagctcgtc

SEQ ID NO: 155356 - DNA, 75 bp, Artificial Sequence
  Synthetic
aggcgcgcgccgtcggccgcgtatcgcgtgtttggcgggacgagctcgtcgtaactgaacaggagcacgcgggcg

SEQ ID NO: 155357 - DNA, 75 bp, Artificial Sequence
  Synthetic
cgggggtcgggcgggggtcgggcgggggtcgggcactaaccgggggtcgggcgggggtcgggcgggggtcgggcg

SEQ ID NO: 155358 - DNA, 75 bp, Artificial Sequence
  Synthetic
gtcgtacacgccttgggcgtcgcacgcgaccggcagggagacgaacagcccgcccgcgctggggacgcgcggcag

SEQ ID NO: 155359 - DNA, 75 bp, Artificial Sequence
  Synthetic
gcgaccggcagggagacgaacagcccgcccgcgctggggacgcgcggcaggaggtccgggtgcgccgggatgacg

SEQ ID NO: 155360 - DNA, 75 bp, Artificial Sequence
  Synthetic
ggcgagggcgggcggtgagggcgggcgggggtcgggcgggggtcgggaaccgggggtcgggcgggggtcgggcac

SEQ ID NO: 155361 - DNA, 75 bp, Artificial Sequence
  Synthetic
cgaacgccacggggtgcagtcgccggtcgcgtgggcccgggtctgggtttcgacccggaagttcgcggccgcccc

SEQ ID NO: 155362 - DNA, 75 bp, Artificial Sequence
  Synthetic
gggtcgggcactaaccgggggttcccgtctctgtctccctctgcagtggactacgtcccgcccgccccccgaaga

SEQ ID NO: 155363 - DNA, 75 bp, Artificial Sequence
  Synthetic
cgggcgggggtcgggcactaaccgggggtcgggcactaaccgggggttcccgtctctgtctccctctgcagtgga

SEQ ID NO: 155364 - DNA, 75 bp, Artificial Sequence
  Synthetic
gcggacagcgggacccccgccgccgccaggcactcgctggagatgatgacgtgaatcagcgaggcggggctgctc

SEQ ID NO: 155365 - DNA, 75 bp, Artificial Sequence
  Synthetic
gtgaatcagcgaggcggggctgctcgggtcccgggtgagatcgtattggacctcgttggcaaagtgcgcgttcat

SEQ ID NO: 155366 - DNA, 75 bp, Artificial Sequence
  Synthetic
ggcccggccggcggtgcgagcccttcccggtgccggaaggggcgtgggtggggggtgcgtgtgcgcgtcctcggg

SEQ ID NO: 155367 - DNA, 75 bp, Artificial Sequence
  Synthetic
gggggtgcgtgtgcgcgtcctcggggcccgcgggcgcacgtgcgcttatacgctgtgtgtttcgtctgtccccag

SEQ ID NO: 155368 - DNA, 75 bp, Artificial Sequence
  Synthetic
ggaatccggggccaggactttaacctgcttttcgtcgacgaggccaactttattcgcccggatgcggtccagacg

SEQ ID NO: 155369 - DNA, 75 bp, Artificial Sequence
  Synthetic
tgcttttcgtcgacgaggccaactttattcgcccggatgcggtccagacgattatgggctttctcaatcaggcca

SEQ ID NO: 155370 - DNA, 75 bp, Artificial Sequence
  Synthetic
agctttttgtacaacctccgcggggccgccgacgagctgctcaacgtggtcacctatatatgcgacgaccacatg

SEQ ID NO: 155371 - DNA, 75 bp, Artificial Sequence
  Synthetic
ccgccgacgagctgctcaacgtggtcacctatatatgcgacgaccacatgccgcgggtggtgacgcacaccaacg

SEQ ID NO: 155372 - DNA, 75 bp, Artificial Sequence
  Synthetic
gacggcgccgttcgccggacggccgatctgtttctgcccgactccttcatgcaggagatcatcggggggcaggcc

SEQ ID NO: 155373 - DNA, 75 bp, Artificial Sequence
  Synthetic
atctgtttctgcccgactccttcatgcaggagatcatcggggggcaggcccgcgagaccggcgacgaccggcccg

SEQ ID NO: 155374 - DNA, 75 bp, Artificial Sequence
  Synthetic
accaccaacagcggcctgatggcccccgagctgtacgtgtacgtggacccggcgttcacggccaacacgcgcgcc

SEQ ID NO: 155375 - DNA, 75 bp, Artificial Sequence
  Synthetic
ccgagctgtacgtgtacgtggacccggcgttcacggccaacacgcgcgcctccggcaccggcatcgcggtcgtcg

SEQ ID NO: 155376 - DNA, 75 bp, Artificial Sequence
  Synthetic
cgcgcgctcacgggatcggcccccgcggacatcgcccgctgcgtcgtgcacagcctcgcccaggtgctggcgctg

SEQ ID NO: 155377 - DNA, 75 bp, Artificial Sequence
  Synthetic
cggacatcgcccgctgcgtcgtgcacagcctcgcccaggtgctggcgctgcaccccggggcgtttcgcagcgttc

SEQ ID NO: 155378 - DNA, 75 bp, Artificial Sequence
  Synthetic
gcccccgtcggcgtctccgtcgtcccaggccgcggtcgccgccgccgcctcctcctcctcctccgcctcttcctc

SEQ ID NO: 155379 - DNA, 75 bp, Artificial Sequence
  Synthetic
acacacgtgcataccgagatgcaccgcatcctggcctcggcgggggccaacggcccggggcccgagctcctcttc

SEQ ID NO: 155380 - DNA, 75 bp, Artificial Sequence
  Synthetic
cggtattgtaccccttctttctgctcaacaaacagaagacgcccgccttcgaatactttatcaaaaagttcaact

SEQ ID NO: 155381 - DNA, 75 bp, Artificial Sequence
  Synthetic
ccgggggcgtcatggcgtcccaggagctcgtctccgtgacggtgcgcctgcagaccgacccggtcgagtatctgt

SEQ ID NO: 155382 - DNA, 75 bp, Artificial Sequence
  Synthetic
gctcgtctccgtgacggtgcgcctgcagaccgacccggtcgagtatctgtccgagcagctcaacaacctcatcga

SEQ ID NO: 155383 - DNA, 75 bp, Artificial Sequence
  Synthetic
gtgccgcggacgacctcatggtcgcggtcatcatggccatttacctggcggccccgaccgggatccccccggcct

SEQ ID NO: 155384 - DNA, 75 bp, Artificial Sequence
  Synthetic
gccccgaccgggatccccccggccttttttccgatcacgcgcacgtcttgagtctttcttgccgtttcttttgtt

SEQ ID NO: 155385 - DNA, 75 bp, Artificial Sequence
  Synthetic
agtctttcttgccgtttcttttgtttctctttctttccccccctctctccgcaataaacgccttcccggaactgt

SEQ ID NO: 155386 - DNA, 75 bp, Artificial Sequence
  Synthetic
ggggtgggcgggggaagcaagaaaacggtcggcgaacacaacatcgggaaaacggattcccgaacgtgcgtcttc

SEQ ID NO: 155387 - DNA, 75 bp, Artificial Sequence
  Synthetic
gacgcctatccctgttattttttcaaaagcgcctgtcggccccgcgcgccgcccgtctgtgcgggcgacgggccc

SEQ ID NO: 155388 - DNA, 75 bp, Artificial Sequence
  Synthetic
gggtagcggataaccggggccatgtcgccggattgcacaacggcggcgccgtcgaacgtacacacccgaaccgcc

SEQ ID NO: 155389 - DNA, 75 bp, Artificial Sequence
  Synthetic
cgccggattgcacaacggcggcgccgtcgaacgtacacacccgaaccgccggggccagggccaggatgtccccga

SEQ ID NO: 155390 - DNA, 75 bp, Artificial Sequence
  Synthetic
ctgcgctcgccgtcctgcatcagcatgggggcttcggggtggatgagctgggcggcttctcgcgtgacgctctgc

SEQ ID NO: 155391 - DNA, 75 bp, Artificial Sequence
  Synthetic
tgggggcttcggggtggatgagctgggcggcttctcgcgtgacgctctgcatctgcaggagcgcgttcacgtatc

SEQ ID NO: 155392 - DNA, 75 bp, Artificial Sequence
  Synthetic
gtggttccttcggttatggagtagaccatgttgaggacgagcgaccgcagctcggtgtttacggaggcgagttgc

SEQ ID NO: 155393 - DNA, 75 bp, Artificial Sequence
  Synthetic
ccatgttgaggacgagcgaccgcagctcggtgtttacggaggcgagttgctggacgtcggccacgagcgagagac

SEQ ID NO: 155394 - DNA, 75 bp, Artificial Sequence
  Synthetic
cgggggtcggggttgaggtcccggatgccccgggcgaccagccgcgcgactatctcgcgggccaggggcgttggg

SEQ ID NO: 155395 - DNA, 75 bp, Artificial Sequence
  Synthetic
tgccccgggcgaccagccgcgcgactatctcgcgggccaggggcgttgggagcgggaccggaaaccgcagcgtga

SEQ ID NO: 155396 - DNA, 75 bp, Artificial Sequence
  Synthetic
gggacgaggctgacgggatccccgttgcagaggtcgacgggggaggtgttgcggagattgacggtgccggcgtgc

SEQ ID NO: 155397 - DNA, 75 bp, Artificial Sequence
  Synthetic
tgcagaggtcgacgggggaggtgttgcggagattgacggtgccggcgtgcgtgagccccaggtccacggggcagg

SEQ ID NO: 155398 - DNA, 75 bp, Artificial Sequence
  Synthetic
cggtacgccagcaacaaccccaacgtgtcgggactaactcctccggagacgaacgattcgtgcgccacgtccgcg

SEQ ID NO: 155399 - DNA, 75 bp, Artificial Sequence
  Synthetic
tgtcgggactaactcctccggagacgaacgattcgtgcgccacgtccgcgagcgccagctggcggcggatggtcg

SEQ ID NO: 155400 - DNA, 75 bp, Artificial Sequence
  Synthetic
ccgtgtgggagagggggcggggcagggctcagcagcacgcacggggaggtctgtcgtgcgcaggagccccaggtg

SEQ ID NO: 155401 - DNA, 75 bp, Artificial Sequence
  Synthetic
tggagggcgtggtgtggcgccccggcgggtggcgggcctgcgcgtgatcgtctattgacgacggccgcccaaccc

SEQ ID NO: 155402 - DNA, 75 bp, Artificial Sequence
  Synthetic
gggaaagctggggaagaagaagccaattttacagagacaggccctttagcggggaggcgtcgtagatgagatact

SEQ ID NO: 155403 - DNA, 75 bp, Artificial Sequence
  Synthetic
attttacagagacaggccctttagcggggaggcgtcgtagatgagatactgcgtaaagtgggtctctcgcgcgtg

SEQ ID NO: 155404 - DNA, 75 bp, Artificial Sequence
  Synthetic
cttaatggaagggcgtggggccggccgccggatgcccgcgggggcctaatgcggcgggaggcgtgggccgctggc

SEQ ID NO: 155405 - DNA, 75 bp, Artificial Sequence
  Synthetic
tgatcgggtaggcttcctgaaacaggccgcacgggtcttccacgagctcgcggcaccccggcgggcgcttaaact

SEQ ID NO: 155406 - DNA, 75 bp, Artificial Sequence
  Synthetic
gccgcacgggtcttccacgagctcgcggcaccccggcgggcgcttaaactgcacgtcgctggcagcggtggccgt

SEQ ID NO: 155407 - DNA, 75 bp, Artificial Sequence
  Synthetic
tggccgtgatgtcggccgcggtgaagaacttgaagcaggggctgaggacgggcgaggccccgttgaggtgatagg

SEQ ID NO: 155408 - DNA, 75 bp, Artificial Sequence
  Synthetic
gaacttgaagcaggggctgaggacgggcgaggccccgttgaggtgataggccccgttgtacagcaggtccccgta

SEQ ID NO: 155409 - DNA, 75 bp, Artificial Sequence
  Synthetic
ccgggtcgctctggccgtggtcgtacatgagggctatgacgtccccctccttgtcccccgcgtacacgccgccgg

SEQ ID NO: 155410 - DNA, 75 bp, Artificial Sequence
  Synthetic
catgagggctatgacgtccccctccttgtcccccgcgtacacgccgccggccgcgcgtccccgcgggttgcaggg

SEQ ID NO: 155411 - DNA, 75 bp, Artificial Sequence
  Synthetic
acacggcatcctgcccgtggtccatgccggcgcgccgcggcacctgggcgcagccaaagaccgggaggggctggg

SEQ ID NO: 155412 - DNA, 75 bp, Artificial Sequence
  Synthetic
gccctgacggagctgtatttcatcctgcggcggggctcggcccccaaaaacgcggaaccagcggcccccaggggg

SEQ ID NO: 155413 - DNA, 75 bp, Artificial Sequence
  Synthetic
gccggcgcgccgcggcacctgggcgcagccaaagaccgggaggggctgggccggccccagccggtttcccgccac

SEQ ID NO: 155414 - DNA, 75 bp, Artificial Sequence
  Synthetic
ccccgcggccgaggtaaaagttttgggggaggttgcccatgtccgtaacggggttgcggacggtggccgtggccg

SEQ ID NO: 155415 - DNA, 75 bp, Artificial Sequence
  Synthetic
ggggaggttgcccatgtccgtaacggggttgcggacggtggccgtggccgcgacggcggtgtagcccacacccag

SEQ ID NO: 155416 - DNA, 75 bp, Artificial Sequence
  Synthetic
tttcgtggcgggccacctggagctggcccagaaagtacgcctccgacgcgcgctcggaaaacagcacgttctcgg

SEQ ID NO: 155417 - DNA, 75 bp, Artificial Sequence
  Synthetic
gcccagaaagtacgcctccgacgcgcgctcggaaaacagcacgttctcggtcacgaagcggtcctgccgcacgac

SEQ ID NO: 155418 - DNA, 75 bp, Artificial Sequence
  Synthetic
ccacggggctcatcttgaagtaccccgccatgagcgcgtaggtcagcgcgttctcccccgccgcgctctcgcggg

SEQ ID NO: 155419 - DNA, 75 bp, Artificial Sequence
  Synthetic
gcccccctgccgggcggggcggtggggcggggccggggtcgcggcggggaaggaaggaaagaccccggaagcgcc

SEQ ID NO: 155420 - DNA, 75 bp, Artificial Sequence
  Synthetic
cgccatgagcgcgtaggtcagcgcgttctcccccgccgcgctctcgcgggcgtgctgcaccacgggctggcggat

SEQ ID NO: 155421 - DNA, 75 bp, Artificial Sequence
  Synthetic
aggaaggaaagaccccggaagcgccgggagggggcgcgcgcggcggccgggagggggcgcgcgcggcggccgggc

SEQ ID NO: 155422 - DNA, 75 bp, Artificial Sequence
  Synthetic
gcgccaggtcgcgcagggccggggggaagttgggcgcgttggccacgtggtcggcgcccgcaaacagcgcgtgga

SEQ ID NO: 155423 - DNA, 75 bp, Artificial Sequence
  Synthetic
gaagttgggcgcgttggccacgtggtcggcgcccgcaaacagcgcgtggacgggcaggacgtagaagtattcgcc

SEQ ID NO: 155424 - DNA, 75 bp, Artificial Sequence
  Synthetic
cgtgcagcgccccgtcgaagatgcgcatgttggccgtcgacgcggtgttggcgcccgcgtcgggcgccgcggagc

SEQ ID NO: 155425 - DNA, 75 bp, Artificial Sequence
  Synthetic
gcgcccgcgtcgggcgccgcggagcacagcagcgccgtcgtgcgctcggccatgttgtgcgccagcacctgcagc

SEQ ID NO: 155426 - DNA, 75 bp, Artificial Sequence
  Synthetic
tttaaggacgcggtaaaccgccactacatctacgacacgcaaggggcggccatcgccggctccaacctctgcacg

SEQ ID NO: 155427 - DNA, 75 bp, Artificial Sequence
  Synthetic
gttgaccgtgttggccaccagattggcgggatgcagcgggtgggcggggtcggtcacgggatcgctcgggcactc

SEQ ID NO: 155428 - DNA, 75 bp, Artificial Sequence
  Synthetic
gcgggatgcagcgggtgggcggggtcggtcacgggatcgctcgggcactcctcgccgggggcgatctccgggacc

SEQ ID NO: 155429 - DNA, 75 bp, Artificial Sequence
  Synthetic
gcagcagcgcccccgcgagaaggccggcaccagcacgtaatagtagattttgtggtggacggtccagtcggccgg

SEQ ID NO: 155430 - DNA, 75 bp, Artificial Sequence
  Synthetic
ccggtgcggccggtcgtcggcggcgtcggccgcgcgggcctgggtgttgtgcagcagccggccgtcgttgcggtt

SEQ ID NO: 155431 - DNA, 75 bp, Artificial Sequence
  Synthetic
cccccgcgtcaatccggcagtctcggtggcggtccagggccgcgtgtcgcataaggccgtcgcagtcccacacga

SEQ ID NO: 155432 - DNA, 75 bp, Artificial Sequence
  Synthetic
gtggcggtccagggccgcgtgtcgcataaggccgtcgcagtcccacacgaggggcggcagcagcgccgggtcgcg

SEQ ID NO: 155433 - DNA, 75 bp, Artificial Sequence
  Synthetic
gcagggtaaagtcgtccaccagctgggccagggcctcgacgtgggccaccaggtcccgatacacggccatgcact

SEQ ID NO: 155434 - DNA, 75 bp, Artificial Sequence
  Synthetic
ggccagggcctcgacgtgggccaccaggtcccgatacacggccatgcactcctcggggaggtcgcccccgaggta

SEQ ID NO: 155435 - DNA, 75 bp, Artificial Sequence
  Synthetic
gcgtgttgttccagtagctggtgatgcactgagtcacgagccgcgccagggcgcagaacacgtgctcgctgccgt

SEQ ID NO: 155436 - DNA, 75 bp, Artificial Sequence
  Synthetic
gcactgagtcacgagccgcgccagggcgcagaacacgtgctcgctgccgtgaatcgcggcttgcagcaggtaaaa

SEQ ID NO: 155437 - DNA, 75 bp, Artificial Sequence
  Synthetic
tagccggcgccatggcgtggcggccaacgccgagctccaggccccgggcgtcacgaaacgccaccggacacagcg

SEQ ID NO: 155438 - DNA, 75 bp, Artificial Sequence
  Synthetic
aacgccgagctccaggccccgggcgtcacgaaacgccaccggacacagcgccaggggcaggttgccgttgaccac

SEQ ID NO: 155439 - DNA, 75 bp, Artificial Sequence
  Synthetic
cgggaagctcgacgtcggccacgcccgcgaagaagtcgaacgcggggtgcagctccagagccaggttggcgttgt

SEQ ID NO: 155440 - DNA, 75 bp, Artificial Sequence
  Synthetic
cgcgaagaagtcgaacgcggggtgcagctccagagccaggttggcgttgtcgggctgcatgaactgctccgcggt

SEQ ID NO: 155441 - DNA, 75 bp, Artificial Sequence
  Synthetic
gccaggcgttcagaaaacgctgctgcatgtccgcgccggggccggccggggccgcgacgtacgccccgtacggat

SEQ ID NO: 155442 - DNA, 75 bp, Artificial Sequence
  Synthetic
catgtccgcgccggggccggccggggccgcgacgtacgccccgtacggattcgcggcctcgacggggtcgtggtt

SEQ ID NO: 155443 - DNA, 75 bp, Artificial Sequence
  Synthetic
tcccgaccgcgttctccatggacagccgcagaacctggtggtcctttccccaaaaaaacagctgccggggaggga

SEQ ID NO: 155444 - DNA, 75 bp, Artificial Sequence
  Synthetic
ccgcagaacctggtggtcctttccccaaaaaaacagctgccggggagggaacgcgcggggctccgggtggccggg

SEQ ID NO: 155445 - DNA, 75 bp, Artificial Sequence
  Synthetic
tgaacagccccaggggcaggacgaacgtcaggtccatggcgcccaccagggggtagggcacgttggtggcggcgt

SEQ ID NO: 155446 - DNA, 75 bp, Artificial Sequence
  Synthetic
gaagaccagcctgtcgcctatggccaccagatccgcgcgcacgcgcgttgtctggggggcgctttcgagttcatc

SEQ ID NO: 155447 - DNA, 75 bp, Artificial Sequence
  Synthetic
tctggggggcgctttcgagttcatccagcgtctcccggttcgcctcgagttgctcctcctgcatctccagcaggt

SEQ ID NO: 155448 - DNA, 75 bp, Artificial Sequence
  Synthetic
cagcgtctcccggttcgcctcgagttgctcctcctgcatctccagcaggtggcggcccacgtcgtccaggctccg

SEQ ID NO: 155449 - DNA, 75 bp, Artificial Sequence
  Synthetic
ccatctcgccgtaggtcaccggcacgtcggcctcggtgtcctccaccttcaggaaggactgcaggaggcgctgtt

SEQ ID NO: 155450 - DNA, 75 bp, Artificial Sequence
  Synthetic
gtcggcctcggtgtcctccaccttcaggaaggactgcaggaggcgctgtttgatggcggcggtggtgaccagcac

SEQ ID NO: 155451 - DNA, 75 bp, Artificial Sequence
  Synthetic
ccacggacggctgcgtcgccgtggtcaggtccacgagccaggcctcgatggcctcgcggcgatggcccgccttgc

SEQ ID NO: 155452 - DNA, 75 bp, Artificial Sequence
  Synthetic
caggtccacgagccaggcctcgatggcctcgcggcgatggcccgccttgcccaggaagaagctcgtgtcgcaaaa

SEQ ID NO: 155453 - DNA, 75 bp, Artificial Sequence
  Synthetic
acagggtgttgcagtaggaccccagcagggcgtcaaactctacgtcatacaggctgttttcgtcggagcgcacgc

SEQ ID NO: 155454 - DNA, 75 bp, Artificial Sequence
  Synthetic
ggcgcccgttgtcgagatatcgttgcatgggcaacagcagggccaggggaggcgccttctccaacagcacgtgca

SEQ ID NO: 155455 - DNA, 75 bp, Artificial Sequence
  Synthetic
catgggcaacagcagggccaggggaggcgccttctccaacagcacgtgcagcatctggtcggccgtgccgcgctc

SEQ ID NO: 155456 - DNA, 75 bp, Artificial Sequence
  Synthetic
gcagctggcgatgcaggctaatgcccgtcccgtccagggcctcccccgtgagcagggcaatggcctcggtggcca

SEQ ID NO: 155457 - DNA, 75 bp, Artificial Sequence
  Synthetic
cgtcccgtccagggcctcccccgtgagcagggcaatggcctcggtggccaggctgaaggcggcgttcagggcccg

SEQ ID NO: 155458 - DNA, 75 bp, Artificial Sequence
  Synthetic
gcgggccgtcgcgggcgatgaggggctggtggacctcgaactgcacacgcccttcgttcatgtaagccagctccg

SEQ ID NO: 155459 - DNA, 75 bp, Artificial Sequence
  Synthetic
gtcatacaggctgttttcgtcggagcgcacgcgggcgaaaaaatcaaagagtctgcggtgggacgccacctcgat

SEQ ID NO: 155460 - DNA, 75 bp, Artificial Sequence
  Synthetic
ccggggggtcgcgggcaggagcggccattgggttccttgggggattcgcaggctccatcaagccgagctcgggaa

SEQ ID NO: 155461 - DNA, 75 bp, Artificial Sequence
  Synthetic
ggggcaacccgaccaacaacaggcgaggggaggaaaggcgtaaagggggcgttgggaggcaaaaagaaagaaaac

SEQ ID NO: 155462 - DNA, 75 bp, Artificial Sequence
  Synthetic
gttgggaggcaaaaagaaagaaaacacccagacgtaggcccgaggaccggccggcgtcctctgtccctgagcacc

SEQ ID NO: 155463 - DNA, 75 bp, Artificial Sequence
  Synthetic
cccgccacacccccgttagaacgcgacgggtgccttcaagatggccctggtccaaaagcgtgctagaaaaaagtt

SEQ ID NO: 155464 - DNA, 75 bp, Artificial Sequence
  Synthetic
acgggtgccttcaagatggccctggtccaaaagcgtgctagaaaaaagttggtaaaggcggcaaagcagtccgcc

SEQ ID NO: 155465 - DNA, 75 bp, Artificial Sequence
  Synthetic
ggcgcggaggggatccgtgcggggcagcagctggctggcggtgatccaatggaaaagcccgtcgggactgaacgt

SEQ ID NO: 155466 - DNA, 75 bp, Artificial Sequence
  Synthetic
agcagctggctggcggtgatccaatggaaaagcccgtcgggactgaacgtctcatgggcggccgccaccagggcg

SEQ ID NO: 155467 - DNA, 75 bp, Artificial Sequence
  Synthetic
cgacaacggcaggcgatcccgtttgatgttcacgtacaggaggagcgcccgtgccagccacgtgacatagtaggc

SEQ ID NO: 155468 - DNA, 75 bp, Artificial Sequence
  Synthetic
atgttcacgtacaggaggagcgcccgtgccagccacgtgacatagtaggcgaggacggcggctataatacatgcc

SEQ ID NO: 155469 - DNA, 75 bp, Artificial Sequence
  Synthetic
ctccagcggcttgaggaccaggaacgaccaagcaaacatcaccacccgcttggaaaagaccggctgggtgtgggg

SEQ ID NO: 155470 - DNA, 75 bp, Artificial Sequence
  Synthetic
gaccaagcaaacatcaccacccgcttggaaaagaccggctgggtgtggggcggaagacgcgagtaggccgaactg

SEQ ID NO: 155471 - DNA, 75 bp, Artificial Sequence
  Synthetic
cggcagttcgccgtcctccccgccacacgcggcctcgtctaccagctcgcgatccaacaaaggaacatcatcccg

SEQ ID NO: 155472 - DNA, 75 bp, Artificial Sequence
  Synthetic
cacgcggcctcgtctaccagctcgcgatccaacaaaggaacatcatcccgcattgtcatggtcggtgcggggagc

SEQ ID NO: 155473 - DNA, 75 bp, Artificial Sequence
  Synthetic
tgccgtgattcgcggagtcggggccttgtgtttctttctttccccccgaatccgttctttcttcctcaccccccc

SEQ ID NO: 155474 - DNA, 75 bp, Artificial Sequence
  Synthetic
ggacccaagcttcagggatggggggcggaggccaaaatcaaacaagcaccgcgcgggttctacacacaaccccca

SEQ ID NO: 155475 - DNA, 75 bp, Artificial Sequence
  Synthetic
cccgggtagtatccgcggatgcgagtgcctggcgaagtcacgtcccagcaggatataaacctcggccgttgggcc

SEQ ID NO: 155476 - DNA, 75 bp, Artificial Sequence
  Synthetic
atgtggttcgcgagccgcacatccgtgcgtccgccctcccccgcgggctgatgacgtggcggttagtcagtggga

SEQ ID NO: 155477 - DNA, 75 bp, Artificial Sequence
  Synthetic
gaggaaacgaagaaaacacccagagggccacgtcgggaatgcgcccggagttgtccttaaaaggccggccgtgcg

SEQ ID NO: 155478 - DNA, 75 bp, Artificial Sequence
  Synthetic
ttgtccttaaaaggccggccgtgcgtgacggaagccgtcgtttgcccaagcaccgacgccgcgatccacagtggg

SEQ ID NO: 155479 - DNA, 75 bp, Artificial Sequence
  Synthetic
cctacgcgcgggcggcacgcgcgagagcaacccacgggtcccgttcgcgccaccgccagcccttgctcccaccac

SEQ ID NO: 155480 - DNA, 75 bp, Artificial Sequence
  Synthetic
gctcgccggccatggagctcagctatgccaccaccctgcaccaccgggacgttgtgttttacgtcacggcagaca

SEQ ID NO: 155481 - DNA, 75 bp, Artificial Sequence
  Synthetic
tgccaccaccctgcaccaccgggacgttgtgttttacgtcacggcagacagaaaccgcgcctactttgtgtgcgg

SEQ ID NO: 155482 - DNA, 75 bp, Artificial Sequence
  Synthetic
ttgccaagtttggcctggtggtccgggggacaggccccaaagaccgcatggtcgccaactacgtacgaagcgagc

SEQ ID NO: 155483 - DNA, 75 bp, Artificial Sequence
  Synthetic
ggggacaggccccaaagaccgcatggtcgccaactacgtacgaagcgagctccgccagcgcggcctgcgggacgt

SEQ ID NO: 155484 - DNA, 75 bp, Artificial Sequence
  Synthetic
acccgaacgtgagctccgagcgagacgtgattaataccaacgacgttgaagtgctggacgaatgcctggccgaat

SEQ ID NO: 155485 - DNA, 75 bp, Artificial Sequence
  Synthetic
cgtgattaataccaacgacgttgaagtgctggacgaatgcctggccgaatactgcacctcgctgcgaaccagccc

SEQ ID NO: 155486 - DNA, 75 bp, Artificial Sequence
  Synthetic
agctatttgagcacccggcgatcgtcaacatttcctcgcgcttcgcgtacaccccctccccctacgtattcgccc

SEQ ID NO: 155487 - DNA, 75 bp, Artificial Sequence
  Synthetic
caacatttcctcgcgcttcgcgtacaccccctccccctacgtattcgccctggcccaggcgcacctcccccggct

SEQ ID NO: 155488 - DNA, 75 bp, Artificial Sequence
  Synthetic
ccccgcgccagcccctggacgcccgcgaccggcgcacggatgtcgtgatcacgggcacccgcgcccccagaccga

SEQ ID NO: 155489 - DNA, 75 bp, Artificial Sequence
  Synthetic
cgaccggcgcacggatgtcgtgatcacgggcacccgcgcccccagaccgatggccgggaccggggccgggggcgc

SEQ ID NO: 155490 - DNA, 75 bp, Artificial Sequence
  Synthetic
accgtgttgtgtccccgagcgtctcttccgcccccccgccgagcgcccccgacgcgagtctgccgcccctggggc

SEQ ID NO: 155491 - DNA, 75 bp, Artificial Sequence
  Synthetic
ttccgcccccccgccgagcgcccccgacgcgagtctgccgcccctggggctccaggaggccgccccgccgggccc

SEQ ID NO: 155492 - DNA, 75 bp, Artificial Sequence
  Synthetic
aggagccccacgccgagtcgggattgacgcgcgaggaggtccgcgccgtgcatgggttccgggagcaggcgtgga

SEQ ID NO: 155493 - DNA, 75 bp, Artificial Sequence
  Synthetic
gacgcgcgaggaggtccgcgccgtgcatgggttccgggagcaggcgtggaagctgtttgggtcggtgggggctcc

SEQ ID NO: 155494 - DNA, 75 bp, Artificial Sequence
  Synthetic
ccgtctactactatctcatccaccgggagcggcgcatgtcccccttccccgcgctcgtgcggctcgtcggtcggt

SEQ ID NO: 155495 - DNA, 75 bp, Artificial Sequence
  Synthetic
tgttactttttattgaaacagacatacggggaaaggggccggaaaccgagacggtggggccggcggtcgcatttt

SEQ ID NO: 155496 - DNA, 75 bp, Artificial Sequence
  Synthetic
ggagcggcgcatgtcccccttccccgcgctcgtgcggctcgtcggtcggtacatccagcgccacggcctgtacgt

SEQ ID NO: 155497 - DNA, 75 bp, Artificial Sequence
  Synthetic
gcgacgcgctggcggccgggaccgtggccgagcagctcctcatgttcgacctcctcccgcccaaggacgtgccgg

SEQ ID NO: 155498 - DNA, 75 bp, Artificial Sequence
  Synthetic
ggccgagcagctcctcatgttcgacctcctcccgcccaaggacgtgccggtggggagcgacgcgcgggccgacag

SEQ ID NO: 155499 - DNA, 75 bp, Artificial Sequence
  Synthetic
ccgtctcgcccgagcacgtcatgtacctcggcgcgttcctgggcgtgttgtacgccggccacggacgcctggccg

SEQ ID NO: 155500 - DNA, 75 bp, Artificial Sequence
  Synthetic
cctcggcgcgttcctgggcgtgttgtacgccggccacggacgcctggccgcggccacgcataccgcgcgcctgac

SEQ ID NO: 155501 - DNA, 75 bp, Artificial Sequence
  Synthetic
ggttgccctgacggcgacgggtggtggccgaacgcctcaccgcgcccgggcacgcggggtgcgttgtgttaaaaa

SEQ ID NO: 155502 - DNA, 75 bp, Artificial Sequence
  Synthetic
cgtttgaccgcgggccggcgggggcggctggccgcacgcgaaccgccgggtacctggacgcgctgcttaccgttt

SEQ ID NO: 155503 - DNA, 75 bp, Artificial Sequence
  Synthetic
gcctggctcgcgcccagcacggccagtctgtgtgagatatcccaataaagtgcagtcgttttctaacccacggat

SEQ ID NO: 155504 - DNA, 75 bp, Artificial Sequence
  Synthetic
caggaatggagaagggaaaggaacagaggcggtagcggacgcacggcggacacaataacaaacagaccgcggaca

SEQ ID NO: 155505 - DNA, 75 bp, Artificial Sequence
  Synthetic
cccccaaataaaaaccaaggcaaaacaataccagaagtcatgtgtatttttgaacatcggtgtctttttatttat

SEQ ID NO: 155506 - DNA, 75 bp, Artificial Sequence
  Synthetic
cacaataacaaacagaccgcggacacggagggagtcggttgggttgggcgtggacgccgctgcgtccacacaccc

SEQ ID NO: 155507 - DNA, 75 bp, Artificial Sequence
  Synthetic
gatgcccgccagggccgcggtgatcataacgacccccagcgcggacgcggccagaaacccgggggcgatggtggc

SEQ ID NO: 155508 - DNA, 75 bp, Artificial Sequence
  Synthetic
ataacgacccccagcgcggacgcggccagaaacccgggggcgatggtggcgatgggcagcgtgtcaaaggccagc

SEQ ID NO: 155509 - DNA, 75 bp, Artificial Sequence
  Synthetic
gtcgctggaaaacacgttcggggtgcccgccaccggcccctgggccagctgctgttgggtggcatccgtgtccac

SEQ ID NO: 155510 - DNA, 75 bp, Artificial Sequence
  Synthetic
cccgccaccggcccctgggccagctgctgttgggtggcatccgtgtccaccagcagcaccgacatgacctccccg

SEQ ID NO: 155511 - DNA, 75 bp, Artificial Sequence
  Synthetic
gttttcggtgcgcaccagccgcttcggctcaatctcccgcgcgtgcccttcgcaggtggcggtgagataggtgat

SEQ ID NO: 155512 - DNA, 75 bp, Artificial Sequence
  Synthetic
ggctcaatctcccgcgcgtgcccttcgcaggtggcggtgagataggtgataaacagcgggcggcggacgtcaacg

SEQ ID NO: 155513 - DNA, 75 bp, Artificial Sequence
  Synthetic
gtagctggcgttgtgggtgatgggcacgaggatccggggctccgcgttgtgcgacgggccgctacactggtgggt

SEQ ID NO: 155514 - DNA, 75 bp, Artificial Sequence
  Synthetic
acgaggatccggggctccgcgttgtgcgacgggccgctacactggtgggtggcctccgggacgaaggcgcggatc

SEQ ID NO: 155515 - DNA, 75 bp, Artificial Sequence
  Synthetic
ctgttgtgccatgacgtccgccgggatgtcggatcgggtggccatggccagcgcgtccaggatgaacccgccctc

SEQ ID NO: 155516 - DNA, 75 bp, Artificial Sequence
  Synthetic
atgtcggatcgggtggccatggccagcgcgtccaggatgaacccgccctcggcgagatcgaagcgcagggaagct

SEQ ID NO: 155517 - DNA, 75 bp, Artificial Sequence
  Synthetic
ggtcctggctagcgcggcacggagatcggcgtgggtcgccgcggcgacgtcggacgtacacagggccgtggttat

SEQ ID NO: 155518 - DNA, 75 bp, Artificial Sequence
  Synthetic
tcggcgtgggtcgccgcggcgacgtcggacgtacacagggccgtggttatgaggaggccccggcgggcgcgttcc

SEQ ID NO: 155519 - DNA, 75 bp, Artificial Sequence
  Synthetic
cgtggcgtaaaacagcgctcggcggaccatcggggcggttagcgcgcggccgccgagaaactcggcgtacagggc

SEQ ID NO: 155520 - DNA, 75 bp, Artificial Sequence
  Synthetic
accatcggggcggttagcgcgcggccgccgagaaactcggcgtacagggcgtcgatcaggcgggccgcgctcggg

SEQ ID NO: 155521 - DNA, 75 bp, Artificial Sequence
  Synthetic
gcccagcgcgtgcgccgccaggctctgctctcgctcgaggatcgcggccaccagatgcccgaggcgcgcctccag

SEQ ID NO: 155522 - DNA, 75 bp, Artificial Sequence
  Synthetic
tgctctcgctcgaggatcgcggccaccagatgcccgaggcgcgcctccagccgcagacgggccgccgggtccaac

SEQ ID NO: 155523 - DNA, 75 bp, Artificial Sequence
  Synthetic
ccaccagccccgcccgcagaggaagaggcggaggcggaggcggaggcggaggcggaggcggaggcggaggcggag

SEQ ID NO: 155524 - DNA, 75 bp, Artificial Sequence
  Synthetic
ggcggccaggccggccagcacgcgcgagtgggccaaaaagcccagcaggtcggagaggcgaatcgcgtcgtgggc

SEQ ID NO: 155525 - DNA, 75 bp, Artificial Sequence
  Synthetic
cggagaggcgaatcgcgtcgtgggcgtgggccgcgttgacgaacgcaaaccccgacgaggcgagcagccccgcga

SEQ ID NO: 155526 - DNA, 75 bp, Artificial Sequence
  Synthetic
gtccgtgccggagcccgggtcctcccccaaaaactccgcataggcccgcgacatatactgggcgtagttcgtgct

SEQ ID NO: 155527 - DNA, 75 bp, Artificial Sequence
  Synthetic
cccaaaaactccgcataggcccgcgacatatactgggcgtagttcgtgctctcctcggggtagccggccacccgc

SEQ ID NO: 155528 - DNA, 75 bp, Artificial Sequence
  Synthetic
gacaaagacgcgatacctggggccggccggaggcccggggagcaccgcgggggcgttttcgtcggtcggatttcc

SEQ ID NO: 155529 - DNA, 75 bp, Artificial Sequence
  Synthetic
gccggaggcccggggagcaccgcgggggcgttttcgtcggtcggatttccgacccgagcgagggtcttgtccgca

SEQ ID NO: 155530 - DNA, 75 bp, Artificial Sequence
  Synthetic
ccccatgaagcccttcccgtatcgcgcgcgcacgagcgcggcgtcgcacccgaacgccagcccgcccgtcgtcca

SEQ ID NO: 155531 - DNA, 75 bp, Artificial Sequence
  Synthetic
gggcggccccgggggcggcgcgttgcgtcggccgtccgggtgcctctcggtcgccccgtcgtctccccgcgggaa

SEQ ID NO: 155532 - DNA, 75 bp, Artificial Sequence
  Synthetic
cgtcggccgtccgggtgcctctcggtcgccccgtcgtctccccgcgggaacgtaagcccctcgcggtccggcgcg

SEQ ID NO: 155533 - DNA, 75 bp, Artificial Sequence
  Synthetic
ctcatcatcgaagagctgaccctggagacccagggcatgtactactgggcgtggggccggacggaccgcccgtcc

SEQ ID NO: 155534 - DNA, 75 bp, Artificial Sequence
  Synthetic
gttgtgcgacagtcccttgagctgggtcacctcggcggggggacgggacgtgggccccgcctcggggagctcggg

SEQ ID NO: 155535 - DNA, 75 bp, Artificial Sequence
  Synthetic
gtcacctcggcggggggacgggacgtgggccccgcctcggggagctcgggcaggctcgcgttccgaggccggccg

SEQ ID NO: 155536 - DNA, 75 bp, Artificial Sequence
  Synthetic
ctcggccgtggtgaccaacacgaaacaaaagcgctcggcgtaccaccgaagcatgggcacggatgccgtagtcag

SEQ ID NO: 155537 - DNA, 75 bp, Artificial Sequence
  Synthetic
caaaagcgctcggcgtaccaccgaagcatgggcacggatgccgtagtcaggttgagttcgcccgggggcgccaag

SEQ ID NO: 155538 - DNA, 75 bp, Artificial Sequence
  Synthetic
cccggtgtttgtgtcgcgccagtacgtgcgggccaaccccagaccgtgcaaaaaccacgggtcgatttgctccgt

SEQ ID NO: 155539 - DNA, 75 bp, Artificial Sequence
  Synthetic
cccgcaggtgcgcgcgcagcgtggcgtggccggcggcgacggtcgcgttggcgtcggggggcggggtcgcctcgg

SEQ ID NO: 155540 - DNA, 75 bp, Artificial Sequence
  Synthetic
aaaaccacgggtcgatttgctccgtccagtacgtgtcatggcccccggcaacgcccaccaggacccccatcacca

SEQ ID NO: 155541 - DNA, 75 bp, Artificial Sequence
  Synthetic
gggggggtgtccgtacccacggcccaaagaggctccgcacctcggaggctatcggaggccctttgttgccgtaag

SEQ ID NO: 155542 - DNA, 75 bp, Artificial Sequence
  Synthetic
aaagaggctccgcacctcggaggctatcggaggccctttgttgccgtaagcgcgggccaaaggatggggtggggt

SEQ ID NO: 155543 - DNA, 75 bp, Artificial Sequence
  Synthetic
cccgctccgtttttcggtggggtgctgatacggtgccagccctggccccgaacccccgcgcttatggacacacca

SEQ ID NO: 155544 - DNA, 75 bp, Artificial Sequence
  Synthetic
tgatacggtgccagccctggccccgaacccccgcgcttatggacacaccacacgacaacaatgccttttattctg

SEQ ID NO: 155545 - DNA, 75 bp, Artificial Sequence
  Synthetic
ttgaactaaactccccccacctcgcgggcaaacgtgcgcgccaggtcgcgtatctcggcgatggacccggcggtt

SEQ ID NO: 155546 - DNA, 75 bp, Artificial Sequence
  Synthetic
gggcaaacgtgcgcgccaggtcgcgtatctcggcgatggacccggcggttgtgacgcgggttgggatcatcccgg

SEQ ID NO: 155547 - DNA, 75 bp, Artificial Sequence
  Synthetic
tccaggacaaatagatgcatcggaaggaggcggtcggccaagacgtccaagacccaggcaaaaatgtggtacaag

SEQ ID NO: 155548 - DNA, 75 bp, Artificial Sequence
  Synthetic
ggcgagccactgcatgtcgttgagcatcccccaggcgtgcggggcggcgggctgcttgacaaagaaacggggggg

SEQ ID NO: 155549 - DNA, 75 bp, Artificial Sequence
  Synthetic
gacccaggcaaaaatgtggtacaagtccccgttgggggccagcagctcgggaacgcggaacagggcaaacagcgt

SEQ ID NO: 155550 - DNA, 75 bp, Artificial Sequence
  Synthetic
gggtcgccgcggcgacccccgtcagccggccccagtcctcccgccacctcccgccgcgctgcaggtaccgcaccg

SEQ ID NO: 155551 - DNA, 75 bp, Artificial Sequence
  Synthetic
ccgccgcgctgcaggtaccgcaccgtgttggcgagtcgatcgtagacacggcgaatggcggacagcatggccagg

SEQ ID NO: 155552 - DNA, 75 bp, Artificial Sequence
  Synthetic
gtctggccaggcggtcggcgtgttcggcctccggaaggacacccaggaccaggttcgtgccgggcgcggtcgggg

SEQ ID NO: 155553 - DNA, 75 bp, Artificial Sequence
  Synthetic
ggcctccggaaggacacccaggaccaggttcgtgccgggcgcggtcgggggcatgagggccacgaacgccaacac

SEQ ID NO: 155554 - DNA, 75 bp, Artificial Sequence
  Synthetic
gcagggaggcgatagggtgccggtcgaaaacaagggtgagggccgggggcggggcttgcgggcccacagcctccc

SEQ ID NO: 155555 - DNA, 75 bp, Artificial Sequence
  Synthetic
gaaaacaagggtgagggccgggggcggggcttgcgggcccacagcctcccccccgatatgaggagccaaaacggc

SEQ ID NO: 155556 - DNA, 75 bp, Artificial Sequence
  Synthetic
gctgttgggtgggcgggtgggggggctggtgaggcggcggtggtgggagggggcggcgtatagcaggacaacgac

SEQ ID NO: 155557 - DNA, 75 bp, Artificial Sequence
  Synthetic
gtctcccaggccaccagatggcgcacctgcacgcgcggcgagaagcacacctgcgggcggggagacacgggggtc

SEQ ID NO: 155558 - DNA, 75 bp, Artificial Sequence
  Synthetic
ccaccgccgcctccccggccgatatctcgccgcggtccagacggtgctgcgtgttgtagatgttcgtcagggtct

SEQ ID NO: 155559 - DNA, 75 bp, Artificial Sequence
  Synthetic
ctcgccgcggtccagacggtgctgcgtgttgtagatgttcgtcagggtctcggaggcccccagcacctgccagta

SEQ ID NO: 155560 - DNA, 75 bp, Artificial Sequence
  Synthetic
ccatcagctgcgcggaggtggtggtcttccccaccccgtggggtccgtctatataaacccgcagcagcgtgggca

SEQ ID NO: 155561 - DNA, 75 bp, Artificial Sequence
  Synthetic
cttccccaccccgtggggtccgtctatataaacccgcagcagcgtgggcagctccggatccccgcgggcttcgga

SEQ ID NO: 155562 - DNA, 75 bp, Artificial Sequence
  Synthetic
tggtgtcggccgcgtttgagcttcgtcaacagggcgctgagggcggcgacgttcgtcgggccgtcgttggccagc

SEQ ID NO: 155563 - DNA, 75 bp, Artificial Sequence
  Synthetic
cgctcgcacgagcagcctgaccgaacgcaggcgcgtgctgttggccggcgtgagaagccatacccgcttctacaa

SEQ ID NO: 155564 - DNA, 75 bp, Artificial Sequence
  Synthetic
tcaacagggcgctgagggcggcgacgttcgtcgggccgtcgttggccagcgcgttggtccgggggcgggcgggca

SEQ ID NO: 155565 - DNA, 75 bp, Artificial Sequence
  Synthetic
cgcaggcgcgtgctgttggccggcgtgagaagccatacccgcttctacaaggcgtttgcccgagaggtgcgggag

SEQ ID NO: 155566 - DNA, 75 bp, Artificial Sequence
  Synthetic
gctgcagggtcgctcgctgttcgaggccacgcgcgtcaccttaatatgcgaagtggacctcgggccgcgccgccc

SEQ ID NO: 155567 - DNA, 75 bp, Artificial Sequence
  Synthetic
tgtgcgtcatcctggagctaaagacatgcaaatcgatttcttccggggacacggccagcaaacgcgaacagcgga

SEQ ID NO: 155568 - DNA, 75 bp, Artificial Sequence
  Synthetic
atgcaaatcgatttcttccggggacacggccagcaaacgcgaacagcggaccacgggcatgaagcagctgcgcca

SEQ ID NO: 155569 - DNA, 75 bp, Artificial Sequence
  Synthetic
acggccagcaaacgcgaacagcggaccacgggcatgaagcagctgcgccactccctgaagctgctgcagtcgctc

SEQ ID NO: 155570 - DNA, 75 bp, Artificial Sequence
  Synthetic
cgcgcagcgtacgctgcgcgtcagccgcgtgacccggctcgtcccgcaaaagatctccggcaacatcaccgcggc

SEQ ID NO: 155571 - DNA, 75 bp, Artificial Sequence
  Synthetic
acgtatgccgtgccgccggaaccgcagacccggcggtcgcggcgccgggtcgccgcgaccgccagaccgcaaagg

SEQ ID NO: 155572 - DNA, 75 bp, Artificial Sequence
  Synthetic
cctcccccccgcgcgccgcggggctgcgttcccgcgcccgcccccgcgcggccggccgcctccccccgcgccccg

SEQ ID NO: 155573 - DNA, 75 bp, Artificial Sequence
  Synthetic
accagagagcgaccccccctccccaggggtcgtaggcgtcgctgcggagggtgggggtgtgcttcagaaaatcgc

SEQ ID NO: 155574 - DNA, 75 bp, Artificial Sequence
  Synthetic
ggcgcttttttgcgtgccggtggccgccaagagcagaccccggaccaaaaccgagtgaggttctgtgtgttgttt

SEQ ID NO: 155575 - DNA, 75 bp, Artificial Sequence
  Synthetic
cccgacccccgcccgaccccgacccccgcccgaccccgacccccgcccgaccccgacccccgcccgaccccgacc

SEQ ID NO: 155576 - DNA, 75 bp, Artificial Sequence
  Synthetic
tggccaagcatcctcacctgcttaagcggaacccgcgggcgcgcggggactcatttgtcgccggcgacacccacc

SEQ ID NO: 155577 - DNA, 75 bp, Artificial Sequence
  Synthetic
gtggtgttgggcgccggccaattcttcccggagcgccgtcgtcgcccgcccgccgccctcgaacatggacccgta

SEQ ID NO: 155578 - DNA, 75 bp, Artificial Sequence
  Synthetic
tcccggagcgccgtcgtcgcccgcccgccgccctcgaacatggacccgtactaccctttcgacgcgctggacgtt

SEQ ID NO: 155579 - DNA, 75 bp, Artificial Sequence
  Synthetic
cgtctctccccagcgccggacgcggacgcgacgctcccaccagccccgcccgcagaggaagaggcggaggaggag

SEQ ID NO: 155580 - DNA, 75 bp, Artificial Sequence
  Synthetic
cgagttcccccgggacttctggatgttgcccgtgttcaacatcccccgggagacggcggcggagcgggcggcagt

SEQ ID NO: 155581 - DNA, 75 bp, Artificial Sequence
  Synthetic
ttgcccgtgttcaacatcccccgggagacggcggcggagcgggcggcagtgctgcaggcccagcgcaccgcggcc

SEQ ID NO: 155582 - DNA, 75 bp, Artificial Sequence
  Synthetic
catcgagcgccggatacgcccgatcgagcagcaggtgcatcacatcgccgacgccctggaggcgctggagaccgc

SEQ ID NO: 155583 - DNA, 75 bp, Artificial Sequence
  Synthetic
gagcagcaggtgcatcacatcgccgacgccctggaggcgctggagaccgcggcggccgcggccgaagaggcggat

SEQ ID NO: 155584 - DNA, 75 bp, Artificial Sequence
  Synthetic
gccgtcgcccaccgcgggccccgccgccgcggagatggaggttcagatcgtacgcaacgacccgccgctacgata

SEQ ID NO: 155585 - DNA, 75 bp, Artificial Sequence
  Synthetic
gccgcggagatggaggttcagatcgtacgcaacgacccgccgctacgatacgataccaacctccccgtggatctg

SEQ ID NO: 155586 - DNA, 75 bp, Artificial Sequence
  Synthetic
ctttggtacctggtaccgcacgatccaggaacgcaccatcgcggacttccccctgaccacccgcagcgccgactt

SEQ ID NO: 155587 - DNA, 75 bp, Artificial Sequence
  Synthetic
caggaacgcaccatcgcggacttccccctgaccacccgcagcgccgactttcgagacgggcgcatgtccaagacc

SEQ ID NO: 155588 - DNA, 75 bp, Artificial Sequence
  Synthetic
gggccagcgccactattccgccttcgagtgcgccgtgctgtgtctgtatctgctgtaccgaaccacccacgagtc

SEQ ID NO: 155589 - DNA, 75 bp, Artificial Sequence
  Synthetic
gagtgcgccgtgctgtgtctgtatctgctgtaccgaaccacccacgagtcctcccccgatcgcgatcgcgctccc

SEQ ID NO: 155590 - DNA, 75 bp, Artificial Sequence
  Synthetic
ggccgcggtaatcggcgacgagagcggacgcccgcagtaccgctaccgcgacgacaagctgcccaaagcgcagtt

SEQ ID NO: 155591 - DNA, 75 bp, Artificial Sequence
  Synthetic
ggacgcccgcagtaccgctaccgcgacgacaagctgcccaaagcgcagttcgcggcggccggcggccgctacgag

SEQ ID NO: 155592 - DNA, 75 bp, Artificial Sequence
  Synthetic
cccgcccctcccgcccctcccgcccctcccgcccctcccgcccctcccgcccctcccgcccctcgccacaaacgc

SEQ ID NO: 155593 - DNA, 75 bp, Artificial Sequence
  Synthetic
ggtgctaccggcggccccgggcgacgttccccgagacaccagcacccgcgtgaaccccgacgacgtggcccaccg

SEQ ID NO: 155594 - DNA, 75 bp, Artificial Sequence
  Synthetic
gttccccgagacaccagcacccgcgtgaaccccgacgacgtggcccaccgcgacgacgtcaaccgcgccgccgcc

SEQ ID NO: 155595 - DNA, 75 bp, Artificial Sequence
  Synthetic
gctgcgggcgaccgccaacaccattacggccctggccgtgcttcggcggctcctcgcgaacggcaacgtgtacgc

SEQ ID NO: 155596 - DNA, 75 bp, Artificial Sequence
  Synthetic
acggccctggccgtgcttcggcggctcctcgcgaacggcaacgtgtacgcggaccgcctcgacaaccgcctgcag

SEQ ID NO: 155597 - DNA, 75 bp, Artificial Sequence
  Synthetic
ggcgtccggattggactcgggcgccataaaaagcggcgacaacaacctggaggcgctgtgcgttaactatgtact

SEQ ID NO: 155598 - DNA, 75 bp, Artificial Sequence
  Synthetic
ataaaaagcggcgacaacaacctggaggcgctgtgcgttaactatgtacttccgctgtatcaggcagaccccacg

SEQ ID NO: 155599 - DNA, 75 bp, Artificial Sequence
  Synthetic
ccaggcggggcggccactggcgtcgacgaggcgcgtggtggatatgtcgtcgggcgcccgccaggcggcgctcgt

SEQ ID NO: 155600 - DNA, 75 bp, Artificial Sequence
  Synthetic
aaccgcacccgcacaaacaccacccctgtgggggagattattaacgcccacgatgccttggggatacaatacgaa

SEQ ID NO: 155601 - DNA, 75 bp, Artificial Sequence
  Synthetic
cgccaagcgattcgccacgttcaacgtgggcagcgactacgacctgttgtactttttgtgtctcgggttcattcc

SEQ ID NO: 155602 - DNA, 75 bp, Artificial Sequence
  Synthetic
gtgggcagcgactacgacctgttgtactttttgtgtctcgggttcattccccagtacctgtccgtggcctaggga

SEQ ID NO: 155603 - DNA, 75 bp, Artificial Sequence
  Synthetic
tccgcctggtcacaaaaggcacggcgccccgaaacgcgggctttagtcccggcccggacgtcggcggacacacaa

SEQ ID NO: 155604 - DNA, 75 bp, Artificial Sequence
  Synthetic
gccccgaaacgcgggctttagtcccggcccggacgtcggcggacacacaacaacggcgggccccgtgggtgggta

SEQ ID NO: 155605 - DNA, 75 bp, Artificial Sequence
  Synthetic
tcccgttttgtttgtttgtgcgggtgcccatggcgtcggcggaaatgcgcgagcggttggaggcgcctctgcccg

SEQ ID NO: 155606 - DNA, 75 bp, Artificial Sequence
  Synthetic
gcccatggcgtcggcggaaatgcgcgagcggttggaggcgcctctgcccgaccgggcggtgcccatctacgtggc

SEQ ID NO: 155607 - DNA, 75 bp, Artificial Sequence
  Synthetic
acccagacacggtgcgtgcggccctgcctccggagaaccccctgccgatcaacgtagaccaccgcgctcggtgcg

SEQ ID NO: 155608 - DNA, 75 bp, Artificial Sequence
  Synthetic
gcctccggagaaccccctgccgatcaacgtagaccaccgcgctcggtgcgaggtgggccgggtgctcgccgtggt

SEQ ID NO: 155609 - DNA, 75 bp, Artificial Sequence
  Synthetic
tggagcgcgtcctcgagacggccgccagcgccgctatttttgagcgccgcggacccgcgctctcccgggaggagc

SEQ ID NO: 155610 - DNA, 75 bp, Artificial Sequence
  Synthetic
cagcgccgctatttttgagcgccgcggacccgcgctctcccgggaggagcgtctgctgtacctgatcaccaacta

SEQ ID NO: 155611 - DNA, 75 bp, Artificial Sequence
  Synthetic
ccgaccgcaccctgtttgcgcacgtggccctgtgcgccatcgggcggcgccttggaaccatcgtcacctacgaca

SEQ ID NO: 155612 - DNA, 75 bp, Artificial Sequence
  Synthetic
ggccctgtgcgccatcgggcggcgccttggaaccatcgtcacctacgacaccagcctagacgcggccatcgctcc

SEQ ID NO: 155613 - DNA, 75 bp, Artificial Sequence
  Synthetic
ccgaggccgagctcgcgctggccgggcgcacctgggcccccggcgtggaggcgctcacacacacgctgctctcca

SEQ ID NO: 155614 - DNA, 75 bp, Artificial Sequence
  Synthetic
gcgcacctgggcccccggcgtggaggcgctcacacacacgctgctctccaccgccgtcaacaacatgatgctgcg

SEQ ID NO: 155615 - DNA, 75 bp, Artificial Sequence
  Synthetic
ttcttcttcttttccggcaccggccgatatgaaccccgtttcggcatcgggcgccccggcccctccgccgcccgg

SEQ ID NO: 155616 - DNA, 75 bp, Artificial Sequence
  Synthetic
gatatgaaccccgtttcggcatcgggcgccccggcccctccgccgcccggcgacgggagttatttgtggatcccc

SEQ ID NO: 155617 - DNA, 75 bp, Artificial Sequence
  Synthetic
gccgctgaccgcgtgcggcctgccggccgcggggacggtggcctacggacaccccggcgccggcccgtccccgca

SEQ ID NO: 155618 - DNA, 75 bp, Artificial Sequence
  Synthetic
ctacccgcctcctcccgcccacccgtacccgggtatgctgttcgcgggccccagtcccctggaggcccagatcgc

SEQ ID NO: 155619 - DNA, 75 bp, Artificial Sequence
  Synthetic
gcatgggaccgggtggaggcgcgcctccggcgtacggcatgcccgcgcacggacatggtggccggaggcccgatt

SEQ ID NO: 155620 - DNA, 75 bp, Artificial Sequence
  Synthetic
cggccgccggagaccacgggatccgggggtcggcgaagcgccgccgacacgaggtggagcagccggagtacgact

SEQ ID NO: 155621 - DNA, 75 bp, Artificial Sequence
  Synthetic
ggggtcggcgaagcgccgccgacacgaggtggagcagccggagtacgactgcggccgtgacgagccggaccggga

SEQ ID NO: 155622 - DNA, 75 bp, Artificial Sequence
  Synthetic
cccggcgcgccgcgcgccaggcttccgggccccacgaaaccatcacggcgctggtgggggcggtgacgtccctgc

SEQ ID NO: 155623 - DNA, 75 bp, Artificial Sequence
  Synthetic
cgggccccacgaaaccatcacggcgctggtgggggcggtgacgtccctgcagcaggaactggcgcacatgcgcgc

SEQ ID NO: 155624 - DNA, 75 bp, Artificial Sequence
  Synthetic
acccccacgcagacacggagacccccgcccaaccaccccgctaccccgccgaggccgtctatctgccgccgccgc

SEQ ID NO: 155625 - DNA, 75 bp, Artificial Sequence
  Synthetic
gcggccatcgccgcgtctgtcttaaaggcgcacagacgcccgattccttccccctctccccatctcccccctccc

SEQ ID NO: 155626 - DNA, 75 bp, Artificial Sequence
  Synthetic
ctcccccgcacacgcccacccccctccgccgccgccgggacccacgcctccccccgccgcgagcttaccccaacc

SEQ ID NO: 155627 - DNA, 75 bp, Artificial Sequence
  Synthetic
ccgccgccgccgggacccacgcctccccccgccgcgagcttaccccaacccgaggcgcccggcgcggaggccggc

SEQ ID NO: 155628 - DNA, 75 bp, Artificial Sequence
  Synthetic
ggggccggggccgtgagagcccgcgacggacgccgaacgacgcggtcgcgcggtatcccgggactcgtcgttgtc

SEQ ID NO: 155629 - DNA, 75 bp, Artificial Sequence
  Synthetic
gggaagtgggccgaatgacacaaaaattaggtcggaggggtgagggggggctaggagccgaaccgatggccccca

SEQ ID NO: 155630 - DNA, 75 bp, Artificial Sequence
  Synthetic
ctaggagccgaaccgatggcccccacacgcgacggaaggcccggaagactaccacggggagggggtgtggaaagc

SEQ ID NO: 155631 - DNA, 75 bp, Artificial Sequence
  Synthetic
tcgtctccggcctcgtcctcgttgtggagcggagagtacctggctttgttgcgcttgcgcagaaccatgttggtg

SEQ ID NO: 155632 - DNA, 75 bp, Artificial Sequence
  Synthetic
ggagcggagagtacctggctttgttgcgcttgcgcagaaccatgttggtgaccttggagctgagcagggcgctcg

SEQ ID NO: 155633 - DNA, 75 bp, Artificial Sequence
  Synthetic
gccatatatcggatcatttctcgggcctcggccaacttggcctcgtcaaacccgcccccctccgcgccttcctcc

SEQ ID NO: 155634 - DNA, 75 bp, Artificial Sequence
  Synthetic
cctcggccaacttggcctcgtcaaacccgcccccctccgcgccttcctccccctccccgcccacgcccccggggt

SEQ ID NO: 155635 - DNA, 75 bp, Artificial Sequence
  Synthetic
ttgcgttgcagttgcaggacgtagcggaaggcgaagaaggccgcgaccaggccggccaggaccagcagccccacg

SEQ ID NO: 155636 - DNA, 75 bp, Artificial Sequence
  Synthetic
gccggccaggaccagcagccccacggcaagcgccccgaaggggttggacataaaggaggacacgcccgagacggc

SEQ ID NO: 155637 - DNA, 75 bp, Artificial Sequence
  Synthetic
atgacgaccttgccgaccgcgcgccccaagtcccccatcccctcgaagaacgcgcacagccccgcgaacatggcg

SEQ ID NO: 155638 - DNA, 75 bp, Artificial Sequence
  Synthetic
ccaagtcccccatcccctcgaagaacgcgcacagccccgcgaacatggcggcgttggcgtcggcgcggatgaccg

SEQ ID NO: 155639 - DNA, 75 bp, Artificial Sequence
  Synthetic
tccgtgtagtccagcaggccgctgtccttgatctcgtggcgcgtgtagacctccaggggcacaaactcgtggtcc

SEQ ID NO: 155640 - DNA, 75 bp, Artificial Sequence
  Synthetic
ccttgatctcgtggcgcgtgtagacctccaggggcacaaactcgtggtcctccagcatggtgatgttcaggtcga

SEQ ID NO: 155641 - DNA, 75 bp, Artificial Sequence
  Synthetic
gcgtactcctcgaagtacacgtagcccccgccgaagatgaagtagcgccggtggcccacggtgcacggctcgagc

SEQ ID NO: 155642 - DNA, 75 bp, Artificial Sequence
  Synthetic
ccccgccgaagatgaagtagcgccggtggcccacggtgcacggctcgagcgcgtcgcgggtgaggcgcagctcgt

SEQ ID NO: 155643 - DNA, 75 bp, Artificial Sequence
  Synthetic
gggccggggggacgggccggggggacggggcggggggacggggcggggggacggggcggggggacggggcggggg

SEQ ID NO: 155644 - DNA, 75 bp, Artificial Sequence
  Synthetic
gggggccggggggccggggggggacggggggacggggggacggggggacggggcggggggacggggggacgggcc

SEQ ID NO: 155645 - DNA, 75 bp, Artificial Sequence
  Synthetic
aagctgaccagggggcggctgtagcacgtccccggccgcgagctgacgcgcatcgagttctgcacgatcacgttg

SEQ ID NO: 155646 - DNA, 75 bp, Artificial Sequence
  Synthetic
acgtccccggccgcgagctgacgcgcatcgagttctgcacgatcacgttgtccggggcgacgggcacgcacgtgg

SEQ ID NO: 155647 - DNA, 75 bp, Artificial Sequence
  Synthetic
gtggcggaggcgatggcgttggggttgagcttgcgggcctcgttccagagagtcagctcgtggttctgcagctcg

SEQ ID NO: 155648 - DNA, 75 bp, Artificial Sequence
  Synthetic
tgagcttgcgggcctcgttccagagagtcagctcgtggttctgcagctcgcaccacgcgacggcgatgcgcccca

SEQ ID NO: 155649 - DNA, 75 bp, Artificial Sequence
  Synthetic
gcgaactcgatcgaggaggtggtcttgatgcgctccacggacgcgttggcgctgggcgcctcccgcagtggcgcg

SEQ ID NO: 155650 - DNA, 75 bp, Artificial Sequence
  Synthetic
cctgctcccgcatgtactcccgcacgtacagctcggcgagcgtgttgctgaggaggggctggtacgcgatgagga

SEQ ID NO: 155651 - DNA, 75 bp, Artificial Sequence
  Synthetic
aggaggggctggtacgcgatgaggaagccccccgtggccaggtagtactgcggctggcccaccttgatgtgcgtg

SEQ ID NO: 155652 - DNA, 75 bp, Artificial Sequence
  Synthetic
cggctggcccaccttgatgtgcgtggcgttgtacttgcgcgcaaacatgcggtcgatggcctcgcgggcatcccg

SEQ ID NO: 155653 - DNA, 75 bp, Artificial Sequence
  Synthetic
tggtggtgaaggtggtcgagatggcgtcggaggagaagcggaaggagccgccgtactcggcgcggagcatctcgt

SEQ ID NO: 155654 - DNA, 75 bp, Artificial Sequence
  Synthetic
gtcggaggagaagcggaaggagccgccgtactcggcgcggagcatctcgtccacctcctgccacttggtcatggt

SEQ ID NO: 155655 - DNA, 75 bp, Artificial Sequence
  Synthetic
gggtcgtcagcaagttgcgggtcgtcggcgacgtggcccgggccttcgtggtgaggtcgcgcgcgtagaagccgt

SEQ ID NO: 155656 - DNA, 75 bp, Artificial Sequence
  Synthetic
cggcgacgtggcccgggccttcgtggtgaggtcgcgcgcgtagaagccgtcgacctgcttgaagcggtcggcggc

SEQ ID NO: 155657 - DNA, 75 bp, Artificial Sequence
  Synthetic
acatgtacacaaagtcgcccgtcgccaacacaaactcatcgtacgggtacaccgaccgcgcgtccacctcctcga

SEQ ID NO: 155658 - DNA, 75 bp, Artificial Sequence
  Synthetic
caacacaaactcatcgtacgggtacaccgaccgcgcgtccacctcctcgacgatgcagttgaccgtcgtgccgta

SEQ ID NO: 155659 - DNA, 75 bp, Artificial Sequence
  Synthetic
gccacccccggctcgtgtgcgtggcgaccttcgccggcttgagctccatgtcggtctcgtggtcgtcccggtgaa

SEQ ID NO: 155660 - DNA, 75 bp, Artificial Sequence
  Synthetic
gaccttcgccggcttgagctccatgtcggtctcgtggtcgtcccggtgaaacgcggtagtctccatgttgttccg

SEQ ID NO: 155661 - DNA, 75 bp, Artificial Sequence
  Synthetic
tcacctcctcgaagggaacgggggcgcggtcctcgaatatccccataaactgggagtagcggtggccgaaccaca

SEQ ID NO: 155662 - DNA, 75 bp, Artificial Sequence
  Synthetic
gcggtcctcgaatatccccataaactgggagtagcggtggccgaaccacacctgcgacacggtcacgtctttgta

SEQ ID NO: 155663 - DNA, 75 bp, Artificial Sequence
  Synthetic
ccgcgatgccctccgtgtagttctgcccctccgggcgcgtcgggcagcggcgcggctgctcaaactgcaccaccg

SEQ ID NO: 155664 - DNA, 75 bp, Artificial Sequence
  Synthetic
ggtggtcgcggggctcgggacggggggcggccgggaggcgggacccccgttcgccgcgacggtcgcggccacgcc

SEQ ID NO: 155665 - DNA, 75 bp, Artificial Sequence
  Synthetic
cccccttctccttaaataaacacaaaccacacgctcgttggttggttaatgccagcgctttatttacgtcttgtt

SEQ ID NO: 155666 - DNA, 75 bp, Artificial Sequence
  Synthetic
tcccgggtagccgcccggcgccggtcggaaggcgtcccccgcccggcggtccggcccgggcccccggcggagcgc

SEQ ID NO: 155667 - DNA, 75 bp, Artificial Sequence
  Synthetic
gcgcccccacgaccagcgcgcaaatcaagccccccccgcgcatggcgggcctacgggggcgcgtcgctcccgccg

SEQ ID NO: 155668 - DNA, 75 bp, Artificial Sequence
  Synthetic
caagccccccccgcgcatggcgggcctacgggggcgcgtcgctcccgccgcccgctagtctgggggcgaggtgct

SEQ ID NO: 155669 - DNA, 75 bp, Artificial Sequence
  Synthetic
ctacgggggcgcgtcgctcccgccgcccgctagtctgggggcgaggtgctgcaggaccgagtagaggatggaaaa

SEQ ID NO: 155670 - DNA, 75 bp, Artificial Sequence
  Synthetic
agctcgggaaggccaagcccctcccgcacaacgcctcaccgccggcggacgcgactaacaacccacgggccgcca

SEQ ID NO: 155671 - DNA, 75 bp, Artificial Sequence
  Synthetic
ggccgctctcgacgatggccaccagcggacagtcggagttgtacgtgaggtacacgcccggcgggtagcggtaca

SEQ ID NO: 155672 - DNA, 75 bp, Artificial Sequence
  Synthetic
cggacagtcggagttgtacgtgaggtacacgcccggcgggtagcggtacagaccttcggaggtcgggcggctgca

SEQ ID NO: 155673 - DNA, 75 bp, Artificial Sequence
  Synthetic
gtgtggtggcgataatgagctcgcgaatatatcgccaggcggcgcgctgggtgggcgtgattccggaaacaccgt

SEQ ID NO: 155674 - DNA, 75 bp, Artificial Sequence
  Synthetic
aatatatcgccaggcggcgcgctgggtgggcgtgattccggaaacaccgtcaaaacagtagaacttttgaaactc

SEQ ID NO: 155675 - DNA, 75 bp, Artificial Sequence
  Synthetic
cgagttcctccttgaggtgcggcaggagccccacgttctcgacgctgtagtacagcgcggtgttggggggctggg

SEQ ID NO: 155676 - DNA, 75 bp, Artificial Sequence
  Synthetic
gagccccacgttctcgacgctgtagtacagcgcggtgttggggggctgggcgaagctgtgggtggagtggtcgaa

SEQ ID NO: 155677 - DNA, 75 bp, Artificial Sequence
  Synthetic
cccccccccaacaaccccaaaggcgcgtgcccggccacagccgtgggtgtggcgcccgtccccttcctctaccgc

SEQ ID NO: 155678 - DNA, 75 bp, Artificial Sequence
  Synthetic
gggccgggtccacctggtggcgcagcagcgacgctcgcatgaaccggtgcgcgtcaaacacgcccggggcggcgc

SEQ ID NO: 155679 - DNA, 75 bp, Artificial Sequence
  Synthetic
cagcgacgctcgcatgaaccggtgcgcgtcaaacacgcccggggcggcgcggttgtcgatgaccgtgcccgcgcc

SEQ ID NO: 155680 - DNA, 75 bp, Artificial Sequence
  Synthetic
cggcgaaggtcgcgggcagcacctcgccgtggacgctgacccgcagcatcttctcgagctccccgcgctgctcgc

SEQ ID NO: 155681 - DNA, 75 bp, Artificial Sequence
  Synthetic
tacagccgccggcgctcccgcacgtccgcggcggcccgcgtcgcgatgtcgccccagctctccggcccctgcgcc

SEQ ID NO: 155682 - DNA, 75 bp, Artificial Sequence
  Synthetic
acgcctccgccccccctcctccgcggcggcccggggctcttcctcctcggcccccccggtcgcgccgccggcccc

SEQ ID NO: 155683 - DNA, 75 bp, Artificial Sequence
  Synthetic
gcggcccggggctcttcctcctcggcccccccggtcgcgccgccggcccccagccgcgccagcacgcggcgcagc

SEQ ID NO: 155684 - DNA, 75 bp, Artificial Sequence
  Synthetic
cgtcaggtggtggtcgtagcacgcgcgtatcagcgcctcgatctgatcgtcgggcgacgtcgcctggccgccgat

SEQ ID NO: 155685 - DNA, 75 bp, Artificial Sequence
  Synthetic
cgtatcagcgcctcgatctgatcgtcgggcgacgtcgcctggccgccgatgatcagggcgtccaccatgtccagc

SEQ ID NO: 155686 - DNA, 75 bp, Artificial Sequence
  Synthetic
ggagtggtggtgggggacacgaaaacacacccacgacactctccccccaccccgaccgccgccgcgccccaccgg

SEQ ID NO: 155687 - DNA, 75 bp, Artificial Sequence
  Synthetic
gaacagcgccagctccacggccaccgcggcggtctcctgctgcagctcgcgctgcgccagcgcgttcaggttgtc

SEQ ID NO: 155688 - DNA, 75 bp, Artificial Sequence
  Synthetic
gctgcgccagcgcgttcaggttgtcggcgaaggcgtccatggtggagtggcgggcgcgatcgccggacgccagcc

SEQ ID NO: 155689 - DNA, 75 bp, Artificial Sequence
  Synthetic
acgtcatgcgcctccagcagggcgtcggcctcctcgcggacagaagagctatcggcgggcggcgggccggcccgg

SEQ ID NO: 155690 - DNA, 75 bp, Artificial Sequence
  Synthetic
cggcctcctcgcggacagaagagctatcggcgggcggcgggccggcccgggccccgccgcccgccgcggtccgcg

SEQ ID NO: 155691 - DNA, 75 bp, Artificial Sequence
  Synthetic
agcccggcggcgtggggcaggtaccgtcgcagctcgttggcgtccagccgcacctgggcctgttgggtgacgtgg

SEQ ID NO: 155692 - DNA, 75 bp, Artificial Sequence
  Synthetic
gtcgcagctcgttggcgtccagccgcacctgggcctgttgggtgacgtggttacagatgcggtccgccaggcggc

SEQ ID NO: 155693 - DNA, 75 bp, Artificial Sequence
  Synthetic
accgcgcacgggtgggacgggtcgctcagctccgggggcacgatgaggcccgaccccaccgccgccaccataaac

SEQ ID NO: 155694 - DNA, 75 bp, Artificial Sequence
  Synthetic
tcagctccgggggcacgatgaggcccgaccccaccgccgccaccataaactcccggacgcgctccagcgcggccg

SEQ ID NO: 155695 - DNA, 75 bp, Artificial Sequence
  Synthetic
aaattctcgacatcatgcaggaagcacagctccatgcggacgtccccgccgtacgtctccagccggatctgctgg

SEQ ID NO: 155696 - DNA, 75 bp, Artificial Sequence
  Synthetic
acagctccatgcggacgtccccgccgtacgtctccagccggatctgctggtggtacggacagggtcgggccagac

SEQ ID NO: 155697 - DNA, 75 bp, Artificial Sequence
  Synthetic
tccaggtggcccaggagccgctccccctcgcgccacgcgtactccaggagcaactccagggtgaccgacagcggg

SEQ ID NO: 155698 - DNA, 75 bp, Artificial Sequence
  Synthetic
cctcgcgccacgcgtactccaggagcaactccagggtgaccgacagcggggtgagaaaggcggcggcctgagcct

SEQ ID NO: 155699 - DNA, 75 bp, Artificial Sequence
  Synthetic
agctttagctgggcgagcttccccaggccgatctgggggtcgcatcgtcgaagcagctctagctgaaaaacgtac

SEQ ID NO: 155700 - DNA, 75 bp, Artificial Sequence
  Synthetic
gggggtgggtcagaggcgcgccccgcgcggactgatgcggcggcgggcccctgacatcccctctttatgcccgtc

SEQ ID NO: 155701 - DNA, 75 bp, Artificial Sequence
  Synthetic
gccgtgattcgcggagtcggggccttgtgtttctttctttcccccccgaatccgttctttcttcctcaccccccc

SEQ ID NO: 155702 - DNA, 75 bp, Artificial Sequence
  Synthetic
tccccacacacccacccaggactcgccaccacaaggaggcgagagcccgtcgctaacccaaagacacagtcacga

SEQ ID NO: 155703 - DNA, 75 bp, Artificial Sequence
  Synthetic
cgcccctagagcatatccaacgtcaggtcctttttctccggtggtccctccccaaacggatcgtcgccgtgaaac

SEQ ID NO: 155704 - DNA, 75 bp, Artificial Sequence
  Synthetic
tcgccgaaatccccaaagttaaacacctccccggcggcgccgagctggctgaccagggcctccgcctcgtgggcc

SEQ ID NO: 155705 - DNA, 75 bp, Artificial Sequence
  Synthetic
cctccccggcggcgccgagctggctgaccagggcctccgcctcgtgggccacctccagggccgcgtcggtcgacc

SEQ ID NO: 155706 - DNA, 75 bp, Artificial Sequence
  Synthetic
tcgctcaggtactcgtcctccagcagcgccagccagtcctcgatctgcagctgctgggtgcgggggcccaggctc

SEQ ID NO: 155707 - DNA, 75 bp, Artificial Sequence
  Synthetic
ttgacggtcgccacaaacacgctgctggcgaccgccgccccgccctccgcaatgatgccccggagctgctcgcac

SEQ ID NO: 155708 - DNA, 75 bp, Artificial Sequence
  Synthetic
cccggccctggggcaggccaggacaaacttgcgggtgcggtcaaagatcagcagcgggcacgcgtttttgccgcc

SEQ ID NO: 155709 - DNA, 75 bp, Artificial Sequence
  Synthetic
aacttgcgggtgcggtcaaagatcagcagcgggcacgcgtttttgccgcccagcaggctggcccagttcccggcc

SEQ ID NO: 155710 - DNA, 75 bp, Artificial Sequence
  Synthetic
ccgtccccccgtccccccgtccccccgtccccccgtccccccgtccccccgtccccccggccccccggccccccg

SEQ ID NO: 155711 - DNA, 75 bp, Artificial Sequence
  Synthetic
gcccagcacgaccatcgggcgcgcggccatcacgggccgcagcaggttgcagctcgcgaacatggacgtccaggc

SEQ ID NO: 155712 - DNA, 75 bp, Artificial Sequence
  Synthetic
gttttcaacaaggccagaaagtccataacaaaatgctggtgtgtgttgctgttcggggccgtgtccgtccccccc

SEQ ID NO: 155713 - DNA, 75 bp, Artificial Sequence
  Synthetic
gccggggtgcgcgtcgagggagtccatcagcgcgcgggccccggcctccaggcccgcgccgccctgcggggccca

SEQ ID NO: 155714 - DNA, 75 bp, Artificial Sequence
  Synthetic
ggacggcgggacccggcgatgacggccgtgagggtgtttatgaagtacgtcgagtggtcgcagtacctcaagatc

SEQ ID NO: 155715 - DNA, 75 bp, Artificial Sequence
  Synthetic
ccgtgagggtgtttatgaagtacgtcgagtggtcgcagtacctcaagatctggttggccatgtagtacatggcca

SEQ ID NO: 155716 - DNA, 75 bp, Artificial Sequence
  Synthetic
ccgggagctcgtgccgggccggggttccatgagccggggtagggtagactcgagacggcggcccgcggtctctct

SEQ ID NO: 155717 - DNA, 75 bp, Artificial Sequence
  Synthetic
tccagggagaacctcttaatgaacgcgatggtctctatgtcctcgcgcgacaagagccgggcggggagctggttg

SEQ ID NO: 155718 - DNA, 75 bp, Artificial Sequence
  Synthetic
cgatggtctctatgtcctcgcgcgacaagagccgggcggggagctggttgcgctggagggcggtccagaaccact

SEQ ID NO: 155719 - DNA, 75 bp, Artificial Sequence
  Synthetic
cgcaaacgtgataggtcttgggaacccgaggggcgacgcggggaaagcgcgcccccgcccggccgccgcgcgccc

SEQ ID NO: 155720 - DNA, 75 bp, Artificial Sequence
  Synthetic
cccgtgtacaggattaccatgtccccgaccggccaggcgtttgccgcggcggcgcgggacgactgggcccgcgtg

SEQ ID NO: 155721 - DNA, 75 bp, Artificial Sequence
  Synthetic
gcgtggaactgcttcagcaggaagcccagcggtccgaggaggatgtccacgcgcttgtcgggcttctggtaggcg

SEQ ID NO: 155722 - DNA, 75 bp, Artificial Sequence
  Synthetic
gcgcttgtcgggcttctggtaggcgctctggaggctggcgacccgcgccttggcggcctcggacgcgttggcgct

SEQ ID NO: 155723 - DNA, 75 bp, Artificial Sequence
  Synthetic
ccagggtcacgcgggcaacgtcgccctcgaagctgctctcggcgggggccgtctggccggccgttaggctggggg

SEQ ID NO: 155724 - DNA, 75 bp, Artificial Sequence
  Synthetic
ctcgaagctgctctcggcgggggccgtctggccggccgttaggctgggggcgcagatagccgccccctccgagag

SEQ ID NO: 155725 - DNA, 75 bp, Artificial Sequence
  Synthetic
tgacgcgccgccgcagcaccggttggaattgattgcgaaagttgcgcccctcgaccgactgcccggcgaacaccc

SEQ ID NO: 155726 - DNA, 75 bp, Artificial Sequence
  Synthetic
gaattgattgcgaaagttgcgcccctcgaccgactgcccggcgaacaccccgtggcactggctcagggccaggtc

SEQ ID NO: 155727 - DNA, 75 bp, Artificial Sequence
  Synthetic
acggcccgcaggtgtacgggtccagcgacagcgacatggcgtggttggcctcggccagaccgtcgcggaacttaa

SEQ ID NO: 155728 - DNA, 75 bp, Artificial Sequence
  Synthetic
cgacagcgacatggcgtggttggcctcggccagaccgtcgcggaacttaaagttgcgcccctcgatcaggttgcg

SEQ ID NO: 155729 - DNA, 75 bp, Artificial Sequence
  Synthetic
ccgtgtgcagggcctcgcggttgccgataatcgtctccagcctccccagggccgtgggcaccgcctggtccacgt

SEQ ID NO: 155730 - DNA, 75 bp, Artificial Sequence
  Synthetic
gataatcgtctccagcctccccagggccgtgggcaccgcctggtccacgtactgcagggcctcgagctcggccat

SEQ ID NO: 155731 - DNA, 75 bp, Artificial Sequence
  Synthetic
tctcggacccgtccgcgcgcttcagggccgagaaggcggcgtagttccccagcacgtcgcagtcgctgtacgcgc

SEQ ID NO: 155732 - DNA, 75 bp, Artificial Sequence
  Synthetic
ggccgagaaggcggcgtagttccccagcacgtcgcagtcgctgtacgcgctgttcatcgttccgaagaccccaat

SEQ ID NO: 155733 - DNA, 75 bp, Artificial Sequence
  Synthetic
tcagcgtcgtgtgcgcgcaggcgtggcgggtctcgaaggtacacaggttgcagggcacgtcggtctggcccgagt

SEQ ID NO: 155734 - DNA, 75 bp, Artificial Sequence
  Synthetic
gcgggtctcgaaggtacacaggttgcagggcacgtcggtctggcccgagtccgcgacgtagcgaaacacgtccat

SEQ ID NO: 155735 - DNA, 75 bp, Artificial Sequence
  Synthetic
gcatcttggccagcagggccggagagaacccgcacagcatggccaggtgctcgccggcgaactcctgggttccgc

SEQ ID NO: 155736 - DNA, 75 bp, Artificial Sequence
  Synthetic
gaacccgcacagcatggccaggtgctcgccggcgaactcctgggttccgccgacgaggggcgccgtggggcgccc

SEQ ID NO: 155737 - DNA, 75 bp, Artificial Sequence
  Synthetic
cgtcagggggtcggaggggcgtcagggggtcggaggggcgtcagggggtcggaggggcgtcagggggtcggaggg

SEQ ID NO: 155738 - DNA, 75 bp, Artificial Sequence
  Synthetic
ccccggggggggcacttacccagttcctcagtgtttgggaaatctattgaactctcccggctcctccgtgttagg

SEQ ID NO: 155739 - DNA, 75 bp, Artificial Sequence
  Synthetic
ccacgtgcgtgccgggcacgagaaagaagcggtaaaaggagggcttgctgtggtccttggggtccgccggcccgg

SEQ ID NO: 155740 - DNA, 75 bp, Artificial Sequence
  Synthetic
cgtcgtccacctcggtcaggtggagggccgagttggtgctgaacaccatggcgcccacgaggcccgcggcgcgcg

SEQ ID NO: 155741 - DNA, 75 bp, Artificial Sequence
  Synthetic
ggggatctcctcgtagacgcgccccccatcctcgctcaccgactcgtaaatggaatctgcgtcctcggagggggc

SEQ ID NO: 155742 - DNA, 75 bp, Artificial Sequence
  Synthetic
tcaagcaggggccacgtggtgatgtcggggggcggctcgtcaaagaccgccatcgacacgatggactccagggcc

SEQ ID NO: 155743 - DNA, 75 bp, Artificial Sequence
  Synthetic
cggggggcggctcgtcaaagaccgccatcgacacgatggactccagggccagggcggcgtcgcccgccatcaccg

SEQ ID NO: 155744 - DNA, 75 bp, Artificial Sequence
  Synthetic
cgcgcgccccgctggggcttaccctggctggcctcgaaggccgtgaacgtaatgtcggcggggagggccgcgccc

SEQ ID NO: 155745 - DNA, 75 bp, Artificial Sequence
  Synthetic
aatgtcggcggggagggccgcgccctcgtggttttcgtcgaacgccaggtgggcggccgcgcgggccacggcgtc

SEQ ID NO: 155746 - DNA, 75 bp, Artificial Sequence
  Synthetic
tccccccccggcccgtccccccgcccccccgccccgtccccccgtccccccgtccccccgtcccggccccccgcc

SEQ ID NO: 155747 - DNA, 75 bp, Artificial Sequence
  Synthetic
acagcaggcgggcgagggggcggttgaaaaacggaagggggtagttgaaattctccccgatcgatcggtggttgc

SEQ ID NO: 155748 - DNA, 75 bp, Artificial Sequence
  Synthetic
gaaaaacggaagggggtagttgaaattctccccgatcgatcggtggttgcagttaaacggatcggcgatgacccg

SEQ ID NO: 155749 - DNA, 75 bp, Artificial Sequence
  Synthetic
cctccgcgtccccgatggttaccttgtccatcccgcccaggtgcaggaaggtgttgctgatgcacacggcctccc

SEQ ID NO: 155750 - DNA, 75 bp, Artificial Sequence
  Synthetic
cgggtcaccgtacctgcgataaggctgcagtgggtggatgggtcctcgcggtacgtacagggtgggggggggagg

SEQ ID NO: 155751 - DNA, 75 bp, Artificial Sequence
  Synthetic
gcggcagggcagccccgcgcgcccccttccccggccctcccccggaaccggccgctcccccgcgggcgccgcccc

SEQ ID NO: 155752 - DNA, 75 bp, Artificial Sequence
  Synthetic
agagccgcgtcaggttgggggcctgggtgctgggggccaggtggcggccgccgtgaaagacgtagacggacgggc

SEQ ID NO: 155753 - DNA, 75 bp, Artificial Sequence
  Synthetic
ggtgctgggggccaggtggcggccgccgtgaaagacgtagacggacgggctgtagtgcgagggcataagcttgag

SEQ ID NO: 155754 - DNA, 75 bp, Artificial Sequence
  Synthetic
ccacgttggcctcaaacccgctctccacggtcaggccgacgatgaggggcgcgacggcgacgtccgcgtcgccgc

SEQ ID NO: 155755 - DNA, 75 bp, Artificial Sequence
  Synthetic
cacggtcaggccgacgatgaggggcgcgacggcgacgtccgcgtcgccgctgcgcgccgacagtagcgacagcag

SEQ ID NO: 155756 - DNA, 75 bp, Artificial Sequence
  Synthetic
tcgggcgcgcgcgcatcgggccagcgccgcggcggaagtcgtcgcgcggactctctggatccgccggggagaccg

SEQ ID NO: 155757 - DNA, 75 bp, Artificial Sequence
  Synthetic
cccccgcccctccccccgcgcccgcggccccgagctcgcagcagcccctccctcccgcgccccgtgccttccctc

SEQ ID NO: 155758 - DNA, 75 bp, Artificial Sequence
  Synthetic
ccggaggaaccttgacggtggtcgtcgttttgggcttggtgtccatggctttcgggagatcggcgaccggcagga

SEQ ID NO: 155759 - DNA, 75 bp, Artificial Sequence
  Synthetic
cgttttgggcttggtgtccatggctttcgggagatcggcgaccggcaggaacgggggcccggcaagacgaccggg

SEQ ID NO: 155760 - DNA, 75 bp, Artificial Sequence
  Synthetic
tctccgatggggtcgaatgccggcgctgggggtggggtctacacccgcccgttcaccgagcggcccctggtgggg

SEQ ID NO: 155761 - DNA, 75 bp, Artificial Sequence
  Synthetic
acccccgcccgcccgacccccgcccgcccgacccccgcccgcccgacccccgcccgcccgacccccgcccgcccg

SEQ ID NO: 155762 - DNA, 75 bp, Artificial Sequence
  Synthetic
ctgggggtggggtctacacccgcccgttcaccgagcggcccctggtgggggtgggatgggtgggatggggtgggc

SEQ ID NO: 155763 - DNA, 75 bp, Artificial Sequence
  Synthetic
gagaatggcccgccaccggaacgcgccggacgggggccccggggttgggcaaggtttgggcgcaaggctccagcg

SEQ ID NO: 155764 - DNA, 75 bp, Artificial Sequence
  Synthetic
aaggtttgggcgcaaggctccagcggcgattcgagaggcctgcggatggcggcccagagctgggtatgctcggcc

SEQ ID NO: 155765 - DNA, 75 bp, Artificial Sequence
  Synthetic
gtcgtcgtcgtcctccagctccgcgtccatgtccacgggctcgcgcctcggcggcgtggccagccccgcggcggt

SEQ ID NO: 155766 - DNA, 75 bp, Artificial Sequence
  Synthetic
tatatactattaggacaaagtgcgaacgcttcgcgttctcactttttttagaagggcggccacgccccctttgac

SEQ ID NO: 155767 - DNA, 75 bp, Artificial Sequence
  Synthetic
acgcttcgcgttctcactttttttagaagggcggccacgccccctttgacgtcacgctcacccgggcggccggcc

SEQ ID NO: 155768 - DNA, 75 bp, Artificial Sequence
  Synthetic
cccccgcacaccccggtcggaggcgatgtcggcggagcagcggaagaagaagaagacgacgacgacgacgacgca

SEQ ID NO: 155769 - DNA, 75 bp, Artificial Sequence
  Synthetic
gggtgtttttggggggggggcgcgaaggcgggcggcggcggcgggcgggcggcagggcggccccgcccgccgcct

SEQ ID NO: 155770 - DNA, 75 bp, Artificial Sequence
  Synthetic
gcggacaccacacactggctctcgaaccccggacgcgcagaagggacccgggcgcgggtccgccggtaagagccg

SEQ ID NO: 155771 - DNA, 75 bp, Artificial Sequence
  Synthetic
gggggaagtcggcggctcgggcggcgtctgggttttttgccccccacaacccccggggagccacccagacggcac

SEQ ID NO: 155772 - DNA, 75 bp, Artificial Sequence
  Synthetic
gtctgggttttttgccccccacaacccccggggagccacccagacggcaccgccgccttgccaccggcagaactt

SEQ ID NO: 155773 - DNA, 75 bp, Artificial Sequence
  Synthetic
cggctcagcgccatacgtactacagcgagtgcgacgaatttcgatttatcgccccgcgttcgctggacgaggacg

SEQ ID NO: 155774 - DNA, 75 bp, Artificial Sequence
  Synthetic
cgagtgcgacgaatttcgatttatcgccccgcgttcgctggacgaggacgcccccgcggagcagcgcaccggggt

SEQ ID NO: 155775 - DNA, 75 bp, Artificial Sequence
  Synthetic
agcgcgacgtcctccgcgtgggcccggagggcttctggccgcgtcgcttgcgcctgtggggcggtgcggaccatg

SEQ ID NO: 155776 - DNA, 75 bp, Artificial Sequence
  Synthetic
caccgtcttccacgtgtacgacatcctggagcacgtggaacacgcgtacagcatgcgcgccgcccagctccacga

SEQ ID NO: 155777 - DNA, 75 bp, Artificial Sequence
  Synthetic
gcatgcgcgccgcccagctccacgagcgatttatggacgccatcacgcccgccgggaccgtcatcacgcttctgg

SEQ ID NO: 155778 - DNA, 75 bp, Artificial Sequence
  Synthetic
gcgatttatggacgccatcacgcccgccgggaccgtcatcacgcttctgggtctgacccccgaaggccatcgcgt

SEQ ID NO: 155779 - DNA, 75 bp, Artificial Sequence
  Synthetic
aggtggatcggcacctgcagtgccgtgccccgcgcgatctctgcgagcgcctggcggcggccctgcgcgagtcgc

SEQ ID NO: 155780 - DNA, 75 bp, Artificial Sequence
  Synthetic
ggcgcgcgggggggaggggctgccgcgagctcggcgggatggaggggagggagggggtggcggggaaccgtgtgc

SEQ ID NO: 155781 - DNA, 75 bp, Artificial Sequence
  Synthetic
tgccccgcgcgatctctgcgagcgcctggcggcggccctgcgcgagtcgccgggggcgtcgttccgcggcatctc

SEQ ID NO: 155782 - DNA, 75 bp, Artificial Sequence
  Synthetic
acgaaacgcgcccgaccctgtactaccgcgtcttcgtgcgaagcgggcgcgcgctggcctacctgtgcgacaact

SEQ ID NO: 155783 - DNA, 75 bp, Artificial Sequence
  Synthetic
ggcggaagagagaagagagcaggggttgggggaaaactgttcttcctccccctttcaagaaacacgaggcggggg

SEQ ID NO: 155784 - DNA, 75 bp, Artificial Sequence
  Synthetic
ccgcgtcttcgtgcgaagcgggcgcgcgctggcctacctgtgcgacaacttttgccccgcgatcaggaagtacga

SEQ ID NO: 155785 - DNA, 75 bp, Artificial Sequence
  Synthetic
tcaccttcggctggtaccgcctcaagcccggccgcgggaacgcgccggcccaaccgcgccccccgacggcgttcg

SEQ ID NO: 155786 - DNA, 75 bp, Artificial Sequence
  Synthetic
gcccggccgcgggaacgcgccggcccaaccgcgccccccgacggcgttcggaacctcgagcgacgtcgagtttaa

SEQ ID NO: 155787 - DNA, 75 bp, Artificial Sequence
  Synthetic
cctacaagctcatgtgcttcgatatcgaatgcaaggccgggggggaggacgagctggcctttccggtcgcggaac

SEQ ID NO: 155788 - DNA, 75 bp, Artificial Sequence
  Synthetic
cgaatgcaaggccgggggggaggacgagctggcctttccggtcgcggaacgcccggaagacctcgtcatccagat

SEQ ID NO: 155789 - DNA, 75 bp, Artificial Sequence
  Synthetic
tgttttcgctcggatcctgcgacctccccgagtcccacctcagcgatctcgcctccaggggcctgccggcccccg

SEQ ID NO: 155790 - DNA, 75 bp, Artificial Sequence
  Synthetic
ccccgagtcccacctcagcgatctcgcctccaggggcctgccggcccccgtcgtcctggagtttgacagcgaatt

SEQ ID NO: 155791 - DNA, 75 bp, Artificial Sequence
  Synthetic
tcgtgaccgggtacaacatcatcaacttcgactggcccttcgtcctgaccaagctgacggagatctacaaggtcc

SEQ ID NO: 155792 - DNA, 75 bp, Artificial Sequence
  Synthetic
cttcgactggcccttcgtcctgaccaagctgacggagatctacaaggtcccgctcgacgggtacgggcgcatgaa

SEQ ID NO: 155793 - DNA, 75 bp, Artificial Sequence
  Synthetic
agcgcagcaagatcaaggtgaacgggatggtgaacatcgacatgtacggcatcatcaccgacaaggtcaaactct

SEQ ID NO: 155794 - DNA, 75 bp, Artificial Sequence
  Synthetic
gatggtgaacatcgacatgtacggcatcatcaccgacaaggtcaaactctccagctacaagctgaacgccgtcgc

SEQ ID NO: 155795 - DNA, 75 bp, Artificial Sequence
  Synthetic
caggccgggccccggctctgttctatgataaagaccaacaggcctcgggggtgggggcggcttctcgtgcccgcc

SEQ ID NO: 155796 - DNA, 75 bp, Artificial Sequence
  Synthetic
ccgcctactacgcctccgggcccgcgcagcgcggggtgatcggcgagtattgtgtgcaggactcgctgctggtcg

SEQ ID NO: 155797 - DNA, 75 bp, Artificial Sequence
  Synthetic
gcagcgcggggtgatcggcgagtattgtgtgcaggactcgctgctggtcgggcagctgttcttcaagtttctgcc

SEQ ID NO: 155798 - DNA, 75 bp, Artificial Sequence
  Synthetic
gcaccatctacgacggccagcagatccgcgtcttcacgtgcctcctgcgccttgcgggccagaagggcttcatcc

SEQ ID NO: 155799 - DNA, 75 bp, Artificial Sequence
  Synthetic
tgccggacacccaggggcggtttcggggcctcgacaaggaggcgcccaagcgcccggccgtgcctcggggggaag

SEQ ID NO: 155800 - DNA, 75 bp, Artificial Sequence
  Synthetic
gggcggggggaagcccccggggcggggcgcggggggaggcggccggccgcgcgggggcgggcgcgggaacgcagc

SEQ ID NO: 155801 - DNA, 75 bp, Artificial Sequence
  Synthetic
gacggggacgaggacggggacgagcgcgaggaggtcgcgcgcgagaccgggggccggcacgttgggtaccagggg

SEQ ID NO: 155802 - DNA, 75 bp, Artificial Sequence
  Synthetic
gcgaggaggtcgcgcgcgagaccgggggccggcacgttgggtaccagggggcccgggtcctcgaccccacctccg

SEQ ID NO: 155803 - DNA, 75 bp, Artificial Sequence
  Synthetic
agcatcatccaggcccacaacctgtgcttcagtacgctctccctgcggcccgaggccgtcgcgcacctggaggcg

SEQ ID NO: 155804 - DNA, 75 bp, Artificial Sequence
  Synthetic
gcttcagtacgctctccctgcggcccgaggccgtcgcgcacctggaggcggaccgggactacctggagatcgagg

SEQ ID NO: 155805 - DNA, 75 bp, Artificial Sequence
  Synthetic
gggaggggcggcgcccgcgggggagcggccggttccgggggagggccgggggagggggcgcgcggggctgccctg

SEQ ID NO: 155806 - DNA, 75 bp, Artificial Sequence
  Synthetic
ctgagcatcctgctgcgcgactggctggccatgcgaaagcagatccgctcgcggatcccccagagcacccccgag

SEQ ID NO: 155807 - DNA, 75 bp, Artificial Sequence
  Synthetic
tggccatgcgaaagcagatccgctcgcggatcccccagagcacccccgaggaggccgtcctcctcgacaagcaac

SEQ ID NO: 155808 - DNA, 75 bp, Artificial Sequence
  Synthetic
cagcacggtcttctgccctgcctgcacgtggccgccaccgtgacgaccatcggccgcgagatgctcctcgcgacg

SEQ ID NO: 155809 - DNA, 75 bp, Artificial Sequence
  Synthetic
acgtggccgccaccgtgacgaccatcggccgcgagatgctcctcgcgacgcgcgcgtacgtgcacgcgcgctggg

SEQ ID NO: 155810 - DNA, 75 bp, Artificial Sequence
  Synthetic
cgggcgcggggaagggggcgggcggggccgccctgccgcccgcccgccgccgccgcccgccttcgcgcccccccc

SEQ ID NO: 155811 - DNA, 75 bp, Artificial Sequence
  Synthetic
gcccccggtccgtactccatgcgcatcatctacggggacacggactccattttcgttttgtgccgcggcctcacg

SEQ ID NO: 155812 - DNA, 75 bp, Artificial Sequence
  Synthetic
tcatctacggggacacggactccattttcgttttgtgccgcggcctcacggccgcgggcctggtggccatgggcg

SEQ ID NO: 155813 - DNA, 75 bp, Artificial Sequence
  Synthetic
tcgtcgtcttcttcttcttccgctgctccgccgacatcgcctccgaccggggtgtgcggggggtcttcttcttct

SEQ ID NO: 155814 - DNA, 75 bp, Artificial Sequence
  Synthetic
cccccgcctcgtgtttcttgaaagggggaggaagaacagttttcccccaacccctgctctcttctctcttccgcc

SEQ ID NO: 155815 - DNA, 75 bp, Artificial Sequence
  Synthetic
ctcgagtgcgaaaaaacgttcaccaagctgctgctcatcgccaagaaaaagtacatcggcgtcatctgcgggggc

SEQ ID NO: 155816 - DNA, 75 bp, Artificial Sequence
  Synthetic
agctgctgctcatcgccaagaaaaagtacatcggcgtcatctgcgggggcaagatgctcatcaagggcgtggatc

SEQ ID NO: 155817 - DNA, 75 bp, Artificial Sequence
  Synthetic
gtcgacctgctgttttacgacgataccgtatccggagcggccgccgcgttagccgagcgccccgcagaggagtgg

SEQ ID NO: 155818 - DNA, 75 bp, Artificial Sequence
  Synthetic
ccgtatccggagcggccgccgcgttagccgagcgccccgcagaggagtggctggcgcgacccctgcccgagggac

SEQ ID NO: 155819 - DNA, 75 bp, Artificial Sequence
  Synthetic
ccggagagggacatccaggactttgtcctcaccgccgaactgagcagacacccgcgcgcgtacaccaacaagcgc

SEQ ID NO: 155820 - DNA, 75 bp, Artificial Sequence
  Synthetic
tcctcaccgccgaactgagcagacacccgcgcgcgtacaccaacaagcgcctggcccacctgacggtgtattaca

SEQ ID NO: 155821 - DNA, 75 bp, Artificial Sequence
  Synthetic
gtcgggtcagggggtcgggggggaggcgtaccttcccgcgcggcgcgtccgcgggcggggacgcggggggccgcc

SEQ ID NO: 155822 - DNA, 75 bp, Artificial Sequence
  Synthetic
tacgtgatcgtggcccagacccgcgaggtagaggagacggtcgcgcggctggccgccctccgcgagctagacgcc

SEQ ID NO: 155823 - DNA, 75 bp, Artificial Sequence
  Synthetic
aggtagaggagacggtcgcgcggctggccgccctccgcgagctagacgccgccgccccaggggacgagcccgccc

SEQ ID NO: 155824 - DNA, 75 bp, Artificial Sequence
  Synthetic
catgccgaccccccgggaggcgcgtccaagccccgcaagctgctggtgtccgagctggcggaggatcccgggtac

SEQ ID NO: 155825 - DNA, 75 bp, Artificial Sequence
  Synthetic
ccaagccccgcaagctgctggtgtccgagctggcggaggatcccgggtacgccatcgcccggggcgttccgctca

SEQ ID NO: 155826 - DNA, 75 bp, Artificial Sequence
  Synthetic
aaggccctgtttggaaataacgccaagatcaccgagagtctgttaaagaggtttattcccgagacgtggcacccc

SEQ ID NO: 155827 - DNA, 75 bp, Artificial Sequence
  Synthetic
agatcaccgagagtctgttaaagaggtttattcccgagacgtggcaccccccggacgacgtggccgcgcggctca

SEQ ID NO: 155828 - DNA, 75 bp, Artificial Sequence
  Synthetic
cagaccgcgccttttatagccccaggggttgctaattaacgcacgcatgcagacgcaatttattttgcatccccc

SEQ ID NO: 155829 - DNA, 75 bp, Artificial Sequence
  Synthetic
cgtcgaatgttgcatagagcctttgatactctagcatgagccccccgtcgaagctgatgtcccgcatcttgcaat

SEQ ID NO: 155830 - DNA, 75 bp, Artificial Sequence
  Synthetic
atactctagcatgagccccccgtcgaagctgatgtcccgcatcttgcaataaatgtctgcggccgacacggtcgg

SEQ ID NO: 155831 - DNA, 75 bp, Artificial Sequence
  Synthetic
acgtgctctgccacacgtgggcggcgaaccggtagccggggcacgcggtcagcatccgatcgatgagccggtagt

SEQ ID NO: 155832 - DNA, 75 bp, Artificial Sequence
  Synthetic
gaaccggtagccggggcacgcggtcagcatccgatcgatgagccggtagtgcaggtgggccgacgtgccggggaa

SEQ ID NO: 155833 - DNA, 75 bp, Artificial Sequence
  Synthetic
ggccgccgcgcgcccccgcccggccgccgcggcccccgcccggccgcccgcgcgcgcgcccccgcccggccgccg

SEQ ID NO: 155834 - DNA, 75 bp, Artificial Sequence
  Synthetic
accgggggtcgcacgccccccctccgcgcaggatcgtgtgcacgaaaaagagctcgggctggccgagcgtatcgg

SEQ ID NO: 155835 - DNA, 75 bp, Artificial Sequence
  Synthetic
gcgcaggatcgtgtgcacgaaaaagagctcgggctggccgagcgtatcggccaggaggtcctggaggggggtgct

SEQ ID NO: 155836 - DNA, 75 bp, Artificial Sequence
  Synthetic
tcccccccgtgcggtgcgtgcgtgtgcctgtgtcttttcgcctctccgcgccgatcgggtagatcctggcggccg

SEQ ID NO: 155837 - DNA, 75 bp, Artificial Sequence
  Synthetic
cgacgcccccccccccgccgcccgacgaaggagacccaagcaccgcagccggaaaaaccgagcggggagtgggcg

SEQ ID NO: 155838 - DNA, 75 bp, Artificial Sequence
  Synthetic
agatcgtattgatctgctgcacgaaggccaggatgagggcctcgcggctgacggtggccagccgcccgtcgcccg

SEQ ID NO: 155839 - DNA, 75 bp, Artificial Sequence
  Synthetic
cgctgcacgcggggcagcagcccccgatccccaggtagtagcccatgcccgagagggtcaggcagttgtcggcca

SEQ ID NO: 155840 - DNA, 75 bp, Artificial Sequence
  Synthetic
ggcacggatagcgagcgcacgatggcgatctcctcggagggcgtctgggcgagggcggcgaagaagccgcggtag

SEQ ID NO: 155841 - DNA, 75 bp, Artificial Sequence
  Synthetic
cgatctcctcggagggcgtctgggcgagggcggcgaagaagccgcggtagcgacggcgctcgtgcaggcagagct

SEQ ID NO: 155842 - DNA, 75 bp, Artificial Sequence
  Synthetic
acgccggggttcccggcggcggaaaagcgcgaccgccgccgggtcttgtcgcggccgggcccgggccgggagccg

SEQ ID NO: 155843 - DNA, 75 bp, Artificial Sequence
  Synthetic
agcgcgaccgccgccgggtcttgtcgcggccgggcccgggccgggagccggagcgacggggggcgatgtcataca

SEQ ID NO: 155844 - DNA, 75 bp, Artificial Sequence
  Synthetic
gagcagcgcgccggcctcgcggacaaatgtggccagcgcggtgggcttcggcacaaatacctggtacgtcttgaa

SEQ ID NO: 155845 - DNA, 75 bp, Artificial Sequence
  Synthetic
aatgtggccagcgcggtgggcttcggcacaaatacctggtacgtcttgaaggtgtagatgagggcccgcagggct

SEQ ID NO: 155846 - DNA, 75 bp, Artificial Sequence
  Synthetic
aagctgcagctcgtcgcgatggtcggcgcgggggtggccaaacaggacccaggggtcgacttccatctccgtgat

SEQ ID NO: 155847 - DNA, 75 bp, Artificial Sequence
  Synthetic
gcgcgggggtggccaaacaggacccaggggtcgacttccatctccgtgatggcgcacatcggatcgcagaacatg

SEQ ID NO: 155848 - DNA, 75 bp, Artificial Sequence
  Synthetic
gcccccgtccccgggctgcgcctcggggtccgcctcgagctggtccacgaccggcactatgcagtcgaagaggct

SEQ ID NO: 155849 - DNA, 75 bp, Artificial Sequence
  Synthetic
gggtccgcctcgagctggtccacgaccggcactatgcagtcgaagaggctggtgttgttctccgagtagcggacg

SEQ ID NO: 155850 - DNA, 75 bp, Artificial Sequence
  Synthetic
cagattgcacagcaggcattccccgccggtgcgcccgcggccccggccgtgcttcagcacggtggccatcagcgg

SEQ ID NO: 155851 - DNA, 75 bp, Artificial Sequence
  Synthetic
gcccgacccccgcccgacccccgcccgacccccgcccgacccccgcccgacccccgcccgacccccgcccgccct

SEQ ID NO: 155852 - DNA, 75 bp, Artificial Sequence
  Synthetic
gcggggccgcgtcgcgcatgcgcgccccgcggtgcgcttcccaggactcgctgaccgcggcgcggcgggcgtccg

SEQ ID NO: 155853 - DNA, 75 bp, Artificial Sequence
  Synthetic
cccgcggtgcgcttcccaggactcgctgaccgcggcgcggcgggcgtccgcggcggcgcgcagccggggccccga

SEQ ID NO: 155854 - DNA, 75 bp, Artificial Sequence
  Synthetic
ctgaccgcggcgcggcgggcgtccgcggcggcgcgcagccggggccccgactcccagacggcgggggtgccggcg

SEQ ID NO: 155855 - DNA, 75 bp, Artificial Sequence
  Synthetic
gggggacggggggacggggggacgggccggggggacggggggacgggccggggggacggggggacggggggacgg

SEQ ID NO: 155856 - DNA, 75 bp, Artificial Sequence
  Synthetic
ctgcgccagcgccccggcggcggcctcgaactccccgttgcgggcggcggcgcgcgtgcagcagctgtctccgcc

SEQ ID NO: 155857 - DNA, 75 bp, Artificial Sequence
  Synthetic
agcaggcgggcgcagtccttccagttcatcagggcggtggtgagggagggttgcgttcccgagcccccgcccgcc

SEQ ID NO: 155858 - DNA, 75 bp, Artificial Sequence
  Synthetic
aaaactgttcttcctccccctttcaagaaacacgaggcggggtcccagaaagggcaggcaggtcagccgcaccgc

SEQ ID NO: 155859 - DNA, 75 bp, Artificial Sequence
  Synthetic
ggggggacgggccggggggacgggccggggggccgggacggggggccgggccggggggacgggccggggggacgg

SEQ ID NO: 155860 - DNA, 75 bp, Artificial Sequence
  Synthetic
ccgggttgcggactgcacgaggaaggaatagttggagtactgcaccttggcggcgcccggggagggcgtcggcct

SEQ ID NO: 155861 - DNA, 75 bp, Artificial Sequence
  Synthetic
gaatagttggagtactgcaccttggcggcgcccggggagggcgtcggcctgggttgcttctgggcgtggcgcccg

SEQ ID NO: 155862 - DNA, 75 bp, Artificial Sequence
  Synthetic
ttctaggtgttttcgtttttgtttctgtttttgtttgttttgttgttgttttcgcggatccggcgtgttcggatc

SEQ ID NO: 155863 - DNA, 75 bp, Artificial Sequence
  Synthetic
gatgtcgttgatggtcagggcgaagcgcgcgaaggagccgacgagggtcgccttcttggtgcgcaggaagtggtg

SEQ ID NO: 155864 - DNA, 75 bp, Artificial Sequence
  Synthetic
cccccgtcgtcgttcccgggggggcaggcgcgggtcgggcccatacgcccaccgcccccacgcgccggtcacccc

SEQ ID NO: 155865 - DNA, 75 bp, Artificial Sequence
  Synthetic
ccttcttggtgcgcaggaagtggtggtccatgacgtagacgaactcgaaggcggccacgaagatgctcgcggcgc

SEQ ID NO: 155866 - DNA, 75 bp, Artificial Sequence
  Synthetic
gcagaggaacgcgtaatcggccacccactggggcgagaggcggtaggcctgcttgtacagctcgatggtgcggca

SEQ ID NO: 155867 - DNA, 75 bp, Artificial Sequence
  Synthetic
aaggtgtcgacggacgccgcggcgaagggccccgtgtccaagagtccctctgccgtggggtctgcgggcgggccg

SEQ ID NO: 155868 - DNA, 75 bp, Artificial Sequence
  Synthetic
ccgggggcgtcgttcccagggggggcaggcgcgggtcgggcccatacgcccaccgcccccacgcgccggtcaccc

SEQ ID NO: 155869 - DNA, 75 bp, Artificial Sequence
  Synthetic
tcgccccgatgggagtctccccgcagccagggtaaggaggggcgggcgtggcgggcaggtgtgcgggcggggtgg

SEQ ID NO: 155870 - DNA, 75 bp, Artificial Sequence
  Synthetic
cggccgcgggggggcgggcgcgacgtcgctctccacgtcctcgtcgagcgcgctcgcgggcggcacgcctaccac

SEQ ID NO: 155871 - DNA, 75 bp, Artificial Sequence
  Synthetic
tcgctctccacgtcctcgtcgagcgcgctcgcgggcggcacgcctaccacgtgacaggccgccaggagctcggcg

SEQ ID NO: 155872 - DNA, 75 bp, Artificial Sequence
  Synthetic
acgctcgaacgcgccctccttccagctgctgcccggcgactcttcgcgcacggcggcgctcgacggcacccccgg

SEQ ID NO: 155873 - DNA, 75 bp, Artificial Sequence
  Synthetic
gcggggcgcacgcgtccgcgaacgttacgggacgcgatccccgactgcgcgctgcggtcccagaccctggaaagt

SEQ ID NO: 155874 - DNA, 75 bp, Artificial Sequence
  Synthetic
gctgcggtcccagaccctggaaagtctagacgcgcgctacgtctcgcgagacggcgcgggggacgcggccgtctg

SEQ ID NO: 155875 - DNA, 75 bp, Artificial Sequence
  Synthetic
ctagacgcgcgctacgtctcgcgagacggcgcgggggacgcggccgtctggttcgaggacatgacccccgccgaa

SEQ ID NO: 155876 - DNA, 75 bp, Artificial Sequence
  Synthetic
cccgagccaggcgccctcccactcctgcccaccacccccagggtctggccggccagacgtgcgtgctctgcacga

SEQ ID NO: 155877 - DNA, 75 bp, Artificial Sequence
  Synthetic
cttcccgcgggcgcccccgcgcggcttttttcccgcgcccgcccccgcgcggcaggacggggactagcaggctgt

SEQ ID NO: 155878 - DNA, 75 bp, Artificial Sequence
  Synthetic
gacgcagcggctggcctccctcctgacgtacgccgggcctataaaagcgcccgacggccccgccgccccacatac

SEQ ID NO: 155879 - DNA, 75 bp, Artificial Sequence
  Synthetic
gagctgctcgcccgaaagcgcgaacggttcgcggcggtcattaaccggttcctggacctgcaccagatcctgcgg

SEQ ID NO: 155880 - DNA, 75 bp, Artificial Sequence
  Synthetic
cataacagtagggggtgggggaacgcgcacccttgcccggtcgcgatggcggggatggggaagccctacggcggc

SEQ ID NO: 155881 - DNA, 75 bp, Artificial Sequence
  Synthetic
cgcacccttgcccggtcgcgatggcggggatggggaagccctacggcggccgcccgggggacgcgttcgagggtc

SEQ ID NO: 155882 - DNA, 75 bp, Artificial Sequence
  Synthetic
ggggagtcgggcccctactcgccatccaacccgccctcgagatgtgccttccagttccacggccaggatgggtcc

SEQ ID NO: 155883 - DNA, 75 bp, Artificial Sequence
  Synthetic
ccaacccgccctcgagatgtgccttccagttccacggccaggatgggtccgacgaggccttcccgatcgagtacg

SEQ ID NO: 155884 - DNA, 75 bp, Artificial Sequence
  Synthetic
cgcgtgcagaacaccggcgtttcggtgctgtttcagggtttttttaaccggccccacggcgccccggggggcgcg

SEQ ID NO: 155885 - DNA, 75 bp, Artificial Sequence
  Synthetic
tgctgtttcagggtttttttaaccggccccacggcgccccggggggcgcgatcacggcggagcagaccaacgtga

SEQ ID NO: 155886 - DNA, 75 bp, Artificial Sequence
  Synthetic
gtcaaggggcgcctcggcctggacgcccggccgatgatggccagcatgtggatcagctgcttcgtgcgcatgccc

SEQ ID NO: 155887 - DNA, 75 bp, Artificial Sequence
  Synthetic
tgggccccgaggacgccgttcgcacgcggcggatcctgtgtcgcgccgccgagcaggccctcgcccgtcgccgcc

SEQ ID NO: 155888 - DNA, 75 bp, Artificial Sequence
  Synthetic
caccactcttccggagcgcccgggccgggggtcgccgcctcgggcccgccagcgccgcccggacggggaccggcc

SEQ ID NO: 155889 - DNA, 75 bp, Artificial Sequence
  Synthetic
cgggggtcgccgcctcgggcccgccagcgccgcccggacggggaccggcccgtccgtggcatcaggccgtgcagt

SEQ ID NO: 155890 - DNA, 75 bp, Artificial Sequence
  Synthetic
gggctgtttctgggggccgctatctggtgggcggttggcgcgcgcctatgaaagggggcgagccaccgtcccgcc

SEQ ID NO: 155891 - DNA, 75 bp, Artificial Sequence
  Synthetic
ggtgggcggttggcgcgcgcctatgaaagggggcgagccaccgtcccgcccgccagtgcatcccagacgcccgcg

SEQ ID NO: 155892 - DNA, 75 bp, Artificial Sequence
  Synthetic
cccaaggtcccgatggccgccccgcagtttcaccgccccagcaccattaccgccgacaacgtccgggcgctcggc

SEQ ID NO: 155893 - DNA, 75 bp, Artificial Sequence
  Synthetic
gaagaggaggcggcggcggcgaccgcggcctgggacgacggagacgccgacgggggcgcggcgcccgcggacgcc

SEQ ID NO: 155894 - DNA, 75 bp, Artificial Sequence
  Synthetic
acaacgctcagttcatcatggataacagctacccgcatccgcacggaacgcagggtgcggtgcgagagtttcttc

SEQ ID NO: 155895 - DNA, 75 bp, Artificial Sequence
  Synthetic
cagggtgcggtgcgagagtttcttcgcgggcaggccgcggcgctgacggacctcggggtgacccacgccaacaac

SEQ ID NO: 155896 - DNA, 75 bp, Artificial Sequence
  Synthetic
gcgggcaggccgcggcgctgacggacctcggggtgacccacgccaacaacacgttcgccccgcagcctatgttcg

SEQ ID NO: 155897 - DNA, 75 bp, Artificial Sequence
  Synthetic
ccgccatcctcccgcccggccgcccactccccgctcggcctctccggctgcggtgcttgggtctccttcgtcggg

SEQ ID NO: 155898 - DNA, 75 bp, Artificial Sequence
  Synthetic
acgtattccccctttgtcgttcgcgaccccaagacccccagcaccccgtgagtcctcggcgggtccctccgcggc

SEQ ID NO: 155899 - DNA, 75 bp, Artificial Sequence
  Synthetic
gcccggcgcggcgccgccctcttggcccccaccccctggggggcgaggggcgagcgcggggcggcggaggaagag

SEQ ID NO: 155900 - DNA, 75 bp, Artificial Sequence
  Synthetic
ggcccaacgatcggcgattaacaacaccaaacaatcgagcgcgtctaacccagtaacatgcgcacgtgatgtagg

SEQ ID NO: 155901 - DNA, 75 bp, Artificial Sequence
  Synthetic
accaaacaatcgagcgcgtctaacccagtaacatgcgcacgtgatgtaggctggtcagcacggcgttgctgcgct

SEQ ID NO: 155902 - DNA, 75 bp, Artificial Sequence
  Synthetic
gcgcggatcaaaaccgccagggcgctacgaccggtgcttcgtacgtagcgtcgcgacaagacggcatttgcctgt

SEQ ID NO: 155903 - DNA, 75 bp, Artificial Sequence
  Synthetic
tacgaccggtgcttcgtacgtagcgtcgcgacaagacggcatttgcctgtacgggcaaggggccaaattgcgagt

SEQ ID NO: 155904 - DNA, 75 bp, Artificial Sequence
  Synthetic
gacccgcacgtgatctgggcggagggcgccggcccgggcgccagcccgcggctgtactcggtcgtcgggccgctg

SEQ ID NO: 155905 - DNA, 75 bp, Artificial Sequence
  Synthetic
gggggcaagtgcggttccggtgggagggggtcgagcgcctcggtatcatccgagtccgagaaacgcagggagtct

SEQ ID NO: 155906 - DNA, 75 bp, Artificial Sequence
  Synthetic
aagtcacagcggacactgggaggtgggtgtttgtatgtgtgggagactcgggcgtcgggaccgagtctcggctct

SEQ ID NO: 155907 - DNA, 75 bp, Artificial Sequence
  Synthetic
ggggggcgggcgggacgtagtccgctgcagagggagacagagacgggaacccccggttagtgcccgacccccgcc

SEQ ID NO: 155908 - DNA, 75 bp, Artificial Sequence
  Synthetic
ggggcggctggggcaggggcggctggggcaggggcggctggggcaggggcggctggggcaggggcggctggggca

SEQ ID NO: 155909 - DNA, 75 bp, Artificial Sequence
  Synthetic
ggggcggctggggcaggggcggctggggcaggggcggctggggcaccgagcgcgcgcggatgcgcgtccgcgcgg

SEQ ID NO: 155910 - DNA, 75 bp, Artificial Sequence
  Synthetic
ccgggcacgacccaaccgcacaaaggctcgctcggggcaaccgggcctggggccaaaggcggggggctggtctgg

SEQ ID NO: 155911 - DNA, 75 bp, Artificial Sequence
  Synthetic
gctcgctcggggcaaccgggcctggggccaaaggcggggggctggtctggacggcggaggtcgggggggcaaggc

SEQ ID NO: 155912 - DNA, 75 bp, Artificial Sequence
  Synthetic
gtgtgttttcatatattttaaataaacaaacaaccggacaaaagtatacccacttcgtgtgcttgtgtttttgtt

SEQ ID NO: 155913 - DNA, 75 bp, Artificial Sequence
  Synthetic
tcagggcccaagacatggtgtcccgtccacgaaggcggcgcccggcctgcgagaaagcgcggatgttgggatcgg

SEQ ID NO: 155914 - DNA, 75 bp, Artificial Sequence
  Synthetic
tcggctgggtcccggggagaggggagggagttcaacgaggccgagagcgaggcgaccgcggggcgcgtgaggcgc

SEQ ID NO: 155915 - DNA, 75 bp, Artificial Sequence
  Synthetic
gagaaagcgcggatgttgggatcggccccccggccccccggcccgtccccccgaccccccggcccgtccccccgg

SEQ ID NO: 155916 - DNA, 75 bp, Artificial Sequence
  Synthetic
gagaaagcgcggatgttgggatcggccccccggccccccggcccgtccccccgtccccccggcccgtccccccgg

SEQ ID NO: 155917 - DNA, 75 bp, Artificial Sequence
  Synthetic
gagaaagcgcggatgttgggatcggccccccggccccccggcccgtccccccgcccccccggcccgtccccccgg

SEQ ID NO: 155918 - DNA, 75 bp, Artificial Sequence
  Synthetic
gagaaagcgcggatgttgggatcggccccccggccccccggcccgtccccccggccccccggcccgtccccccgg

SEQ ID NO: 155919 - DNA, 75 bp, Artificial Sequence
  Synthetic
ggcgaccgcggggcgcgtgaggcgccggggtgggccggccgcggggccccgggggggtgtcggcgagggacccgc

SEQ ID NO: 155920 - DNA, 75 bp, Artificial Sequence
  Synthetic
cttcggcgggcggaggcgggatgggcgcgagcgtgggggcgggaaaggccccgcgagccgaggcggggccgggcg

SEQ ID NO: 155921 - DNA, 75 bp, Artificial Sequence
  Synthetic
ccgcgagccgaggcggggccgggcggaaggggcaaagcagaaacccaagccgggggcgcggactccggggtgggc

SEQ ID NO: 155922 - DNA, 75 bp, Artificial Sequence
  Synthetic
gagtgccggcggacgccacccctcggggggggcggaggcccggggcgcgcgcgatttggcacgcgtccggcggga

SEQ ID NO: 155923 - DNA, 75 bp, Artificial Sequence
  Synthetic
gggggggcggaggcccggggcgcgcgcgatttggcacgcgtccggcgggatctgcgcacgcgcggcacggcggcg

SEQ ID NO: 155924 - DNA, 75 bp, Artificial Sequence
  Synthetic
cgcggggggactcggtgtgggtggcgagggccgtgggtcgtcgcgaggggccacgggcacgcgccccgtgttttg

SEQ ID NO: 155925 - DNA, 75 bp, Artificial Sequence
  Synthetic
ctctctcttgccgggttttagtctctgtctctccgggtctcctcctcccgccgggccgccgctccgtcgctcgca

SEQ ID NO: 155926 - DNA, 75 bp, Artificial Sequence
  Synthetic
tgggcgtggggccgccggcgtcgtcggacgccagctcctccaggccgtggatccaggcccacatgcgagggggga

SEQ ID NO: 155927 - DNA, 75 bp, Artificial Sequence
  Synthetic
gacggggggacgggacggggggacgggacggggggacgggacggggggacgggacggggggacgggacgggggga

SEQ ID NO: 155928 - DNA, 75 bp, Artificial Sequence
  Synthetic
ggacgccagctcctccaggccgtggatccaggcccacatgcgaggggggacgggctcgccggtggtggcgtcggt

SEQ ID NO: 155929 - DNA, 75 bp, Artificial Sequence
  Synthetic
gggacggggggacgggacggggggacgggacggggggccgggacggggggccgggcggggggccggggggacggg

SEQ ID NO: 155930 - DNA, 75 bp, Artificial Sequence
  Synthetic
cagcggggtcctcgggacccgatccgccatccccccccgcaaggtcccgcgggtcgcgggcggcggtcggggcag

SEQ ID NO: 155931 - DNA, 75 bp, Artificial Sequence
  Synthetic
gccatccccccccgcaaggtcccgcgggtcgcgggcggcggtcggggcagagggacctgcctcgtcggcgagggg

SEQ ID NO: 155932 - DNA, 75 bp, Artificial Sequence
  Synthetic
cgtcgaagggccgcccgaggatggcccgcgcgaagaaggggtccgcgtcggcggcgctcgccgcgagaacgtccc

SEQ ID NO: 155933 - DNA, 75 bp, Artificial Sequence
  Synthetic
ccgcgcgaagaaggggtccgcgtcggcggcgctcgccgcgagaacgtcccccgcggtagccacaaacggaagctc

SEQ ID NO: 155934 - DNA, 75 bp, Artificial Sequence
  Synthetic
acgcccggaacccggggcaccgcccgtacccccccaacggacccaaagacgcacccacacggacccgcggacgct

SEQ ID NO: 155935 - DNA, 75 bp, Artificial Sequence
  Synthetic
ccggggcttcccacaagaccgcgaccggggtcatggagatgtccacgaggaccaggcacgggggcccgtcggcga

SEQ ID NO: 155936 - DNA, 75 bp, Artificial Sequence
  Synthetic
cggggtcatggagatgtccacgaggaccaggcacgggggcccgtcggcgagagggcgctcggcgatgagcgccga

SEQ ID NO: 155937 - DNA, 75 bp, Artificial Sequence
  Synthetic
cgtcgtcttcttcttcttccgctgctccgccgacatcgcctccgaccggggtgtgcggggggggggggtcttctt

SEQ ID NO: 155938 - DNA, 75 bp, Artificial Sequence
  Synthetic
cggtgtggaggaggccgacggcccacgtctcgatgtcggacgacacgacgtcgcgcagggcggcgtccggcccgc

SEQ ID NO: 155939 - DNA, 75 bp, Artificial Sequence
  Synthetic
cgtctcgatgtcggacgacacgacgtcgcgcagggcggcgtccggcccgccggggcgcgagtcgaagagcgtcag

SEQ ID NO: 155940 - DNA, 75 bp, Artificial Sequence
  Synthetic
ccaccacgacgggcgcgccgaggagcaccgcggccagaaccaggtccatggccgtaacgcgcgcggcgggggtgc

SEQ ID NO: 155941 - DNA, 75 bp, Artificial Sequence
  Synthetic
caccgcggccagaaccaggtccatggccgtaacgcgcgcggcgggggtgcggtgggtcgcggcggccagcacggc

SEQ ID NO: 155942 - DNA, 75 bp, Artificial Sequence
  Synthetic
acgcctcgcgcccccccgccgggccgagcgtctggccagactccaggcgtgcggccaggagggcgtcgaagctgt

SEQ ID NO: 155943 - DNA, 75 bp, Artificial Sequence
  Synthetic
cggggcgcaggcgatacgcgcacccgagcgtgcgttacgtatgtctgccacccgagcgggattagggggtggggg

SEQ ID NO: 155944 - DNA, 75 bp, Artificial Sequence
  Synthetic
gagcgtctggccagactccaggcgtgcggccaggagggcgtcgaagctgtcgtactcggtgtagtcgtcgggaaa

SEQ ID NO: 155945 - DNA, 75 bp, Artificial Sequence
  Synthetic
gccggggggacgggccggggggacgggacggggggccggggcggggggccggggcggggggccggggcggggggc

SEQ ID NO: 155946 - DNA, 75 bp, Artificial Sequence
  Synthetic
cgaggacgctcaccgccgccagggcctgggccggactgagcttcccgagcgccggggcgtcccggcgctgggtcc

SEQ ID NO: 155947 - DNA, 75 bp, Artificial Sequence
  Synthetic
ctgggccggactgagcttcccgagcgccggggcgtcccggcgctgggtcccgagctccaaggccgagcgccaggg

SEQ ID NO: 155948 - DNA, 75 bp, Artificial Sequence
  Synthetic
ggccctcgagacgcgcaacttttggccacacagagaaaggcccccagactaagtcacccgggtccccgaacaaaa

SEQ ID NO: 155949 - DNA, 75 bp, Artificial Sequence
  Synthetic
gtcagggggtcgggtcagggggtcgggtcagggggtcgggtcagggggtcggaggggaggcgtaccttcccgcgc

SEQ ID NO: 155950 - DNA, 75 bp, Artificial Sequence
  Synthetic
gcgtgccgaacaggaggccccgggtcggggggcctccgtccaaaaacgtcggcaacacgcggatgcgggcgtcgg

SEQ ID NO: 155951 - DNA, 75 bp, Artificial Sequence
  Synthetic
cggggggcctccgtccaaaaacgtcggcaacacgcggatgcgggcgtcgggatgcggggtcaggcgctggacgaa

SEQ ID NO: 155952 - DNA, 75 bp, Artificial Sequence
  Synthetic
tgtactcgtgctggcgaacgaggtccaggcgccagaagttgtagatgtgttccggaacgccggccaccagcgcga

SEQ ID NO: 155953 - DNA, 75 bp, Artificial Sequence
  Synthetic
caggcgccagaagttgtagatgtgttccggaacgccggccaccagcgcgaccagcacgtcgttctcgttgaaggc

SEQ ID NO: 155954 - DNA, 75 bp, Artificial Sequence
  Synthetic
ccgctccggacgcccagcccagctgggcccagcgacacccaaactcgcgcgtgagggtggtggcgacgagggcga

SEQ ID NO: 155955 - DNA, 75 bp, Artificial Sequence
  Synthetic
ggcccagcgacacccaaactcgcgcgtgagggtggtggcgacgagggcgacgtacagctcggccgccgcgtccat

SEQ ID NO: 155956 - DNA, 75 bp, Artificial Sequence
  Synthetic
gaaagttggcggcctgggcgtcgctgagggccagctggagccggttcacgacggtcagcacgtacatggccgtga

SEQ ID NO: 155957 - DNA, 75 bp, Artificial Sequence
  Synthetic
gagggccagctggagccggttcacgacggtcagcacgtacatggccgtgaccgtcggggccgattcgaggacgtc

SEQ ID NO: 155958 - DNA, 75 bp, Artificial Sequence
  Synthetic
cgccgagtttgtcggtgacggccgggaagcatagcgcgtactgcagcggcgttccgtccggggccaaaaagctgg

SEQ ID NO: 155959 - DNA, 75 bp, Artificial Sequence
  Synthetic
gaagcatagcgcgtactgcagcggcgttccgtccggggccaaaaagctggtggcgaacggcagatccagagcgct

SEQ ID NO: 155960 - DNA, 75 bp, Artificial Sequence
  Synthetic
acgcctcgccccggcggcgcagcagctgcgggtcgacctcgtggccctcgggggaagaagaggcccgggcgcggg

SEQ ID NO: 155961 - DNA, 75 bp, Artificial Sequence
  Synthetic
ctgcgggtcgacctcgtggccctcgggggaagaagaggcccgggcgcgggcgtcgagggcgcgaagatcaacgag

SEQ ID NO: 155962 - DNA, 75 bp, Artificial Sequence
  Synthetic
ccttccccgcgcccgccgccgcgggccgccgcccctccccccgcgcgccgcgcgccttttttcccccgccgcccc

SEQ ID NO: 155963 - DNA, 75 bp, Artificial Sequence
  Synthetic
tggcgtacgcgctatataagcccatgcggtattggatgagttcccgcgcgccccggaactcctccaccgcccacg

SEQ ID NO: 155964 - DNA, 75 bp, Artificial Sequence
  Synthetic
gcggtattggatgagttcccgcgcgccccggaactcctccaccgcccacggggccaggtccgcggccgccgcgtc

SEQ ID NO: 155965 - DNA, 75 bp, Artificial Sequence
  Synthetic
aggggagggagggggtggcggggaaccgtgtgcgggcgggcgggtgcttggtgctactgtgtggtctgcgagggc

SEQ ID NO: 155966 - DNA, 75 bp, Artificial Sequence
  Synthetic
gcgggcgccgcccctccccccgcgcgccgcgcgccttttttcccgcgcccgcccccgcgcgccttttttcccgcg

SEQ ID NO: 155967 - DNA, 75 bp, Artificial Sequence
  Synthetic
ccctgcgcaccacctcatcccgcagccgggcgcacagggcggtgtgcttggtgacgcgcgcgcccagctcctcca

SEQ ID NO: 155968 - DNA, 75 bp, Artificial Sequence
  Synthetic
ccgggcgcacagggcggtgtgcttggtgacgcgcgcgcccagctcctccacggcctccgcgcgctcggcgccctt

SEQ ID NO: 155969 - DNA, 75 bp, Artificial Sequence
  Synthetic
caaactcccgagctccccgcccccctaaagacgacagtcgcaccaccgctcgccctggcagaccacacagtagca

SEQ ID NO: 155970 - DNA, 75 bp, Artificial Sequence
  Synthetic
ggggcgcgaaggcgggcggcggcggcgggcgggcggcagggcggccccgcgcgcccccttccccgcgcccggcgc

SEQ ID NO: 155971 - DNA, 75 bp, Artificial Sequence
  Synthetic
gggcccgcagccccgacaccgtgttggtggtgtcctgcagggcgcgcagctgctcgtgcatggcgcggaacccct

SEQ ID NO: 155972 - DNA, 75 bp, Artificial Sequence
  Synthetic
ggtggtgtcctgcagggcgcgcagctgctcgtgcatggcgcggaacccctcgggggacttccaggcgcccccccg

SEQ ID NO: 155973 - DNA, 75 bp, Artificial Sequence
  Synthetic
tcccctccatcccgccgatctcgcagcagcccctcccccccgcgcgccgcggggctgctttcccgcgcccgcccc

SEQ ID NO: 155974 - DNA, 75 bp, Artificial Sequence
  Synthetic
gcagcccctcccccccgcgcgccgcggggctgctttcccgcgcccgcccccgcgcggccgcctccccccgcgccc

SEQ ID NO: 155975 - DNA, 75 bp, Artificial Sequence
  Synthetic
ccagggacctccgcagggcgtcgacgcggcgccgagtatcaaagagcgcccccaggcggccggcgtgccgcgcca

SEQ ID NO: 155976 - DNA, 75 bp, Artificial Sequence
  Synthetic
gcggcgccgagtatcaaagagcgcccccaggcggccggcgtgccgcgccagggggccggggccgtcgccgcgggc

SEQ ID NO: 155977 - DNA, 75 bp, Artificial Sequence
  Synthetic
cccccgcgcccgcggccccgagctcgcagcagcccctccctcccgcgccccgtgccttccctcccgctcctgcgg

SEQ ID NO: 155978 - DNA, 75 bp, Artificial Sequence
  Synthetic
cgtgccttccctcccgctcctgcgggggggctcgggccacctgaccttcgtaacctgcactcaggtcagagcccc

SEQ ID NO: 155979 - DNA, 75 bp, Artificial Sequence
  Synthetic
taacctgcactcaggtcagagccccagaccccccgcgggcgcgggagacgtgccgcccgcccgaccccgaccccc

SEQ ID NO: 155980 - DNA, 75 bp, Artificial Sequence
  Synthetic
taaccgcgggcacgtcgagctcgcgcgttttctcggtctgatccaacagaacctcgacctggtcggcgatctccg

SEQ ID NO: 155981 - DNA, 75 bp, Artificial Sequence
  Synthetic
cgttttctcggtctgatccaacagaacctcgacctggtcggcgatctccgccaccgagcgcgcctggtcgagcgt

SEQ ID NO: 155982 - DNA, 75 bp, Artificial Sequence
  Synthetic
tggccaggccctcggcctcgatctgggcccggcgctcgcgcgcggccagcgcctcccgcaggcccgccatgaccc

SEQ ID NO: 155983 - DNA, 75 bp, Artificial Sequence
  Synthetic
ggcccggcgctcgcgcgcggccagcgcctcccgcaggcccgccatgacccgctcggtggcctccgcgcgctgctg

SEQ ID NO: 155984 - DNA, 75 bp, Artificial Sequence
  Synthetic
cgaaggcgacatactcggcgtacgccgtgttcttcacggggctctggtccacgcgctccaacgccgccgcgcacg

SEQ ID NO: 155985 - DNA, 75 bp, Artificial Sequence
  Synthetic
cgtgttcttcacggggctctggtccacgcgctccaacgccgccgcgcacgcgaccagcgcgtcctcgctgggaca

SEQ ID NO: 155986 - DNA, 75 bp, Artificial Sequence
  Synthetic
tccgggccgcggatatctgctccgcggcggccgccaggtccaggggcacgccgccgagcgcccggtgcacgtcgg

SEQ ID NO: 155987 - DNA, 75 bp, Artificial Sequence
  Synthetic
ggcggccgccaggtccaggggcacgccgccgagcgcccggtgcacgtcggcccggatggcgtccaggcgatcgcg

SEQ ID NO: 155988 - DNA, 75 bp, Artificial Sequence
  Synthetic
gcaggccgggcacgctcgtcatgtcgtccgccaggcgccccacggcctcgtggtagtcgataaacccgtcgcccg

SEQ ID NO: 155989 - DNA, 75 bp, Artificial Sequence
  Synthetic
gtccgccaggcgccccacggcctcgtggtagtcgataaacccgtcgcccgcctgggccatttccaggagcccctc

SEQ ID NO: 155990 - DNA, 75 bp, Artificial Sequence
  Synthetic
cggcgtaggtttcggcggcggcgtggaacgccgcgctccagccgaggcggtggatggcggcgagcggggggagca

SEQ ID NO: 155991 - DNA, 75 bp, Artificial Sequence
  Synthetic
gaacgccgcgctccagccgaggcggtggatggcggcgagcggggggagcatggggtggcgctggttctcgggggt

SEQ ID NO: 155992 - DNA, 75 bp, Artificial Sequence
  Synthetic
cgttggccgcgagcgcctgctcggcgcgcttgcggaagtcccgggggttgtagccgtgcgtgcccgccagcgcct

SEQ ID NO: 155993 - DNA, 75 bp, Artificial Sequence
  Synthetic
gcaggcggcgcagctcgaccacgtcgaactcggcgcggttctcgacgcggtccagcgccgcctcgacgccggcgg

SEQ ID NO: 155994 - DNA, 75 bp, Artificial Sequence
  Synthetic
cccagcgctcgctgctgccccgggcgcgctgggccgccatcttcgccgtcaggtcggcgacggcggcctcaagtt

SEQ ID NO: 155995 - DNA, 75 bp, Artificial Sequence
  Synthetic
gcgctgggccgccatcttcgccgtcaggtcggcgacggcggcctcaagttcgtcggcgcggcgtcgcgtggcgcc

SEQ ID NO: 155996 - DNA, 75 bp, Artificial Sequence
  Synthetic
cggccgtcccttcggcgtgcagcaggcccccgaacccagcctcgtgccccgcgaggctttcccgagcagcggtcg

SEQ ID NO: 155997 - DNA, 75 bp, Artificial Sequence
  Synthetic
gcccccgaacccagcctcgtgccccgcgaggctttcccgagcagcggtcgtcgcgcgggccgcggcatcgatgag

SEQ ID NO: 155998 - DNA, 75 bp, Artificial Sequence
  Synthetic
ccaggtcggcggccgccgaccccagggtcgtgagctcgtcgatggccccccgcgcctccagggccagccgagtcg

SEQ ID NO: 155999 - DNA, 75 bp, Artificial Sequence
  Synthetic
ggtcgtgagctcgtcgatggccccccgcgcctccagggccagccgagtcgcctttacataccccgcggcgctatc

SEQ ID NO: 156000 - DNA, 75 bp, Artificial Sequence
  Synthetic
ccccccgtccccccgtcccggccccccgtccccccgtccccccgtcccgccccccggcccgtccccccggcccgg

SEQ ID NO: 156001 - DNA, 75 bp, Artificial Sequence
  Synthetic
cgcccagggccgacaccgcgtccgccagggcgccatgcgcccgcacggccgcgtccaccgtcgccgcgggacttg

SEQ ID NO: 156002 - DNA, 75 bp, Artificial Sequence
  Synthetic
cagggcgccatgcgcccgcacggccgcgtccaccgtcgccgcgggacttgccgtcgcgacggcggcgctcccggc

SEQ ID NO: 156003 - DNA, 75 bp, Artificial Sequence
  Synthetic
agaactgcacgaggaccggcgtctcgggggcgtcggcgaacagggtcttcagcaccaccacgaaggcgggatgca

SEQ ID NO: 156004 - DNA, 75 bp, Artificial Sequence
  Synthetic
ggccggccagagccgtcgcggtatccggggtcgggtgttccagggcctcccggtactgccccagcagcccccaca

SEQ ID NO: 156005 - DNA, 75 bp, Artificial Sequence
  Synthetic
tgggacttggactccgcataaagggagtctcgaaggacagaaactaggacagttcataggccgggagcgtggggc

SEQ ID NO: 156006 - DNA, 75 bp, Artificial Sequence
  Synthetic
tcggccaggtcggtccaccccgcgggcagggaggcccgcagggtcgccagcacggccggacacgcctttagcccc

SEQ ID NO: 156007 - DNA, 75 bp, Artificial Sequence
  Synthetic
gcagggaggcccgcagggtcgccagcacggccggacacgcctttagccccacaaagtccgggaggggccgcagga

SEQ ID NO: 156008 - DNA, 75 bp, Artificial Sequence
  Synthetic
gcgcgctcccgcgcgtcgttgagcatcgcctccagggcgtgggcgcgctcccgaagccgggagcgcgcctccgga

SEQ ID NO: 156009 - DNA, 75 bp, Artificial Sequence
  Synthetic
tcgcctccagggcgtgggcgcgctcccgaagccgggagcgcgcctccggagcgagctccgccgtcatcttggccg

SEQ ID NO: 156010 - DNA, 75 bp, Artificial Sequence
  Synthetic
tcgggggacagcccgcccccgtcgacgtacggcgcggggccggtcgccgggacgaaggccgcgtcgctgtccagc

SEQ ID NO: 156011 - DNA, 75 bp, Artificial Sequence
  Synthetic
cgtacggcgcggggccggtcgccgggacgaaggccgcgtcgctgtccagctgctgcgcgagcgccgcgtcgaggg

SEQ ID NO: 156012 - DNA, 75 bp, Artificial Sequence
  Synthetic
tcgttgatgccgtggatgctgcgcgccagctcttccaggggcttgcgttcgatgagcccctgggtcgcggcgtcg

SEQ ID NO: 156013 - DNA, 75 bp, Artificial Sequence
  Synthetic
ccagctcttccaggggcttgcgttcgatgagcccctgggtcgcggcgtcggtcaggaccgagagccaggccgcca

SEQ ID NO: 156014 - DNA, 75 bp, Artificial Sequence
  Synthetic
aggatggcctgggggctggtggcgagggggggcgggggggggagcgcggcgcgctgagcgacgtcccgcgtgtgt

SEQ ID NO: 156015 - DNA, 75 bp, Artificial Sequence
  Synthetic
gggggggcgggggggggagcgcggcgcgctgagcgacgtcccgcgtgtgttggtcaaaggccggtagcgattcca

SEQ ID NO: 156016 - DNA, 75 bp, Artificial Sequence
  Synthetic
tcgtggctgtcgctggcctgcagggccttcgcgctgtatacggctccccggtggaagtactccttgatcgcgctc

SEQ ID NO: 156017 - DNA, 75 bp, Artificial Sequence
  Synthetic
tcgatcgcccggcgggcctggatccgcacgtcctccagccgcgcctggatggcctcggggcccagggcgggcggg

SEQ ID NO: 156018 - DNA, 75 bp, Artificial Sequence
  Synthetic
caggggcccggcgcgctgcgagaccgagtcgaccccgcgggcgagggcgtctaaggcctcgcgcatctcgcgggc

SEQ ID NO: 156019 - DNA, 75 bp, Artificial Sequence
  Synthetic
gagtcgaccccgcgggcgagggcgtctaaggcctcgcgcatctcgcgggcctccgcctcgacccgcatctcttcg

SEQ ID NO: 156020 - DNA, 75 bp, Artificial Sequence
  Synthetic
gtgcgtcggggtggcgggggcgaacagggtgttcgggtgggcgcgcgagcgctccaggagccactctccgaggcg

SEQ ID NO: 156021 - DNA, 75 bp, Artificial Sequence
  Synthetic
agggtgttcgggtgggcgcgcgagcgctccaggagccactctccgaggcgtgcgtacagattggccggcggggcg

SEQ ID NO: 156022 - DNA, 75 bp, Artificial Sequence
  Synthetic
ctcccgaataacgtccctggcgaccaggaccagcttagcgagggccaggcgcccgatctgcgaattttcgtccag

SEQ ID NO: 156023 - DNA, 75 bp, Artificial Sequence
  Synthetic
ccccccgcacaccccggtcggaggcgatgtcggcggagcagcggaagaagaagaagacgacgacgacgacgcagg

SEQ ID NO: 156024 - DNA, 75 bp, Artificial Sequence
  Synthetic
gcccgatctgcgaattttcgtccagcacgtgctggatgaggggccggtgggcggccacgtccgccaggctcatgc

SEQ ID NO: 156025 - DNA, 75 bp, Artificial Sequence
  Synthetic
ggaggaggaggcggaggacgccgacgacgaggatccggattttgatgagtcagaggcggccgagcgccggcgggg

SEQ ID NO: 156026 - DNA, 75 bp, Artificial Sequence
  Synthetic
ggccgttttgcggggcagcatgcgcagggtgaagtccagcagggccgcggccgggccggccaccccggcctgcgt

SEQ ID NO: 156027 - DNA, 75 bp, Artificial Sequence
  Synthetic
ccgggccggccaccccggcctgcgtatgcgtgcgggccccgttctcgatcaaaaaggcgaggacgcgctcaaaga

SEQ ID NO: 156028 - DNA, 75 bp, Artificial Sequence
  Synthetic
ccccccccactcccacccccacttcctgtctcctccccgtcttcccccccccccacctccccctgcccccgaggc

SEQ ID NO: 156029 - DNA, 75 bp, Artificial Sequence
  Synthetic
cgcagggcgttgatggtgagctgcgaacacgcggccacctcgcgggccagggcggcatcgcgcgccgcgagccgg

SEQ ID NO: 156030 - DNA, 75 bp, Artificial Sequence
  Synthetic
ggcgagacgacgccgtccgcggcaggctcgtcgacggcctccccggacgccggggccgcctcgtcggcatcggca

SEQ ID NO: 156031 - DNA, 75 bp, Artificial Sequence
  Synthetic
ggaggaggcggggacctcggcggcgacgggggccttcttcttgggcgcggacttcttcttggccttggcgggcgg

SEQ ID NO: 156032 - DNA, 75 bp, Artificial Sequence
  Synthetic
acgggggccttcttcttgggcgcggacttcttcttggccttggcgggcggggccttgggggcgggcctctcgccc

SEQ ID NO: 156033 - DNA, 75 bp, Artificial Sequence
  Synthetic
cccgcggccctgcgtcgtcgtcgtcgtcgtcgtcttcttcttccgctgctccgccgacatcgcctccgaccgggg

SEQ ID NO: 156034 - DNA, 75 bp, Artificial Sequence
  Synthetic
cttgggcaagccggtagaatagcgcgcccggtggcgacccaccggcactgcccccacctccaggacccgcaggtc

SEQ ID NO: 156035 - DNA, 75 bp, Artificial Sequence
  Synthetic
gcccggtggcgacccaccggcactgcccccacctccaggacccgcaggtcctcggcttcttcggccgcgtccccg

SEQ ID NO: 156036 - DNA, 75 bp, Artificial Sequence
  Synthetic
gtccggggccgagggcttcgcgggcggggtcccctccagggctgctgcccacacatcatcgggggggcggtttgg

SEQ ID NO: 156037 - DNA, 75 bp, Artificial Sequence
  Synthetic
ccggcggccagccccgccgcagctcataaaaatcgtgagtcacggcaaccgcaccttcgcctccggccctccgcc

SEQ ID NO: 156038 - DNA, 75 bp, Artificial Sequence
  Synthetic
gggcccgaggccccccggggggcctcggggggccggtcggcccgaggggtctggacgtgggtgggcgcggggagc

SEQ ID NO: 156039 - DNA, 75 bp, Artificial Sequence
  Synthetic
ctggacgtgggtgggcgcggggagcgcggggacgaccgggcccgagccttctccgtcccccctggggaccacacc

SEQ ID NO: 156040 - DNA, 75 bp, Artificial Sequence
  Synthetic
gacaaagagcgccccgagccccccgatctcgccccgcagggggtgggtgatggccacgcgccgctcgacgaacgg

SEQ ID NO: 156041 - DNA, 75 bp, Artificial Sequence
  Synthetic
atctcgccccgcagggggtgggtgatggccacgcgccgctcgacgaacggttcgtcctgcaggtaagtctcgctg

SEQ ID NO: 156042 - DNA, 75 bp, Artificial Sequence
  Synthetic
ttccgggttcgtggtaatgagatgccggccccgcgctcccgttggcccccgccggccccaaaggggccggcgagg

SEQ ID NO: 156043 - DNA, 75 bp, Artificial Sequence
  Synthetic
ccccgggccggagggcacaaaaaacaccatggcgcccgcccaccgcaccttggggcggtcgtgggcgtaatacgt

SEQ ID NO: 156044 - DNA, 75 bp, Artificial Sequence
  Synthetic
accatggcgcccgcccaccgcaccttggggcggtcgtgggcgtaatacgtcaggtacgggtacacgtcgcccgcc

SEQ ID NO: 156045 - DNA, 75 bp, Artificial Sequence
  Synthetic
cggaggggggtcagggggtcggaggggggtcagggggtcggaggggggtcagggggtcggaggggaggcgcacct

SEQ ID NO: 156046 - DNA, 75 bp, Artificial Sequence
  Synthetic
aaacagataggccgtgtcgccgtcccggtagagccccatgcccagggggccgatggtcaggagcgtgtaggacag

SEQ ID NO: 156047 - DNA, 75 bp, Artificial Sequence
  Synthetic
cggtagagccccatgcccagggggccgatggtcaggagcgtgtaggacagcggccgcatggcccaggggccggcg

SEQ ID NO: 156048 - DNA, 75 bp, Artificial Sequence
  Synthetic
cccgaagaagcccacctcgccgtacacccgcgaaaacacgcaacgcaggccgccgcgcgccgccgggtactccag

SEQ ID NO: 156049 - DNA, 75 bp, Artificial Sequence
  Synthetic
acccgcgaaaacacgcaacgcaggccgccgcgcgccgccgggtactccaggaagttggggagctcgataatggaa

SEQ ID NO: 156050 - DNA, 75 bp, Artificial Sequence
  Synthetic
tgcgccgcgcctacgcgcccctgctggcgcgcgagaacgcggcgctgaccggggcgcgaacccccgacgacggcg

SEQ ID NO: 156051 - DNA, 75 bp, Artificial Sequence
  Synthetic
ctccaccagacatccctcgatggcctccgcggacagcacgtcgcggggccccacgtcgaaaagaagactgagaaa

SEQ ID NO: 156052 - DNA, 75 bp, Artificial Sequence
  Synthetic
tccgcggacagcacgtcgcggggccccacgtcgaaaagaagactgagaaacgacagggacgagcgcatgcacgat

SEQ ID NO: 156053 - DNA, 75 bp, Artificial Sequence
  Synthetic
gtcccggccccccgtccccccggcccggccccccgtccccccggcccgtccccccgtccccccgtccccccgtcc

SEQ ID NO: 156054 - DNA, 75 bp, Artificial Sequence
  Synthetic
ggccccgccccaaagggggcggggccgcagggtaaaagaagtgagaacgcgaagcgttcgcacttcgtcctaata

SEQ ID NO: 156055 - DNA, 75 bp, Artificial Sequence
  Synthetic
gaccacgatatcgcgatccccctggcgcttcatcgtggggtgaggtagcgcggccggaatcatgtgtgccgcgcc

SEQ ID NO: 156056 - DNA, 75 bp, Artificial Sequence
  Synthetic
ccggccccccggcccggccccccggcccggccccccggcccggccccccggcccggccccccggcccgtcccccc

SEQ ID NO: 156057 - DNA, 75 bp, Artificial Sequence
  Synthetic
cgcgaggacccatccacccactgcagccttatcgcaggtacggtgacccggggggccgggacggggggacggggg

SEQ ID NO: 156058 - DNA, 75 bp, Artificial Sequence
  Synthetic
gacgggacggggggccgggacggggggacggggggacgggacggggggacggggggccgggggacgggccggggg

SEQ ID NO: 156059 - DNA, 75 bp, Artificial Sequence
  Synthetic
tcacccgtcccggctggcgtgcgcagcccgggccgtgttgcgggccctcttaaggggcggcggcaggacggggac

SEQ ID NO: 156060 - DNA, 75 bp, Artificial Sequence
  Synthetic
ccatcaaccgcctgttcgtccccctaaccacacacccggtatcgcgtgtgtgtggtttcccgggaagccacatcc

SEQ ID NO: 156061 - DNA, 75 bp, Artificial Sequence
  Synthetic
gatcggcgcggagaggcgaaaagacacaggcacacgcacgcaccgcacggggggggagagagaccgccaaccccc

SEQ ID NO: 156062 - DNA, 75 bp, Artificial Sequence
  Synthetic
caaccaactcccagatggatgggtgcgataataaagctttattattgtttaaccaaaggcgagtcctacgggtgt

SEQ ID NO: 156063 - DNA, 75 bp, Artificial Sequence
  Synthetic
cgataataaagctttattattgtttaaccaaaggcgagtcctacgggtgtaccggtggtgtctcctgcggcgtca

SEQ ID NO: 156064 - DNA, 75 bp, Artificial Sequence
  Synthetic
ccaccctgtacgtaccgcgaggacccatccacccactgcagccttatcgcaggtacggtgacccggggggccggg

SEQ ID NO: 156065 - DNA, 75 bp, Artificial Sequence
  Synthetic
ggacggggggacggggggacggggggccgggacggggggacggggggccgggacggggggacggggggccgggac

SEQ ID NO: 156066 - DNA, 75 bp, Artificial Sequence
  Synthetic
ggacggggggacggggggacggggggccgggacggggggacggggggccgggacggggggtcggggggccgggac

SEQ ID NO: 156067 - DNA, 75 bp, Artificial Sequence
  Synthetic
ggacggggggacggggggacggggggccgggacggggggacggggggccgggacggggggccggggggccgggac

SEQ ID NO: 156068 - DNA, 75 bp, Artificial Sequence
  Synthetic
ggacggggggacggggggacggggggccgggacggggggacggggggccgggacgggggggcggggggccgggac

SEQ ID NO: 156069 - DNA, 75 bp, Artificial Sequence
  Synthetic
ggacggggggacggggggacggggggccgggacggggggtcggggggccgggacggggggacggggggccgggac

SEQ ID NO: 156070 - DNA, 75 bp, Artificial Sequence
  Synthetic
ggacggggggacggggggacggggggccgggacggggggtcggggggccgggacggggggtcggggggccgggac

SEQ ID NO: 156071 - DNA, 75 bp, Artificial Sequence
  Synthetic
ggacggggggacggggggacggggggccgggacggggggtcggggggccgggacggggggccggggggccgggac

SEQ ID NO: 156072 - DNA, 75 bp, Artificial Sequence
  Synthetic
ggacggggggacggggggacggggggccgggacggggggtcggggggccgggacgggggggcggggggccgggac

SEQ ID NO: 156073 - DNA, 75 bp, Artificial Sequence
  Synthetic
ggacggggggacggggggacggggggccgggacggggggccggggggccgggacggggggacggggggccgggac

SEQ ID NO: 156074 - DNA, 75 bp, Artificial Sequence
  Synthetic
ggacggggggacggggggacggggggccgggacggggggccggggggccgggacggggggtcggggggccgggac

SEQ ID NO: 156075 - DNA, 75 bp, Artificial Sequence
  Synthetic
ggacggggggacggggggacggggggccgggacggggggccggggggccgggacggggggccggggggccgggac

SEQ ID NO: 156076 - DNA, 75 bp, Artificial Sequence
  Synthetic
ggacggggggacggggggacggggggccgggacggggggccggggggccgggacgggggggcggggggccgggac

SEQ ID NO: 156077 - DNA, 75 bp, Artificial Sequence
  Synthetic
ggacggggggacggggggacggggggccgggacgggggggcggggggccgggacggggggacggggggccgggac

SEQ ID NO: 156078 - DNA, 75 bp, Artificial Sequence
  Synthetic
ggacggggggacggggggacggggggccgggacgggggggcggggggccgggacggggggtcggggggccgggac

SEQ ID NO: 156079 - DNA, 75 bp, Artificial Sequence
  Synthetic
ggacggggggacggggggacggggggccgggacgggggggcggggggccgggacggggggccggggggccgggac

SEQ ID NO: 156080 - DNA, 75 bp, Artificial Sequence
  Synthetic
ggacggggggacggggggacggggggccgggacgggggggcggggggccgggacgggggggcggggggccgggac

SEQ ID NO: 156081 - DNA, 75 bp, Artificial Sequence
  Synthetic
gccgggcgcgtcgacggcgcgcgggcctgcgtgtcctgtgggccgggtgtcgtgggttcgggggtgctaccgccg

SEQ ID NO: 156082 - DNA, 75 bp, Artificial Sequence
  Synthetic
cctgcgtgtcctgtgggccgggtgtcgtgggttcgggggtgctaccgccggcatcttgggcctccaggtccccgg

SEQ ID NO: 156083 - DNA, 75 bp, Artificial Sequence
  Synthetic
ggacgggccggggcgggacgggccggggcgggacggggggggggcgggacgggccgggggggacgggacgggccg

SEQ ID NO: 156084 - DNA, 75 bp, Artificial Sequence
  Synthetic
gggcgggacggggggggggcgggacgggccgggggggacgggacgggccggggcgggacggggggagggacggga

SEQ ID NO: 156085 - DNA, 75 bp, Artificial Sequence
  Synthetic
tcggtgacctgcaggagctcgtttattaatagccagtccatgctcagcgtagcggccagcccctggggagacagg

SEQ ID NO: 156086 - DNA, 75 bp, Artificial Sequence
  Synthetic
ttaatagccagtccatgctcagcgtagcggccagcccctggggagacaggtccacggagtccggaaccaccgtcg

SEQ ID NO: 156087 - DNA, 75 bp, Artificial Sequence
  Synthetic
cggttcgtgagcacgacgaggtctgcggccgggctggggggcgcgtcctcggtcgcgtgggccatcacctcctga

SEQ ID NO: 156088 - DNA, 75 bp, Artificial Sequence
  Synthetic
atggctgcggtgcgctgatcggccgagctggcgaagggcgccacgaccagcgcgcgctccgtctgcaggcccttc

SEQ ID NO: 156089 - DNA, 75 bp, Artificial Sequence
  Synthetic
ggccgcgcgcgcggcctgatagccggccgagaggcgccgccagcgcgccaggaactgactcatgtaacagaaccc

SEQ ID NO: 156090 - DNA, 75 bp, Artificial Sequence
  Synthetic
gccgagaggcgccgccagcgcgccaggaactgactcatgtaacagaacccggggacctggtcccccgacatcaac

SEQ ID NO: 156091 - DNA, 75 bp, Artificial Sequence
  Synthetic
ttcccgccgcacgacggccagcacgttaccctcgtgcgagacctgggccgccagctcgtcgcataccccgaggtg

SEQ ID NO: 156092 - DNA, 75 bp, Artificial Sequence
  Synthetic
ttaccctcgtgcgagacctgggccgccagctcgtcgcataccccgaggtgcgccgtcgtctcggtgacgacggac

SEQ ID NO: 156093 - DNA, 75 bp, Artificial Sequence
  Synthetic
cccggcccgtccccccgaccccccggcccgtccccgtccccccggcccgtccccccgtccccccgtccccccgtc

SEQ ID NO: 156094 - DNA, 75 bp, Artificial Sequence
  Synthetic
cccggcccgtccccccgtccccccggcccgtccccgtccccccggcccgtccccccgtccccccgtccccccgtc

SEQ ID NO: 156095 - DNA, 75 bp, Artificial Sequence
  Synthetic
cccggcccgtccccccgcccccccggcccgtccccgtccccccggcccgtccccccgtccccccgtccccccgtc

SEQ ID NO: 156096 - DNA, 75 bp, Artificial Sequence
  Synthetic
cccggcccgtccccccggccccccggcccgtccccgtccccccggcccgtccccccgtccccccgtccccccgtc

SEQ ID NO: 156097 - DNA, 75 bp, Artificial Sequence
  Synthetic
ggcgtgctgggaggggcggcatcgggccccgcccacggtccgccacgccccgcgcgtcatcggcagggggcgtgg

SEQ ID NO: 156098 - DNA, 75 bp, Artificial Sequence
  Synthetic
gccgcagtactggctcaccgcgtcgcccatggcctcggggcgccagggccccaggcgctcgtgggcgtctgcgac

SEQ ID NO: 156099 - DNA, 75 bp, Artificial Sequence
  Synthetic
cccatggcctcggggcgccagggccccaggcgctcgtgggcgtctgcgaccacggcgtacaggcggtgcccgtcg

SEQ ID NO: 156100 - DNA, 75 bp, Artificial Sequence
  Synthetic
cagcagcacgatcgcgtcctccagctggcggaccagggggtcggcgcgctcggcgagctcctgcagcaccccccg

SEQ ID NO: 156101 - DNA, 75 bp, Artificial Sequence
  Synthetic
tggcggaccagggggtcggcgcgctcggcgagctcctgcagcaccccccgggccgccagggcgtacatgctgatc

SEQ ID NO: 156102 - DNA, 75 bp, Artificial Sequence
  Synthetic
cgcgggccgcagctgctcgacggcccccctggcgatcacgtacagctcgcgcagcagctgctcgatgttgtcggc

SEQ ID NO: 156103 - DNA, 75 bp, Artificial Sequence
  Synthetic
cccctggcgatcacgtacagctcgcgcagcagctgctcgatgttgtcggccatctgcatcgtgggcccgacgccg

SEQ ID NO: 156104 - DNA, 75 bp, Artificial Sequence
  Synthetic
ccggcgggacatggcgggcggctgggctcggcgtaggcccggagccggagcgcgtcggggcgggagagttcactc

SEQ ID NO: 156105 - DNA, 75 bp, Artificial Sequence
  Synthetic
gtgcccctcgacggtggggagatagcccaggccgaagtcgcgcgcccaggccagcacccgcagggcaaactcgat

SEQ ID NO: 156106 - DNA, 75 bp, Artificial Sequence
  Synthetic
cctgctagtccccgtcctgccgcgcgggggcgggcgcgggaaaaaagccgcgcgggggcgcccgcgggaaagcag

SEQ ID NO: 156107 - DNA, 75 bp, Artificial Sequence
  Synthetic
ccgtccccccgtcccgtccccccgtcccgtccccccgtcccgtccccccgtcccgtccccccgtcccgtcccccc

SEQ ID NO: 156108 - DNA, 75 bp, Artificial Sequence
  Synthetic
ggggcggggcaggtaggcagcgttgcacgtggccctcagcgcgtccccgaccaccagggccagcacgtaagggac

SEQ ID NO: 156109 - DNA, 75 bp, Artificial Sequence
  Synthetic
gaaccccgggtcggcgaggacgttggggtggatgccctccagggccgggaagcggatcttggtggccgcggccag

SEQ ID NO: 156110 - DNA, 75 bp, Artificial Sequence
  Synthetic
gggtggatgccctccagggccgggaagcggatcttggtggccgcggccaggtgaaccgagggggcgtggctaggc

SEQ ID NO: 156111 - DNA, 75 bp, Artificial Sequence
  Synthetic
ccccccgtcccggccccccgggtcaccgtacctgcgataaggctgcagtgggtggatgggtcctcgcggtacgta

SEQ ID NO: 156112 - DNA, 75 bp, Artificial Sequence
  Synthetic
gagggggaaggaatcgggcgtctgtgcgcctttgagacagacgcggcgatggccgcgcgcgtgtgtgagaaataa

SEQ ID NO: 156113 - DNA, 75 bp, Artificial Sequence
  Synthetic
caggtcccagtgggtctggccgtacacgtcgagccagatgagcgccgtctcgcgcaggaggctgggctggccggc

SEQ ID NO: 156114 - DNA, 75 bp, Artificial Sequence
  Synthetic
acgtcgagccagatgagcgccgtctcgcgcaggaggctgggctggccggcgctgaagcggcgctcggccgtctca

SEQ ID NO: 156115 - DNA, 75 bp, Artificial Sequence
  Synthetic
ggccgggcccatgatgcgcgccagcgtctggctgaggacgccgcccgacaggccgaccgcctcacagagccgccc

SEQ ID NO: 156116 - DNA, 75 bp, Artificial Sequence
  Synthetic
gtctggctgaggacgccgcccgacaggccgaccgcctcacagagccgcccgtgcgtgtgctcgctggcgccctgg

SEQ ID NO: 156117 - DNA, 75 bp, Artificial Sequence
  Synthetic
ggcgggcgggggtcgggcgggcgggggtcgggcgggcgggggtcgggcgggcgggggtcgggcgggcgggggtcg

SEQ ID NO: 156118 - DNA, 75 bp, Artificial Sequence
  Synthetic
gagcccgaacacgttcgcccccgcaagggcaatgcacccaaagagctgctggatctcgctgagcccgtggccggg

SEQ ID NO: 156119 - DNA, 75 bp, Artificial Sequence
  Synthetic
ggatctcgctgagcccgtggccggggggcgtccgcgcgggcacccccgccaccaaaaacccctccagggccgata

SEQ ID NO: 156120 - DNA, 75 bp, Artificial Sequence
  Synthetic
atcaccacggagggcgagttgctgttctggaccaaagcccacgtctgctgcagcagcgcgaggagccgttgctgg

SEQ ID NO: 156121 - DNA, 75 bp, Artificial Sequence
  Synthetic
tctggaccaaagcccacgtctgctgcagcagcgcgaggagccgttgctgggccccggcggagggcggctccccta

SEQ ID NO: 156122 - DNA, 75 bp, Artificial Sequence
  Synthetic
gcgggggcgggcgcgggaaagcagccccgcggcgcgcgggggggaggggctgctgcgagatcggcgggatggagg

SEQ ID NO: 156123 - DNA, 75 bp, Artificial Sequence
  Synthetic
ctcagaaacggcacgtcggggtcgaagacggccgcgtccgtccgcacgcgcgccatcagcgtccccgggggcgcg

SEQ ID NO: 156124 - DNA, 75 bp, Artificial Sequence
  Synthetic
agacggccgcgtccgtccgcacgcgcgccatcagcgtccccgggggcgcgcacgccgaccgcgggctgacgcggc

SEQ ID NO: 156125 - DNA, 75 bp, Artificial Sequence
  Synthetic
gcctcgaggggcgggatcatgatagccgggtcgatctcccgcaccgtgtgctgaaactgggccagcagcggcggc

SEQ ID NO: 156126 - DNA, 75 bp, Artificial Sequence
  Synthetic
ccgggtcgatctcccgcaccgtgtgctgaaactgggccagcagcggcggcgggaccaccgcgccccgatcggggg

SEQ ID NO: 156127 - DNA, 75 bp, Artificial Sequence
  Synthetic
ggcgcgggaaaaaaggcgcgcgggggcgggcgcgggcaagcggccccgcggcgcgcggggggaggggcggcgccc

SEQ ID NO: 156128 - DNA, 75 bp, Artificial Sequence
  Synthetic
ggggtcagggcggcgtcgtcgatgcgctgtaggtgcgccgagaacagcgtcacccaattgctgaccagggccaag

SEQ ID NO: 156129 - DNA, 75 bp, Artificial Sequence
  Synthetic
cccccccaagcaagcggggggccggggggtttggctccactggcatctagaccgcgcctcgcgtcgggccagatg

SEQ ID NO: 156130 - DNA, 75 bp, Artificial Sequence
  Synthetic
gctgtaggtgcgccgagaacagcgtcacccaattgctgaccagggccaagaaccggagaccctcttgcacgatcg

SEQ ID NO: 156131 - DNA, 75 bp, Artificial Sequence
  Synthetic
cgcccgcctttgcgcccccccccccaaaaacacccccccgggggttgactccccgggggaaaggaggcggggcgg

SEQ ID NO: 156132 - DNA, 75 bp, Artificial Sequence
  Synthetic
tgccccaggggaaccggggacatcttaagcgacatctccccgagggcctccagggaggtccgcgggttcatggcc

SEQ ID NO: 156133 - DNA, 75 bp, Artificial Sequence
  Synthetic
taagcgacatctccccgagggcctccagggaggtccgcgggttcatggccaggcagctctgggtgacggtccgcc

SEQ ID NO: 156134 - DNA, 75 bp, Artificial Sequence
  Synthetic
gagtgaactctcccgccccgacgcgctccggctccgggcctacgccgagcccagccgcccgccatgtcccgccgg

SEQ ID NO: 156135 - DNA, 75 bp, Artificial Sequence
  Synthetic
gccgccgtggtgcgcagcccggcggcctccagcgcgtgggtcgtgtcggagccggtgatcgccaggaccgtgtcc

SEQ ID NO: 156136 - DNA, 75 bp, Artificial Sequence
  Synthetic
cctccagcgcgtgggtcgtgtcggagccggtgatcgccaggaccgtgtccttgatgacgtccatctcccggaagg

SEQ ID NO: 156137 - DNA, 75 bp, Artificial Sequence
  Synthetic
gcgccggcggcggccccccgcgtccccgcccgcggacgcgccgcgcgggaaggtacgcctcccctccgaccccct

SEQ ID NO: 156138 - DNA, 75 bp, Artificial Sequence
  Synthetic
ccggggaggttctcggccaagagcgccgtctccggaagcccgtgggcccggtgcaaggcgcacagttgctccagg

SEQ ID NO: 156139 - DNA, 75 bp, Artificial Sequence
  Synthetic
ccgtctccggaagcccgtgggcccggtgcaaggcgcacagttgctccaggagcgggtgccagcacgcccgcgcct

SEQ ID NO: 156140 - DNA, 75 bp, Artificial Sequence
  Synthetic
cgcagtttggccgcggacagaaacgccggctcgtccgcgctgcccgccggctcgctcgagggggagggcggccgg

SEQ ID NO: 156141 - DNA, 75 bp, Artificial Sequence
  Synthetic
ggacctgcaacggtccgtttgggggtggagcggacgggggggtcatgccggcgggcgccgggacctggagcgcgc

SEQ ID NO: 156142 - DNA, 75 bp, Artificial Sequence
  Synthetic
gcgggcccaaacgggaatgactgccgccgccctatacggaggggctaagtatcgcccggggacccttcgaaaccc

SEQ ID NO: 156143 - DNA, 75 bp, Artificial Sequence
  Synthetic
gaggaggaggaggaggcggcggcggcggcgcgcgggtcctccgccgccgcgggcccgggccgtcgggcggtctag

SEQ ID NO: 156144 - DNA, 75 bp, Artificial Sequence
  Synthetic
cgggcgtgtcgcaagtacgccgcgaaggcgcggcgtgttatacggcgcgttatgtcccggcattccgttcgtggg

SEQ ID NO: 156145 - DNA, 75 bp, Artificial Sequence
  Synthetic
ggggcggcgcgacggcggcccggaccaagtgtatcgcggccgttccgtggggcggcccaacaggccctttaaaca

SEQ ID NO: 156146 - DNA, 75 bp, Artificial Sequence
  Synthetic
tcggacaccggaacccaccagaggcggaagccgccttcgcccgtgagggtgcgtgtgttttctggtggcgtgttt

SEQ ID NO: 156147 - DNA, 75 bp, Artificial Sequence
  Synthetic
ggggggtggttggcggtctctctcccccccgtgcggtgcgtgcgtgtgcctgtgtcttttcgcctctccgcgccg

SEQ ID NO: 156148 - DNA, 75 bp, Artificial Sequence
  Synthetic
gcccgttggcgatcggcgggaaaaccatgaaaaccaagccactcccgacagccccgatggcgtgggccgagagtg

SEQ ID NO: 156149 - DNA, 75 bp, Artificial Sequence
  Synthetic
cggcgcgtcctgcgcccgcccatcgctcgccgcgacggcccggtgcttttgggggacagggcccccaggaggacg

SEQ ID NO: 156150 - DNA, 75 bp, Artificial Sequence
  Synthetic
ctcgccgcgacggcccggtgcttttgggggacagggcccccaggaggacggccagtacgatgtggctgctgggga

SEQ ID NO: 156151 - DNA, 75 bp, Artificial Sequence
  Synthetic
aacgcgcgctacccgagacgataccgagcaggccgtggacaagatcctcaggggagcccggcgcgcgggagggct

SEQ ID NO: 156152 - DNA, 75 bp, Artificial Sequence
  Synthetic
ggggagcccggcgcgcgggagggctgaccgtccccggcgccccccgctatcacctgacccgccaggtaaccctga

SEQ ID NO: 156153 - DNA, 75 bp, Artificial Sequence
  Synthetic
gaccgtccccggcgccccccgctatcacctgacccgccaggtaaccctgacggatctctgccaaccaaacgcgga

SEQ ID NO: 156154 - DNA, 75 bp, Artificial Sequence
  Synthetic
acctggcccgccatcgggctccgcccggccggcagaccgagcgactggccgaggcctggggccagctcctggagg

SEQ ID NO: 156155 - DNA, 75 bp, Artificial Sequence
  Synthetic
gagtcaacccccgggggggtgtttttgggggggggcgcgaaggcgggcggcggcggcgggcgggcggcagggcag

SEQ ID NO: 156156 - DNA, 75 bp, Artificial Sequence
  Synthetic
gaggcctggggccagctcctggaggcctccgccctggggtccgggcgggccgagagcggctgcgcgcgcgcgggc

SEQ ID NO: 156157 - DNA, 75 bp, Artificial Sequence
  Synthetic
acgaggtcatgcggtttttcggggggctagtgtcgtgggtcacacaggacgagctggctagcgtcaccgccgtct

SEQ ID NO: 156158 - DNA, 75 bp, Artificial Sequence
  Synthetic
gcagcggaccccaggaggccacacacaccggccacccgggcaggccctgttcggccgttaccatcccggcctgcg

SEQ ID NO: 156159 - DNA, 75 bp, Artificial Sequence
  Synthetic
ttcctgtacttggtcttcacctaccgacagtgccgggaccaggagctctgttgcgtgtacgtggtcaagagccag

SEQ ID NO: 156160 - DNA, 75 bp, Artificial Sequence
  Synthetic
gacagtgccgggaccaggagctctgttgcgtgtacgtggtcaagagccagctccccccgcgcggactggaggcgg

SEQ ID NO: 156161 - DNA, 75 bp, Artificial Sequence
  Synthetic
gccgaggacatgacgccccctcccccgaaccgaaacgttgactttccgctcgccgtcctggccgcgagctcgcaa

SEQ ID NO: 156162 - DNA, 75 bp, Artificial Sequence
  Synthetic
cgaaccgaaacgttgactttccgctcgccgtcctggccgcgagctcgcaatccccgcggtgctcggcgagccaag

SEQ ID NO: 156163 - DNA, 75 bp, Artificial Sequence
  Synthetic
cgggggcgccctaccgcacgcacctgcacatacgccgccttcgcagagctgggtgtcatgccagacgacagcccc

SEQ ID NO: 156164 - DNA, 75 bp, Artificial Sequence
  Synthetic
gcacatacgccgccttcgcagagctgggtgtcatgccagacgacagcccccgctgtctgcaccgcaccgagcggt

SEQ ID NO: 156165 - DNA, 75 bp, Artificial Sequence
  Synthetic
gcagccttatcgcaggtacggtgacccgggggcgccggggcggggggacgggacggggggacggggggacgggac

SEQ ID NO: 156166 - DNA, 75 bp, Artificial Sequence
  Synthetic
caactccgccctcgccgtcttggccgtgcgcggccccgtgcgtccgtctcaataaagccaggttaaatccgtgac

SEQ ID NO: 156167 - DNA, 75 bp, Artificial Sequence
  Synthetic
gtgcgcggccccgtgcgtccgtctcaataaagccaggttaaatccgtgacgtggtgtgtttggcgtgtgtctctg

SEQ ID NO: 156168 - DNA, 75 bp, Artificial Sequence
  Synthetic
aataaagccaggttaaatccgtgacgtggtgtgtttggcgtgtgtctctgaaatggcggaaaccgacatgcaaat

SEQ ID NO: 156169 - DNA, 75 bp, Artificial Sequence
  Synthetic
tccttagattgactcagcacacgatcgcaccccacccctgtgtgccggggataaaagccaacgcgggcggtctgg

SEQ ID NO: 156170 - DNA, 75 bp, Artificial Sequence
  Synthetic
cctgggggattgtgggaatcctcgggtgtgctgctgttggggccgcacccaccggccccgcgtccgatacaacaa

SEQ ID NO: 156171 - DNA, 75 bp, Artificial Sequence
  Synthetic
ggcgactgcccgggtgattcgtcggccggtgcgtcctttcggtcgtaccgcccaccccgcctcccacgggcccgc

SEQ ID NO: 156172 - DNA, 75 bp, Artificial Sequence
  Synthetic
ccggtgcgtcctttcggtcgtaccgcccaccccgcctcccacgggcccgccgctgtttccgttcatcgcgtccga

SEQ ID NO: 156173 - DNA, 75 bp, Artificial Sequence
  Synthetic
cgccggagcgcggtctccgtccgaacgacaggaaccccgggagcccgaggtcgccccccctggcggcgaccacgt

SEQ ID NO: 156174 - DNA, 75 bp, Artificial Sequence
  Synthetic
atggtgctttccagcgatccccccggccccgcggcctaccgcattagcgacagcagctttgttcaatgcggctcc

SEQ ID NO: 156175 - DNA, 75 bp, Artificial Sequence
  Synthetic
cccccccaccccccgaacatcgcggcggacccgaggagtttgagggcgccggggacggcgaaccccccgaggacg

SEQ ID NO: 156176 - DNA, 75 bp, Artificial Sequence
  Synthetic
cagcagctttgttcaatgcggctccaactgcagtatgataatcgacggagacgtggcgcgcggtcatttgcgtga

SEQ ID NO: 156177 - DNA, 75 bp, Artificial Sequence
  Synthetic
cctcgagggcgctacgtccaccggcgccttcgtcgcgatctcaaacgtcgcagccggcggggatggccgaaccgc

SEQ ID NO: 156178 - DNA, 75 bp, Artificial Sequence
  Synthetic
ggacccagacgtccggggagttcctccacgggaacccaaggacccccgaaccccaaggaccccaggctgtccccc

SEQ ID NO: 156179 - DNA, 75 bp, Artificial Sequence
  Synthetic
ccacgggaacccaaggacccccgaaccccaaggaccccaggctgtccccccgccccctcctcccccctttccatg

SEQ ID NO: 156180 - DNA, 75 bp, Artificial Sequence
  Synthetic
tgagaaataaagaacgagacagacgaaaacgtaccgccttgtgtggtttattcgggggtcgggcgggggtcgggg

SEQ ID NO: 156181 - DNA, 75 bp, Artificial Sequence
  Synthetic
acgtcggggccgcggagtcatggtcagacggcccgtcgtccgactccgaaacggaggactcggactcctcggacg

SEQ ID NO: 156182 - DNA, 75 bp, Artificial Sequence
  Synthetic
gggtgggggtggggggcgagaaacgatgaaggacgggaaagggaacagcgaccaaatgtcacgataagaataaac

SEQ ID NO: 156183 - DNA, 75 bp, Artificial Sequence
  Synthetic
cccccggtgccgccccccacgccgcggagggggcggcggcccgcccccggaagaggcgcgggtcggactcgggcc

SEQ ID NO: 156184 - DNA, 75 bp, Artificial Sequence
  Synthetic
acccaccaagacagggagccagaacgcaggccgggccccggctctgttctatgataaagaccaacaggcctcggg

SEQ ID NO: 156185 - DNA, 75 bp, Artificial Sequence
  Synthetic
gctgtctcgatcctcttcgatctgggccgcaggggcgactgacgacgatgacagcgactccgactcgcggtcgga

SEQ ID NO: 156186 - DNA, 75 bp, Artificial Sequence
  Synthetic
acagcgactccgactcgcggtcggacgactccgtgcagcccgacgttgtcgttcgtcgcagatggagcgacggcc

SEQ ID NO: 156187 - DNA, 75 bp, Artificial Sequence
  Synthetic
ggggtcggggtcgggcgggggtcggggtcgggcgggggtcggggtcgggcgggggtcggggtcgggcgggggtcg

SEQ ID NO: 156188 - DNA, 75 bp, Artificial Sequence
  Synthetic
cgactccgtgcagcccgacgttgtcgttcgtcgcagatggagcgacggccccgcccccgtggcctttcccaagcc

SEQ ID NO: 156189 - DNA, 75 bp, Artificial Sequence
  Synthetic
ggccgggctccgcgacggacccgcgcgcgtcggccgactccgattccgcggcccacgccgccgcaccccaggcgg

SEQ ID NO: 156190 - DNA, 75 bp, Artificial Sequence
  Synthetic
cgcgtcggccgactccgattccgcggcccacgccgccgcaccccaggcggacgtggcgccggttctggacagcca

SEQ ID NO: 156191 - DNA, 75 bp, Artificial Sequence
  Synthetic
ccgagaacgcggaggcggtggcgcggtttctgggggacgccgtcgaccgcgagcccgcgctcatgctggagtact

SEQ ID NO: 156192 - DNA, 75 bp, Artificial Sequence
  Synthetic
gtttctgggggacgccgtcgaccgcgagcccgcgctcatgctggagtacttctgtcggtgcgcccgcgaggagag

SEQ ID NO: 156193 - DNA, 75 bp, Artificial Sequence
  Synthetic
acgactttgggctcctgaactacgcgctcgctgagatgcgacgcctgtgcctggaccttcccccggtccccccca

SEQ ID NO: 156194 - DNA, 75 bp, Artificial Sequence
  Synthetic
acgcatacacgccctatcatctgagggagtatgcgacgcggctggttaacgggttcaaacccctggtgcggcggt

SEQ ID NO: 156195 - DNA, 75 bp, Artificial Sequence
  Synthetic
gcagctatggagcggtcggtaatataactttggttgtcgccacacgccccgtgccgggcatgggttgtgcgggaa

SEQ ID NO: 156196 - DNA, 75 bp, Artificial Sequence
  Synthetic
gcggggctgccctgccgcccgcccgccgccgccgcccgccttcgcgcccccccccaaaaaacaccccccccgggg

SEQ ID NO: 156197 - DNA, 75 bp, Artificial Sequence
  Synthetic
acccgggaggcctcctttgaggaatggatgcgctccaaggaggtggacctggacttcgggctgacggaaaggctt

SEQ ID NO: 156198 - DNA, 75 bp, Artificial Sequence
  Synthetic
ggatgcgctccaaggaggtggacctggacttcgggctgacggaaaggcttcgcgaacacgaggcccagctaatga

SEQ ID NO: 156199 - DNA, 75 bp, Artificial Sequence
  Synthetic
aacacgctcgtcgagcgggggctgcagtcggcgctgaagtacgaagagttttacctcaagcgcttcggcgggcac

SEQ ID NO: 156200 - DNA, 75 bp, Artificial Sequence
  Synthetic
agtcggcgctgaagtacgaagagttttacctcaagcgcttcggcgggcactacatggagtccgtcttccagatgt

SEQ ID NO: 156201 - DNA, 75 bp, Artificial Sequence
  Synthetic
cacatcgccctggggcgacaggggtcgtggtgggaaatgttcaagttctttttccaccgcctctacgaccaccag

SEQ ID NO: 156202 - DNA, 75 bp, Artificial Sequence
  Synthetic
cgtggtgggaaatgttcaagttctttttccaccgcctctacgaccaccagatcgtgccgtccacccccgccatgc

SEQ ID NO: 156203 - DNA, 75 bp, Artificial Sequence
  Synthetic
ccccaggccaccactaaccaggccaccctccgggccatcaccggcaacgtgagcgccatcctcgcccgcaacggg

SEQ ID NO: 156204 - DNA, 75 bp, Artificial Sequence
  Synthetic
ccctccgggccatcaccggcaacgtgagcgccatcctcgcccgcaacgggggcatcgggctgtgcatgcaggcgt

SEQ ID NO: 156205 - DNA, 75 bp, Artificial Sequence
  Synthetic
cgccggggggctccggggggcggcgggcccccagcgtctcgagcacggacggcgacgacgggctcgcgggcccgt

SEQ ID NO: 156206 - DNA, 75 bp, Artificial Sequence
  Synthetic
ctcgactccctggtggcggcgcacaacaaacagagcacgcgccccaccggggcgtgcgtgtacctggaaccctgg

SEQ ID NO: 156207 - DNA, 75 bp, Artificial Sequence
  Synthetic
acaaacagagcacgcgccccaccggggcgtgcgtgtacctggaaccctggcacagcgacgttcgggccgtgctca

SEQ ID NO: 156208 - DNA, 75 bp, Artificial Sequence
  Synthetic
gcgttctggctccctgtcttggtgggtgggcgggctggctggcgggtaaaaaaagagtgtgtccgtgttgacagg

SEQ ID NO: 156209 - DNA, 75 bp, Artificial Sequence
  Synthetic
ttcagcgccctctggatgccggacctgttcttcaagcgcctgatccgccacctcgacggcgagaaaaacgtcacc

SEQ ID NO: 156210 - DNA, 75 bp, Artificial Sequence
  Synthetic
tgttcttcaagcgcctgatccgccacctcgacggcgagaaaaacgtcacctggtccctgttcgaccgggacacca

SEQ ID NO: 156211 - DNA, 75 bp, Artificial Sequence
  Synthetic
cacctcgaggccatggggttcggcgaaacgatccccatccaggacctggcgtacgccatcgtgcgcagcgcggcc

SEQ ID NO: 156212 - DNA, 75 bp, Artificial Sequence
  Synthetic
cagagggagacagagacgggaacccccggttagtgcccgacccccgcccagtgcccgacccccgcccagtgcccg

SEQ ID NO: 156213 - DNA, 75 bp, Artificial Sequence
  Synthetic
acccccgcccagtgcccgacccccgcccagtacccgacccccgcccgccctcaccgtcggccaggtcatcgtcct

SEQ ID NO: 156214 - DNA, 75 bp, Artificial Sequence
  Synthetic
ccccggcgcccaccccgcccgcacacctgcccgccacgcccgcccctcctcaccctggctgggagaaaggaggag

SEQ ID NO: 156215 - DNA, 75 bp, Artificial Sequence
  Synthetic
gacctgcaacggtccgtctgggggtggagcggacgggggggtcatgcctgcgggcgccgggacctggagcgcgct

SEQ ID NO: 156216 - DNA, 75 bp, Artificial Sequence
  Synthetic
gctccgcgacgccgtgcaggcgtgcgtgctaatggttaatatcatgatagacagcacgctgcagccgacgcccca

SEQ ID NO: 156217 - DNA, 75 bp, Artificial Sequence
  Synthetic
ttttttctctgtttgttactttttattgaaaacagacatacggggaaaggggccggaaaccgagacggtggggcc

SEQ ID NO: 156218 - DNA, 75 bp, Artificial Sequence
  Synthetic
gcctgcacacggcgtgcctgaagatgggcctggatctggagtcggccgagttccgggacctgaacacacacatcg

SEQ ID NO: 156219 - DNA, 75 bp, Artificial Sequence
  Synthetic
gaagaccagtaacgcgctgtgcgttcgcggggcgcgtcccttcagccactttaagcgcagcatgtaccgggccgg

SEQ ID NO: 156220 - DNA, 75 bp, Artificial Sequence
  Synthetic
agtgggagatgctacgccagagcatgatgaaacacggcctgcgcaacagccagttcatcgcgctcatgcccaccg

SEQ ID NO: 156221 - DNA, 75 bp, Artificial Sequence
  Synthetic
gggggggggaaacgggggtgggtggaagggaagaggaaggagaaagggggggtggatccgaacacgccggatccg

SEQ ID NO: 156222 - DNA, 75 bp, Artificial Sequence
  Synthetic
cagcgagggctttgcccccctgttcaccaacctgttcagcaaggtgaccagggacggcgagacgctgcgccccaa

SEQ ID NO: 156223 - DNA, 75 bp, Artificial Sequence
  Synthetic
gggacggcgagacgctgcgccccaacacgctcttgctgaaggaactcgagcgcacgttcggcgggaagcggctcc

SEQ ID NO: 156224 - DNA, 75 bp, Artificial Sequence
  Synthetic
cacgctcttgctgaaggaactcgagcgcacgttcggcgggaagcggctcctggacgcgatggacgggctcgaggc

SEQ ID NO: 156225 - DNA, 75 bp, Artificial Sequence
  Synthetic
ccctccggcggttcaagacggccttcgactacgaccaggaactgctgatcgacctgtgtgcagaccgcgccccct

SEQ ID NO: 156226 - DNA, 75 bp, Artificial Sequence
  Synthetic
cgactacgaccaggaactgctgatcgacctgtgtgcagaccgcgccccctatgttgatcacagccaatccatgac

SEQ ID NO: 156227 - DNA, 75 bp, Artificial Sequence
  Synthetic
tccgccttctcgtccacgcatataagcgcggcctgaagacggggatgtactactgcaaggttcgcaaggcgacca

SEQ ID NO: 156228 - DNA, 75 bp, Artificial Sequence
  Synthetic
gcgcggcctgaagacggggatgtactactgcaaggttcgcaaggcgaccaacagcggggtgttcgccggcgacga

SEQ ID NO: 156229 - DNA, 75 bp, Artificial Sequence
  Synthetic
ggggacgcttgacggggccgacccccggcccgcttaagcggtcgggggacccccgtgggccgtgcgccgcccccc

SEQ ID NO: 156230 - DNA, 75 bp, Artificial Sequence
  Synthetic
ggtcaggcgtcgctctcggtcccgcatatcgccatggatcccgccgtctcccccgcgagcaccgaccccctagat

SEQ ID NO: 156231 - DNA, 75 bp, Artificial Sequence
  Synthetic
atatcgccatggatcccgccgtctcccccgcgagcaccgaccccctagatacccacgcgtcgggggccggggcgg

SEQ ID NO: 156232 - DNA, 75 bp, Artificial Sequence
  Synthetic
tgccccgacatcaaccaccttcgttccctcagcatcctgaaccgctggctggagaccgagctcgtgttcgtgggg

SEQ ID NO: 156233 - DNA, 75 bp, Artificial Sequence
  Synthetic
ccctcagcatcctgaaccgctggctggagaccgagctcgtgttcgtgggggacgaggaggacgtctccaagctct

SEQ ID NO: 156234 - DNA, 75 bp, Artificial Sequence
  Synthetic
gcggacgacctggtgacggaaaacctgggcggcctctccggcctcttcgaacagaaggacattcttcactactac

SEQ ID NO: 156235 - DNA, 75 bp, Artificial Sequence
  Synthetic
tgggcggcctctccggcctcttcgaacagaaggacattcttcactactacgtggagcaggaatgcatcgaggtcg

SEQ ID NO: 156236 - DNA, 75 bp, Artificial Sequence
  Synthetic
gaccaggcgcggcgcgcctatgtggcccgcaccatcaaccacccggccattcgcgtcaaggtggactggctggag

SEQ ID NO: 156237 - DNA, 75 bp, Artificial Sequence
  Synthetic
cccgcaccatcaaccacccggccattcgcgtcaaggtggactggctggaggcgcgggtgcgggaatgcgactcga

SEQ ID NO: 156238 - DNA, 75 bp, Artificial Sequence
  Synthetic
gcctcgttcgccgccatcgcgtacctgcgcaccaacaacctcctgcgggtcacctgccagtcgaacgacctcatc

SEQ ID NO: 156239 - DNA, 75 bp, Artificial Sequence
  Synthetic
tgcgcaccaacaacctcctgcgggtcacctgccagtcgaacgacctcatcagccgcgacgaggccgtgcatacga

SEQ ID NO: 156240 - DNA, 75 bp, Artificial Sequence
  Synthetic
gaggcggcgcgcgtgtaccggctgtttcgggaggcggtggatatcgagatcgggttcatccgatcccaggccccg

SEQ ID NO: 156241 - DNA, 75 bp, Artificial Sequence
  Synthetic
ttcgggaggcggtggatatcgagatcgggttcatccgatcccaggccccgacggacagctctatcctgagtccgg

SEQ ID NO: 156242 - DNA, 75 bp, Artificial Sequence
  Synthetic
ctgggcctgatccatatgcagcccctgtattccgcccccgcccccgacgccagctttcccctcagcctcatgtcc

SEQ ID NO: 156243 - DNA, 75 bp, Artificial Sequence
  Synthetic
tgtattccgcccccgcccccgacgccagctttcccctcagcctcatgtccaccgacaaacacaccaacttcttcg

SEQ ID NO: 156244 - DNA, 75 bp, Artificial Sequence
  Synthetic
ggggccgggacggggggacgggagggacggggggacgggacggggggacgggacggggggacgggacggggggcc

SEQ ID NO: 156245 - DNA, 75 bp, Artificial Sequence
  Synthetic
gggtcagggggtcggaggggaggggtcgggtcggggggtcggaggggggtcgggtcggaggggcgtcagagggga

SEQ ID NO: 156246 - DNA, 75 bp, Artificial Sequence
  Synthetic
tctgggcgcccttgtagcgatgtctaaccgaaataaaggggtcgaaacggactgttgggtctccggtgtgattat

SEQ ID NO: 156247 - DNA, 75 bp, Artificial Sequence
  Synthetic
ggggaaagggaaggaacgcccgaaaccagagaaaaggaccaaaagggaaacgcgtccaaccgataaatcaagcgc

SEQ ID NO: 156248 - DNA, 75 bp, Artificial Sequence
  Synthetic
attaacaggtcgggcatcgggaggggatgggggcgcgcgtttcctccgttccggctactcgtcccagaatttagc

SEQ ID NO: 156249 - DNA, 75 bp, Artificial Sequence
  Synthetic
gatgggggcgcgcgtttcctccgttccggctactcgtcccagaatttagccaggacgtccttgtaaaacgcgggc

SEQ ID NO: 156250 - DNA, 75 bp, Artificial Sequence
  Synthetic
ggcggtgatatgccgagtcacgatggagcgcgctaaatcttcgtcgcggaggtcctgatagatgggcagtctttt

SEQ ID NO: 156251 - DNA, 75 bp, Artificial Sequence
  Synthetic
ggggtgggaggtatcagtgggtgacagagtcttttaaaagacgtgtcccggggccctcgagacgcgcaacttttg

SEQ ID NO: 156252 - DNA, 75 bp, Artificial Sequence
  Synthetic
ttggggctgataagcgatatgacgtacttgacgtatctgtgctccaccagctcggcgatggtcatcggatcgggc

SEQ ID NO: 156253 - DNA, 75 bp, Artificial Sequence
  Synthetic
ctcggcgatggtcatcggatcgggcagccagtccagggcctccggggcgtcgtggatgacgtggcggcgacgtcc

SEQ ID NO: 156254 - DNA, 75 bp, Artificial Sequence
  Synthetic
agccagtccagggcctccggggcgtcgtggatgacgtggcggcgacgtccggcgacatagccgcggtgttccgcg

SEQ ID NO: 156255 - DNA, 75 bp, Artificial Sequence
  Synthetic
cgaggaggacgaccgggcgccgtcgcgcggcccaccggcgacgtccgggggctggaggggggggtcttcttcgta

SEQ ID NO: 156256 - DNA, 75 bp, Artificial Sequence
  Synthetic
cgcggcccaccggcgacgtccgggggctggaggggggggtcttcttcgtagtcgtcctcgcccgcgatctgttgg

SEQ ID NO: 156257 - DNA, 75 bp, Artificial Sequence
  Synthetic
ggtcagcgtaggcatgctctccagggagcgcgagttggcgcgctcccgccgggccgcccggcgggcctgggatcg

SEQ ID NO: 156258 - DNA, 75 bp, Artificial Sequence
  Synthetic
gagcgcgagttggcgcgctcccgccgggccgcccggcgggcctgggatcggctcggggcggtccagtgacactcg

SEQ ID NO: 156259 - DNA, 75 bp, Artificial Sequence
  Synthetic
accccctccctaccctcccctccatcccgccgatctcgcagcagcccctccccccgcgcgccgcggggctgcttt

SEQ ID NO: 156260 - DNA, 75 bp, Artificial Sequence
  Synthetic
gtggcagcggacgaacagcgccaggaactgcgggtaactcatcttgaagtactgcagcaggtcgcggcagtgaat

SEQ ID NO: 156261 - DNA, 75 bp, Artificial Sequence
  Synthetic
aactgcgggtaactcatcttgaagtactgcagcaggtcgcggcagtgaatcgtcggaatgtagccggtgctgatg

SEQ ID NO: 156262 - DNA, 75 bp, Artificial Sequence
  Synthetic
gcgggcgccgcgcccccgtcggcgtctccgtcgtcccaggccgcggtcgccgccgcctcctcctcctcctcctcc

SEQ ID NO: 156263 - DNA, 75 bp, Artificial Sequence
  Synthetic
gcactcaggtcagagccccagaccccccgcgggcgcgggagacgtgccgcccgcccgacccccgcccgacccccg

SEQ ID NO: 156264 - DNA, 75 bp, Artificial Sequence
  Synthetic
cccgcgggcgcgggagacgtgccgcccgcccgacccccgcccgacccccgcccccgcccgcccgacccccgcccg

SEQ ID NO: 156265 - DNA, 75 bp, Artificial Sequence
  Synthetic
cacgtacgcgaccgtgttggtatgatagaggttcgcgcaggcgtcgtcggcctccagctgacccgagttgatgta

SEQ ID NO: 156266 - DNA, 75 bp, Artificial Sequence
  Synthetic
ccgcgccggccggcgacgcccccgcgggccacggggagtagggggagctaacactcggcttgctgcccgaaggga

SEQ ID NO: 156267 - DNA, 75 bp, Artificial Sequence
  Synthetic
cctccagctgacccgagttgatgtaggcgtaccccagcgcccgcagaacgcggatacagaacaggtgagccaggc

SEQ ID NO: 156268 - DNA, 75 bp, Artificial Sequence
  Synthetic
gcggcccgcgttccccggtcccccggggcgaaggcgtgcccgcggcggcgcatgttggaaaaggcgaaactgggc

SEQ ID NO: 156269 - DNA, 75 bp, Artificial Sequence
  Synthetic
gggcgaaggcgtgcccgcggcggcgcatgttggaaaaggcgaaactgggcctggagtcggtgatgggggaaggcg

SEQ ID NO: 156270 - DNA, 75 bp, Artificial Sequence
  Synthetic
gtcgtgcgggccaggatcgccttggccccgaacacaaccggctcggtacactcgaccccgcgatcggtcacgaag

SEQ ID NO: 156271 - DNA, 75 bp, Artificial Sequence
  Synthetic
ccccgaacacaaccggctcggtacactcgaccccgcgatcggtcacgaagatggggaacagggacttttgggtaa

SEQ ID NO: 156272 - DNA, 75 bp, Artificial Sequence
  Synthetic
taacttgggtagcggcgctgatatttaaccaccagggtatacatgacattccacaggtccacggcgatgggggta

SEQ ID NO: 156273 - DNA, 75 bp, Artificial Sequence
  Synthetic
taaccaccagggtatacatgacattccacaggtccacggcgatgggggtaaagtagccctccggggcccggaggc

SEQ ID NO: 156274 - DNA, 75 bp, Artificial Sequence
  Synthetic
agacccattccggcacgattgtaggtgcggataggtctctctacagagctgtataggtgtgacggtccgggacac

SEQ ID NO: 156275 - DNA, 75 bp, Artificial Sequence
  Synthetic
tgcggataggtctctctacagagctgtataggtgtgacggtccgggacacccaagcccgccgcccctgtgtacag

SEQ ID NO: 156276 - DNA, 75 bp, Artificial Sequence
  Synthetic
ggggccgtcctgtgcgggattgcgttttacgtgacgtcaatcgcccgaggcgcataaaggtccggcggccagccc

SEQ ID NO: 156277 - DNA, 75 bp, Artificial Sequence
  Synthetic
cgctctttataattcttttttatttcccatctacgtgcggattggtgcaaccgccggcgcgcgccggtgcaggcc

SEQ ID NO: 156278 - DNA, 75 bp, Artificial Sequence
  Synthetic
ccctcccccgagccctcaaagagggtgtggcctaactagcggaaggcgtatttaaccagactagggcggcgggtc

SEQ ID NO: 156279 - DNA, 75 bp, Artificial Sequence
  Synthetic
tttaaccagactagggcggcgggtccgccgtagtccttggctcgggtagccactgctctgtggctcgggtccccc

SEQ ID NO: 156280 - DNA, 75 bp, Artificial Sequence
  Synthetic
gcgtcatccgccccctccgcctgcgacacaaacggccgcgcctccgggcccggtgacacgacgcgcctcgtctct

SEQ ID NO: 156281 - DNA, 75 bp, Artificial Sequence
  Synthetic
cggtgacacgacgcgcctcgtctctgcggattgtcccgggagcgtcgcggcatggctcatcttcccggcggtgcg

SEQ ID NO: 156282 - DNA, 75 bp, Artificial Sequence
  Synthetic
gcggattgtcccgggagcgtcgcggcatggctcatcttcccggcggtgcggccgccgcccccctttcggaggacg

SEQ ID NO: 156283 - DNA, 75 bp, Artificial Sequence
  Synthetic
cccacgtccgtatgttaattgcaataaagtggttgattgtcattacggtctactaggttgtctttttttgggggg

SEQ ID NO: 156284 - DNA, 75 bp, Artificial Sequence
  Synthetic
gtgctgcagggcgccgagctgaacgggatcctgcaggcctttgcgccgcttcgcacgagccttttggactcgctc

SEQ ID NO: 156285 - DNA, 75 bp, Artificial Sequence
  Synthetic
ggatcctgcaggcctttgcgccgcttcgcacgagccttttggactcgctcctggtcgtgggcgaccgaggcatcc

SEQ ID NO: 156286 - DNA, 75 bp, Artificial Sequence
  Synthetic
tcgcagttcagtcgctatcgatggggcggacccaccgcggcgttcctgtctctcgtggaccagaagcgatccctg

SEQ ID NO: 156287 - DNA, 75 bp, Artificial Sequence
  Synthetic
gcggacccaccgcggcgttcctgtctctcgtggaccagaagcgatccctgctgagcgtgtttcgcgccaaccagt

SEQ ID NO: 156288 - DNA, 75 bp, Artificial Sequence
  Synthetic
cgcacgctggtgcagcgcatatggacgaccgcgtccgacggagaggccgtggagcttgccagcgagacgctcatg

SEQ ID NO: 156289 - DNA, 75 bp, Artificial Sequence
  Synthetic
cgaccgcgtccgacggagaggccgtggagcttgccagcgagacgctcatgaaacgcgagttgacgagcttcgcgg

SEQ ID NO: 156290 - DNA, 75 bp, Artificial Sequence
  Synthetic
cagctcacgaaggtggtgaacgccgtcggggacgagaccgccaaacccaccacgttcgagctcggccccaacggc

SEQ ID NO: 156291 - DNA, 75 bp, Artificial Sequence
  Synthetic
tcggggacgagaccgccaaacccaccacgttcgagctcggccccaacggcaagttttccgtgtttaacgcgcgca

SEQ ID NO: 156292 - DNA, 75 bp, Artificial Sequence
  Synthetic
cttccgctgctccgccgacatcgcctccgaccggggtgtgcgggggggggggtcttcttcttcttcttcaggggc

SEQ ID NO: 156293 - DNA, 75 bp, Artificial Sequence
  Synthetic
tcccgtccacgaaggcggcgcccggcctgcgagaaagcgcggatgttgggatcggggccccgtccccccgtcccg

SEQ ID NO: 156294 - DNA, 75 bp, Artificial Sequence
  Synthetic
cctgcgagaaagcgcggatgttgggatcggggccccgtccccccgtcccgtccccccgtcccgtccccccgtccc

SEQ ID NO: 156295 - DNA, 75 bp, Artificial Sequence
  Synthetic
gcccaggtccagattctgaccagcgcgctgaagaaggcgggccaggcggccgccaacgccaagacggtctacggg

SEQ ID NO: 156296 - DNA, 75 bp, Artificial Sequence
  Synthetic
cgctgaagaaggcgggccaggcggccgccaacgccaagacggtctacggggaaaacacacaccgcacattctcgg

SEQ ID NO: 156297 - DNA, 75 bp, Artificial Sequence
  Synthetic
ccccccggcccgtcccgccccccccccgtcccgccccggcccgtcccgccccggcccgtcccgccccggcccgtc

SEQ ID NO: 156298 - DNA, 75 bp, Artificial Sequence
  Synthetic
ggcggggggaccctcaagttcttcctcacggccgacgtccccagcgtgtgtgtcaccgccaccggccccaacgcg

SEQ ID NO: 156299 - DNA, 75 bp, Artificial Sequence
  Synthetic
tcacggccgacgtccccagcgtgtgtgtcaccgccaccggccccaacgcggtgtcggcggtgtttcttttaaaac

SEQ ID NO: 156300 - DNA, 75 bp, Artificial Sequence
  Synthetic
gggagcttggcgtcccaggactctcgggccggcccgaccgacagccaggacttctcctccgagccggacgcgggc

SEQ ID NO: 156301 - DNA, 75 bp, Artificial Sequence
  Synthetic
gggccggcccgaccgacagccaggacttctcctccgagccggacgcgggcgaccgcggcgccccagaagaagaag

SEQ ID NO: 156302 - DNA, 75 bp, Artificial Sequence
  Synthetic
accaagcggaggcacgccggggccgaagttgtccccgcggacgacgccaccaagcgcccgaagacgggcgtgccc

SEQ ID NO: 156303 - DNA, 75 bp, Artificial Sequence
  Synthetic
aagttgtccccgcggacgacgccaccaagcgcccgaagacgggcgtgcccgccgcccccacgcgagccgagtcgc

SEQ ID NO: 156304 - DNA, 75 bp, Artificial Sequence
  Synthetic
ggcggccgctacgcgtgctactttcgcgacctccagaccggcgacgcgagccccagccccctctccgccttccgg

SEQ ID NO: 156305 - DNA, 75 bp, Artificial Sequence
  Synthetic
tcgtgtgtggttccgggttgcgcctccgtcctttccaccccccttccccctccttttttgttttgcgtgcgctta

SEQ ID NO: 156306 - DNA, 75 bp, Artificial Sequence
  Synthetic
ccgtcctttccaccccccttccccctccttttttgttttgcgtgcgcttataagagcgggcccggggcccttcgc

SEQ ID NO: 156307 - DNA, 75 bp, Artificial Sequence
  Synthetic
acagccccggggtcgcgggcgggagcggcgaacactgcctcggaggggatgatggggacgacgggcgcccccgcc

SEQ ID NO: 156308 - DNA, 75 bp, Artificial Sequence
  Synthetic
cggcgaacactgcctcggaggggatgatggggacgacgggcgcccccgcctggcctgcgtgggtgccatcgctcg

SEQ ID NO: 156309 - DNA, 75 bp, Artificial Sequence
  Synthetic
tacgtccggtgtgtgcaccgcgaagaatccagaaacatgtccgtcgttttcagggcccaagacatcccggccccc

SEQ ID NO: 156310 - DNA, 75 bp, Artificial Sequence
  Synthetic
ctgtcgttctgtcgcgcggcccgtatgcggacgccatgtcgggggcgttcgtgatcgggagcaccggcctggggt

SEQ ID NO: 156311 - DNA, 75 bp, Artificial Sequence
  Synthetic
tgcggacgccatgtcgggggcgttcgtgatcgggagcaccggcctggggttcctccgcgccccccccgcgttcgc

SEQ ID NO: 156312 - DNA, 75 bp, Artificial Sequence
  Synthetic
ggggccggggggccggggggccggggggacggggggacggggggacggggggacggggggacggggggacggggg

SEQ ID NO: 156313 - DNA, 75 bp, Artificial Sequence
  Synthetic
cggccgtggccctgtggagcctcggggaggccggcgcgcctccgggggttccgggcccggcgacccagtgcctgg

SEQ ID NO: 156314 - DNA, 75 bp, Artificial Sequence
  Synthetic
ggaggccggcgcgcctccgggggttccgggcccggcgacccagtgcctggcgctcggggccgcctacgcggcgct

SEQ ID NO: 156315 - DNA, 75 bp, Artificial Sequence
  Synthetic
ccctgtttgtcggcaccctgggggttgtcgtcggcgggctgacgataggcggcagtgcgcgctactggtggatcg

SEQ ID NO: 156316 - DNA, 75 bp, Artificial Sequence
  Synthetic
acccccgcgccgccgcggccctgacggcggcggtggtggcgggcctcgggacaaccgccgccggggacagctttt

SEQ ID NO: 156317 - DNA, 75 bp, Artificial Sequence
  Synthetic
tctcccccgccccgatacgccccggaggacgccgagcggccaacagaccacggacccctgttaccgtcgacgcac

SEQ ID NO: 156318 - DNA, 75 bp, Artificial Sequence
  Synthetic
caccagcgatctccgcgggtctgcggcgacggggccgcacggcccgaaaacatctgggttcccgtggtgaccttt

SEQ ID NO: 156319 - DNA, 75 bp, Artificial Sequence
  Synthetic
tccgtcaggcccggtcctgccgctgtggccccaggtgtttgtcgggggccacgcggcggcgggcctgacggagct

SEQ ID NO: 156320 - DNA, 75 bp, Artificial Sequence
  Synthetic
ctgcggccccgccccctttggggcggagccgcccgcggaccaacggggcgacctcgccggcccctttggggccgg

SEQ ID NO: 156321 - DNA, 75 bp, Artificial Sequence
  Synthetic
gtgtcagaccctcgcgccccgggacctcacggacccgctgctgtttgcgtacgtcggattccaggtcgtgaacca

SEQ ID NO: 156322 - DNA, 75 bp, Artificial Sequence
  Synthetic
gcgccgtgtggatctcgctgacgcaggtgcttgggctccggcgccgccttcacaaggacccagacgccgggccct

SEQ ID NO: 156323 - DNA, 75 bp, Artificial Sequence
  Synthetic
ggtgcttgggctccggcgccgccttcacaaggacccagacgccgggccctgggcggccgcgaccctgcggggcct

SEQ ID NO: 156324 - DNA, 75 bp, Artificial Sequence
  Synthetic
cgcggatggcggcgagccggcggtcggggtgatcgccatttcaaataaaaggcacgagttccccgaataccaccg

SEQ ID NO: 156325 - DNA, 75 bp, Artificial Sequence
  Synthetic
tacccgatcggcgcggagaggcgaaaagacacaggcacacgcacgcaccgcacgggggggagagagaccgccaac

SEQ ID NO: 156326 - DNA, 75 bp, Artificial Sequence
  Synthetic
gcgggcccatcactgttagggtgttaggttgggaggtggcacaaaaagcgacacacccgtgttgtagttgtccgc

SEQ ID NO: 156327 - DNA, 75 bp, Artificial Sequence
  Synthetic
aggttgggaggtggcacaaaaagcgacacacccgtgttgtagttgtccgcgggaggcggtggtttccggcaaccc

SEQ ID NO: 156328 - DNA, 75 bp, Artificial Sequence
  Synthetic
ttctggtcatggcccttggacgggtgggcctagccgtgggcctgtggggcctgctgtgggtgggtgtggtcgtgg

SEQ ID NO: 156329 - DNA, 75 bp, Artificial Sequence
  Synthetic
gggcctagccgtgggcctgtggggcctgctgtgggtgggtgtggtcgtggtgctggccaatgcctcccccggacg

SEQ ID NO: 156330 - DNA, 75 bp, Artificial Sequence
  Synthetic
cgtccccgcggaacgcatccgccccccgaaccacacccacgcccccccaaccccgcaaggcgacgaaaagtaagg

SEQ ID NO: 156331 - DNA, 75 bp, Artificial Sequence
  Synthetic
ccgaaccacacccacgcccccccaaccccgcaaggcgacgaaaagtaaggcctccaccgccaaaccggccccgcc

SEQ ID NO: 156332 - DNA, 75 bp, Artificial Sequence
  Synthetic
gccacgacccgctggcccggtacggctcgcgggtgcaaatccgatgccggtttcccaactccacccgcacggagt

SEQ ID NO: 156333 - DNA, 75 bp, Artificial Sequence
  Synthetic
ctcgcgggtgcaaatccgatgccggtttcccaactccacccgcacggagtcccgcctccagatctggcgttatgc

SEQ ID NO: 156334 - DNA, 75 bp, Artificial Sequence
  Synthetic
tggtaaacgtgtcggccccgcccgggggccaactggtgtatgacagcgcccccaaccgaacggacccgcacgtga

SEQ ID NO: 156335 - DNA, 75 bp, Artificial Sequence
  Synthetic
cccccgccggcgctcggccgcctctgactcatcaaaatccggatcctcgtcgtcggcgtcctccgcctcctcctc

SEQ ID NO: 156336 - DNA, 75 bp, Artificial Sequence
  Synthetic
tcatcatcgaagagctgaccctggagacccagggcatgtactactgggtgtggggccggacggaccgcccgtccg

SEQ ID NO: 156337 - DNA, 75 bp, Artificial Sequence
  Synthetic
tggggccggacggaccgcccgtccgcgtacgggacctgggtgcgcgttcgcgtgttccgccctccgtcgctgacc

SEQ ID NO: 156338 - DNA, 75 bp, Artificial Sequence
  Synthetic
cgtacgggacctgggtgcgcgttcgcgtgttccgccctccgtcgctgaccatccacccccacgcggtgctggagg

SEQ ID NO: 156339 - DNA, 75 bp, Artificial Sequence
  Synthetic
cgcgcggagttcgtctggttcgaggacggtcgccgggtattcgatccggcccagatacacacgcagacgcaggag

SEQ ID NO: 156340 - DNA, 75 bp, Artificial Sequence
  Synthetic
ccagatacacacgcagacgcaggagaaccccgacggcttttccaccgtctccaccgtgacctccgcggccgtcgg

SEQ ID NO: 156341 - DNA, 75 bp, Artificial Sequence
  Synthetic
gacccccgcggcgaccgcgggccgcctggagcgccgccgggcccgcgcggcggtggccggccgcgacgccacggg

SEQ ID NO: 156342 - DNA, 75 bp, Artificial Sequence
  Synthetic
cggtggccggccgcgacgccacgggccgcttcacggccgggcggccccggcgggtcgagctggacgccgacgcgg

SEQ ID NO: 156343 - DNA, 75 bp, Artificial Sequence
  Synthetic
acctgccagctgacgtggcaccgcgactccgtgtcgttctctcggcgcaacgccagcggcacggcatcggtgctg

SEQ ID NO: 156344 - DNA, 75 bp, Artificial Sequence
  Synthetic
actccgtgtcgttctctcggcgcaacgccagcggcacggcatcggtgctgccgcggccaaccatcaccatggagt

SEQ ID NO: 156345 - DNA, 75 bp, Artificial Sequence
  Synthetic
aaggcggcgcccggcctgcgagaaagcgcggatgttgggatcggcgccccggccccccgccccgtccccccgtcc

SEQ ID NO: 156346 - DNA, 75 bp, Artificial Sequence
  Synthetic
acgtttgcctggttcctgggggacgactcctcgccggcggagaaggtggccgtcgcgtcccagacatcgtgcggg

SEQ ID NO: 156347 - DNA, 75 bp, Artificial Sequence
  Synthetic
actcctcgccggcggagaaggtggccgtcgcgtcccagacatcgtgcgggcgccccggcaccgccacgatccgct

SEQ ID NO: 156348 - DNA, 75 bp, Artificial Sequence
  Synthetic
ccccgccccgaccccccgccccgtccccccgtccccccgtccccccgtccccccgtcccccccgtccccccgtcc

SEQ ID NO: 156349 - DNA, 75 bp, Artificial Sequence
  Synthetic
ccccgccccgtccccccgccccgtccccccgtccccccgtccccccgtccccccgtcccccccgtccccccgtcc

SEQ ID NO: 156350 - DNA, 75 bp, Artificial Sequence
  Synthetic
ccccgccccgcccccccgccccgtccccccgtccccccgtccccccgtccccccgtcccccccgtccccccgtcc

SEQ ID NO: 156351 - DNA, 75 bp, Artificial Sequence
  Synthetic
ccccgccccggccccccgccccgtccccccgtccccccgtccccccgtccccccgtcccccccgtccccccgtcc

SEQ ID NO: 156352 - DNA, 75 bp, Artificial Sequence
  Synthetic
ggatacccggacggaattccggtcctagagcaccacggcagccaccagcccccgccgcgggaccccaccgagcgg

SEQ ID NO: 156353 - DNA, 75 bp, Artificial Sequence
  Synthetic
tagagcaccacggcagccaccagcccccgccgcgggaccccaccgagcggcaggtgatccgggcggtggaggggg

SEQ ID NO: 156354 - DNA, 75 bp, Artificial Sequence
  Synthetic
tccccccgccccgtccccccgccccgtccccccgccccgtccccccggcccgtccccccgccccgccccgtcccc

SEQ ID NO: 156355 - DNA, 75 bp, Artificial Sequence
  Synthetic
ttataagccgccgcactcgcttttcccaccggaaaatcctcggcccgatccgaacggcgcacgccgcgtgggctc

SEQ ID NO: 156356 - DNA, 75 bp, Artificial Sequence
  Synthetic
ccaccggaaaatcctcggcccgatccgaacggcgcacgccgcgtgggctccaaacgcctccggaagagagcgccc

SEQ ID NO: 156357 - DNA, 75 bp, Artificial Sequence
  Synthetic
gccgccccgttgccgtcggcggcggcgtcgccggccgacgagcgcgcggtgcccgccggctacggcgccgcgggg

SEQ ID NO: 156358 - DNA, 75 bp, Artificial Sequence
  Synthetic
acccgcctaccagcccctcgcccccgcggcctccccggcgcgggctcgtgttccggccgtggcctggatcggcgt

SEQ ID NO: 156359 - DNA, 75 bp, Artificial Sequence
  Synthetic
gcggcctccccggcgcgggctcgtgttccggccgtggcctggatcggcgtcggaacgatcgtcggggcctttgcg

SEQ ID NO: 156360 - DNA, 75 bp, Artificial Sequence
  Synthetic
gccgtgcgacagcggctggcaggaattcaacgcgggatgcgtcgcgtgggaccccacccccgtcgagcacgagca

SEQ ID NO: 156361 - DNA, 75 bp, Artificial Sequence
  Synthetic
ttcaacgcgggatgcgtcgcgtgggaccccacccccgtcgagcacgagcaggcggtcggcggctgcagcgcgccg

SEQ ID NO: 156362 - DNA, 75 bp, Artificial Sequence
  Synthetic
cccgtccccccgtcccgtccccccgtcccgtccccccgtccccccgtcccgtccccccgccccggcgcccccggg

SEQ ID NO: 156363 - DNA, 75 bp, Artificial Sequence
  Synthetic
cgtccaggcggagagatcgtcgggttactggtgggtgaacggagacggcatccggacctgtctgagactcgtcga

SEQ ID NO: 156364 - DNA, 75 bp, Artificial Sequence
  Synthetic
tactggtgggtgaacggagacggcatccggacctgtctgagactcgtcgacagcgtcagtggcatcgacgagttt

SEQ ID NO: 156365 - DNA, 75 bp, Artificial Sequence
  Synthetic
gtttgtccgcttcgtaacttcgatacgtaacgccctggggttgccgtgaggcgcgcgtccgacggtcccgcttct

SEQ ID NO: 156366 - DNA, 75 bp, Artificial Sequence
  Synthetic
tttctctgtttgttactttttattgaaacagacatacggggaaaggggccggaaaccgagacggtggggccggcg

SEQ ID NO: 156367 - DNA, 75 bp, Artificial Sequence
  Synthetic
aaacagacatacggggaaaggggccggaaaccgagacggtggggccggcggtcgcatttttttaatggctctggt

SEQ ID NO: 156368 - DNA, 75 bp, Artificial Sequence
  Synthetic
gttttcagggcccaagacatgcccggccccccgtcccggccccccggcccggccccccgtcccggccccccgtcc

SEQ ID NO: 156369 - DNA, 75 bp, Artificial Sequence
  Synthetic
agagggcagacccgccccagtcgtacaggggattttccgcctcgatgtacggggagtccggggcgtctcccggcg

SEQ ID NO: 156370 - DNA, 75 bp, Artificial Sequence
  Synthetic
ctcgtaaatggaatctgcgtcctcggagggggcgcggggggcgtggctttcggccggccaggcggcggcggtggt

SEQ ID NO: 156371 - DNA, 75 bp, Artificial Sequence
  Synthetic
ccgacgcccgcgggcatggcggcgtcatcgtcgggcagcagatacgtgttttccatctggtccggttcggcctcc

SEQ ID NO: 156372 - DNA, 75 bp, Artificial Sequence
  Synthetic
catcgtcgggcagcagatacgtgttttccatctggtccggttcggcctccgcgtccggcccccaggtccgcaccg

SEQ ID NO: 156373 - DNA, 75 bp, Artificial Sequence
  Synthetic
gctgccggccgctgctcggggggcgcggggttgcggggcgggaggcgcgggggcgccccggccatatgcgtgtaa

SEQ ID NO: 156374 - DNA, 75 bp, Artificial Sequence
  Synthetic
cggggttgcggggcgggaggcgcgggggcgccccggccatatgcgtgtaatacgtggccggccggccggcgcagg

SEQ ID NO: 156375 - DNA, 75 bp, Artificial Sequence
  Synthetic
tcgcggtggcgcctgaacctccgaggggccgcgggggtcgagtgggggcgagcccgggggagcggcgggggtgcg

SEQ ID NO: 156376 - DNA, 75 bp, Artificial Sequence
  Synthetic
gggccgcgggggtcgagtgggggcgagcccgggggagcggcgggggtgcgttatcgcgccgggtccgttgtatct

SEQ ID NO: 156377 - DNA, 75 bp, Artificial Sequence
  Synthetic
gccgcgaggcgcaggatggactcgtagtggggcgacggggttccgctccgaagcaggtccggggccagggcggcc

SEQ ID NO: 156378 - DNA, 75 bp, Artificial Sequence
  Synthetic
gtggtctgccagggcgagcggtggtgcgactgtcgtctttaggggggcggggagctcgggagtttgtggcggtcc

SEQ ID NO: 156379 - DNA, 75 bp, Artificial Sequence
  Synthetic
ccgaaccaggacttgatgctgagttccatccgggcccagctcggggcggtcatcgtggggaacaggggggcggcg

SEQ ID NO: 156380 - DNA, 75 bp, Artificial Sequence
  Synthetic
ggagctcgggagtttgtggcggtccgcggcagcctgctagtccccgtcctgccgcgcgggggcgggcgcgggaaa

SEQ ID NO: 156381 - DNA, 75 bp, Artificial Sequence
  Synthetic
gttcaggctgtcggaggcccagacgacatacccggtaagcgtcgcgttaattatatactgggcgtggtggtggac

SEQ ID NO: 156382 - DNA, 75 bp, Artificial Sequence
  Synthetic
acatacccggtaagcgtcgcgttaattatatactgggcgtggtggtggactatggatagaacctcgacggtcgag

SEQ ID NO: 156383 - DNA, 75 bp, Artificial Sequence
  Synthetic
ccacaggtgggccaggcgcgtcaggtggcccaggacgtcgctgaccgccgcccgcagggccatgcactgcatcga

SEQ ID NO: 156384 - DNA, 75 bp, Artificial Sequence
  Synthetic
tggcccaggacgtcgctgaccgccgcccgcagggccatgcactgcatcgagcccgtggtgccgctgggcccgcgg

SEQ ID NO: 156385 - DNA, 75 bp, Artificial Sequence
  Synthetic
cgccacgaaccggcgatcggcggggcccaggcggcgacacacgtacttgtccgccgtccacagcatccacgaggc

SEQ ID NO: 156386 - DNA, 75 bp, Artificial Sequence
  Synthetic
cccaggcggcgacacacgtacttgtccgccgtccacagcatccacgaggcccaatggtacaacacggagacgtag

SEQ ID NO: 156387 - DNA, 75 bp, Artificial Sequence
  Synthetic
ggagtccccgtcctgccgccgccccttaagagggcccgcaacacggcccgggctgcgcacgccagccgggacggg

SEQ ID NO: 156388 - DNA, 75 bp, Artificial Sequence
  Synthetic
gccgcgccccggcgctccagccgtgccgcgccccggcgcgctcccaaccgcagactcccaaatggtccctgcgta

SEQ ID NO: 156389 - DNA, 75 bp, Artificial Sequence
  Synthetic
gtctgcggggcgcataaagaacatgtactgctggagcctgtgggccgcgtcgcgcaaccccgccaccgcggcggc

SEQ ID NO: 156390 - DNA, 75 bp, Artificial Sequence
  Synthetic
tactgctggagcctgtgggccgcgtcgcgcaaccccgccaccgcggcggcgtacttggccgcggcggccccgctc

SEQ ID NO: 156391 - DNA, 75 bp, Artificial Sequence
  Synthetic
cacgtgcaggctggggtcgcagtcgcccgccgggtcgtcggggatgtccaggccgctgggcacgaccgtctggag

SEQ ID NO: 156392 - DNA, 75 bp, Artificial Sequence
  Synthetic
cgcggggggtctggggctctgacctgagtgcaggttacgaaggtcaggtggcccgagcccccccgcaggagcggg

SEQ ID NO: 156393 - DNA, 75 bp, Artificial Sequence
  Synthetic
cccgccgggtcgtcggggatgtccaggccgctgggcacgaccgtctggaggtacttccagtactgcgctaggatg

SEQ ID NO: 156394 - DNA, 75 bp, Artificial Sequence
  Synthetic
ggcggccgacgcgtagtgccggatgtagtcgtagtgcgggtcgctggcgagcccgtctacgatcaggctctcggg

SEQ ID NO: 156395 - DNA, 75 bp, Artificial Sequence
  Synthetic
tagtcgtagtgcgggtcgctggcgagcccgtctacgatcaggctctcggggacggtgttatggtgccgcgccgcc

SEQ ID NO: 156396 - DNA, 75 bp, Artificial Sequence
  Synthetic
ccgcccgcggacgcgccgcgcgggaaggtacgcctcccccccgaccccctgacccgaccccctgacccgaccccc

SEQ ID NO: 156397 - DNA, 75 bp, Artificial Sequence
  Synthetic
ggcgcgctgccgcaggacgcccacggccgcgctgaggagcccctccggggtggggagcagacacccggcgaagat

SEQ ID NO: 156398 - DNA, 75 bp, Artificial Sequence
  Synthetic
gcgccgctcggggacgcccgcgttggcgccgcggatgaggttggccggcgtcaggcaccgcgccagccgcaggga

SEQ ID NO: 156399 - DNA, 75 bp, Artificial Sequence
  Synthetic
cccgaccccctgacccccgtgtctccccgcccgcaggtgtgcttctcgccgcgcgtgcaggtgcgccatctggtg

SEQ ID NO: 156400 - DNA, 75 bp, Artificial Sequence
  Synthetic
cccgccggtcggaggtatgccgcgtcccgggatatagggttgctttttatggggaggcgcctatgggcgtggcgg

SEQ ID NO: 156401 - DNA, 75 bp, Artificial Sequence
  Synthetic
cccgggatatagggttgctttttatggggaggcgcctatgggcgtggcgggccgcccagcccggtcgcgcgcctc

SEQ ID NO: 156402 - DNA, 75 bp, Artificial Sequence
  Synthetic
tttccgaaactgcgccatgatgtccacgacgcggacccgcggccccagcacggactcgctattcaggggggcggg

SEQ ID NO: 156403 - DNA, 75 bp, Artificial Sequence
  Synthetic
acgacgcggacccgcggccccagcacggactcgctattcaggggggcgggggggaaggccgccaggtcttcgagc

SEQ ID NO: 156404 - DNA, 75 bp, Artificial Sequence
  Synthetic
cgcggggcgaaggtccacgtgttccgcggcggcgcgcacgtccgcccaaaatttggcgggggtggtccgcgcgta

SEQ ID NO: 156405 - DNA, 75 bp, Artificial Sequence
  Synthetic
gcggcggcgcgcacgtccgcccaaaatttggcgggggtggtccgcgcgtacaggggctgggtcgcgcggaggacg

SEQ ID NO: 156406 - DNA, 75 bp, Artificial Sequence
  Synthetic
gccgtcaaacgcggccagggccacgcacgcgaccaccgtgtcggccaggcccagcagccgctgcaggatgagccc

SEQ ID NO: 156407 - DNA, 75 bp, Artificial Sequence
  Synthetic
cacgcgaccaccgtgtcggccaggcccagcagccgctgcaggatgagccccgtcgccagcacggcgcgcgcggcc

SEQ ID NO: 156408 - DNA, 75 bp, Artificial Sequence
  Synthetic
cagggtaacggtcgccagggccgtgtgcagcgcgtacacggccgcgcccagcacggcgttcagcccgctggtggc

SEQ ID NO: 156409 - DNA, 75 bp, Artificial Sequence
  Synthetic
tgcagcgcgtacacggccgcgcccagcacggcgttcagcccgctggtggcgagcaggcggcgcgccgcggtgtcg

SEQ ID NO: 156410 - DNA, 75 bp, Artificial Sequence
  Synthetic
ggcgcgaaacagcgcctcctgctccacgtccgcaaacgcggggtgggcggagtgcgggtgcaggcgcgcccccac

SEQ ID NO: 156411 - DNA, 75 bp, Artificial Sequence
  Synthetic
acgtccgcaaacgcggggtgggcggagtgcgggtgcaggcgcgcccccacgaccaccgagagccactggaccgtc

SEQ ID NO: 156412 - DNA, 75 bp, Artificial Sequence
  Synthetic
ctcccgcgggagcacgcatttgacggcgccggggttgaagcgggcgagcagagccccggtggcgatgtacgtcat

SEQ ID NO: 156413 - DNA, 75 bp, Artificial Sequence
  Synthetic
gcgccggggttgaagcgggcgagcagagccccggtggcgatgtacgtcatgcgccccgcgtagcgggcggccacg

SEQ ID NO: 156414 - DNA, 75 bp, Artificial Sequence
  Synthetic
ggccctcttaaggggcggcggcaggacggggactccgccccgcctcctttcccccggggagtcaacccccggggg

SEQ ID NO: 156415 - DNA, 75 bp, Artificial Sequence
  Synthetic
ccccgtgtctccccgcccgcaggtgtgcttctcgccgcgcgtgcaggtgcgccatctggtggcctgggagacggc

SEQ ID NO: 156416 - DNA, 75 bp, Artificial Sequence
  Synthetic
gcgctttctcgcaggccgggcgccgccttcgtggacgggacaccggtgtggtaactggcgacaaggcgtcgccac

SEQ ID NO: 156417 - DNA, 75 bp, Artificial Sequence
  Synthetic
ccccagcgaactgcgaaagaccgcggcgtcggggccggggtgggggggcgcggcccctcccgcgctgagcagcgg

SEQ ID NO: 156418 - DNA, 75 bp, Artificial Sequence
  Synthetic
gcgtcggggccggggtgggggggcgcggcccctcccgcgctgagcagcggcacggcggcggcccccacgggccgc

SEQ ID NO: 156419 - DNA, 75 bp, Artificial Sequence
  Synthetic
gagggacggggaagggggcggccggggctgccctgccgcccgcccgccgccgccgccgcccgccttcgcgccccc

SEQ ID NO: 156420 - DNA, 75 bp, Artificial Sequence
  Synthetic
gagctccgagccgcgcccctccgtgtgcaggcgcgtcccgcagacccacccgttgatcgccacccgcacgatggc

SEQ ID NO: 156421 - DNA, 75 bp, Artificial Sequence
  Synthetic
tgcaggcgcgtcccgcagacccacccgttgatcgccacccgcacgatggcgtccaccagaaagcccatcgcgcgg

SEQ ID NO: 156422 - DNA, 75 bp, Artificial Sequence
  Synthetic
cgtgacgtaccaggccagcgcctcgccctgctgcagcgtctggcggaaaaacacctttgggtcggccggggaggc

SEQ ID NO: 156423 - DNA, 75 bp, Artificial Sequence
  Synthetic
ccctgctgcagcgtctggcggaaaaacacctttgggtcggccggggaggcaaagtgcatgacccccacgcgcgac

SEQ ID NO: 156424 - DNA, 75 bp, Artificial Sequence
  Synthetic
ggccagggccgagcgcacggactcgtcccacgcggcgactcggggggtcaggcggtccagggggaatgccgcctg

SEQ ID NO: 156425 - DNA, 75 bp, Artificial Sequence
  Synthetic
tcccacgcggcgactcggggggtcaggcggtccagggggaatgccgcctgcagctccgggcccgacacgcggccc

SEQ ID NO: 156426 - DNA, 75 bp, Artificial Sequence
  Synthetic
ggtcgggcgggggtcgggcgggggtcgggcgggggtcgggcgggggtcgggcgggggtcgggcgggggtcgggcg

SEQ ID NO: 156427 - DNA, 75 bp, Artificial Sequence
  Synthetic
cgcgacggcggcggggtagtcgtcctcctcgtagttgagctcgtccaggaacagcggcgagggcaccacccgcga

SEQ ID NO: 156428 - DNA, 75 bp, Artificial Sequence
  Synthetic
tcctcgtagttgagctcgtccaggaacagcggcgagggcaccacccgcgaaccgcccacccgccccaaaacgtcg

SEQ ID NO: 156429 - DNA, 75 bp, Artificial Sequence
  Synthetic
gctgtcccggcgtccgcgaacggactggctcctggccgtaacggacctggggcgcggaaaggacgcccggcgggg

SEQ ID NO: 156430 - DNA, 75 bp, Artificial Sequence
  Synthetic
tggctcctggccgtaacggacctggggcgcggaaaggacgcccggcgggggggcgccgccgcccgggcctcggac

SEQ ID NO: 156431 - DNA, 75 bp, Artificial Sequence
  Synthetic
cggctcttcgctcgccatctcccccgcggcctcgacctcgctgtcgtcgtccacgttaaacaccgcccgcaggta

SEQ ID NO: 156432 - DNA, 75 bp, Artificial Sequence
  Synthetic
ggaggcccaaacggggaggtggggggtagggggcggtcccagggagcggggggtaggaaccggcacgacgggaac

SEQ ID NO: 156433 - DNA, 75 bp, Artificial Sequence
  Synthetic
cacgcagacccgcgggcaaatgcgagaacgggacccgcgcgcctgcctttatacgcggaccccagcaccacgagc

SEQ ID NO: 156434 - DNA, 75 bp, Artificial Sequence
  Synthetic
gaacgggacccgcgcgcctgcctttatacgcggaccccagcaccacgagccgttctgtgacgcgaatctacacga

SEQ ID NO: 156435 - DNA, 75 bp, Artificial Sequence
  Synthetic
atacgcggaccccagcaccacgagccgttctgtgacgcgaatctacacgaccgcgggctcgtaggcgcgactaac

SEQ ID NO: 156436 - DNA, 75 bp, Artificial Sequence
  Synthetic
tcatggtcccgtaataaacagccaacgcacgccgcgtatgatgagttgcttgccaatgtttattgctgtggttgc

SEQ ID NO: 156437 - DNA, 75 bp, Artificial Sequence
  Synthetic
tgccaatgtttattgctgtggttgcgaaccctctatcgcgatacagacggaggtgaggcggggcggcggtggggg

SEQ ID NO: 156438 - DNA, 75 bp, Artificial Sequence
  Synthetic
ggcatcggtaaacatctgttcaaactcaaaatcgtccacgtccaaagccccatacgagacggggtcgtgggtcat

SEQ ID NO: 156439 - DNA, 75 bp, Artificial Sequence
  Synthetic
tcaaaatcgtccacgtccaaagccccatacgagacggggtcgtgggtcattcccggggagggggactccacgtcc

SEQ ID NO: 156440 - DNA, 75 bp, Artificial Sequence
  Synthetic
cacctcctcgccgtccaggcggagttcgtctcccaggctgacgtcggtaatgggggcggtggtggacagtctgcg

SEQ ID NO: 156441 - DNA, 75 bp, Artificial Sequence
  Synthetic
tcgtctcccaggctgacgtcggtaatgggggcggtggtggacagtctgcgggggcgttgtcccgcggagagaaac

SEQ ID NO: 156442 - DNA, 75 bp, Artificial Sequence
  Synthetic
cgggaggtcgagcaggccctcgattgtcgatccgtaattgtttctggtccgcccgcggctatacgcgtgctcccg

SEQ ID NO: 156443 - DNA, 75 bp, Artificial Sequence
  Synthetic
gtcgatccgtaattgtttctggtccgcccgcggctatacgcgtgctcccgcatgacggactcgccctccgaggtc

SEQ ID NO: 156444 - DNA, 75 bp, Artificial Sequence
  Synthetic
cccagaggagcgggcctggttgccctgcaggacgggcggggtcgtgaggggcgccccgggttcctccgccgccgc

SEQ ID NO: 156445 - DNA, 75 bp, Artificial Sequence
  Synthetic
tgcaggacgggcggggtcgtgaggggcgccccgggttcctccgccgccgcacttcgcaccagcgggaggttcagg

SEQ ID NO: 156446 - DNA, 75 bp, Artificial Sequence
  Synthetic
tccccgcacggtgagcgatccgttgataaacatcaggggctgaaacagacacgccaactggcgccagctctccag

SEQ ID NO: 156447 - DNA, 75 bp, Artificial Sequence
  Synthetic
ataaacatcaggggctgaaacagacacgccaactggcgccagctctccaggtcgcagcagaggccgtcgaacaga

SEQ ID NO: 156448 - DNA, 75 bp, Artificial Sequence
  Synthetic
gcctgcgccggcggcggccccccgcgtccccgcccgcggacgcgccgcgcgggaaggtgcgcctcccctccgacc

SEQ ID NO: 156449 - DNA, 75 bp, Artificial Sequence
  Synthetic
cagaaagaggtatagatgcagaaacaggacgcgcgccaggcgcgcggtctcgcggtagtacctgtccgcgatcgt

SEQ ID NO: 156450 - DNA, 75 bp, Artificial Sequence
  Synthetic
aggacgcgcgccaggcgcgcggtctcgcggtagtacctgtccgcgatcgtggtgcgcagcatctcccgcaggtcg

SEQ ID NO: 156451 - DNA, 75 bp, Artificial Sequence
  Synthetic
gacgtagtccgctgcagagggagacagagacgggaacccccggttagtgcccgacccccgcccgacccccgcccg

SEQ ID NO: 156452 - DNA, 75 bp, Artificial Sequence
  Synthetic
gtccccgcccgcggacgcgccgcgcgggaaggtgcgcctcccctccgaccccctgacccccctccgaccccctga

SEQ ID NO: 156453 - DNA, 75 bp, Artificial Sequence
  Synthetic
gtcgggcgggggtcgggcactaaccgggggttcccgtctctgtctccctctgcagcggactacgtcccgcccgcc

SEQ ID NO: 156454 - DNA, 75 bp, Artificial Sequence
  Synthetic
gcgcaggtaccggtacagggccgagcaaaaatttgccaacacggtccggtagctctcctcccgcgcccgcagctc

SEQ ID NO: 156455 - DNA, 75 bp, Artificial Sequence
  Synthetic
caaaaatttgccaacacggtccggtagctctcctcccgcgcccgcagctcaccgcggaaaaactgcgccatggcc

SEQ ID NO: 156456 - DNA, 75 bp, Artificial Sequence
  Synthetic
cacgtcgccgtgggcgcgaatgtcgatcggggagcgctcggggacgtgcgcatccccccagtcgatcacgtcgct

SEQ ID NO: 156457 - DNA, 75 bp, Artificial Sequence
  Synthetic
atcggggagcgctcggggacgtgcgcatccccccagtcgatcacgtcgctgggcagcgtcgacagaaacttgcac

SEQ ID NO: 156458 - DNA, 75 bp, Artificial Sequence
  Synthetic
ccaggtatctagcatggtacacagcgcgggacccgcgctgaagcccagatcgtcgaggagacggttaaacagggc

SEQ ID NO: 156459 - DNA, 75 bp, Artificial Sequence
  Synthetic
gcgggacccgcgctgaagcccagatcgtcgaggagacggttaaacagggccgcgggggggacgggcatgggcggc

SEQ ID NO: 156460 - DNA, 75 bp, Artificial Sequence
  Synthetic
ggcggctggggtgttcttgggacccccggctggcctggggggcggtggcgaaaccccgtccgcgtccgcaaacag

SEQ ID NO: 156461 - DNA, 75 bp, Artificial Sequence
  Synthetic
aaaccccgtccgcgtccgcaaacagatcgtcgaccaacaggtccatgggggcggttgggtccgggaataacgatc

SEQ ID NO: 156462 - DNA, 75 bp, Artificial Sequence
  Synthetic
acacagtcacgagacacgatatcgactgtagttgcgatcgtttattttatacacaacaccaacctttccttcgac

SEQ ID NO: 156463 - DNA, 75 bp, Artificial Sequence
  Synthetic
gggatccgggacccgcgacagaaaaaggccggggccctcgcgaagggaatcgccgggggtgccgtgcgtccccga

SEQ ID NO: 156464 - DNA, 75 bp, Artificial Sequence
  Synthetic
tcccgcccctcccgcccctcccgcccctcccgcccctcccgcccctcccgcccctcccgcccctcccgcccctcc

SEQ ID NO: 156465 - DNA, 75 bp, Artificial Sequence
  Synthetic
tccgcactctgcccggctcgccccgtcccccctcttgctgcttttccgcgcgcctctctttcccgttgctttccc

SEQ ID NO: 156466 - DNA, 75 bp, Artificial Sequence
  Synthetic
aacgcggccggggtcgctactcgagggggcggcggggacgggaagccgagcgggcgggggcccgtgcggtcgcgg

SEQ ID NO: 156467 - DNA, 75 bp, Artificial Sequence
  Synthetic
cgggcgggggcccgtgcggtcgcggcggcacgccccgcggggcggccccgggcggccgcggtcgcgtcgacgtcc

SEQ ID NO: 156468 - DNA, 75 bp, Artificial Sequence
  Synthetic
cgttcgcgcgctgcaggaggttcttgccctcgcagaccgtcacgcgaatggtggtgaggtcgaggagctcgttga

SEQ ID NO: 156469 - DNA, 75 bp, Artificial Sequence
  Synthetic
gccctcgcagaccgtcacgcgaatggtggtgaggtcgaggagctcgttgaggtcttcgtcggtgtgcggccgcga

SEQ ID NO: 156470 - DNA, 75 bp, Artificial Sequence
  Synthetic
gcccgaccgcggcgcagaagacgcgcttgttgaacccggccacccggggggtccacggcgccgtggggctcggtg

SEQ ID NO: 156471 - DNA, 75 bp, Artificial Sequence
  Synthetic
gtctggccggccagaccctgggggtggtgggcaggagtgggagggcgcctggctcggggagggaggagggggggg

SEQ ID NO: 156472 - DNA, 75 bp, Artificial Sequence
  Synthetic
ggccagtccctgggcgggtgtcttggttcttcccgaggccgtgggagcgggggcgtctaggagcacggcggagtc

SEQ ID NO: 156473 - DNA, 75 bp, Artificial Sequence
  Synthetic
gggccttaggcgccccgcgcgtcattttgggggtccgcgcgggaggggcgtgcgagcgcccgccggcgcccacgg

SEQ ID NO: 156474 - DNA, 75 bp, Artificial Sequence
  Synthetic
cgtatgttaattgcaataaagtggttgattgtcattacggtctactaggttgtctttttttttggggggggggga

SEQ ID NO: 156475 - DNA, 75 bp, Artificial Sequence
  Synthetic
gtggggggggaaagacggggaggagacaggaagtgggggtgggagtgggggggggggacggacacggccccgaac

SEQ ID NO: 156476 - DNA, 75 bp, Artificial Sequence
  Synthetic
gcgacggacgccgaacgacgcggtcgcgcggtatcccgggactcgtcgttgtcttcggacgacgacgagtcccgg

SEQ ID NO: 156477 - DNA, 75 bp, Artificial Sequence
  Synthetic
tagagggcatacccagcctcgtcataatggagaaagcgaacctcgcccctcgggcgcgcgcgcatcgggccagcg

SEQ ID NO: 156478 - DNA, 75 bp, Artificial Sequence
  Synthetic
tcccgccaagctcgcagcagcccctcccccccgcgcgccgcggggctgcgttcccgcgcccgcccccgcgcggcc

SEQ ID NO: 156479 - DNA, 75 bp, Artificial Sequence
  Synthetic
gccatagtacagctcctcgtgggtcccgcgcggcgcttcccgcggacacgacttgacggagcggcgagaggtcat

SEQ ID NO: 156480 - DNA, 75 bp, Artificial Sequence
  Synthetic
ccgcgcggcgcttcccgcggacacgacttgacggagcggcgagaggtcatggtctatcggagacaccggggacgc

SEQ ID NO: 156481 - DNA, 75 bp, Artificial Sequence
  Synthetic
cgggccacctgacctccgtaacctgcactcaggtcagagccccagaccccccgcgggcgcgggagacgtgccgcc

SEQ ID NO: 156482 - DNA, 75 bp, Artificial Sequence
  Synthetic
aggcggcgagggagggaaagagggagaccggcggggtacgggagagcagcgagggcctgcgtaacccacgggggc

SEQ ID NO: 156483 - DNA, 75 bp, Artificial Sequence
  Synthetic
cgggggagagtttataggaagtggatataaccgcaggcgacgggactaaccaatccccgggggggcaacggacag

SEQ ID NO: 156484 - DNA, 75 bp, Artificial Sequence
  Synthetic
tattttaaataaacaaacaaccggacaaaagtatacccacttcgtgtgcttgtgtttttggttgaggggggggtg

SEQ ID NO: 156485 - DNA, 75 bp, Artificial Sequence
  Synthetic
cccaacgacacgcccaccccttcccaacagggcgggctcaggctgacccggcggccagtgcccgctggcatatct

SEQ ID NO: 156486 - DNA, 75 bp, Artificial Sequence
  Synthetic
aacagggcgggctcaggctgacccggcggccagtgcccgctggcatatctgatacacgtgcgcgatcatacatac

SEQ ID NO: 156487 - DNA, 75 bp, Artificial Sequence
  Synthetic
acaccacaccggcgctgtcgccccggcattgcgcgtccccgataacgccgcgtgcgcctgccgcgttcggcggct

SEQ ID NO: 156488 - DNA, 75 bp, Artificial Sequence
  Synthetic
gcattgcgcgtccccgataacgccgcgtgcgcctgccgcgttcggcggctccccgggcacgcccgcgacgagcgc

SEQ ID NO: 156489 - DNA, 75 bp, Artificial Sequence
  Synthetic
caaataaaaaccaaggcaaaacaataccagaagtcatgtgtattttgaacatcggtgtctttttatttatacaca

SEQ ID NO: 156490 - DNA, 75 bp, Artificial Sequence
  Synthetic
tcgcggcgatgagtcagtgggggcccagggcgatccttgtccagacggacagcaccaaccggaatgccgatgggg

SEQ ID NO: 156491 - DNA, 75 bp, Artificial Sequence
  Synthetic
cagggcgatccttgtccagacggacagcaccaaccggaatgccgatggggactggcaagcggccgtagctattcg

SEQ ID NO: 156492 - DNA, 75 bp, Artificial Sequence
  Synthetic
ggcgggggtcgggcgggggtcgggcgggggtcggggggggtcgggcgggggtcgggcgggggtcgggcactaacc

SEQ ID NO: 156493 - DNA, 75 bp, Artificial Sequence
  Synthetic
ttaccccggcagaatgcggggactccgaatgggccgtgggccgcgtctctctgggcctgcgaatggcaatgccgc

SEQ ID NO: 156494 - DNA, 75 bp, Artificial Sequence
  Synthetic
cccgcgcccacgcggtagaggaaggggacgggcgccacacccacggctgtggctgggcacgcgcctttggggttg

SEQ ID NO: 156495 - DNA, 75 bp, Artificial Sequence
  Synthetic
ccccgcggtatccggccccgggccccacgtgatgctcggtctcgtcgactcgggctaccgcggaaccgtcctggc

SEQ ID NO: 156496 - DNA, 75 bp, Artificial Sequence
  Synthetic
cgggctaccgcggaaccgtcctggccgtggtcgtagccccgaacgggacgcgcgggtttgcccccggggccctcc

SEQ ID NO: 156497 - DNA, 75 bp, Artificial Sequence
  Synthetic
ccgggccacccccccgaccctcaccgagccgagctccctgcaccggtttccgcagttggcgccgtccccgctggc

SEQ ID NO: 156498 - DNA, 75 bp, Artificial Sequence
  Synthetic
cgcagttggcgccgtccccgctggcagggttacgagaagatccttggttggacggggcgctcgcgaccgccgggg

SEQ ID NO: 156499 - DNA, 75 bp, Artificial Sequence
  Synthetic
agggttacgagaagatccttggttggacggggcgctcgcgaccgccgggggggcggtggccctgccggccagacg

SEQ ID NO: 156500 - DNA, 75 bp, Artificial Sequence
  Synthetic
aaggatacgggttggctcgcgggcggtgcggctgacctgcctgccctttctgggacccccgcctcgtgtttcttg

SEQ ID NO: 156501 - DNA, 75 bp, Artificial Sequence
  Synthetic
agcacggcgactgcgtgcacgaggcgcccgcctttctgccaaagcgcgaggaggacgcaggctttgacattctca

SEQ ID NO: 156502 - DNA, 75 bp, Artificial Sequence
  Synthetic
tccaccgagccgtgaccgtcccggccaacggcgccacggtcatacagccgtccctccgcgtattgcgcgcggccg

SEQ ID NO: 156503 - DNA, 75 bp, Artificial Sequence
  Synthetic
acggaccagaggcctgctatgtgctggggcggtcgtcgctcaatgccaggggcctcctggtcatgcctacgcgct

SEQ ID NO: 156504 - DNA, 75 bp, Artificial Sequence
  Synthetic
ggccctccgggcacgcctgtgcgtttgttgtatgtaacctgaccggagtcccggtgaccctacaagccgggtcca

SEQ ID NO: 156505 - DNA, 75 bp, Artificial Sequence
  Synthetic
ggccattgccggctccaacctctgcacggagatcgtccacccgtcctccaaacgctccagcggggtctgcaacct

SEQ ID NO: 156506 - DNA, 75 bp, Artificial Sequence
  Synthetic
cccgacaacatccacgaggacggcgcattccgggcctaccccagaggggttccggacgcgaccgccaccccccga

SEQ ID NO: 156507 - DNA, 75 bp, Artificial Sequence
  Synthetic
ctctctctctctccgccatcctcccgcccggccgcccactccccgctcggcctctccggctgcggtgcttgggtc

SEQ ID NO: 156508 - DNA, 75 bp, Artificial Sequence
  Synthetic
ccccggccccccggcccgtccccccggcccgtcccccccggcccgtccccccggcccgtccccccggcccgtccc

SEQ ID NO: 156509 - DNA, 75 bp, Artificial Sequence
  Synthetic
gatcaccagatacagcaaggcccggtccgggtccagtccgagccgctcgcacagcgcgtcccccgtcgtctcgtg

SEQ ID NO: 156510 - DNA, 75 bp, Artificial Sequence
  Synthetic
ttgttgtctgtctgcccggcactcggttgtccgttctgtcgtcgctatcacatacgcacaaacacacgggtagag

SEQ ID NO: 156511 - DNA, 75 bp, Artificial Sequence
  Synthetic
gttgtccgttctgtcgtcgctatcacatacgcacaaacacacgggtagagtggaaccgaaaccggtcgacgttta

SEQ ID NO: 156512 - DNA, 75 bp, Artificial Sequence
  Synthetic
cccggccccccgggtcaccgtacctgcgataaggctgcagtgggtggatgggtcctcgcggtacgtacagggtgg

SEQ ID NO: 156513 - DNA, 75 bp, Artificial Sequence
  Synthetic
acgaggcctggcgtttgggggcggacgtgcgatgacgtgggtccggtgtagggtccgcggggggcacgggcccgg

SEQ ID NO: 156514 - DNA, 75 bp, Artificial Sequence
  Synthetic
cgtgcgatgacgtgggtccggtgtagggtccgcggggggcacgggcccggggcgaacgggggatctgtcgccggc

SEQ ID NO: 156515 - DNA, 75 bp, Artificial Sequence
  Synthetic
cggggggggcctcggtcgctccgagccccgcggtgcgggtccctccggccagagccgaggtggagagaccaaggg

SEQ ID NO: 156516 - DNA, 75 bp, Artificial Sequence
  Synthetic
ccccgcggtgcgggtccctccggccagagccgaggtggagagaccaagggcccgctccgcgatcgccacgtcctc

SEQ ID NO: 156517 - DNA, 75 bp, Artificial Sequence
  Synthetic
cgtccgccgacttgtccgcggcccccaccgacatgtacatctgcaggatggtggccatgcacgtgtccgccaggc

SEQ ID NO: 156518 - DNA, 75 bp, Artificial Sequence
  Synthetic
caccgacatgtacatctgcaggatggtggccatgcacgtgtccgccaggcggcgcatcttgtcccgatgcgccgc

SEQ ID NO: 156519 - DNA, 75 bp, Artificial Sequence
  Synthetic
gcctctcgaggttgaccatgcaggcgtggtatgtgcgggccagggcgcgcgccttcacgaggcgccgggtgtcgt

SEQ ID NO: 156520 - DNA, 75 bp, Artificial Sequence
  Synthetic
gtggtatgtgcgggccagggcgcgcgccttcacgaggcgccgggtgtcgtccagcgactctagggcgtcgtcgag

SEQ ID NO: 156521 - DNA, 75 bp, Artificial Sequence
  Synthetic
gccgcggctccgcctccgagggcggagccgcggcccgaatcatctcatattgttgttcctcggggcgcgttcccc

SEQ ID NO: 156522 - DNA, 75 bp, Artificial Sequence
  Synthetic
agccgcggcccgaatcatctcatattgttgttcctcggggcgcgttccccaaccgcacagcaccccgagcaggga

SEQ ID NO: 156523 - DNA, 75 bp, Artificial Sequence
  Synthetic
ccccctccgggttcgcaggggcgatggggacggaagactgcgatcacgaagggcggtcggttgcggctcccgtgg

SEQ ID NO: 156524 - DNA, 75 bp, Artificial Sequence
  Synthetic
ggggacggaagactgcgatcacgaagggcggtcggttgcggctcccgtggaggttacggcgctgtatgcgaccga

SEQ ID NO: 156525 - DNA, 75 bp, Artificial Sequence
  Synthetic
gggccgagccgttgtatatattcagctacgacgcgtaccggcccgatgcgcccaatggccccacgggcgcgccca

SEQ ID NO: 156526 - DNA, 75 bp, Artificial Sequence
  Synthetic
ctacgacgcgtaccggcccgatgcgcccaatggccccacgggcgcgcccaccgaacaggagaggttcgaggggag

SEQ ID NO: 156527 - DNA, 75 bp, Artificial Sequence
  Synthetic
cgccaaccaccccccccccccccactgccgcccctgaagaagaagaagaagacccccccccccgcacaccccggt

SEQ ID NO: 156528 - DNA, 75 bp, Artificial Sequence
  Synthetic
tgaccttttgtttattggggacggaagtgggcgtgacccaccacccgaaagggcgcacccggcccatgtttgtgt

SEQ ID NO: 156529 - DNA, 75 bp, Artificial Sequence
  Synthetic
agtgggcgtgacccaccacccgaaagggcgcacccggcccatgtttgtgtgccgcttcgagcgagcggacgacgt

SEQ ID NO: 156530 - DNA, 75 bp, Artificial Sequence
  Synthetic
ggggacgggccggggggccgggacggggggccgggacggggggccgggacggggggacgggacggggggccggga

SEQ ID NO: 156531 - DNA, 75 bp, Artificial Sequence
  Synthetic
gcggggaaggaaggaaagaccccggaagcgccgggagggggcgccggcgcgacgcgggcggccgggcgggggcgc

SEQ ID NO: 156532 - DNA, 75 bp, Artificial Sequence
  Synthetic
acatcacagcaactctggacttggaggcgacgtttgcgctccacgctaacatcatcatggctctcaccgtggcca

SEQ ID NO: 156533 - DNA, 75 bp, Artificial Sequence
  Synthetic
ggcgacgtttgcgctccacgctaacatcatcatggctctcaccgtggccatcgtccacaacgcccccgcccgcat

SEQ ID NO: 156534 - DNA, 75 bp, Artificial Sequence
  Synthetic
cgggcgggggcgcgcggcggccgggcgggggcgcgcggcggccgggcgggggcgcgcggcggccgggcgggggcg

SEQ ID NO: 156535 - DNA, 75 bp, Artificial Sequence
  Synthetic
cggtcgtcgggcgcatgtccctggggcagcgcggcctcaccacgctgttcgtgcaccacgaggcgcgcgtgctgg

SEQ ID NO: 156536 - DNA, 75 bp, Artificial Sequence
  Synthetic
gcagcgcggcctcaccacgctgttcgtgcaccacgaggcgcgcgtgctggcggcgtaccgccgggcgtattatgg

SEQ ID NO: 156537 - DNA, 75 bp, Artificial Sequence
  Synthetic
agagcctggtgctggccgctaggtactacctactccaggctccgcgcttggggggcgccggagccacgtacgatc

SEQ ID NO: 156538 - DNA, 75 bp, Artificial Sequence
  Synthetic
gggggcgccggagccacgtacgatctgcaggccgtgaaagacatctgcgcgacctacgcgatcccccacgaccca

SEQ ID NO: 156539 - DNA, 75 bp, Artificial Sequence
  Synthetic
tcggttctgttgcacgagccagtactcccgcggggccgcggccgctgggtttccgctgtatgtggagcgccgcat

SEQ ID NO: 156540 - DNA, 75 bp, Artificial Sequence
  Synthetic
tcccgcggggccgcggccgctgggtttccgctgtatgtggagcgccgcatcgccgccgacgtacgcgagaccagc

SEQ ID NO: 156541 - DNA, 75 bp, Artificial Sequence
  Synthetic
ccgggaatttattacgtacatctacctggcccactttgagtgcttcagccccccgcgcctggccacgcatctccg

SEQ ID NO: 156542 - DNA, 75 bp, Artificial Sequence
  Synthetic
ctggcccactttgagtgcttcagccccccgcgcctggccacgcatctccgggccgtgaccacccacgaccccagc

SEQ ID NO: 156543 - DNA, 75 bp, Artificial Sequence
  Synthetic
acagttcttccggcacgtgcgcgcccagctgaacatccgcgagtacgtaaagcaaaacgtcacccccagggaaac

SEQ ID NO: 156544 - DNA, 75 bp, Artificial Sequence
  Synthetic
agcaaaacgtcacccccagggaaaccgccctggcggcagacgcggccgccgcctacctgcgcgcgcgcacgtatg

SEQ ID NO: 156545 - DNA, 75 bp, Artificial Sequence
  Synthetic
cgcgtactgcggggtcgcagactcgtccaccaaaatgatgggacgtctggcggaagcagaaaggctcctagtccc

SEQ ID NO: 156546 - DNA, 75 bp, Artificial Sequence
  Synthetic
tccaccaaaatgatgggacgtctggcggaagcagaaaggctcctagtcccccacggctggcccgcgttcgcacca

SEQ ID NO: 156547 - DNA, 75 bp, Artificial Sequence
  Synthetic
cggaatcgtcaagcgcctcctcaagctggccgccacggagcagcagggcacgacgcccccggcgatcgcggctct

SEQ ID NO: 156548 - DNA, 75 bp, Artificial Sequence
  Synthetic
ggcggcggcgcccgagcccggcgcgctcggccggcggctcacgcgccgcatttgcgcccggggccccgcgctccc

SEQ ID NO: 156549 - DNA, 75 bp, Artificial Sequence
  Synthetic
ctcggccggcggctcacgcgccgcatttgcgcccggggccccgcgctccccccgggcggcctggccgtcgggggc

SEQ ID NO: 156550 - DNA, 75 bp, Artificial Sequence
  Synthetic
gaacatcatcctggatctggacatcgccctgaaggagcccgtcccctttccccggctccacgaggccctgggtca

SEQ ID NO: 156551 - DNA, 75 bp, Artificial Sequence
  Synthetic
gccctgaaggagcccgtcccctttccccggctccacgaggccctgggtcactttaggcgcggggcgctggcggcg

SEQ ID NO: 156552 - DNA, 75 bp, Artificial Sequence
  Synthetic
agtgggaggaggacacggaccccatggacacgacccacggccccctcccggacgacgaggccgcgtacctcgacc

SEQ ID NO: 156553 - DNA, 75 bp, Artificial Sequence
  Synthetic
acgcagggaccatttgggagtctgcggttgggagcgcgccggggcgcggcacggctggagcgccggggcgcggcc

SEQ ID NO: 156554 - DNA, 75 bp, Artificial Sequence
  Synthetic
ggacacgacccacggccccctcccggacgacgaggccgcgtacctcgacctgctacacgaacagataccagcggc

SEQ ID NO: 156555 - DNA, 75 bp, Artificial Sequence
  Synthetic
ggctgcgcgtgtgcctaccggtccccgccccgtacgttgtgcacggctccctgacgatgcgtggggtggcgaggg

SEQ ID NO: 156556 - DNA, 75 bp, Artificial Sequence
  Synthetic
cgccccgtacgttgtgcacggctccctgacgatgcgtggggtggcgagggtgatccagcaggcggtgctgttgga

SEQ ID NO: 156557 - DNA, 75 bp, Artificial Sequence
  Synthetic
gggggggggcgcgaaggcgggcggcggcggcgggcgggcggcagggcggccccgcccgcccccttccccgcgccc

SEQ ID NO: 156558 - DNA, 75 bp, Artificial Sequence
  Synthetic
tcgatacgggcgtgtacgcccacggccacagcctgcgcttgccgtatttcgccaagatcggccccgacggctccg

SEQ ID NO: 156559 - DNA, 75 bp, Artificial Sequence
  Synthetic
gccaagatcggccccgacggctccgcgtgcggccggttattgcccgtcttcgtgatcccccccgcgtgcgaggac

SEQ ID NO: 156560 - DNA, 75 bp, Artificial Sequence
  Synthetic
ccgacccgcggcgcttccactttcacgccccgcccatgttttccgcggccccgcgggagatccgcgtcctccaca

SEQ ID NO: 156561 - DNA, 75 bp, Artificial Sequence
  Synthetic
cgccccgcccatgttttccgcggccccgcgggagatccgcgtcctccacagcctgggcggggactatgtcagctt

SEQ ID NO: 156562 - DNA, 75 bp, Artificial Sequence
  Synthetic
ccgccaccccctccctaccctcccctccatcccgccgagctcgcagcagcccctcccccccgcgcgccgcggggc

SEQ ID NO: 156563 - DNA, 75 bp, Artificial Sequence
  Synthetic
agaccctgacggaggttctgggccgctacgatgtgcggcccgacgccggggagaccgtggaggggttcgcgtcag

SEQ ID NO: 156564 - DNA, 75 bp, Artificial Sequence
  Synthetic
ctacgatgtgcggcccgacgccggggagaccgtggaggggttcgcgtcagaactgctggggcgaatagtcgcgtg

SEQ ID NO: 156565 - DNA, 75 bp, Artificial Sequence
  Synthetic
ttcgccgggccgtcattaaggacgactgggtcctgctgcagctgatccccggccgcggcgccctgaaccaaagcc

SEQ ID NO: 156566 - DNA, 75 bp, Artificial Sequence
  Synthetic
ctgggtcctgctgcagctgatccccggccgcggcgccctgaaccaaagcctctcgtgtctgcgcttcaagcacgg

SEQ ID NO: 156567 - DNA, 75 bp, Artificial Sequence
  Synthetic
ccaacaaccgcctatgcgcgtccctgtgtcagcagtgctttgccactaaatgcgataacaaccgcctgcacacgc

SEQ ID NO: 156568 - DNA, 75 bp, Artificial Sequence
  Synthetic
gtgtcagcagtgctttgccactaaatgcgataacaaccgcctgcacacgctgtttaccgtcgatgcgggcacgcc

SEQ ID NO: 156569 - DNA, 75 bp, Artificial Sequence
  Synthetic
ggcctacggcctcgtgctcgcgtggtacatcgtctttggtgccagtccgctccaccgatgtatttacgcggtgcg

SEQ ID NO: 156570 - DNA, 75 bp, Artificial Sequence
  Synthetic
tacatcgtctttggtgccagtccgctccaccgatgtatttacgcggtgcgccccgccggggcacacaacgatacc

SEQ ID NO: 156571 - DNA, 75 bp, Artificial Sequence
  Synthetic
gaccgccccccccggcggggcatggaccccccacgcccgcgtctgctacgccaatatcatcgaaggtcgggccgt

SEQ ID NO: 156572 - DNA, 75 bp, Artificial Sequence
  Synthetic
accccccacgcccgcgtctgctacgccaatatcatcgaaggtcgggccgtgtccctcccggccatccccggcgcc

SEQ ID NO: 156573 - DNA, 75 bp, Artificial Sequence
  Synthetic
cctctgggacacccagatgcgcctggtggtcgtcggttggtttctgtatctagcgttcgtcgcccttcaccaacg

SEQ ID NO: 156574 - DNA, 75 bp, Artificial Sequence
  Synthetic
gtggtcgtcggttggtttctgtatctagcgttcgtcgcccttcaccaacgacgatgcatgttcggcgtcgtgagt

SEQ ID NO: 156575 - DNA, 75 bp, Artificial Sequence
  Synthetic
ccgcatagtgtcgagcgtgttcttgcaatacccctacacgaaaatcacccgcctcctctgcgagctatccgttca

SEQ ID NO: 156576 - DNA, 75 bp, Artificial Sequence
  Synthetic
caatacccctacacgaaaatcacccgcctcctctgcgagctatccgttcaacgccagaccctggtgcagctgttc

SEQ ID NO: 156577 - DNA, 75 bp, Artificial Sequence
  Synthetic
cttgtgtggtttattcgggggtcgggcgggggtcgggcgggggtcgggcgggggcgggcgggggtcgggcgggcg

SEQ ID NO: 156578 - DNA, 75 bp, Artificial Sequence
  Synthetic
cgtgggctgcgagctgctgctccgcttcgtggccctcggtctcatcgtcggcaccgctctcatctcccggggcgc

SEQ ID NO: 156579 - DNA, 75 bp, Artificial Sequence
  Synthetic
gtggcccgagcccccccgcaggagcgggagggaaggcacggggcgcgggagggaggggctgctgcgagctcgggg

SEQ ID NO: 156580 - DNA, 75 bp, Artificial Sequence
  Synthetic
gcaccgctctcatctcccggggcgcctgcgcgatcacacaccccctgtttctaacaatcaccacctggtgtttcg

SEQ ID NO: 156581 - DNA, 75 bp, Artificial Sequence
  Synthetic
gtatttcatcctgcggcggggctcggcccccaaaaacgcggaaccagcggcccccagggggcgctccaaagggtg

SEQ ID NO: 156582 - DNA, 75 bp, Artificial Sequence
  Synthetic
ggggaggcggccggttccgggggcgggccgcgggaaagcagccccgcggcgcgcggggggaggggctgctgcgag

SEQ ID NO: 156583 - DNA, 75 bp, Artificial Sequence
  Synthetic
tgcgcctgtgctatatcgccgtcgtggccggggtggtgcttgtggcgcttcgctacgaacaggagattcagcggc

SEQ ID NO: 156584 - DNA, 75 bp, Artificial Sequence
  Synthetic
ttccgcacccccgcctacgcgtgtacgcgaaggcggacccagacctgccgtatgctaattaaatacataaaaccc

SEQ ID NO: 156585 - DNA, 75 bp, Artificial Sequence
  Synthetic
gggacggcgggggcgggggcggtgacgcccgacggggagggacaaggaggagtttcggaaagccggccccggtcg

SEQ ID NO: 156586 - DNA, 75 bp, Artificial Sequence
  Synthetic
gagggccggggaagggggcgggcgcggctgtcctgccgcccgcccgccgccgccgcccgccttcgcgcccccccc

SEQ ID NO: 156587 - DNA, 75 bp, Artificial Sequence
  Synthetic
agtttcggaaagccggccccggtcgtgcgggtataagggcagccaccggcccactgggcgctgtgtgctgccgtg

SEQ ID NO: 156588 - DNA, 75 bp, Artificial Sequence
  Synthetic
tgcgggtataagggcagccaccggcccactgggcgctgtgtgctgccgtgtgccgaccccggttgcgcgtcggtg

SEQ ID NO: 156589 - DNA, 75 bp, Artificial Sequence
  Synthetic
cgccgcccgccttcgcgccccccccaaaaaacacccccccgggggttcacgccccgggggaaaagaggcggggcg

SEQ ID NO: 156590 - DNA, 75 bp, Artificial Sequence
  Synthetic
gaggacacccgccatcccagccccggcgacctacaacatggctaccgacattgatatgctaatcgacctaggatt

SEQ ID NO: 156591 - DNA, 75 bp, Artificial Sequence
  Synthetic
gcgacctacaacatggctaccgacattgatatgctaatcgacctaggattggacctgtccgacagcgagctcgag

SEQ ID NO: 156592 - DNA, 75 bp, Artificial Sequence
  Synthetic
cggggggccgggacggggggccgggacggggggacgggacggggggccgggacggggggccgggacggggggcgg

SEQ ID NO: 156593 - DNA, 75 bp, Artificial Sequence
  Synthetic
cgacagcagcggggagtgttcctcgtcggacgaggacatggaagacccctgcggagacggaggggcggaggccat

SEQ ID NO: 156594 - DNA, 75 bp, Artificial Sequence
  Synthetic
tcggacgaggacatggaagacccctgcggagacggaggggcggaggccatcgacgcggcgattcccaaaggtccc

SEQ ID NO: 156595 - DNA, 75 bp, Artificial Sequence
  Synthetic
ggcagcgcggcggggagccgacgatccgccacccgcgaccaccggcgtgtggtcgcgcctcgggaccaggcggtc

SEQ ID NO: 156596 - DNA, 75 bp, Artificial Sequence
  Synthetic
ccgccacccgcgaccaccggcgtgtggtcgcgcctcgggaccaggcggtcggcttccccccgggaaccgcacggg

SEQ ID NO: 156597 - DNA, 75 bp, Artificial Sequence
  Synthetic
aggcgggcggcgaggtcgccgccggggccggggtcgatacggccccggcggcgccgactccacaccaaacccccg

SEQ ID NO: 156598 - DNA, 75 bp, Artificial Sequence
  Synthetic
aaccaagggggtcgccaccccgcgtcggcgcggacggacggccccggcgccacccacggcgaggcgcggcgcgga

SEQ ID NO: 156599 - DNA, 75 bp, Artificial Sequence
  Synthetic
cacccacggcgaggcgcggcgcggaggggagcagctcgacgtctccgggggcccgcggccacgaggcacgcgcca

SEQ ID NO: 156600 - DNA, 75 bp, Artificial Sequence
  Synthetic
ggggagcagctcgacgtctccgggggcccgcggccacgaggcacgcgccaggccccccctccgctgatggcgctg

SEQ ID NO: 156601 - DNA, 75 bp, Artificial Sequence
  Synthetic
cggccggcgcggaggcgggcgcggcgctcaggcgccccagggcggcgagcacccccgcggcgccgtagccggcgg

SEQ ID NO: 156602 - DNA, 75 bp, Artificial Sequence
  Synthetic
ggcgccctctgccgacaccatcgaccccgccgttcgggcggttctgcgatccatatccgagcgcgcggcggtcga

SEQ ID NO: 156603 - DNA, 75 bp, Artificial Sequence
  Synthetic
cccgccgttcgggcggttctgcgatccatatccgagcgcgcggcggtcgagcgcatcagcgaaagctttggacgc

SEQ ID NO: 156604 - DNA, 75 bp, Artificial Sequence
  Synthetic
gaacagcccctgggctcccgtgctggccacccaagcgggggggtttgacgccgagacccgtcgggtttcctggga

SEQ ID NO: 156605 - DNA, 75 bp, Artificial Sequence
  Synthetic
aaaccggcgccccgggtgccatggacacatcccccgccgctagcgttcccgcgccgcaggtcgccgtccgtgcgc

SEQ ID NO: 156606 - DNA, 75 bp, Artificial Sequence
  Synthetic
gccacccaagcgggggggtttgacgccgagacccgtcgggtttcctgggaaaccctggtcgctcacggcccgagc

SEQ ID NO: 156607 - DNA, 75 bp, Artificial Sequence
  Synthetic
catgcgcgactgcgtgctgcgccaggaaaatctcatcgaggccctggcgtccgcggatgagacgctggcgtggtg

SEQ ID NO: 156608 - DNA, 75 bp, Artificial Sequence
  Synthetic
gaaaatctcatcgaggccctggcgtccgcggatgagacgctggcgtggtgcaagatgtgcattcaccacaatctg

SEQ ID NO: 156609 - DNA, 75 bp, Artificial Sequence
  Synthetic
aaacctcgccacgcgcctgcgcccctttctgcagtgctacctgaaggcccgaggcctgtgcgggctggacgacct

SEQ ID NO: 156610 - DNA, 75 bp, Artificial Sequence
  Synthetic
tttctgcagtgctacctgaaggcccgaggcctgtgcgggctggacgacctgtgctcgcggcgacgcctgtcggac

SEQ ID NO: 156611 - DNA, 75 bp, Artificial Sequence
  Synthetic
ccgcgtcgagcgcggcgtgtcggagatcgactacacgaccgtgggggttggggccggcgagacgatgcactttta

SEQ ID NO: 156612 - DNA, 75 bp, Artificial Sequence
  Synthetic
aataaaaggcacgagttccccgaataccaccggcgtgtgatgatttcgccctaccgctccgatccccggggggag

SEQ ID NO: 156613 - DNA, 75 bp, Artificial Sequence
  Synthetic
atcgactacacgaccgtgggggttggggccggcgagacgatgcacttttacatcccgggggcctgcatggcgggt

SEQ ID NO: 156614 - DNA, 75 bp, Artificial Sequence
  Synthetic
cgagctgacggccagtcacactatcgcccccttatatgtgcacggcaaatacttctactgcaactccctatttta

SEQ ID NO: 156615 - DNA, 75 bp, Artificial Sequence
  Synthetic
gcccccttatatgtgcacggcaaatacttctactgcaactccctattttaggcaagaataaacatattgacgtca

SEQ ID NO: 156616 - DNA, 75 bp, Artificial Sequence
  Synthetic
agactccggggcgatgccggcgtgcgcgtgggaggagggcgatgacccaccggataaatgtggggccccggcccg

SEQ ID NO: 156617 - DNA, 75 bp, Artificial Sequence
  Synthetic
gcgtgggaggagggcgatgacccaccggataaatgtggggccccggcccggcccgcttcatagcgcgtccaggaa

SEQ ID NO: 156618 - DNA, 75 bp, Artificial Sequence
  Synthetic
acgcccctctcgaacctgtttttacgggccccggacatcacccacgtcgcccccccgtactgtctgaatgccacg

SEQ ID NO: 156619 - DNA, 75 bp, Artificial Sequence
  Synthetic
gggccccggacatcacccacgtcgcccccccgtactgtctgaatgccacgtggcaggccgaaaacgccctgcaca

SEQ ID NO: 156620 - DNA, 75 bp, Artificial Sequence
  Synthetic
gcctcctgctcgaccagcggccccatccactgttttttctttgcggtgtacaaggactcgcagcactcccttccg

SEQ ID NO: 156621 - DNA, 75 bp, Artificial Sequence
  Synthetic
tccactgttttttctttgcggtgtacaaggactcgcagcactcccttccgctggttaccgagctccgcaacttcg

SEQ ID NO: 156622 - DNA, 75 bp, Artificial Sequence
  Synthetic
ggggggcggctgcggtgcacgggcccattcagctgcggaaccatcaaggacgtctccggtgcatcccccgcgggg

SEQ ID NO: 156623 - DNA, 75 bp, Artificial Sequence
  Synthetic
cattcagctgcggaaccatcaaggacgtctccggtgcatcccccgcgggggaatacacgataaacggtatcgtgt

SEQ ID NO: 156624 - DNA, 75 bp, Artificial Sequence
  Synthetic
tccgcggccctacaacaccttcgctctataagctcaagcggcacggccgctcgcgcggcagaacagcgacgccac

SEQ ID NO: 156625 - DNA, 75 bp, Artificial Sequence
  Synthetic
ctataagctcaagcggcacggccgctcgcgcggcagaacagcgacgccacaaaatcaaaatcaaaatcaaggtat

SEQ ID NO: 156626 - DNA, 75 bp, Artificial Sequence
  Synthetic
gagaaccaaccaaaacagacgcggtgtgagtttgtgggttataggaacccggtaaataccacgcgacgaaccagc

SEQ ID NO: 156627 - DNA, 75 bp, Artificial Sequence
  Synthetic
gtgagtttgtgggttataggaacccggtaaataccacgcgacgaaccagcatgtgtgttaacgcgacttttattc

SEQ ID NO: 156628 - DNA, 75 bp, Artificial Sequence
  Synthetic
taacgacgaccaccgcgaccaccccaaaaaccgcatgacgacacgtcccgccacaccaccctggggcttggggcg

SEQ ID NO: 156629 - DNA, 75 bp, Artificial Sequence
  Synthetic
aaaaaccgcatgacgacacgtcccgccacaccaccctggggcttggggcgtgtcggagctcgacgcacagcgggc

SEQ ID NO: 156630 - DNA, 75 bp, Artificial Sequence
  Synthetic
acgtgcgcgagctttgcacgcggggttggtcggccggccccacggacccgcccggtggctcggtcggacatgcgg

SEQ ID NO: 156631 - DNA, 75 bp, Artificial Sequence
  Synthetic
ttggtcggccggccccacggacccgcccggtggctcggtcggacatgcggccatgaccatggcgtaggtgggggg

SEQ ID NO: 156632 - DNA, 75 bp, Artificial Sequence
  Synthetic
ctcccacgccagggtgggccccaatcatagtttccggtagaaacaggggggtctccacaaacaacccccctgggc

SEQ ID NO: 156633 - DNA, 75 bp, Artificial Sequence
  Synthetic
catagtttccggtagaaacaggggggtctccacaaacaacccccctgggccaaagctccggcgccgcgcccgtcg

SEQ ID NO: 156634 - DNA, 75 bp, Artificial Sequence
  Synthetic
agcggccacgctcacacacctcgccgtcaccggaagaagccggtgaaacaagcccaaccggcgacgtccctgcag

SEQ ID NO: 156635 - DNA, 75 bp, Artificial Sequence
  Synthetic
gaccgcggtagtgtacctcacccacgcctcctcggtgcgctatcgtcggctgcggtaactccggggccgggcccg

SEQ ID NO: 156636 - DNA, 75 bp, Artificial Sequence
  Synthetic
gtcaccggaagaagccggtgaaacaagcccaaccggcgacgtccctgcagagtacggtggaggcgagtccgtggg

SEQ ID NO: 156637 - DNA, 75 bp, Artificial Sequence
  Synthetic
cgggcgggggtcgggcactaaccgggggttcccgtctctgtctccctctgcagcggactacgtcccgcccgcccc

SEQ ID NO: 156638 - DNA, 75 bp, Artificial Sequence
  Synthetic
gccccccgtcccgtccccccgtcccggccccccgtcccggccccccgtcccgccccccgtcccggccccccgtcc

SEQ ID NO: 156639 - DNA, 75 bp, Artificial Sequence
  Synthetic
tctcgtatgggggcggggcgtcaatcacgctatcatctccgtcatccctgcatgcgtgggcatgcccagccccca

SEQ ID NO: 156640 - DNA, 75 bp, Artificial Sequence
  Synthetic
cacgctatcatctccgtcatccctgcatgcgtgggcatgcccagcccccaacgccatggtggggattcgcggctc

SEQ ID NO: 156641 - DNA, 75 bp, Artificial Sequence
  Synthetic
gcgcccccgcccggccgccgcgcgcccccgcccggccgccgcgcgcccccgcccggccgccgcgcgcccccgccc

SEQ ID NO: 156642 - DNA, 75 bp, Artificial Sequence
  Synthetic
gcccgcgtcgcgccggcgccccctcccggcgcttccggggcctttccttccttccccgccgcgaccccggccccg

SEQ ID NO: 156643 - DNA, 75 bp, Artificial Sequence
  Synthetic
gacgaacacacggtggcgatcttttctttacttcggcagaccagcgagccccggccccggcccgcgccccgccgc

SEQ ID NO: 156644 - DNA, 75 bp, Artificial Sequence
  Synthetic
ggcaggtcccggtcccggacccggacccgatcccggtcgcccgggagaacgccgaggggtgcgccggaccagggc

SEQ ID NO: 156645 - DNA, 75 bp, Artificial Sequence
  Synthetic
cgcccaccccggggtccacacaggagcgcgcgggcggcagaaacgcgggcgcggcggcggtcggggtgggagtgg

SEQ ID NO: 156646 - DNA, 75 bp, Artificial Sequence
  Synthetic
gcggcggcggtcggggtgggagtggtggtgggggacacgaaaacacacccacgacactctccccccaccccgacc

SEQ ID NO: 156647 - DNA, 75 bp, Artificial Sequence
  Synthetic
cccgcgcccgcagcctccggcagcacgccgaccaccgccgccaccccccaaacagccaaggcgcggtggggggcg

SEQ ID NO: 156648 - DNA, 75 bp, Artificial Sequence
  Synthetic
tggtggtgaacgatgggggaaacacgggggggaggggtccggggcgaggcgggcgggcgaaggaaggggggggtg

SEQ ID NO: 156649 - DNA, 75 bp, Artificial Sequence
  Synthetic
cctcctcctcctccgcctcttcctctgcgggcggggctggtgggagcgtcgcgtccgcgtccggcgctggggaga

SEQ ID NO: 156650 - DNA, 75 bp, Artificial Sequence
  Synthetic
gggggtggtggtgctggtggtggaaagacatgatagagggaacaaagaaatagaagaaaaccacaaccggcgcgt

SEQ ID NO: 156651 - DNA, 75 bp, Artificial Sequence
  Synthetic
gcggcggcggtggaaagcggaaaaacggaggatggaagggcagaagatggggagtcccgatcctcctcctgcatc

SEQ ID NO: 156652 - DNA, 75 bp, Artificial Sequence
  Synthetic
cccgacgaaggagacccaagcaccgcagccggagaggccgagcggggagtgggcggccgggcgggaggatggcgg

SEQ ID NO: 156653 - DNA, 75 bp, Artificial Sequence
  Synthetic
ccgtcccggccccccgtcccggccccccgtcccgtccccccgtcccggccccccgtcccggccccccgtcccggc

SEQ ID NO: 156654 - DNA, 75 bp, Artificial Sequence
  Synthetic
cgcggccgcagccgagcagcgccgcgggctccggggccgggccgggccggcaacgccccgcgccggccgcggcgg

SEQ ID NO: 156655 - DNA, 75 bp, Artificial Sequence
  Synthetic
caacgccccgcgccggccgcggcggagagaacccctgtgtcattgtttacgtggccgcgggccagcagacgggcc

SEQ ID NO: 156656 - DNA, 75 bp, Artificial Sequence
  Synthetic
cgccgtgcccggagatccattaagccgccggagagcccgagccccgcccgcgtgttgctgtgggcatttctgctg

SEQ ID NO: 156657 - DNA, 75 bp, Artificial Sequence
  Synthetic
cgccggagagcccgagccccgcccgcgtgttgctgtgggcatttctgctgcgtcatccctgtctttataaaaccg

SEQ ID NO: 156658 - DNA, 75 bp, Artificial Sequence
  Synthetic
ccggagaaggaaggctgctccgcgcaccggcgcgcccttctcctctcccctccctacctccccctctcttccccc

SEQ ID NO: 156659 - DNA, 75 bp, Artificial Sequence
  Synthetic
gcctcggggacccccgggcgggccggggcttggccgccgaggtgcgccccggccggaggggcccccgcacctcgg

SEQ ID NO: 156660 - DNA, 75 bp, Artificial Sequence
  Synthetic
gggcttggccgccgaggtgcgccccggccggaggggcccccgcacctcggcggccgccccctccggcgccgcgcg

SEQ ID NO: 156661 - DNA, 75 bp, Artificial Sequence
  Synthetic
ggccggaggggcccccgcacctcggcggccgccccctccggcgccgcgcgttcgcgaaaggcgcgaaaggggccc

SEQ ID NO: 156662 - DNA, 75 bp, Artificial Sequence
  Synthetic
gcgcctgcgtgtgtctcgtgtgagagagcgcgcccctcgaacgccgcgcgttctcgcaggtaggtttagggtcgt

SEQ ID NO: 156663 - DNA, 75 bp, Artificial Sequence
  Synthetic
aaacacgaggcgggggtcccagaaagggcaggcaggtcagccgcaccgcccgcgagccaacccgtatcctttttt

SEQ ID NO: 156664 - DNA, 75 bp, Artificial Sequence
  Synthetic
caaccccaaaggcgcgtgcccagccacagccgtgggtgcggcgcccgtccccttcctctaccgcgtgggcgcggg

SEQ ID NO: 156665 - DNA, 75 bp, Artificial Sequence
  Synthetic
ggggccgctagggaaaggtaggcacgcgcgcggtgtgtcgacttgcatgccccgcaaaacgcgtcgtgtcgtgtt

SEQ ID NO: 156666 - DNA, 75 bp, Artificial Sequence
  Synthetic
gtgtggtgttgcgaacgcgcgagccccctcgccccgatgggagtctccccgcagccagggtaaggaggggcgggc

SEQ ID NO: 156667 - DNA, 75 bp, Artificial Sequence
  Synthetic
tggggtgagtgcggttgcatgcctcgggtctcctcttcctgctcctcctcctttctcccagccagggtgaggagg

SEQ ID NO: 156668 - DNA, 75 bp, Artificial Sequence
  Synthetic
ggcggggtgggcgccggggcgggggtgggcacgggcgtaagtgcgggtgcatgcctcgggtcttctcttctccct

SEQ ID NO: 156669 - DNA, 75 bp, Artificial Sequence
  Synthetic
gggatcggggtcccggccccccggcccggccccccggccccccggcccggccccccgccccccggcccgtccccc

SEQ ID NO: 156670 - DNA, 75 bp, Artificial Sequence
  Synthetic
gggcagagggcgtgcatgcgttgtgattcaaccgccctcgcccccgccccactttcccccctctctatcaaagtt

SEQ ID NO: 156671 - DNA, 75 bp, Artificial Sequence
  Synthetic
gccggccagacgtgcgtgctctgcacgatcgggcccccctccctgtcaacacggacacactctttttttacccgc

SEQ ID NO: 156672 - DNA, 75 bp, Artificial Sequence
  Synthetic
gcccccctgcgcgggggagctgcatcaaaggccaacaacaaagtgtgtcaaaagcatcacaaaactttattgtaa

SEQ ID NO: 156673 - DNA, 75 bp, Artificial Sequence
  Synthetic
tttcctcaagttttcaacaaggccagaaagtccataacaaaatgctggtgtgtgttgctgttcggggccgtgtcc

SEQ ID NO: 156674 - DNA, 75 bp, Artificial Sequence
  Synthetic
cccccccacctccccctgcccccgaggcgcctcggccggtggtccggtggggggcggcttcccttcgggcagcaa

SEQ ID NO: 156675 - DNA, 75 bp, Artificial Sequence
  Synthetic
cggcgacgaggagtgggaggaggacacggaccccatggacacgacccacggccccctcccggacgacgaggccgc

SEQ ID NO: 156676 - DNA, 75 bp, Artificial Sequence
  Synthetic
gccgagtgttagctccccctactccccgtggcccgcgggggcgtcgccggccggcgcgggcgcgccctgctcccg

SEQ ID NO: 156677 - DNA, 75 bp, Artificial Sequence
  Synthetic
ccgtggcccgcgggggcgtcgccggccggcgcgggcgcgccctgctcccgagaccacgggtggcgcgaccggagg

SEQ ID NO: 156678 - DNA, 75 bp, Artificial Sequence
  Synthetic
gcccaccggggtcatccagaggctgttccactccgacgcggggggcgtcgggtagtcggggggcctcacgcagtt

SEQ ID NO: 156679 - DNA, 75 bp, Artificial Sequence
  Synthetic
cgcgcgagaacgcggcgctgaccggggcgcgaacccccgacgacggcggcgacgccaaccgccgcgacggcgacg

SEQ ID NO: 156680 - DNA, 75 bp, Artificial Sequence
  Synthetic
ttccactccgacgcggggggcgtcgggtagtcggggggcctcacgcagttgcgcgcgtgctcggggagcagggtg

SEQ ID NO: 156681 - DNA, 75 bp, Artificial Sequence
  Synthetic
cgtctggtccacgaggaccacgtaggcccctatgtggcccgtctccatgtccaggacgggcaggcagtcccccgt

SEQ ID NO: 156682 - DNA, 75 bp, Artificial Sequence
  Synthetic
gcccctatgtggcccgtctccatgtccaggacgggcaggcagtcccccgtgaccgtcttgttcacgtaaggcgcc

SEQ ID NO: 156683 - DNA, 75 bp, Artificial Sequence
  Synthetic
gggcgccgggtcgcgggccccgggctcggggccgccctccgcgtggcgcgtcttcctggcacacttcctcggccc

SEQ ID NO: 156684 - DNA, 75 bp, Artificial Sequence
  Synthetic
cgccggacgcggacgcgacgctcccaccagccccgcccgcagaggaagaggcggaggaggaggaggcggaggagg

SEQ ID NO: 156685 - DNA, 75 bp, Artificial Sequence
  Synthetic
gcggcggcggcgaccgcggcctgggacgacggagacgccgacgggggcgcggcgcccgcggacgccggggcgagc

SEQ ID NO: 156686 - DNA, 75 bp, Artificial Sequence
  Synthetic
cgcagggcccgagtccgacccgcgcctcttccgggggcgggccgccgccccctccgcggcgtggggggcggcacc

SEQ ID NO: 156687 - DNA, 75 bp, Artificial Sequence
  Synthetic
ctcttccgggggcgggccgccgccccctccgcggcgtggggggcggcaccgggggtgttggtgccgcgggggacc

SEQ ID NO: 156688 - DNA, 75 bp, Artificial Sequence
  Synthetic
gcctgcccggcccagactctgtgcttgggtgtcggtctgagcctgggtcatgcgcgaccggggcgcgcggtgcgc

SEQ ID NO: 156689 - DNA, 75 bp, Artificial Sequence
  Synthetic
tgggtgtcggtctgagcctgggtcatgcgcgaccggggcgcgcggtgcgcgtccaccggcacggcgggcggcgcg

SEQ ID NO: 156690 - DNA, 75 bp, Artificial Sequence
  Synthetic
gggcggactccggacgcgcggggcgacggccgcgcgggggcgcgccgcgcgccccgacgactgtggcagacctcc

SEQ ID NO: 156691 - DNA, 75 bp, Artificial Sequence
  Synthetic
gcggcccggggcccgcggggcggcgcggagacggcgggggagagtcgctgatgactatggggggctcctgggccg

SEQ ID NO: 156692 - DNA, 75 bp, Artificial Sequence
  Synthetic
cggagacggcgggggagagtcgctgatgactatggggggctcctgggccgcgcggggctgtctcgcggggggcgt

SEQ ID NO: 156693 - DNA, 75 bp, Artificial Sequence
  Synthetic
atgactatggggggctcctgggccgcgcggggctgtctcgcggggggcgtcctgccctccgccgccgcggcgtct

SEQ ID NO: 156694 - DNA, 75 bp, Artificial Sequence
  Synthetic
agaggccactctcggcacgacggccgcgacggcagggccgcccccagacccagatcccacccccgcccgcaacgg

SEQ ID NO: 156695 - DNA, 75 bp, Artificial Sequence
  Synthetic
gcgacggcagggccgcccccagacccagatcccacccccgcccgcaacggggcgccgccgctgctgctgctccgc

SEQ ID NO: 156696 - DNA, 75 bp, Artificial Sequence
  Synthetic
ggtcgcccccgcaccgccgcccccgcgccggggcgctcttcggggggcgggcgggacgtagtccactgcagaggg

SEQ ID NO: 156697 - DNA, 75 bp, Artificial Sequence
  Synthetic
ccgacccccgcccgccctcaccgtcggccaggtcatcgtcctcgtcgtccgtgccgggccacgggggggtgggcg

SEQ ID NO: 156698 - DNA, 75 bp, Artificial Sequence
  Synthetic
ggccaggtcatcgtcctcgtcgtccgtgccgggccacgggggggtgggcgacagggcgcggaccgtgtgtccccc

SEQ ID NO: 156699 - DNA, 75 bp, Artificial Sequence
  Synthetic
ccacggccgtgccggaccgcacggccgcctcggcctccacgcgggtccgggggtcgttcactatcgggatggtgc

SEQ ID NO: 156700 - DNA, 75 bp, Artificial Sequence
  Synthetic
cgcctcggcctccacgcgggtccgggggtcgttcactatcgggatggtgctgaacgacccgctggcggtcacgcc

SEQ ID NO: 156701 - DNA, 75 bp, Artificial Sequence
  Synthetic
acggaatccaggtcttcatgcacgggatgcagaaggggtgcaggcagggaaaactctggcagcgcaggggcgggg

SEQ ID NO: 156702 - DNA, 75 bp, Artificial Sequence
  Synthetic
gatgcagaaggggtgcaggcagggaaaactctggcagcgcaggggcggggcgatctcgtccgtgcacacggcgca

SEQ ID NO: 156703 - DNA, 75 bp, Artificial Sequence
  Synthetic
ccccgcaggatccctgcgcgtcggcgggcgtggggctgccctggcgctcggccgggggccgggccgggggcgtgg

SEQ ID NO: 156704 - DNA, 75 bp, Artificial Sequence
  Synthetic
gggcgtggggctgccctggcgctcggccgggggccgggccgggggcgtggccgcgtccatcaggcccgcctcgaa

SEQ ID NO: 156705 - DNA, 75 bp, Artificial Sequence
  Synthetic
cggtcgccgccgcctcctcctcctcctcctcctcctcctcctgcctcttcctctgcgcctcttcctctgcgcctc

SEQ ID NO: 156706 - DNA, 75 bp, Artificial Sequence
  Synthetic
cgtcgtcagagattcccacctcggtctcctcctccgagtcgctgctggcgagccactgcatgtcgttgagcatcc

SEQ ID NO: 156707 - DNA, 75 bp, Artificial Sequence
  Synthetic
gtccctccctcaccccggccccccgcccgctgctttttgttcggaagggggggagaaaggggtccgtaaccaaag

SEQ ID NO: 156708 - DNA, 75 bp, Artificial Sequence
  Synthetic
gggcggcgcacggcccacgggggtcccccgaccgcttaagcgggccgggggtcggccccgtcaagcgtccccgcc

SEQ ID NO: 156709 - DNA, 75 bp, Artificial Sequence
  Synthetic
ccccgaccgcttaagcgggccgggggtcggccccgtcaagcgtccccgcccccgagcccaccgcccgcgaccacc

SEQ ID NO: 156710 - DNA, 75 bp, Artificial Sequence
  Synthetic
ggggggcggggacagggggtgtgtgggtaaaagcaacgtcggaaaatcaaacccaatgccccaaacaggaaaaaa

SEQ ID NO: 156711 - DNA, 75 bp, Artificial Sequence
  Synthetic
gggtcgccctctcaccgtgccgggggtctgccgcggcggccgctcggggccggggtccgcccgggagctcgtgcc

SEQ ID NO: 156712 - DNA, 75 bp, Artificial Sequence
  Synthetic
ggccgcgcgggggcgggcgcgggaacgcagccccgcggcgcgcgggggggaggggctgctgcgagctcggcggga

SEQ ID NO: 156713 - DNA, 75 bp, Artificial Sequence
  Synthetic
cgcagtgccggggtgcgaatgcggcccgaccgtcacacggggctgccttatacccggcgcctatccactccccca

SEQ ID NO: 156714 - DNA, 75 bp, Artificial Sequence
  Synthetic
ccgaccgtcacacggggctgccttatacccggcgcctatccactcccccaaaggggcggcatttacgattccccc

SEQ ID NO: 156715 - DNA, 75 bp, Artificial Sequence
  Synthetic
gggcggccccgtccccggggaccaaccgggtgtactccaagaaccccattagcatgcgccgccccccgccgacgc

SEQ ID NO: 156716 - DNA, 75 bp, Artificial Sequence
  Synthetic
ccgggtgtactccaagaaccccattagcatgcgccgccccccgccgacgcagatgggagtccccccggcgccccg

SEQ ID NO: 156717 - DNA, 75 bp, Artificial Sequence
  Synthetic
actaggaagcccaggggaccaataggggccgatcagcccacccacccggcggcgcgcgaggctctgcgtgttctg

SEQ ID NO: 156718 - DNA, 75 bp, Artificial Sequence
  Synthetic
ccaagaaagtaatcagcataacccggaaccccgagggagtaattacgcggggagcgaggggccgtccgaacgttt

SEQ ID NO: 156719 - DNA, 75 bp, Artificial Sequence
  Synthetic
cgagcgggaacgccggcccattaaaagttgctaattaccatgagcggggatggcggccgggaccgcctattaaaa

SEQ ID NO: 156720 - DNA, 75 bp, Artificial Sequence
  Synthetic
agttgctaattaccatgagcggggatggcggccgggaccgcctattaaaagtttctaattaccataccgggaagc

SEQ ID NO: 156721 - DNA, 75 bp, Artificial Sequence
  Synthetic
ccccgcccgcggacgcgccgcgcgggaaggtacgcctcccctccgaccctccgaccctccgaccctccgaccctc

SEQ ID NO: 156722 - DNA, 75 bp, Artificial Sequence
  Synthetic
ggttggccggcgccgccccctggggcgggcggagcggcggggcggcgccgggccctcgcggatatatacgcgggg

SEQ ID NO: 156723 - DNA, 75 bp, Artificial Sequence
  Synthetic
cgggcggagcggcggggcggcgccgggccctcgcggatatatacgcggggctcccatcgtctcttcggagagcgg

SEQ ID NO: 156724 - DNA, 75 bp, Artificial Sequence
  Synthetic
cgccggttcaaccctagaccgcccgacggcccgggcccgcggcggcggaggacccgcgcgccgccgccgccgcct

SEQ ID NO: 156725 - DNA, 75 bp, Artificial Sequence
  Synthetic
acggtccgatgaccgcctcggccgccgccacgcggcgccggaaccggtcgcggtcggcccgctcgcgcgcccagg

SEQ ID NO: 156726 - DNA, 75 bp, Artificial Sequence
  Synthetic
gggtggcgggcctgcgcgtgatcgtctattgacgacggccgcccaacccgagcgaccttcccctcccactttccc

SEQ ID NO: 156727 - DNA, 75 bp, Artificial Sequence
  Synthetic
cctgcgggcggggagacacgggggtcagggggtcgggtcggggggtcggaggggaggggtcgggtcggggggtcg

SEQ ID NO: 156728 - DNA, 75 bp, Artificial Sequence
  Synthetic
cgccaggtactccgtcgtggtgcgcagccgtagggccaggtggggcggaagggggcgctgcggcccgcgctcctt

SEQ ID NO: 156729 - DNA, 75 bp, Artificial Sequence
  Synthetic
gcgcggcggcggcggggggcaggcggcggcaggcgcggcgtgcggggcctccggcgccttccccccgccctcgct

SEQ ID NO: 156730 - DNA, 75 bp, Artificial Sequence
  Synthetic
cgtcgctgtcgtccgcctggggcaccagcagccagcgccgcaggagcgaggacgcggccggcgcgctctcgaccg

SEQ ID NO: 156731 - DNA, 75 bp, Artificial Sequence
  Synthetic
catttgggagtctgcggttgggagcgcgccggggcgcggcacggctggagcgccggggcgcggccggcgccgggg

SEQ ID NO: 156732 - DNA, 75 bp, Artificial Sequence
  Synthetic
cggcggggaccccggcgggacatggcgggcggctgggctcggcgtaggcccggagccggagcgcgtcggggcggg

SEQ ID NO: 156733 - DNA, 75 bp, Artificial Sequence
  Synthetic
cgggcggctgggctcggcgtaggcccggagccggagcgcgtcggggcgggagagttcactcggcacgcatgcacg

SEQ ID NO: 156734 - DNA, 75 bp, Artificial Sequence
  Synthetic
gccctcttaaggggcggcggcaggacggggactcccgccccgcctcttttcccccggggagtcaacccccggggg

SEQ ID NO: 156735 - DNA, 75 bp, Artificial Sequence
  Synthetic
ggcgggcggcggcggcgggcgggcggcagggcagccccgcccgcccccttccccgcgcccgccgctcccggccct

SEQ ID NO: 156736 - DNA, 75 bp, Artificial Sequence
  Synthetic
ccgacccccgaataaaccacacaaggcggtacgttctcgtctgtctcgttctttatttctcacacacgcgcgcgg

SEQ ID NO: 156737 - DNA, 75 bp, Artificial Sequence
  Synthetic
ctccagctccgcgtccatgtccacgggctcgcgcctcggcggcgtggccagccccgcggcggtccccaccacctc

SEQ ID NO: 156738 - DNA, 75 bp, Artificial Sequence
  Synthetic
ggctcgcgcctcggcggcgtggccagccccgcggcggtccccaccacctccacgccgccgcccgccgcggccagc

SEQ ID NO: 156739 - DNA, 75 bp, Artificial Sequence
  Synthetic
gcccgcgtccgcgtcgtcgcgcagcaccagcgggggcgcgtcgccgtcgggctcgagcagcgcccgcgcgcagaa

SEQ ID NO: 156740 - DNA, 75 bp, Artificial Sequence
  Synthetic
accagcgggggcgcgtcgccgtcgggctcgagcagcgcccgcgcgcagaactcccgccgcggcccgcgcagctcc

SEQ ID NO: 156741 - DNA, 75 bp, Artificial Sequence
  Synthetic
cagcggcgcgcccaggccccagcgcgcgcaggcgcggtgcgagtgcgcctcgtcctcgcagaagtccggcgcgcc

SEQ ID NO: 156742 - DNA, 75 bp, Artificial Sequence
  Synthetic
gcgcaggcgcggtgcgagtgcgcctcgtcctcgcagaagtccggcgcgccgggcgccatggcgtcgcccgcgccc

SEQ ID NO: 156743 - DNA, 75 bp, Artificial Sequence
  Synthetic
gcgcggggacatgggcaccagcgtgtcggggccgaagcgcgtgcgcacgcggtaccgcacgttggccccgcggca

SEQ ID NO: 156744 - DNA, 75 bp, Artificial Sequence
  Synthetic
tcggggccgaagcgcgtgcgcacgcggtaccgcacgttggccccgcggcagaggcgcagcggcggcgcgtcgggg

SEQ ID NO: 156745 - DNA, 75 bp, Artificial Sequence
  Synthetic
cacgcggccggaggccagcacggtgcggcgcaggtcccgcgccgccggccagcgcacggcgcactgcacggcggg

SEQ ID NO: 156746 - DNA, 75 bp, Artificial Sequence
  Synthetic
cggcgcaggtcccgcgccgccggccagcgcacggcgcactgcacggcgggcagcacctcgcaggccaggtaggcg

SEQ ID NO: 156747 - DNA, 75 bp, Artificial Sequence
  Synthetic
ggcgttgacgacgatgaggcggcggtcgcaggcgccggccagcagccccaggaactccacggcgccggcgaaggc

SEQ ID NO: 156748 - DNA, 75 bp, Artificial Sequence
  Synthetic
caggtcccgcgtggacagcagcagcacgccctgcgcgcccagcgccgagacgtcgggggcgccggtccagttgcc

SEQ ID NO: 156749 - DNA, 75 bp, Artificial Sequence
  Synthetic
gcaggcaggacagcccgccgcgctcggcggaccactccggggggggcccgcccccggcgcggcccgcggccaggt

SEQ ID NO: 156750 - DNA, 75 bp, Artificial Sequence
  Synthetic
ggcggaccactccggggggggcccgcccccggcgcggcccgcggccaggtcctcgcccggcagcggcgagtagag

SEQ ID NO: 156751 - DNA, 75 bp, Artificial Sequence
  Synthetic
ccgcgcggcgcagcgggcccgaggcgcgcagcgggccgaaggcggcgggcgcgccgccggggggcggggcggcgc

SEQ ID NO: 156752 - DNA, 75 bp, Artificial Sequence
  Synthetic
gcgcagcgggccgaaggcggcgggcgcgccgccggggggcggggcggcgcagcgcgcggccagcgaggccagcgc

SEQ ID NO: 156753 - DNA, 75 bp, Artificial Sequence
  Synthetic
ggtccgtgagctcggccacggcccgcggggcgcagtaggcctccagggcggcggccgagggcgccggcgtgtggc

SEQ ID NO: 156754 - DNA, 75 bp, Artificial Sequence
  Synthetic
gcggccgagggcgccggcgtgtggctgggccccggcggctggcggcgccagccgccctgcgggtcggggccctcg

SEQ ID NO: 156755 - DNA, 75 bp, Artificial Sequence
  Synthetic
cggcggggcggggggcgcggcccccgcgggaggggcggccgcggggcggggggcgtccgcgcggctcttcttcgg

SEQ ID NO: 156756 - DNA, 75 bp, Artificial Sequence
  Synthetic
gcgggaggggcggccgcggggcggggggcgtccgcgcggctcttcttcggggggcgcggggcgccgccgggcggc

SEQ ID NO: 156757 - DNA, 75 bp, Artificial Sequence
  Synthetic
ggcgggcgcggcgagcgagtcggccgcggcgacggtgtcggccagcagggggcgcaggctctggttctggaagag

SEQ ID NO: 156758 - DNA, 75 bp, Artificial Sequence
  Synthetic
gcggcgacggtgtcggccagcagggggcgcaggctctggttctggaagagcaggtccgcggcggcggcggcggcg

SEQ ID NO: 156759 - DNA, 75 bp, Artificial Sequence
  Synthetic
gaccaggctcacggcgcgcacggcggccacggcggcctcgctgccgccggccacgcgcaggtccccgcgcaggcg

SEQ ID NO: 156760 - DNA, 75 bp, Artificial Sequence
  Synthetic
gccacggcggcctcgctgccgccggccacgcgcaggtccccgcgcaggcgcatcagcaccagcgcgtcgcgcacg

SEQ ID NO: 156761 - DNA, 75 bp, Artificial Sequence
  Synthetic
cggggcggccgcgcccgcgggccccgggcgcgggggcgcggcgggccgggctccggccagccccggcacggccgc

SEQ ID NO: 156762 - DNA, 75 bp, Artificial Sequence
  Synthetic
gcccggcgccgggcggaaggcgccccccgcccggcggtgcggcccgggcccccggcggagcgcgggggccccggg

SEQ ID NO: 156763 - DNA, 75 bp, Artificial Sequence
  Synthetic
gtcgccgtcgcggcggttggcgtcgccgccgtcgtcgggggttcgcgccccggtcagcgccgcgttctcgcgcgc

SEQ ID NO: 156764 - DNA, 75 bp, Artificial Sequence
  Synthetic
ccgccgtcgtcgggggttcgcgccccggtcagcgccgcgttctcgcgcgccagcaggggcgcgtaggcgcggcgc

SEQ ID NO: 156765 - DNA, 75 bp, Artificial Sequence
  Synthetic
ggccacggcggccgccacgtgcgccaggccccagccgaagcggcccgccgccatggcgtaccccaggtggggcac

SEQ ID NO: 156766 - DNA, 75 bp, Artificial Sequence
  Synthetic
aggccccagccgaagcggcccgccgccatggcgtaccccaggtggggcacggcccgcgccacgctgccggagatg

SEQ ID NO: 156767 - DNA, 75 bp, Artificial Sequence
  Synthetic
cccccccccgccgccgccgccctctgcccgcgtcccaccgagacgccgcgccgcgtgagccgtccgccgggggac

SEQ ID NO: 156768 - DNA, 75 bp, Artificial Sequence
  Synthetic
cagcgccacgtccccgggcgccacgcgcgggttctggagccaccccatcgcctccgcgtccggcgtgtacagcag

SEQ ID NO: 156769 - DNA, 75 bp, Artificial Sequence
  Synthetic
cgcgggttctggagccaccccatcgcctccgcgtccggcgtgtacagcagccgcgtgatcagggcgtactgctgc

SEQ ID NO: 156770 - DNA, 75 bp, Artificial Sequence
  Synthetic
ctcgaaccgggcccgcgcctcctccgcctcgggcgccccccagaggccggggcggctgtcgcccagcccgccgta

SEQ ID NO: 156771 - DNA, 75 bp, Artificial Sequence
  Synthetic
gcctcgggcgccccccagaggccggggcggctgtcgcccagcccgccgtacagcacgcgccccgggggcgggggg

SEQ ID NO: 156772 - DNA, 75 bp, Artificial Sequence
  Synthetic
gtagaaggcgccggaggccgcgtcggcgtccagctcgacccgccggggccgcccggccgtgaagcggcccgtggc

SEQ ID NO: 156773 - DNA, 75 bp, Artificial Sequence
  Synthetic
gcccggccgtgaagcggcccgtggcgtcgcggccggccaccgccgcgcgggcccggcgccgctccaggcggcccg

SEQ ID NO: 156774 - DNA, 75 bp, Artificial Sequence
  Synthetic
ccggggcgccgcccccggggccctcgcgggcacccccgcctcctcgtcgtccgcgccgagggtcccgcccgcggc

SEQ ID NO: 156775 - DNA, 75 bp, Artificial Sequence
  Synthetic
gcgggcacccccgcctcctcgtcgtccgcgccgagggtcccgcccgcggcgtggtctgcggcgctggcgggggcg

SEQ ID NO: 156776 - DNA, 75 bp, Artificial Sequence
  Synthetic
gcgcgtccgcgcggcgggtttggtcgcgggtgactggggtggggggcggcgggcaaccgggcctccgggcacgac

SEQ ID NO: 156777 - DNA, 75 bp, Artificial Sequence
  Synthetic
cgcttttctatcggttttgctaactccggaaaataaacgtgttttttatggaacgttccctacctgtcgtgtcat

SEQ ID NO: 156778 - DNA, 75 bp, Artificial Sequence
  Synthetic
tggtggtggtgtcggcggggcgccgggggtcgcggcgacaggctggccatggggtccgggtacgccccgcggacc

SEQ ID NO: 156779 - DNA, 75 bp, Artificial Sequence
  Synthetic
ggtgtgcgggcggggtgggcgtgagtggcggtgcatgcctcgggtctcctcttcctgctcctcctcctttcccgc

SEQ ID NO: 156780 - DNA, 75 bp, Artificial Sequence
  Synthetic
ggggtcgcggcgacaggctggccatggggtccgggtacgccccgcggaccgcggacgtcgtctccggtccgcgga

SEQ ID NO: 156781 - DNA, 75 bp, Artificial Sequence
  Synthetic
ccgtcgcgctccggggggggcgacgggatcgtgcgaacggcctcgtccaccatcgaggccagcagggccagctgc

SEQ ID NO: 156782 - DNA, 75 bp, Artificial Sequence
  Synthetic
cgtcttcgttctcctccggcccaccgtgccacccgaacccgggccgcgcggcggggcgacggtccgggttcgggg

SEQ ID NO: 156783 - DNA, 75 bp, Artificial Sequence
  Synthetic
gtgccacccgaacccgggccgcgcggcggggcgacggtccgggttcggggtgggcggcggtccgtcggctggatc

SEQ ID NO: 156784 - DNA, 75 bp, Artificial Sequence
  Synthetic
gtgcgtgtgcctgtgtcttttcgcctctccgcgccgatcgggtagatcctggcggccgcgtcggtagccgcgctc

SEQ ID NO: 156785 - DNA, 75 bp, Artificial Sequence
  Synthetic
tctccgcgccgatcgggtagatcctggcggccgcgtcggtagccgcgctccgtgtggacgatcgccccgtcgcct

SEQ ID NO: 156786 - DNA, 75 bp, Artificial Sequence
  Synthetic
cggaggaggagcgatcgacgccgccgcgccccggctcgccggggttccgcccccaggtggaaccgcattatgcgc

SEQ ID NO: 156787 - DNA, 75 bp, Artificial Sequence
  Synthetic
gcgccccggctcgccggggttccgcccccaggtggaaccgcattatgcgcggccccgccccgacgcccgcgcgtc

SEQ ID NO: 156788 - DNA, 75 bp, Artificial Sequence
  Synthetic
gcggcatctcattagcgcccggcgcgggcggcttccgcttccgcccgcgatgctaatgagaccctcgtcgcgggc

SEQ ID NO: 156789 - DNA, 75 bp, Artificial Sequence
  Synthetic
gggctcgctcccctgcccttccgggttcgtggtaatgagatgccggccccgcgctcccgttggcccccgccggcc

SEQ ID NO: 156790 - DNA, 75 bp, Artificial Sequence
  Synthetic
aaagggggcggggccgcagggtaaaagaagtgagaacgcgaagcgttcgcacttcgtcctaatagtatatatatt

SEQ ID NO: 156791 - DNA, 75 bp, Artificial Sequence
  Synthetic
ccccctacaacagtgttgtccgttggttgggtggttggggtgcgggggtgggcgggggaagcaagaaaacggtcg

SEQ ID NO: 156792 - DNA, 75 bp, Artificial Sequence
  Synthetic
agaagtgagaacgcgaagcgttcgcacttcgtcctaatagtatatatattattagggcaaagtgcgagcgctggc

SEQ ID NO: 156793 - DNA, 75 bp, Artificial Sequence
  Synthetic
ccggccttttttccgatcacgcgcacgtcttgagtctttcttgccgtttcttttgtttctctttctttccccccc

SEQ ID NO: 156794 - DNA, 75 bp, Artificial Sequence
  Synthetic
gccccgaggcgggcccggacggggggcgggccgttcctcgcgcacataaagggccggcgtcccggtcgccgccgc

SEQ ID NO: 156795 - DNA, 75 bp, Artificial Sequence
  Synthetic
ggggggcggggacagggggtgtgtgtgggtaaaagcaacgtcggaaaatcaaacccaatgccccaaacagaaaaa

SEQ ID NO: 156796 - DNA, 75 bp, Artificial Sequence
  Synthetic
gggggacgggccggggggacgggccggggggacgggccggggggacgggccggggggacgggccggggggacggg

SEQ ID NO: 156797 - DNA, 75 bp, Artificial Sequence
  Synthetic
gacggggggacgggccggggggacggggggacgggccggggggacggggggacgggccggggggacggggggacg

SEQ ID NO: 156798 - DNA, 75 bp, Artificial Sequence
  Synthetic
gaggaggaggaagaggaggcggcggcggcgaccgcggcctgggacgacggagacgccgacgggggcgcggcgccc

SEQ ID NO: 156799 - DNA, 75 bp, Artificial Sequence
  Synthetic
ccccgggttcacggaagcgcagacgccccgtcctccccagctcgtcggaatctgagggtaagcccgacacagaat

SEQ ID NO: 156800 - DNA, 75 bp, Artificial Sequence
  Synthetic
ccccgtcctccccagctcgtcggaatctgagggtaagcccgacacagaatcggaatcctcctcgaccgagtcgtc

SEQ ID NO: 156801 - DNA, 75 bp, Artificial Sequence
  Synthetic
agctcggggggaggtattttttggatctgtcggcagaatcgaccacggggacggaatcggagggaacggggccgt

SEQ ID NO: 156802 - DNA, 75 bp, Artificial Sequence
  Synthetic
cccccggttagtgcccgacccccgcccgacccccgcccgacccccgcccgacccccgcccgacccccgcccgacc

SEQ ID NO: 156803 - DNA, 75 bp, Artificial Sequence
  Synthetic
tcaacctgcgattaacgagctcccccgaccggcgtgcgggtgtggttttccccgaggtgtggagaaacgacagac

SEQ ID NO: 156804 - DNA, 75 bp, Artificial Sequence
  Synthetic
cgaccggcgtgcgggtgtggttttccccgaggtgtggagaaacgacagacctatccgcgcggcgcaaccccaggc

SEQ ID NO: 156805 - DNA, 75 bp, Artificial Sequence
  Synthetic
gccaggcccagatgcggagcggagccgcctggacgcttgatctgcattacatacgccagtgcgtcaaccagctct

SEQ ID NO: 156806 - DNA, 75 bp, Artificial Sequence
  Synthetic
cgcctggacgcttgatctgcattacatacgccagtgcgtcaaccagctctttcggatcctgcgtgccgccccgaa

SEQ ID NO: 156807 - DNA, 75 bp, Artificial Sequence
  Synthetic
tcatgggctactgccggacccgcctggggccgcgcacgtggggccgcctgctgcagatctcgggcggaacctggg

SEQ ID NO: 156808 - DNA, 75 bp, Artificial Sequence
  Synthetic
ggggccgcgcacgtggggccgcctgctgcagatctcgggcggaacctgggacgtgcgcctgcgaaacgcaatccg

SEQ ID NO: 156809 - DNA, 75 bp, Artificial Sequence
  Synthetic
cctgtctgaacgccaggcgttacggccccgagtgtgatgttggcaatctcgagaccaacggcggctcgacgagcg

SEQ ID NO: 156810 - DNA, 75 bp, Artificial Sequence
  Synthetic
gagaccaacggcggctcgacgagcgatgatgagatatcggatgcgacggactcggacgataccctcgcgtcccat

SEQ ID NO: 156811 - DNA, 75 bp, Artificial Sequence
  Synthetic
cgcgtccggcggggctatcgcggctcggctggagtgtgagtttgggacgtttgactggacgtccgaggagggctc

SEQ ID NO: 156812 - DNA, 75 bp, Artificial Sequence
  Synthetic
cggctggagtgtgagtttgggacgtttgactggacgtccgaggagggctcccagccctggctgtccgcggtggtc

SEQ ID NO: 156813 - DNA, 75 bp, Artificial Sequence
  Synthetic
tcgcgcaacggaagccccagaacgcgaggacgggtgccgaaaaatgcgcttccccgccgcctgcccctatccctg

SEQ ID NO: 156814 - DNA, 75 bp, Artificial Sequence
  Synthetic
gaggacgggtgccgaaaaatgcgcttccccgccgcctgcccctatccctgcggccacacatttctccggccatga

SEQ ID NO: 156815 - DNA, 75 bp, Artificial Sequence
  Synthetic
tctggtttttctgggggtggaggaaggaacgacaaaaaaagaaacaaacgcgacaccgctcgtacgtgtaatggg

SEQ ID NO: 156816 - DNA, 75 bp, Artificial Sequence
  Synthetic
cgacaccgctcgtacgtgtaatggggcgcagtgttttttattagcatcggggggggggttagaggttggtgattg

SEQ ID NO: 156817 - DNA, 75 bp, Artificial Sequence
  Synthetic
ggggggggttagaggttggtgattggatagcaaacgtgggatgacggaggccactcgtcgccaacggccagcggg

SEQ ID NO: 156818 - DNA, 75 bp, Artificial Sequence
  Synthetic
gatagcaaacgtgggatgacggaggccactcgtcgccaacggccagcgggggcccggggttctgggggtcatcgt

SEQ ID NO: 156819 - DNA, 75 bp, Artificial Sequence
  Synthetic
ccactcgtcgccaacggccagcgggggcccggggttctgggggtcatcgtcccccgtctgccaggagggctcatc

SEQ ID NO: 156820 - DNA, 75 bp, Artificial Sequence
  Synthetic
gggtcgccggatgcgggcgggatgatgcggggcggggtttgttgtgaggagccacgagggaccgtagccagcgaa

SEQ ID NO: 156821 - DNA, 75 bp, Artificial Sequence
  Synthetic
tgcggggcggggtttgttgtgaggagccacgagggaccgtagccagcgaagacagctgcgttcccggtcgccggg

SEQ ID NO: 156822 - DNA, 75 bp, Artificial Sequence
  Synthetic
ccagggggtgattaggcgctgcggggaacggggtccacgacacggtccgctcgggcaaaaaccgatcgggcaggg

SEQ ID NO: 156823 - DNA, 75 bp, Artificial Sequence
  Synthetic
gttggtcttcatggcgatgaagcgaaaccccagccgggttttttgtgcgtactcgaaaaacggcacacacaggtc

SEQ ID NO: 156824 - DNA, 75 bp, Artificial Sequence
  Synthetic
cttgatgcaggagccgaaaacacgcaggggcatccagaatctcgatgctttccagggggtcgtcctccgcaaaca

SEQ ID NO: 156825 - DNA, 75 bp, Artificial Sequence
  Synthetic
aggggcatccagaatctcgatgctttccagggggtcgtcctccgcaaacaggcccgtcgtggtgtttgggggaca

SEQ ID NO: 156826 - DNA, 75 bp, Artificial Sequence
  Synthetic
tcagaggctcggccagcctgcgaaggttcgcggggcgaaccaccaccggggttcccagaggctcggaggccagga

SEQ ID NO: 156827 - DNA, 75 bp, Artificial Sequence
  Synthetic
gttcgcggggcgaaccaccaccggggttcccagaggctcggaggccaggatccggcattgccgaagcagaaaact

SEQ ID NO: 156828 - DNA, 75 bp, Artificial Sequence
  Synthetic
ggtctaggagggtaaccacacttacaacaacaacgcccatgtcggtatattaggcccgtggtccgatcttcactc

SEQ ID NO: 156829 - DNA, 75 bp, Artificial Sequence
  Synthetic
aacaacaacgcccatgtcggtatattaggcccgtggtccgatcttcactcactcgcctgtctgcggacctatgca

SEQ ID NO: 156830 - DNA, 75 bp, Artificial Sequence
  Synthetic
gttcgcacgttcgattttttcagccttgtttggttggctaggtatcccggataatctgacgttccggatataggg

SEQ ID NO: 156831 - DNA, 75 bp, Artificial Sequence
  Synthetic
cgacaaactgccgcttcttaaaacaccggggcccgtcgctcggggtgctcgttggttggcacgcgcgacgcggcg

SEQ ID NO: 156832 - DNA, 75 bp, Artificial Sequence
  Synthetic
gttggttggcacgcgcgacgcggcgaatggcctgtcgtaagttctgtggggtctaccgtagacccgacaagagac

SEQ ID NO: 156833 - DNA, 75 bp, Artificial Sequence
  Synthetic
aatggcctgtcgtaagttctgtggggtctaccgtagacccgacaagagacaggaggcgtccgtcccgccggagac

SEQ ID NO: 156834 - DNA, 75 bp, Artificial Sequence
  Synthetic
aggggcggcggcaggacggggactcccgccccgcctcctttcccccggggagtcaacccccgggggggtgttttt

SEQ ID NO: 156835 - DNA, 75 bp, Artificial Sequence
  Synthetic
atgcgtacctggcccccgggcccccggaaaccatccacccttcccgcccaccgtcccccggcgaggctgcgcgcc

SEQ ID NO: 156836 - DNA, 75 bp, Artificial Sequence
  Synthetic
ggaaaccatccacccttcccgcccaccgtcccccggcgaggctgcgcgcctgtgtcagctgcaggagatcttggc

SEQ ID NO: 156837 - DNA, 75 bp, Artificial Sequence
  Synthetic
cggcggcgggcgggcggcagggcggccccgcccgcccccttccccgtccctcccccggaaccggccgctcccccg

SEQ ID NO: 156838 - DNA, 75 bp, Artificial Sequence
  Synthetic
aggaggaagacgaggccgacgatgacgccccggatgacgtggcctacccggaggactacgcggaggggcgttttc

SEQ ID NO: 156839 - DNA, 75 bp, Artificial Sequence
  Synthetic
gaggactacgcggaggggcgttttctgtccatggtttcggccgcccccctgcccggagccagcggccatcctcct

SEQ ID NO: 156840 - DNA, 75 bp, Artificial Sequence
  Synthetic
gcggaccgccacaaactcccgagctccccgcccccctaaagacgacagtcgcaccaccgctcgccctcgcagacc

SEQ ID NO: 156841 - DNA, 75 bp, Artificial Sequence
  Synthetic
ggtgggggccacggggttcaccccggaagagctcgacaccatggaccgggaggcacttcgggccatcagccgcgg

SEQ ID NO: 156842 - DNA, 75 bp, Artificial Sequence
  Synthetic
gcaccaccgctcgccctcgcagaccacacagttgcaccaagcacccgcccgcccgcacacggttccccgccaccc

SEQ ID NO: 156843 - DNA, 75 bp, Artificial Sequence
  Synthetic
gaagagctcgacaccatggaccgggaggcacttcgggccatcagccgcgggtgcaagcccccttcgaccctggca

SEQ ID NO: 156844 - DNA, 75 bp, Artificial Sequence
  Synthetic
gtcggaggggtgtgtctttgatagcagccacccgaactaccctcatcgggtaatcgtcaaggcggggtggtacgc

SEQ ID NO: 156845 - DNA, 75 bp, Artificial Sequence
  Synthetic
agccacccgaactaccctcatcgggtaatcgtcaaggcggggtggtacgccagcacgagccacgaggcgcggctg

SEQ ID NO: 156846 - DNA, 75 bp, Artificial Sequence
  Synthetic
cgtttctggggtcacgtgtctggtcctccccaagtatcactgcgacctgtatacctatctgagcaagcgcccgtc

SEQ ID NO: 156847 - DNA, 75 bp, Artificial Sequence
  Synthetic
ctccccaagtatcactgcgacctgtatacctatctgagcaagcgcccgtctccgttgggccacctacagataacc

SEQ ID NO: 156848 - DNA, 75 bp, Artificial Sequence
  Synthetic
cccgcgggcgcgggagacgtgccgccgcccgaccccgacccccgcccgaccccgacccccgcccgaccccgaccc

SEQ ID NO: 156849 - DNA, 75 bp, Artificial Sequence
  Synthetic
catcatccaccgcgatattaagaccgagaacatcttcatcaacacccccgagaacatctgtctgggggactttgg

SEQ ID NO: 156850 - DNA, 75 bp, Artificial Sequence
  Synthetic
gagaacatcttcatcaacacccccgagaacatctgtctgggggactttggggcggcgtgctttgtgcgcgggtgt

SEQ ID NO: 156851 - DNA, 75 bp, Artificial Sequence
  Synthetic
gccgcgggcccgcttccccgcggccgcccccgcgcggcttttttcccgcgcccgcccccgcgcggcaggacgggg

SEQ ID NO: 156852 - DNA, 75 bp, Artificial Sequence
  Synthetic
cccccgcccgaccccgacccccgcccgaccccgacccccgcccgacccccgaataaaccacacaaggcggtacgt

SEQ ID NO: 156853 - DNA, 75 bp, Artificial Sequence
  Synthetic
ccccgaggtcctggccggggatccgtacacccaggtaatcgacatctggagcgccggcctggtgatctttgagac

SEQ ID NO: 156854 - DNA, 75 bp, Artificial Sequence
  Synthetic
tacacccaggtaatcgacatctggagcgccggcctggtgatctttgagaccgccgtccacaccgcgtccttgttc

SEQ ID NO: 156855 - DNA, 75 bp, Artificial Sequence
  Synthetic
catcatccgacaggcccaggtacacgtcgacgagtttccgacgcacgcggaatcgcgcctcaccgcgcactaccg

SEQ ID NO: 156856 - DNA, 75 bp, Artificial Sequence
  Synthetic
ccggcgtggacccgaccggcgtggacccgctactacaagatccacacagacgtcgaatatctcatctgcaaagcc

SEQ ID NO: 156857 - DNA, 75 bp, Artificial Sequence
  Synthetic
cttacctttgacgcggcgctccgcccaagcgccgcggagttgctgcgcctgccgctatttcaccctaagtgaccc

SEQ ID NO: 156858 - DNA, 75 bp, Artificial Sequence
  Synthetic
ggggggctggttggatgtttttgcacaaaaagacgcggcccccgggctttggtgtttttggcaccttgccgcccg

SEQ ID NO: 156859 - DNA, 75 bp, Artificial Sequence
  Synthetic
ggtgtttttggcaccttgccgcccggcgtcatgcacgccatcgctcccaggttgcttcttctttttgttctttct

SEQ ID NO: 156860 - DNA, 75 bp, Artificial Sequence
  Synthetic
gcgtcatgcacgccatcgctcccaggttgcttcttctttttgttctttctggtcttccggggacacgcggcgggt

SEQ ID NO: 156861 - DNA, 75 bp, Artificial Sequence
  Synthetic
ggaggttcccccgtggctcaatattgttatgcctatccccggttggacgatcccgggcccttgggttccgcggac

SEQ ID NO: 156862 - DNA, 75 bp, Artificial Sequence
  Synthetic
tcccgggcccttgggttccgcggacgccgggcggcaagacctgccccggcgcgtcgtccgtcacgagcccctggg

SEQ ID NO: 156863 - DNA, 75 bp, Artificial Sequence
  Synthetic
ggccgccgcgcgcccccgcccggccgccgcgcgcccccgcccggccgccgcgcgcccccgcccggccgccgcgcg

SEQ ID NO: 156864 - DNA, 75 bp, Artificial Sequence
  Synthetic
gatttggcgcacccaacgcaacgtatgcggcccgtgtgacgtactaccggctcacccgcgcctgccgtcagccca

SEQ ID NO: 156865 - DNA, 75 bp, Artificial Sequence
  Synthetic
tgcggcccgtgtgacgtactaccggctcacccgcgcctgccgtcagcccatcctccttcggcagtatggagggtg

SEQ ID NO: 156866 - DNA, 75 bp, Artificial Sequence
  Synthetic
cgtaccagggcggcgggcctccgacccggtacgctctcgtaaatgcttccctgctggtgccgatctgggaccgcg

SEQ ID NO: 156867 - DNA, 75 bp, Artificial Sequence
  Synthetic
cgaactcggcggcgagctgcacgtgggtctgttgtgggtagaggtgggcggggagggccccggccccaccgcccc

SEQ ID NO: 156868 - DNA, 75 bp, Artificial Sequence
  Synthetic
cgggccgcccgtggcgctcggtgcccccggtatggtattccgcccccaaccccgggtttcgtggcctgcgtttcc

SEQ ID NO: 156869 - DNA, 75 bp, Artificial Sequence
  Synthetic
gcccgccgcccccagcgacctaccacgcgtcgcttttgctccccagagcctgctggtggggattacgggccgcac

SEQ ID NO: 156870 - DNA, 75 bp, Artificial Sequence
  Synthetic
attgggcccccggggccctagatgacggtccgtacgcccccttcccaccccgcccgcggtttcgacgcgccctgc

SEQ ID NO: 156871 - DNA, 75 bp, Artificial Sequence
  Synthetic
cggcgcctcatggccttgaccgaggacgcgtcctccgattcgcctacgtccgctccggagaagacgcccctccct

SEQ ID NO: 156872 - DNA, 75 bp, Artificial Sequence
  Synthetic
cgctccggagaagacgcccctccctgtgtcggccaccgccatggcgccctcagtcgacccaagcgcggaaccgac

SEQ ID NO: 156873 - DNA, 75 bp, Artificial Sequence
  Synthetic
gacccaagcaccgcagccggagaggccgagcggggagtgggcggccgggcgggaggatggcggagagagagaaag

SEQ ID NO: 156874 - DNA, 75 bp, Artificial Sequence
  Synthetic
cgcccccgcaaccactactccccccgacgagatggccacacaagccgcaacggtcgccgttacgccggaggaaac

SEQ ID NO: 156875 - DNA, 75 bp, Artificial Sequence
  Synthetic
ccgccgcggcggcaacgcccggggccgggcacacgaacaccagcagcgcctccgcagcgaaaacgccccccacca

SEQ ID NO: 156876 - DNA, 75 bp, Artificial Sequence
  Synthetic
cacgtctacccacgcgaccccccgccccacgactccggggccccaaacaacccctcccggacccgcaaccccggg

SEQ ID NO: 156877 - DNA, 75 bp, Artificial Sequence
  Synthetic
cccctcccggacccgcaaccccgggtccggtgggcgcctccgccgcgcccacggccgattcccccctcaccgcct

SEQ ID NO: 156878 - DNA, 75 bp, Artificial Sequence
  Synthetic
gacccccgcccgaccccgacccccgcccgaccccgacccccgcccgacccccgcccgacccgacccccccccccc

SEQ ID NO: 156879 - DNA, 75 bp, Artificial Sequence
  Synthetic
gccggggacggcgaaccccccgaggacgacgacagcgccaccggcctcgccttccgaactccgaaccccaacaaa

SEQ ID NO: 156880 - DNA, 75 bp, Artificial Sequence
  Synthetic
acgacgacagcgccaccggcctcgccttccgaactccgaaccccaacaaaccaccccccgcgcgccccgggccca

SEQ ID NO: 156881 - DNA, 75 bp, Artificial Sequence
  Synthetic
gccaataccctccttttttctttttctcttccccccccaaaaaacaataaacagctaattgcgtacgacaaacca

SEQ ID NO: 156882 - DNA, 75 bp, Artificial Sequence
  Synthetic
cctcgcccccccgcccaagctcccgctaaggacatgccctcgggccccacaccccaacacatccccctgttctgg

SEQ ID NO: 156883 - DNA, 75 bp, Artificial Sequence
  Synthetic
ctaaggacatgccctcgggccccacaccccaacacatccccctgttctggttcctaacggcctcccctgctctag

SEQ ID NO: 156884 - DNA, 75 bp, Artificial Sequence
  Synthetic
ctggtcgccttggcagcacaactttggcgcggccgggcggggcgcaggcgatacgcgcacccgagcgtgcgttac

SEQ ID NO: 156885 - DNA, 75 bp, Artificial Sequence
  Synthetic
cgcaacttttggccacacagagaaaggcccccagactaagtcacccgggtccccgaacaaaaacaaaaaccttga

SEQ ID NO: 156886 - DNA, 75 bp, Artificial Sequence
  Synthetic
acgccgcgcgttctcgcaggtaggtttagggtcgtacaggtgagcttctgctgaggcggcgggagaggggggggg

SEQ ID NO: 156887 - DNA, 75 bp, Artificial Sequence
  Synthetic
ccgcacccaccggccccgcgtccgatacaacaaacgcgaccgcacgcctccccacgcaccccccactcatccgtt

SEQ ID NO: 156888 - DNA, 75 bp, Artificial Sequence
  Synthetic
ctggggatggcgtgtctactcgaggtcctgcgtcgcctgggtcgcgagttggcgaggtgctgcccccacgcgggc

SEQ ID NO: 156889 - DNA, 75 bp, Artificial Sequence
  Synthetic
ccccgattgtgtgtcgggtgcccggggtacagcagctatggagcggtcggtaatataactttggttgtcgccaca

SEQ ID NO: 156890 - DNA, 75 bp, Artificial Sequence
  Synthetic
taatataactttggttgtcgccacacgccccgcgccgggcatgggttgtgcgggaaggacgaaataatccggcga

SEQ ID NO: 156891 - DNA, 75 bp, Artificial Sequence
  Synthetic
aagcccacaacccatcccacaaggggggttatggcggacccaccgcaccaccatactccgattcgaccacatatg

SEQ ID NO: 156892 - DNA, 75 bp, Artificial Sequence
  Synthetic
gggttatggcggacccaccgcaccaccatactccgattcgaccacatatgcaaccaaatcacccccagaggggag

SEQ ID NO: 156893 - DNA, 75 bp, Artificial Sequence
  Synthetic
gggggacggggggacggggggacggggggacgggacggggggacggggggacgggacggggggacggggggacgg

SEQ ID NO: 156894 - DNA, 75 bp, Artificial Sequence
  Synthetic
cccggggtcggtgtggtgttcggtcataagctgcattgcgaacgactagtcgccgtttttcgtgtgcatcgcgta

SEQ ID NO: 156895 - DNA, 75 bp, Artificial Sequence
  Synthetic
ataagctgcattgcgaacgactagtcgccgtttttcgtgtgcatcgcgtatcacggcatggggcgtttgacctcc

SEQ ID NO: 156896 - DNA, 75 bp, Artificial Sequence
  Synthetic
ctgcgccaaatacgccttagcagacccctcgcttaagatggccgatcccaatcgatttcgcgggaagaaccttcc

SEQ ID NO: 156897 - DNA, 75 bp, Artificial Sequence
  Synthetic
ccctcgcttaagatggccgatcccaatcgatttcgcgggaagaaccttccggttttggaccagctgaccgacccc

SEQ ID NO: 156898 - DNA, 75 bp, Artificial Sequence
  Synthetic
ccagccccccagcatcccgatcactgtgtactacgcagtgctggaacgtgcctgccgcagcgtgctcctacatgc

SEQ ID NO: 156899 - DNA, 75 bp, Artificial Sequence
  Synthetic
gtgtactacgcagtgctggaacgtgcctgccgcagcgtgctcctacatgccccatcggaggccccccagatcgtg

SEQ ID NO: 156900 - DNA, 75 bp, Artificial Sequence
  Synthetic
ccctcctccctccccgagccaggcgccctcccactcctgcccaccacccccagggtctggccggccagacgtgcg

SEQ ID NO: 156901 - DNA, 75 bp, Artificial Sequence
  Synthetic
ctggtatcgcatgggagacaattgcgctatccccatcacggttatggaatacaccgagtgcccctacaacaagtc

SEQ ID NO: 156902 - DNA, 75 bp, Artificial Sequence
  Synthetic
gctatccccatcacggttatggaatacaccgagtgcccctacaacaagtcgttgggggtctgccccatccgaacg

SEQ ID NO: 156903 - DNA, 75 bp, Artificial Sequence
  Synthetic
cctgggattcctgatgcacgcccccgccttcgagaccgcgggtacgtacctgcggctagtgaagataaacgactg

SEQ ID NO: 156904 - DNA, 75 bp, Artificial Sequence
  Synthetic
tgcggctagtgaagataaacgactggacggagatcacacaatttatcctggagcaccgggcccgcgcctcctgca

SEQ ID NO: 156905 - DNA, 75 bp, Artificial Sequence
  Synthetic
gcctaccaacagggcgtgacggtcgacagcatcgggatgctaccccgctttatccccgaaaaccagcgcaccgtc

SEQ ID NO: 156906 - DNA, 75 bp, Artificial Sequence
  Synthetic
acagcatcgggatgctaccccgctttatccccgaaaaccagcgcaccgtcgccctatacagcttaaaaatcgccg

SEQ ID NO: 156907 - DNA, 75 bp, Artificial Sequence
  Synthetic
ctgtccgacaccaccaacgccacgcaacccgaactcgttccggaagaccccgaggactcggccctcttagaggat

SEQ ID NO: 156908 - DNA, 75 bp, Artificial Sequence
  Synthetic
aacccgaactcgttccggaagaccccgaggactcggccctcttagaggatcccgccgggacggtgtcttcgcaga

SEQ ID NO: 156909 - DNA, 75 bp, Artificial Sequence
  Synthetic
gggccggggggacggggcggggggacgggacggggggacggggggccggggggacggggggccggggggacgggg

SEQ ID NO: 156910 - DNA, 75 bp, Artificial Sequence
  Synthetic
gggccggggggacggggcggggggacgggacggggggacggggggccggggggtcggggggccggggggacgggg

SEQ ID NO: 156911 - DNA, 75 bp, Artificial Sequence
  Synthetic
gggccggggggacggggcggggggacgggacggggggacggggggccggggggccggggggccggggggacgggg

SEQ ID NO: 156912 - DNA, 75 bp, Artificial Sequence
  Synthetic
gggccggggggacggggcggggggacgggacggggggacggggggccgggggggcggggggccggggggacgggg

SEQ ID NO: 156913 - DNA, 75 bp, Artificial Sequence
  Synthetic
gcccccgccgcccccagcaacccgggcctgatcatcggcgcgctggccggcagtaccctggcggtgctggtcatc

SEQ ID NO: 156914 - DNA, 75 bp, Artificial Sequence
  Synthetic
gcctgatcatcggcgcgctggccggcagtaccctggcggtgctggtcatcggcggtattgcgttttgggtacgcc

SEQ ID NO: 156915 - DNA, 75 bp, Artificial Sequence
  Synthetic
gacgacgcgcccccctcgcaccagccattgttttactagaggagtttccccgctcccgtgtacctctgggcccgt

SEQ ID NO: 156916 - DNA, 75 bp, Artificial Sequence
  Synthetic
ccgtagcaggcccctggcggccagccaggtcacggacgcgttgtgcagatgcgcgatgctcaggttcgtcgtcgg

SEQ ID NO: 156917 - DNA, 75 bp, Artificial Sequence
  Synthetic
gtgggacttggactccgcataaagggagtctcgaaggagggaaactaggacagttcataggccgggagcgtgggg

SEQ ID NO: 156918 - DNA, 75 bp, Artificial Sequence
  Synthetic
ccgtccgatcccggtatgcccggccgctcgctgcagggcctggcgatcctgggcctgtgggtctgcgccaccggc

SEQ ID NO: 156919 - DNA, 75 bp, Artificial Sequence
  Synthetic
gctcgctgcagggcctggcgatcctgggcctgtgggtctgcgccaccggcctggtcgtccgcggccccacggtca

SEQ ID NO: 156920 - DNA, 75 bp, Artificial Sequence
  Synthetic
gctcccaccagccccgcccgcagaggaagaggcggaggaggaagaggcggaggaggaagaggcggaggaggagga

SEQ ID NO: 156921 - DNA, 75 bp, Artificial Sequence
  Synthetic
ttcgtggaagaggacctgcgtgttttcggggagcttcattttgtgggggcccaggtcccccacacaaactactac

SEQ ID NO: 156922 - DNA, 75 bp, Artificial Sequence
  Synthetic
tcggggagcttcattttgtgggggcccaggtcccccacacaaactactacgacggcatcatcgagctgtttcact

SEQ ID NO: 156923 - DNA, 75 bp, Artificial Sequence
  Synthetic
gcatgcccccgccgccccgccgtggcgttcaccttgtgtcgctcgacgcaccacgcccacagccccgcctatccg

SEQ ID NO: 156924 - DNA, 75 bp, Artificial Sequence
  Synthetic
accctggagctgggtctggcgcggcagccgcttctgcgggttcgaacggcaacgcgcgactatgccggtctgtat

SEQ ID NO: 156925 - DNA, 75 bp, Artificial Sequence
  Synthetic
gggggtggcgctctctgccaacgggacgtttgtgtataacggctcggactacggctcctgcgatccggcgcagct

SEQ ID NO: 156926 - DNA, 75 bp, Artificial Sequence
  Synthetic
cgagagcgccccgcccaattccacgcgatcggccagcgaatcgagacacaggctaaccgtagcccaggtaatcca

SEQ ID NO: 156927 - DNA, 75 bp, Artificial Sequence
  Synthetic
cgatcggccagcgaatcgagacacaggctaaccgtagcccaggtaatccagatcgccataccggcgtccatcatc

SEQ ID NO: 156928 - DNA, 75 bp, Artificial Sequence
  Synthetic
ggctaaccgtagcccaggtaatccagatcgccataccggcgtccatcatcgcctttgtgtttctgggcagctgta

SEQ ID NO: 156929 - DNA, 75 bp, Artificial Sequence
  Synthetic
atttacaaccccgggggcgtttcctgcgcggtcaacgaggcggccatggcccgcctcggagccgagctgcgatcc

SEQ ID NO: 156930 - DNA, 75 bp, Artificial Sequence
  Synthetic
gacgccgttcgtcgtcgtccacgaccatgccttccctaacgtcgatagctgaggaatcggagccaggtccagtcg

SEQ ID NO: 156931 - DNA, 75 bp, Artificial Sequence
  Synthetic
cggaactcgctgttttttttttttttttttttttttttcttgtttattactctgtttattacattgaaacagaca

SEQ ID NO: 156932 - DNA, 75 bp, Artificial Sequence
  Synthetic
gaggaatcggagccaggtccagtcgtgctgctgtccgtcagtcctcggccccgcagtggcccgacggccccccaa

SEQ ID NO: 156933 - DNA, 75 bp, Artificial Sequence
  Synthetic
ccgcagtggcccgacggccccccaagaggtctaggtccaagcgggccgttcggcaggcccgccccaccgccccca

SEQ ID NO: 156934 - DNA, 75 bp, Artificial Sequence
  Synthetic
gacgtagtccactgcagagggagacagagacgggaacccccggttagtgcccgacccccggttagtgcccgaccc

SEQ ID NO: 156935 - DNA, 75 bp, Artificial Sequence
  Synthetic
aaataaacgccctacaagaaagcttttgtgtctgagtgtctggtttttctgggggtggaggaaggaacgacaaaa

SEQ ID NO: 156936 - DNA, 75 bp, Artificial Sequence
  Synthetic
gttggatccctttgtgatcgttcgtcattccccggatggcatgggaggcgggtaatggatgggcggggcccgggg

SEQ ID NO: 156937 - DNA, 75 bp, Artificial Sequence
  Synthetic
acccccggttcccgacccccgcccgacccccgcccgccctcaccgcccgccctcgcccgcccgacccccgcccga

SEQ ID NO: 156938 - DNA, 75 bp, Artificial Sequence
  Synthetic
gggaggaaaaagaataaagggggtagtgtcggagaggcccgccgcgcatttaaggagtcgccgccccgactctgt

SEQ ID NO: 156939 - DNA, 75 bp, Artificial Sequence
  Synthetic
gtcttcgggtgacttggtgcgccgccgtcagctagtctccgatctgccccgaccgacggctcctgccacccgaac

SEQ ID NO: 156940 - DNA, 75 bp, Artificial Sequence
  Synthetic
tttttgttggagtttgggtcgtatcgtgcctggcggcagcacccagaacgtcctggaaacgggtaacctcgggcg

SEQ ID NO: 156941 - DNA, 75 bp, Artificial Sequence
  Synthetic
gcccacaaactactgtgggccgcggaacccctggatgcctgcggtcccctgcgcccgtcgtgggtggcgctgtgg

SEQ ID NO: 156942 - DNA, 75 bp, Artificial Sequence
  Synthetic
tcgtggatgcggcgtgcatgcgcgccccggaaccgctcgccatagcatacagtcccccgttccccgcgggcgacg

SEQ ID NO: 156943 - DNA, 75 bp, Artificial Sequence
  Synthetic
cgcggacggggcatgggaccgggtggaggcgcgcctccggcgtacggcatgcccgcgcacggacatggtggccgg

SEQ ID NO: 156944 - DNA, 75 bp, Artificial Sequence
  Synthetic
gagagtctggtcatctacggggccctggagacggacagcggtctgtacaccctgtccgtggtcggcctaagcgac

SEQ ID NO: 156945 - DNA, 75 bp, Artificial Sequence
  Synthetic
ttctggtcgtggagcccgcccctgtgccgaccccgacccccgacgactacgacgaagaagacgacgcgggcgtga

SEQ ID NO: 156946 - DNA, 75 bp, Artificial Sequence
  Synthetic
cccgtcgcccccccgacgcaccctcgtgttatccccgaggtgtcccacgtgcgcggggtaacggtccatatggag

SEQ ID NO: 156947 - DNA, 75 bp, Artificial Sequence
  Synthetic
gtgttatccccgaggtgtcccacgtgcgcggggtaacggtccatatggagaccccggaggccattctgtttgccc

SEQ ID NO: 156948 - DNA, 75 bp, Artificial Sequence
  Synthetic
tgcggttacccccggtcccgctcccccgctacatcagccctcccccgcacacgcccacccccctccgccgccgcc

SEQ ID NO: 156949 - DNA, 75 bp, Artificial Sequence
  Synthetic
gacggtccgtacgccatggacgtcgtctggatgcggtttgacgtgccgtcctcgtgcgccgagatgcggatctac

SEQ ID NO: 156950 - DNA, 75 bp, Artificial Sequence
  Synthetic
tctggatgcggtttgacgtgccgtcctcgtgcgccgagatgcggatctacgaagcttgtctgtatcacccgcagc

SEQ ID NO: 156951 - DNA, 75 bp, Artificial Sequence
  Synthetic
ccgtccccccgtccccccgtcccgtccccccgtccccccgtcccgtccccccgtccccccgtccccccgtccccc

SEQ ID NO: 156952 - DNA, 75 bp, Artificial Sequence
  Synthetic
gcgtaccgcctggcggtccgcagctacgccggctgttccaggactacgcccccgccgcgatgttttgccgaggct

SEQ ID NO: 156953 - DNA, 75 bp, Artificial Sequence
  Synthetic
acgccggctgttccaggactacgcccccgccgcgatgttttgccgaggctcgcatggaaccggtcccggggttgg

SEQ ID NO: 156954 - DNA, 75 bp, Artificial Sequence
  Synthetic
cacgccggcctctacctgtgcgtggtgtacgtggacgatcatatccacgcctggggccacatgaccatcagcacc

SEQ ID NO: 156955 - DNA, 75 bp, Artificial Sequence
  Synthetic
tgtacgtggacgatcatatccacgcctggggccacatgaccatcagcaccgcggcgcagtaccggaacgcggtgg

SEQ ID NO: 156956 - DNA, 75 bp, Artificial Sequence
  Synthetic
ccgcacgtgagagccccccatcccgcgccctccgcgcgcggcccgctgcgcctcggggcggtgctgggggcggcc

SEQ ID NO: 156957 - DNA, 75 bp, Artificial Sequence
  Synthetic
cgccctccgcgcgcggcccgctgcgcctcggggcggtgctgggggcggccctgttgctggccgccctcgggctgt

SEQ ID NO: 156958 - DNA, 75 bp, Artificial Sequence
  Synthetic
aaaagccgggcctcggcgacgggccccacttacattcgcgtggcggacagcgagctgtacgcggactggagttcg

SEQ ID NO: 156959 - DNA, 75 bp, Artificial Sequence
  Synthetic
ccacttacattcgcgtggcggacagcgagctgtacgcggactggagttcggacagcgagggggagcgcgacgggt

SEQ ID NO: 156960 - DNA, 75 bp, Artificial Sequence
  Synthetic
gcggaacccgcgggcgcgcggggactcatttgtcgccggcgacacccacccgacaacagcccctgggtgtcgacc

SEQ ID NO: 156961 - DNA, 75 bp, Artificial Sequence
  Synthetic
tccggctttgagatcttatcaccaacggctccgtctgtatacccccatagcgaggggcgtaaatctcgccgcccg

SEQ ID NO: 156962 - DNA, 75 bp, Artificial Sequence
  Synthetic
cggctccgtctgtatacccccatagcgaggggcgtaaatctcgccgcccgctcaccacctttggttcgggaagcc

SEQ ID NO: 156963 - DNA, 75 bp, Artificial Sequence
  Synthetic
gtcttccgacgacgcggacgtcggcgatgaactgattgccatcgcggacgcacgcggggacccgccagagaccct

SEQ ID NO: 156964 - DNA, 75 bp, Artificial Sequence
  Synthetic
gatgaactgattgccatcgcggacgcacgcggggacccgccagagaccctgccccccggcgcgggcggcgccgcg

SEQ ID NO: 156965 - DNA, 75 bp, Artificial Sequence
  Synthetic
ggccctccacgccgtggacgccccctcccaattcgtcacctggctcgccgtgcgctggctgcggggggcggtggg

SEQ ID NO: 156966 - DNA, 75 bp, Artificial Sequence
  Synthetic
ccagcgccggacgcggacgcgacgctcccaccagccccgcccgcagaggaagaggcggaggaggaggaggaggag

SEQ ID NO: 156967 - DNA, 75 bp, Artificial Sequence
  Synthetic
gccgaggccgccctcgccggttcaaccctagaccgcccgacggcccgggcccgcggcggcggaggacccgcgcgc

SEQ ID NO: 156968 - DNA, 75 bp, Artificial Sequence
  Synthetic
gcgcgtcggtgccgctttaccccgcggcctcgcccgtcccggcagaagcctactactcggaaagcgaagacgagg

SEQ ID NO: 156969 - DNA, 75 bp, Artificial Sequence
  Synthetic
ggcctcgcccgtcccggcagaagcctactactcggaaagcgaagacgaggccgccaacgacttcctcgtgcgcat

SEQ ID NO: 156970 - DNA, 75 bp, Artificial Sequence
  Synthetic
ccgcggcggcggaggacccgcgcgccgccgccgccgcctcctcctcctcctccgcgggtccgccgtcttcgtggg

SEQ ID NO: 156971 - DNA, 75 bp, Artificial Sequence
  Synthetic
tcgggctggttatcgcctgtctcgtcgtggccctcctatctggagggttcggggcacttttggtgtggctgctcc

SEQ ID NO: 156972 - DNA, 75 bp, Artificial Sequence
  Synthetic
ttcctcagtgtttgggaaatctattgaactctcccggctcctccgtgttagggaagtctcttggggaaatctatt

SEQ ID NO: 156973 - DNA, 75 bp, Artificial Sequence
  Synthetic
ccgggtacgggctccagacgaaggacccatacatttccccatccgcaccccacatctggcgttctagagtcacga

SEQ ID NO: 156974 - DNA, 75 bp, Artificial Sequence
  Synthetic
cccatacatttccccatccgcaccccacatctggcgttctagagtcacgacgcatttgcccccgtccccgcagca

SEQ ID NO: 156975 - DNA, 75 bp, Artificial Sequence
  Synthetic
caccctgtccccgggacgtggtcaggaccgggggtccgcacccaaacgcacgaaacaaatgctggcagtgtgccg

SEQ ID NO: 156976 - DNA, 75 bp, Artificial Sequence
  Synthetic
ggaagggggggagaaaggggtccgtaaccaaaggtggtctgcgtcctttggattccgacccctcgtctccccccc

SEQ ID NO: 156977 - DNA, 75 bp, Artificial Sequence
  Synthetic
gaccgggggtccgcacccaaacgcacgaaacaaatgctggcagtgtgccgaatataaccccgcgtaggaacacgt

SEQ ID NO: 156978 - DNA, 75 bp, Artificial Sequence
  Synthetic
gcatatggcgatgtgtttggacgcagggcgcagccgcggcgataaaattcatggcggccgtccgccagggccaca

SEQ ID NO: 156979 - DNA, 75 bp, Artificial Sequence
  Synthetic
gggcgcagccgcggcgataaaattcatggcggccgtccgccagggccacagcggcgaggactccctgttggcccg

SEQ ID NO: 156980 - DNA, 75 bp, Artificial Sequence
  Synthetic
ccagcgggggcggtgggtcgtgggtgttgagagcacacaggcgggacacctcgatcaccgtccgaaaaaaggccc

SEQ ID NO: 156981 - DNA, 75 bp, Artificial Sequence
  Synthetic
gtgcgccagggcctgggcgttgagagggtacaactcggagccgggggactccgggggccggtccgcgcggtgccg

SEQ ID NO: 156982 - DNA, 75 bp, Artificial Sequence
  Synthetic
ttttttgggggggggcgcgaaggcgggcggcggcggcgggcgggcggcagggcagccccgcgcgcccccttcccc

SEQ ID NO: 156983 - DNA, 75 bp, Artificial Sequence
  Synthetic
tcccgacgcggggcagaacgtacgtgcgttggcgcggcgatgaggggtccgggctgccgaggggggcgtagggga

SEQ ID NO: 156984 - DNA, 75 bp, Artificial Sequence
  Synthetic
gcgttggcgcggcgatgaggggtccgggctgccgaggggggcgtaggggaccgggctaggcaagcccgcgggttg

SEQ ID NO: 156985 - DNA, 75 bp, Artificial Sequence
  Synthetic
gggggtcgcgggtccctgggtatgcgcgggaccctgggttctctgggagatcgtggaactcgcggttccctgggc

SEQ ID NO: 156986 - DNA, 75 bp, Artificial Sequence
  Synthetic
gcgggaccctgggttctctgggagatcgtggaactcgcggttccctgggctctcggggaacccggggctccctgg

SEQ ID NO: 156987 - DNA, 75 bp, Artificial Sequence
  Synthetic
cccccgtccccccggcccgtccccccgaccccccgccccgaccccccgtccccccgaccccccgtccccccgtcc

SEQ ID NO: 156988 - DNA, 75 bp, Artificial Sequence
  Synthetic
cccccgtccccccggcccgtccccccgaccccccgccccgaccccccgtccccccgtccccccgtccccccgtcc

SEQ ID NO: 156989 - DNA, 75 bp, Artificial Sequence
  Synthetic
cccccgtccccccggcccgtccccccgaccccccgccccgaccccccgtccccccgcccccccgtccccccgtcc

SEQ ID NO: 156990 - DNA, 75 bp, Artificial Sequence
  Synthetic
cccccgtccccccggcccgtccccccgaccccccgccccgaccccccgtccccccggccccccgtccccccgtcc

SEQ ID NO: 156991 - DNA, 75 bp, Artificial Sequence
  Synthetic
cccccgtccccccggcccgtccccccgaccccccgccccgtccccccgtccccccgaccccccgtccccccgtcc

SEQ ID NO: 156992 - DNA, 75 bp, Artificial Sequence
  Synthetic
cccccgtccccccggcccgtccccccgaccccccgccccgtccccccgtccccccgtccccccgtccccccgtcc

SEQ ID NO: 156993 - DNA, 75 bp, Artificial Sequence
  Synthetic
cccccgtccccccggcccgtccccccgaccccccgccccgtccccccgtccccccgcccccccgtccccccgtcc

SEQ ID NO: 156994 - DNA, 75 bp, Artificial Sequence
  Synthetic
cccccgtccccccggcccgtccccccgaccccccgccccgtccccccgtccccccggccccccgtccccccgtcc

SEQ ID NO: 156995 - DNA, 75 bp, Artificial Sequence
  Synthetic
cccccgtccccccggcccgtccccccgaccccccgccccgcccccccgtccccccgaccccccgtccccccgtcc

SEQ ID NO: 156996 - DNA, 75 bp, Artificial Sequence
  Synthetic
cccccgtccccccggcccgtccccccgaccccccgccccgcccccccgtccccccgtccccccgtccccccgtcc

SEQ ID NO: 156997 - DNA, 75 bp, Artificial Sequence
  Synthetic
cccccgtccccccggcccgtccccccgaccccccgccccgcccccccgtccccccgcccccccgtccccccgtcc

SEQ ID NO: 156998 - DNA, 75 bp, Artificial Sequence
  Synthetic
cccccgtccccccggcccgtccccccgaccccccgccccgcccccccgtccccccggccccccgtccccccgtcc

SEQ ID NO: 156999 - DNA, 75 bp, Artificial Sequence
  Synthetic
cccccgtccccccggcccgtccccccgaccccccgccccggccccccgtccccccgaccccccgtccccccgtcc

SEQ ID NO: 157000 - DNA, 75 bp, Artificial Sequence
  Synthetic
cccccgtccccccggcccgtccccccgaccccccgccccggccccccgtccccccgtccccccgtccccccgtcc

SEQ ID NO: 157001 - DNA, 75 bp, Artificial Sequence
  Synthetic
cccccgtccccccggcccgtccccccgaccccccgccccggccccccgtccccccgcccccccgtccccccgtcc

SEQ ID NO: 157002 - DNA, 75 bp, Artificial Sequence
  Synthetic
cccccgtccccccggcccgtccccccgaccccccgccccggccccccgtccccccggccccccgtccccccgtcc

SEQ ID NO: 157003 - DNA, 75 bp, Artificial Sequence
  Synthetic
cccccgtccccccggcccgtccccccgtccccccgccccgaccccccgtccccccgaccccccgtccccccgtcc

SEQ ID NO: 157004 - DNA, 75 bp, Artificial Sequence
  Synthetic
cccccgtccccccggcccgtccccccgtccccccgccccgaccccccgtccccccgtccccccgtccccccgtcc

SEQ ID NO: 157005 - DNA, 75 bp, Artificial Sequence
  Synthetic
cccccgtccccccggcccgtccccccgtccccccgccccgaccccccgtccccccgcccccccgtccccccgtcc

SEQ ID NO: 157006 - DNA, 75 bp, Artificial Sequence
  Synthetic
cccccgtccccccggcccgtccccccgtccccccgccccgaccccccgtccccccggccccccgtccccccgtcc

SEQ ID NO: 157007 - DNA, 75 bp, Artificial Sequence
  Synthetic
cccccgtccccccggcccgtccccccgtccccccgccccgtccccccgtccccccgaccccccgtccccccgtcc

SEQ ID NO: 157008 - DNA, 75 bp, Artificial Sequence
  Synthetic
cccccgtccccccggcccgtccccccgtccccccgccccgtccccccgtccccccgtccccccgtccccccgtcc

SEQ ID NO: 157009 - DNA, 75 bp, Artificial Sequence
  Synthetic
cccccgtccccccggcccgtccccccgtccccccgccccgtccccccgtccccccgcccccccgtccccccgtcc

SEQ ID NO: 157010 - DNA, 75 bp, Artificial Sequence
  Synthetic
cccccgtccccccggcccgtccccccgtccccccgccccgtccccccgtccccccggccccccgtccccccgtcc

SEQ ID NO: 157011 - DNA, 75 bp, Artificial Sequence
  Synthetic
cccccgtccccccggcccgtccccccgtccccccgccccgcccccccgtccccccgaccccccgtccccccgtcc

SEQ ID NO: 157012 - DNA, 75 bp, Artificial Sequence
  Synthetic
cccccgtccccccggcccgtccccccgtccccccgccccgcccccccgtccccccgtccccccgtccccccgtcc

SEQ ID NO: 157013 - DNA, 75 bp, Artificial Sequence
  Synthetic
cccccgtccccccggcccgtccccccgtccccccgccccgcccccccgtccccccgcccccccgtccccccgtcc

SEQ ID NO: 157014 - DNA, 75 bp, Artificial Sequence
  Synthetic
cccccgtccccccggcccgtccccccgtccccccgccccgcccccccgtccccccggccccccgtccccccgtcc

SEQ ID NO: 157015 - DNA, 75 bp, Artificial Sequence
  Synthetic
cccccgtccccccggcccgtccccccgtccccccgccccggccccccgtccccccgaccccccgtccccccgtcc

SEQ ID NO: 157016 - DNA, 75 bp, Artificial Sequence
  Synthetic
cccccgtccccccggcccgtccccccgtccccccgccccggccccccgtccccccgtccccccgtccccccgtcc

SEQ ID NO: 157017 - DNA, 75 bp, Artificial Sequence
  Synthetic
cccccgtccccccggcccgtccccccgtccccccgccccggccccccgtccccccgcccccccgtccccccgtcc

SEQ ID NO: 157018 - DNA, 75 bp, Artificial Sequence
  Synthetic
cccccgtccccccggcccgtccccccgtccccccgccccggccccccgtccccccggccccccgtccccccgtcc

SEQ ID NO: 157019 - DNA, 75 bp, Artificial Sequence
  Synthetic
cccccgtccccccggcccgtccccccgcccccccgccccgaccccccgtccccccgaccccccgtccccccgtcc

SEQ ID NO: 157020 - DNA, 75 bp, Artificial Sequence
  Synthetic
cccccgtccccccggcccgtccccccgcccccccgccccgaccccccgtccccccgtccccccgtccccccgtcc

SEQ ID NO: 157021 - DNA, 75 bp, Artificial Sequence
  Synthetic
cccccgtccccccggcccgtccccccgcccccccgccccgaccccccgtccccccgcccccccgtccccccgtcc

SEQ ID NO: 157022 - DNA, 75 bp, Artificial Sequence
  Synthetic
cccccgtccccccggcccgtccccccgcccccccgccccgaccccccgtccccccggccccccgtccccccgtcc

SEQ ID NO: 157023 - DNA, 75 bp, Artificial Sequence
  Synthetic
cccccgtccccccggcccgtccccccgcccccccgccccgtccccccgtccccccgaccccccgtccccccgtcc

SEQ ID NO: 157024 - DNA, 75 bp, Artificial Sequence
  Synthetic
cccccgtccccccggcccgtccccccgcccccccgccccgtccccccgtccccccgtccccccgtccccccgtcc

SEQ ID NO: 157025 - DNA, 75 bp, Artificial Sequence
  Synthetic
cccccgtccccccggcccgtccccccgcccccccgccccgtccccccgtccccccgcccccccgtccccccgtcc

SEQ ID NO: 157026 - DNA, 75 bp, Artificial Sequence
  Synthetic
cccccgtccccccggcccgtccccccgcccccccgccccgtccccccgtccccccggccccccgtccccccgtcc

SEQ ID NO: 157027 - DNA, 75 bp, Artificial Sequence
  Synthetic
cccccgtccccccggcccgtccccccgcccccccgccccgcccccccgtccccccgaccccccgtccccccgtcc

SEQ ID NO: 157028 - DNA, 75 bp, Artificial Sequence
  Synthetic
cccccgtccccccggcccgtccccccgcccccccgccccgcccccccgtccccccgtccccccgtccccccgtcc

SEQ ID NO: 157029 - DNA, 75 bp, Artificial Sequence
  Synthetic
cccccgtccccccggcccgtccccccgcccccccgccccgcccccccgtccccccgcccccccgtccccccgtcc

SEQ ID NO: 157030 - DNA, 75 bp, Artificial Sequence
  Synthetic
cccccgtccccccggcccgtccccccgcccccccgccccgcccccccgtccccccggccccccgtccccccgtcc

SEQ ID NO: 157031 - DNA, 75 bp, Artificial Sequence
  Synthetic
cccccgtccccccggcccgtccccccgcccccccgccccggccccccgtccccccgaccccccgtccccccgtcc

SEQ ID NO: 157032 - DNA, 75 bp, Artificial Sequence
  Synthetic
cccccgtccccccggcccgtccccccgcccccccgccccggccccccgtccccccgtccccccgtccccccgtcc

SEQ ID NO: 157033 - DNA, 75 bp, Artificial Sequence
  Synthetic
cccccgtccccccggcccgtccccccgcccccccgccccggccccccgtccccccgcccccccgtccccccgtcc

SEQ ID NO: 157034 - DNA, 75 bp, Artificial Sequence
  Synthetic
cccccgtccccccggcccgtccccccgcccccccgccccggccccccgtccccccggccccccgtccccccgtcc

SEQ ID NO: 157035 - DNA, 75 bp, Artificial Sequence
  Synthetic
cccccgtccccccggcccgtccccccggccccccgccccgaccccccgtccccccgaccccccgtccccccgtcc

SEQ ID NO: 157036 - DNA, 75 bp, Artificial Sequence
  Synthetic
cccccgtccccccggcccgtccccccggccccccgccccgaccccccgtccccccgtccccccgtccccccgtcc

SEQ ID NO: 157037 - DNA, 75 bp, Artificial Sequence
  Synthetic
cccccgtccccccggcccgtccccccggccccccgccccgaccccccgtccccccgcccccccgtccccccgtcc

SEQ ID NO: 157038 - DNA, 75 bp, Artificial Sequence
  Synthetic
cccccgtccccccggcccgtccccccggccccccgccccgaccccccgtccccccggccccccgtccccccgtcc

SEQ ID NO: 157039 - DNA, 75 bp, Artificial Sequence
  Synthetic
cccccgtccccccggcccgtccccccggccccccgccccgtccccccgtccccccgaccccccgtccccccgtcc

SEQ ID NO: 157040 - DNA, 75 bp, Artificial Sequence
  Synthetic
cccccgtccccccggcccgtccccccggccccccgccccgtccccccgtccccccgtccccccgtccccccgtcc

SEQ ID NO: 157041 - DNA, 75 bp, Artificial Sequence
  Synthetic
cccccgtccccccggcccgtccccccggccccccgccccgtccccccgtccccccgcccccccgtccccccgtcc

SEQ ID NO: 157042 - DNA, 75 bp, Artificial Sequence
  Synthetic
cccccgtccccccggcccgtccccccggccccccgccccgtccccccgtccccccggccccccgtccccccgtcc

SEQ ID NO: 157043 - DNA, 75 bp, Artificial Sequence
  Synthetic
cccccgtccccccggcccgtccccccggccccccgccccgcccccccgtccccccgaccccccgtccccccgtcc

SEQ ID NO: 157044 - DNA, 75 bp, Artificial Sequence
  Synthetic
cccccgtccccccggcccgtccccccggccccccgccccgcccccccgtccccccgtccccccgtccccccgtcc

SEQ ID NO: 157045 - DNA, 75 bp, Artificial Sequence
  Synthetic
cccccgtccccccggcccgtccccccggccccccgccccgcccccccgtccccccgcccccccgtccccccgtcc

SEQ ID NO: 157046 - DNA, 75 bp, Artificial Sequence
  Synthetic
cccccgtccccccggcccgtccccccggccccccgccccgcccccccgtccccccggccccccgtccccccgtcc

SEQ ID NO: 157047 - DNA, 75 bp, Artificial Sequence
  Synthetic
cccccgtccccccggcccgtccccccggccccccgccccggccccccgtccccccgaccccccgtccccccgtcc

SEQ ID NO: 157048 - DNA, 75 bp, Artificial Sequence
  Synthetic
cccccgtccccccggcccgtccccccggccccccgccccggccccccgtccccccgtccccccgtccccccgtcc

SEQ ID NO: 157049 - DNA, 75 bp, Artificial Sequence
  Synthetic
cccccgtccccccggcccgtccccccggccccccgccccggccccccgtccccccgcccccccgtccccccgtcc

SEQ ID NO: 157050 - DNA, 75 bp, Artificial Sequence
  Synthetic
cccccgtccccccggcccgtccccccggccccccgccccggccccccgtccccccggccccccgtccccccgtcc

SEQ ID NO: 157051 - DNA, 75 bp, Artificial Sequence
  Synthetic
ttcgggatcgagagggccgcacagactcgtagtagacccgaatctccacgtttccccgccgccggatcatggtcg

SEQ ID NO: 157052 - DNA, 75 bp, Artificial Sequence
  Synthetic
ctcgtagtagacccgaatctccacgtttccccgccgccggatcatggtcgccgccccggtgcgggggcccgtcgg

SEQ ID NO: 157053 - DNA, 75 bp, Artificial Sequence
  Synthetic
tcggatggggtgccttttaaggaaaggtctcggctgcccgccccaaccggggtttgggggtgggccggggaaacc

SEQ ID NO: 157054 - DNA, 75 bp, Artificial Sequence
  Synthetic
ctaagcgccggcgcgctggttgggtgggggtagaggggagtccccggtcgacgagatcgtatcaaggggccagca

SEQ ID NO: 157055 - DNA, 75 bp, Artificial Sequence
  Synthetic
acgagatcgtatcaaggggccagcacgcgatcctgccgctcgttcgatctagcacacccacgggtctgctgtgtg

SEQ ID NO: 157056 - DNA, 75 bp, Artificial Sequence
  Synthetic
cgcgatcctgccgctcgttcgatctagcacacccacgggtctgctgtgtgggatttcgactcgcgggatccgatc

SEQ ID NO: 157057 - DNA, 75 bp, Artificial Sequence
  Synthetic
ctggccgcctctcggtcctcccgttcccttttatggatctccgcgcagacatcgccatacgtccggtgtgtgcac

SEQ ID NO: 157058 - DNA, 75 bp, Artificial Sequence
  Synthetic
ccccgtccccccggcccgtccccccgtccccccggcccgtccccccgtccccccggcccgtccccccgtcccccc

SEQ ID NO: 157059 - DNA, 75 bp, Artificial Sequence
  Synthetic
ccccggcccgtccccccgtccccccgtccccccgtccccccggccccccgtccccccgtccccccgtcccccgtc

SEQ ID NO: 157060 - DNA, 75 bp, Artificial Sequence
  Synthetic
ccccgtccccccgtccccccggcccgtccccccggcccgtccccccggcccgtccccccggcccgtccccccggc

SEQ ID NO: 157061 - DNA, 75 bp, Artificial Sequence
  Synthetic
cgtccccccggcccgtccccccggccccccggcccgtccccccggcccgtccccccggcccgtccccccggcccg

SEQ ID NO: 157062 - DNA, 75 bp, Artificial Sequence
  Synthetic
cgtctctgtatccgatccgatccgggtgcgtcggtgccccgctcgccgccggcgtctctgtctcgctgtggcccc

SEQ ID NO: 157063 - DNA, 75 bp, Artificial Sequence
  Synthetic
gtgcgtcggtgccccgctcgccgccggcgtctctgtctcgctgtggcccccttcgcgatgccgccgctgccgtcc

SEQ ID NO: 157064 - DNA, 75 bp, Artificial Sequence
  Synthetic
ccaggatctacccgatcggcgcggagaggcgaaaagacacaggcacacgcacgcaccgcacgggggggagagaga

SEQ ID NO: 157065 - DNA, 75 bp, Artificial Sequence
  Synthetic
cggtctccgccgcgcagccggtgtgcccctggtgcggcggcgaccgggacgccggccctttatgtgcgcgaggaa

SEQ ID NO: 157066 - DNA, 75 bp, Artificial Sequence
  Synthetic
gcgggccccgggcagggcgccagcgctcgcactttgccctaataatatatatactattaggacgaagtgcgaacg

SEQ ID NO: 157067 - DNA, 75 bp, Artificial Sequence
  Synthetic
atactattaggacgaagtgcgaacgcttcgcgttctcacttcttttaccctgcggccccgccccctttggggcgg

SEQ ID NO: 157068 - DNA, 75 bp, Artificial Sequence
  Synthetic
gccccagaccccccgcgggcgcgggagacgtgccgccgcccgaccccgacccccgcccgaccccgacccccgccc

SEQ ID NO: 157069 - DNA, 75 bp, Artificial Sequence
  Synthetic
gggagcgcggggccggcatctcattaccacgaacccggaagggcaggggagcgagcccgcccgcgacgagggtct

SEQ ID NO: 157070 - DNA, 75 bp, Artificial Sequence
  Synthetic
gcccgggccgccgatctgtttgtgtcacagatgatggggtcccgctaactcgcctccaggatccggacttggggg

SEQ ID NO: 157071 - DNA, 75 bp, Artificial Sequence
  Synthetic
cggcgcgaccaacgggccgccgccacggacgcggacgcgcgggcgtcggggcggggccgcgcataatgcggttcc

SEQ ID NO: 157072 - DNA, 75 bp, Artificial Sequence
  Synthetic
cggacgcggacgcgcgggcgtcggggcggggccgcgcataatgcggttccacctgggggcggaaccccggcgagc

SEQ ID NO: 157073 - DNA, 75 bp, Artificial Sequence
  Synthetic
cccgccccgcgcgccccgaggactatatcagccaggcgacggggcgatcgtccacacggagcgcggctaccgacg

SEQ ID NO: 157074 - DNA, 75 bp, Artificial Sequence
  Synthetic
cagtcccccggagctcgggtctgggttttattgggacctgccctcggaatcgcggctcccagtccaagccccccc

SEQ ID NO: 157075 - DNA, 75 bp, Artificial Sequence
  Synthetic
gcggggccgaggtcgcgatggcggacgaggacgggggacgtctccgggccgcggcggagacgaccggcggccccg

SEQ ID NO: 157076 - DNA, 75 bp, Artificial Sequence
  Synthetic
gccgatgccgatgccgacgaggcggccccggcgtccggggaggccgtcgatgagcctgccgcggacggcgtcgtc

SEQ ID NO: 157077 - DNA, 75 bp, Artificial Sequence
  Synthetic
ccccggcgtccggggaggccgtcgatgagcctgccgcggacggcgtcgtctcgccgcggcagctggccctgctgg

SEQ ID NO: 157078 - DNA, 75 bp, Artificial Sequence
  Synthetic
acgatgacgacgaccgcgacgcgggccgctgggtccgcggaccggagacgacgtccgcggtccgcggggcgtacc

SEQ ID NO: 157079 - DNA, 75 bp, Artificial Sequence
  Synthetic
aaaatccggatcctcgtcgtcggcgtcctccgcctcctcctccgcctcctcctcctcgtctgcatccgcctcctc

SEQ ID NO: 157080 - DNA, 75 bp, Artificial Sequence
  Synthetic
tcctccgcctcctcctccgcctcctcctcctcgtctgcatccgcctcctcgtctgacgacgacgacgacgacgac

SEQ ID NO: 157081 - DNA, 75 bp, Artificial Sequence
  Synthetic
gccgcccgcgcccccgccagcgccgcagaccacgccgcgggcgggaccctcggcgcggacgacgaggaggcgggg

SEQ ID NO: 157082 - DNA, 75 bp, Artificial Sequence
  Synthetic
tgggctcggaaaccgcggccgggggcgcggccgccatggcgagtcacccggccgtgctgtggtttagttaaggtt

SEQ ID NO: 157083 - DNA, 75 bp, Artificial Sequence
  Synthetic
cagaccacgccgcgggcgggaccctcggcgcggacgacgaggaggcgggggtgcccgcgagggccccgggggcgg

SEQ ID NO: 157084 - DNA, 75 bp, Artificial Sequence
  Synthetic
ccggttccgggggagggacggggaagggggcgcgcggggctgccctgccgcccgcccgccgccgccgcccgcctt

SEQ ID NO: 157085 - DNA, 75 bp, Artificial Sequence
  Synthetic
agacgaggaggcggatgcagacgaggaggaggaggcggaggaggaggcggaggaaggcggaggaggaggcggagg

SEQ ID NO: 157086 - DNA, 75 bp, Artificial Sequence
  Synthetic
ggccggccgcgacgccacgggccgcttcacggccgggcggccccggcgggtcgagctggacgccgacgcggcctc

SEQ ID NO: 157087 - DNA, 75 bp, Artificial Sequence
  Synthetic
ttcacggccgggcggccccggcgggtcgagctggacgccgacgcggcctccggcgccttctacgcgcgctaccgc

SEQ ID NO: 157088 - DNA, 75 bp, Artificial Sequence
  Synthetic
ggggcgcgtgctgtacggcgggctgggcgacagccgccccggcctctggggggcgcccgaggcggaggaggcgcg

SEQ ID NO: 157089 - DNA, 75 bp, Artificial Sequence
  Synthetic
ggcgacagccgccccggcctctggggggcgcccgaggcggaggaggcgcgggcccggttcgaggcctcgggcgcc

SEQ ID NO: 157090 - DNA, 75 bp, Artificial Sequence
  Synthetic
ccgccgccaaaccgccgaacgacgccgcgtggtcatcctcgtcgccgaaatccccaaagttaaacacctccccgg

SEQ ID NO: 157091 - DNA, 75 bp, Artificial Sequence
  Synthetic
cctgatcacgcggctgctgtacacgccggacgcggaggcgatggggtggctccagaacccgcgcgtggcgcccgg

SEQ ID NO: 157092 - DNA, 75 bp, Artificial Sequence
  Synthetic
ccggacgcggaggcgatggggtggctccagaacccgcgcgtggcgcccggggacgtggcgctggaccaggcctgc

SEQ ID NO: 157093 - DNA, 75 bp, Artificial Sequence
  Synthetic
cgtggcgcgggccgtgccccacctggggtacgccatggcggcgggccgcttcggctggggcctggcgcacgtggc

SEQ ID NO: 157094 - DNA, 75 bp, Artificial Sequence
  Synthetic
gggtacgccatggcggcgggccgcttcggctggggcctggcgcacgtggcggccgccgtggccatgagccgccgc

SEQ ID NO: 157095 - DNA, 75 bp, Artificial Sequence
  Synthetic
acctcggccccgcggccctgcgtcgtcgtcgtcgtcttcttcttccgctgctccgccgacatcgcctccgaccgg

SEQ ID NO: 157096 - DNA, 75 bp, Artificial Sequence
  Synthetic
gcggcgctgaccggggcgcgaacccccgacgacggcggcgacgccaaccgccgcgacggcgacgacgcccgcggg

SEQ ID NO: 157097 - DNA, 75 bp, Artificial Sequence
  Synthetic
gccgcgggggtgctcgccgccctggggcgcctgagcgccgcgcccgcctccgcgccggccggggccgacgacgac

SEQ ID NO: 157098 - DNA, 75 bp, Artificial Sequence
  Synthetic
ccggcccgtccccccgtccccccggcccgtccccccgtccccccgtccccccgtcccggccccccggcccggccc

SEQ ID NO: 157099 - DNA, 75 bp, Artificial Sequence
  Synthetic
cgcggaggcgggccgcgtggccgtggagtgcctggccgcctgccgcgggatcctggaggcgctggcggagggctt

SEQ ID NO: 157100 - DNA, 75 bp, Artificial Sequence
  Synthetic
gagtgcctggccgcctgccgcgggatcctggaggcgctggcggagggcttcgacggcgacctggcggccgtgccg

SEQ ID NO: 157101 - DNA, 75 bp, Artificial Sequence
  Synthetic
cccccgtcccggccccccggcccgtccccccggcccgtccccccgtcccggccccccgtcccgtccccccggccc

SEQ ID NO: 157102 - DNA, 75 bp, Artificial Sequence
  Synthetic
cgcggccgccccgccgcacgccgacgcgccccgcctgcgcgcctggctgcgcgagctgcggttcgtgcgcgacgc

SEQ ID NO: 157103 - DNA, 75 bp, Artificial Sequence
  Synthetic
gcgccccgcctgcgcgcctggctgcgcgagctgcggttcgtgcgcgacgcgctggtgctgatgcgcctgcgcggg

SEQ ID NO: 157104 - DNA, 75 bp, Artificial Sequence
  Synthetic
cgtgagcctggtcgccggggccctgggcccggcgctgccgcggagcccgcgcctgctgagctccgccgccgccgc

SEQ ID NO: 157105 - DNA, 75 bp, Artificial Sequence
  Synthetic
cgccgcggacctgctcttccagaaccagagcctgcgccccctgctggccgacaccgtcgccgcggccgactcgct

SEQ ID NO: 157106 - DNA, 75 bp, Artificial Sequence
  Synthetic
ccccggccagggcgccgcccggcggcgccccgcgccccccgaagaagagccgcgcggacgccccccgccccgcgg

SEQ ID NO: 157107 - DNA, 75 bp, Artificial Sequence
  Synthetic
cgccccgcgccccccgaagaagagccgcgcggacgccccccgccccgcggccgcccctcccgcgggggccgcgcc

SEQ ID NO: 157108 - DNA, 75 bp, Artificial Sequence
  Synthetic
cccgccggcccgccgagggccccgacccgcagggcggctggcgccgccagccgccggggcccagccacacgccgg

SEQ ID NO: 157109 - DNA, 75 bp, Artificial Sequence
  Synthetic
cccgcagggcggctggcgccgccagccgccggggcccagccacacgccggcgccctcggccgccgccctggaggc

SEQ ID NO: 157110 - DNA, 75 bp, Artificial Sequence
  Synthetic
cgggcgggggtcgggcgggggtcgggcgggggtcgggcactaaccgggggttcccgtctctgtctccctctgcag

SEQ ID NO: 157111 - DNA, 75 bp, Artificial Sequence
  Synthetic
ccgcgccgtggcgcccggccctcatgttcgacccgcgcgcgctggcctcgctggccgcgcgctgcgccgccccgc

SEQ ID NO: 157112 - DNA, 75 bp, Artificial Sequence
  Synthetic
gttcgacccgcgcgcgctggcctcgctggccgcgcgctgcgccgccccgccccccggcggcgcgcccgccgcctt

SEQ ID NO: 157113 - DNA, 75 bp, Artificial Sequence
  Synthetic
gccaggtgcccgacccggaggacgtgcgcgtggtgatcctctactcgccgctgccgggcgaggacctggccgcgg

SEQ ID NO: 157114 - DNA, 75 bp, Artificial Sequence
  Synthetic
ctgccgggcgaggacctggccgcgggccgcgccgggggcgggccccccccggagtggtccgccgagcgcggcggg

SEQ ID NO: 157115 - DNA, 75 bp, Artificial Sequence
  Synthetic
ggccgcctgggcgggcaactggaccggcgcccccgacgtctcggcgctgggcgcgcagggcgtgctgctgctgtc

SEQ ID NO: 157116 - DNA, 75 bp, Artificial Sequence
  Synthetic
ggcgcccccgacgtctcggcgctgggcgcgcagggcgtgctgctgctgtccacgcgggacctggccttcgccggc

SEQ ID NO: 157117 - DNA, 75 bp, Artificial Sequence
  Synthetic
cgtcgtcaacgccgtgcgcgccgcggactggcccgccgacgggcccgtggtctcgcggcagcacgcctacctggc

SEQ ID NO: 157118 - DNA, 75 bp, Artificial Sequence
  Synthetic
gactggcccgccgacgggcccgtggtctcgcggcagcacgcctacctggcctgcgaggtgctgcccgccgtgcag

SEQ ID NO: 157119 - DNA, 75 bp, Artificial Sequence
  Synthetic
ctccggccgcgtgttcgggccgggggtcttcgcgcgcgtggaggccgcgcacgcgcgcctgtaccccgacgcgcc

SEQ ID NO: 157120 - DNA, 75 bp, Artificial Sequence
  Synthetic
gtcttcgcgcgcgtggaggccgcgcacgcgcgcctgtaccccgacgcgccgccgctgcgcctctgccgcggggcc

SEQ ID NO: 157121 - DNA, 75 bp, Artificial Sequence
  Synthetic
catgtccccgcgcgagtaccgccgcgccgtgctcccggcgctggacggccgggccgccgcctcgggcgcgggcga

SEQ ID NO: 157122 - DNA, 75 bp, Artificial Sequence
  Synthetic
gccgtgctcccggcgctggacggccgggccgccgcctcgggcgcgggcgacgccatggcgcccggcgcgccggac

SEQ ID NO: 157123 - DNA, 75 bp, Artificial Sequence
  Synthetic
gggcgcgccgctgcggcccgtctacgtggcgctggggcgcgacgccgtgcgcggcggcccggcggagctgcgcgg

SEQ ID NO: 157124 - DNA, 75 bp, Artificial Sequence
  Synthetic
gtggcgctggggcgcgacgccgtgcgcggcggcccggcggagctgcgcgggccgcggcgggagttctgcgcgcgg

SEQ ID NO: 157125 - DNA, 75 bp, Artificial Sequence
  Synthetic
cgcggacgcgggcccgcccccgcagatacgctgggcgtcggccgcgggccgcgcggggacggtgctggccgcggc

SEQ ID NO: 157126 - DNA, 75 bp, Artificial Sequence
  Synthetic
cgcggggcgtacccggaccccatggccagcctgtcgccgcgacccccggcgccccgccgacaccaccaccaccac

SEQ ID NO: 157127 - DNA, 75 bp, Artificial Sequence
  Synthetic
cgaggcgcgagcccgtggacatggacgcggagctggaggacgacgacgacggactgtttggggagtgacgggggg

SEQ ID NO: 157128 - DNA, 75 bp, Artificial Sequence
  Synthetic
cgggcgtctgtgcgcctttgagacagacgcggcgatggccgcgcgcgtgtgtgagaaataaagaacgagacagac

SEQ ID NO: 157129 - DNA, 75 bp, Artificial Sequence
  Synthetic
cgggcgggggtcgggcactaactacgggcgggggtcgggcactaaccgggggttcgggggtcgggcactaaccgg

SEQ ID NO: 157130 - DNA, 75 bp, Artificial Sequence
  Synthetic
cgggcggcacgtctcccgcgcccgcggggggtctggggctctgacctgagtgcaggttaccaaggtcaggtggcc

SEQ ID NO: 157131 - DNA, 75 bp, Artificial Sequence
  Synthetic
cgagcccccccgcaggagcgggagggaaggcacggggcgcgggagggaggggctgctgcgagctcggggccgcgg

SEQ ID NO: 157132 - DNA, 75 bp, Artificial Sequence
  Synthetic
cgggaaaaaagccgcgcgggggcgcccgcgggaaggcagccccgcggcgcgcggggggaggggcggcgcccgcgg

SEQ ID NO: 157133 - DNA, 75 bp, Artificial Sequence
  Synthetic
ctcttcctcctccgcctcttcctcctccgcctcttcctcctccgcctcttcctctgcgggcggggctggtgggag

SEQ ID NO: 157134 - DNA, 75 bp, Artificial Sequence
  Synthetic
acggggaagggggcgcgcggggctgccctgccgcccgcccgccgccgccgcccgccttcgcgcccccccccaaaa

SEQ ID NO: 157135 - DNA, 75 bp, Artificial Sequence
  Synthetic
ccctgccgcccgcccgccgccgccgcccgccttcgcgcccccccccaaaaaacaccccccccgggggttgactcc

SEQ ID NO: 157136 - DNA, 75 bp, Artificial Sequence
  Synthetic
ggcgcccgcgggaaggcagccccgcggcgcgcggggggaggggcggcgcccgcgggggagcggccggctccgggg

SEQ ID NO: 157137 - DNA, 75 bp, Artificial Sequence
  Synthetic
gtcgcccatgcaaattaaatacacgacccgcctcgggcctacgcaccctcgcacgtcgcatgcaaattaaaatcg

SEQ ID NO: 157138 - DNA, 75 bp, Artificial Sequence
  Synthetic
gagggaaggcacggggcgcgggagggaggggctgctgcgagctcggggccgcgggcgcggggggaggggcggggg

SEQ ID NO: 157139 - DNA, 75 bp, Artificial Sequence
  Synthetic
gcgccgcgtggcggcggccgaggcggtcatcggaccgtgcctggagcccgaggcccgagctcgggcccgagcccg

SEQ ID NO: 157140 - DNA, 75 bp, Artificial Sequence
  Synthetic
ctccgtcgtcccaggccgcggtcgccgccgccgcctcctcttcctcctccgccgcctcctcttcctcctccgccg

SEQ ID NO: 157141 - DNA, 75 bp, Artificial Sequence
  Synthetic
gggggagacgaggggtcggaatccaaaggacgcagaccacctttggttacggacccctttctcccccccttccga

SEQ ID NO: 157142 - DNA, 75 bp, Artificial Sequence
  Synthetic
tgggggggggtgaccggcgcgtgggggcggtgggcgtatgggcccgacccgcgcctgccccccctgggaacgacg

SEQ ID NO: 157143 - DNA, 75 bp, Artificial Sequence
  Synthetic
ggttttgctaactccggaaaataaacgtgtttttttttatggaacgttccctacctgtcgtgtcatctctcgggg

SEQ ID NO: 157144 - DNA, 75 bp, Artificial Sequence
  Synthetic
cggcgcttccggggtctttccttccttccccgccgcgaccccggccccgccccaccgccccgcccggcagggggg

SEQ ID NO: 157145 - DNA, 75 bp, Artificial Sequence
  Synthetic
gttagtgcccgacccccgcccgacccccgcccgaccccccccgacccccgcccgacccccgcccgacccccgccc

SEQ ID NO: 157146 - DNA, 75 bp, Artificial Sequence
  Synthetic
aagcaacgggaaagagaggcgcgcggaaaagcagcaagaggggggacggggcgagccgggcagagtgcggagccc

SEQ ID NO: 157147 - DNA, 75 bp, Artificial Sequence
  Synthetic
ccctccccaccccacccaccgaccaacgacggcgtttggccaataccctccctttttctttttctcttccccccc

SEQ ID NO: 157148 - DNA, 75 bp, Artificial Sequence
  Synthetic
ggcggtctgggttaccacaacaggtgggtgcttcggggacttgacggtcgccactctcctgcgagccctcacgtc

SEQ ID NO: 157149 - DNA, 75 bp, Artificial Sequence
  Synthetic
gcagagcacgcacgtctggccggccagaccctgggggtggtgggcaggagtgggagggcgcctggctcggggagg

SEQ ID NO: 157150 - DNA, 75 bp, Artificial Sequence
  Synthetic
cccggccgccccgctcccgggcccgaccctcgccccttcccttctcctcgtcttcccccgtcccgccgcgcccct

SEQ ID NO: 157151 - DNA, 75 bp, Artificial Sequence
  Synthetic
gcgacgctcccaccagccccgcccgcagaggaagaggcggaggaggaggaagcagaggaagaggcggaggaggag

SEQ ID NO: 157152 - DNA, 75 bp, Artificial Sequence
  Synthetic
gaccgccgcggggctggccacgccgccgaggcgcgagcccgtggacatggacgcggagctggaggacgacgacga

SEQ ID NO: 157153 - DNA, 75 bp, Artificial Sequence
  Synthetic
gaggaggaggaggaggaggaggaggaggcggcggcgaccgcggcctgggacgacggagacgccgacgggggcgcg

SEQ ID NO: 157154 - DNA, 75 bp, Artificial Sequence
  Synthetic
gggagatggggcgagggggaaggaatcgggcgtctgtgcgcctttaagacagacgcggcgatggccgcgcgcgtg

SEQ ID NO: 157155 - DNA, 75 bp, Artificial Sequence
  Synthetic
ggtcgggcgggggtcggggtcgggcgggggtcggggtcgggcgggggtcggggtcgggcgggcgggggtcgggcg

SEQ ID NO: 157156 - DNA, 75 bp, Artificial Sequence
  Synthetic
tgaccggcgcgtgggggcggtgggcgtatgggcccgacccgcgcctgcccccccgggaacgacgacggggggggg

SEQ ID NO: 157157 - DNA, 75 bp, Artificial Sequence
  Synthetic
cgaacacgccggatccgcgaaaacaacaacaaaacaaacaaaaacagaaacaaaaacgaaaacacctagaaaaaa

SEQ ID NO: 157158 - DNA, 75 bp, Artificial Sequence
  Synthetic
aggatacgggttggctcgcgggcggtgcggctgacctgcctgccctttctgggaccccgcctcgtgtttcttgaa

SEQ ID NO: 157159 - DNA, 75 bp, Artificial Sequence
  Synthetic
cacccgtccccgggggcagagggcgtgcatgcgttgtgattcaaccgccctcgcccccgccccactttcccccct

SEQ ID NO: 157160 - DNA, 75 bp, Artificial Sequence
  Synthetic
caacccctgctctcttctctcttccgcccgccccccccctctcccgccgcctcagcagaagctcacctgtacgac

SEQ ID NO: 157161 - DNA, 75 bp, Artificial Sequence
  Synthetic
ggtgcgactgtcgtctttaggggggcggggagctcgggagtttgtggcggtccgcggagcctgctagtccccgtc

SEQ ID NO: 157162 - DNA, 75 bp, Artificial Sequence
  Synthetic
ggcgggcgcgggcaagcggccccgcggcgcgcggggggaggggcggcgcccgcgggggagcggccggttccgggg

SEQ ID NO: 157163 - DNA, 75 bp, Artificial Sequence
  Synthetic
ctccgaccccctgacgcccctccgaccccctgacgcccctccgaccccctgacgcccctccgaccccctgacccc

SEQ ID NO: 157164 - DNA, 75 bp, Artificial Sequence
  Synthetic
gggggtcggaggggaggcgtaccttcccgcgcggcgcgtccgcgggcggggacgcggggggccgccgccggcgca

SEQ ID NO: 157165 - DNA, 75 bp, Artificial Sequence
  Synthetic
gcggaggaggaggaggaggaagaggaggcggcggcggcgaccgcggcctgggacgacggagacgccgacgggggc

SEQ ID NO: 157166 - DNA, 75 bp, Artificial Sequence
  Synthetic
ccccccctctctctctctctctctctccgccatcctcccgcccggccgcccactccccgctcggtttttccggct

SEQ ID NO: 157167 - DNA, 75 bp, Artificial Sequence
  Synthetic
cgcccgcacacggttccccgccaccccctccctcccctccatcccgccgagctcgcggcagcccctcccccccgc

SEQ ID NO: 157168 - DNA, 75 bp, Artificial Sequence
  Synthetic
ccccgagctcgcagcagcccctccctcccgcgccccgtgccttccctcccgctcctgcgggggggctcgggccac

SEQ ID NO: 157169 - DNA, 75 bp, Artificial Sequence
  Synthetic
gtgccgcccgcccgacccccgcccgacccccgacccccgcccgacccccgacccccgcccgcccgacccccgccc

SEQ ID NO: 157170 - DNA, 75 bp, Artificial Sequence
  Synthetic
ccagcaccccgtgagtcctcggcgggtccctccgcggccgtctctcgttgcccccctttcccccttcccgggtgg

SEQ ID NO: 157171 - DNA, 75 bp, Artificial Sequence
  Synthetic
cccccctttcccccttcccgggtggttcaataaaaaacaccaacatacgatattcgcgtttgatacgtttattgg

SEQ ID NO: 157172 - DNA, 75 bp, Artificial Sequence
  Synthetic
cccacccccccgtggcccggcacggacgacgaggacgatgacctggccgacggtgagggcgggcgggggtcgggc

SEQ ID NO: 157173 - DNA, 75 bp, Artificial Sequence
  Synthetic
acgacgaggacgatgacctggccgacggtgagggcgggcgggggtcgggcactgggcgggggtcgggcactgggc

SEQ ID NO: 157174 - DNA, 75 bp, Artificial Sequence
  Synthetic
cgctatggggttcgtctgtctgtttgggcttgtcgttatgggagcctggggggcgtggggtgggtcacaggcaac

SEQ ID NO: 157175 - DNA, 75 bp, Artificial Sequence
  Synthetic
cgcccgacccccgcccgacccccgcccgacccccgcccgacccccgcccgacccccgcccgacccccgcccgacc

SEQ ID NO: 157176 - DNA, 75 bp, Artificial Sequence
  Synthetic
gcgcccttccgcgtccgcgatgacctcccggcccgccgaccaggactcggtgcgttccagcgcgtcggtgccgct

SEQ ID NO: 157177 - DNA, 75 bp, Artificial Sequence
  Synthetic
caccccccctccccacacacccacccaggactcgccaccacaaggaggcgagagcccgtcgctaacccaaagaca

SEQ ID NO: 157178 - DNA, 75 bp, Artificial Sequence
  Synthetic
gccgggccggggggccgggccggggggacgggccggggggccgggccggggggccgggccggggggccgggccgg

SEQ ID NO: 157179 - DNA, 75 bp, Artificial Sequence
  Synthetic
acggtgacccggggggccggggcggggggccggggcggggggccggggcggggggccggggcggggggccggggc

SEQ ID NO: 157180 - DNA, 75 bp, Artificial Sequence
  Synthetic
gggacggggggggggggacggggggacggggggacggggggggggacggggggacggggggccggggggccgggg

SEQ ID NO: 157181 - DNA, 75 bp, Artificial Sequence
  Synthetic
ggccggggcggggggccggggcggggggccggggggacggggggccggggcggggggccggggcgccgatcccaa

SEQ ID NO: 157182 - DNA, 75 bp, Artificial Sequence
  Synthetic
cggggggccggggcgccgatcccaacatccgcgctttctcgcaggccgggcgccgccttcgtggacgggacaccg

SEQ ID NO: 157183 - DNA, 75 bp, Artificial Sequence
  Synthetic
gctgatctgaatttcccgcagaacctcgaccagtaggtctgttgtgtttgctgggaactcgcccgccgttgggga

SEQ ID NO: 157184 - DNA, 75 bp, Artificial Sequence
  Synthetic
gcccgtccccccgtccccccggcccgtccccccgtccccccggcccgtccccccgtccccccgtccccccgtccc

SEQ ID NO: 157185 - DNA, 75 bp, Artificial Sequence
  Synthetic
ccccgcgggcgccgcccctccccccgcgcgccgcggggccgcttgcccgcgcccgcccccgcgcgccttttttcc

SEQ ID NO: 157186 - DNA, 75 bp, Artificial Sequence
  Synthetic
cccgcgggcgccgcccctccccccgcgcgccgcggggccgcttgcccgcgcccgcccccgcgcgcgccttttttc

SEQ ID NO: 157187 - DNA, 75 bp, Artificial Sequence
  Synthetic
caggccccctcctcactcggctacctcgcggaccaccaaaaactcccgagctccccgccccctaaagacgacagt

SEQ ID NO: 157188 - DNA, 75 bp, Artificial Sequence
  Synthetic
ctggtcccgcaggacgatgtagggcaggggggactcctccaagaactcggccacgccggccgtcgcgtgccgccg

SEQ ID NO: 157189 - DNA, 75 bp, Artificial Sequence
  Synthetic
gaccccgacccccgcccgaccccgacccccgcccgaccccgacccccgcccgaccccgacccccgcccgaccccg

SEQ ID NO: 157190 - DNA, 75 bp, Artificial Sequence
  Synthetic
ccccccgcacaccccggtcggaggcgatgtcggcggagcagcggaagaagaagacgacgacgacgacgcagggcc

SEQ ID NO: 157191 - DNA, 75 bp, Artificial Sequence
  Synthetic
agcgtctcgagcgcgggcggcgacggcgggctcgcgagcccgccgtcgccgccgccctgccctgactgcgggggg

SEQ ID NO: 157192 - DNA, 75 bp, Artificial Sequence
  Synthetic
gaggaggcgggggtgcccgcgagggccccgggggcggcgccccggccgagcccgcccagggccgagcccgccccc

SEQ ID NO: 157193 - DNA, 75 bp, Artificial Sequence
  Synthetic
gcgcgcgccgccgccgaggcggtccgggcccacatcacgaccaactacggcgggacgcgggccggggcgcggctg

SEQ ID NO: 157194 - DNA, 75 bp, Artificial Sequence
  Synthetic
cgcctccaggatcccgcggcaggcggccaggcactccacggccacgcggcccgcctccgcgcgccggccgccgcc

SEQ ID NO: 157195 - DNA, 75 bp, Artificial Sequence
  Synthetic
gtcgcagatggagcgacggccccgcccccggggcctttcccaagccccggcgccccggcgactcccccggaaacc

SEQ ID NO: 157196 - DNA, 75 bp, Artificial Sequence
  Synthetic
cccacccctccacggacaacgacacccccgtcctccccccgagacccgacccccgcccccggggacacagggacg

SEQ ID NO: 157197 - DNA, 75 bp, Artificial Sequence
  Synthetic
attcgggggtcgggcgggggtcgggggtcgggcgggggtcgggcgggggggcgggggtcgggggtcgggcggggg

SEQ ID NO: 157198 - DNA, 75 bp, Artificial Sequence
  Synthetic
gtgccgccccaaacctcgtgacttccccaccgctccgggcggcccgtcccccgcgctcggaagggaggcgtgtcc

SEQ ID NO: 157199 - DNA, 75 bp, Artificial Sequence
  Synthetic
cgcgggggggaggggctgctgcgagatcggcgggatggaggggagggtagggagggggtggcggggaaccgtgtg

SEQ ID NO: 157200 - DNA, 75 bp, Artificial Sequence
  Synthetic
ctgcccggactgcgggggggtatccggtgcgggagggaccgtggcggctatgggcgtcggggaggaggcggggac

SEQ ID NO: 157201 - DNA, 75 bp, Artificial Sequence
  Synthetic
ggagcgggagggaaggcacggggcgcgggagggaggggctgctgcgagctcggcggggcgggcgcggggggaggg

SEQ ID NO: 157202 - DNA, 75 bp, Artificial Sequence
  Synthetic
ccccgcggcgcgcggggggaggggcggcgcccgcgggggagcggccggttccgggggagggacggggaagggggc

SEQ ID NO: 157203 - DNA, 75 bp, Artificial Sequence
  Synthetic
cccgaccccctgaccccccgacccgaccccctgaccccccgacccgaccccctgaccccccgacccgaccccctg

SEQ ID NO: 157204 - DNA, 75 bp, Artificial Sequence
  Synthetic
agtccccgtcctgccgcgcgggggcgggcgcgggaaaaaagccgcgcgggggcggcgggggaaaaaaggcgcgcg

SEQ ID NO: 157205 - DNA, 75 bp, Artificial Sequence
  Synthetic
cgcaggtacggtgacccgggggcgccgggacggggggacgggccggggcggggggacgggccgggacggggggac

SEQ ID NO: 157206 - DNA, 75 bp, Artificial Sequence
  Synthetic
ccccctccccaccccacccaccgaccaacgacggcgtttggccaataccctccttttttctttttctcttccccc

SEQ ID NO: 157207 - DNA, 75 bp, Artificial Sequence
  Synthetic
ccgcgtccccgcccgcggacgcgccgcgcgggaaggtacgcctcccctccgaccccctgacccgaccccctgacc

SEQ ID NO: 157208 - DNA, 75 bp, Artificial Sequence
  Synthetic
gcgccgcgcccccgtcggcgtctccgtcgtcccaggccgcggtcgccgccgccgcctcctcttcctcctccgcct

SEQ ID NO: 157209 - DNA, 75 bp, Artificial Sequence
  Synthetic
gaccctcgccccttcccttctcctcgtcttcccccgtcccgccgcgccccttccctcttccttctctctctctgt

SEQ ID NO: 157210 - DNA, 75 bp, Artificial Sequence
  Synthetic
gtttttgtttttgtttctgtttttgtttgttttgttattattttcgcggatccggcgtgttcggatccacccccc

SEQ ID NO: 157211 - DNA, 75 bp, Artificial Sequence
  Synthetic
tggggggggggggtgaccggcgcgtgggggcggtgggcgtatgggcccgacccgcgcctgcccccccccgggaac

SEQ ID NO: 157212 - DNA, 75 bp, Artificial Sequence
  Synthetic
agcgcggatgttgggatcggcgccccggccccccgccccggccccccggccccccggccccccgccccggccccc

SEQ ID NO: 157213 - DNA, 75 bp, Artificial Sequence
  Synthetic
cccccggccccccgccccggccccccgccccggccccccgtccccccggcccgtccccccggccccccgccccgg

SEQ ID NO: 157214 - DNA, 75 bp, Artificial Sequence
  Synthetic
tccccccggcaccccggccccccggccccccggccccccgccccggccccccgccccggccccccgccccggccc

SEQ ID NO: 157215 - DNA, 75 bp, Artificial Sequence
  Synthetic
tccccccggctccccggccccccggccccccggccccccgccccggccccccgccccggccccccgccccggccc

SEQ ID NO: 157216 - DNA, 75 bp, Artificial Sequence
  Synthetic
tccccccggccccccggccccccggccccccggccccccgccccggccccccgccccggccccccgccccggccc

SEQ ID NO: 157217 - DNA, 75 bp, Artificial Sequence
  Synthetic
tccccccggcgccccggccccccggccccccggccccccgccccggccccccgccccggccccccgccccggccc

SEQ ID NO: 157218 - DNA, 75 bp, Artificial Sequence
  Synthetic
ccgccccggccccccgccccggcccggccccccgccccggccccccggcccggccccccggcccggccccccgcc

SEQ ID NO: 157219 - DNA, 75 bp, Artificial Sequence
  Synthetic
gccgacggtgagggcgggcgggggtcgggcgggggtcgggcgggggtcgggcgggggtcgggcgggggtcgggca

SEQ ID NO: 157220 - DNA, 75 bp, Artificial Sequence
  Synthetic
gtctccgtcgtcccaggccgcggtcgccgccgccgcctcctcttcctcctcctcctcctcctccgccgcctcttc

SEQ ID NO: 157221 - DNA, 75 bp, Artificial Sequence
  Synthetic
gggtggacctcgaacagctgcgccaggtcggcgccggggggctccggggggcggcgggcccccagcgtctcgagc

SEQ ID NO: 157222 - DNA, 75 bp, Artificial Sequence
  Synthetic
ggggcgggcacgagaagccgcccccacccccgaggcctgttggtctttatcatagaacagagccggggcccggcc

SEQ ID NO: 157223 - DNA, 75 bp, Artificial Sequence
  Synthetic
acccccgaggcctgttggtctttatcatagaacagagccggggcccggcctgcgttctggctccctgtcttggtg

SEQ ID NO: 157224 - DNA, 75 bp, Artificial Sequence
  Synthetic
cgacgcgttttgcggggcatgcaagtcgacacaccgcgcgcgtgcctacctttccctagcggccccggcccccgg

SEQ ID NO: 157225 - DNA, 75 bp, Artificial Sequence
  Synthetic
gggtgaccggcgcgtgggggcggtgggcgtatgggcccgacccgcgcctgccccccctgggaacgacgcccccgg

SEQ ID NO: 157226 - DNA, 75 bp, Artificial Sequence
  Synthetic
aacgcggaaccagcggcccccagggggcgctccaaagggtggtcgggcgtctgcgggcgctgctgttccatcatc

SEQ ID NO: 157227 - DNA, 75 bp, Artificial Sequence
  Synthetic
agagagagagaaggaagagggaaggggcgcggcgggacgggggaagacgaggagaagggaaggggcgagggtcgg

SEQ ID NO: 157228 - DNA, 75 bp, Artificial Sequence
  Synthetic
gggctcgggcccgagctcgggcctcgggctccaggcacggtccgatgaccgcctcggccgccgccacgcggcgcc

SEQ ID NO: 157229 - DNA, 75 bp, Artificial Sequence
  Synthetic
gacacgggggtcagggggtcgggtcagggggtcgggtcagggggtcgggtcagggggtcgggtcagggggtcagg

SEQ ID NO: 157230 - DNA, 75 bp, Artificial Sequence
  Synthetic
gcgtgtgtgagaaataaagaacgagacagacgaaaacgtaccgccttgtgtggtttattcgggggtcgggcgggg

SEQ ID NO: 157231 - DNA, 75 bp, Artificial Sequence
  Synthetic
aaccgtgtgcgggcgggcgggtgcttggtgcaactgtctggtctgcgagggcgagcggtggtgcgactgtcgtct

SEQ ID NO: 157232 - DNA, 75 bp, Artificial Sequence
  Synthetic
ccccgacccccgcccgacccccgaataaaccacacaaggcggtacgttttcgtctgtctcgttctttatttctca

SEQ ID NO: 157233 - DNA, 75 bp, Artificial Sequence
  Synthetic
caccgccgccaccccccaaacagccaaggcgcggtggggggcgtggtggtgaacgatgggggaaacacggggggg

SEQ ID NO: 157234 - DNA, 75 bp, Artificial Sequence
  Synthetic
acatcgccatacgtccggtgtgtgcaccgcgaagaatccagaaacatgtccgtcgttttcagggcccaagacatc

SEQ ID NO: 157235 - DNA, 75 bp, Artificial Sequence
  Synthetic
cgtcgttttcagggcccaagacatccccccgtcccgtccccccgtcccgtcccggcccgtcccgtccccccgtcc

SEQ ID NO: 157236 - DNA, 75 bp, Artificial Sequence
  Synthetic
cggtcgccgccgccgccgccgccgccgcctcctcctcctcctcctcctccgcctccgcctccgcctccgcctccg

SEQ ID NO: 157237 - DNA, 75 bp, Artificial Sequence
  Synthetic
agccagacgcgagtgtgggacgacacgcccgcagcccccccccgccatggcgggggggaagccttactgtttatt

SEQ ID NO: 157238 - DNA, 75 bp, Artificial Sequence
  Synthetic
gggcgggggtcgggcgggggtcggggtcgggcgggggtcggggtcgggcgggggtcggggtcgggcgggggtcgg

SEQ ID NO: 157239 - DNA, 75 bp, Artificial Sequence
  Synthetic
gtcgggcgggggtcggggtcgggcgggggtcggggtcgggcgggggtcggggtcgggcgggggtcggggtcgggc

SEQ ID NO: 157240 - DNA, 75 bp, Artificial Sequence
  Synthetic
ggagtttttggtggtccgcgaggtagccgagtgaggagggggcctgctgtggcacagcctgctagtccccgtcct

SEQ ID NO: 157241 - DNA, 75 bp, Artificial Sequence
  Synthetic
gggacgggccggggggacgggccggggggacgggccggggggacggggcggggggacgggacggggggacggggg

SEQ ID NO: 157242 - DNA, 75 bp, Artificial Sequence
  Synthetic
gggacgggccggggggacgggccggggggacgggccggggggacggggcggggggacgggtcggggggacggggg

SEQ ID NO: 157243 - DNA, 75 bp, Artificial Sequence
  Synthetic
gggacgggccggggggacgggccggggggacgggccggggggacggggcggggggacgggccggggggacggggg

SEQ ID NO: 157244 - DNA, 75 bp, Artificial Sequence
  Synthetic
gggacgggccggggggacgggccggggggacgggccggggggacggggcggggggacggggcggggggacggggg

SEQ ID NO: 157245 - DNA, 75 bp, Artificial Sequence
  Synthetic
ggacggggggacggggggacgggacggggggacggggggacgggccggggggacggggggacgggccggggggac

SEQ ID NO: 157246 - DNA, 75 bp, Artificial Sequence
  Synthetic
ggacggggggacggggggacgggtcggggggacggggggacgggccggggggacggggggacgggccggggggac

SEQ ID NO: 157247 - DNA, 75 bp, Artificial Sequence
  Synthetic
ggacggggggacggggggacgggccggggggacggggggacgggccggggggacggggggacgggccggggggac

SEQ ID NO: 157248 - DNA, 75 bp, Artificial Sequence
  Synthetic
ggacggggggacggggggacggggcggggggacggggggacgggccggggggacggggggacgggccggggggac

SEQ ID NO: 157249 - DNA, 75 bp, Artificial Sequence
  Synthetic
ccccccctctcccgccgcctcagcagaagctcacctgtacgaccctaaacctacctgcgagaacgcgcggcgttc

SEQ ID NO: 157250 - DNA, 75 bp, Artificial Sequence
  Synthetic
cggagcctgggtcccccggcggacggctcacgcggcgcggcgtctcggtgggacgcgggcagagggcggcggcgg

SEQ ID NO: 157251 - DNA, 75 bp, Artificial Sequence
  Synthetic
cctcgcacgtcgcatgcaaattaaaatcgcgcgcagagccgatccggcctcgggcctgcttgcccctcccccggc

SEQ ID NO: 157252 - DNA, 75 bp, Artificial Sequence
  Synthetic
gtcgcccaaccgaggtccccgtgcacagaccgcgccttttatagccccgggggttgttaattaacgcacgcatgc

SEQ ID NO: 157253 - DNA, 75 bp, Artificial Sequence
  Synthetic
agggagaagagaagacccgaggcatgcacccgcacttacgcccgtgcccacccccgccccggcgcccaccccgcc

SEQ ID NO: 157254 - DNA, 75 bp, Artificial Sequence
  Synthetic
cggatccggcgtgttcggatccaccccccctttctccttcctcttcccttccacccacccccgtttccccccccc

SEQ ID NO: 157255 - DNA, 75 bp, Artificial Sequence
  Synthetic
catctacgacacgcaaggggcggccatcgccggctccaacctctgcaccgagatcgtccacccggcctccaagcg

SEQ ID NO: 157256 - DNA, 75 bp, Artificial Sequence
  Synthetic
gggggggtggatccgaacacgccggatccgcgaaaataataacaaaacaaacaaaaacagaaacaaaaacaaaaa

SEQ ID NO: 157257 - DNA, 75 bp, Artificial Sequence
  Synthetic
ccaggcagacgtttgactttgggcggctccgcgacgccgtgcaggcgtgcgtgctgatggtgaacatcatgatcg

SEQ ID NO: 157258 - DNA, 75 bp, Artificial Sequence
  Synthetic
gctccgcgacgccgtgcaggcgtgcgtgctgatggtgaacatcatgatcgacagcacgctacaacccacgcccca

SEQ ID NO: 157259 - DNA, 75 bp, Artificial Sequence
  Synthetic
gcctgcacacggcctgcctgaagctggggctggatctggagtctgccgaatttcaggacctgaacaaacacatcg

SEQ ID NO: 157260 - DNA, 75 bp, Artificial Sequence
  Synthetic
gaagaccagcaacgcgctgtgcgttcgcggggcccgtcccttcaaccactttaagcgcagcatgtatcgcgccgg

SEQ ID NO: 157261 - DNA, 75 bp, Artificial Sequence
  Synthetic
gggccgggcccggccgccggttgtcttcttttccaccccttccgtcccccgtacccaccacaccccaccccaccc

SEQ ID NO: 157262 - DNA, 75 bp, Artificial Sequence
  Synthetic
ggcatcggggcgcgagatacccgaggggatcgcgatgtctgcttcgaaacaatccgtgatcatggcgccgggccg

SEQ ID NO: 157263 - DNA, 75 bp, Artificial Sequence
  Synthetic
cgagacaccggaacgcgggggtgcgggagggccggaaagcgcaacgcaaccgggacgatgatgaaacagagatgg

SEQ ID NO: 157264 - DNA, 75 bp, Artificial Sequence
  Synthetic
ggggggacggggggacgggcggggggacggggggccggggggacgggccggggggacggggggacgggccggggg

SEQ ID NO: 157265 - DNA, 75 bp, Artificial Sequence
  Synthetic
gggagagggaaagcaacgggaaagagaggcgcgcggaaaagcagcaagaggggggacggggcgagccgggcagag

SEQ ID NO: 157266 - DNA, 75 bp, Artificial Sequence
  Synthetic
gccagcggcccacgcctcccgccgcattaggcccccgcgggcatccggcggccggccccacgcccttccattaag

SEQ ID NO: 157267 - DNA, 75 bp, Artificial Sequence
  Synthetic
ccccacccaccgaccaacgacggcgtttggccaataccctccttttttctttttctcttccccccccccccaaaa

SEQ ID NO: 157268 - DNA, 75 bp, Artificial Sequence
  Synthetic
cccccccaacaaccccaaaggcgcgtgcccagccacagccgtgggtgtggcgcccgtccccttcctctaccgcgt

SEQ ID NO: 157269 - DNA, 75 bp, Artificial Sequence
  Synthetic
ttttttttttctctgtttgttactttttattgaaaacagacatgcggggaaaggggccggaaaccgagacggtgg

SEQ ID NO: 157270 - DNA, 75 bp, Artificial Sequence
  Synthetic
cccacgtccgtatgttaattgcaataaagtggttgattgtcattacggtctactaggttgtctttttttttgggg

SEQ ID NO: 157271 - DNA, 75 bp, Artificial Sequence
  Synthetic
gggggcgggcgggacgtagtccactgcagagggagacagagacgggaaacccccggttagtgcccgacccccggt

SEQ ID NO: 157272 - DNA, 75 bp, Artificial Sequence
  Synthetic
ggatcggggtcccgtccccccggcccgtccccccgtccccccggcccgtccccccgaccccccggcccgtccccc

SEQ ID NO: 157273 - DNA, 75 bp, Artificial Sequence
  Synthetic
ggatcggggtcccgtccccccggcccgtccccccgtccccccggcccgtccccccgtccccccggcccgtccccc

SEQ ID NO: 157274 - DNA, 75 bp, Artificial Sequence
  Synthetic
ggatcggggtcccgtccccccggcccgtccccccgtccccccggcccgtccccccgcccccccggcccgtccccc

SEQ ID NO: 157275 - DNA, 75 bp, Artificial Sequence
  Synthetic
ggatcggggtcccgtccccccggcccgtccccccgtccccccggcccgtccccccggccccccggcccgtccccc

SEQ ID NO: 157276 - DNA, 75 bp, Artificial Sequence
  Synthetic
caccctgtacgtaccacgaggacccatccacccactgcagccttatcgcaggtacggtgacccgggccgggggga

SEQ ID NO: 157277 - DNA, 75 bp, Artificial Sequence
  Synthetic
gccccaaacctcgtgacttccccaccgctccgggcggcccgtcccccgcgcccggaagggaggcgtgtccttcct

SEQ ID NO: 157278 - DNA, 75 bp, Artificial Sequence
  Synthetic
acggggggacggggggacggggggacgggacggggggacggggggacggggcggggggccggggggacgggccgg

SEQ ID NO: 157279 - DNA, 75 bp, Artificial Sequence
  Synthetic
acgtagtccgctgcagagggagacagagacgggaacccccggttagtgcccgacccccgcccgacccccgcccga

SEQ ID NO: 157280 - DNA, 75 bp, Artificial Sequence
  Synthetic
aatccaagcgaccccgaatcaacctgcgattaacgagctcccccgaccggcgcgcgggtgtggttttccccgagg

SEQ ID NO: 157281 - DNA, 75 bp, Artificial Sequence
  Synthetic
ggcgcgaaggcgggcggcggcggcgggcgggcggcagggcggccccgcccgccgccttccccgcgcctcccccgg

SEQ ID NO: 157282 - DNA, 75 bp, Artificial Sequence
  Synthetic
tctcacacacgcgcgcggccatcgccgcgtctgtctcaaaggcgcacagacgcccgattccttccccctctcccc

SEQ ID NO: 157283 - DNA, 75 bp, Artificial Sequence
  Synthetic
gtcgccccccccggagcgcgacggcgcggaagaagaagcggcccgctcgccttctccgccgcggaccccctccat

SEQ ID NO: 157284 - DNA, 75 bp, Artificial Sequence
  Synthetic
ccgccgctccgtcgctcgcagtgccggggtgcgaatgcggcccgaccgtcacacggggctgccttatacccggcg

SEQ ID NO: 157285 - DNA, 75 bp, Artificial Sequence
  Synthetic
tcgtcgtcgtcgtcgtcgttctcctcgccataatcggcgcgcatggagggggtccgcggcggagaaggcgagcgg

SEQ ID NO: 157286 - DNA, 75 bp, Artificial Sequence
  Synthetic
cggcgctcaggcgccccagggcggcgagcacccccgcggcgccgtagccggcgggcaccgcgcgctcgtcggccg

SEQ ID NO: 157287 - DNA, 75 bp, Artificial Sequence
  Synthetic
ccggaagactaccacggggagggggtgtggaaagcgaccggtcgcagggagacggggttggtttggggttggttt

SEQ ID NO: 157288 - DNA, 75 bp, Artificial Sequence
  Synthetic
ggggtggcggggaaccgtgtgcgggcgggcgggtgcttggtgcaactgtgtggtctgcgagggcgagcggtggtg

SEQ ID NO: 157289 - DNA, 75 bp, Artificial Sequence
  Synthetic
gcctttccctccccccccccccccaccctgtacggaccgcaaggacccatccacccactgcagccttatcgcagg

SEQ ID NO: 157290 - DNA, 75 bp, Artificial Sequence
  Synthetic
gactcccgccccgcctcttttcccccggggagtcaacccccgggggggtgttttttggggggggcgcgaaggcgg

SEQ ID NO: 157291 - DNA, 75 bp, Artificial Sequence
  Synthetic
ttttttggggggggcgcgaaggcgggcggcggcggcgggcgggcggcagggcagccccgcccgcccccttccccg

SEQ ID NO: 157292 - DNA, 75 bp, Artificial Sequence
  Synthetic
ccccgccccctaaagacgacagtcgcaccaccgctcgccctcgcagaccacacagtagcaccaagcacccgcccg

SEQ ID NO: 157293 - DNA, 75 bp, Artificial Sequence
  Synthetic
ctccctaccctcccctccatcccgccgagctcgcagcagcccctcccccccgcgcgccgcagggctgctttcccg

SEQ ID NO: 157294 - DNA, 75 bp, Artificial Sequence
  Synthetic
ccccgcgccccgccccgggggcttcccccgcccctccccccgcgcccgcggccccgagctcgcagcagcccctcc

SEQ ID NO: 157295 - DNA, 75 bp, Artificial Sequence
  Synthetic
ccccggcccgtccccccgtccccccggcccgtccccccgtcccccccccgtcccgtccccccgtccccccgtccc

SEQ ID NO: 157296 - DNA, 75 bp, Artificial Sequence
  Synthetic
ccccgacccccgcccgaccccgacccccgcccgaccccgacccccgcccgacccccgaataaaccacacaaggcg

SEQ ID NO: 157297 - DNA, 75 bp, Artificial Sequence
  Synthetic
ccccttccgccccacctggccctacggctgcgcaccacgacggagtacctggcgcgcctgagcctgcgccggcgg

SEQ ID NO: 157298 - DNA, 75 bp, Artificial Sequence
  Synthetic
ggcgcgcctgagcctgcgccggcggccccccgcgtccccgcccgcggacgcgccgcgcgggaaggtgcgcctccc

SEQ ID NO: 157299 - DNA, 75 bp, Artificial Sequence
  Synthetic
ccccccgcgtccccgcccgcggacgcgccgcgcgggaaggtgcgcctcccctccgacccctcccctccgaccccc

SEQ ID NO: 157300 - DNA, 75 bp, Artificial Sequence
  Synthetic
cgccgcgcgggaaggtgcgcctcccctccgacccctcccctccgaccccccgacccgacccctcccctctgacgc

SEQ ID NO: 157301 - DNA, 75 bp, Artificial Sequence
  Synthetic
cggcatcgcgaagggggccacagcgagacagagacgccggcggcgagcggggcaccgacgcacccggatcggatc

SEQ ID NO: 157302 - DNA, 75 bp, Artificial Sequence
  Synthetic
ggccggggcggggggccggggagccggggggccggggcgccggggggacggggggacggggggacggggacgggg

SEQ ID NO: 157303 - DNA, 75 bp, Artificial Sequence
  Synthetic
ggccggggcggggggccggggtgccggggggccggggcgccggggggacggggggacggggggacggggacgggg

SEQ ID NO: 157304 - DNA, 75 bp, Artificial Sequence
  Synthetic
ggccggggcggggggccggggcgccggggggccggggcgccggggggacggggggacggggggacggggacgggg

SEQ ID NO: 157305 - DNA, 75 bp, Artificial Sequence
  Synthetic
ggccggggcggggggccggggggccggggggccggggcgccggggggacggggggacggggggacggggacgggg

SEQ ID NO: 157306 - DNA, 75 bp, Artificial Sequence
  Synthetic
ccaccggccccgcgtccgacacaacaaacacgaccgcacgcctccccacgccccccccactcatccgctccgggg

SEQ ID NO: 157307 - DNA, 75 bp, Artificial Sequence
  Synthetic
ggaagaggcggaggaggaggaggaggaagaggaggcggcggaggaggaagaggcggcggaggaggaagaggaggc

SEQ ID NO: 157308 - DNA, 75 bp, Artificial Sequence
  Synthetic
tcgggtactgggcgggggtcgggcactgggcgggggtcgggcactgggcgggggtcgggcactgggcgggggtcg

SEQ ID NO: 157309 - DNA, 75 bp, Artificial Sequence
  Synthetic
gaccaccgccacgcccggaacccggggcactgcccgtacccccccaacggacccaaagacgcacccacacggacc

SEQ ID NO: 157310 - DNA, 75 bp, Artificial Sequence
  Synthetic
caacgacggcgtttggccaataccctccttttttctttttctctttcccccccaaaaaaaaacaataaacagcta

SEQ ID NO: 157311 - DNA, 75 bp, Artificial Sequence
  Synthetic
gaggaggcggatgcagacgaggaggaggaggcggaggaggaggcggaggacgccgacgacgaggatccggatttt

SEQ ID NO: 157312 - DNA, 75 bp, Artificial Sequence
  Synthetic
ggacacggccccgaacagcaacacacaccagcattttgttatggactttctggccttgttgaaaacttgaggaaa

SEQ ID NO: 157313 - DNA, 75 bp, Artificial Sequence
  Synthetic
cgtcgtcatcgtcgtcgtcgtcgttctcctcgccataatcggcgcgcatggagggggtccgcggcggagaaggcg

SEQ ID NO: 157314 - DNA, 75 bp, Artificial Sequence
  Synthetic
attaaaatcgtgcacagagccgatccggcctcgggtctgcttgcccctcccccggcccagcacaggcaggctcgt

SEQ ID NO: 157315 - DNA, 75 bp, Artificial Sequence
  Synthetic
gcctgctagtccccgtcctgccgcgcgggggcgggcgcgggaaaaaagccgcgcgggggcgcccgcgggaaggca

SEQ ID NO: 157316 - DNA, 75 bp, Artificial Sequence
  Synthetic
cccccccggccccccgccccggccccccgtccccccggccccccgtcccccccgtccccccgtccccccggaccc

SEQ ID NO: 157317 - DNA, 75 bp, Artificial Sequence
  Synthetic
cccccccggccccccgccccggccccccgtccccccggccccccgtcccccccgtccccccgtccccccggtccc

SEQ ID NO: 157318 - DNA, 75 bp, Artificial Sequence
  Synthetic
cccccccggccccccgccccggccccccgtccccccggccccccgtcccccccgtccccccgtccccccggcccc

SEQ ID NO: 157319 - DNA, 75 bp, Artificial Sequence
  Synthetic
cccccccggccccccgccccggccccccgtccccccggccccccgtcccccccgtccccccgtccccccgggccc

SEQ ID NO: 157320 - DNA, 75 bp, Artificial Sequence
  Synthetic
cccgtccccccggccccccgtcccccccgtccccccgtccccccggacccccggccccccggccccccggccccc

SEQ ID NO: 157321 - DNA, 75 bp, Artificial Sequence
  Synthetic
cccgtccccccggccccccgtcccccccgtccccccgtccccccggtcccccggccccccggccccccggccccc

SEQ ID NO: 157322 - DNA, 75 bp, Artificial Sequence
  Synthetic
cccgtccccccggccccccgtcccccccgtccccccgtccccccggccccccggccccccggccccccggccccc

SEQ ID NO: 157323 - DNA, 75 bp, Artificial Sequence
  Synthetic
cccgtccccccggccccccgtcccccccgtccccccgtccccccgggcccccggccccccggccccccggccccc

SEQ ID NO: 157324 - DNA, 75 bp, Artificial Sequence
  Synthetic
ggacgggccggggggccgggacggggggacgggccggggggccgggacggggggacgggacggggggacgggccg

SEQ ID NO: 157325 - DNA, 75 bp, Artificial Sequence
  Synthetic
gacggggggacggggggacggggggacgggccggggggacggggggacgggccggggggacggggggacgggccg

SEQ ID NO: 157326 - DNA, 75 bp, Artificial Sequence
  Synthetic
gacggggggacggggggtcggggggacgggccggggggacggggggacgggccggggggacggggggacgggccg

SEQ ID NO: 157327 - DNA, 75 bp, Artificial Sequence
  Synthetic
gacggggggacggggggccggggggacgggccggggggacggggggacgggccggggggacggggggacgggccg

SEQ ID NO: 157328 - DNA, 75 bp, Artificial Sequence
  Synthetic
gacggggggacgggggggcggggggacgggccggggggacggggggacgggccggggggacggggggacgggccg

SEQ ID NO: 157329 - DNA, 75 bp, Artificial Sequence
  Synthetic
ggggggcaagtgcagtaacccagttcctcagtgtttgggaaatctattgaactctcccggctcctccgtgttagg

SEQ ID NO: 157330 - DNA, 75 bp, Artificial Sequence
  Synthetic
gagagagaaaaaaaaaagcgaccccacctccccgcgcgtttgcggggcgaccatcgggggggatgggattttttg

SEQ ID NO: 157331 - DNA, 75 bp, Artificial Sequence
  Synthetic
ccgggaaacccccccccgccagcctttaacaaaacccgcgccttttgcgtccacccctcgtttactgctcggatg

SEQ ID NO: 157332 - DNA, 75 bp, Artificial Sequence
  Synthetic
ttaacaaaacccgcgccttttgcgtccacccctcgtttactgctcggatggcgaccgtgcactactcccgccgac

SEQ ID NO: 157333 - DNA, 75 bp, Artificial Sequence
  Synthetic
ccacccctcgtttactgctcggatggcgaccgtgcactactcccgccgacctgggaccccgccggtcaccctcac

SEQ ID NO: 157334 - DNA, 75 bp, Artificial Sequence
  Synthetic
gcgacccccatcccctacctacccacatacgccgaggccgtggcagacgcgccccccccttacagaagccgcgag

SEQ ID NO: 157335 - DNA, 75 bp, Artificial Sequence
  Synthetic
catacgccgaggccgtggcagacgcgccccccccttacagaagccgcgagagtctggtgttctccccgcctcttt

SEQ ID NO: 157336 - DNA, 75 bp, Artificial Sequence
  Synthetic
ccaacagtcttacgattgcctagactgcgcttatgatggaatccacagacttcagctggcttttctaagaattcg

SEQ ID NO: 157337 - DNA, 75 bp, Artificial Sequence
  Synthetic
tgcgcttatgatggaatccacagacttcagctggcttttctaagaattcgcaaatgctgtgtaccggctttttta

SEQ ID NO: 157338 - DNA, 75 bp, Artificial Sequence
  Synthetic
ctgctgtcgtggtcgccattgttgccgtttttcccgaggaacctcccaactcaactacatgaaactactgtccgg

SEQ ID NO: 157339 - DNA, 75 bp, Artificial Sequence
  Synthetic
cgtttttcccgaggaacctcccaactcaactacatgaaactactgtccggaaggggaaggtatttattctcgctt

SEQ ID NO: 157340 - DNA, 75 bp, Artificial Sequence
  Synthetic
acaaaagctatatatgtcaccaaagccaacgtcgccatctggagtactacacccagtacgttgcataacctgtcc

SEQ ID NO: 157341 - DNA, 75 bp, Artificial Sequence
  Synthetic
gtggcgacgcgttgttctgcataagctctgtatgctgatacataaacacagagtctgtatcgctatcagattccc

SEQ ID NO: 157342 - DNA, 75 bp, Artificial Sequence
  Synthetic
ctctgtatgctgatacataaacacagagtctgtatcgctatcagattcccgaacaccttccggtaccccatactc

SEQ ID NO: 157343 - DNA, 75 bp, Artificial Sequence
  Synthetic
aaaaatataatattaacaggatttgcttatactttgctacagcttatataaatttatgtgcgatacatcttaagt

SEQ ID NO: 157344 - DNA, 75 bp, Artificial Sequence
  Synthetic
cttatactttgctacagcttatataaatttatgtgcgatacatcttaagtgcatccgtacgttatttatacattg

SEQ ID NO: 157345 - DNA, 75 bp, Artificial Sequence
  Synthetic
cccaataaaggttctacaaaaaatgctttattgggtgtttgtttaatagctattatcgtaacccacccccgtaaa

SEQ ID NO: 157346 - DNA, 75 bp, Artificial Sequence
  Synthetic
ctttattgggtgtttgtttaatagctattatcgtaacccacccccgtaaaatcataaaatgcatgtaatttctga

SEQ ID NO: 157347 - DNA, 75 bp, Artificial Sequence
  Synthetic
gcatttattatgggctccactctggtgcgtcccagtttaaacgccaccgccgaggaaaatcccgcgtcagaaacg

SEQ ID NO: 157348 - DNA, 75 bp, Artificial Sequence
  Synthetic
tgcgtcccagtttaaacgccaccgccgaggaaaatcccgcgtcagaaacgcgatgtttattacgagtgcttgcgg

SEQ ID NO: 157349 - DNA, 75 bp, Artificial Sequence
  Synthetic
aggaacgttacacattacctgtaccaaaacctatgtaattattggcaaatatagcaaacccggcgaacgtcttag

SEQ ID NO: 157350 - DNA, 75 bp, Artificial Sequence
  Synthetic
aaaacctatgtaattattggcaaatatagcaaacccggcgaacgtcttagccttgcccgtctaatagggcgtgca

SEQ ID NO: 157351 - DNA, 75 bp, Artificial Sequence
  Synthetic
ttattattttggcgatgaaggaaaagcgatccacaacgcttgggtatgaatgtggtacgggcttgcatttactgg

SEQ ID NO: 157352 - DNA, 75 bp, Artificial Sequence
  Synthetic
gcgatccacaacgcttgggtatgaatgtggtacgggcttgcatttactggctccatctatgggtacatttctccg

SEQ ID NO: 157353 - DNA, 75 bp, Artificial Sequence
  Synthetic
ctctgtttatggcggggtaatatttatgatatgcatatgcaacgtcttatgttttgggagaatatcgcgcaaaat

SEQ ID NO: 157354 - DNA, 75 bp, Artificial Sequence
  Synthetic
atgatatgcatatgcaacgtcttatgttttgggagaatatcgcgcaaaataccactgaaacaccttgtataacgt

SEQ ID NO: 157355 - DNA, 75 bp, Artificial Sequence
  Synthetic
agactctggtgaagccgcacttaccacgtcagaccgacccactctcccaaccctaacagcccaaggaagaccaac

SEQ ID NO: 157356 - DNA, 75 bp, Artificial Sequence
  Synthetic
cgattgtacgtatttttatttaaatgtgtagttcatagtccgccgacagccgctcgggcttttcccccacataca

SEQ ID NO: 157357 - DNA, 75 bp, Artificial Sequence
  Synthetic
gtgtagttcatagtccgccgacagccgctcgggcttttcccccacatacaacatgatcgtatgcctcggatgcac

SEQ ID NO: 157358 - DNA, 75 bp, Artificial Sequence
  Synthetic
ggatttacaatgacagtgatacccaatagccgccagatgtacacccagctgtccggactccagcatcatctgctg

SEQ ID NO: 157359 - DNA, 75 bp, Artificial Sequence
  Synthetic
atagccgccagatgtacacccagctgtccggactccagcatcatctgctgagttgcggcgctgaagggtgcatcg

SEQ ID NO: 157360 - DNA, 75 bp, Artificial Sequence
  Synthetic
ccggtaacagtcgttgggaatttaggaggctgcaaaacggctgtaggtcaacatacattggggattcagatggtt

SEQ ID NO: 157361 - DNA, 75 bp, Artificial Sequence
  Synthetic
gaggctgcaaaacggctgtaggtcaacatacattggggattcagatggtttatctcgacgtccaagtccaatcaa

SEQ ID NO: 157362 - DNA, 75 bp, Artificial Sequence
  Synthetic
ccgcatgttgctcgaagagcacataacctcttaacaccgtacagaggggatggcgtcggtgcatgtgagttggca

SEQ ID NO: 157363 - DNA, 75 bp, Artificial Sequence
  Synthetic
acctcttaacaccgtacagaggggatggcgtcggtgcatgtgagttggcagggcatgtccacgttgtttccaacg

SEQ ID NO: 157364 - DNA, 75 bp, Artificial Sequence
  Synthetic
cgacgccaacgggtcaggtttaagattcactcggatgggttgactgctttcggaagctcccgttgtatccattaa

SEQ ID NO: 157365 - DNA, 75 bp, Artificial Sequence
  Synthetic
ttcactcggatgggttgactgctttcggaagctcccgttgtatccattaattaaacgttcggtacacgtctggtg

SEQ ID NO: 157366 - DNA, 75 bp, Artificial Sequence
  Synthetic
aattgcaaagatattggtttgaaagcaatgtaatcccgcccatatatccccaacgtcgccttaaaaactcccaca

SEQ ID NO: 157367 - DNA, 75 bp, Artificial Sequence
  Synthetic
ttaatatagaatcacataaacaattgataaaatcaaggggtgatgtataatgattaaaaatataaattgatatgt

SEQ ID NO: 157368 - DNA, 75 bp, Artificial Sequence
  Synthetic
tgattaaaaatataaattgatatgttttacaagcatgaaataggtatttactattctaacaggtaaatatgctta

SEQ ID NO: 157369 - DNA, 75 bp, Artificial Sequence
  Synthetic
tttacaagcatgaaataggtatttactattctaacaggtaaatatgcttaatgattaaaaatacaaattagtatg

SEQ ID NO: 157370 - DNA, 75 bp, Artificial Sequence
  Synthetic
ttttattttagcagttaaaggtactacacttaaaatatttaccgtatggacgggcgtcagaaagatgcccggccc

SEQ ID NO: 157371 - DNA, 75 bp, Artificial Sequence
  Synthetic
acacttaaaatatttaccgtatggacgggcgtcagaaagatgcccggcccaagttgagagggtacattcaacacg

SEQ ID NO: 157372 - DNA, 75 bp, Artificial Sequence
  Synthetic
agggcctctaaaacaccggccagacatgacccgggtgtatattcttgtaacacttgaacgttacaactgatatca

SEQ ID NO: 157373 - DNA, 75 bp, Artificial Sequence
  Synthetic
atgacccgggtgtatattcttgtaacacttgaacgttacaactgatatcatcatattccacaaatttagagccac

SEQ ID NO: 157374 - DNA, 75 bp, Artificial Sequence
  Synthetic
aatcataacaaacatataagtagtaatacacgtgatatcactaaaacgttgctggcgcaacagttcggggagagt

SEQ ID NO: 157375 - DNA, 75 bp, Artificial Sequence
  Synthetic
atacacgtgatatcactaaaacgttgctggcgcaacagttcggggagagtacgagaccccaaatcgttgtccctg

SEQ ID NO: 157376 - DNA, 75 bp, Artificial Sequence
  Synthetic
gccccagctttaactttaaattctccaaaagtgacttcgaggttgcaacaatgggattatttgtgtagatgggca

SEQ ID NO: 157377 - DNA, 75 bp, Artificial Sequence
  Synthetic
caaaagtgacttcgaggttgcaacaatgggattatttgtgtagatgggcaagttttttgccgctaacattttaat

SEQ ID NO: 157378 - DNA, 75 bp, Artificial Sequence
  Synthetic
tccaacgcttcaatcaaagattctccacgtatgactctctcacgcaacgcgcgggcaatacgtgagtccatttta

SEQ ID NO: 157379 - DNA, 75 bp, Artificial Sequence
  Synthetic
cacgtatgactctctcacgcaacgcgcgggcaatacgtgagtccattttatatgactcaaaggtacgataaagtt

SEQ ID NO: 157380 - DNA, 75 bp, Artificial Sequence
  Synthetic
ccaagatgtgttttgttttatccccggaaaacatccaccggaagcccatgaatcaccctcttgtattgtggcata

SEQ ID NO: 157381 - DNA, 75 bp, Artificial Sequence
  Synthetic
ggaaaacatccaccggaagcccatgaatcaccctcttgtattgtggcatatcggactaccagtttttcaattgtt

SEQ ID NO: 157382 - DNA, 75 bp, Artificial Sequence
  Synthetic
tggtcacgctggctcccgcggtggagacgacttcaatagcacggcccgtaattcgatcgaccgggatatcatact

SEQ ID NO: 157383 - DNA, 75 bp, Artificial Sequence
  Synthetic
gacgacttcaatagcacggcccgtaattcgatcgaccgggatatcatactcttttcgaatacgctctcggcgggc

SEQ ID NO: 157384 - DNA, 75 bp, Artificial Sequence
  Synthetic
tacgattcgtcatgtgtctgatcatttctttctcccgtggtcattgcaggaggcgttgtaggacgccgtcttcga

SEQ ID NO: 157385 - DNA, 75 bp, Artificial Sequence
  Synthetic
ttctttctcccgtggtcattgcaggaggcgttgtaggacgccgtcttcgatttgacagggatcgatcacggtgtt

SEQ ID NO: 157386 - DNA, 75 bp, Artificial Sequence
  Synthetic
tctggatgatcgtcgatgtccccgttcgatgcgtgcatatccagtctccacgtctcttcctccatgatggtttga

SEQ ID NO: 157387 - DNA, 75 bp, Artificial Sequence
  Synthetic
tcgatgcgtgcatatccagtctccacgtctcttcctccatgatggtttgaatcgggtaatacaacaaccaaagtt

SEQ ID NO: 157388 - DNA, 75 bp, Artificial Sequence
  Synthetic
cacgccttccgtgccttcgtttggaataccgtggattatatgctgtatctgcagtacgctccacatacacagttc

SEQ ID NO: 157389 - DNA, 75 bp, Artificial Sequence
  Synthetic
ataccgtggattatatgctgtatctgcagtacgctccacatacacagttctagacgttgtggagtcctcgcctgg

SEQ ID NO: 157390 - DNA, 75 bp, Artificial Sequence
  Synthetic
gcccaatcggtgacttccaatgcaaagtcatccgaaggttcgtctggtagcaaattcataaagtcttcacaaata

SEQ ID NO: 157391 - DNA, 75 bp, Artificial Sequence
  Synthetic
agtcatccgaaggttcgtctggtagcaaattcataaagtcttcacaaatagtagacacgtctgggtcggttggaa

SEQ ID NO: 157392 - DNA, 75 bp, Artificial Sequence
  Synthetic
atatctgacaattgcgtgtttgcagttgcctgtatcttccgccaatgttgtagaatttataggctcacccaaccc

SEQ ID NO: 157393 - DNA, 75 bp, Artificial Sequence
  Synthetic
ttgcctgtatcttccgccaatgttgtagaatttataggctcacccaaccccgcaatgggcgtgtttagtcacatg

SEQ ID NO: 157394 - DNA, 75 bp, Artificial Sequence
  Synthetic
ttccccaaacaagcttacctgcaccctttgttcgtaatgcataaaaataaccactgctatagcaaatatgacgat

SEQ ID NO: 157395 - DNA, 75 bp, Artificial Sequence
  Synthetic
ctttgttcgtaatgcataaaaataaccactgctatagcaaatatgacgatataaaaacattttatagcaaggccg

SEQ ID NO: 157396 - DNA, 75 bp, Artificial Sequence
  Synthetic
cagcccgcgcagcccgtccagcccgcgcagcccgcgcagcccgcgcagcccgcgcagcccgcgcagcccgtccag

SEQ ID NO: 157397 - DNA, 75 bp, Artificial Sequence
  Synthetic
cccgtccagcccgtccagcccgcgcagcccgtccagcccgtccagcccgtccagcccgcgcagcccgtccagccc

SEQ ID NO: 157398 - DNA, 75 bp, Artificial Sequence
  Synthetic
tgcatataccacgtattccccccgtattgatatgatttaaatgattatccttggttggttttggtctaacataag

SEQ ID NO: 157399 - DNA, 75 bp, Artificial Sequence
  Synthetic
attgatatgatttaaatgattatccttggttggttttggtctaacataagatataagctctactatagcgagcgt

SEQ ID NO: 157400 - DNA, 75 bp, Artificial Sequence
  Synthetic
gcgcagcccgtccagcccgtccagcccgcgcagcccgtccagcccgcgcagcccgtccagcccgcgcagcccgtc

SEQ ID NO: 157401 - DNA, 75 bp, Artificial Sequence
  Synthetic
cgaatgtatgtggggtataataacgcgcatggtgtatatgcaacgccaagcgttaaaagcacaatacatccagat

SEQ ID NO: 157402 - DNA, 75 bp, Artificial Sequence
  Synthetic
cgcatggtgtatatgcaacgccaagcgttaaaagcacaatacatccagatgatatatgagcgataacctccaaaa

SEQ ID NO: 157403 - DNA, 75 bp, Artificial Sequence
  Synthetic
catatataaaaaacttatagggtcagcattaaatactttactcataccatcccgtcgcatggaaacatcacataa

SEQ ID NO: 157404 - DNA, 75 bp, Artificial Sequence
  Synthetic
gcattaaatactttactcataccatcccgtcgcatggaaacatcacataacaaccttgccaactttgtatatggg

SEQ ID NO: 157405 - DNA, 75 bp, Artificial Sequence
  Synthetic
gcccgtccagcccgcgcagcccgtccagcccgtccagcccgcgcagcccgtccagcccgcgcagcccgtccagcc

SEQ ID NO: 157406 - DNA, 75 bp, Artificial Sequence
  Synthetic
cccgtgttacgtaattcagtgaatatgatgtgggggatattaactcacaggatgatcggaatggcccaaacatac

SEQ ID NO: 157407 - DNA, 75 bp, Artificial Sequence
  Synthetic
tgatgtgggggatattaactcacaggatgatcggaatggcccaaacatacgacgtattcgtcgaaattgtaaata

SEQ ID NO: 157408 - DNA, 75 bp, Artificial Sequence
  Synthetic
aaaatcatttttagctgcacgcaccaaaaataagcgtgacaattacgtgttcccagaacaattcgaattttgtca

SEQ ID NO: 157409 - DNA, 75 bp, Artificial Sequence
  Synthetic
aaaaataagcgtgacaattacgtgttcccagaacaattcgaattttgtcatgcaaaggtgtagaaatagcggttt

SEQ ID NO: 157410 - DNA, 75 bp, Artificial Sequence
  Synthetic
attttcccggcagctgtaatcgtatccagataggccatccaaaaacgttgagtggtttacaaacgttacatatat

SEQ ID NO: 157411 - DNA, 75 bp, Artificial Sequence
  Synthetic
ccagataggccatccaaaaacgttgagtggtttacaaacgttacatatataagagagttgttataagacccccat

SEQ ID NO: 157412 - DNA, 75 bp, Artificial Sequence
  Synthetic
tggttgcatacacacactcatgttcaaactttacacgagcggtataccatagggtaaaaacagcatgtccgctaa

SEQ ID NO: 157413 - DNA, 75 bp, Artificial Sequence
  Synthetic
aaactttacacgagcggtataccatagggtaaaaacagcatgtccgctaagtagacacataattataaaatgttc

SEQ ID NO: 157414 - DNA, 75 bp, Artificial Sequence
  Synthetic
acccgtggaagatggcaattcaagcacgatgtagtatcacacggttggtgttaactcgaagttaaatttggataa

SEQ ID NO: 157415 - DNA, 75 bp, Artificial Sequence
  Synthetic
acgatgtagtatcacacggttggtgttaactcgaagttaaatttggataattaggtacttctagagtaaagattg

SEQ ID NO: 157416 - DNA, 75 bp, Artificial Sequence
  Synthetic
tgtagcaaaacattgttgtgcaagcgaaatacacaaacggttgtgatgatccactcgcagagacacaaatgtccg

SEQ ID NO: 157417 - DNA, 75 bp, Artificial Sequence
  Synthetic
gaaatacacaaacggttgtgatgatccactcgcagagacacaaatgtccggggagccgttcttcctccgcgatgg

SEQ ID NO: 157418 - DNA, 75 bp, Artificial Sequence
  Synthetic
ttgttccgcatatgagctgaaataacacccagtcccttttgatggcgatacactttgatgatgttaaggtatatt

SEQ ID NO: 157419 - DNA, 75 bp, Artificial Sequence
  Synthetic
cacccagtcccttttgatggcgatacactttgatgatgttaaggtatattcgcgatcacgcccggggaaatgaac

SEQ ID NO: 157420 - DNA, 75 bp, Artificial Sequence
  Synthetic
aatattgtgctgtcgacaaaggcctccagtgtaaatgcgtccagacaagttaccccgcgctcttttagagccttt

SEQ ID NO: 157421 - DNA, 75 bp, Artificial Sequence
  Synthetic
ccagtgtaaatgcgtccagacaagttaccccgcgctcttttagagcctttgttaaagatatttgcggggagctaa

SEQ ID NO: 157422 - DNA, 75 bp, Artificial Sequence
  Synthetic
acgttcaaaaaactctgcgtattcccccccaaggttatgtaaaataaattgaactggaacattcgactgcggtct

SEQ ID NO: 157423 - DNA, 75 bp, Artificial Sequence
  Synthetic
cccccaaggttatgtaaaataaattgaactggaacattcgactgcggtcttgaatgaaaatgaaagtttgccggg

SEQ ID NO: 157424 - DNA, 75 bp, Artificial Sequence
  Synthetic
atatatcaatacactgctcaggtacaacataaaatgggagtagttgtccaaccgccgtccctgtggttgttactt

SEQ ID NO: 157425 - DNA, 75 bp, Artificial Sequence
  Synthetic
aacataaaatgggagtagttgtccaaccgccgtccctgtggttgttactttggagaaaaaaggcagtcttaaact

SEQ ID NO: 157426 - DNA, 75 bp, Artificial Sequence
  Synthetic
tctataaacgaaaagtcccgtaaatacggaccaatatattcaacaaattcccgttccagcaacaccgcttgctgt

SEQ ID NO: 157427 - DNA, 75 bp, Artificial Sequence
  Synthetic
acggaccaatatattcaacaaattcccgttccagcaacaccgcttgctgtaatatttgtgcaaacccctttaaag

SEQ ID NO: 157428 - DNA, 75 bp, Artificial Sequence
  Synthetic
atttgggattggtacgcataccctgaaacctattttctctttacagttacagggtagagtttcatgcaagttttc

SEQ ID NO: 157429 - DNA, 75 bp, Artificial Sequence
  Synthetic
aaacctattttctctttacagttacagggtagagtttcatgcaagttttcattgtttgatacatcggcgtgtgta

SEQ ID NO: 157430 - DNA, 75 bp, Artificial Sequence
  Synthetic
caaaaaaccatacatcctctgtataattctcttctacacacgtgtataattcgccattttctatgtaaaaatcga

SEQ ID NO: 157431 - DNA, 75 bp, Artificial Sequence
  Synthetic
attctcttctacacacgtgtataattcgccattttctatgtaaaaatcgatgtcagaatggctggttatatccaa

SEQ ID NO: 157432 - DNA, 75 bp, Artificial Sequence
  Synthetic
acggtaggttcaggatatgcagttttataaaaataacatgggtctttgttagggtttaccacggcctttggaaaa

SEQ ID NO: 157433 - DNA, 75 bp, Artificial Sequence
  Synthetic
tataaaaataacatgggtctttgttagggtttaccacggcctttggaaaaagtaattgcatggccgttaaaatac

SEQ ID NO: 157434 - DNA, 75 bp, Artificial Sequence
  Synthetic
atgtaaaatacccaatgggatgggttttcttatatgaaagtctacatcaagtatgaggtttgtgattataagatt

SEQ ID NO: 157435 - DNA, 75 bp, Artificial Sequence
  Synthetic
gtatgaggtttgtgattataagatttgtattaaatagctcattcctgtttatataaagctgatctttgggtatgt

SEQ ID NO: 157436 - DNA, 75 bp, Artificial Sequence
  Synthetic
aacagacgtagataatagtaaagtcaactgcatatctcgtagtgaagcggcaacaaaattacatggattaatttg

SEQ ID NO: 157437 - DNA, 75 bp, Artificial Sequence
  Synthetic
tttaaggtcctccgcaattaatcgagcctcgtgcggtaaagtgtaacggtttgttattgatgaccacgtatcatt

SEQ ID NO: 157438 - DNA, 75 bp, Artificial Sequence
  Synthetic
ccgtgaggcaaggctacccgatatacaggcattggtccagttacctcagaatggccgatgagggcttctaatgga

SEQ ID NO: 157439 - DNA, 75 bp, Artificial Sequence
  Synthetic
caggcattggtccagttacctcagaatggccgatgagggcttctaatggagttttataactcaggatggatacat

SEQ ID NO: 157440 - DNA, 75 bp, Artificial Sequence
  Synthetic
agagaaaaacagtaatagttttgtaatccccgggctcgtatcaaaaccagtacgaccactttggttaggtgtatc

SEQ ID NO: 157441 - DNA, 75 bp, Artificial Sequence
  Synthetic
atccccgggctcgtatcaaaaccagtacgaccactttggttaggtgtatcgtttgcaaagttggctgctcgtaac

SEQ ID NO: 157442 - DNA, 75 bp, Artificial Sequence
  Synthetic
caaaattagacaattcgtcaaaaccgggtggatttgagggaatagtggaggaccatccatatggactaaattgtt

SEQ ID NO: 157443 - DNA, 75 bp, Artificial Sequence
  Synthetic
gggtggatttgagggaatagtggaggaccatccatatggactaaattgtttttcaatgttttccacacgacgagt

SEQ ID NO: 157444 - DNA, 75 bp, Artificial Sequence
  Synthetic
cctataaacttgctaggttttgcggcatacgtaagacttaaagtatatgttttagtaattgtatatttatgtcca

SEQ ID NO: 157445 - DNA, 75 bp, Artificial Sequence
  Synthetic
catacgtaagacttaaagtatatgttttagtaattgtatatttatgtccaatctcaggtccaagttcagtgacat

SEQ ID NO: 157446 - DNA, 75 bp, Artificial Sequence
  Synthetic
gtcacgcatgttgagacgagaacgtacatgattaaaaaaattagcagtagctctttttcccaggttggatgattt

SEQ ID NO: 157447 - DNA, 75 bp, Artificial Sequence
  Synthetic
acatgattaaaaaaattagcagtagctctttttcccaggttggatgattttaagaggaccggtttattcacaaaa

SEQ ID NO: 157448 - DNA, 75 bp, Artificial Sequence
  Synthetic
ggtctgcgatctgtttccgattgaaacattcaaaatgtgccagataaatataatcaacaaattcacggtctggaa

SEQ ID NO: 157449 - DNA, 75 bp, Artificial Sequence
  Synthetic
acattcaaaatgtgccagataaatataatcaacaaattcacggtctggaactttaaggccttttctatcgttggt

SEQ ID NO: 157450 - DNA, 75 bp, Artificial Sequence
  Synthetic
tccgttgtgtctgtatgtattcgctgtaaaatgtacgatagagcatttttggctgtcaaacctcgtgtatatgtt

SEQ ID NO: 157451 - DNA, 75 bp, Artificial Sequence
  Synthetic
gtaaaatgtacgatagagcatttttggctgtcaaacctcgtgtatatgttgaggaacaacaaaacatggaaagtt

SEQ ID NO: 157452 - DNA, 75 bp, Artificial Sequence
  Synthetic
attgtacccactacaattaggtaatgccgggacttggtaagttaaaaacaaatctttaattgcctgtaagtcata

SEQ ID NO: 157453 - DNA, 75 bp, Artificial Sequence
  Synthetic
gccgggacttggtaagttaaaaacaaatctttaattgcctgtaagtcatataagggggtttccaacgtattgtaa

SEQ ID NO: 157454 - DNA, 75 bp, Artificial Sequence
  Synthetic
agcgtgtagccaacactagcgttttttcagagggtccaaatcgaacaatataccaaaacggcgagcatccatacc

SEQ ID NO: 157455 - DNA, 75 bp, Artificial Sequence
  Synthetic
ttcagagggtccaaatcgaacaatataccaaaacggcgagcatccatacccccagtagagtcgtcgatatgcagc

SEQ ID NO: 157456 - DNA, 75 bp, Artificial Sequence
  Synthetic
tataatgatgttagctcctgacgaccaacggattttttaactaacttgcagagtgttgcctctgtgatgcatagg

SEQ ID NO: 157457 - DNA, 75 bp, Artificial Sequence
  Synthetic
caacggattttttaactaacttgcagagtgttgcctctgtgatgcataggccgttgtccgataatccctttcggt

SEQ ID NO: 157458 - DNA, 75 bp, Artificial Sequence
  Synthetic
agtttgtataacttccgagtgaatgtcaaacgtctccgatatacatagggtatcagatattatatgcggatttag

SEQ ID NO: 157459 - DNA, 75 bp, Artificial Sequence
  Synthetic
tcaaacgtctccgatatacatagggtatcagatattatatgcggatttaggggtgctccataccataacgcctta

SEQ ID NO: 157460 - DNA, 75 bp, Artificial Sequence
  Synthetic
ttttaaaacaacaaaaaaatataggccagacccgggatcgtacatctccagttgaaaatccaccaattaaataaa

SEQ ID NO: 157461 - DNA, 75 bp, Artificial Sequence
  Synthetic
ccagacccgggatcgtacatctccagttgaaaatccaccaattaaataaaaaataacgttgacgtccctactaca

SEQ ID NO: 157462 - DNA, 75 bp, Artificial Sequence
  Synthetic
tcatcgttttcagttacttcacgtgggcgtttagttgggattacttgcgtgatctcttccctcccatttttgaca

SEQ ID NO: 157463 - DNA, 75 bp, Artificial Sequence
  Synthetic
ggcgtttagttgggattacttgcgtgatctcttccctcccatttttgacaaagacgtcatctaagtcgggagtcc

SEQ ID NO: 157464 - DNA, 75 bp, Artificial Sequence
  Synthetic
ttctgtgcttatctgcccggtaagcaacaacagcgagtgggagattgcacatccctttgtggcaaataataaccg

SEQ ID NO: 157465 - DNA, 75 bp, Artificial Sequence
  Synthetic
aacaacagcgagtgggagattgcacatccctttgtggcaaataataaccgaatcgtcggtttggaggatttatcc

SEQ ID NO: 157466 - DNA, 75 bp, Artificial Sequence
  Synthetic
tcaatcatgcagacggtgtgtgccagcttatgtggatatgctcgaataccaactgaagagccatcttatgaagag

SEQ ID NO: 157467 - DNA, 75 bp, Artificial Sequence
  Synthetic
gcttatgtggatatgctcgaataccaactgaagagccatcttatgaagaggtgcgtgtaaacacgcacccccaag

SEQ ID NO: 157468 - DNA, 75 bp, Artificial Sequence
  Synthetic
ggctttaaccgctgtgaatggattattgcctgcacctctaacgttagaagacgtagtcgcttctgcagataatac

SEQ ID NO: 157469 - DNA, 75 bp, Artificial Sequence
  Synthetic
ttgcctgcacctctaacgttagaagacgtagtcgcttctgcagataatacccgtcgtttggtccgcgcccaggct

SEQ ID NO: 157470 - DNA, 75 bp, Artificial Sequence
  Synthetic
ctcgtaacattgaatgtttaaaacagcaccattttactgaagataaccccggtcttaacgccgtggtccgttcac

SEQ ID NO: 157471 - DNA, 75 bp, Artificial Sequence
  Synthetic
gcaccattttactgaagataaccccggtcttaacgccgtggtccgttcacacatggaaaactcaaaacggcttgc

SEQ ID NO: 157472 - DNA, 75 bp, Artificial Sequence
  Synthetic
catttgtatttatcggttggcgcggtggatgttactacggatgatattgtcgatcaaaccctgagaatgaccgct

SEQ ID NO: 157473 - DNA, 75 bp, Artificial Sequence
  Synthetic
tggatgttactacggatgatattgtcgatcaaaccctgagaatgaccgctgaaagtgaagtggtcatgtctgatg

SEQ ID NO: 157474 - DNA, 75 bp, Artificial Sequence
  Synthetic
ggtcgttgctaaacctcaggcatcgtttgatgtttcccacaaccatgaattatctatagctaaaggggaaaatgt

SEQ ID NO: 157475 - DNA, 75 bp, Artificial Sequence
  Synthetic
tatctatagctaaaggggaaaatgtgggtttaaaaacatcacctattaaatcggaggcgacacaattatctgaaa

SEQ ID NO: 157476 - DNA, 75 bp, Artificial Sequence
  Synthetic
ggataataacacatctaacctaacaaaaaaaacgtatccgacagaaactcttcagcccgtgttgaccccaaaaca

SEQ ID NO: 157477 - DNA, 75 bp, Artificial Sequence
  Synthetic
aaaaaaacgtatccgacagaaactcttcagcccgtgttgaccccaaaacagacgcaagatgtacaacgcacaacc

SEQ ID NO: 157478 - DNA, 75 bp, Artificial Sequence
  Synthetic
tgcttgtataaatattgaaataaaaactaaaaacgtttctggtgtatgtttttattttgtatataaaattaaaac

SEQ ID NO: 157479 - DNA, 75 bp, Artificial Sequence
  Synthetic
actaaaaacgtttctggtgtatgtttttattttgtatataaaattaaaacattgctggctggcgtggttattaca

SEQ ID NO: 157480 - DNA, 75 bp, Artificial Sequence
  Synthetic
atcgtttgtttctttatcagttgaaccaaatccacgcgttccccgttcgctgggtgtggctattagatctaacgt

SEQ ID NO: 157481 - DNA, 75 bp, Artificial Sequence
  Synthetic
ccaaatccacgcgttccccgttcgctgggtgtggctattagatctaacgttttagtaaaataccattgtacaccc

SEQ ID NO: 157482 - DNA, 75 bp, Artificial Sequence
  Synthetic
cataaggaaatgcaatattacttaaaacgttgtgttttaagtgtatttgggtgttgtgatctattaacaggacct

SEQ ID NO: 157483 - DNA, 75 bp, Artificial Sequence
  Synthetic
aacgttgtgttttaagtgtatttgggtgttgtgatctattaacaggacctgtgcaagacgatctcccgtttttat

SEQ ID NO: 157484 - DNA, 75 bp, Artificial Sequence
  Synthetic
tatacgtagaatttacagtgttctcctgcaggccatgccgttggacacacgataatgcctgatcggcttttcgat

SEQ ID NO: 157485 - DNA, 75 bp, Artificial Sequence
  Synthetic
ctgcaggccatgccgttggacacacgataatgcctgatcggcttttcgatgatcttccaaaaatataagcgttta

SEQ ID NO: 157486 - DNA, 75 bp, Artificial Sequence
  Synthetic
tcttataatcggtaagacaatttttataaattcattcctttttaaatataggttatatggtacacaaatatcata

SEQ ID NO: 157487 - DNA, 75 bp, Artificial Sequence
  Synthetic
ttgatgatatgtttgtaggttaagggaacatcgatatggtattctgcagaatccctatgtaaaggttgcccctgc

SEQ ID NO: 157488 - DNA, 75 bp, Artificial Sequence
  Synthetic
caggtataacgggtttttcataatttgacggcgagtttgataagggttgaacttgtatcgatttaaaaattggat

SEQ ID NO: 157489 - DNA, 75 bp, Artificial Sequence
  Synthetic
tgacggcgagtttgataagggttgaacttgtatcgatttaaaaattggatccagatgtttaagaacgttttttgg

SEQ ID NO: 157490 - DNA, 75 bp, Artificial Sequence
  Synthetic
ccggtatgaaataaacggcgcttagcaccccttgcgcttcccggtttaatccccggtaacacagaaaaaagcctg

SEQ ID NO: 157491 - DNA, 75 bp, Artificial Sequence
  Synthetic
accgggaacaagtagattgttaaatgtccgggtaaaataacggttactcctggccggtaatacaaaagggctgaa

SEQ ID NO: 157492 - DNA, 75 bp, Artificial Sequence
  Synthetic
gtccgggtaaaataacggttactcctggccggtaatacaaaagggctgaaattactcctctgtaacccgcatcaa

SEQ ID NO: 157493 - DNA, 75 bp, Artificial Sequence
  Synthetic
gtcttcatcagcaagggcagtatctttgcattgaattaacaacagtgcgtattcattgggaggcgccgacttaac

SEQ ID NO: 157494 - DNA, 75 bp, Artificial Sequence
  Synthetic
ttgcattgaattaacaacagtgcgtattcattgggaggcgccgacttaaccaacagctccaactgctgcatataa

SEQ ID NO: 157495 - DNA, 75 bp, Artificial Sequence
  Synthetic
cagatggcagttcgagtttcttgtggttccggagtaacaacggttgatgtcgacttactttatcgtctaacacgc

SEQ ID NO: 157496 - DNA, 75 bp, Artificial Sequence
  Synthetic
gttccggagtaacaacggttgatgtcgacttactttatcgtctaacacgcattgcagcgtatctgcacattcagg

SEQ ID NO: 157497 - DNA, 75 bp, Artificial Sequence
  Synthetic
tttaaacaccgattcggaatagtttggctacaaaacatatcacctgtatttactgccgtttccaagatgggatca

SEQ ID NO: 157498 - DNA, 75 bp, Artificial Sequence
  Synthetic
ggctacaaaacatatcacctgtatttactgccgtttccaagatgggatcaattaccgcttcgttcatattaataa

SEQ ID NO: 157499 - DNA, 75 bp, Artificial Sequence
  Synthetic
agacagcagtggggagccaaactttgcagaacggaatttttggcatgccagctgttcggctcgtggagtttatat

SEQ ID NO: 157500 - DNA, 75 bp, Artificial Sequence
  Synthetic
gcagaacggaatttttggcatgccagctgttcggctcgtggagtttatatcgacggatcaatgatcaccaccctt

SEQ ID NO: 157501 - DNA, 75 bp, Artificial Sequence
  Synthetic
tgtgtgtagcccttatttcgttagcttatcatgcgtgtttccggttatttactcgttctgtattacgcagcacgt

SEQ ID NO: 157502 - DNA, 75 bp, Artificial Sequence
  Synthetic
ttatcatgcgtgtttccggttatttactcgttctgtattacgcagcacgtggtaaacccgtttgcctataaaagg

SEQ ID NO: 157503 - DNA, 75 bp, Artificial Sequence
  Synthetic
gtttaatacgcggtctgccgtgtttggatatttcacgaccctatcgtttatttacgtaatggcatcttccgacgg

SEQ ID NO: 157504 - DNA, 75 bp, Artificial Sequence
  Synthetic
gtgcgtcgtaaaacaacgcctagttattccggacaatatcgaaccgcgcggcgaagtgtggtcgtaggacccccc

SEQ ID NO: 157505 - DNA, 75 bp, Artificial Sequence
  Synthetic
acattaccacagttggggccgattctccttctccagtgtacgcggatctttattttgaacataaaaatacgaccc

SEQ ID NO: 157506 - DNA, 75 bp, Artificial Sequence
  Synthetic
tccttctccagtgtacgcggatctttattttgaacataaaaatacgacccctcgcgtacatcaaccaaacgactc

SEQ ID NO: 157507 - DNA, 75 bp, Artificial Sequence
  Synthetic
gacatcgatgaagtagtggccgcctttcgggaggcccgtttgagacatgaactggttgaagatgctgtatatgaa

SEQ ID NO: 157508 - DNA, 75 bp, Artificial Sequence
  Synthetic
ttcgggaggcccgtttgagacatgaactggttgaagatgctgtatatgaaaacccgctaagtgtagaaaaaccat

SEQ ID NO: 157509 - DNA, 75 bp, Artificial Sequence
  Synthetic
ggttaaacctaaattagaggattcaccgaagcgagctcccccgggagcaggcgcaattgccagcgggagaccaat

SEQ ID NO: 157510 - DNA, 75 bp, Artificial Sequence
  Synthetic
gcgcaattgccagcgggagaccaatttccttcagcactgcaccaaaaaccgcaacaagctcgtggtgcggtccta

SEQ ID NO: 157511 - DNA, 75 bp, Artificial Sequence
  Synthetic
ttgtgaagcggtccggcgcgtagccgccatgcaggcacaaaaggctgccgaagcggcttggaatagtaatccccc

SEQ ID NO: 157512 - DNA, 75 bp, Artificial Sequence
  Synthetic
gccatgcaggcacaaaaggctgccgaagcggcttggaatagtaatcccccaaggaataacgccgaattagaccgt

SEQ ID NO: 157513 - DNA, 75 bp, Artificial Sequence
  Synthetic
ttacggtgcatgagggtttaaatttaatacaagccgctaatgaagcagacctaggtgaaggagcatcggtatcca

SEQ ID NO: 157514 - DNA, 75 bp, Artificial Sequence
  Synthetic
aatacaagccgctaatgaagcagacctaggtgaaggagcatcggtatccaaacgtggacataatcgaaaaactgg

SEQ ID NO: 157515 - DNA, 75 bp, Artificial Sequence
  Synthetic
gaacctatgtacgcacaagttcgtaagccaaaaagtcgaacggatacacaaacgactgggcgtataactaatcga

SEQ ID NO: 157516 - DNA, 75 bp, Artificial Sequence
  Synthetic
agccaaaaagtcgaacggatacacaaacgactgggcgtataactaatcgaagtagggcccgttctgcatcaagaa

SEQ ID NO: 157517 - DNA, 75 bp, Artificial Sequence
  Synthetic
ttacgcagtaacggtttacccggtattatgtataataaataaacgtataaaagacagtcgtggtttgtgtttatt

SEQ ID NO: 157518 - DNA, 75 bp, Artificial Sequence
  Synthetic
gggggggggttattttcgggggggggtccgaccagcccgcccgtcgcccgcccgcacagacagacagacactttt

SEQ ID NO: 157519 - DNA, 75 bp, Artificial Sequence
  Synthetic
ttatgtataataaataaacgtataaaagacagtcgtggtttgtgtttattataaatgtgtattatatgtcacata

SEQ ID NO: 157520 - DNA, 75 bp, Artificial Sequence
  Synthetic
ccccataaaaccgcgacatcgcgggaacacgcgcgaacaagaaactctctccctctctctctctctctctctcta

SEQ ID NO: 157521 - DNA, 75 bp, Artificial Sequence
  Synthetic
gtggtattatgaacagtttataatcagttgctaccaaacaaaccccattagacggcgggttttgataaagggaat

SEQ ID NO: 157522 - DNA, 75 bp, Artificial Sequence
  Synthetic
tggcgctcacgagaaaaggaggggactccgtcacccccgactctgcggggggctcctccccccgcgccctcccca

SEQ ID NO: 157523 - DNA, 75 bp, Artificial Sequence
  Synthetic
agttgctaccaaacaaaccccattagacggcgggttttgataaagggaatcgcttatttaaactaaagattttac

SEQ ID NO: 157524 - DNA, 75 bp, Artificial Sequence
  Synthetic
catgccaaaacatgaaaacccatacagtgaaaaaacgggaagtgcgaatgcagattaaaagagtgtatccgattg

SEQ ID NO: 157525 - DNA, 75 bp, Artificial Sequence
  Synthetic
gaaccgaacatcctagtacagatacgtggaatcgtagtaaaacggaacaagcggttgtggacgcatttgatgaat

SEQ ID NO: 157526 - DNA, 75 bp, Artificial Sequence
  Synthetic
gtggaatcgtagtaaaacggaacaagcggttgtggacgcatttgatgaatcgttgtttggtgatgtagcatcgga

SEQ ID NO: 157527 - DNA, 75 bp, Artificial Sequence
  Synthetic
tcacatgcagttaaaactgctccgtctccgccttgggtagctagccctaaaattttatatcaacagttaatacgg

SEQ ID NO: 157528 - DNA, 75 bp, Artificial Sequence
  Synthetic
ctccgccttgggtagctagccctaaaattttatatcaacagttaatacgggatcttgatttttcagaagggccgc

SEQ ID NO: 157529 - DNA, 75 bp, Artificial Sequence
  Synthetic
gaacgaggatttattctcatgttttcctattaatgaggacctatattccgatatgatggttttatccccggatcc

SEQ ID NO: 157530 - DNA, 75 bp, Artificial Sequence
  Synthetic
cctattaatgaggacctatattccgatatgatggttttatccccggatccagatgacgttatctcaaccgtttca

SEQ ID NO: 157531 - DNA, 75 bp, Artificial Sequence
  Synthetic
atttaacaacccggggttccgttcgattgcctagtccaccaaagcaaccgacggggcttccagcttacgttcagg

SEQ ID NO: 157532 - DNA, 75 bp, Artificial Sequence
  Synthetic
attgcctagtccaccaaagcaaccgacggggcttccagcttacgttcaggaggtccaggattcgtttaccgtaga

SEQ ID NO: 157533 - DNA, 75 bp, Artificial Sequence
  Synthetic
acaaaactactagttacttattgtaaatcgattatacgttatctccaaggaacggcgaaaaggacgacaataggt

SEQ ID NO: 157534 - DNA, 75 bp, Artificial Sequence
  Synthetic
aatcgattatacgttatctccaaggaacggcgaaaaggacgacaataggtcttaatatacaaaaccctgaccaga

SEQ ID NO: 157535 - DNA, 75 bp, Artificial Sequence
  Synthetic
gccgcctcgtccacaaagtcggctgccccgagccccagaccccgagactgtcgcgcgaggtccttgcaaccgtca

SEQ ID NO: 157536 - DNA, 75 bp, Artificial Sequence
  Synthetic
tattctacttagatattatcgtgaggtggcaagtttggcgcgtcttctgtacctacatttatatttaaccgtaac

SEQ ID NO: 157537 - DNA, 75 bp, Artificial Sequence
  Synthetic
gtggcaagtttggcgcgtcttctgtacctacatttatatttaaccgtaacgcgtgaattttcctggcgtttgtac

SEQ ID NO: 157538 - DNA, 75 bp, Artificial Sequence
  Synthetic
tgtttgcggctttaaaattcacctggaccgaacgtcgacagttcacgtgtgcgtttcatcctgtattatgcaacc

SEQ ID NO: 157539 - DNA, 75 bp, Artificial Sequence
  Synthetic
gaccgaacgtcgacagttcacgtgtgcgtttcatcctgtattatgcaaccacggcattgtgttattagaagggaa

SEQ ID NO: 157540 - DNA, 75 bp, Artificial Sequence
  Synthetic
gaaataaattaccgccgccgagaactgggactgcctctagttagatgtggtcttgttgaagaaaacaaatctccg

SEQ ID NO: 157541 - DNA, 75 bp, Artificial Sequence
  Synthetic
tgggactgcctctagttagatgtggtcttgttgaagaaaacaaatctccgttggttcaacaaccctcattttcgg

SEQ ID NO: 157542 - DNA, 75 bp, Artificial Sequence
  Synthetic
tcttacccaccacattaagcgtaagttagacgcatatgcggtcaaacatcctcaagaaccgagacatgtacgagc

SEQ ID NO: 157543 - DNA, 75 bp, Artificial Sequence
  Synthetic
gaaaatagaaactacggtagtagcatcgaagctatgattttagcacctccgtccccatccgagatcctgccgggg

SEQ ID NO: 157544 - DNA, 75 bp, Artificial Sequence
  Synthetic
tcgaagctatgattttagcacctccgtccccatccgagatcctgccgggggacccaccacgcccacccacgtgtg

SEQ ID NO: 157545 - DNA, 75 bp, Artificial Sequence
  Synthetic
gtccccatccgagatcctgccgggggacccaccacgcccacccacgtgtgggtttttaacgcgttaaacgtcatt

SEQ ID NO: 157546 - DNA, 75 bp, Artificial Sequence
  Synthetic
gaaaacgtgcatgcgttttttatttttacaatgcgccgtatatggtatgtctgtcatgtgctctaaagtcccata

SEQ ID NO: 157547 - DNA, 75 bp, Artificial Sequence
  Synthetic
ttacaatgcgccgtatatggtatgtctgtcatgtgctctaaagtcccatatataaaagaagccccaacgagtgta

SEQ ID NO: 157548 - DNA, 75 bp, Artificial Sequence
  Synthetic
gatgttttacaggcgcgtttgtttgtctcggttataagtatgcagtcgggtcattataaccggaggcaatcccgc

SEQ ID NO: 157549 - DNA, 75 bp, Artificial Sequence
  Synthetic
tctcggttataagtatgcagtcgggtcattataaccggaggcaatcccgccgacagcggatatcgtctaatacca

SEQ ID NO: 157550 - DNA, 75 bp, Artificial Sequence
  Synthetic
aacacgttatcggtcaaccaattggtatacacacccaccccagatattgtccaattcagaaacattagttgcggt

SEQ ID NO: 157551 - DNA, 75 bp, Artificial Sequence
  Synthetic
tatacacacccaccccagatattgtccaattcagaaacattagttgcggttcaagaactactgaactccgagatg

SEQ ID NO: 157552 - DNA, 75 bp, Artificial Sequence
  Synthetic
aggcggaggagggagaggcggaggaggacgcgattgacgacgagggaggcggaggaggacgcgatcgacgacgag

SEQ ID NO: 157553 - DNA, 75 bp, Artificial Sequence
  Synthetic
cggatgattttccgggatacgccttacatcattctacatataatggatccgaacaaaatacatcaacttccagac

SEQ ID NO: 157554 - DNA, 75 bp, Artificial Sequence
  Synthetic
gaggcggaggaggattatttttctgtaagtcaagtttgcagtcgagacgcggatgaggtttattttacgttagac

SEQ ID NO: 157555 - DNA, 75 bp, Artificial Sequence
  Synthetic
ccggaaataagttacagtaccgatcttcgcattgcaaaggttatggagcctgcggtatcaaaggaacttaatgta

SEQ ID NO: 157556 - DNA, 75 bp, Artificial Sequence
  Synthetic
ccctaacaggctctatgttagcgcataatgggtttgatgagtcctggtttgctatgcgcgaatgtacccgtcgcg

SEQ ID NO: 157557 - DNA, 75 bp, Artificial Sequence
  Synthetic
taatgggtttgatgagtcctggtttgctatgcgcgaatgtacccgtcgcgaatatattacggtccaaggattata

SEQ ID NO: 157558 - DNA, 75 bp, Artificial Sequence
  Synthetic
gctatgcgcgaatgtacccgtcgcgaatatattacggtccaaggattatacgacccaattcatttacggtatcag

SEQ ID NO: 157559 - DNA, 75 bp, Artificial Sequence
  Synthetic
cacagattttgagaactataccagcccttcctaacatgacacttggtgaacttttattgatttttcctattgaat

SEQ ID NO: 157560 - DNA, 75 bp, Artificial Sequence
  Synthetic
ccttcctaacatgacacttggtgaacttttattgatttttcctattgaatttatggcccagccaatttctataga

SEQ ID NO: 157561 - DNA, 75 bp, Artificial Sequence
  Synthetic
ttagataggcgggcttccagtaaaacacataaatacggcccgcgttggaattccgtctacgcacttccatataat

SEQ ID NO: 157562 - DNA, 75 bp, Artificial Sequence
  Synthetic
cacataaatacggcccgcgttggaattccgtctacgcacttccatataatgcgggtaaaatgtatgtacaacaca

SEQ ID NO: 157563 - DNA, 75 bp, Artificial Sequence
  Synthetic
acgtgctgtgggccaaggaacggccatttggcatcacatgatattatccacagcagcatgcgctatttctaatcg

SEQ ID NO: 157564 - DNA, 75 bp, Artificial Sequence
  Synthetic
atttggcatcacatgatattatccacagcagcatgcgctatttctaatcgcatttcacatggagatggattagga

SEQ ID NO: 157565 - DNA, 75 bp, Artificial Sequence
  Synthetic
ttagcgcaaactgtatttttttgggacgtaacgataattttggcgtgggggatccatgttggttagaagaccatc

SEQ ID NO: 157566 - DNA, 75 bp, Artificial Sequence
  Synthetic
acgtaacgataattttggcgtgggggatccatgttggttagaagaccatcttgccggattaccacgagaagccgt

SEQ ID NO: 157567 - DNA, 75 bp, Artificial Sequence
  Synthetic
ttggttttgccaaatcggggtccaacggttgccattatgcgtggtttttttggggcgttggcatattggcccgaa

SEQ ID NO: 157568 - DNA, 75 bp, Artificial Sequence
  Synthetic
cggttgccattatgcgtggtttttttggggcgttggcatattggcccgaactaagaattgctataagtgaaccat

SEQ ID NO: 157569 - DNA, 75 bp, Artificial Sequence
  Synthetic
cggtcacatggaacttgccgaatggtttttattttcacgtacacatagtttaaagccacaatttaccccaacgga

SEQ ID NO: 157570 - DNA, 75 bp, Artificial Sequence
  Synthetic
tttttattttcacgtacacatagtttaaagccacaatttaccccaacggaacgggaaatgttagcgtcatttttt

SEQ ID NO: 157571 - DNA, 75 bp, Artificial Sequence
  Synthetic
gaatgttgaactggatctgtagagcaactgcaatgtatttagctgctccttaccattcccgttcggcttacatcg

SEQ ID NO: 157572 - DNA, 75 bp, Artificial Sequence
  Synthetic
aactgcaatgtatttagctgctccttaccattcccgttcggcttacatcgcggtctgtgaatctctgccctatta

SEQ ID NO: 157573 - DNA, 75 bp, Artificial Sequence
  Synthetic
ttatgtgatttagaggtattactgttaggcgaggtcgacctcccaactgtttgtgaatcctacgcaactattgca

SEQ ID NO: 157574 - DNA, 75 bp, Artificial Sequence
  Synthetic
taggcgaggtcgacctcccaactgtttgtgaatcctacgcaactattgcacacgaattaaccggatatgaggctg

SEQ ID NO: 157575 - DNA, 75 bp, Artificial Sequence
  Synthetic
gatagagtttgccgattgttataaggaaagtgagaccgatttaatggtaagcgcgtacctgggggccgttttatt

SEQ ID NO: 157576 - DNA, 75 bp, Artificial Sequence
  Synthetic
gaaagtgagaccgatttaatggtaagcgcgtacctgggggccgttttattgttacaacgggtgttgggtcatgca

SEQ ID NO: 157577 - DNA, 75 bp, Artificial Sequence
  Synthetic
gtgctgcgttgtacggaggatgttcaatttacatcccccgaggtattttagatgcatataatactttaatgttgg

SEQ ID NO: 157578 - DNA, 75 bp, Artificial Sequence
  Synthetic
aatttacatcccccgaggtattttagatgcatataatactttaatgttggcagcaagtcctctttacgctcacca

SEQ ID NO: 157579 - DNA, 75 bp, Artificial Sequence
  Synthetic
cgcgatgatgcaatgcaaactttggggattcgaccgacaacggacgttttacccaaagagcaagacaggatagtt

SEQ ID NO: 157580 - DNA, 75 bp, Artificial Sequence
  Synthetic
caggcatcacctatagatatgaacttccgttttgtgggattggagaccatctatccccgagaacagcccattccc

SEQ ID NO: 157581 - DNA, 75 bp, Artificial Sequence
  Synthetic
ctatccccgagaacagcccattccctccgtggacctagccgaaaatcttatgcaatacaggaatgaaattctggg

SEQ ID NO: 157582 - DNA, 75 bp, Artificial Sequence
  Synthetic
tccgtggacctagccgaaaatcttatgcaatacaggaatgaaattctgggtttggattggaaaagcgtagccatg

SEQ ID NO: 157583 - DNA, 75 bp, Artificial Sequence
  Synthetic
tgtgatttttttcattaggatgaaaagaacgtttcctagccacacccacaaaggagtttgtaaaataaaatctct

SEQ ID NO: 157584 - DNA, 75 bp, Artificial Sequence
  Synthetic
agaacgtttcctagccacacccacaaaggagtttgtaaaataaaatctctgtttagaccttaaaatttgttgtgt

SEQ ID NO: 157585 - DNA, 75 bp, Artificial Sequence
  Synthetic
tcgacctttacaagatataatttgtccatatcgcaatgttttctcggtttgcgcgttccttttccagcgatgata

SEQ ID NO: 157586 - DNA, 75 bp, Artificial Sequence
  Synthetic
ccatatcgcaatgttttctcggtttgcgcgttccttttccagcgatgatagaacgcgtaaatcttatgatggtag

SEQ ID NO: 157587 - DNA, 75 bp, Artificial Sequence
  Synthetic
cgtgatttgcccacacctacccgggactggtgttctatttcccaacgcataaccagcgagcgcgtgagggatgga

SEQ ID NO: 157588 - DNA, 75 bp, Artificial Sequence
  Synthetic
actggtgttctatttcccaacgcataaccagcgagcgcgtgagggatggatgtcttattccaacgcccggcgagg

SEQ ID NO: 157589 - DNA, 75 bp, Artificial Sequence
  Synthetic
atctgaaaagaccgacagcctaacatcgccggttttacaaagtaccgaaagacacagtgttctgcttggattaca

SEQ ID NO: 157590 - DNA, 75 bp, Artificial Sequence
  Synthetic
tcgccggttttacaaagtaccgaaagacacagtgttctgcttggattacaccataataatgttcctgaatcgttg

SEQ ID NO: 157591 - DNA, 75 bp, Artificial Sequence
  Synthetic
ttcatgacgggtttatgcagcgttatatggaaacaattcaaagatgtttggatgacctgaaactttctggggatg

SEQ ID NO: 157592 - DNA, 75 bp, Artificial Sequence
  Synthetic
tatggaaacaattcaaagatgtttggatgacctgaaactttctggggatggactttggtgggtttatgaaaatac

SEQ ID NO: 157593 - DNA, 75 bp, Artificial Sequence
  Synthetic
acaggagccgaggtaccggtgacttcagagaaggtaaataaaaagtctaaatccacggttttgttgttttcatcc

SEQ ID NO: 157594 - DNA, 75 bp, Artificial Sequence
  Synthetic
cagagaaggtaaataaaaagtctaaatccacggttttgttgttttcatccgtagttgccaataaaccaatatcca

SEQ ID NO: 157595 - DNA, 75 bp, Artificial Sequence
  Synthetic
aaattcggattaccggggaatatgtcaggagctacgtgaggcgttaggagctgtgcaaaagtatatgtattttat

SEQ ID NO: 157596 - DNA, 75 bp, Artificial Sequence
  Synthetic
caggagctacgtgaggcgttaggagctgtgcaaaagtatatgtattttatgcgtccagatgatcctacaaacccc

SEQ ID NO: 157597 - DNA, 75 bp, Artificial Sequence
  Synthetic
aagaaattgcggcttacacggctactggctacgggtggatgttatggttcttggacgttgtggacgccagggtat

SEQ ID NO: 157598 - DNA, 75 bp, Artificial Sequence
  Synthetic
ttggacgttgtggacgccagggtatgtcgccatctcaaacttcaatttcgacggattcgagggccgcgcgcgtct

SEQ ID NO: 157599 - DNA, 75 bp, Artificial Sequence
  Synthetic
gcattcgcacttcccgttttttcactgtatgggttttcatgttttggcatgtgtccaaccaccgttcgcactttc

SEQ ID NO: 157600 - DNA, 75 bp, Artificial Sequence
  Synthetic
gacatttaaaaacgggtcctgcggtctcagcgggcacaggagttgcgtttattttagcagcaacaactgccagcg

SEQ ID NO: 157601 - DNA, 75 bp, Artificial Sequence
  Synthetic
ctcagcgggcacaggagttgcgtttattttagcagcaacaactgccagcgctcttactgcgcttttgcgtattag

SEQ ID NO: 157602 - DNA, 75 bp, Artificial Sequence
  Synthetic
cgggatggtttaaatggaaccgcagctgcaattgttgcggcggttgaacttattacgcttttgcaccaccatttt

SEQ ID NO: 157603 - DNA, 75 bp, Artificial Sequence
  Synthetic
ctgcaattgttgcggcggttgaacttattacgcttttgcaccaccattttcaatacttaattaatatgatgctta

SEQ ID NO: 157604 - DNA, 75 bp, Artificial Sequence
  Synthetic
gggattaaacgatccttatatattaaaggcgctacgcgcccagggacggtttttatattttgcgggtcagttggt

SEQ ID NO: 157605 - DNA, 75 bp, Artificial Sequence
  Synthetic
ttttatattttgcgggtcagttggttagaacaatgtcaacacacagttgggttgtgttagagaccagcacccata

SEQ ID NO: 157606 - DNA, 75 bp, Artificial Sequence
  Synthetic
tgtggttttcccgggccgtggcgcagagtattttagcacatgggggtaaacccacaaagtattatgctcaggttc

SEQ ID NO: 157607 - DNA, 75 bp, Artificial Sequence
  Synthetic
gagtattttagcacatgggggtaaacccacaaagtattatgctcaggttcttgccgccagtaaacggtatactcc

SEQ ID NO: 157608 - DNA, 75 bp, Artificial Sequence
  Synthetic
ccatcgagtgtgtctgatcagccgtatattcgttttaatcgactgggatctccaatagggacaggtatagggaat

SEQ ID NO: 157609 - DNA, 75 bp, Artificial Sequence
  Synthetic
tccaatagggacaggtatagggaatttggaatgtgtctgtttaacgggaaattatttatctgacgacgtaaatgc

SEQ ID NO: 157610 - DNA, 75 bp, Artificial Sequence
  Synthetic
gcaccgttaaacagtatagcacccgatacaaatagacagcggacttctcgcgttttagttcgtccagacacgggt

SEQ ID NO: 157611 - DNA, 75 bp, Artificial Sequence
  Synthetic
atacaaatagacagcggacttctcgcgttttagttcgtccagacacgggtttggatgtaactgtccgaaaaaacc

SEQ ID NO: 157612 - DNA, 75 bp, Artificial Sequence
  Synthetic
cggtagtccagttgacccaacgtatcctgatcattacacccggataaaggcggaatatgaaggtccggttcggga

SEQ ID NO: 157613 - DNA, 75 bp, Artificial Sequence
  Synthetic
cctgatcattacacccggataaaggcggaatatgaaggtccggttcgggatgaatcaaacacaatgtttgaccaa

SEQ ID NO: 157614 - DNA, 75 bp, Artificial Sequence
  Synthetic
cccaagcatctttaaatgatcacgtatatgaaaatataccacccaaggaagtgggttttaactcatcttcagacc

SEQ ID NO: 157615 - DNA, 75 bp, Artificial Sequence
  Synthetic
cacctccggagacatgcatacagacgatgacttatcaccagattttatacccaacgacgttcccgttagatgtaa

SEQ ID NO: 157616 - DNA, 75 bp, Artificial Sequence
  Synthetic
gatgacttatcaccagattttatacccaacgacgttcccgttagatgtaaaaccacggttacgtttaggaaaaat

SEQ ID NO: 157617 - DNA, 75 bp, Artificial Sequence
  Synthetic
ccaacgacgttcccgttagatgtaaaaccacggttacgtttaggaaaaatacgcctaagagtcatcattaagtac

SEQ ID NO: 157618 - DNA, 75 bp, Artificial Sequence
  Synthetic
aggcactttggcggtcatttccacaaccaggttaaaattgggggatttgggagaaaatagtctattgcgtatttt

SEQ ID NO: 157619 - DNA, 75 bp, Artificial Sequence
  Synthetic
accaggttaaaattgggggatttgggagaaaatagtctattgcgtattttctgttcaataattggactgcgttat

SEQ ID NO: 157620 - DNA, 75 bp, Artificial Sequence
  Synthetic
ttataaaaggaattactcctttaaattttacttaatgtacccacaatatcaagtggtcgtttgtatttaacgatt

SEQ ID NO: 157621 - DNA, 75 bp, Artificial Sequence
  Synthetic
ttttacttaatgtacccacaatatcaagtggtcgtttgtatttaacgattattaccggtaccatgggagacttgt

SEQ ID NO: 157622 - DNA, 75 bp, Artificial Sequence
  Synthetic
tacgttaaccggcgaacttcagtacttaaaacaagtggatgatattttaaggtatggagttcggaaacgcgatcg

SEQ ID NO: 157623 - DNA, 75 bp, Artificial Sequence
  Synthetic
ttaaaacaagtggatgatattttaaggtatggagttcggaaacgcgatcgaacaggaatcggaacgttatcttta

SEQ ID NO: 157624 - DNA, 75 bp, Artificial Sequence
  Synthetic
tgcgaaatgaatttcctcttttaactacaaagcgtgttttttggagggccgtcgtggaagagttgttatggttta

SEQ ID NO: 157625 - DNA, 75 bp, Artificial Sequence
  Synthetic
tacaaagcgtgttttttggagggccgtcgtggaagagttgttatggtttatccgcgggtcaaccgattccaaaga

SEQ ID NO: 157626 - DNA, 75 bp, Artificial Sequence
  Synthetic
tgggatatatacggatcgagcaaatttctaaataggaatggcttccataaaagacacacgggggaccttggcccc

SEQ ID NO: 157627 - DNA, 75 bp, Artificial Sequence
  Synthetic
ttctaaataggaatggcttccataaaagacacacgggggaccttggccccatttacggcttccagtggagacatt

SEQ ID NO: 157628 - DNA, 75 bp, Artificial Sequence
  Synthetic
atcaaactatttacagcaaggaatcgatcagctgcaaactgttatagatacaattaaaacaaacccagaaagccg

SEQ ID NO: 157629 - DNA, 75 bp, Artificial Sequence
  Synthetic
gatcagctgcaaactgttatagatacaattaaaacaaacccagaaagccgacgaatgattatatcgtcttggaat

SEQ ID NO: 157630 - DNA, 75 bp, Artificial Sequence
  Synthetic
tacctccatgtcacacgttatgtcagttttacgttgcaaacggtgaattatcctgccaagtataccagagatcgg

SEQ ID NO: 157631 - DNA, 75 bp, Artificial Sequence
  Synthetic
gttttacgttgcaaacggtgaattatcctgccaagtataccagagatcgggggatatgggccttggggtaccgtt

SEQ ID NO: 157632 - DNA, 75 bp, Artificial Sequence
  Synthetic
acctacatagtagcgcatgttacaggacttaaaaccggagatttaattcatacaatgggggatgcacatatttac

SEQ ID NO: 157633 - DNA, 75 bp, Artificial Sequence
  Synthetic
gacttaaaaccggagatttaattcatacaatgggggatgcacatatttacttgaatcatatagatgctttaaaag

SEQ ID NO: 157634 - DNA, 75 bp, Artificial Sequence
  Synthetic
ttttccttgccttaaaattattcgaaatgtaacagatataaacgactttaaatgggacgattttcagcttgatgg

SEQ ID NO: 157635 - DNA, 75 bp, Artificial Sequence
  Synthetic
aatgtaacagatataaacgactttaaatgggacgattttcagcttgatggatataatccacacccccccctaaaa

SEQ ID NO: 157636 - DNA, 75 bp, Artificial Sequence
  Synthetic
ttaaatgttgtcaagacagtagatgtgttgcgaatgtaataaaatgatatacacagacgcgtttggttggtttct

SEQ ID NO: 157637 - DNA, 75 bp, Artificial Sequence
  Synthetic
tgttgcgaatgtaataaaatgatatacacagacgcgtttggttggtttctgtttatgaacagcaacggatgcata

SEQ ID NO: 157638 - DNA, 75 bp, Artificial Sequence
  Synthetic
caatgtcccaaggatagatatcacaccaattataactgctacaacggaaaatgtagtggcgtaggtagatgcatc

SEQ ID NO: 157639 - DNA, 75 bp, Artificial Sequence
  Synthetic
ccaattataactgctacaacggaaaatgtagtggcgtaggtagatgcatcgtaggtataaacggccgaaaacgga

SEQ ID NO: 157640 - DNA, 75 bp, Artificial Sequence
  Synthetic
gatgacacgaataggtgataggtccgtcgagttccgatgttggacaagaactttgcatgtttacaaaccgtttgt

SEQ ID NO: 157641 - DNA, 75 bp, Artificial Sequence
  Synthetic
gtcgagttccgatgttggacaagaactttgcatgtttacaaaccgtttgttttgatcacacaccccagtaatctc

SEQ ID NO: 157642 - DNA, 75 bp, Artificial Sequence
  Synthetic
tcgttaacccaccatacgaaatgtacaacgccacgtggcacacattttgccgtacatactatgtgtccatcaata

SEQ ID NO: 157643 - DNA, 75 bp, Artificial Sequence
  Synthetic
caacgccacgtggcacacattttgccgtacatactatgtgtccatcaataatacctatagacacgttgggaaatg

SEQ ID NO: 157644 - DNA, 75 bp, Artificial Sequence
  Synthetic
agaatatttcatattagagacgccatcccgaatccataaaacattacattggatggctgggggtgggtaatccat

SEQ ID NO: 157645 - DNA, 75 bp, Artificial Sequence
  Synthetic
tcccgaatccataaaacattacattggatggctgggggtgggtaatccatttgtttttgctgtggaattcgtacc

SEQ ID NO: 157646 - DNA, 75 bp, Artificial Sequence
  Synthetic
tggcatattcttgtattgcatcggttataaaattttttccgatgttaccaaaccttgaagtccaccgaacacgta

SEQ ID NO: 157647 - DNA, 75 bp, Artificial Sequence
  Synthetic
tataaaattttttccgatgttaccaaaccttgaagtccaccgaacacgtaccgagtgcggtggataatactttga

SEQ ID NO: 157648 - DNA, 75 bp, Artificial Sequence
  Synthetic
tgtccggttaagactggatcgccgacaacggtaatatttggacgataatacgttgtaactgtaatactgtgttcc

SEQ ID NO: 157649 - DNA, 75 bp, Artificial Sequence
  Synthetic
caacggtaatatttggacgataatacgttgtaactgtaatactgtgttccgatataacgttcttagtttttgtat

SEQ ID NO: 157650 - DNA, 75 bp, Artificial Sequence
  Synthetic
ctccgtggtagcatccatagataaaattgttacagaaaaatcagacgttgttttaacatctggtattacataatt

SEQ ID NO: 157651 - DNA, 75 bp, Artificial Sequence
  Synthetic
attgttacagaaaaatcagacgttgttttaacatctggtattacataattttccttagcgtgtgtaaatatctca

SEQ ID NO: 157652 - DNA, 75 bp, Artificial Sequence
  Synthetic
cactgttgctatataacataaccggtaaatctggcatgcgtattaacgcattgcccagttgacggtgcggatcta

SEQ ID NO: 157653 - DNA, 75 bp, Artificial Sequence
  Synthetic
taaatctggcatgcgtattaacgcattgcccagttgacggtgcggatctataaggtgacgcgtaaaccaaacttc

SEQ ID NO: 157654 - DNA, 75 bp, Artificial Sequence
  Synthetic
gacttccaccttgttatatttgaaccttccggatctaaagaatattgttcatatgttttttgttgctgcttaaag

SEQ ID NO: 157655 - DNA, 75 bp, Artificial Sequence
  Synthetic
cttccggatctaaagaatattgttcatatgttttttgttgctgcttaaaggccgcctgttgtccggtcgttagac

SEQ ID NO: 157656 - DNA, 75 bp, Artificial Sequence
  Synthetic
ccgccgtgaacgcattgtatattttcaaatagaaaaggtggttgtgaatgttgggcgttggctgcgggatcgggc

SEQ ID NO: 157657 - DNA, 75 bp, Artificial Sequence
  Synthetic
ccacgctccccttaaataaaagattaaaacacccaccgcggaatttaaatgatggaaacgtttttttcgacattg

SEQ ID NO: 157658 - DNA, 75 bp, Artificial Sequence
  Synthetic
aaaacacccaccgcggaatttaaatgatggaaacgtttttttcgacattgggaataataaaaacggcttttgcaa

SEQ ID NO: 157659 - DNA, 75 bp, Artificial Sequence
  Synthetic
tacgatacatatgtaccacatagatagcatagatttattataatataaacacacacgtgatatactttagtgata

SEQ ID NO: 157660 - DNA, 75 bp, Artificial Sequence
  Synthetic
agcatagatttattataatataaacacacacgtgatatactttagtgatatgagatgccataaaacagtcaatag

SEQ ID NO: 157661 - DNA, 75 bp, Artificial Sequence
  Synthetic
aatacacgtcaaacccgccgcaactgttgatgttagaattataatagctccccatgaaatgccggcaaatgttac

SEQ ID NO: 157662 - DNA, 75 bp, Artificial Sequence
  Synthetic
gttgatgttagaattataatagctccccatgaaatgccggcaaatgttacagctatacccgtcaccgaggtcgtt

SEQ ID NO: 157663 - DNA, 75 bp, Artificial Sequence
  Synthetic
tttttttttcttgatataaaacggcaaaaccctgtaacccaaatgctataatatgacctcctattgaaactgcta

SEQ ID NO: 157664 - DNA, 75 bp, Artificial Sequence
  Synthetic
aaaaccctgtaacccaaatgctataatatgacctcctattgaaactgctaacgttacttgtgtaagtttgataaa

SEQ ID NO: 157665 - DNA, 75 bp, Artificial Sequence
  Synthetic
attgcccacattaatggggtaactatatataacaccgggggtataacagacattatacgaattcctttaaacacg

SEQ ID NO: 157666 - DNA, 75 bp, Artificial Sequence
  Synthetic
tatataacaccgggggtataacagacattatacgaattcctttaaacacgcgtttaagggtccgggaactttctc

SEQ ID NO: 157667 - DNA, 75 bp, Artificial Sequence
  Synthetic
attttgtgtatatacaacggcaaaacctaaatctgtataagtgtttaattgcttatggcgatttttacgatatat

SEQ ID NO: 157668 - DNA, 75 bp, Artificial Sequence
  Synthetic
cctaaatctgtataagtgtttaattgcttatggcgatttttacgatatatacacgtatcttgcaaatcggtggcg

SEQ ID NO: 157669 - DNA, 75 bp, Artificial Sequence
  Synthetic
caatagatatacacaatccaataagaacctcatatttactgacatacatatataaaataacggttagtaaacctc

SEQ ID NO: 157670 - DNA, 75 bp, Artificial Sequence
  Synthetic
aacctcatatttactgacatacatatataaaataacggttagtaaacctcccaacccagttcccaacatcataac

SEQ ID NO: 157671 - DNA, 75 bp, Artificial Sequence
  Synthetic
aatgtcgtaacaaagttgtagtaatggatatgcacagcagccactgttccggtaatcgcggatatggaaattccc

SEQ ID NO: 157672 - DNA, 75 bp, Artificial Sequence
  Synthetic
ggatatgcacagcagccactgttccggtaatcgcggatatggaaattcccagtaattctacaaatggaagatccc

SEQ ID NO: 157673 - DNA, 75 bp, Artificial Sequence
  Synthetic
taacacagcaaaacccaacacgaccaccgtctgcaaacatcgtcccaattttgctaatgtgcgtagaaatttcac

SEQ ID NO: 157674 - DNA, 75 bp, Artificial Sequence
  Synthetic
accgtctgcaaacatcgtcccaattttgctaatgtgcgtagaaatttcacggatgttggccataaccccgaaacg

SEQ ID NO: 157675 - DNA, 75 bp, Artificial Sequence
  Synthetic
tgacggcagcttcgcagacgtgatattgtaaaattaacccggacgtgataacacttgcttgtagtcccacgagaa

SEQ ID NO: 157676 - DNA, 75 bp, Artificial Sequence
  Synthetic
ttgtaaaattaacccggacgtgataacacttgcttgtagtcccacgagaaacaaccgcgatgctgaggttattgc

SEQ ID NO: 157677 - DNA, 75 bp, Artificial Sequence
  Synthetic
ccgacacatccttggattgattgagcgcggattaattctctgtctaacacacccaggttttcatcatggacagct

SEQ ID NO: 157678 - DNA, 75 bp, Artificial Sequence
  Synthetic
cgcggattaattctctgtctaacacacccaggttttcatcatggacagctctttcaccattcacggccatgtctt

SEQ ID NO: 157679 - DNA, 75 bp, Artificial Sequence
  Synthetic
aaatgtgttcatctatggtacacacaagtttgtatgtaaaatataagcaaaagttgcacttatttaactgtacat

SEQ ID NO: 157680 - DNA, 75 bp, Artificial Sequence
  Synthetic
aagtttgtatgtaaaatataagcaaaagttgcacttatttaactgtacatattacgtcagattcacgtgataatt

SEQ ID NO: 157681 - DNA, 75 bp, Artificial Sequence
  Synthetic
gtccactggaggagccacacaatattcgcgaattccgattccctcctgccatgtggtttcggggagtttcccccc

SEQ ID NO: 157682 - DNA, 75 bp, Artificial Sequence
  Synthetic
tcgcgaattccgattccctcctgccatgtggtttcggggagtttcccccccattttatttccggtatttttttcg

SEQ ID NO: 157683 - DNA, 75 bp, Artificial Sequence
  Synthetic
ttttttttaatggtggttcatccttcacagattccatgttcgcaaataattgcatcgaggttaatttttctttaa

SEQ ID NO: 157684 - DNA, 75 bp, Artificial Sequence
  Synthetic
cacagattccatgttcgcaaataattgcatcgaggttaatttttctttaaggtctttgggacttaagaacgttgc

SEQ ID NO: 157685 - DNA, 75 bp, Artificial Sequence
  Synthetic
gaacgttggatatacaatccaaccatgggggagttagttaaggcgagataaaaattaatataacacgtctcatcc

SEQ ID NO: 157686 - DNA, 75 bp, Artificial Sequence
  Synthetic
tgggggagttagttaaggcgagataaaaattaatataacacgtctcatcccgtgttaacttaagattttgtacgg

SEQ ID NO: 157687 - DNA, 75 bp, Artificial Sequence
  Synthetic
caataatactccaaattcacgcatactcccgctgccataaacaacattattaaggatcctttttgaatttgtgat

SEQ ID NO: 157688 - DNA, 75 bp, Artificial Sequence
  Synthetic
ctcccgctgccataaacaacattattaaggatcctttttgaatttgtgattgagcgtattaaattatatggtgta

SEQ ID NO: 157689 - DNA, 75 bp, Artificial Sequence
  Synthetic
aaacattaaatgagataaaaccacccccggcggtctggatgtacatatccgtggctgttagaatgaagcatgttg

SEQ ID NO: 157690 - DNA, 75 bp, Artificial Sequence
  Synthetic
cccggcggtctggatgtacatatccgtggctgttagaatgaagcatgttgtaaacccaaaagttttaagtagtcg

SEQ ID NO: 157691 - DNA, 75 bp, Artificial Sequence
  Synthetic
tttaagcaaatgcttatatctggagttagatttgggaacatcattgtataacaagcgagttcacgttttacaact

SEQ ID NO: 157692 - DNA, 75 bp, Artificial Sequence
  Synthetic
acaagcgagttcacgttttacaacttgtttgtaacattgtacttgatcatctggaccacaatcacccgggcgttg

SEQ ID NO: 157693 - DNA, 75 bp, Artificial Sequence
  Synthetic
cgctcggggggttgtccggtgaatttaaaatataaccgtgttggggtcgacggatcttttgtatggcgaaacgcg

SEQ ID NO: 157694 - DNA, 75 bp, Artificial Sequence
  Synthetic
taaaatataaccgtgttggggtcgacggatcttttgtatggcgaaacgcgtcaataagcgaggaccgtccctccg

SEQ ID NO: 157695 - DNA, 75 bp, Artificial Sequence
  Synthetic
cccagtccaattatactggtcaaacatatttgccggtataggaatatacagttgttctgtttccaaactacagtg

SEQ ID NO: 157696 - DNA, 75 bp, Artificial Sequence
  Synthetic
atatttgccggtataggaatatacagttgttctgtttccaaactacagtgaataattaatccttcgtcgctgaat

SEQ ID NO: 157697 - DNA, 75 bp, Artificial Sequence
  Synthetic
taaccagaggtgatatagacgaaattaaaccagtaagcgttttttccgttaaaacagctctggcgatttctgggg

SEQ ID NO: 157698 - DNA, 75 bp, Artificial Sequence
  Synthetic
taaaccagtaagcgttttttccgttaaaacagctctggcgatttctggggcgtcaaaacccgcatgcaattccat

SEQ ID NO: 157699 - DNA, 75 bp, Artificial Sequence
  Synthetic
ctcaaatccataatttactacttaaaatgtttactatagaaaaagtaatcatatgtaaacacacgagtttcgtta

SEQ ID NO: 157700 - DNA, 75 bp, Artificial Sequence
  Synthetic
aatgtttactatagaaaaagtaatcatatgtaaacacacgagtttcgttaatatgtttgtttaacccgatccggt

SEQ ID NO: 157701 - DNA, 75 bp, Artificial Sequence
  Synthetic
tatttgaatagtacggcccatgggagggaacatttccacgtgttccaatacagggggtgttccttaatagggact

SEQ ID NO: 157702 - DNA, 75 bp, Artificial Sequence
  Synthetic
gggaacatttccacgtgttccaatacagggggtgttccttaatagggactgtgcaataaaatacgtaagaagtta

SEQ ID NO: 157703 - DNA, 75 bp, Artificial Sequence
  Synthetic
aaaaaatatgtacatcattatatacgtctgtaattaacacaagatcacatcgaagaatcactgaagccgctgtga

SEQ ID NO: 157704 - DNA, 75 bp, Artificial Sequence
  Synthetic
gtctgtaattaacacaagatcacatcgaagaatcactgaagccgctgtgaaacctttcacaagacgatataaact

SEQ ID NO: 157705 - DNA, 75 bp, Artificial Sequence
  Synthetic
ttggactgacacgctttatccatgaacataaactggttaaacccagcatcatttcaacgccacccggagttttaa

SEQ ID NO: 157706 - DNA, 75 bp, Artificial Sequence
  Synthetic
acataaactggttaaacccagcatcatttcaacgccacccggagttttaacccccgtggcggtagacgtatggaa

SEQ ID NO: 157707 - DNA, 75 bp, Artificial Sequence
  Synthetic
ttataccctgtgggtaaacgcgagaatttacacggaccatctgtcacgatacattgtcttggagtcttattgcgg

SEQ ID NO: 157708 - DNA, 75 bp, Artificial Sequence
  Synthetic
atttacacggaccatctgtcacgatacattgtcttggagtcttattgcggctattaacacaacggtcatactatc

SEQ ID NO: 157709 - DNA, 75 bp, Artificial Sequence
  Synthetic
agacggcccattatcacgtggagccaaggcaattatgtcacgggccatgaaccacgatgaaaggggaacctcgga

SEQ ID NO: 157710 - DNA, 75 bp, Artificial Sequence
  Synthetic
aaggcaattatgtcacgggccatgaaccacgatgaaaggggaacctcggacttaacccgtgttctactatcatcc

SEQ ID NO: 157711 - DNA, 75 bp, Artificial Sequence
  Synthetic
acaaaacatcggaaacatatgacagtgtgtttcgaaactcttccgcgagttgtattcctagcgaagaaaacaaat

SEQ ID NO: 157712 - DNA, 75 bp, Artificial Sequence
  Synthetic
tgtgtttcgaaactcttccgcgagttgtattcctagcgaagaaaacaaatcccaggatatgtttttggacggttg

SEQ ID NO: 157713 - DNA, 75 bp, Artificial Sequence
  Synthetic
tgcctgcgcgaccaaaacgtatgcagtcttacctctacaatgccatcccgaggacatcctaaccatcgattatat

SEQ ID NO: 157714 - DNA, 75 bp, Artificial Sequence
  Synthetic
gtcttacctctacaatgccatcccgaggacatcctaaccatcgattatatcacaaattgtgtgcaagtcttatta

SEQ ID NO: 157715 - DNA, 75 bp, Artificial Sequence
  Synthetic
ggcggttgacattgaggcggacgaggcatgtgcaaacttatttcatacgcgtacagtggctttggtttatacgac

SEQ ID NO: 157716 - DNA, 75 bp, Artificial Sequence
  Synthetic
gcatgtgcaaacttatttcatacgcgtacagtggctttggtttatacgacagatactgatttactcttcatgggc

SEQ ID NO: 157717 - DNA, 75 bp, Artificial Sequence
  Synthetic
ctatgtttgctccagtagtacgatgtcgcgatttgcttcaatatttaggaattacataccctgaatttttggttg

SEQ ID NO: 157718 - DNA, 75 bp, Artificial Sequence
  Synthetic
tcgcgatttgcttcaatatttaggaattacataccctgaatttttggttgcctttgttcgctgtcagaccgattt

SEQ ID NO: 157719 - DNA, 75 bp, Artificial Sequence
  Synthetic
gttcagcaagttattcaggataccggcctgaaaattccacatcaaatggacacttcaacgcgctcccccacttac

SEQ ID NO: 157720 - DNA, 75 bp, Artificial Sequence
  Synthetic
gcctgaaaattccacatcaaatggacacttcaacgcgctcccccacttacgactcgtggagacatggcgaggttt

SEQ ID NO: 157721 - DNA, 75 bp, Artificial Sequence
  Synthetic
gggtaaaacagaaaacggagtgtccgtttccaaatatgcatctaaccgatcggaggtgacagtagacgccagttg

SEQ ID NO: 157722 - DNA, 75 bp, Artificial Sequence
  Synthetic
gtttccaaatatgcatctaaccgatcggaggtgacagtagacgccagttgggctttaaaccttctgccaccctca

SEQ ID NO: 157723 - DNA, 75 bp, Artificial Sequence
  Synthetic
gcgcatttgttgaacatataatcgccgtggtaactccattgacccgcggtcgcctaaagttaatgaaacgtgtaa

SEQ ID NO: 157724 - DNA, 75 bp, Artificial Sequence
  Synthetic
cgtggtaactccattgacccgcggtcgcctaaagttaatgaaacgtgtaaatattatgcaaaatacggcagaccc

SEQ ID NO: 157725 - DNA, 75 bp, Artificial Sequence
  Synthetic
cataacttaaagggggaaaaaatggctcgccaatacgcacgtatttttaaacagtttattcctactccactccca

SEQ ID NO: 157726 - DNA, 75 bp, Artificial Sequence
  Synthetic
ctcgccaatacgcacgtatttttaaacagtttattcctactccactcccactaaacactgtattaacaaaatatt

SEQ ID NO: 157727 - DNA, 75 bp, Artificial Sequence
  Synthetic
cttaatggttcattgttttattttgctcgtatatacatgttataaatcgtttatcactgtgcccgcataagatgt

SEQ ID NO: 157728 - DNA, 75 bp, Artificial Sequence
  Synthetic
ctcgtatatacatgttataaatcgtttatcactgtgcccgcataagatgtactgtgtctctcaaaaaaatttgtg

SEQ ID NO: 157729 - DNA, 75 bp, Artificial Sequence
  Synthetic
gtggaaagtccgaatcgggaggtggggtgttaaatagttttggtacattaatcgctgataaaagcctgtccgcgc

SEQ ID NO: 157730 - DNA, 75 bp, Artificial Sequence
  Synthetic
ggtgttaaatagttttggtacattaatcgctgataaaagcctgtccgcgctgaatttcacgtattgtgtaattgc

SEQ ID NO: 157731 - DNA, 75 bp, Artificial Sequence
  Synthetic
ggtgcatgggattttaaaaacgcacactcgatttcaacggcttccgaaaacagttgatgtattctggtgatagcg

SEQ ID NO: 157732 - DNA, 75 bp, Artificial Sequence
  Synthetic
actcgatttcaacggcttccgaaaacagttgatgtattctggtgatagcgggtttttcgggtacatagttattgt

SEQ ID NO: 157733 - DNA, 75 bp, Artificial Sequence
  Synthetic
tatggcttcatctcggcttataaggtcgttaaattgacaagttacaacaaatagtccgttattgcgtaaatatgc

SEQ ID NO: 157734 - DNA, 75 bp, Artificial Sequence
  Synthetic
tcgttaaattgacaagttacaacaaatagtccgttattgcgtaaatatgcaatagccgcgaacgatgatacaaaa

SEQ ID NO: 157735 - DNA, 75 bp, Artificial Sequence
  Synthetic
gtatatatttttctgcaacggatgggttgtcccgtaccttttcttccaaccattgtactttttgttggatcgacg

SEQ ID NO: 157736 - DNA, 75 bp, Artificial Sequence
  Synthetic
gttgtcccgtaccttttcttccaaccattgtactttttgttggatcgacggattattaatagtgacatttacgta

SEQ ID NO: 157737 - DNA, 75 bp, Artificial Sequence
  Synthetic
ctgaacaacattagttgaatttgactatagacacgcgcgtggacaacctcgatgcactcttgttcaatgtagtaa

SEQ ID NO: 157738 - DNA, 75 bp, Artificial Sequence
  Synthetic
tatagacacgcgcgtggacaacctcgatgcactcttgttcaatgtagtaatggtgaatatccttttgggaaaaga

SEQ ID NO: 157739 - DNA, 75 bp, Artificial Sequence
  Synthetic
atttaccagatcatctgccgccgataaaaatgtaaaaataaatctgtagaatattagttcatcttccgttaaaca

SEQ ID NO: 157740 - DNA, 75 bp, Artificial Sequence
  Synthetic
aaaaatgtaaaaataaatctgtagaatattagttcatcttccgttaaacagtccaagtattgataatcatcttca

SEQ ID NO: 157741 - DNA, 75 bp, Artificial Sequence
  Synthetic
gattcgaaatgctcagggcacgtaaattgtttatatctggacactccggcctgtaaaaaaaatgactgcaatctt

SEQ ID NO: 157742 - DNA, 75 bp, Artificial Sequence
  Synthetic
ttttttatcacgtcaaatcgattttaaaaagcctgccgctccatttggaatatatatattctgtgaaaagcccgc

SEQ ID NO: 157743 - DNA, 75 bp, Artificial Sequence
  Synthetic
attgtttatatctggacactccggcctgtaaaaaaaatgactgcaatctttctgatccattttggaatagtttcc

SEQ ID NO: 157744 - DNA, 75 bp, Artificial Sequence
  Synthetic
tatatatattctgtgaaaagcccgcccacaccccataaaaccgcgacatcgcgggaacacgcgcgaacaagaaac

SEQ ID NO: 157745 - DNA, 75 bp, Artificial Sequence
  Synthetic
gtacaggttaattcgcctcccgcaaacagtccgctgttcgtagctttacgaattttacagtagtacatacccgtt

SEQ ID NO: 157746 - DNA, 75 bp, Artificial Sequence
  Synthetic
acagtccgctgttcgtagctttacgaattttacagtagtacatacccgttttaaggccggctttataggcacgta

SEQ ID NO: 157747 - DNA, 75 bp, Artificial Sequence
  Synthetic
gggaattgtcccgtctgggcgttcctcaataaataaagtcattgattgactttggtcaataaatggcgccctttc

SEQ ID NO: 157748 - DNA, 75 bp, Artificial Sequence
  Synthetic
tcaataaataaagtcattgattgactttggtcaataaatggcgccctttctgcacacatatcaacgagatcctct

SEQ ID NO: 157749 - DNA, 75 bp, Artificial Sequence
  Synthetic
attttaagagtgggtgactattagataaacagccaaacgaacgtattactgaccattggtttttctcaagtatgt

SEQ ID NO: 157750 - DNA, 75 bp, Artificial Sequence
  Synthetic
taaacagccaaacgaacgtattactgaccattggtttttctcaagtatgtttataacttccagtcgtttttcttc

SEQ ID NO: 157751 - DNA, 75 bp, Artificial Sequence
  Synthetic
tccataaggtctaagttgggtctaagtaactcacccgaggtggtgaccttactaaacatattattataaattgga

SEQ ID NO: 157752 - DNA, 75 bp, Artificial Sequence
  Synthetic
gtaactcacccgaggtggtgaccttactaaacatattattataaattggagagaaaccctcactgcactccgtta

SEQ ID NO: 157753 - DNA, 75 bp, Artificial Sequence
  Synthetic
taacgctaagaactgcgagttgtataacccataagcgcaaatatcatctcgcagggtacaccatggtaaatctaa

SEQ ID NO: 157754 - DNA, 75 bp, Artificial Sequence
  Synthetic
aacccataagcgcaaatatcatctcgcagggtacaccatggtaaatctaaataacttatcgtagaaaacccatct

SEQ ID NO: 157755 - DNA, 75 bp, Artificial Sequence
  Synthetic
tactttcggtaaaacccttaaacggggctaagccgccaatcttacacatttccatgcttgttttcattgtctcat

SEQ ID NO: 157756 - DNA, 75 bp, Artificial Sequence
  Synthetic
ggctaagccgccaatcttacacatttccatgcttgttttcattgtctcatacaacattaactccgctatttgtac

SEQ ID NO: 157757 - DNA, 75 bp, Artificial Sequence
  Synthetic
gttaaatcaaatcctaagcggagacaagttgtatgtaacccttgtatgccaatgccaagtgatcggttgtttttt

SEQ ID NO: 157758 - DNA, 75 bp, Artificial Sequence
  Synthetic
aagttgtatgtaacccttgtatgccaatgccaagtgatcggttgttttttacacctttacatgattttttacatg

SEQ ID NO: 157759 - DNA, 75 bp, Artificial Sequence
  Synthetic
gtttaaaaaaataacagtcgttcttgctgtcaattgaaggtcgtttaaattaaatgacactgggcctttggataa

SEQ ID NO: 157760 - DNA, 75 bp, Artificial Sequence
  Synthetic
gctgtcaattgaaggtcgtttaaattaaatgacactgggcctttggataagcacgttgtaagatttatgctggca

SEQ ID NO: 157761 - DNA, 75 bp, Artificial Sequence
  Synthetic
cgtctgccttttgaacaatttccgtacacaaatttgaccccgtgatagcatttccttgggtattcatatgataat

SEQ ID NO: 157762 - DNA, 75 bp, Artificial Sequence
  Synthetic
acacaaatttgaccccgtgatagcatttccttgggtattcatatgataattacgattacaggcatctttgaacat

SEQ ID NO: 157763 - DNA, 75 bp, Artificial Sequence
  Synthetic
gcactgcgtatgattgtgaatgcgatatcttgaatgggaacagaagaaacgcctaatccttctctctctaaacgt

SEQ ID NO: 157764 - DNA, 75 bp, Artificial Sequence
  Synthetic
tatcttgaatgggaacagaagaaacgcctaatccttctctctctaaacgtaaataggttgaagtgaatgcctccc

SEQ ID NO: 157765 - DNA, 75 bp, Artificial Sequence
  Synthetic
tctgttatcaaaaagagtccactgaacattactagccccttttagatagcttaggtatctttcaaaaaataaatc

SEQ ID NO: 157766 - DNA, 75 bp, Artificial Sequence
  Synthetic
acattactagccccttttagatagcttaggtatctttcaaaaaataaatctggggtccataaacaacaaaatatg

SEQ ID NO: 157767 - DNA, 75 bp, Artificial Sequence
  Synthetic
gaaccaacattccacgtgtggccaaaacagtttgtagatcgacgtgccatggttctatgtaaacacaaactccag

SEQ ID NO: 157768 - DNA, 75 bp, Artificial Sequence
  Synthetic
aacagtttgtagatcgacgtgccatggttctatgtaaacacaaactccagttggtcgttcacaatcactgttaat

SEQ ID NO: 157769 - DNA, 75 bp, Artificial Sequence
  Synthetic
tttaaaactgcaagaagacctttcgtttgattttccgtaggtattaaattcagactctgtagagaaattcccact

SEQ ID NO: 157770 - DNA, 75 bp, Artificial Sequence
  Synthetic
tttgattttccgtaggtattaaattcagactctgtagagaaattcccactccgcctcgactttgtaataccgttc

SEQ ID NO: 157771 - DNA, 75 bp, Artificial Sequence
  Synthetic
agctctcccaacagtgatggattccgggtccattaaataacaactggccgttgccccggtctctcgacctaaaaa

SEQ ID NO: 157772 - DNA, 75 bp, Artificial Sequence
  Synthetic
gggtccattaaataacaactggccgttgccccggtctctcgacctaaaaacatcataaccggtgtagccgggaca

SEQ ID NO: 157773 - DNA, 75 bp, Artificial Sequence
  Synthetic
aaaatacccgacagacatcagtccatgtataaccatcatttattccgggaataagagttgcgattttaggcaggt

SEQ ID NO: 157774 - DNA, 75 bp, Artificial Sequence
  Synthetic
tgtataaccatcatttattccgggaataagagttgcgattttaggcaggtttacgatttctgttgtcacggtggc

SEQ ID NO: 157775 - DNA, 75 bp, Artificial Sequence
  Synthetic
agcgactctaatttaccttcctctaacttagttaaataaaagtcttcgtactttaaagcagactgtagtccaagg

SEQ ID NO: 157776 - DNA, 75 bp, Artificial Sequence
  Synthetic
acttagttaaataaaagtcttcgtactttaaagcagactgtagtccaagggtagctaaagcggggtattgatctt

SEQ ID NO: 157777 - DNA, 75 bp, Artificial Sequence
  Synthetic
acgaatttcgtccctccgcccttcaattgcttggcggactcggggagttaaacagagaattggggaagtcaacca

SEQ ID NO: 157778 - DNA, 75 bp, Artificial Sequence
  Synthetic
attgcttggcggactcggggagttaaacagagaattggggaagtcaaccacgtttccatggaaacggatcgtagg

SEQ ID NO: 157779 - DNA, 75 bp, Artificial Sequence
  Synthetic
tcgacgacgagggagaggcggaggagggagaggcggaggaggacgcgatcgacgacgagggagaggcggaggagg

SEQ ID NO: 157780 - DNA, 75 bp, Artificial Sequence
  Synthetic
cacaacatcggtacactcgctcatcttgtcgcgtcaccgccttaagttttgagacgatagtgctaatatactcca

SEQ ID NO: 157781 - DNA, 75 bp, Artificial Sequence
  Synthetic
ttaattccaccggtgtggttgattcgggcggaatgatgtattccttgtagccatgttgacataatcggtttataa

SEQ ID NO: 157782 - DNA, 75 bp, Artificial Sequence
  Synthetic
tttgaactccataacggataacgtatttaggctccggaataaacctttaaaccctaaactcacagctgagttagt

SEQ ID NO: 157783 - DNA, 75 bp, Artificial Sequence
  Synthetic
tttaggctccggaataaacctttaaaccctaaactcacagctgagttagttctacaatattgtagactcccttat

SEQ ID NO: 157784 - DNA, 75 bp, Artificial Sequence
  Synthetic
ccccagtatataatatcacgcaaaacccacgctatgttaaattcagtttattttacatacatgctttaataataa

SEQ ID NO: 157785 - DNA, 75 bp, Artificial Sequence
  Synthetic
cccacgctatgttaaattcagtttattttacatacatgctttaataataacattcgttccatgtatttgtacccc

SEQ ID NO: 157786 - DNA, 75 bp, Artificial Sequence
  Synthetic
agttggcacgttataacctccgaaccgttccatgcgtcttgtataacgcacagactctgatggaattgttccaat

SEQ ID NO: 157787 - DNA, 75 bp, Artificial Sequence
  Synthetic
cgttccatgcgtcttgtataacgcacagactctgatggaattgttccaattaacgtatatgccgcatacatgcag

SEQ ID NO: 157788 - DNA, 75 bp, Artificial Sequence
  Synthetic
aatcgccggtccattgatacaatcgctgtctagccaagttccaatttactcctgtaatttcgccaatactacatc

SEQ ID NO: 157789 - DNA, 75 bp, Artificial Sequence
  Synthetic
ctgtctagccaagttccaatttactcctgtaatttcgccaatactacatcgagggcttgtcgggtcattggataa

SEQ ID NO: 157790 - DNA, 75 bp, Artificial Sequence
  Synthetic
ttatatggctggtgggtatttgcaaccccttcagtcccccaggcggcattttcagctcgtatgcgtcctaacagg

SEQ ID NO: 157791 - DNA, 75 bp, Artificial Sequence
  Synthetic
ccccttcagtcccccaggcggcattttcagctcgtatgcgtcctaacaggaagccaataccacgaccaaaacatt

SEQ ID NO: 157792 - DNA, 75 bp, Artificial Sequence
  Synthetic
atgcagtcttacaccttctcgttggcgtcgctgtgtatatacaaaaaccaagaacacatgcttcagtccgtccgc

SEQ ID NO: 157793 - DNA, 75 bp, Artificial Sequence
  Synthetic
cgtcgctgtgtatatacaaaaaccaagaacacatgcttcagtccgtccgcggaaagatgtaaatctttgtcaacg

SEQ ID NO: 157794 - DNA, 75 bp, Artificial Sequence
  Synthetic
tggctgtgaccctgcgagttgaagttttgtctgtacgtgcagcttcttggggacctttggccacggcggttatat

SEQ ID NO: 157795 - DNA, 75 bp, Artificial Sequence
  Synthetic
tttgtctgtacgtgcagcttcttggggacctttggccacggcggttatattgcataaattatcctgaatggtata

SEQ ID NO: 157796 - DNA, 75 bp, Artificial Sequence
  Synthetic
ataaatcgatgtggaaatacatgacattgtaccatcgcacgtaaacactccgaaaaccttatgagccgcgtttcc

SEQ ID NO: 157797 - DNA, 75 bp, Artificial Sequence
  Synthetic
attgtaccatcgcacgtaaacactccgaaaaccttatgagccgcgtttccatacgactgcatccataggcagaaa

SEQ ID NO: 157798 - DNA, 75 bp, Artificial Sequence
  Synthetic
tgcctgtttatccgtatattcttctgcccggcatgcggcgatgaaacttaatgacgttacatatgctctaagccc

SEQ ID NO: 157799 - DNA, 75 bp, Artificial Sequence
  Synthetic
gcccggcatgcggcgatgaaacttaatgacgttacatatgctctaagccccccaccttctccaacggtccaagga

SEQ ID NO: 157800 - DNA, 75 bp, Artificial Sequence
  Synthetic
gtaaaccctctagtattacatcggggtcacgtccagcctgtgtaagtgtattagcttctccaatcatgtcagatg

SEQ ID NO: 157801 - DNA, 75 bp, Artificial Sequence
  Synthetic
gtcacgtccagcctgtgtaagtgtattagcttctccaatcatgtcagatggatgacgaaggattaagacgattga

SEQ ID NO: 157802 - DNA, 75 bp, Artificial Sequence
  Synthetic
aaaaaatcggttaatgacacttgttggattagctgtgtcgttgatttaaaattatttaacgggagtctaatggta

SEQ ID NO: 157803 - DNA, 75 bp, Artificial Sequence
  Synthetic
ggattagctgtgtcgttgatttaaaattatttaacgggagtctaatggtaacttgcgggttaccaattgaagttg

SEQ ID NO: 157804 - DNA, 75 bp, Artificial Sequence
  Synthetic
attaataacaattgaacggggggttacttgaatagacgcggtttctgtacgttttggtggtacatgtatcggttg

SEQ ID NO: 157805 - DNA, 75 bp, Artificial Sequence
  Synthetic
acttgaatagacgcggtttctgtacgttttggtggtacatgtatcggttgtttgttcagacctccaaagcgaggg

SEQ ID NO: 157806 - DNA, 75 bp, Artificial Sequence
  Synthetic
ttccgaagaagcccggagcataagtcatatgaagcccgttccctatttgaataaaacggttatttcctaaaagac

SEQ ID NO: 157807 - DNA, 75 bp, Artificial Sequence
  Synthetic
catatgaagcccgttccctatttgaataaaacggttatttcctaaaagactgatattagttccacatagcgtttg

SEQ ID NO: 157808 - DNA, 75 bp, Artificial Sequence
  Synthetic
gttggttgactccccatagctgagggggtaaattcacacaatgcaatcgtgacgtggtactatctgaaatgttgc

SEQ ID NO: 157809 - DNA, 75 bp, Artificial Sequence
  Synthetic
gggtaaattcacacaatgcaatcgtgacgtggtactatctgaaatgttgcctggggtatgtgtacacattataca

SEQ ID NO: 157810 - DNA, 75 bp, Artificial Sequence
  Synthetic
aggtaggaggagcctataaaaatattttgattggcgttaaaaggttcttcaacttaccgtgacgtcctttttatt

SEQ ID NO: 157811 - DNA, 75 bp, Artificial Sequence
  Synthetic
tttgattggcgttaaaaggttcttcaacttaccgtgacgtcctttttattaacatgcgtttttattgatgttaca

SEQ ID NO: 157812 - DNA, 75 bp, Artificial Sequence
  Synthetic
tgtagctttttcatatcacgttataaagttaagtcagcgtagaatataccatggaagaaccaatttgttatgata

SEQ ID NO: 157813 - DNA, 75 bp, Artificial Sequence
  Synthetic
aagttaagtcagcgtagaatataccatggaagaaccaatttgttatgatacacaaaaacttttggatgatttaag

SEQ ID NO: 157814 - DNA, 75 bp, Artificial Sequence
  Synthetic
aacgaaagaccatggtcaccagagaaaacagaaatcgccagagttaaggtagttaagtttttacgatctacccag

SEQ ID NO: 157815 - DNA, 75 bp, Artificial Sequence
  Synthetic
aaacagaaatcgccagagttaaggtagttaagtttttacgatctacccagaaaattccagctaaacattttattc

SEQ ID NO: 157816 - DNA, 75 bp, Artificial Sequence
  Synthetic
tatctgttttgtatattccaatacatttttggcggaggctgctttcacggccgaaaatttacccggactgttgtt

SEQ ID NO: 157817 - DNA, 75 bp, Artificial Sequence
  Synthetic
tttttggcggaggctgctttcacggccgaaaatttacccggactgttgttttggagactagatctagactggacg

SEQ ID NO: 157818 - DNA, 75 bp, Artificial Sequence
  Synthetic
aaattttaacccagctatcaagtgtagtacaagattccgagacgttacatcgtttatcggccaataaattacgaa

SEQ ID NO: 157819 - DNA, 75 bp, Artificial Sequence
  Synthetic
agtacaagattccgagacgttacatcgtttatcggccaataaattacgaacctcgtctaaatttggacccgtttc

SEQ ID NO: 157820 - DNA, 75 bp, Artificial Sequence
  Synthetic
ataaatatgtacgaggtcgccttaaaggatgcaacaacagccattgaatcaccattcactcacgctcgtattgga

SEQ ID NO: 157821 - DNA, 75 bp, Artificial Sequence
  Synthetic
aggatgcaacaacagccattgaatcaccattcactcacgctcgtattggaatgttggaaagcgccattgcagctt

SEQ ID NO: 157822 - DNA, 75 bp, Artificial Sequence
  Synthetic
ttacgatatgccatttgttcaagaggggattcgtgttttaacacaatatgcaggatggcttcttccgtttaatgt

SEQ ID NO: 157823 - DNA, 75 bp, Artificial Sequence
  Synthetic
gggattcgtgttttaacacaatatgcaggatggcttcttccgtttaatgttatgtggaatcagattcaaaatagc

SEQ ID NO: 157824 - DNA, 75 bp, Artificial Sequence
  Synthetic
tttttataatctgtatgattgatgaatatctcacggaaacgccagtacatagcatatcagaattatttgcagata

SEQ ID NO: 157825 - DNA, 75 bp, Artificial Sequence
  Synthetic
atatctcacggaaacgccagtacatagcatatcagaattatttgcagatactgtaaatttaattaaagatgaggc

SEQ ID NO: 157826 - DNA, 75 bp, Artificial Sequence
  Synthetic
acgaatccacgaacggtgcacgagtcacgaatttcctcagctctggcttatcgagacccttatgtttttgagaca

SEQ ID NO: 157827 - DNA, 75 bp, Artificial Sequence
  Synthetic
cgatgtgtggggagggcgcggggggaggagccccccgcagagtcgggggtgacggagtcccctccttttctcgtg

SEQ ID NO: 157828 - DNA, 75 bp, Artificial Sequence
  Synthetic
cacgaatttcctcagctctggcttatcgagacccttatgtttttgagacatccccgggaatgcttgctaggagac

SEQ ID NO: 157829 - DNA, 75 bp, Artificial Sequence
  Synthetic
aagcaacctcttatcgttgtccacccccggaattcatattgaggcgctgttacatttactaaactccgacccgga

SEQ ID NO: 157830 - DNA, 75 bp, Artificial Sequence
  Synthetic
cccggaattcatattgaggcgctgttacatttactaaactccgacccggaagcggaaaccacatctggaagtaat

SEQ ID NO: 157831 - DNA, 75 bp, Artificial Sequence
  Synthetic
gtgcgggcgggcgacgggcgggctggtcggacccccccccgaaaataaccccccccccggtttctgggcgcccgg

SEQ ID NO: 157832 - DNA, 75 bp, Artificial Sequence
  Synthetic
gagagagaaaaaaaaaaagcgaccccacctccccgcgcgtttgcggggcgaccattgggggggatgggatttttt

SEQ ID NO: 157833 - DNA, 75 bp, Artificial Sequence
  Synthetic
gggaaaaggttcaggctagtacatcgcctagtatgttaataagcacccttgccgaatccgggtttacaagatttt

SEQ ID NO: 157834 - DNA, 75 bp, Artificial Sequence
  Synthetic
gcctagtatgttaataagcacccttgccgaatccgggtttacaagattttcatgcaaattgctacgtcggtttat

SEQ ID NO: 157835 - DNA, 75 bp, Artificial Sequence
  Synthetic
attcacggaagcgttgtagcagacgagcatattacagatttccaacaaacactaggatgtctcgctttagtgggt

SEQ ID NO: 157836 - DNA, 75 bp, Artificial Sequence
  Synthetic
agcatattacagatttccaacaaacactaggatgtctcgctttagtgggtggactggcataccaattagtggaaa

SEQ ID NO: 157837 - DNA, 75 bp, Artificial Sequence
  Synthetic
gttaacatatacacggacagtaaacgagaccgaaaaacggtatgaaacgctattacccgccttaggattaccacc

SEQ ID NO: 157838 - DNA, 75 bp, Artificial Sequence
  Synthetic
gggaggcctgggacaaattatgcggcgctgttttgctccacgaccccttattgaaagtatacaagcgacacgcgt

SEQ ID NO: 157839 - DNA, 75 bp, Artificial Sequence
  Synthetic
gcagaagctagagagacaacatattttaagcaaacacataatcaatcctcaggtgcgttattaccacaagcagga

SEQ ID NO: 157840 - DNA, 75 bp, Artificial Sequence
  Synthetic
ttaagcaaacacataatcaatcctcaggtgcgttattaccacaagcaggacaaagtgccgtacgcgaagccgtac

SEQ ID NO: 157841 - DNA, 75 bp, Artificial Sequence
  Synthetic
ttcaagatggggtattactcccccggtggatgtgggtatgacacctcctatttgtgttgatccaccggctacagg

SEQ ID NO: 157842 - DNA, 75 bp, Artificial Sequence
  Synthetic
gtggatgtgggtatgacacctcctatttgtgttgatccaccggctacagggttggaagctgtcatgataacagaa

SEQ ID NO: 157843 - DNA, 75 bp, Artificial Sequence
  Synthetic
aatataatcgctctagcgtgtttgtggaaccgtcgtttgtgccttatattattgcaacaagcacgcttgatgccc

SEQ ID NO: 157844 - DNA, 75 bp, Artificial Sequence
  Synthetic
ggaaccgtcgtttgtgccttatattattgcaacaagcacgcttgatgccctttcggcaacaatagctttgtcttt

SEQ ID NO: 157845 - DNA, 75 bp, Artificial Sequence
  Synthetic
ttgtctattcttcagtgggctcgcgattatggatccggaaccgtgcccaatgcagatggatatcgcacaaaacta

SEQ ID NO: 157846 - DNA, 75 bp, Artificial Sequence
  Synthetic
attatggatccggaaccgtgcccaatgcagatggatatcgcacaaaactatctgctcttataacaatattagaac

SEQ ID NO: 157847 - DNA, 75 bp, Artificial Sequence
  Synthetic
acttttaccatctcacgtttctactatagattcccttatatgcgaacttcatcggactgttggcattgccgttga

SEQ ID NO: 157848 - DNA, 75 bp, Artificial Sequence
  Synthetic
atagattcccttatatgcgaacttcatcggactgttggcattgccgttgacctgcttccccagcacgtccgtcct

SEQ ID NO: 157849 - DNA, 75 bp, Artificial Sequence
  Synthetic
caaatagcgtttttttagcaactctctattatgatgaactttacggtcgttggacccgactggataaaacatcgc

SEQ ID NO: 157850 - DNA, 75 bp, Artificial Sequence
  Synthetic
ctattatgatgaactttacggtcgttggacccgactggataaaacatcgcaggcgttggttgaaaattttacatc

SEQ ID NO: 157851 - DNA, 75 bp, Artificial Sequence
  Synthetic
atgttaatgttacaaaaattttttgcgtgtcgtttttatccaacgccagatcttcaggcggttggtatctgtaac

SEQ ID NO: 157852 - DNA, 75 bp, Artificial Sequence
  Synthetic
cgtgtcgtttttatccaacgccagatcttcaggcggttggtatctgtaacccaaaggttgaacgcgatgaacaat

SEQ ID NO: 157853 - DNA, 75 bp, Artificial Sequence
  Synthetic
tgctgatgcggttggtcatattgttgggacaatacaaggaatccgaacgcaaatgagagtgggaatatccagcct

SEQ ID NO: 157854 - DNA, 75 bp, Artificial Sequence
  Synthetic
gggacaatacaaggaatccgaacgcaaatgagagtgggaatatccagcctgcgcacaattatggccgatgcttcc

SEQ ID NO: 157855 - DNA, 75 bp, Artificial Sequence
  Synthetic
taatgactaaaacctccacttctgctattgggcctcttttttcaacgatggcttcccggtatgcacggtttacac

SEQ ID NO: 157856 - DNA, 75 bp, Artificial Sequence
  Synthetic
tattgggcctcttttttcaacgatggcttcccggtatgcacggtttacacaggatcaaatggacattttaatgcg

SEQ ID NO: 157857 - DNA, 75 bp, Artificial Sequence
  Synthetic
aatatacccggtcttgcaaatgtagagatttttttaaataggtgggaacgaatagcaacagcttgtaggcatgcc

SEQ ID NO: 157858 - DNA, 75 bp, Artificial Sequence
  Synthetic
agatttttttaaataggtgggaacgaatagcaacagcttgtaggcatgccacggcagtcccgtctgccgaatcta

SEQ ID NO: 157859 - DNA, 75 bp, Artificial Sequence
  Synthetic
gcgcggtttaaaaaatatacaagaggatcgtgtaaatgccccaacctcatatatgagtcacgcccgaaatctgga

SEQ ID NO: 157860 - DNA, 75 bp, Artificial Sequence
  Synthetic
gatcgtgtaaatgccccaacctcatatatgagtcacgcccgaaatctggaagatcacaaggcagcagtttcattc

SEQ ID NO: 157861 - DNA, 75 bp, Artificial Sequence
  Synthetic
ttgtggattctggacctcagatgggcgcggttttaacttcacaatgtaatataggaacatgggagaatgtaaatg

SEQ ID NO: 157862 - DNA, 75 bp, Artificial Sequence
  Synthetic
aataacgacaacggtcagagacgtaatttcagaggctccgacgctgataataggacaaagatggcttcgtccaga

SEQ ID NO: 157863 - DNA, 75 bp, Artificial Sequence
  Synthetic
atttcagaggctccgacgctgataataggacaaagatggcttcgtccagatgagattttatctaatgtagatttg

SEQ ID NO: 157864 - DNA, 75 bp, Artificial Sequence
  Synthetic
taggacaaagatggcttcgtccagatgagattttatctaatgtagatttgcgtcttggcgtacccgggaatacaa

SEQ ID NO: 157865 - DNA, 75 bp, Artificial Sequence
  Synthetic
aggcgtgtttatgtacattaaagtatttgtggtttttattgactgggcgtttcgtttgtataacgctgttgttgc

SEQ ID NO: 157866 - DNA, 75 bp, Artificial Sequence
  Synthetic
tttgtggtttttattgactgggcgtttcgtttgtataacgctgttgttgctagtattttcataacctcctaggtt

SEQ ID NO: 157867 - DNA, 75 bp, Artificial Sequence
  Synthetic
cgctctttgggatttgaatcatcgtaaacgtagcgtccctaccagttgagcgcgtaattttcgtaagcaataaaa

SEQ ID NO: 157868 - DNA, 75 bp, Artificial Sequence
  Synthetic
aaacgtagcgtccctaccagttgagcgcgtaattttcgtaagcaataaaatggatataattccgcctatagctgt

SEQ ID NO: 157869 - DNA, 75 bp, Artificial Sequence
  Synthetic
aatcaatttgacggtgccctgggaccggcgtcaggtctgtcatgtttaagaacatctttatcgtttttgcatatg

SEQ ID NO: 157870 - DNA, 75 bp, Artificial Sequence
  Synthetic
cggcgtcaggtctgtcatgtttaagaacatctttatcgtttttgcatatgacatatgcgcatggaattaatgcaa

SEQ ID NO: 157871 - DNA, 75 bp, Artificial Sequence
  Synthetic
atgtttacaagagggtgcagcatggactacggatctgtctaatatggggaggggtgtcccagatatgtgtgctct

SEQ ID NO: 157872 - DNA, 75 bp, Artificial Sequence
  Synthetic
actacggatctgtctaatatggggaggggtgtcccagatatgtgtgctcttgttgatctccccaatcgaatttca

SEQ ID NO: 157873 - DNA, 75 bp, Artificial Sequence
  Synthetic
gtacgtgctgcgttttgtctagaatatacggcgatagccatttttttaccgttccagacgagggttttatgtgca

SEQ ID NO: 157874 - DNA, 75 bp, Artificial Sequence
  Synthetic
atacggcgatagccatttttttaccgttccagacgagggttttatgtgcacacaaattcccgctagagcgttttt

SEQ ID NO: 157875 - DNA, 75 bp, Artificial Sequence
  Synthetic
gagtcgtatacaattataactgtagactcaacgggaatggccatctatcgtcagggaaacatatcttttattttt

SEQ ID NO: 157876 - DNA, 75 bp, Artificial Sequence
  Synthetic
actcaacgggaatggccatctatcgtcagggaaacatatcttttatttttgatccacatggccatgggactatag

SEQ ID NO: 157877 - DNA, 75 bp, Artificial Sequence
  Synthetic
taccacggatgtgtactcttatatcgcatcggagtatacccaccgccccgataacgtagaatcccaatgggccgc

SEQ ID NO: 157878 - DNA, 75 bp, Artificial Sequence
  Synthetic
gcatcggagtatacccaccgccccgataacgtagaatcccaatgggccgctgcattagttttttttgtcaccgca

SEQ ID NO: 157879 - DNA, 75 bp, Artificial Sequence
  Synthetic
cgctatcttcggcagtaacgcttatatacggaagctgtgatacatattttacagatgaacaatattgcgaaaaac

SEQ ID NO: 157880 - DNA, 75 bp, Artificial Sequence
  Synthetic
atacggaagctgtgatacatattttacagatgaacaatattgcgaaaaactggttacagctcaacatccgttgct

SEQ ID NO: 157881 - DNA, 75 bp, Artificial Sequence
  Synthetic
attgtgcttaataaatcgtctatagtacctcttcaccaaaacgttggtgaaagtgtatccttggaagcaacccta

SEQ ID NO: 157882 - DNA, 75 bp, Artificial Sequence
  Synthetic
tacctcttcaccaaaacgttggtgaaagtgtatccttggaagcaaccctacattcaacgttaaccaacacggttg

SEQ ID NO: 157883 - DNA, 75 bp, Artificial Sequence
  Synthetic
cgaggttgatccttggcatgcggttctagaaacaacctcgactgggtctggcgttttggattgtcgtcgtagacg

SEQ ID NO: 157884 - DNA, 75 bp, Artificial Sequence
  Synthetic
ctagaaacaacctcgactgggtctggcgttttggattgtcgtcgtagacgccgtccttcatggactcctccttca

SEQ ID NO: 157885 - DNA, 75 bp, Artificial Sequence
  Synthetic
acgatggtttggtaaataatacacattccacggataatttacataaacccgctaaaaaggttctcaaatttaaac

SEQ ID NO: 157886 - DNA, 75 bp, Artificial Sequence
  Synthetic
ttccacggataatttacataaacccgctaaaaaggttctcaaatttaaaccaactgtagacgtgccggataaaac

SEQ ID NO: 157887 - DNA, 75 bp, Artificial Sequence
  Synthetic
ctacgagaagttgctaacaccccagacgttgtgttaaatgtatccaatgtagatacgcctgaatccagtcccact

SEQ ID NO: 157888 - DNA, 75 bp, Artificial Sequence
  Synthetic
acgttgtgttaaatgtatccaatgtagatacgcctgaatccagtcccactttttcacggaacatgaatgtaggaa

SEQ ID NO: 157889 - DNA, 75 bp, Artificial Sequence
  Synthetic
tctatttgaacagagtggtgatgtcaacatggttgtcgaaaaactactacaacatgggcatgaaattagcaatgg

SEQ ID NO: 157890 - DNA, 75 bp, Artificial Sequence
  Synthetic
aacatggttgtcgaaaaactactacaacatgggcatgaaattagcaatggatacgtacaaaatgcggtgggtacg

SEQ ID NO: 157891 - DNA, 75 bp, Artificial Sequence
  Synthetic
caaatgttcccatttgggtaacaaggcccttggtcatgccagacgaaaaggatccattggagctttttattaacc

SEQ ID NO: 157892 - DNA, 75 bp, Artificial Sequence
  Synthetic
gcccttggtcatgccagacgaaaaggatccattggagctttttattaacctcaccattttgcgtttaacgggatt

SEQ ID NO: 157893 - DNA, 75 bp, Artificial Sequence
  Synthetic
catcatggtgctacaagcgttgtatcagactttataggtccccttggggaaattttaacaggatttccctccgcc

SEQ ID NO: 157894 - DNA, 75 bp, Artificial Sequence
  Synthetic
cagactttataggtccccttggggaaattttaacaggatttccctccgccgcggaacttatacgcgttacaagtt

SEQ ID NO: 157895 - DNA, 75 bp, Artificial Sequence
  Synthetic
ggaatatgctattaaaactgttctccggaaaaaatgtacaattggcatgctcattatcgctaagtttggtctagt

SEQ ID NO: 157896 - DNA, 75 bp, Artificial Sequence
  Synthetic
cggaaaaaatgtacaattggcatgctcattatcgctaagtttggtctagttgccatgcgggttcaggatacaacc

SEQ ID NO: 157897 - DNA, 75 bp, Artificial Sequence
  Synthetic
tgttagaagcggatctaggaggttcgtcgcccatagacctctattctagactgtcgacaggtcttataagtatac

SEQ ID NO: 157898 - DNA, 75 bp, Artificial Sequence
  Synthetic
tatatatatatatatatagaaagaaagtgcgaacggtggttggacacatgccaaaacatgaaaacccatacagtg

SEQ ID NO: 157899 - DNA, 75 bp, Artificial Sequence
  Synthetic
gtcgcccatagacctctattctagactgtcgacaggtcttataagtatactaaattcgcctattatttctcatcc

SEQ ID NO: 157900 - DNA, 75 bp, Artificial Sequence
  Synthetic
acccgtacagggtccctgtctgaacgaatacgtcttctttgtgaattagtctcggcccgggagacacgctatatg

SEQ ID NO: 157901 - DNA, 75 bp, Artificial Sequence
  Synthetic
gaatacgtcttctttgtgaattagtctcggcccgggagacacgctatatgcgtgaacacaccgcgcttgtttcta

SEQ ID NO: 157902 - DNA, 75 bp, Artificial Sequence
  Synthetic
acggtctacccgcaataaaattgatgccattcaaataccagaagttccccaggaacccccggaagaaaccgacat

SEQ ID NO: 157903 - DNA, 75 bp, Artificial Sequence
  Synthetic
tttgggtccctctccgtcgtcattacgttcgcgcaatcaacaagcgtatacaccaccacccctcccaacgattat

SEQ ID NO: 157904 - DNA, 75 bp, Artificial Sequence
  Synthetic
gccattcaaataccagaagttccccaggaacccccggaagaaaccgacattccacccgaagagttaattcggcgt

SEQ ID NO: 157905 - DNA, 75 bp, Artificial Sequence
  Synthetic
caatgctattgacctcggctgttacagaatacttcacccgcggagtgttatatagcacacgggccttgatcgctg

SEQ ID NO: 157906 - DNA, 75 bp, Artificial Sequence
  Synthetic
agaatacttcacccgcggagtgttatatagcacacgggccttgatcgctgaacaatcccctaggcgttttcgggt

SEQ ID NO: 157907 - DNA, 75 bp, Artificial Sequence
  Synthetic
caacggcttttagattctcttccggaattcgacgctaaattaacggcaatcatatcgtccctgtctatacaccct

SEQ ID NO: 157908 - DNA, 75 bp, Artificial Sequence
  Synthetic
aattcgacgctaaattaacggcaatcatatcgtccctgtctatacaccctcctcctgagactatacaaaatctcc

SEQ ID NO: 157909 - DNA, 75 bp, Artificial Sequence
  Synthetic
tattaaagaaggggaagatttaaacacagacacggctctcgtatcgtggttatctgtagtcggggaagctcaaac

SEQ ID NO: 157910 - DNA, 75 bp, Artificial Sequence
  Synthetic
acagacacggctctcgtatcgtggttatctgtagtcggggaagctcaaaccgcaggttacttatccagacgagag

SEQ ID NO: 157911 - DNA, 75 bp, Artificial Sequence
  Synthetic
aaaccattaatacacgcgcaacgcaacgggcttccgcggaagcagagttgtcttgctttaatacgctaagcgcgg

SEQ ID NO: 157912 - DNA, 75 bp, Artificial Sequence
  Synthetic
acgggcttccgcggaagcagagttgtcttgctttaatacgctaagcgcggccgtagaccaagccgtaaaggacta

SEQ ID NO: 157913 - DNA, 75 bp, Artificial Sequence
  Synthetic
aagtatcctgaaataacacgggatgatttattagcaacaattgtacgtgctacagacgatttggtgcgacagata

SEQ ID NO: 157914 - DNA, 75 bp, Artificial Sequence
  Synthetic
atttattagcaacaattgtacgtgctacagacgatttggtgcgacagataaaaattttaagtgatccaatgatcc

SEQ ID NO: 157915 - DNA, 75 bp, Artificial Sequence
  Synthetic
aagacgattggaaacaaggcttaaagaggttcagacgtatgcaaacgaggcccgaaccacacaggacacaataaa

SEQ ID NO: 157916 - DNA, 75 bp, Artificial Sequence
  Synthetic
gaggttcagacgtatgcaaacgaggcccgaaccacacaggacacaataaagagtcgaaaacaggcggcatataat

SEQ ID NO: 157917 - DNA, 75 bp, Artificial Sequence
  Synthetic
taaccggttttgtgggacttagggctgcagtagatttattaccggaacttgcttctgagttagatgtccaaggag

SEQ ID NO: 157918 - DNA, 75 bp, Artificial Sequence
  Synthetic
tgcagtagatttattaccggaacttgcttctgagttagatgtccaaggagccctggtaaatctcaggaccaaagt

SEQ ID NO: 157919 - DNA, 75 bp, Artificial Sequence
  Synthetic
tctcaacttacgggtgatttctgggcgttatttaaccaatatcgagacattttagaacatcccggaaacgcacgc

SEQ ID NO: 157920 - DNA, 75 bp, Artificial Sequence
  Synthetic
cgttatttaaccaatatcgagacattttagaacatcccggaaacgcacgcacatctgtcttaggaggactgggag

SEQ ID NO: 157921 - DNA, 75 bp, Artificial Sequence
  Synthetic
tgtgccgatacctacggagtatagaccatcattgcttgcgttttttggtgacgtggcagatgtgcttgcatccga

SEQ ID NO: 157922 - DNA, 75 bp, Artificial Sequence
  Synthetic
ccatcattgcttgcgttttttggtgacgtggcagatgtgcttgcatccgacatcgcgaccgtatctactaacccg

SEQ ID NO: 157923 - DNA, 75 bp, Artificial Sequence
  Synthetic
gaggcggaggaggacgcgatcgacgacgagggagaggcggaggaggacgcgatcgacgacgagggagaggcggag

SEQ ID NO: 157924 - DNA, 75 bp, Artificial Sequence
  Synthetic
ttgttgcaactcttagtaaagcgacgttagtttcatctacagtgccagccttatcctttgtgttgtcgttatata

SEQ ID NO: 157925 - DNA, 75 bp, Artificial Sequence
  Synthetic
gttagtttcatctacagtgccagccttatcctttgtgttgtcgttatataaaaaatatcaggctttacaacaaga

SEQ ID NO: 157926 - DNA, 75 bp, Artificial Sequence
  Synthetic
gaattacaaaaacaacttggagatgacttctccaccctagctgtctcatctggacacttgaagtttatatcatct

SEQ ID NO: 157927 - DNA, 75 bp, Artificial Sequence
  Synthetic
acttctccaccctagctgtctcatctggacacttgaagtttatatcatcttcaaatgtagatgattatgaaataa

SEQ ID NO: 157928 - DNA, 75 bp, Artificial Sequence
  Synthetic
aaatgtgcacgccctaatggatacggttaaacttgttgaagttgaactgcaaaagctacccccccattgtattgc

SEQ ID NO: 157929 - DNA, 75 bp, Artificial Sequence
  Synthetic
gttaaacttgttgaagttgaactgcaaaagctacccccccattgtattgctgggacatctaccttatctcgagta

SEQ ID NO: 157930 - DNA, 75 bp, Artificial Sequence
  Synthetic
caatggcacatgagaagaaggaacaggcaaaagtgttaattaccgattgtgaacgtgcacataaacaacaaacga

SEQ ID NO: 157931 - DNA, 75 bp, Artificial Sequence
  Synthetic
ggcaaaagtgttaattaccgattgtgaacgtgcacataaacaacaaacgactcgggttttgtatgagcgttggac

SEQ ID NO: 157932 - DNA, 75 bp, Artificial Sequence
  Synthetic
gcaatggaaacgcgccatatatttaacgggacagaactggcacggttgcgagatatggccgctgcgggagggttt

SEQ ID NO: 157933 - DNA, 75 bp, Artificial Sequence
  Synthetic
gatatacacgcagtttacccacaagcacgtcaggttgtagcggcatgtgaaactacagccgttacggcattagat

SEQ ID NO: 157934 - DNA, 75 bp, Artificial Sequence
  Synthetic
cccccgaaaatacaaatattccaccacctttggctttgttaagagggttaacatggtttgatgatttttcgatta

SEQ ID NO: 157935 - DNA, 75 bp, Artificial Sequence
  Synthetic
acctttggctttgttaagagggttaacatggtttgatgatttttcgattacggctcccgtattcaccgttatgtt

SEQ ID NO: 157936 - DNA, 75 bp, Artificial Sequence
  Synthetic
cttctgcttatgcgtattcgcgcggttgtgttattatccgccgatacgtctattaatggaatacctaactaccga

SEQ ID NO: 157937 - DNA, 75 bp, Artificial Sequence
  Synthetic
ttgtgttattatccgccgatacgtctattaatggaatacctaactaccgagatatgatattacgaacctcggggg

SEQ ID NO: 157938 - DNA, 75 bp, Artificial Sequence
  Synthetic
tgggtatgttgatttttacacacggtcttatgatcagtttataaccgaaagtgtaacgttaagtgaacttagagc

SEQ ID NO: 157939 - DNA, 75 bp, Artificial Sequence
  Synthetic
tcttatgatcagtttataaccgaaagtgtaacgttaagtgaacttagagcagacatcagacaggctgccggggct

SEQ ID NO: 157940 - DNA, 75 bp, Artificial Sequence
  Synthetic
tggaggaagtaactcatgttcgggcacacgaaacggctaaacttgcacttaaagaaggtgtcttcattacattac

SEQ ID NO: 157941 - DNA, 75 bp, Artificial Sequence
  Synthetic
acacgaaacggctaaacttgcacttaaagaaggtgtcttcattacattaccaagcgaaggtttattgattcgggc

SEQ ID NO: 157942 - DNA, 75 bp, Artificial Sequence
  Synthetic
cataaacgatttataggaacggcatatgaaagagttttacaaacaatggtagaccgcgatctaaaggaggccaac

SEQ ID NO: 157943 - DNA, 75 bp, Artificial Sequence
  Synthetic
atgaaagagttttacaaacaatggtagaccgcgatctaaaggaggccaacgcagagcttgcacagtttcgtatgg

SEQ ID NO: 157944 - DNA, 75 bp, Artificial Sequence
  Synthetic
aatacaaattttacaaaacattgttgatactgccaatgccactgagcaacaagaagacgtggatttcactaacct

SEQ ID NO: 157945 - DNA, 75 bp, Artificial Sequence
  Synthetic
gatactgccaatgccactgagcaacaagaagacgtggatttcactaacctgaagacgttattaaaactaaccccc

SEQ ID NO: 157946 - DNA, 75 bp, Artificial Sequence
  Synthetic
ttgatagatctacttccgttcaggacattgtcacgcagtttgcattgctgttagggcgtctggaagaagaaactg

SEQ ID NO: 157947 - DNA, 75 bp, Artificial Sequence
  Synthetic
cattgtcacgcagtttgcattgctgttagggcgtctggaagaagaaactggtacgttggacattcaggcggttga

SEQ ID NO: 157948 - DNA, 75 bp, Artificial Sequence
  Synthetic
attgactcccatccactaagtgtgcgtatagacggtaccggccccctgcatacttataaagatagggtggataaa

SEQ ID NO: 157949 - DNA, 75 bp, Artificial Sequence
  Synthetic
gtatagacggtaccggccccctgcatacttataaagatagggtggataaactttatgcgttacggactaaattag

SEQ ID NO: 157950 - DNA, 75 bp, Artificial Sequence
  Synthetic
cggtgaggttacgtgggacgatgcatggacaacatttaaaagagaaacgggggatatgttggcatcgggggacac

SEQ ID NO: 157951 - DNA, 75 bp, Artificial Sequence
  Synthetic
tggacaacatttaaaagagaaacgggggatatgttggcatcgggggacacgtacgctacttccgtagatagtata

SEQ ID NO: 157952 - DNA, 75 bp, Artificial Sequence
  Synthetic
tggttgacatgctttgttccgaacccgaattttttttattgcctgtggaaacgaaaaaccgtctccaaaaaaagc

SEQ ID NO: 157953 - DNA, 75 bp, Artificial Sequence
  Synthetic
acgaaaaaccgtctccaaaaaaagcaacaggaacgtaaaacggcgttggatgttgtgttgcaaaaacaaagacag

SEQ ID NO: 157954 - DNA, 75 bp, Artificial Sequence
  Synthetic
tttgaagagaccgcgtctcgcttacgagctttaattgaacgtattccaacggagagtgaccatgacgttcttcgt

SEQ ID NO: 157955 - DNA, 75 bp, Artificial Sequence
  Synthetic
gagctttaattgaacgtattccaacggagagtgaccatgacgttcttcgtatgttattacatgatttcgatcaat

SEQ ID NO: 157956 - DNA, 75 bp, Artificial Sequence
  Synthetic
aacacagtatatgacatttcgaaatttactcatggtacggttaggcttgtatgcaagttatgctgagatttttcc

SEQ ID NO: 157957 - DNA, 75 bp, Artificial Sequence
  Synthetic
ttactcatggtacggttaggcttgtatgcaagttatgctgagatttttccacccgcgtctccaaacggagtgttt

SEQ ID NO: 157958 - DNA, 75 bp, Artificial Sequence
  Synthetic
tatgtctagaagaccaatcccgatgcattcgcgcgcgggtggccgcgtttatgggggaggcgtctgtggtgcaaa

SEQ ID NO: 157959 - DNA, 75 bp, Artificial Sequence
  Synthetic
cattcgcgcgcgggtggccgcgtttatgggggaggcgtctgtggtgcaaacgtttagggaagccagatcttctat

SEQ ID NO: 157960 - DNA, 75 bp, Artificial Sequence
  Synthetic
accttttacttggatactgatggggttccacttcgatatagagtgtgttataaatcagttggggttaaacttgga

SEQ ID NO: 157961 - DNA, 75 bp, Artificial Sequence
  Synthetic
ttccacttcgatatagagtgtgttataaatcagttggggttaaacttggaaccatgctatgcagtcagggtggat

SEQ ID NO: 157962 - DNA, 75 bp, Artificial Sequence
  Synthetic
tgaaggtattgtggaagaaactacactatcggcattacgcgtggccaatgaggtcaatgagctacgcattgaata

SEQ ID NO: 157963 - DNA, 75 bp, Artificial Sequence
  Synthetic
ctatcggcattacgcgtggccaatgaggtcaatgagctacgcattgaatacgaatccgctataaaatccgggttt

SEQ ID NO: 157964 - DNA, 75 bp, Artificial Sequence
  Synthetic
atcgccacgccgaatggggtaaaaccaacgcacgcagagccattgcagagatatacgccggccttataacaacaa

SEQ ID NO: 157965 - DNA, 75 bp, Artificial Sequence
  Synthetic
caacgcacgcagagccattgcagagatatacgccggccttataacaacaacattgacacgacaatacggggttca

SEQ ID NO: 157966 - DNA, 75 bp, Artificial Sequence
  Synthetic
gaaaaacaccacctaacttctgtaatgggcaatggactaactaaaccaatccagagaaggggtgatgtacgcgta

SEQ ID NO: 157967 - DNA, 75 bp, Artificial Sequence
  Synthetic
tgggcaatggactaactaaaccaatccagagaaggggtgatgtacgcgtattagagttaaccctatctgatattg

SEQ ID NO: 157968 - DNA, 75 bp, Artificial Sequence
  Synthetic
ggtacatcttctcaattttgctagattggatttaattaaacagcatgagtatatggcccgtaccctcagacccgt

SEQ ID NO: 157969 - DNA, 75 bp, Artificial Sequence
  Synthetic
ttggatttaattaaacagcatgagtatatggcccgtaccctcagacccgtaatcgaggccgcatttagaggtcgt

SEQ ID NO: 157970 - DNA, 75 bp, Artificial Sequence
  Synthetic
acccgaaaggcaatgcccgggccttttttaatgccgccccatccaaacataaactcccgttagctcttggatcaa

SEQ ID NO: 157971 - DNA, 75 bp, Artificial Sequence
  Synthetic
taacggatccttttgcgccatggcaactttcccccccccccggggtaaaggccaatgtcgatgcagttacccgta

SEQ ID NO: 157972 - DNA, 75 bp, Artificial Sequence
  Synthetic
gccaatgtcgatgcagttacccgtataatggcaacagatcgtcttgcgaccattactgtacttgggcgcatgtgt

SEQ ID NO: 157973 - DNA, 75 bp, Artificial Sequence
  Synthetic
cattactgtacttgggcgcatgtgtctcccgccaatttccttagtgtcaatgtggaatacgctgcaaccggagga

SEQ ID NO: 157974 - DNA, 75 bp, Artificial Sequence
  Synthetic
ctcccgccaatttccttagtgtcaatgtggaatacgctgcaaccggaggaattcgcatacagaacacaagatgat

SEQ ID NO: 157975 - DNA, 75 bp, Artificial Sequence
  Synthetic
tggatttgtcatccacgcttaatgcaagatttgataccgctcccagcaataccacgttagagtggaatacagacc

SEQ ID NO: 157976 - DNA, 75 bp, Artificial Sequence
  Synthetic
aagatttgataccgctcccagcaataccacgttagagtggaatacagaccgtaaagtaattacagatgcttatat

SEQ ID NO: 157977 - DNA, 75 bp, Artificial Sequence
  Synthetic
acagtaacgggggcggcaccaactcacgtttctaatgtaacagcgtttgacatagcaactacggctattttattt

SEQ ID NO: 157978 - DNA, 75 bp, Artificial Sequence
  Synthetic
acgtttctaatgtaacagcgtttgacatagcaactacggctattttatttggggctcctttggttattgccatgg

SEQ ID NO: 157979 - DNA, 75 bp, Artificial Sequence
  Synthetic
ggccagccctctcgcggccccctcgagagagaaaaaaaaaagcgaccccacctccccgcgcgtttgcggggcgac

SEQ ID NO: 157980 - DNA, 75 bp, Artificial Sequence
  Synthetic
ttccggacttactttggggttaaaattattcgattcccggcatatggctacagattcgggtatatcctcagccgt

SEQ ID NO: 157981 - DNA, 75 bp, Artificial Sequence
  Synthetic
ttattcgattcccggcatatggctacagattcgggtatatcctcagccgtatctcccgatattgtttcttggggg

SEQ ID NO: 157982 - DNA, 75 bp, Artificial Sequence
  Synthetic
acccaattgaaaatgcatgtttaattgtccaactagaaaaactgtccgcgctcattgcaaacaaacctcttacaa

SEQ ID NO: 157983 - DNA, 75 bp, Artificial Sequence
  Synthetic
tgtccaactagaaaaactgtccgcgctcattgcaaacaaacctcttacaaacaatcccccgtgtttactgctatt

SEQ ID NO: 157984 - DNA, 75 bp, Artificial Sequence
  Synthetic
gttttatgggaacgaaaagactcgattccagctccggattatgtggtcttttgggggccagaatctcttattgat

SEQ ID NO: 157985 - DNA, 75 bp, Artificial Sequence
  Synthetic
ttccagctccggattatgtggtcttttgggggccagaatctcttattgatttgccgtacatcgactccgatgagg

SEQ ID NO: 157986 - DNA, 75 bp, Artificial Sequence
  Synthetic
tccattttactcgcaaattattgccggttatgcgccccaaggccccccaaacctcgacacaactgatttttaccc

SEQ ID NO: 157987 - DNA, 75 bp, Artificial Sequence
  Synthetic
acctcgacacaactgatttttacccaacggagccactatttaagtctcccgttcaagttgttagaagttccaaat

SEQ ID NO: 157988 - DNA, 75 bp, Artificial Sequence
  Synthetic
ccgcgcagcccatagaaccgggcacacaaatagtggtacaaaattttaagaaaccccaaagcgtaaaaacaaccc

SEQ ID NO: 157989 - DNA, 75 bp, Artificial Sequence
  Synthetic
acaaatagtggtacaaaattttaagaaaccccaaagcgtaaaaacaacccttagccaaaaagatattcccttgta

SEQ ID NO: 157990 - DNA, 75 bp, Artificial Sequence
  Synthetic
tgtggaaactgaatcagaaacggctgtgcttatacctaagcaattaaccacctccattaaaacaaccgtttgtaa

SEQ ID NO: 157991 - DNA, 75 bp, Artificial Sequence
  Synthetic
cctccattaaaacaaccgtttgtaaaagtattaccccaccaaataaccaattgtcggattggaaaaataatccac

SEQ ID NO: 157992 - DNA, 75 bp, Artificial Sequence
  Synthetic
aagtattaccccaccaaataaccaattgtcggattggaaaaataatccacagcaaaaccaaacgttaaaccaagc

SEQ ID NO: 157993 - DNA, 75 bp, Artificial Sequence
  Synthetic
acctccattccgacagatgactcgatatcttaccggacttggattgaaaaatcaaatcaaacacaaaaacggcat

SEQ ID NO: 157994 - DNA, 75 bp, Artificial Sequence
  Synthetic
tatcttaccggacttggattgaaaaatcaaatcaaacacaaaaacggcatcaaaatgaccctcgaatgtataact

SEQ ID NO: 157995 - DNA, 75 bp, Artificial Sequence
  Synthetic
taaccaattaccttcttgggttgacacggcagccgatgccccccaaacggacctattgacaaactataaaacaag

SEQ ID NO: 157996 - DNA, 75 bp, Artificial Sequence
  Synthetic
acggcagccgatgccccccaaacggacctattgacaaactataaaacaagacagccgtcgccaaactttccgcgg

SEQ ID NO: 157997 - DNA, 75 bp, Artificial Sequence
  Synthetic
ctaacccgtttaactcaccgaacagagacctatatgaaagtgattttagtgaaccttctgacggctatagcagtg

SEQ ID NO: 157998 - DNA, 75 bp, Artificial Sequence
  Synthetic
agacctatatgaaagtgattttagtgaaccttctgacggctatagcagtgagagtgaaaattctatcgtactaag

SEQ ID NO: 157999 - DNA, 75 bp, Artificial Sequence
  Synthetic
gttcctaggcacgtacgcgttgttaatgccgatgtagtcaccggtcgacgttatgtccgagggaccgccttggga

SEQ ID NO: 158000 - DNA, 75 bp, Artificial Sequence
  Synthetic
atgccgatgtagtcaccggtcgacgttatgtccgagggaccgccttgggagcactggccctgttaagccaggcat

SEQ ID NO: 158001 - DNA, 75 bp, Artificial Sequence
  Synthetic
atatacacgtaaacttttaatggaccacacggaagatatatttcaaggcctggggtatgttaaattgttattaga

SEQ ID NO: 158002 - DNA, 75 bp, Artificial Sequence
  Synthetic
cacacggaagatatatttcaaggcctggggtatgttaaattgttattagatggaacatatatataaagtagcgcc

SEQ ID NO: 158003 - DNA, 75 bp, Artificial Sequence
  Synthetic
attattttctgtgtatttttatttacaccctacgacttcttgaagcgtttccagattgtcccgtgtgggacaagg

SEQ ID NO: 158004 - DNA, 75 bp, Artificial Sequence
  Synthetic
caccctacgacttcttgaagcgtttccagattgtcccgtgtgggacaaggtctgtcccttacccccctggggggt

SEQ ID NO: 158005 - DNA, 75 bp, Artificial Sequence
  Synthetic
tgtggcacgccttgggccgcgggcggtgatccggttgttggctggacagtgcttgactgtgctccctgttgcggt

SEQ ID NO: 158006 - DNA, 75 bp, Artificial Sequence
  Synthetic
gtgatccggttgttggctggacagtgcttgactgtgctccctgttgcggttgttgtccagaagaccccgacacca

SEQ ID NO: 158007 - DNA, 75 bp, Artificial Sequence
  Synthetic
cgacgtcgtttgaggtggggggtgttgcggggatgatcccgaaaacgccaacgcggcgggctgttgtaaagcaga

SEQ ID NO: 158008 - DNA, 75 bp, Artificial Sequence
  Synthetic
tgcggggatgatcccgaaaacgccaacgcggcgggctgttgtaaagcagactgatcggcgctctgtgttttttgc

SEQ ID NO: 158009 - DNA, 75 bp, Artificial Sequence
  Synthetic
ccaaactcatggatggatttgggggttgtggtcgtataatacgcgggttaaacgtacgttttaagccaaccgttg

SEQ ID NO: 158010 - DNA, 75 bp, Artificial Sequence
  Synthetic
ttgtggtcgtataatacgcgggttaaacgtacgttttaagccaaccgttggtcttaaccatgtcatagggtcagt

SEQ ID NO: 158011 - DNA, 75 bp, Artificial Sequence
  Synthetic
atcgtatttgcattatggttagcgcgtgcacgcgcggcactggccgcggctcccacggtgtaaatgcttctggca

SEQ ID NO: 158012 - DNA, 75 bp, Artificial Sequence
  Synthetic
gtgcacgcgcggcactggccgcggctcccacggtgtaaatgcttctggcatcagcgatgtccacacggtgaccag

SEQ ID NO: 158013 - DNA, 75 bp, Artificial Sequence
  Synthetic
aagtcgtattaaagcaacgggggtgtaagccgcaattgcttccaccgaaaatgtggtggggttgctgggatcaaa

SEQ ID NO: 158014 - DNA, 75 bp, Artificial Sequence
  Synthetic
atgtggtggggttgctgggatcaaagactacacgagacgatgcgggttgtgtcatcgtttattagtttacgggac

SEQ ID NO: 158015 - DNA, 75 bp, Artificial Sequence
  Synthetic
ctgcgcaggatctgtacggaaaggcaatttatttccagaaaagcaccgcccctaatacaactaccagtacaatta

SEQ ID NO: 158016 - DNA, 75 bp, Artificial Sequence
  Synthetic
aatttatttccagaaaagcaccgcccctaatacaactaccagtacaattacaacgaacagggcatatgtcacgtt

SEQ ID NO: 158017 - DNA, 75 bp, Artificial Sequence
  Synthetic
acacgcgtagtttgggtatcgggtaacgcaggtttaatgtcactttgcatttgaacagacgtgtttggacttccg

SEQ ID NO: 158018 - DNA, 75 bp, Artificial Sequence
  Synthetic
acgcaggtttaatgtcactttgcatttgaacagacgtgtttggacttccgttctcgggtggggatctgaatgaag

SEQ ID NO: 158019 - DNA, 75 bp, Artificial Sequence
  Synthetic
attattgccagtttccttatacatgtatgcatccgtggcgcgggccataagtttaatggtgcgagatggatcttc

SEQ ID NO: 158020 - DNA, 75 bp, Artificial Sequence
  Synthetic
tatgcatccgtggcgcgggccataagtttaatggtgcgagatggatcttccggtcccataaaacgaaaggataac

SEQ ID NO: 158021 - DNA, 75 bp, Artificial Sequence
  Synthetic
agttcacccacattaaagcctggagaggtcggcggtcaatacccccacctcgtttaattgattccaaagcagata

SEQ ID NO: 158022 - DNA, 75 bp, Artificial Sequence
  Synthetic
aggtcggcggtcaatacccccacctcgtttaattgattccaaagcagataggttgataccggtacttaacgttga

SEQ ID NO: 158023 - DNA, 75 bp, Artificial Sequence
  Synthetic
atggacacttcagccactggtgcgttagtcggacgaaaaaaaaaaccttgaaatagcacagacacccccgtattt

SEQ ID NO: 158024 - DNA, 75 bp, Artificial Sequence
  Synthetic
tagtcggacgaaaaaaaaaaccttgaaatagcacagacacccccgtattttgaatttttatgtaagggtcacaat

SEQ ID NO: 158025 - DNA, 75 bp, Artificial Sequence
  Synthetic
acgcataatatactctaccggaaaggcttcggatacgttgtcttcgccgttaaactgaaaaacacaacgggcggg

SEQ ID NO: 158026 - DNA, 75 bp, Artificial Sequence
  Synthetic
gcttcggatacgttgtcttcgccgttaaactgaaaaacacaacgggcgggggggcgttgtggatcaaatattgga

SEQ ID NO: 158027 - DNA, 75 bp, Artificial Sequence
  Synthetic
cgcttggtaccaccaaccgaatacgttgtaaaagattatctccgcaacccctcctgcgttcactccgtacatacg

SEQ ID NO: 158028 - DNA, 75 bp, Artificial Sequence
  Synthetic
ttgtaaaagattatctccgcaacccctcctgcgttcactccgtacatacgttctccgtgacatattgatctaagg

SEQ ID NO: 158029 - DNA, 75 bp, Artificial Sequence
  Synthetic
gtatttagaccatttatcgtgggatataggaggagtttggagtgatccaccccctgacgacttattaatgcgttt

SEQ ID NO: 158030 - DNA, 75 bp, Artificial Sequence
  Synthetic
ataggaggagtttggagtgatccaccccctgacgacttattaatgcgtttattttccccatgtattaagcatcct

SEQ ID NO: 158031 - DNA, 75 bp, Artificial Sequence
  Synthetic
tttggccatgactcccgcaaagcgttcacggcgacgggtcacgctggcactatgttcacatggaacaacataagc

SEQ ID NO: 158032 - DNA, 75 bp, Artificial Sequence
  Synthetic
tcacggcgacgggtcacgctggcactatgttcacatggaacaacataagcagatttttctgaatcgttactttct

SEQ ID NO: 158033 - DNA, 75 bp, Artificial Sequence
  Synthetic
gactggtaaatgatatataatttaattgagcgtcagttgtaggtagaattgcttctatttccgggggaattaaat

SEQ ID NO: 158034 - DNA, 75 bp, Artificial Sequence
  Synthetic
ttgagcgtcagttgtaggtagaattgcttctatttccgggggaattaaattttcaaaccaaacggaaagagtaaa

SEQ ID NO: 158035 - DNA, 75 bp, Artificial Sequence
  Synthetic
gactccagtgcatcgatatttaatagattaacatcggtgtctgtaattaaatcgcgggccctcatcccagagatg

SEQ ID NO: 158036 - DNA, 75 bp, Artificial Sequence
  Synthetic
gattaacatcggtgtctgtaattaaatcgcgggccctcatcccagagatggatcgggtagaatcagaagaaccca

SEQ ID NO: 158037 - DNA, 75 bp, Artificial Sequence
  Synthetic
ctccgaaaatacatcttctaattccggatggtgttccgacgcattttccgattcgtacatcgcttataatccagc

SEQ ID NO: 158038 - DNA, 75 bp, Artificial Sequence
  Synthetic
ggatggtgttccgacgcattttccgattcgtacatcgcttataatccagcccttctgctaaaaaacgatttgtta

SEQ ID NO: 158039 - DNA, 75 bp, Artificial Sequence
  Synthetic
acttaataaatgttccccgtgcaatagaaaacaacgtcacttatgaggcctcttcggcggtaggtgtggataatg

SEQ ID NO: 158040 - DNA, 75 bp, Artificial Sequence
  Synthetic
agaaaacaacgtcacttatgaggcctcttcggcggtaggtgtggataatgaaatgacctcaagtaccactgaatt

SEQ ID NO: 158041 - DNA, 75 bp, Artificial Sequence
  Synthetic
aaacgcgcggggaggtggggtcgctttttttttctctctcgagggggccgcgagagggctgggccccccctcccg

SEQ ID NO: 158042 - DNA, 75 bp, Artificial Sequence
  Synthetic
gcgttagacagagcctgtttggtctgtagaacgcttgatttgtataaacgtaaatttggactgacaccggaatgg

SEQ ID NO: 158043 - DNA, 75 bp, Artificial Sequence
  Synthetic
gtagaacgcttgatttgtataaacgtaaatttggactgacaccggaatgggttgcggactacgccatgttatgta

SEQ ID NO: 158044 - DNA, 75 bp, Artificial Sequence
  Synthetic
ggggggggttattttcggggggggtccgaccagcccgcccgtcgcccgcccgcacagacagacagacactttttt

SEQ ID NO: 158045 - DNA, 75 bp, Artificial Sequence
  Synthetic
tgcagttgtcacttttagcgctgcctttgaatttgtgtatcttatggatcgttactacctgtgccgttataacgt

SEQ ID NO: 158046 - DNA, 75 bp, Artificial Sequence
  Synthetic
tttgaatttgtgtatcttatggatcgttactacctgtgccgttataacgttactttggttgggtcctttgccagg

SEQ ID NO: 158047 - DNA, 75 bp, Artificial Sequence
  Synthetic
aaagacatttttttttgcatgtatgttttcgtaccgatggagggttaccaggtatacgaccgccccccggtaagg

SEQ ID NO: 158048 - DNA, 75 bp, Artificial Sequence
  Synthetic
ttttcgtaccgatggagggttaccaggtatacgaccgccccccggtaaggaaatggccaacaaagtaagatattc

SEQ ID NO: 158049 - DNA, 75 bp, Artificial Sequence
  Synthetic
gtagttagggctgcattactatcgatcagcacgtctcgtttagacgaaaccgaaacgcgtaagtcattttacttt

SEQ ID NO: 158050 - DNA, 75 bp, Artificial Sequence
  Synthetic
tcagcacgtctcgtttagacgaaaccgaaacgcgtaagtcattttactttaatcaggacggactgactggaggcc

SEQ ID NO: 158051 - DNA, 75 bp, Artificial Sequence
  Synthetic
taattggaaagattgcgcgcggatggttgactgttcatcatcggaacatcgcacaagtgggatgattacctgcgc

SEQ ID NO: 158052 - DNA, 75 bp, Artificial Sequence
  Synthetic
gttgactgttcatcatcggaacatcgcacaagtgggatgattacctgcgcggaacgtgcattaaaagaggatata

SEQ ID NO: 158053 - DNA, 75 bp, Artificial Sequence
  Synthetic
aacttaaaaaatcgtcttacgtagaagcagcttggggttacgcagacttggctttattattactgagtggggttg

SEQ ID NO: 158054 - DNA, 75 bp, Artificial Sequence
  Synthetic
agcagcttggggttacgcagacttggctttattattactgagtggggttgctacttggaatgtagacgagcgtac

SEQ ID NO: 158055 - DNA, 75 bp, Artificial Sequence
  Synthetic
ggatgtgttaaatcatactggcaggcgaaccggattgaaaactccagggacgttccaaaacaattttccaaattt

SEQ ID NO: 158056 - DNA, 75 bp, Artificial Sequence
  Synthetic
cgaaccggattgaaaactccagggacgttccaaaacaattttccaaatttacgagcgaggatgcctgtcccgaag

SEQ ID NO: 158057 - DNA, 75 bp, Artificial Sequence
  Synthetic
taccttaaaaaacgcaaagtgccgtggtcgcacgaataccgaatgcatgttatgttgtttattaaccatagggca

SEQ ID NO: 158058 - DNA, 75 bp, Artificial Sequence
  Synthetic
ggtcgcacgaataccgaatgcatgttatgttgtttattaaccatagggcactattggatcgctttgcggcagttt

SEQ ID NO: 158059 - DNA, 75 bp, Artificial Sequence
  Synthetic
caaataacacaagtttatttgactgtatcgaacctgtaatcaatgcatggagcctagataaccccattaaactta

SEQ ID NO: 158060 - DNA, 75 bp, Artificial Sequence
  Synthetic
tatcgaacctgtaatcaatgcatggagcctagataaccccattaaacttaaatttccatttaatgatgagggtcg

SEQ ID NO: 158061 - DNA, 75 bp, Artificial Sequence
  Synthetic
ggttccgaggccgtatataaacatttattttgcgatctcctatgcgctctctcggaattacagacaaaccctaaa

SEQ ID NO: 158062 - DNA, 75 bp, Artificial Sequence
  Synthetic
tattttgcgatctcctatgcgctctctcggaattacagacaaaccctaaaattttatttgcccatcctacaaccg

SEQ ID NO: 158063 - DNA, 75 bp, Artificial Sequence
  Synthetic
taaagcccaactggctgcacaaaacagatttgaaggtcgtgtatgtgctggcctgtggacattggcgtatgcatt

SEQ ID NO: 158064 - DNA, 75 bp, Artificial Sequence
  Synthetic
agatttgaaggtcgtgtatgtgctggcctgtggacattggcgtatgcatttaaagcctaccagatttttccacgc

SEQ ID NO: 158065 - DNA, 75 bp, Artificial Sequence
  Synthetic
tacgagatggaggacttatgcttcgacgacatgcaatatcgctggtctccctcgaacacaccctatcgaagtatg

SEQ ID NO: 158066 - DNA, 75 bp, Artificial Sequence
  Synthetic
acgacatgcaatatcgctggtctccctcgaacacaccctatcgaagtatgtctaggcgatataaatccgtatctc

SEQ ID NO: 158067 - DNA, 75 bp, Artificial Sequence
  Synthetic
ctccagaacgccatgccgccgtcaaaccattcgaggaaaacttatgtcaaaggagcggtctgtgtaccgccatta

SEQ ID NO: 158068 - DNA, 75 bp, Artificial Sequence
  Synthetic
accattcgaggaaaacttatgtcaaaggagcggtctgtgtaccgccattattttaattacatcgcaaggtccccc

SEQ ID NO: 158069 - DNA, 75 bp, Artificial Sequence
  Synthetic
gcttaatcgtgccaattattaagacgacccctgtcacccttccgtttaacttgggtcagacagtggcggataact

SEQ ID NO: 158070 - DNA, 75 bp, Artificial Sequence
  Synthetic
gacccctgtcacccttccgtttaacttgggtcagacagtggcggataactgcctgtcgttatccggaatgggtta

SEQ ID NO: 158071 - DNA, 75 bp, Artificial Sequence
  Synthetic
ccgacatgcactgcatctggagaaccgcgtctatgtcgaaccgatcgggcggctctgatactagcatatgttcag

SEQ ID NO: 158072 - DNA, 75 bp, Artificial Sequence
  Synthetic
cgcgtctatgtcgaaccgatcgggcggctctgatactagcatatgttcagcagcttaacaacatatacgaatatc

SEQ ID NO: 158073 - DNA, 75 bp, Artificial Sequence
  Synthetic
gctatcagaccgagccaacatgcaagcagcgtccgctgaacccctattgtcgagcgtattggcacaaccggaatt

SEQ ID NO: 158074 - DNA, 75 bp, Artificial Sequence
  Synthetic
gcagcgtccgctgaacccctattgtcgagcgtattggcacaaccggaattattttttatgtatcatattatgagg

SEQ ID NO: 158075 - DNA, 75 bp, Artificial Sequence
  Synthetic
tacttttttatcgtgatggagatgccggagggtttatgatgtatgttatatttccggggaaatctgttcacctcc

SEQ ID NO: 158076 - DNA, 75 bp, Artificial Sequence
  Synthetic
cggagggtttatgatgtatgttatatttccggggaaatctgttcacctccattacagactaatcgatcatataca

SEQ ID NO: 158077 - DNA, 75 bp, Artificial Sequence
  Synthetic
gtcgcacacgtttggcagacaacatttttactgtcggtatgtcgcaacccagaacaacaaacagagactgtggtg

SEQ ID NO: 158078 - DNA, 75 bp, Artificial Sequence
  Synthetic
ttttactgtcggtatgtcgcaacccagaacaacaaacagagactgtggtgccatccattggaacatcggacgttt

SEQ ID NO: 158079 - DNA, 75 bp, Artificial Sequence
  Synthetic
tgatggagaattgcttttggaatacaaaagactctacgcattatttgatgactttgttcctcctcggtgatttca

SEQ ID NO: 158080 - DNA, 75 bp, Artificial Sequence
  Synthetic
aaaagactctacgcattatttgatgactttgttcctcctcggtgatttcagcttcagtgttcattttattatccc

SEQ ID NO: 158081 - DNA, 75 bp, Artificial Sequence
  Synthetic
gcctgccgcctgcaagcggtttagcattttaacgttaacaactcgtgtctctggaataaaacgttttaaaagccg

SEQ ID NO: 158082 - DNA, 75 bp, Artificial Sequence
  Synthetic
attttaacgttaacaactcgtgtctctggaataaaacgttttaaaagccgttctgtgagtttagtgtcgtttcca

SEQ ID NO: 158083 - DNA, 75 bp, Artificial Sequence
  Synthetic
ccgtcccaatgagatgagaaaaataatagtcaatgtttaaagacagcccgtgtgatgttacgtgaatgggatctt

SEQ ID NO: 158084 - DNA, 75 bp, Artificial Sequence
  Synthetic
atagtcaatgtttaaagacagcccgtgtgatgttacgtgaatgggatcttccgctaagtcagatattattaactt

SEQ ID NO: 158085 - DNA, 75 bp, Artificial Sequence
  Synthetic
cctgcggtattctgtaaaggatctccacgtagcaaagctacactttttgcatcagcctccacttcgtctgtgggg

SEQ ID NO: 158086 - DNA, 75 bp, Artificial Sequence
  Synthetic
cacgtagcaaagctacactttttgcatcagcctccacttcgtctgtgggggccacaataacataagggatgcgtt

SEQ ID NO: 158087 - DNA, 75 bp, Artificial Sequence
  Synthetic
tctcattactaatttataatatactgttaagtgagccaagcgacggtttatgtaggcggatggtggacgactaag

SEQ ID NO: 158088 - DNA, 75 bp, Artificial Sequence
  Synthetic
gttaagtgagccaagcgacggtttatgtaggcggatggtggacgactaagctcggccgtcataacaaacttatta

SEQ ID NO: 158089 - DNA, 75 bp, Artificial Sequence
  Synthetic
ggcgatgtgcatctgcaattatgcgtccaaacccggccatcccagacggcatggcccgtctattccattcagcaa

SEQ ID NO: 158090 - DNA, 75 bp, Artificial Sequence
  Synthetic
tccaaacccggccatcccagacggcatggcccgtctattccattcagcaatggaaacacacgacgcctccgccgc

SEQ ID NO: 158091 - DNA, 75 bp, Artificial Sequence
  Synthetic
aacaacagttctacaagtttgcgggcataatcgttaataaattgacagttgttttttctaaccaagtcgactccc

SEQ ID NO: 158092 - DNA, 75 bp, Artificial Sequence
  Synthetic
cataatcgttaataaattgacagttgttttttctaaccaagtcgactcccttcattaaaacctttccgccgtaaa

SEQ ID NO: 158093 - DNA, 75 bp, Artificial Sequence
  Synthetic
tataagcaaaagttttataaaagttttttcacactccaactttataggaggacaaaacagagccgttgaaattat

SEQ ID NO: 158094 - DNA, 75 bp, Artificial Sequence
  Synthetic
ttttcacactccaactttataggaggacaaaacagagccgttgaaattatatgtgccattttctcgccgatttta

SEQ ID NO: 158095 - DNA, 75 bp, Artificial Sequence
  Synthetic
tgaatcggataaacacagaatccgtatctccatatataacctttacctcgtacgctttttgggagagaacgctac

SEQ ID NO: 158096 - DNA, 75 bp, Artificial Sequence
  Synthetic
atctccatatataacctttacctcgtacgctttttgggagagaacgctactttcaatgtctggaaacgctgtaat

SEQ ID NO: 158097 - DNA, 75 bp, Artificial Sequence
  Synthetic
ttatgaatataatctctggtacttaataacatttgacggccaattgtagtgacagtggccgctacgtataaacat

SEQ ID NO: 158098 - DNA, 75 bp, Artificial Sequence
  Synthetic
ataacatttgacggccaattgtagtgacagtggccgctacgtataaacatggcagaaatccctgcgcaactccag

SEQ ID NO: 158099 - DNA, 75 bp, Artificial Sequence
  Synthetic
tacttttatcgcggcttgttgtttgtctaataacactgcttcatctgaagaacttccgggtatgcgcgctctaat

SEQ ID NO: 158100 - DNA, 75 bp, Artificial Sequence
  Synthetic
tctaataacactgcttcatctgaagaacttccgggtatgcgcgctctaatagccttgcgcatagccaaccagtct

SEQ ID NO: 158101 - DNA, 75 bp, Artificial Sequence
  Synthetic
ctcgaacgttagagcgcacaaaaaaaagacgttttcctccaactgtaaaggtggcataatcggatggattcaaac

SEQ ID NO: 158102 - DNA, 75 bp, Artificial Sequence
  Synthetic
aagacgttttcctccaactgtaaaggtggcataatcggatggattcaaacgtttaaccgtctcaaaatttaacgt

SEQ ID NO: 158103 - DNA, 75 bp, Artificial Sequence
  Synthetic
gcctgaattatacttggatataaacttgcaaaatccaatacgaccaccggatcgatataaaatcccgtatcaggg

SEQ ID NO: 158104 - DNA, 75 bp, Artificial Sequence
  Synthetic
ttgcaaaatccaatacgaccaccggatcgatataaaatcccgtatcagggtcaaaaaccctggctcctttatatc

SEQ ID NO: 158105 - DNA, 75 bp, Artificial Sequence
  Synthetic
agtgggagaaacgctctcgtcttcatccatctcttcctcaacatccccgacatcgggaataacatccttatattc

SEQ ID NO: 158106 - DNA, 75 bp, Artificial Sequence
  Synthetic
tccatctcttcctcaacatccccgacatcgggaataacatccttatattcaaaagtagctgggtatcccccatcg

SEQ ID NO: 158107 - DNA, 75 bp, Artificial Sequence
  Synthetic
ccagtcctaataaacaggtgtaaatcctaacctgctgtccgtcgtaaatagccttggttaaagtaattctagcta

SEQ ID NO: 158108 - DNA, 75 bp, Artificial Sequence
  Synthetic
cctaacctgctgtccgtcgtaaatagccttggttaaagtaattctagctagccttgcaaccgcggataactcaag

SEQ ID NO: 158109 - DNA, 75 bp, Artificial Sequence
  Synthetic
ttccccacaagagccgagtcttgtatacaatattcaccaataattcctcgtgtattcggtccactagcgtaatat

SEQ ID NO: 158110 - DNA, 75 bp, Artificial Sequence
  Synthetic
tacaatattcaccaataattcctcgtgtattcggtccactagcgtaatatcccggaatgtctttgtagggcaaat

SEQ ID NO: 158111 - DNA, 75 bp, Artificial Sequence
  Synthetic
acgtgcaaccgaatctaatttataactcgagagttttaatttttcagttgcaattgcatacatatccagagatat

SEQ ID NO: 158112 - DNA, 75 bp, Artificial Sequence
  Synthetic
ctcgagagttttaatttttcagttgcaattgcatacatatccagagatatgagaccgttgatctttaccttgctt

SEQ ID NO: 158113 - DNA, 75 bp, Artificial Sequence
  Synthetic
catcccatatcttaaacagacccccacggtttatactgccataaccatcaagcttgagactgtatatagaattaa

SEQ ID NO: 158114 - DNA, 75 bp, Artificial Sequence
  Synthetic
acggtttatactgccataaccatcaagcttgagactgtatatagaattaagtttctccataataaacgcccaatc

SEQ ID NO: 158115 - DNA, 75 bp, Artificial Sequence
  Synthetic
gcaaactcgggagcgtactgttttacgagggtcataaatgcaattaatagctcgaattcactatcaaactccagc

SEQ ID NO: 158116 - DNA, 75 bp, Artificial Sequence
  Synthetic
cgagggtcataaatgcaattaatagctcgaattcactatcaaactccagcacagtcggctccggtaaccccgcgt

SEQ ID NO: 158117 - DNA, 75 bp, Artificial Sequence
  Synthetic
tggtaagtcacaagagccaagggaaaacagtaaaatgtgttctaaagactgtcgagggattgaatataatagaca

SEQ ID NO: 158118 - DNA, 75 bp, Artificial Sequence
  Synthetic
aacagtaaaatgtgttctaaagactgtcgagggattgaatataatagacaagaaatttggattacaagatcctcc

SEQ ID NO: 158119 - DNA, 75 bp, Artificial Sequence
  Synthetic
gctcattagatcctcctgatttacattcaatatcgaaacataacaacttgtagtcaggccatgagtcatcgtttg

SEQ ID NO: 158120 - DNA, 75 bp, Artificial Sequence
  Synthetic
ttcaatatcgaaacataacaacttgtagtcaggccatgagtcatcgtttggtatagcctgcagattatccgacat

SEQ ID NO: 158121 - DNA, 75 bp, Artificial Sequence
  Synthetic
gttaattggcgacttgccggtcgaactcgaacacgttccccatcaactccaggttttagttgataccaaccaaaa

SEQ ID NO: 158122 - DNA, 75 bp, Artificial Sequence
  Synthetic
ctcgaacacgttccccatcaactccaggttttagttgataccaaccaaaactaacaaagccgggattatccatta

SEQ ID NO: 158123 - DNA, 75 bp, Artificial Sequence
  Synthetic
accttcatactttttcaactccgggtgaaagttatcacaaagataatttgtaaatttagatgagggagaatacac

SEQ ID NO: 158124 - DNA, 75 bp, Artificial Sequence
  Synthetic
tgaaagttatcacaaagataatttgtaaatttagatgagggagaatacaccctgtaaaacgcacatggctgtgta

SEQ ID NO: 158125 - DNA, 75 bp, Artificial Sequence
  Synthetic
caataacctcaacgcgaaagctttctggagatgcgcttttaaacgaggtaccatgaaaagcgttcttgtctccat

SEQ ID NO: 158126 - DNA, 75 bp, Artificial Sequence
  Synthetic
tggagatgcgcttttaaacgaggtaccatgaaaagcgttcttgtctccatttaacgttgcatcattttgtgttat

SEQ ID NO: 158127 - DNA, 75 bp, Artificial Sequence
  Synthetic
ggttttcatgttttggcatgtgtccaaccaccgttcgcactttctttctatatatatatatatatatatatatat

SEQ ID NO: 158128 - DNA, 75 bp, Artificial Sequence
  Synthetic
agtaatacagataactcgctaccggaacgtatgccacaagcggtatccacctcggctttgtttatataaaaatat

SEQ ID NO: 158129 - DNA, 75 bp, Artificial Sequence
  Synthetic
aacgtatgccacaagcggtatccacctcggctttgtttatataaaaatattgacagatgccgtatacatgaactg

SEQ ID NO: 158130 - DNA, 75 bp, Artificial Sequence
  Synthetic
gccaagtaaagtaataacggtaccaagcggtcgtgttgcagttgcaaaccgggatacatctccattagacgcggc

SEQ ID NO: 158131 - DNA, 75 bp, Artificial Sequence
  Synthetic
agcggtcgtgttgcagttgcaaaccgggatacatctccattagacgcggcttctgttgtttcgacaatatcatat

SEQ ID NO: 158132 - DNA, 75 bp, Artificial Sequence
  Synthetic
caaacttatccccacgaaagtcgatttccccccaaatattcacgcgtctaggccaggggctggaacaacgaaaat

SEQ ID NO: 158133 - DNA, 75 bp, Artificial Sequence
  Synthetic
ttccccccaaatattcacgcgtctaggccaggggctggaacaacgaaaatccagaatcggaacttcttttccatt

SEQ ID NO: 158134 - DNA, 75 bp, Artificial Sequence
  Synthetic
agtgtaccgacgtgaaccccctttcgttcttccatgggcacatcttcatctaaacatttaggggccaaaaattga

SEQ ID NO: 158135 - DNA, 75 bp, Artificial Sequence
  Synthetic
gttcttccatgggcacatcttcatctaaacatttaggggccaaaaattgaaacgatgacatggtagttttgtaac

SEQ ID NO: 158136 - DNA, 75 bp, Artificial Sequence
  Synthetic
gcgcccggttcttgggttatatttaatccctgatgcttgggttaaaaagggattacaaaaccccgttctgatcgc

SEQ ID NO: 158137 - DNA, 75 bp, Artificial Sequence
  Synthetic
atccctgatgcttgggttaaaaagggattacaaaaccccgttctgatcgccattttatgttaacgattgataatc

SEQ ID NO: 158138 - DNA, 75 bp, Artificial Sequence
  Synthetic
aacacaaccccacgcccttctaatacataaagtgtaatcacgtgatttgttgtggtttccgcatatgtaataccc

SEQ ID NO: 158139 - DNA, 75 bp, Artificial Sequence
  Synthetic
cataaagtgtaatcacgtgatttgttgtggtttccgcatatgtaatacccgtttaaaagcctctcttcttaatgt

SEQ ID NO: 158140 - DNA, 75 bp, Artificial Sequence
  Synthetic
catttgaccctgccaacaaccccccattattacgagtacttcaccaaaatggaaaatactcagaagactgtgaca

SEQ ID NO: 158141 - DNA, 75 bp, Artificial Sequence
  Synthetic
attattacgagtacttcaccaaaatggaaaatactcagaagactgtgacagtgcccacggggcccctgggttacg

SEQ ID NO: 158142 - DNA, 75 bp, Artificial Sequence
  Synthetic
ggatctggaggaaatttcatttttggccgctcgtagcacggactctgatttggctttattacctttgatgcgtaa

SEQ ID NO: 158143 - DNA, 75 bp, Artificial Sequence
  Synthetic
gccgctcgtagcacggactctgatttggctttattacctttgatgcgtaatttgaccgtggaaaaaacttttaca

SEQ ID NO: 158144 - DNA, 75 bp, Artificial Sequence
  Synthetic
tgtgcgggcgggcgacgggcgggctggtcggacccccccccgaaaactaaccccccccggtttctgggcgcccgg

SEQ ID NO: 158145 - DNA, 75 bp, Artificial Sequence
  Synthetic
cacgcactacgggtcttgccggagctggtattaccttaaaactcactaccagtcatttctatccatctgtctttg

SEQ ID NO: 158146 - DNA, 75 bp, Artificial Sequence
  Synthetic
tggtattaccttaaaactcactaccagtcatttctatccatctgtctttgtctttcacggaggcaaacacgtttt

SEQ ID NO: 158147 - DNA, 75 bp, Artificial Sequence
  Synthetic
acacgcgcgtgtaacgcggctcgagaacggtttgggttttcacgctgccaagggcctcctgttgacggtgctgtt

SEQ ID NO: 158148 - DNA, 75 bp, Artificial Sequence
  Synthetic
aacggtttgggttttcacgctgccaagggcctcctgttgacggtgctgttgagacgaccggcgctgagatatgca

SEQ ID NO: 158149 - DNA, 75 bp, Artificial Sequence
  Synthetic
tacaatattatacttggtggtcacggcattgtttaaggaagccgtatttatgtgcaacgtgtttctgcattatgg

SEQ ID NO: 158150 - DNA, 75 bp, Artificial Sequence
  Synthetic
gcattgtttaaggaagccgtatttatgtgcaacgtgtttctgcattatggaggactcgatattgttcatattaac

SEQ ID NO: 158151 - DNA, 75 bp, Artificial Sequence
  Synthetic
tatttccggtacaacttttcatgcccgatgttaaccgtctggtacccgacccattcaacactcatcacaggtcta

SEQ ID NO: 158152 - DNA, 75 bp, Artificial Sequence
  Synthetic
cgatgttaaccgtctggtacccgacccattcaacactcatcacaggtctatcggagagggttttgtatacccaac

SEQ ID NO: 158153 - DNA, 75 bp, Artificial Sequence
  Synthetic
catttaatacatgactgtgttattgctcccatggccgttgccttgcgcgtcagaaatgtaactgccgtcgcccga

SEQ ID NO: 158154 - DNA, 75 bp, Artificial Sequence
  Synthetic
ctcccatggccgttgccttgcgcgtcagaaatgtaactgccgtcgcccgaggagcggcccaccttgcttttgatg

SEQ ID NO: 158155 - DNA, 75 bp, Artificial Sequence
  Synthetic
ccctgacattacgtacacgtattttcagtcctcttcaagtggaaccactaccgcccgtggagcgcgtcgaaacga

SEQ ID NO: 158156 - DNA, 75 bp, Artificial Sequence
  Synthetic
cagtcctcttcaagtggaaccactaccgcccgtggagcgcgtcgaaacgatgtcaactccacgtctaagcctagc

SEQ ID NO: 158157 - DNA, 75 bp, Artificial Sequence
  Synthetic
tggcgtctattatggccgctgacacagccttgcacgcagaagttatattcaacactggaatttacgaagaaactc

SEQ ID NO: 158158 - DNA, 75 bp, Artificial Sequence
  Synthetic
agccttgcacgcagaagttatattcaacactggaatttacgaagaaactccaacagatatcaaagaatggccaat

SEQ ID NO: 158159 - DNA, 75 bp, Artificial Sequence
  Synthetic
ccaaggctaaacgctctggggtcatataccgctcgtgtggccggggtcattggtgcgatggttttcagcccaaat

SEQ ID NO: 158160 - DNA, 75 bp, Artificial Sequence
  Synthetic
ataccgctcgtgtggccggggtcattggtgcgatggttttcagcccaaattctgcgttgtatctaactgaggtgg

SEQ ID NO: 158161 - DNA, 75 bp, Artificial Sequence
  Synthetic
ggatgggggaccgggtccatcatttaatcgattttaccagtttgccggacctcatttagctgcgaatccccaaac

SEQ ID NO: 158162 - DNA, 75 bp, Artificial Sequence
  Synthetic
aatcgattttaccagtttgccggacctcatttagctgcgaatccccaaacagatcgagatggccacgttctatcc

SEQ ID NO: 158163 - DNA, 75 bp, Artificial Sequence
  Synthetic
cagagtttagcgtggattatttggcactcatttgtggatttggagcacccctgttggcgcgactgcttttttatc

SEQ ID NO: 158164 - DNA, 75 bp, Artificial Sequence
  Synthetic
actcatttgtggatttggagcacccctgttggcgcgactgcttttttatctagaacgctgtgacgctggtgcgtt

SEQ ID NO: 158165 - DNA, 75 bp, Artificial Sequence
  Synthetic
aaatatgttacggggacctttgactctgaaattccatgtagtttatgtgaaaaacacacgcggccggtatgcgct

SEQ ID NO: 158166 - DNA, 75 bp, Artificial Sequence
  Synthetic
ctgaaattccatgtagtttatgtgaaaaacacacgcggccggtatgcgctcacacaacagtacaccgacttagac

SEQ ID NO: 158167 - DNA, 75 bp, Artificial Sequence
  Synthetic
cacccgtcaacctattggggtgtttggaacaatgaacagccaatatagcgactgcgatcctctaggaaactatgc

SEQ ID NO: 158168 - DNA, 75 bp, Artificial Sequence
  Synthetic
ggaacaatgaacagccaatatagcgactgcgatcctctaggaaactatgctccatatttaatccttcgaaaaccc

SEQ ID NO: 158169 - DNA, 75 bp, Artificial Sequence
  Synthetic
caaccatgcaggacacttatagggctacactagaacgcttgtttatcgatctagaacaagagcgactactggatc

SEQ ID NO: 158170 - DNA, 75 bp, Artificial Sequence
  Synthetic
tacactagaacgcttgtttatcgatctagaacaagagcgactactggatcgcggtgccccatgttcttccgaggg

SEQ ID NO: 158171 - DNA, 75 bp, Artificial Sequence
  Synthetic
ccaacgtttcgtcgcatattagacacactgcgtgcgcgtatagaacagacaacaacacaatttatgaaagtgttg

SEQ ID NO: 158172 - DNA, 75 bp, Artificial Sequence
  Synthetic
cactgcgtgcgcgtatagaacagacaacaacacaatttatgaaagtgttggttgagacccgcgattataagatcc

SEQ ID NO: 158173 - DNA, 75 bp, Artificial Sequence
  Synthetic
ttcaatggcgttaacgtttgatccatactcaggagcattttgtcccattaccaattttttagttaaacgaacaca

SEQ ID NO: 158174 - DNA, 75 bp, Artificial Sequence
  Synthetic
tactcaggagcattttgtcccattaccaattttttagttaaacgaacacacctagccgtggtacaagacttagca

SEQ ID NO: 158175 - DNA, 75 bp, Artificial Sequence
  Synthetic
acggacagcaagttgaggggcggaactttcgtaaccaattccaacctgttttgcggcggcgttttgttgacctgt

SEQ ID NO: 158176 - DNA, 75 bp, Artificial Sequence
  Synthetic
ctttcgtaaccaattccaacctgttttgcggcggcgttttgttgacctgtttaatggggggtttatatcaacacg

SEQ ID NO: 158177 - DNA, 75 bp, Artificial Sequence
  Synthetic
ggtcctgtatccgccccaaatccgacattgggacaagacgcgcccgcggggcgtacctttgatggggatttagcg

SEQ ID NO: 158178 - DNA, 75 bp, Artificial Sequence
  Synthetic
cattgggacaagacgcgcccgcggggcgtacctttgatggggatttagcgcgcgtaagcgtggaagttattcggg

SEQ ID NO: 158179 - DNA, 75 bp, Artificial Sequence
  Synthetic
tttttcaggtaactgtacaaatctctctgaggcagcccgggcaaggcttgtaggccttgcaagtgcgtaccaacg

SEQ ID NO: 158180 - DNA, 75 bp, Artificial Sequence
  Synthetic
tctgaggcagcccgggcaaggcttgtaggccttgcaagtgcgtaccaacgccaagaaaaaagagtggatatgtta

SEQ ID NO: 158181 - DNA, 75 bp, Artificial Sequence
  Synthetic
aacagtttcacggcctgttatttcctcggggtatgccaccaaacagtaaatcccccaacccgcagtggttttgga

SEQ ID NO: 158182 - DNA, 75 bp, Artificial Sequence
  Synthetic
tcggggtatgccaccaaacagtaaatcccccaacccgcagtggttttggaccctgttacaacgcaaccagatgcc

SEQ ID NO: 158183 - DNA, 75 bp, Artificial Sequence
  Synthetic
attaccactattgcagctgttaaacggtttaccgaggaatatgcagcaataaactttattaatctacccccaacc

SEQ ID NO: 158184 - DNA, 75 bp, Artificial Sequence
  Synthetic
ggtttaccgaggaatatgcagcaataaactttattaatctacccccaacctgcataggagaattagcccagtttt

SEQ ID NO: 158185 - DNA, 75 bp, Artificial Sequence
  Synthetic
ctgcgatcattcacagtaccttataaataccttaacttctataattacgggtgccaggcgcccgcgtgacccatc

SEQ ID NO: 158186 - DNA, 75 bp, Artificial Sequence
  Synthetic
aataccttaacttctataattacgggtgccaggcgcccgcgtgacccatcatccgttttgcattggattcgtaaa

SEQ ID NO: 158187 - DNA, 75 bp, Artificial Sequence
  Synthetic
aaacccaagcaaaggcgcttcttgaaaaaacggaaaacttaccggaattatggactacggcttttacttcaactc

SEQ ID NO: 158188 - DNA, 75 bp, Artificial Sequence
  Synthetic
aaaaacggaaaacttaccggaattatggactacggcttttacttcaactcatttagtccgcgcggccatgaatca

SEQ ID NO: 158189 - DNA, 75 bp, Artificial Sequence
  Synthetic
acggcgggatcgggctttcgggaagcggccgaggtgggcgcgacggcgggatcgggctttcgggaagcggccgag

SEQ ID NO: 158190 - DNA, 75 bp, Artificial Sequence
  Synthetic
agcattagtaaatatcacggagcggcaggaaacaaccgcgtctttcaggcagggaattggagcggtttaaacggg

SEQ ID NO: 158191 - DNA, 75 bp, Artificial Sequence
  Synthetic
caggaaacaaccgcgtctttcaggcagggaattggagcggtttaaacgggggtaaaaatgtatgcccgctattta

SEQ ID NO: 158192 - DNA, 75 bp, Artificial Sequence
  Synthetic
tataattcagttatacttacgggtgtgggttgagattcagtcgataattgtatacacgcgatcgttaaaattaaa

SEQ ID NO: 158193 - DNA, 75 bp, Artificial Sequence
  Synthetic
aatagcatgtcctagaggaggttttatctgccccgtaacaggtccctcgtcgggaaatcgagaaaccaccctatc

SEQ ID NO: 158194 - DNA, 75 bp, Artificial Sequence
  Synthetic
atctgccccgtaacaggtccctcgtcgggaaatcgagaaaccaccctatccgaccaagttcgcggtataattgtc

SEQ ID NO: 158195 - DNA, 75 bp, Artificial Sequence
  Synthetic
ccatatacgccacggttgtgcgtgcagtgggcgctcgagcacaacatatggcatttgacgactggttaagtctta

SEQ ID NO: 158196 - DNA, 75 bp, Artificial Sequence
  Synthetic
agtgggcgctcgagcacaacatatggcatttgacgactggttaagtcttacagacgatgagtttttagccagaga

SEQ ID NO: 158197 - DNA, 75 bp, Artificial Sequence
  Synthetic
atccaaaccctggaaacgccctggaccgtagaaggcgctctagaagcagtaaagattctagatgaaaaaacgaca

SEQ ID NO: 158198 - DNA, 75 bp, Artificial Sequence
  Synthetic
gcgggagatggggaaacccccacaaacctagcatttaattttgattcttgtgaaccaagccatgacaccacatct

SEQ ID NO: 158199 - DNA, 75 bp, Artificial Sequence
  Synthetic
acatttcagggtcaactgtccctggtcttaaacgaccccccgaagatgacgaactctttgatcttagtggtattc

SEQ ID NO: 158200 - DNA, 75 bp, Artificial Sequence
  Synthetic
tcttaaacgaccccccgaagatgacgaactctttgatcttagtggtattcccataaaacatgggaacattacaat

SEQ ID NO: 158201 - DNA, 75 bp, Artificial Sequence
  Synthetic
tccaattaaagcccacacgcgggtgagtgtacgtaataaacaagtcaatattacatattctgttgtgttttcttt

SEQ ID NO: 158202 - DNA, 75 bp, Artificial Sequence
  Synthetic
ttttgcgtgtagtccttacccatatgacctgtaatatagtgtgtctccaaccattcagcttacagtccagtggac

SEQ ID NO: 158203 - DNA, 75 bp, Artificial Sequence
  Synthetic
ccattcagcttacagtccagtggacagtaacagcccgataacatggaattggatattaatcgaacattgttggtt

SEQ ID NO: 158204 - DNA, 75 bp, Artificial Sequence
  Synthetic
agtaacagcccgataacatggaattggatattaatcgaacattgttggttctactgggtcaagtttatacgtaca

SEQ ID NO: 158205 - DNA, 75 bp, Artificial Sequence
  Synthetic
atgtgatccaagggtggcgtgtcgctttttatatcggttagcggctaactgtttgacagttcgttatttattaaa

SEQ ID NO: 158206 - DNA, 75 bp, Artificial Sequence
  Synthetic
tttttatatcggttagcggctaactgtttgacagttcgttatttattaaagctgtttctccggggatttaatacc

SEQ ID NO: 158207 - DNA, 75 bp, Artificial Sequence
  Synthetic
cggtttgtgcactgcattgggcattatgttatgtaaagggagaaggtgagcgtttgtttgagttgctgcaacatt

SEQ ID NO: 158208 - DNA, 75 bp, Artificial Sequence
  Synthetic
gactaaagactcaaactgtatcaaagattactttgtctcagcgtttaacttaaaaacctgccaatatcaccatga

SEQ ID NO: 158209 - DNA, 75 bp, Artificial Sequence
  Synthetic
gattactttgtctcagcgtttaacttaaaaacctgccaatatcaccatgagctgtcgttaacaacatacggaggt

SEQ ID NO: 158210 - DNA, 75 bp, Artificial Sequence
  Synthetic
taaaaacctgccaatatcaccatgagctgtcgttaacaacatacggaggttacgtatcgagtgaaattcagtttt

SEQ ID NO: 158211 - DNA, 75 bp, Artificial Sequence
  Synthetic
acagcttaattactgctatattatcacgtcttctcgtgaggcgctaaacacattggaaaccgtgacgcggtttat

SEQ ID NO: 158212 - DNA, 75 bp, Artificial Sequence
  Synthetic
acgtcttctcgtgaggcgctaaacacattggaaaccgtgacgcggtttatgacagatactataggaagcggtcta

SEQ ID NO: 158213 - DNA, 75 bp, Artificial Sequence
  Synthetic
cggcgcatccatgtgctatatgttttgaagaattatgtataacagctaaccaaggtgagaccttacatcgtagat

SEQ ID NO: 158214 - DNA, 75 bp, Artificial Sequence
  Synthetic
tactaagcaagttcgggttaacgtggatgttgacgatattattcggtgtttaccatatatccctgatgtaccgga

SEQ ID NO: 158215 - DNA, 75 bp, Artificial Sequence
  Synthetic
gatgttgacgatattattcggtgtttaccatatatccctgatgtaccggatatcaaacgtcaatccgccgttgaa

SEQ ID NO: 158216 - DNA, 75 bp, Artificial Sequence
  Synthetic
taccatatatccctgatgtaccggatatcaaacgtcaatccgccgttgaagcgttacgaacacttcaaaccaaga

SEQ ID NO: 158217 - DNA, 75 bp, Artificial Sequence
  Synthetic
gaacgatacgtttgaccaaacatacgaaattgcgagcaccatgcttgattcttataatgtttttaaacctgcccc

SEQ ID NO: 158218 - DNA, 75 bp, Artificial Sequence
  Synthetic
gaaattgcgagcaccatgcttgattcttataatgtttttaaacctgcccctcggtgtatgtacgccatcagcgag

SEQ ID NO: 158219 - DNA, 75 bp, Artificial Sequence
  Synthetic
ccactgaaggaccccaacgtactttagacgtgtttgttgataatttggatgtattaaacgaacatgaaaaacacg

SEQ ID NO: 158220 - DNA, 75 bp, Artificial Sequence
  Synthetic
agacgtgtttgttgataatttggatgtattaaacgaacatgaaaaacacgcagaacttacagccgtaacggttga

SEQ ID NO: 158221 - DNA, 75 bp, Artificial Sequence
  Synthetic
atacactttgatagggcgttttctgaagaactcggatctctggatgcaattgatagtattttggttggcaatcgc

SEQ ID NO: 158222 - DNA, 75 bp, Artificial Sequence
  Synthetic
aagaactcggatctctggatgcaattgatagtattttggttggcaatcgctcatcctcaccagacagtcagatag

SEQ ID NO: 158223 - DNA, 75 bp, Artificial Sequence
  Synthetic
ccatcatctatcgtcgcctctcatgcgtcacatttctaacccgagtcatgataacgaagccgccttacgccaact

SEQ ID NO: 158224 - DNA, 75 bp, Artificial Sequence
  Synthetic
cgtcacatttctaacccgagtcatgataacgaagccgccttacgccaacttttagaaagagttgggtgtgaggat

SEQ ID NO: 158225 - DNA, 75 bp, Artificial Sequence
  Synthetic
gcgctacagcatccgaatgtgatctgaacgatgatagtagcataacttttgctgttcatggatgggaaaacctgt

SEQ ID NO: 158226 - DNA, 75 bp, Artificial Sequence
  Synthetic
gaacgatgatagtagcataacttttgctgttcatggatgggaaaacctgttatccaaagcaaaaattgacgctgc

SEQ ID NO: 158227 - DNA, 75 bp, Artificial Sequence
  Synthetic
catctgtctaagcgctctctaaccagcctcggtagatgtatccgcgaacagcgccaagagctagaaaaaacactc

SEQ ID NO: 158228 - DNA, 75 bp, Artificial Sequence
  Synthetic
gcctcggtagatgtatccgcgaacagcgccaagagctagaaaaaacactcagggtaaacgtttatggagaggcct

SEQ ID NO: 158229 - DNA, 75 bp, Artificial Sequence
  Synthetic
aaatgggtttggggcacgaaacgtgtttttagctaaggtttcccaggcagggtgtattatcgacaatcgcattca

SEQ ID NO: 158230 - DNA, 75 bp, Artificial Sequence
  Synthetic
tttttagctaaggtttcccaggcagggtgtattatcgacaatcgcattcaggaagcggcctttgatgcacataga

SEQ ID NO: 158231 - DNA, 75 bp, Artificial Sequence
  Synthetic
atacagtagatgcggctatgttacctgcacttacacataaattttttgagttggtcaacggcccattgtttaatc

SEQ ID NO: 158232 - DNA, 75 bp, Artificial Sequence
  Synthetic
tgcacttacacataaattttttgagttggtcaacggcccattgtttaatcacgatgaacaccgttttgcacaacc

SEQ ID NO: 158233 - DNA, 75 bp, Artificial Sequence
  Synthetic
gtggaaaacgttggcctatttccgcacttaaaagaggaattggcaaagtttatgggcggtgtcgttggttccaac

SEQ ID NO: 158234 - DNA, 75 bp, Artificial Sequence
  Synthetic
acttaaaagaggaattggcaaagtttatgggcggtgtcgttggttccaactggcttctcagtccatttaggggct

SEQ ID NO: 158235 - DNA, 75 bp, Artificial Sequence
  Synthetic
cgttacttttgcacagagacttgcctggaaatatattagggagcttgtgtttgcaaccacactattcacctctgt

SEQ ID NO: 158236 - DNA, 75 bp, Artificial Sequence
  Synthetic
tggaaatatattagggagcttgtgtttgcaaccacactattcacctctgttttccattgtggggaggtgcggtta

SEQ ID NO: 158237 - DNA, 75 bp, Artificial Sequence
  Synthetic
atccacgcgggtgcacgtctcaacctaaaggtataggcagttcccacggacccttagacggcatttatttaacgt

SEQ ID NO: 158238 - DNA, 75 bp, Artificial Sequence
  Synthetic
taaaggtataggcagttcccacggacccttagacggcatttatttaacgtacgaagaaacatgtccccttgtggc

SEQ ID NO: 158239 - DNA, 75 bp, Artificial Sequence
  Synthetic
atcgaccagaataccgtcgtaatctacgattcagacgttttttctcttctatacaccctaatgcagcggctggct

SEQ ID NO: 158240 - DNA, 75 bp, Artificial Sequence
  Synthetic
acgattcagacgttttttctcttctatacaccctaatgcagcggctggctccggattcaacggacccggcgtttt

SEQ ID NO: 158241 - DNA, 75 bp, Artificial Sequence
  Synthetic
ttatgctttttatgcatattttctatgtttgttacggcggttgtgtcggtctctccaagctcgttttatgagagt

SEQ ID NO: 158242 - DNA, 75 bp, Artificial Sequence
  Synthetic
tgtttgttacggcggttgtgtcggtctctccaagctcgttttatgagagtttacaagtagagcccacacaatcag

SEQ ID NO: 158243 - DNA, 75 bp, Artificial Sequence
  Synthetic
gggcgatggtgatgaaatcagagaagctatacacaagtcccaggacgccgaaacaaaacccacgttttacgtctg

SEQ ID NO: 158244 - DNA, 75 bp, Artificial Sequence
  Synthetic
gctatacacaagtcccaggacgccgaaacaaaacccacgttttacgtctgcccaccgccaacaggctccacaatc

SEQ ID NO: 158245 - DNA, 75 bp, Artificial Sequence
  Synthetic
gtccggattatcaccttggtaaaaactttacagagggtattgctgttgtttataaagaaaacattgcagcgtaca

SEQ ID NO: 158246 - DNA, 75 bp, Artificial Sequence
  Synthetic
ctttacagagggtattgctgttgtttataaagaaaacattgcagcgtacaagtttaaggcgacggtatattacaa

SEQ ID NO: 158247 - DNA, 75 bp, Artificial Sequence
  Synthetic
gccggaagttcttatacgcaaattactaatagatatgcggatagggtaccaattcccgtttcagagatcacggac

SEQ ID NO: 158248 - DNA, 75 bp, Artificial Sequence
  Synthetic
ctaatagatatgcggatagggtaccaattcccgtttcagagatcacggacaccattgataagtttggcaagtgtt

SEQ ID NO: 158249 - DNA, 75 bp, Artificial Sequence
  Synthetic
taaccacaaagttgaagcctttaatgaggataaaaatccacaggatatgcctctaatcgcatcaaaatataattc

SEQ ID NO: 158250 - DNA, 75 bp, Artificial Sequence
  Synthetic
gaggataaaaatccacaggatatgcctctaatcgcatcaaaatataattctgtgggatccaaagcatggcatact

SEQ ID NO: 158251 - DNA, 75 bp, Artificial Sequence
  Synthetic
gaacccccggaacatataggacgggcacgtcggtgaattgcatcattgaggaagttgaagccagatcaatattcc

SEQ ID NO: 158252 - DNA, 75 bp, Artificial Sequence
  Synthetic
cacgtcggtgaattgcatcattgaggaagttgaagccagatcaatattcccttatgatagttttggactttccac

SEQ ID NO: 158253 - DNA, 75 bp, Artificial Sequence
  Synthetic
ttttttggcctacgggatggtgcatacagagaacattccaattatgcaatggatcgttttcaccagtttgagggt

SEQ ID NO: 158254 - DNA, 75 bp, Artificial Sequence
  Synthetic
acagagaacattccaattatgcaatggatcgttttcaccagtttgagggttatagacaaagggatcttgacacta

SEQ ID NO: 158255 - DNA, 75 bp, Artificial Sequence
  Synthetic
gaactttttagtcacgcctcatttaacggttggttggaactggaagccaaaacgaacggaagtttgttcgcttgt

SEQ ID NO: 158256 - DNA, 75 bp, Artificial Sequence
  Synthetic
acggttggttggaactggaagccaaaacgaacggaagtttgttcgcttgtcaagtggcgtgaggttgaagacgta

SEQ ID NO: 158257 - DNA, 75 bp, Artificial Sequence
  Synthetic
ttcgctttacaatgaaaacactttctaccacgtttataagtgaaacaaacgagtttaatcttaaccaaatccatc

SEQ ID NO: 158258 - DNA, 75 bp, Artificial Sequence
  Synthetic
taccacgtttataagtgaaacaaacgagtttaatcttaaccaaatccatctcagtcaatgtgtaaaggaggaagc

SEQ ID NO: 158259 - DNA, 75 bp, Artificial Sequence
  Synthetic
acaaccagatacaactcatctcatgttagaaccggggatatccagacctaccttgccagaggggggtttgttgtg

SEQ ID NO: 158260 - DNA, 75 bp, Artificial Sequence
  Synthetic
ttagaaccggggatatccagacctaccttgccagaggggggtttgttgtggtgtttcaacccctgctgagcaatt

SEQ ID NO: 158261 - DNA, 75 bp, Artificial Sequence
  Synthetic
attggtccgtgaaaacactaatcattcaccacaaaaacacccgactcgaaataccagatcccgacgaagcgtgcc

SEQ ID NO: 158262 - DNA, 75 bp, Artificial Sequence
  Synthetic
tcaccacaaaaacacccgactcgaaataccagatcccgacgaagcgtgccagttgagttgcgtgccaatagaaca

SEQ ID NO: 158263 - DNA, 75 bp, Artificial Sequence
  Synthetic
ttgctatgctccagtttacatatgaccacattcaagagcatgttaatgaaatgttggcacgtatctcctcgtcgt

SEQ ID NO: 158264 - DNA, 75 bp, Artificial Sequence
  Synthetic
ccacattcaagagcatgttaatgaaatgttggcacgtatctcctcgtcgtggtgccagctacaaaatcgcgaacg

SEQ ID NO: 158265 - DNA, 75 bp, Artificial Sequence
  Synthetic
attaacccaagtgctttagcgagcaccattttggatcaacgtgttaaagctcgtattctcggcgacgttatctcc

SEQ ID NO: 158266 - DNA, 75 bp, Artificial Sequence
  Synthetic
ccattttggatcaacgtgttaaagctcgtattctcggcgacgttatctccgtttctaattgtccagaactgggat

SEQ ID NO: 158267 - DNA, 75 bp, Artificial Sequence
  Synthetic
ctctatgagggtatctggtagtactacgcgttgttatagccgtcctttaatttcaatagttagtttaaatgggtc

SEQ ID NO: 158268 - DNA, 75 bp, Artificial Sequence
  Synthetic
acgcgttgttatagccgtcctttaatttcaatagttagtttaaatgggtccgggacggtggagggccagcttgga

SEQ ID NO: 158269 - DNA, 75 bp, Artificial Sequence
  Synthetic
gagatctgttagaaccatgcgtggctaatcacaagcgatattttctatttgggcatcactacgtatattatgagg

SEQ ID NO: 158270 - DNA, 75 bp, Artificial Sequence
  Synthetic
taatcacaagcgatattttctatttgggcatcactacgtatattatgaggattatcgttacgtccgtgaaatcgc

SEQ ID NO: 158271 - DNA, 75 bp, Artificial Sequence
  Synthetic
acttacgtagatttaaacttaacacttcttaaagatagagagtttatgccgctgcaagtatatacaagagacgag

SEQ ID NO: 158272 - DNA, 75 bp, Artificial Sequence
  Synthetic
ttcttaaagatagagagtttatgccgctgcaagtatatacaagagacgagctgcgggatacaggattactagact

SEQ ID NO: 158273 - DNA, 75 bp, Artificial Sequence
  Synthetic
aatgcattcgctgcgtttttatgacatagacaaggttgtgcaatatgatagcggaacggccattatgcagggcat

SEQ ID NO: 158274 - DNA, 75 bp, Artificial Sequence
  Synthetic
atagacaaggttgtgcaatatgatagcggaacggccattatgcagggcatggctcagtttttccagggacttggg

SEQ ID NO: 158275 - DNA, 75 bp, Artificial Sequence
  Synthetic
tggttcttggggccacgggagcgctgctttccaccgtacacggatttaccacgtttttatctaacccatttgggg

SEQ ID NO: 158276 - DNA, 75 bp, Artificial Sequence
  Synthetic
gctttccaccgtacacggatttaccacgtttttatctaacccatttggggcattggccgtgggattattggtttt

SEQ ID NO: 158277 - DNA, 75 bp, Artificial Sequence
  Synthetic
gcgtaccggtacgtgcttaaacttaaaacaagcccgatgaaggcattatatccactcacaaccaaggggttaaaa

SEQ ID NO: 158278 - DNA, 75 bp, Artificial Sequence
  Synthetic
cagttaccggaaggaatggatccctttgccgagaaacccaacgctactgataccccaatagaagaaattggcgac

SEQ ID NO: 158279 - DNA, 75 bp, Artificial Sequence
  Synthetic
atagcgggtttgatcccgataaatttcgagaagcccaggaaatgattaaatatatgacgttagtatctgcggctg

SEQ ID NO: 158280 - DNA, 75 bp, Artificial Sequence
  Synthetic
tcgagaagcccaggaaatgattaaatatatgacgttagtatctgcggctgagcgccaagaatctaaagcccgcaa

SEQ ID NO: 158281 - DNA, 75 bp, Artificial Sequence
  Synthetic
acttcacgtcttaccggccttgctttacgaaatcgccgaggatactcccgtgttcgcaccgagaatgtaacgggg

SEQ ID NO: 158282 - DNA, 75 bp, Artificial Sequence
  Synthetic
tacgaaatcgccgaggatactcccgtgttcgcaccgagaatgtaacgggggtgtaaatagccagggggtttgttt

SEQ ID NO: 158283 - DNA, 75 bp, Artificial Sequence
  Synthetic
acgttactcatgtgtctccattacgcatcacagggggtatttatacccgataatatacaaaacgcgttttgtacc

SEQ ID NO: 158284 - DNA, 75 bp, Artificial Sequence
  Synthetic
catcacagggggtatttatacccgataatatacaaaacgcgttttgtacctctaccgcacccgatatcttaacgg

SEQ ID NO: 158285 - DNA, 75 bp, Artificial Sequence
  Synthetic
aacgcgctacaacaaccgtcgtctatcgcacatcatccgtccaaacagtgcgcttcaagtctcaatgaaacagta

SEQ ID NO: 158286 - DNA, 75 bp, Artificial Sequence
  Synthetic
tcgcacatcatccgtccaaacagtgcgcttcaagtctcaatgaaacagtaaaagattctccccccgcgatttatg

SEQ ID NO: 158287 - DNA, 75 bp, Artificial Sequence
  Synthetic
acaattaccccgcgacggtacaccccgagacgtatgttctgtgggacagctaacctgtcgagcatgtgcaacgaa

SEQ ID NO: 158288 - DNA, 75 bp, Artificial Sequence
  Synthetic
cgagacgtatgttctgtgggacagctaacctgtcgagcatgtgcaacgaaaccttttcgccttaaccgcgacagc

SEQ ID NO: 158289 - DNA, 75 bp, Artificial Sequence
  Synthetic
cagggggccgtcatatttcactggcactggagattataacgggtcgatgggtttgcatcccgcgtgtgtttccgg

SEQ ID NO: 158290 - DNA, 75 bp, Artificial Sequence
  Synthetic
actggagattataacgggtcgatgggtttgcatcccgcgtgtgtttccggataccccagaggaaaaatggatggc

SEQ ID NO: 158291 - DNA, 75 bp, Artificial Sequence
  Synthetic
caaccatcatcaggggatgaagattctgacaccgattaaatttaacttaaataaaaccttaccacccataaaaac

SEQ ID NO: 158292 - DNA, 75 bp, Artificial Sequence
  Synthetic
ctgacaccgattaaatttaacttaaataaaaccttaccacccataaaaacgccttctgtttgtttaacacgacac

SEQ ID NO: 158293 - DNA, 75 bp, Artificial Sequence
  Synthetic
acacgccttttatgaatgtaatacttttatttgttggttaacaccgccccaccatcatctgatttgcaaacatat

SEQ ID NO: 158294 - DNA, 75 bp, Artificial Sequence
  Synthetic
gtcgccccgcaaacgcgcggggaggtggggtcgcttttttttttctctctcgagggggccgcgagagggctgggc

SEQ ID NO: 158295 - DNA, 75 bp, Artificial Sequence
  Synthetic
tttatttgttggttaacaccgccccaccatcatctgatttgcaaacatatcggcgtcgtctgccgtggacccctg

SEQ ID NO: 158296 - DNA, 75 bp, Artificial Sequence
  Synthetic
tccactgcatttacatcttgtccaactgtatctgtatgtggggtgcttgttgtattttgggatgagcatagaccc

SEQ ID NO: 158297 - DNA, 75 bp, Artificial Sequence
  Synthetic
ctgtatctgtatgtggggtgcttgttgtattttgggatgagcatagacccgaaacgctttgaagctgttttaata

SEQ ID NO: 158298 - DNA, 75 bp, Artificial Sequence
  Synthetic
cccctctggtatatttgtatggtgcgacaaaggcatttgtgtcccattttgtgattttagctctgtaacctcctg

SEQ ID NO: 158299 - DNA, 75 bp, Artificial Sequence
  Synthetic
gacaaaggcatttgtgtcccattttgtgattttagctctgtaacctcctgttgcagttttgccacaaccccagca

SEQ ID NO: 158300 - DNA, 75 bp, Artificial Sequence
  Synthetic
ctctgtgtctcctctgccaatatgatggagaaactcgacgtctccgatgcgttatatacgttggttcaccgggaa

SEQ ID NO: 158301 - DNA, 75 bp, Artificial Sequence
  Synthetic
gtccatttgagactccccactataaaaagaatccaattccctttgatccatgctcttgaaatcccgttttcctgg

SEQ ID NO: 158302 - DNA, 75 bp, Artificial Sequence
  Synthetic
aaatttacacacggggtctgcaagtcaataccccgttcggcggccaatgcgttcataaatgcggacatttgcatt

SEQ ID NO: 158303 - DNA, 75 bp, Artificial Sequence
  Synthetic
tccaaacgattgggtggtggatatcccggaaacccgtacggtcccccgaagtgtcccggagggcaaccataaccc

SEQ ID NO: 158304 - DNA, 75 bp, Artificial Sequence
  Synthetic
ggtgtggagatccatatggcccgacgatatactgtccgttatttggagctccaattgatacctgcggatttttag

SEQ ID NO: 158305 - DNA, 75 bp, Artificial Sequence
  Synthetic
tctgcccggttaacagctgtgaataatacgcggtaggtatcagtacaaattcccctccggttggaacgcccgacg

SEQ ID NO: 158306 - DNA, 75 bp, Artificial Sequence
  Synthetic
gttacctgctacagaagccatatcgctgtcgttcctacacaactgcgtaacctttaaatgcggaacagtcttttc

SEQ ID NO: 158307 - DNA, 75 bp, Artificial Sequence
  Synthetic
ctgtcgttcctacacaactgcgtaacctttaaatgcggaacagtcttttcacaatcttcatttgattccccaaca

SEQ ID NO: 158308 - DNA, 75 bp, Artificial Sequence
  Synthetic
cgccggggtggaatgtggcgtttataacacccgcgttgggtaatttagactccaccccattaacgttggttatcc

SEQ ID NO: 158309 - DNA, 75 bp, Artificial Sequence
  Synthetic
aacacccgcgttgggtaatttagactccaccccattaacgttggttatccgagcaagtccatatccggtgctagc

SEQ ID NO: 158310 - DNA, 75 bp, Artificial Sequence
  Synthetic
ccggcttcgcgtctacgttttgcaaccacgtcccatctatctcttaaaagcatattgttcacggctgtggataat

SEQ ID NO: 158311 - DNA, 75 bp, Artificial Sequence
  Synthetic
ccacgtcccatctatctcttaaaagcatattgttcacggctgtggataataacaccttggcgagtttatcttcgc

SEQ ID NO: 158312 - DNA, 75 bp, Artificial Sequence
  Synthetic
cgcgtagtctttaaccagcgacaataaccgcgctttactttccatcgataaaacccggaatggttcaattgaaga

SEQ ID NO: 158313 - DNA, 75 bp, Artificial Sequence
  Synthetic
aaccgcgctttactttccatcgataaaacccggaatggttcaattgaagattccggggtacagtcataattgacc

SEQ ID NO: 158314 - DNA, 75 bp, Artificial Sequence
  Synthetic
cacataacgcaacatgggtaaaaaaattaccgtctggtatctcattcggggacaatcgttttgaagacagggata

SEQ ID NO: 158315 - DNA, 75 bp, Artificial Sequence
  Synthetic
attaccgtctggtatctcattcggggacaatcgttttgaagacagggatacggagggtaagtaatttgtgaccaa

SEQ ID NO: 158316 - DNA, 75 bp, Artificial Sequence
  Synthetic
aatacagaatctctatttccaaaaaaattcgaatgggccgcttcaaacagcaccgcatgtagttgagggcatcta

SEQ ID NO: 158317 - DNA, 75 bp, Artificial Sequence
  Synthetic
aattcgaatgggccgcttcaaacagcaccgcatgtagttgagggcatctaacgatacccaaaaaaaaaggtccgc

SEQ ID NO: 158318 - DNA, 75 bp, Artificial Sequence
  Synthetic
ttcacccacgacacagtcttttcgatgatcgatgtttattggtattttactagtaggcggcaaagcggaccgcac

SEQ ID NO: 158319 - DNA, 75 bp, Artificial Sequence
  Synthetic
tgatcgatgtttattggtattttactagtaggcggcaaagcggaccgcacaatctctggggtaatatttaattcc

SEQ ID NO: 158320 - DNA, 75 bp, Artificial Sequence
  Synthetic
aatacccagccacgtataacgcttcacagttctcttcgtcagcttcagcagccattataaacaccccacggaccg

SEQ ID NO: 158321 - DNA, 75 bp, Artificial Sequence
  Synthetic
acagttctcttcgtcagcttcagcagccattataaacaccccacggaccggatagtgaatactcacggtgtggag

SEQ ID NO: 158322 - DNA, 75 bp, Artificial Sequence
  Synthetic
agacaaaatatagaagatcatagtcactgttaacgttgaactgcgcaaggcggcgactttcttccaatgccgccc

SEQ ID NO: 158323 - DNA, 75 bp, Artificial Sequence
  Synthetic
actgttaacgttgaactgcgcaaggcggcgactttcttccaatgccgcccttacacgcggttggtgcattaacat

SEQ ID NO: 158324 - DNA, 75 bp, Artificial Sequence
  Synthetic
ataacactgtcatgtattgataccacggcggctatgggtagggatgtaacattttgtcggcggtgttctaattcc

SEQ ID NO: 158325 - DNA, 75 bp, Artificial Sequence
  Synthetic
cggcggctatgggtagggatgtaacattttgtcggcggtgttctaattccaatgcaattaagcttatgagccgat

SEQ ID NO: 158326 - DNA, 75 bp, Artificial Sequence
  Synthetic
tattacggttcttcctaaacttccacgactaagctgggtatgcgcgtctaaacaaagagcaactaatccaggaaa

SEQ ID NO: 158327 - DNA, 75 bp, Artificial Sequence
  Synthetic
cgactaagctgggtatgcgcgtctaaacaaagagcaactaatccaggaaacatttcagtcagctctgtggtccga

SEQ ID NO: 158328 - DNA, 75 bp, Artificial Sequence
  Synthetic
atcgttcacataaaaattgaaagttattattaccgcttttaaacttcccatcaaaccccgtcgctccgcgcaaga

SEQ ID NO: 158329 - DNA, 75 bp, Artificial Sequence
  Synthetic
attattaccgcttttaaacttcccatcaaaccccgtcgctccgcgcaagattacattgttggtaggggttcctgt

SEQ ID NO: 158330 - DNA, 75 bp, Artificial Sequence
  Synthetic
tgaaaattattttttagtttatctccgtatacgttcccgttccataataagcgccttaataataataacgccgta

SEQ ID NO: 158331 - DNA, 75 bp, Artificial Sequence
  Synthetic
cgtatacgttcccgttccataataagcgccttaataataataacgccgtaatcgtgtcaattgttaaccttaata

SEQ ID NO: 158332 - DNA, 75 bp, Artificial Sequence
  Synthetic
gttttgggcccgttctaaatacgccgcggccgcctgttgaatcttgtccacatatgcggtatgattgcgatcaat

SEQ ID NO: 158333 - DNA, 75 bp, Artificial Sequence
  Synthetic
gcggccgcctgttgaatcttgtccacatatgcggtatgattgcgatcaataatgtcattaaccccaggattaaac

SEQ ID NO: 158334 - DNA, 75 bp, Artificial Sequence
  Synthetic
gcaaccgtataagcgcatccataacagaatgtgacgttaaggcgccttgatcataccgccccccacgagcatgaa

SEQ ID NO: 158335 - DNA, 75 bp, Artificial Sequence
  Synthetic
agaatgtgacgttaaggcgccttgatcataccgccccccacgagcatgaaactggtcgcgtggtagacgatcata

SEQ ID NO: 158336 - DNA, 75 bp, Artificial Sequence
  Synthetic
tcgtgtgttgtcatataattcacaaatgtctcagtatattccggtaggtgctctataaggttcccgaaggacgaa

SEQ ID NO: 158337 - DNA, 75 bp, Artificial Sequence
  Synthetic
atgtctcagtatattccggtaggtgctctataaggttcccgaaggacgaaacttgaggttcgtggacactattag

SEQ ID NO: 158338 - DNA, 75 bp, Artificial Sequence
  Synthetic
taataccgcacactcgaacgcggagtacgctctatctccaacatacattctcccggcggactgtagacatgttac

SEQ ID NO: 158339 - DNA, 75 bp, Artificial Sequence
  Synthetic
tacgctctatctccaacatacattctcccggcggactgtagacatgttaccgttgtgttcataaacgtacgggaa

SEQ ID NO: 158340 - DNA, 75 bp, Artificial Sequence
  Synthetic
cgcgtgcagctacgggcctatctaacacaagccgttcctgcagagtacgataccatggcccgaaaacaatccctg

SEQ ID NO: 158341 - DNA, 75 bp, Artificial Sequence
  Synthetic
cacaagccgttcctgcagagtacgataccatggcccgaaaacaatccctggagagttattgccccttgcccttcc

SEQ ID NO: 158342 - DNA, 75 bp, Artificial Sequence
  Synthetic
aaaagtgtctgtctgtctgtgcgggcgggcgacgggcgggctggtcggaccccccccgaaaataaccccccccgg

SEQ ID NO: 158343 - DNA, 75 bp, Artificial Sequence
  Synthetic
acttgaaagtttgtatcgtactgcaacggtgcatcatttttggcaatctgtacctcggggtgtatagactcattg

SEQ ID NO: 158344 - DNA, 75 bp, Artificial Sequence
  Synthetic
acggtgcatcatttttggcaatctgtacctcggggtgtatagactcattgcgtattatttctgtacgtgtacatt

SEQ ID NO: 158345 - DNA, 75 bp, Artificial Sequence
  Synthetic
cgcctcggcagcagccgtctccagggaatccaaaaccttggccatgcgcgttagttgttcttcgaggggctttaa

SEQ ID NO: 158346 - DNA, 75 bp, Artificial Sequence
  Synthetic
gacccgcgtccccctgtcgccccgtgaataccggcagtacgtgctgccgggttttgacggttgcaaggacctcgc

SEQ ID NO: 158347 - DNA, 75 bp, Artificial Sequence
  Synthetic
gaatccaaaaccttggccatgcgcgttagttgttcttcgaggggctttaaacgacgatctatttccgttggtaac

SEQ ID NO: 158348 - DNA, 75 bp, Artificial Sequence
  Synthetic
ctaatgcggcaacggccgccgcattttttaacgttaacgtatttttttccaaatcgggattcatacgccctctta

SEQ ID NO: 158349 - DNA, 75 bp, Artificial Sequence
  Synthetic
ttttaacgttaacgtatttttttccaaatcgggattcatacgccctcttaactcaaacgcgggagccgtccagta

SEQ ID NO: 158350 - DNA, 75 bp, Artificial Sequence
  Synthetic
aagttcttagtggtagacaaaaatatcccacatttattcggaaacgagatagatccgaacccatatctcgccgtc

SEQ ID NO: 158351 - DNA, 75 bp, Artificial Sequence
  Synthetic
tcccacatttattcggaaacgagatagatccgaacccatatctcgccgtcatggtgtctgcagcaaacaaagtca

SEQ ID NO: 158352 - DNA, 75 bp, Artificial Sequence
  Synthetic
gctttaaaagctgttttcttacccatgggaaaacatcccggttatactttgtaaaattccaccacaagcacctaa

SEQ ID NO: 158353 - DNA, 75 bp, Artificial Sequence
  Synthetic
tgggaaaacatcccggttatactttgtaaaattccaccacaagcacctaaagaaggccttctaaggggtaaatcc

SEQ ID NO: 158354 - DNA, 75 bp, Artificial Sequence
  Synthetic
actttgttaaagcggaacgatggcatgatttcgcacgctttttcgcaagagaacatacgtgaattttctttttgc

SEQ ID NO: 158355 - DNA, 75 bp, Artificial Sequence
  Synthetic
tgatttcgcacgctttttcgcaagagaacatacgtgaattttctttttgcatagacgtcttcgctctctaacgga

SEQ ID NO: 158356 - DNA, 75 bp, Artificial Sequence
  Synthetic
acattctccaaatgcgacgctagcataacaaggtttccatgaatcacctttgggggtaaccgagttacctgtaac

SEQ ID NO: 158357 - DNA, 75 bp, Artificial Sequence
  Synthetic
taacaaggtttccatgaatcacctttgggggtaaccgagttacctgtaacaggttcagaccccgttgagatacaa

SEQ ID NO: 158358 - DNA, 75 bp, Artificial Sequence
  Synthetic
ttcatcagatcccgtgggtgtggtttcctttattaaagccatggtatccctcagctggcgcataccctcgcaaaa

SEQ ID NO: 158359 - DNA, 75 bp, Artificial Sequence
  Synthetic
cgtccagcccgcgcagcccgtccagcccgcgcagcccgcgcagaccgtccagcccgcgcagcccgcgcagcccgt

SEQ ID NO: 158360 - DNA, 75 bp, Artificial Sequence
  Synthetic
tcagctggcgcataccctcgcaaaactggtgatacttagtaggggtatgtatattagcgctaaaacggcaagatt

SEQ ID NO: 158361 - DNA, 75 bp, Artificial Sequence
  Synthetic
gcgcagcccgcgcagaccgtccagcccgcgcagcccgcgcagcccgtccagcccgcgcagcccgcgcagcccgcg

SEQ ID NO: 158362 - DNA, 75 bp, Artificial Sequence
  Synthetic
ctttccggcaccactggattccgtttgtataatacaaacacaatcggggcgtcggcgtcccaaatttacttcaaa

SEQ ID NO: 158363 - DNA, 75 bp, Artificial Sequence
  Synthetic
tgtataatacaaacacaatcggggcgtcggcgtcccaaatttacttcaaacgacattgatatgcgtacagccctt

SEQ ID NO: 158364 - DNA, 75 bp, Artificial Sequence
  Synthetic
cgggcgggcgacgggcgggctggtcggaccccccccgaaaataacccccccccggtttctgggcgcccggcggac

SEQ ID NO: 158365 - DNA, 75 bp, Artificial Sequence
  Synthetic
ggcccagccctctcgcggccccctcgagagagaaaaaaaaaaaagcgaccccacctccccgcgcgtttgcggggc

SEQ ID NO: 158366 - DNA, 75 bp, Artificial Sequence
  Synthetic
acaggagttttgccagcctcgggttgaacgcgtccgcgaaacctcgacgtacgttatcaatatcctttttgagta

SEQ ID NO: 158367 - DNA, 75 bp, Artificial Sequence
  Synthetic
gaacgcgtccgcgaaacctcgacgtacgttatcaatatcctttttgagtacatcgtaaaaacgagtgtggcaacg

SEQ ID NO: 158368 - DNA, 75 bp, Artificial Sequence
  Synthetic
cgaattcgactagcggacatatttgaagttccgtcccagaagataacctaagacgcgtttgtctacaataaacat

SEQ ID NO: 158369 - DNA, 75 bp, Artificial Sequence
  Synthetic
aagttccgtcccagaagataacctaagacgcgtttgtctacaataaacatgtcaacggataaaaccgatgtaaaa

SEQ ID NO: 158370 - DNA, 75 bp, Artificial Sequence
  Synthetic
acggggcgtatggaattggaaaaacaaccgccgccgaagaatttttacaccactttgcaataacaccaaaccgga

SEQ ID NO: 158371 - DNA, 75 bp, Artificial Sequence
  Synthetic
aaccgccgccgaagaatttttacaccactttgcaataacaccaaaccggatcttactcattggggagcccctgtc

SEQ ID NO: 158372 - DNA, 75 bp, Artificial Sequence
  Synthetic
gacgccatttgcggaatttacggaacacaaactcgccgtcttaatggagacgtttcgcctgaagacgcacaacgc

SEQ ID NO: 158373 - DNA, 75 bp, Artificial Sequence
  Synthetic
cacaaactcgccgtcttaatggagacgtttcgcctgaagacgcacaacgcctcacggctcattttcagagcctgt

SEQ ID NO: 158374 - DNA, 75 bp, Artificial Sequence
  Synthetic
tgcgaaaatctcggcattgatggacacaagtacatcggatctcgtacaagtaaataaggagccgtataaaattat

SEQ ID NO: 158375 - DNA, 75 bp, Artificial Sequence
  Synthetic
acaagtacatcggatctcgtacaagtaaataaggagccgtataaaattatgttatccgaccgacacccaatcgcc

SEQ ID NO: 158376 - DNA, 75 bp, Artificial Sequence
  Synthetic
gatacttagtgggagatatgtccccagcggcgcttcctgggttattgtttacgcttcccgctgaaccccccggga

SEQ ID NO: 158377 - DNA, 75 bp, Artificial Sequence
  Synthetic
agcggcgcttcctgggttattgtttacgcttcccgctgaaccccccgggaccaacttggtagtttgtaccgtttc

SEQ ID NO: 158378 - DNA, 75 bp, Artificial Sequence
  Synthetic
agcaaacgggccagaccgggagaaacggttaatctgccgtttgttatggttctgagaaatgtatatataatgctt

SEQ ID NO: 158379 - DNA, 75 bp, Artificial Sequence
  Synthetic
ctaacaactggcacgcgggctggaacacactgtcattttgtaatgatgtatttaaacagaaattacaaaaatccg

SEQ ID NO: 158380 - DNA, 75 bp, Artificial Sequence
  Synthetic
cacactgtcattttgtaatgatgtatttaaacagaaattacaaaaatccgagtgtataaaactacgcgaagtacc

SEQ ID NO: 158381 - DNA, 75 bp, Artificial Sequence
  Synthetic
tttaaacagaaattacaaaaatccgagtgtataaaactacgcgaagtacctgggattgaagacacgttattcgcc

SEQ ID NO: 158382 - DNA, 75 bp, Artificial Sequence
  Synthetic
gagagtttggaaatattctgccgttatgggcatggggaatggagaccctttcaaactgcttacgaagcatgtctc

SEQ ID NO: 158383 - DNA, 75 bp, Artificial Sequence
  Synthetic
atgggcatggggaatggagaccctttcaaactgcttacgaagcatgtctccgttcgtattatcgttagaacagac

SEQ ID NO: 158384 - DNA, 75 bp, Artificial Sequence
  Synthetic
aaaactctgctaccccagatgaccccggcaaacatgtcctccggtgcatggaatatattgaaagagcttgttaat

SEQ ID NO: 158385 - DNA, 75 bp, Artificial Sequence
  Synthetic
gaatatattgaaagagcttgttaatgccgttcaggacaacacttcctaaatatacctagtatttacgtatgtacc

SEQ ID NO: 158386 - DNA, 75 bp, Artificial Sequence
  Synthetic
actcgcgtgtacgtgtttttcttttttatatatgcgtcatttattaccacatcctttaatcccgcctttatctcc

SEQ ID NO: 158387 - DNA, 75 bp, Artificial Sequence
  Synthetic
ttatatatgcgtcatttattaccacatcctttaatcccgcctttatctccctaaaacggagtggtaatattaaaa

SEQ ID NO: 158388 - DNA, 75 bp, Artificial Sequence
  Synthetic
gaggggtaaaggcacgctgtgtgcataacgttgcggtgatattgtagcgcaagtaacagcgactatgtttgcgct

SEQ ID NO: 158389 - DNA, 75 bp, Artificial Sequence
  Synthetic
taacgttgcggtgatattgtagcgcaagtaacagcgactatgtttgcgctagttttagcggtggtaattcttcct

SEQ ID NO: 158390 - DNA, 75 bp, Artificial Sequence
  Synthetic
acgtaacaccaacccctgcgactcgctctatcggacatatgtctgctcttctacgagaatattccgaccgtaata

SEQ ID NO: 158391 - DNA, 75 bp, Artificial Sequence
  Synthetic
ctctatcggacatatgtctgctcttctacgagaatattccgaccgtaatatgtctctgaaattagaagcctttta

SEQ ID NO: 158392 - DNA, 75 bp, Artificial Sequence
  Synthetic
attaaatcacttcactggggaaatgatagaaaacacgttttcttggttattgttaaggttaaccctacaacacac

SEQ ID NO: 158393 - DNA, 75 bp, Artificial Sequence
  Synthetic
atagaaaacacgttttcttggttattgttaaggttaaccctacaacacacgaaggagacgtcgggctggttatat

SEQ ID NO: 158394 - DNA, 75 bp, Artificial Sequence
  Synthetic
ccatttcaaagcagaacatcgagcaccgtttcctgctggacgttttggatttcttagtcaccctgtgacacccga

SEQ ID NO: 158395 - DNA, 75 bp, Artificial Sequence
  Synthetic
ccgtttcctgctggacgttttggatttcttagtcaccctgtgacacccgacgtgagcttctttgacagttcgttt

SEQ ID NO: 158396 - DNA, 75 bp, Artificial Sequence
  Synthetic
ttgttgcgtttactacgttcccaccaaacccccttgtatggcatttggaaagagctgagaccgcagcaactgcag

SEQ ID NO: 158397 - DNA, 75 bp, Artificial Sequence
  Synthetic
aaacccccttgtatggcatttggaaagagctgagaccgcagcaactgcagaaaggccgtttggggtaagtctttt

SEQ ID NO: 158398 - DNA, 75 bp, Artificial Sequence
  Synthetic
aatactattctggaacataaagcgcattttgctacatgggatgcccttgcccgacatacttttttttctgccgaa

SEQ ID NO: 158399 - DNA, 75 bp, Artificial Sequence
  Synthetic
attttgctacatgggatgcccttgcccgacatacttttttttctgccgaagcaattatcaccaactcaacgttga

SEQ ID NO: 158400 - DNA, 75 bp, Artificial Sequence
  Synthetic
ggtatggccaattcgatactgggccaccggttcggtgcttctcacaagcgactcgggtcgtgtggaagtaaatat

SEQ ID NO: 158401 - DNA, 75 bp, Artificial Sequence
  Synthetic
accggttcggtgcttctcacaagcgactcgggtcgtgtggaagtaaatattggtgtaggatttatgagctcgctc

SEQ ID NO: 158402 - DNA, 75 bp, Artificial Sequence
  Synthetic
tagaattaattgttgtaccacatacagtaaaactgaacgcggttacaagcgacaccacatggttccagctaaatc

SEQ ID NO: 158403 - DNA, 75 bp, Artificial Sequence
  Synthetic
agtaaaactgaacgcggttacaagcgacaccacatggttccagctaaatccaccgggtccggatccggggccatc

SEQ ID NO: 158404 - DNA, 75 bp, Artificial Sequence
  Synthetic
gggttggatatgaatttttcaaagcatgctacggtcgatatatgcgcatatcccgaagagagtttggattaccgc

SEQ ID NO: 158405 - DNA, 75 bp, Artificial Sequence
  Synthetic
atgctacggtcgatatatgcgcatatcccgaagagagtttggattaccgctatcatttatccatggcccacacgg

SEQ ID NO: 158406 - DNA, 75 bp, Artificial Sequence
  Synthetic
ggatcaacatgacataaacgaggaaagctattaccatatcgccgcaagaatagccacatcaatttttgcgttgtc

SEQ ID NO: 158407 - DNA, 75 bp, Artificial Sequence
  Synthetic
agctattaccatatcgccgcaagaatagccacatcaatttttgcgttgtcggaaatgggccgtaccacagaatat

SEQ ID NO: 158408 - DNA, 75 bp, Artificial Sequence
  Synthetic
ttcagtatcaattaaaattccttaattacattttaatgcggataggagcaggagctcatcccaacactatatccg

SEQ ID NO: 158409 - DNA, 75 bp, Artificial Sequence
  Synthetic
ttacattttaatgcggataggagcaggagctcatcccaacactatatccggaacctcggatctgatctttgccga

SEQ ID NO: 158410 - DNA, 75 bp, Artificial Sequence
  Synthetic
tcacttctttttggtcaggtaaaacccgcaaatgtcgattattttatttcatatgatgaagcccgtgatcaacta

SEQ ID NO: 158411 - DNA, 75 bp, Artificial Sequence
  Synthetic
ccgcaaatgtcgattattttatttcatatgatgaagcccgtgatcaactaaagaccgcatacgcgctttcccgtg

SEQ ID NO: 158412 - DNA, 75 bp, Artificial Sequence
  Synthetic
tctcgccaggcgtgttataatgagcatatacaaggggctgcttgtgaagcaaaatttaaatgctacagagaggca

SEQ ID NO: 158413 - DNA, 75 bp, Artificial Sequence
  Synthetic
atatacaaggggctgcttgtgaagcaaaatttaaatgctacagagaggcaggctttattttttgcctcaatgatt

SEQ ID NO: 158414 - DNA, 75 bp, Artificial Sequence
  Synthetic
aaaattcatctcgggtattagacggtcgcacaactttgcttttaatgacatccatgtgtacggcagctcacgcca

SEQ ID NO: 158415 - DNA, 75 bp, Artificial Sequence
  Synthetic
tcgcacaactttgcttttaatgacatccatgtgtacggcagctcacgccacgcaagcagcacttaacatacaaga

SEQ ID NO: 158416 - DNA, 75 bp, Artificial Sequence
  Synthetic
aaacacatgtttacaataccaaacgtatacagtccttgtatgggttcccttcgtacagacctcacggaagagatt

SEQ ID NO: 158417 - DNA, 75 bp, Artificial Sequence
  Synthetic
tatacagtccttgtatgggttcccttcgtacagacctcacggaagagattcatgttatgaatctcctgtcggcaa

SEQ ID NO: 158418 - DNA, 75 bp, Artificial Sequence
  Synthetic
ggtattgcatacccaactagacgaatctgaaatattcgacgcggcatttaaaaccatgatgatttttaccacatg

SEQ ID NO: 158419 - DNA, 75 bp, Artificial Sequence
  Synthetic
tctgaaatattcgacgcggcatttaaaaccatgatgatttttaccacatggactgccaaagatttgcatatactc

SEQ ID NO: 158420 - DNA, 75 bp, Artificial Sequence
  Synthetic
cgtgtcaagatgcagccgcgcgtaacggagaatatgtgctcattcttccagctgtccagggacacagttatgtga

SEQ ID NO: 158421 - DNA, 75 bp, Artificial Sequence
  Synthetic
gctgtccagggacacagttatgtgattacacgaaacaaaccccaaaggggtttggtatattccctggcagatgtg

SEQ ID NO: 158422 - DNA, 75 bp, Artificial Sequence
  Synthetic
gatgtatataaccccatatccgttgtttatttaagcaaggatacttgcgtgtctgaacatggtgtcatagagacg

SEQ ID NO: 158423 - DNA, 75 bp, Artificial Sequence
  Synthetic
tttatttaagcaaggatacttgcgtgtctgaacatggtgtcatagagacggtcgcactgccccatccggacaatt

SEQ ID NO: 158424 - DNA, 75 bp, Artificial Sequence
  Synthetic
tgtttttcttaggtatctaaccacgggggcgattatggatataattattattgacagcaaagatacagaacgaca

SEQ ID NO: 158425 - DNA, 75 bp, Artificial Sequence
  Synthetic
ggggcgattatggatataattattattgacagcaaagatacagaacgacaactagccgctatgggaaactccaca

SEQ ID NO: 158426 - DNA, 75 bp, Artificial Sequence
  Synthetic
gggtaatgcaagtcccccccgatggtcgccccgcaaacgcgcggggaggtggggtcgcttttttttttctctctc

SEQ ID NO: 158427 - DNA, 75 bp, Artificial Sequence
  Synthetic
acggggatgactctaaggctgtgttgttgtttccaaacggaactgtggtaacgcttctaggattcgaacgacgac

SEQ ID NO: 158428 - DNA, 75 bp, Artificial Sequence
  Synthetic
gttgtttccaaacggaactgtggtaacgcttctaggattcgaacgacgacaagccatacgaatgtcgggacaata

SEQ ID NO: 158429 - DNA, 75 bp, Artificial Sequence
  Synthetic
tttctggcggtagtggggtttggtattatcggatggatgttatgtggaaattcccgccttcgagaatataataaa

SEQ ID NO: 158430 - DNA, 75 bp, Artificial Sequence
  Synthetic
ttatcggatggatgttatgtggaaattcccgccttcgagaatataataaaatacctctgacataaaaaacatgta

SEQ ID NO: 158431 - DNA, 75 bp, Artificial Sequence
  Synthetic
tctctacaatactttattcgcgaataatacacactacctttgggtttttttcccgtccccaaatggtgtttggtg

SEQ ID NO: 158432 - DNA, 75 bp, Artificial Sequence
  Synthetic
aatacacactacctttgggtttttttcccgtccccaaatggtgtttggtgcactctaccaaaaaatagagcgcct

SEQ ID NO: 158433 - DNA, 75 bp, Artificial Sequence
  Synthetic
tctgtctgtgcgggcgggcgacgggcgggctggtcggaccccccccgaaaataaccccccccggtttctgggcgc

SEQ ID NO: 158434 - DNA, 75 bp, Artificial Sequence
  Synthetic
gcccagccctctcgcggccccctcgagagagaaaaaaaaaaagcgaccccacctccccgcgcgtttgcggggcga

SEQ ID NO: 158435 - DNA, 75 bp, Artificial Sequence
  Synthetic
caaaatacggttcaaaggcattacccgatattgtattgtagtacagggcaatgggaattgatgatcccaataaac

SEQ ID NO: 158436 - DNA, 75 bp, Artificial Sequence
  Synthetic
cgatattgtattgtagtacagggcaatgggaattgatgatcccaataaacggcatagacgcacagcgccgttata

SEQ ID NO: 158437 - DNA, 75 bp, Artificial Sequence
  Synthetic
tctaagtaccgggatatctcatactcatgcctttccgtgacagaaacatcaaccggaacagtatccgataaacca

SEQ ID NO: 158438 - DNA, 75 bp, Artificial Sequence
  Synthetic
catgcctttccgtgacagaaacatcaaccggaacagtatccgataaaccaactcctgtttttgcaaggcgtaaaa

SEQ ID NO: 158439 - DNA, 75 bp, Artificial Sequence
  Synthetic
atgtgacgtttccttgtaacagggaagctgggggagtggtaagaacaacaaagtttcagccaacgtgccaataaa

SEQ ID NO: 158440 - DNA, 75 bp, Artificial Sequence
  Synthetic
agctgggggagtggtaagaacaacaaagtttcagccaacgtgccaataaagcccacttccctcaagaggctgttt

SEQ ID NO: 158441 - DNA, 75 bp, Artificial Sequence
  Synthetic
aatcttgagcaacttgatccgtgtcatcatcactgggtaacgcgttaacataactacgcgttaaatcttcaataa

SEQ ID NO: 158442 - DNA, 75 bp, Artificial Sequence
  Synthetic
atcatcactgggtaacgcgttaacataactacgcgttaaatcttcaataacggcataacaattaaacgcttccca

SEQ ID NO: 158443 - DNA, 75 bp, Artificial Sequence
  Synthetic
acgaaccgttgacaggacgtcagatcacgtccgtaagcatgcccgaaaaatggaagttccccccgttcgccatat

SEQ ID NO: 158444 - DNA, 75 bp, Artificial Sequence
  Synthetic
tggaagttccccccgttcgccatataccgcaacaactgcagtatatatcgtctcacgggcttcattaagttcatc

SEQ ID NO: 158445 - DNA, 75 bp, Artificial Sequence
  Synthetic
gcccgcgcagcccgcgcagcccgcgcagcccgcgcagcccgcgcagcccgtccagcccgtccagcccgcgcagcc

SEQ ID NO: 158446 - DNA, 75 bp, Artificial Sequence
  Synthetic
ttaaatataacctcatccgcaaaaaaaaccgcacatgataacgcgcggatacaatgagtagtggctttatggcga

SEQ ID NO: 158447 - DNA, 75 bp, Artificial Sequence
  Synthetic
aaaccgcacatgataacgcgcggatacaatgagtagtggctttatggcgaggatcccaaatgtccattacccggg

SEQ ID NO: 158448 - DNA, 75 bp, Artificial Sequence
  Synthetic
acttagtgtaatatgatcggacttcttacgccgtctaggctgtttctcagaatacggttcacccgaaatcggcac

SEQ ID NO: 158449 - DNA, 75 bp, Artificial Sequence
  Synthetic
ttacgccgtctaggctgtttctcagaatacggttcacccgaaatcggcacatcatctgcttttacgtcttccgta

SEQ ID NO: 158450 - DNA, 75 bp, Artificial Sequence
  Synthetic
caattatacttgttttttcatcgtcgttacttccgttaagcgcgtctcgtatctcgggcgtcccgtcgaataatc

SEQ ID NO: 158451 - DNA, 75 bp, Artificial Sequence
  Synthetic
gttacttccgttaagcgcgtctcgtatctcgggcgtcccgtcgaataatccactcactagctcctgcaaaccttc

SEQ ID NO: 158452 - DNA, 75 bp, Artificial Sequence
  Synthetic
accaatgaaaaactggcttcgtttggtacgtacataaagccatttgtggtattaatggcggtgggtgttggaaac

SEQ ID NO: 158453 - DNA, 75 bp, Artificial Sequence
  Synthetic
gtacgtacataaagccatttgtggtattaatggcggtgggtgttggaaacaattttagcttattctcgcgcgtaa

SEQ ID NO: 158454 - DNA, 75 bp, Artificial Sequence
  Synthetic
atgcgtcacggggagggacacgagataatctgcgagcgtagggtcctccacttcaacatcaaatgttccgcaaag

SEQ ID NO: 158455 - DNA, 75 bp, Artificial Sequence
  Synthetic
taatctgcgagcgtagggtcctccacttcaacatcaaatgttccgcaaaggtcgcgatccaccgcccccgatccc

SEQ ID NO: 158456 - DNA, 75 bp, Artificial Sequence
  Synthetic
aaaacacgcagttattattggatgataccgcccatgtcttcccggtgcgattgagctcacttcgaacgtaactgg

SEQ ID NO: 158457 - DNA, 75 bp, Artificial Sequence
  Synthetic
taccgcccatgtcttcccggtgcgattgagctcacttcgaacgtaactggcaacagatctgtcaccgggtccgac

SEQ ID NO: 158458 - DNA, 75 bp, Artificial Sequence
  Synthetic
gcgatctcgcctccatgtttgcggggtatggaaattaagcatcccccgcatataaaatacgccctggtagcacgc

SEQ ID NO: 158459 - DNA, 75 bp, Artificial Sequence
  Synthetic
gtatggaaattaagcatcccccgcatataaaatacgccctggtagcacgctcgttaaaataaaacgttacgccgt

SEQ ID NO: 158460 - DNA, 75 bp, Artificial Sequence
  Synthetic
aaattccatattaaagcgtttatcggaacattaacctcgaacttgccgtcccgtgatcgtgtgatcgccaacctt

SEQ ID NO: 158461 - DNA, 75 bp, Artificial Sequence
  Synthetic
gaacattaacctcgaacttgccgtcccgtgatcgtgtgatcgccaaccttaggtccacaccgaatatgagaaata

SEQ ID NO: 158462 - DNA, 75 bp, Artificial Sequence
  Synthetic
caccgtggtatcattaacgtcatatgaaaagatccaatcaatccaatcaaccacacctcctaccgtttagcacgt

SEQ ID NO: 158463 - DNA, 75 bp, Artificial Sequence
  Synthetic
gaaaagatccaatcaatccaatcaaccacacctcctaccgtttagcacgtcagctatgtgacatgctccaaacat

SEQ ID NO: 158464 - DNA, 75 bp, Artificial Sequence
  Synthetic
taacagtctgtcaggcggggtatattctacataatacaaggatcggctttaactttgtcaacatttttactttgg

SEQ ID NO: 158465 - DNA, 75 bp, Artificial Sequence
  Synthetic
tctacataatacaaggatcggctttaactttgtcaacatttttactttggactataaactgcgactgaacgttat

SEQ ID NO: 158466 - DNA, 75 bp, Artificial Sequence
  Synthetic
gaacagacaaaggacttgcttagcgttatggttaaccagcaccccgaagaggacgcaaaagtgtgtaaatccagt

SEQ ID NO: 158467 - DNA, 75 bp, Artificial Sequence
  Synthetic
ttatggttaaccagcaccccgaagaggacgcaaaagtgtgtaaatccagtgataattcaccgctttataacacca

SEQ ID NO: 158468 - DNA, 75 bp, Artificial Sequence
  Synthetic
tacggacttactattaagctctgcatgtacccgcacatctaccgtaaacaggtcggcgtttacgcaacactccgt

SEQ ID NO: 158469 - DNA, 75 bp, Artificial Sequence
  Synthetic
tgtacccgcacatctaccgtaaacaggtcggcgtttacgcaacactccgtgttttatattatatccacggtgttg

SEQ ID NO: 158470 - DNA, 75 bp, Artificial Sequence
  Synthetic
tttttttttactataaagcgacacgctgtatgctcttattcacagccgggttacttctgacgattctacatcact

SEQ ID NO: 158471 - DNA, 75 bp, Artificial Sequence
  Synthetic
ctgtatgctcttattcacagccgggttacttctgacgattctacatcactttcgacttattattatgttattgtg

SEQ ID NO: 158472 - DNA, 75 bp, Artificial Sequence
  Synthetic
ctgctacccttatctacatcccagcaactgctgcttggaattattgttgtgactcgaacaatgctattttgtatt

SEQ ID NO: 158473 - DNA, 75 bp, Artificial Sequence
  Synthetic
aactgctgcttggaattattgttgtgactcgaacaatgctattttgtattacggcgtattatactctttttatag

SEQ ID NO: 158474 - DNA, 75 bp, Artificial Sequence
  Synthetic
cggacacttgcaaagtgaggttatttttccagatagtgtttcaaaaatacttcctgtgtcgtggggtccaagtcc

SEQ ID NO: 158475 - DNA, 75 bp, Artificial Sequence
  Synthetic
ttcctgtgtcgtggggtccaagtccagccgtgttactggtaatggcggcagttatttacgctatggactgtttgg

SEQ ID NO: 158476 - DNA, 75 bp, Artificial Sequence
  Synthetic
tggacacggtatcctttattgggccaagggtgtgggtccgtgttatgttaaaaacatctatttcgttttagtcca

SEQ ID NO: 158477 - DNA, 75 bp, Artificial Sequence
  Synthetic
cagtctaaaaataatgttgggtatttataattaccgcccccgtgttacttggaaacacccatacatatgttccac

SEQ ID NO: 158478 - DNA, 75 bp, Artificial Sequence
  Synthetic
tataattaccgcccccgtgttacttggaaacacccatacatatgttccactctacatcaaacttctcgcagtttt

SEQ ID NO: 158479 - DNA, 75 bp, Artificial Sequence
  Synthetic
ggaaacacccatacatatgttccactctacatcaaacttctcgcagttttcttgttcccgcacacgtttacacgt

SEQ ID NO: 158480 - DNA, 75 bp, Artificial Sequence
  Synthetic
acaaaatgacaacggtttcatgtcccgctaacgtgattactacaacggaatctgatcgtattgctgggttattta

SEQ ID NO: 158481 - DNA, 75 bp, Artificial Sequence
  Synthetic
cgctaacgtgattactacaacggaatctgatcgtattgctgggttatttaacatcccagcggggatcattccaac

SEQ ID NO: 158482 - DNA, 75 bp, Artificial Sequence
  Synthetic
gtgtgtgcacaccgttgcatttttgatttttttaaacaaatacgatcagatgataacagcctttactcggctcaa

SEQ ID NO: 158483 - DNA, 75 bp, Artificial Sequence
  Synthetic
atttttttaaacaaatacgatcagatgataacagcctttactcggctcaattcgatattcttttggggacatact

SEQ ID NO: 158484 - DNA, 75 bp, Artificial Sequence
  Synthetic
tctagaacttggactgtctgtcgcttgcatctgtactaaatttccggagctggcttacgtgcgagatggcgttat

SEQ ID NO: 158485 - DNA, 75 bp, Artificial Sequence
  Synthetic
tgcatctgtactaaatttccggagctggcttacgtgcgagatggcgttattcaatttgaggtacaacaacccatg

SEQ ID NO: 158486 - DNA, 75 bp, Artificial Sequence
  Synthetic
tcgatcagcctgttcataattatatggttaagcggatacacaagcgttcgttaagcgctgcgtttgcaattgcat

SEQ ID NO: 158487 - DNA, 75 bp, Artificial Sequence
  Synthetic
ggttaagcggatacacaagcgttcgttaagcgctgcgtttgcaattgcatcggaagcgttgagtttgttaagtaa

SEQ ID NO: 158488 - DNA, 75 bp, Artificial Sequence
  Synthetic
gactcatcgttacgtataagagctatccaacagatggctcgtaatttacgcaccgttttggactcatttgaacga

SEQ ID NO: 158489 - DNA, 75 bp, Artificial Sequence
  Synthetic
tccaacagatggctcgtaatttacgcaccgttttggactcatttgaacgaggcactgccgatcaacttcttggtg

SEQ ID NO: 158490 - DNA, 75 bp, Artificial Sequence
  Synthetic
atcgctgctttcaccaattaataaattccaacccgagggacatctaaatcgtgttgcacgcgcggccctactttc

SEQ ID NO: 158491 - DNA, 75 bp, Artificial Sequence
  Synthetic
ttccaacccgagggacatctaaatcgtgttgcacgcgcggccctactttcggacctcaaacgtagagtctgtgcg

SEQ ID NO: 158492 - DNA, 75 bp, Artificial Sequence
  Synthetic
ccagggaacctaggctgatctctgcgtatctgtcggatatggtttcgtgcacccaaccatcggtgatggtatcac

SEQ ID NO: 158493 - DNA, 75 bp, Artificial Sequence
  Synthetic
gtatctgtcggatatggtttcgtgcacccaaccatcggtgatggtatcacgaataactcatacaaacactcgcgg

SEQ ID NO: 158494 - DNA, 75 bp, Artificial Sequence
  Synthetic
acaacagcaaccttaaaacggcaactattacagggaattttacaaattgacgacaccgccgctgacgtaccagta

SEQ ID NO: 158495 - DNA, 75 bp, Artificial Sequence
  Synthetic
tattacagggaattttacaaattgacgacaccgccgctgacgtaccagtaacatatggcgaaatggttctacagg

SEQ ID NO: 158496 - DNA, 75 bp, Artificial Sequence
  Synthetic
cccgcgcagcccgcgcagcccgcgcagcccgcgcagcccgcgcagaccgtccagcccgcgcagaccgtccagccc

SEQ ID NO: 158497 - DNA, 75 bp, Artificial Sequence
  Synthetic
gatgggaaaggccgtccgcggaatggatgatgtagcccgccatctccttgatataaccgaccctaacacgttaaa

SEQ ID NO: 158498 - DNA, 75 bp, Artificial Sequence
  Synthetic
gatgatgtagcccgccatctccttgatataaccgaccctaacacgttaaacataccgtctatacccccacaatcc

SEQ ID NO: 158499 - DNA, 75 bp, Artificial Sequence
  Synthetic
ttccggttaacgcccgtgttcctgcggatttagtgattgttggggataaacttgtattcttagaagcattagaac

SEQ ID NO: 158500 - DNA, 75 bp, Artificial Sequence
  Synthetic
ggatttagtgattgttggggataaacttgtattcttagaagcattagaacggcgggtctaccaagctacgcgcgt

SEQ ID NO: 158501 - DNA, 75 bp, Artificial Sequence
  Synthetic
gatattacgtttatcatgccaatgggagtgtttcaggcaaactccatggacagatatacacgacacgccggcgat

SEQ ID NO: 158502 - DNA, 75 bp, Artificial Sequence
  Synthetic
gagtgtttcaggcaaactccatggacagatatacacgacacgccggcgatttttcaactgtatccgaacaggatc

SEQ ID NO: 158503 - DNA, 75 bp, Artificial Sequence
  Synthetic
ttttttttataataaagatgggatattaacacagttgactcttcgtgatgcaatgggtaccatctgccacagttc

SEQ ID NO: 158504 - DNA, 75 bp, Artificial Sequence
  Synthetic
ttaacacagttgactcttcgtgatgcaatgggtaccatctgccacagttcattgcttgatgtcgaggccacactt

SEQ ID NO: 158505 - DNA, 75 bp, Artificial Sequence
  Synthetic
atcgtcagtgttattttggtgtatacgtggccgagggtacagaggacacattggatgttcaaatggggaggttta

SEQ ID NO: 158506 - DNA, 75 bp, Artificial Sequence
  Synthetic
cgtggccgagggtacagaggacacattggatgttcaaatggggaggtttatggaaacgtgggcagatatgatgcc

SEQ ID NO: 158507 - DNA, 75 bp, Artificial Sequence
  Synthetic
catttaacaattctacagtttatagctccgagcaacccgcgtctaaggtttgaattaaaccccgcctttgatttt

SEQ ID NO: 158508 - DNA, 75 bp, Artificial Sequence
  Synthetic
ctccgagcaacccgcgtctaaggtttgaattaaaccccgcctttgatttttttgttgcaccgggggacgtagacc

SEQ ID NO: 158509 - DNA, 75 bp, Artificial Sequence
  Synthetic
agccatgccaaccgttaacgcaacattacggattatcaacggaaacattcccgtgcctctatgtcccatttcatt

SEQ ID NO: 158510 - DNA, 75 bp, Artificial Sequence
  Synthetic
ttacggattatcaacggaaacattcccgtgcctctatgtcccatttcatttcgagactgtcgcggaacccaactc

SEQ ID NO: 158511 - DNA, 75 bp, Artificial Sequence
  Synthetic
cggcaaccattaaagccgtaaaggatacatttgaagaccgcgcatacccaactattttctacatgctagaggctg

SEQ ID NO: 158512 - DNA, 75 bp, Artificial Sequence
  Synthetic
tacatttgaagaccgcgcatacccaactattttctacatgctagaggctgttattcatggaaacgaaagaaactt

SEQ ID NO: 158513 - DNA, 75 bp, Artificial Sequence
  Synthetic
cagtgtattcgcgggtattgggagcaatcccacagggtggcatttgtaaataactttcacatgttaatgtacata

SEQ ID NO: 158514 - DNA, 75 bp, Artificial Sequence
  Synthetic
aatcccacagggtggcatttgtaaataactttcacatgttaatgtacataactacatatctcggaaacggtgagc

SEQ ID NO: 158515 - DNA, 75 bp, Artificial Sequence
  Synthetic
tcgggatttactgcagcatgtaagagcattacgccaaactataaccgattttacaatacaaggagagggccataa

SEQ ID NO: 158516 - DNA, 75 bp, Artificial Sequence
  Synthetic
gcattacgccaaactataaccgattttacaatacaaggagagggccataacggcgagacctcggaagcgctaaat

SEQ ID NO: 158517 - DNA, 75 bp, Artificial Sequence
  Synthetic
ttgcacctattctatgggattgtgatgcgttaatataccgtgatgaagccgcccgagaccgactccccgcaattc

SEQ ID NO: 158518 - DNA, 75 bp, Artificial Sequence
  Synthetic
tgcgttaatataccgtgatgaagccgcccgagaccgactccccgcaattcgtgtaagcgggcgaaacggatacca

SEQ ID NO: 158519 - DNA, 75 bp, Artificial Sequence
  Synthetic
gggcataacttccaacgacgcgataatgtgttaatccacgggagacccgttcggggagacacgggtcagggtatt

SEQ ID NO: 158520 - DNA, 75 bp, Artificial Sequence
  Synthetic
atgtgttaatccacgggagacccgttcggggagacacgggtcagggtattcccattaccccacaccatgaccgtg

SEQ ID NO: 158521 - DNA, 75 bp, Artificial Sequence
  Synthetic
ctactatattgtcattcctgcattttcccgcggttcctgttgtacaatgggcgtgcgttatgatcgcctataccc

SEQ ID NO: 158522 - DNA, 75 bp, Artificial Sequence
  Synthetic
tcccgcggttcctgttgtacaatgggcgtgcgttatgatcgcctataccctgcgttacaggcagttatcgttccg

SEQ ID NO: 158523 - DNA, 75 bp, Artificial Sequence
  Synthetic
caactaccccagaagatccaagacaccctcttcacgcacaccaactcgttccgaactctcttaacgtttacttcc

SEQ ID NO: 158524 - DNA, 75 bp, Artificial Sequence
  Synthetic
ccctcttcacgcacaccaactcgttccgaactctcttaacgtttacttccataatgcacacctaaccgttgatgg

SEQ ID NO: 158525 - DNA, 75 bp, Artificial Sequence
  Synthetic
ttaatgggggatatggctgaacgaacgacggccattttagtatcaagcgcccccgatgcgggagccgccacggca

SEQ ID NO: 158526 - DNA, 75 bp, Artificial Sequence
  Synthetic
cgacggccattttagtatcaagcgcccccgatgcgggagccgccacggcaacaaccagaaatatgagaatatatg

SEQ ID NO: 158527 - DNA, 75 bp, Artificial Sequence
  Synthetic
cagcccgcgcagcccgtccagcccgcgcagcccgtccagcccgcgcagcccatagaaccgggcacacaaatagtg

SEQ ID NO: 158528 - DNA, 75 bp, Artificial Sequence
  Synthetic
tatgatggcatatcaggcgtacgatgaaaccattgcaacgggtacttttttttatcccgttccggtcaaccctct

SEQ ID NO: 158529 - DNA, 75 bp, Artificial Sequence
  Synthetic
gaaaccattgcaacgggtacttttttttatcccgttccggtcaaccctctgtttgcatgtccggaacatttggca

SEQ ID NO: 158530 - DNA, 75 bp, Artificial Sequence
  Synthetic
ggcgggttttggcaaaaatggtaccaccaatccctccttttctgggagccaaccaccacgcaactatacgccaac

SEQ ID NO: 158531 - DNA, 75 bp, Artificial Sequence
  Synthetic
accaatccctccttttctgggagccaaccaccacgcaactatacgccaacccgttgcctaccatgtaacgcatag

SEQ ID NO: 158532 - DNA, 75 bp, Artificial Sequence
  Synthetic
tattctcttcttggagggtattttaagtttacaccaatatctcttacacatcaactacgaacgggatttcacccc

SEQ ID NO: 158533 - DNA, 75 bp, Artificial Sequence
  Synthetic
agtttacaccaatatctcttacacatcaactacgaacgggatttcaccccgggattgcctttaccgtagtgcgcc

SEQ ID NO: 158534 - DNA, 75 bp, Artificial Sequence
  Synthetic
tttatatgccgagcgtgcttctgaatcgtactttgtcggacaaatccaagtacaccatcatgatgctattggggg

SEQ ID NO: 158535 - DNA, 75 bp, Artificial Sequence
  Synthetic
ggtaaactttaccctaacccaacccagagctcacgtggacctgggagtcgggtatacagctgtatgtgccacagc

SEQ ID NO: 158536 - DNA, 75 bp, Artificial Sequence
  Synthetic
atgggcaatactacccaaaatctttttttttcacgaggaggagtgccaatgttacatgataacgttaccgaatcg

SEQ ID NO: 158537 - DNA, 75 bp, Artificial Sequence
  Synthetic
ttttttcacgaggaggagtgccaatgttacatgataacgttaccgaatcgttgcgtcgtataacagcatcggggg

SEQ ID NO: 158538 - DNA, 75 bp, Artificial Sequence
  Synthetic
acccatcttcggcggactgcgtcctgctacatcggcaggaattgcacgagggcaagcctctgtgtgtgagtttgt

SEQ ID NO: 158539 - DNA, 75 bp, Artificial Sequence
  Synthetic
ggccatgccggtgtccactgacctacaatattttagaactgcatgcaatcctagaggtcgagcatctggaatgtt

SEQ ID NO: 158540 - DNA, 75 bp, Artificial Sequence
  Synthetic
atagaggctataatgtttgatcacacacaatcggatgttgcttatacagatcgagcaactcttaacccatgggca

SEQ ID NO: 158541 - DNA, 75 bp, Artificial Sequence
  Synthetic
cacaatcggatgttgcttatacagatcgagcaactcttaacccatgggcatcacaaaaacattcatacggtgaca

SEQ ID NO: 158542 - DNA, 75 bp, Artificial Sequence
  Synthetic
tacaggcgcttctcctatctacagcccatgctttaagttttttacaccagcggaggttaacactaattgtaatac

SEQ ID NO: 158543 - DNA, 75 bp, Artificial Sequence
  Synthetic
ccatgctttaagttttttacaccagcggaggttaacactaattgtaatacactggatcggcttctaatggaggca

SEQ ID NO: 158544 - DNA, 75 bp, Artificial Sequence
  Synthetic
ccgacactgaatatcaatttaaacgccctcccggttctaccgaaatgacacaggatccgtgtggcctttttcaag

SEQ ID NO: 158545 - DNA, 75 bp, Artificial Sequence
  Synthetic
ccctcccggttctaccgaaatgacacaggatccgtgtggcctttttcaagaagcatatccaccactatgctcaag

SEQ ID NO: 158546 - DNA, 75 bp, Artificial Sequence
  Synthetic
cacgcgggagaaaccggggcagatgaagttcacttagcccaatatctgattcgagacgcgtcgccccttagggga

SEQ ID NO: 158547 - DNA, 75 bp, Artificial Sequence
  Synthetic
aagttcacttagcccaatatctgattcgagacgcgtcgccccttaggggatgtcttcctcttccgcgataatttc

SEQ ID NO: 158548 - DNA, 75 bp, Artificial Sequence
  Synthetic
taaaagccctgtagagcgcattggcatcttacttgagatttggatacgctcggccgacttggtctgtttcacgct

SEQ ID NO: 158549 - DNA, 75 bp, Artificial Sequence
  Synthetic
atcttacttgagatttggatacgctcggccgacttggtctgtttcacgcttccttaaacaacatggctatgccat

SEQ ID NO: 158550 - DNA, 75 bp, Artificial Sequence
  Synthetic
agaactatccccggcggaaacatctgcattacagaaatgtgagggaaaaattattaccttctcaaccctgcgtca

SEQ ID NO: 158551 - DNA, 75 bp, Artificial Sequence
  Synthetic
gcattacagaaatgtgagggaaaaattattaccttctcaaccctgcgtcatcgagcttcactggtggatatagcg

SEQ ID NO: 158552 - DNA, 75 bp, Artificial Sequence
  Synthetic
ctccaccagacacgctctcgctgttagaggcataccgaatgcgattcgcggcagttataacacgggtcatcccgg

SEQ ID NO: 158553 - DNA, 75 bp, Artificial Sequence
  Synthetic
agaggcataccgaatgcgattcgcggcagttataacacgggtcatcccgggaaagttgttggcgcatgccattgg

SEQ ID NO: 158554 - DNA, 75 bp, Artificial Sequence
  Synthetic
tttattcaaaatacatcccccgttgatctttgtaatggcgattacatctgcttacttcctccggttttcgggtcc

SEQ ID NO: 158555 - DNA, 75 bp, Artificial Sequence
  Synthetic
atctttgtaatggcgattacatctgcttacttcctccggttttcgggtccgcagactcaattcgcttggactctg

SEQ ID NO: 158556 - DNA, 75 bp, Artificial Sequence
  Synthetic
aaccatcccccagaccttaatgcgagaaatcatcgccaaagtggttgcacgggccgttgagcgcacggccgcggg

SEQ ID NO: 158557 - DNA, 75 bp, Artificial Sequence
  Synthetic
gaaatcatcgccaaagtggttgcacgggccgttgagcgcacggccgcgggtgctcaaattttaccccacgaagtt

SEQ ID NO: 158558 - DNA, 75 bp, Artificial Sequence
  Synthetic
acaatggaaggcgttatgaactcgaaacaaatttacaacatcgggacggatcggatgcggctattcgcacattgg

SEQ ID NO: 158559 - DNA, 75 bp, Artificial Sequence
  Synthetic
aacaaatttacaacatcgggacggatcggatgcggctattcgcacattggttttaaatctaatgttttccataaa

SEQ ID NO: 158560 - DNA, 75 bp, Artificial Sequence
  Synthetic
ctgattccaactttgttagtccaaggagcacacgacggttatgtaaatttattgatacaaacggccaattgcgtt

SEQ ID NO: 158561 - DNA, 75 bp, Artificial Sequence
  Synthetic
gagcacacgacggttatgtaaatttattgatacaaacggccaattgcgttagagaaaccggccagttaattaata

SEQ ID NO: 158562 - DNA, 75 bp, Artificial Sequence
  Synthetic
cggccatcgccgatttcccatatatgaaactatttcatcttggatatcaacatcatctagactgggggatacctt

SEQ ID NO: 158563 - DNA, 75 bp, Artificial Sequence
  Synthetic
gaaactatttcatcttggatatcaacatcatctagactgggggataccttgggaactcgcgcaattttacgcgtc

SEQ ID NO: 158564 - DNA, 75 bp, Artificial Sequence
  Synthetic
ttcatccgggagaccgcacagccgtgattcaagtgtaaacaggtgttaataaaaacacaaccagtctagttacat

SEQ ID NO: 158565 - DNA, 75 bp, Artificial Sequence
  Synthetic
gattcaagtgtaaacaggtgttaataaaaacacaaccagtctagttacatttcacgcgtcttgtttttatttaat

SEQ ID NO: 158566 - DNA, 75 bp, Artificial Sequence
  Synthetic
catgaactgccaatatacacggacataattaatgcaaccatcagatcatctgacattgttcccgtggtaccttta

SEQ ID NO: 158567 - DNA, 75 bp, Artificial Sequence
  Synthetic
taattaatgcaaccatcagatcatctgacattgttcccgtggtacctttacccgtgtaagtttttgtgtctagat

SEQ ID NO: 158568 - DNA, 75 bp, Artificial Sequence
  Synthetic
tgtcaggttatccaactgtttacatagatactccacggggtctacacctaactttactgttagggatacaagctc

SEQ ID NO: 158569 - DNA, 75 bp, Artificial Sequence
  Synthetic
agatactccacggggtctacacctaactttactgttagggatacaagctcctgtgaggctattatatttccggag

SEQ ID NO: 158570 - DNA, 75 bp, Artificial Sequence
  Synthetic
cggcgggatcgggctttcgggaagcggccgaggtgggcgcgacggcgggatcgggctttcgggtagcggccgagg

SEQ ID NO: 158571 - DNA, 75 bp, Artificial Sequence
  Synthetic
cggccggcgttttttgtttctgtaataaaaaaaaagggtacgccacgctacatccgggaggtatggaatgataaa

SEQ ID NO: 158572 - DNA, 75 bp, Artificial Sequence
  Synthetic
taaaaaaaaagggtacgccacgctacatccgggaggtatggaatgataaaacagtaacactggagcggaagatag

SEQ ID NO: 158573 - DNA, 75 bp, Artificial Sequence
  Synthetic
aactgttgtgctatagccaacgatatggcaactgcagaatcctggctgctgtttccctctatagaaacgtgtacg

SEQ ID NO: 158574 - DNA, 75 bp, Artificial Sequence
  Synthetic
tggcaactgcagaatcctggctgctgtttccctctatagaaacgtgtacgtttgtaaatgtattggggtgtaaag

SEQ ID NO: 158575 - DNA, 75 bp, Artificial Sequence
  Synthetic
aacgcaacgccctatctcactggaagacgtgccagttaaagctctaagaaaaaagtgctccaatccaaatataat

SEQ ID NO: 158576 - DNA, 75 bp, Artificial Sequence
  Synthetic
gacgtgccagttaaagctctaagaaaaaagtgctccaatccaaatataatccaatccgacttataacgaccaaca

SEQ ID NO: 158577 - DNA, 75 bp, Artificial Sequence
  Synthetic
gtgtatttgaggtaaatgcagggtctacgtaaacgtacaacactgacgataatatagcacaattcgcaacggttg

SEQ ID NO: 158578 - DNA, 75 bp, Artificial Sequence
  Synthetic
tacgtaaacgtacaacactgacgataatatagcacaattcgcaacggttgacggccgatataaaataaacctctc

SEQ ID NO: 158579 - DNA, 75 bp, Artificial Sequence
  Synthetic
cggtcaaaccccacacccccagaattctgtttacgcccacctacaatttcctgcacgaaggagtcggccataaat

SEQ ID NO: 158580 - DNA, 75 bp, Artificial Sequence
  Synthetic
tctgtttacgcccacctacaatttcctgcacgaaggagtcggccataaataaatctgcagtgcgccgcatggctc

SEQ ID NO: 158581 - DNA, 75 bp, Artificial Sequence
  Synthetic
atttaatacataacacgaacaagctgtgacatcgctatgtgctaaaacacgcggcatgtgatcgtcgcatacata

SEQ ID NO: 158582 - DNA, 75 bp, Artificial Sequence
  Synthetic
gtgacatcgctatgtgctaaaacacgcggcatgtgatcgtcgcatacatatgtaacaacgtttaacaactgatcc

SEQ ID NO: 158583 - DNA, 75 bp, Artificial Sequence
  Synthetic
aacttgtacttgcttttccggtatttgttgatgaaacaaaaataattttacaattggtttgatttaaaaatccga

SEQ ID NO: 158584 - DNA, 75 bp, Artificial Sequence
  Synthetic
tgttgatgaaacaaaaataattttacaattggtttgatttaaaaatccgactatagtttgtacagcatcaggtcg

SEQ ID NO: 158585 - DNA, 75 bp, Artificial Sequence
  Synthetic
agaagattaaaatcttgacctcggataccctggaacgatagaaagatatatagttaccccaccaaagtttaaatg

SEQ ID NO: 158586 - DNA, 75 bp, Artificial Sequence
  Synthetic
tagttaccccaccaaagtttaaatgtatccttaaataccacgtacgtaaaaaatgtttgaatacgtacatatttc

SEQ ID NO: 158587 - DNA, 75 bp, Artificial Sequence
  Synthetic
ccggtgtataatggaagcccatttggcaaatgaaaccaaacatgcactttggcataatgatcacacaaaaggatt

SEQ ID NO: 158588 - DNA, 75 bp, Artificial Sequence
  Synthetic
gcaaatgaaaccaaacatgcactttggcataatgatcacacaaaaggattactacacgttgtgatacctaacgcg

SEQ ID NO: 158589 - DNA, 75 bp, Artificial Sequence
  Synthetic
ccgcattactgattttaaagaaacccggacaacgcttcaaggttgaagtacaaacaagatatcatgctacaggtc

SEQ ID NO: 158590 - DNA, 75 bp, Artificial Sequence
  Synthetic
cggacaacgcttcaaggttgaagtacaaacaagatatcatgctacaggtcaatgcgaaccgtggtgtcaagtttt

SEQ ID NO: 158591 - DNA, 75 bp, Artificial Sequence
  Synthetic
ttaacaaatctcttaataccaaaaacggaaccatttgtttcacacgttttttcggccacgcataattcaggggga

SEQ ID NO: 158592 - DNA, 75 bp, Artificial Sequence
  Synthetic
cggaaccatttgtttcacacgttttttcggccacgcataattcagggggattgattttatcattgcctgtttatc

SEQ ID NO: 158593 - DNA, 75 bp, Artificial Sequence
  Synthetic
atttaacgttatagcgatacgaataaatactggaaaccgcaagcaccgtgatatttgtattatgtatgcagaact

SEQ ID NO: 158594 - DNA, 75 bp, Artificial Sequence
  Synthetic
aatactggaaaccgcaagcaccgtgatatttgtattatgtatgcagaactaatcccaaacggaacgcgttatttt

SEQ ID NO: 158595 - DNA, 75 bp, Artificial Sequence
  Synthetic
gagggagaggcggaggagggagaggcggaggaggacgcggcggaggaggacgcgatcgacgacgagggagaggcg

SEQ ID NO: 158596 - DNA, 75 bp, Artificial Sequence
  Synthetic
tatgcaaacagctgattgcgtatatccgatgcacccctcgtcttgcatcgtctataaaaatatacgcagagcata

SEQ ID NO: 158597 - DNA, 75 bp, Artificial Sequence
  Synthetic
ccgatgcacccctcgtcttgcatcgtctataaaaatatacgcagagcatatggtggcagccatgggtgaatcaca

SEQ ID NO: 158598 - DNA, 75 bp, Artificial Sequence
  Synthetic
cccgtttcatccataatcgatcttgatcgacagttaacttctggaggtattgatgactcccctgctgaaacacgc

SEQ ID NO: 158599 - DNA, 75 bp, Artificial Sequence
  Synthetic
atcgacagttaacttctggaggtattgatgactcccctgctgaaacacgcatacaggaaaataatcgggacgtcc

SEQ ID NO: 158600 - DNA, 75 bp, Artificial Sequence
  Synthetic
cattgttaactccaggcaccccgtccgaccttctagttcccgcgttgcatctgggttgcttcaaagtgcaaaggg

SEQ ID NO: 158601 - DNA, 75 bp, Artificial Sequence
  Synthetic
cgaccttctagttcccgcgttgcatctgggttgcttcaaagtgcaaagggccacggagcgcaaacttccaacaca

SEQ ID NO: 158602 - DNA, 75 bp, Artificial Sequence
  Synthetic
atggcgtccttgagccgcctggacaagggcgatttacgggaaagaaaaacaattcgtccgccagcatcccacctt

SEQ ID NO: 158603 - DNA, 75 bp, Artificial Sequence
  Synthetic
agggcgatttacgggaaagaaaaacaattcgtccgccagcatcccacctttacaagacgttctattgtttacccc

SEQ ID NO: 158604 - DNA, 75 bp, Artificial Sequence
  Synthetic
atggaatggttcgacatctgttatgcccaattagttagcggggacactccagcagatttctggaaacggcgtccc

SEQ ID NO: 158605 - DNA, 75 bp, Artificial Sequence
  Synthetic
cccaattagttagcggggacactccagcagatttctggaaacggcgtcccctatcaattgtaccgcgacattacg

SEQ ID NO: 158606 - DNA, 75 bp, Artificial Sequence
  Synthetic
agtatcttacaacggatcctctgcctggggaggacgtattaccggaagtccaattttatatcactctgcacaggc

SEQ ID NO: 158607 - DNA, 75 bp, Artificial Sequence
  Synthetic
tggggaggacgtattaccggaagtccaattttatatcactctgcacaggctattattgatgctgcgtgtataaat

SEQ ID NO: 158608 - DNA, 75 bp, Artificial Sequence
  Synthetic
tacatgtgacagctcgccaagagctagtcgcgcgtttaccgtttttggctaacgtcctaaataatcaaaccccct

SEQ ID NO: 158609 - DNA, 75 bp, Artificial Sequence
  Synthetic
agtcgcgcgtttaccgtttttggctaacgtcctaaataatcaaacccccttacccgcctttaaaccaggcgccga

SEQ ID NO: 158610 - DNA, 75 bp, Artificial Sequence
  Synthetic
caagcgtgtgtgacatcgctaacccaaggtcttataacggagttacaaacgaacccgactctacaacaactcatg

SEQ ID NO: 158611 - DNA, 75 bp, Artificial Sequence
  Synthetic
aaggtcttataacggagttacaaacgaacccgactctacaacaactcatggaatatgatattgcagattcttccc

SEQ ID NO: 158612 - DNA, 75 bp, Artificial Sequence
  Synthetic
ccgcacaccagacctgattcagactatagtttcggtgttaacggaaatgtcaatggatgcgttttataacagctc

SEQ ID NO: 158613 - DNA, 75 bp, Artificial Sequence
  Synthetic
atagtttcggtgttaacggaaatgtcaatggatgcgttttataacagctccttgatgtatgcggttttggcgtat

SEQ ID NO: 158614 - DNA, 75 bp, Artificial Sequence
  Synthetic
aaggtggggggtatataccctaccttcacgcttccttcccatgctggttaggtaatcgttctatatatttatttg

SEQ ID NO: 158615 - DNA, 75 bp, Artificial Sequence
  Synthetic
tcacgcttccttcccatgctggttaggtaatcgttctatatatttatttgactattataattcaggaggggaaat

SEQ ID NO: 158616 - DNA, 75 bp, Artificial Sequence
  Synthetic
cccgtagccttagaaaaggttggtattggtaattccacacaactgaggggtaaatttatacgcagcgcggatatt

SEQ ID NO: 158617 - DNA, 75 bp, Artificial Sequence
  Synthetic
ttggtaattccacacaactgaggggtaaatttatacgcagcgcggatattgttgatattggaatttgttctaagt

SEQ ID NO: 158618 - DNA, 75 bp, Artificial Sequence
  Synthetic
catttgtctaggatttaaccagcaattacaatccattttagttttaccggggggatttgcggcatgtttttgtat

SEQ ID NO: 158619 - DNA, 75 bp, Artificial Sequence
  Synthetic
ttacaatccattttagttttaccggggggatttgcggcatgtttttgtattaccgataccctacaggcagcacta

SEQ ID NO: 158620 - DNA, 75 bp, Artificial Sequence
  Synthetic
tagacagattctgcttctctattcccaacccccataaataaattagtgtcactataaaaacataacaccagaatc

SEQ ID NO: 158621 - DNA, 75 bp, Artificial Sequence
  Synthetic
caacccccataaataaattagtgtcactataaaaacataacaccagaatctcttcatatttaattttacgtcatt

SEQ ID NO: 158622 - DNA, 75 bp, Artificial Sequence
  Synthetic
atataaaataaccgggtgggttgcattaaacccacaagtacccgggcggcaatccgctagactgtttttctgctc

SEQ ID NO: 158623 - DNA, 75 bp, Artificial Sequence
  Synthetic
ttaaacccacaagtacccgggcggcaatccgctagactgtttttctgctcatggaattacaacgcatatttccgc

SEQ ID NO: 158624 - DNA, 75 bp, Artificial Sequence
  Synthetic
caaattaacccccgaggcagttcagagactctgcgatgcattaacgctggatatgggattatggaagtccatcct

SEQ ID NO: 158625 - DNA, 75 bp, Artificial Sequence
  Synthetic
agactctgcgatgcattaacgctggatatgggattatggaagtccatcctgaccgatccccgggtgaaaataatg

SEQ ID NO: 158626 - DNA, 75 bp, Artificial Sequence
  Synthetic
ggatcgctccgtttatcccccttcaaacggatactactaatattgccgttgttgtagccacaatttacatcacgc

SEQ ID NO: 158627 - DNA, 75 bp, Artificial Sequence
  Synthetic
aacggatactactaatattgccgttgttgtagccacaatttacatcacgcgcccacgtcagatgaacttacctcc

SEQ ID NO: 158628 - DNA, 75 bp, Artificial Sequence
  Synthetic
tttaattacgaggtctcgtacgcaatgacggcgactttaagaatttatccggttgaaaacatagaccatgttttt

SEQ ID NO: 158629 - DNA, 75 bp, Artificial Sequence
  Synthetic
tgacggcgactttaagaatttatccggttgaaaacatagaccatgtttttggagcaacgtttaagaacccgatcg

SEQ ID NO: 158630 - DNA, 75 bp, Artificial Sequence
  Synthetic
ggatcctcgagcagatcccacccccgcagatcttacaccaacgccaaacttaagcgactacttacaacccccgcg

SEQ ID NO: 158631 - DNA, 75 bp, Artificial Sequence
  Synthetic
gcagatcttacaccaacgccaaacttaagcgactacttacaacccccgcggcttccgaaaaatccatacgcatgt

SEQ ID NO: 158632 - DNA, 75 bp, Artificial Sequence
  Synthetic
ggtcagacgaacgaaggcgtttatatgtactggctatggaacctaatttaatagggctatgtcccgccggatggc

SEQ ID NO: 158633 - DNA, 75 bp, Artificial Sequence
  Synthetic
tgtactggctatggaacctaatttaatagggctatgtcccgccggatggcatgctcggatacttggctctgtatt

SEQ ID NO: 158634 - DNA, 75 bp, Artificial Sequence
  Synthetic
ggatgtgatgaatgtaatcatagagttcacgtgggggcactgtatgcgttaccccatgtcacaaatcatgcggaa

SEQ ID NO: 158635 - DNA, 75 bp, Artificial Sequence
  Synthetic
ttcacgtgggggcactgtatgcgttaccccatgtcacaaatcatgcggaaggttgtgtgtgttgggctccgtgta

SEQ ID NO: 158636 - DNA, 75 bp, Artificial Sequence
  Synthetic
attaaaagtggaggtagacattggcgccacgcaggttctttttgtagatgtcaccacctgcattcgaattacgag

SEQ ID NO: 158637 - DNA, 75 bp, Artificial Sequence
  Synthetic
gccacgcaggttctttttgtagatgtcaccacctgcattcgaattacgagtactaaaaatcctcgcattaccgca

SEQ ID NO: 158638 - DNA, 75 bp, Artificial Sequence
  Synthetic
ccaacgccagtggtctctctgtaccagtaaattcatctgggtggcagctttatatgtttggagaaacattaagcc

SEQ ID NO: 158639 - DNA, 75 bp, Artificial Sequence
  Synthetic
agtaaattcatctgggtggcagctttatatgtttggagaaacattaagccgggctattattaacggctgtggtct

SEQ ID NO: 158640 - DNA, 75 bp, Artificial Sequence
  Synthetic
acacaaagattatcgggtgaaccggaacctacaaccacctagtataccttaactcaaccgccgttgtggaaaggt

SEQ ID NO: 158641 - DNA, 75 bp, Artificial Sequence
  Synthetic
aacctacaaccacctagtataccttaactcaaccgccgttgtggaaaggtatatgtcaacatttacagtaatata

SEQ ID NO: 158642 - DNA, 75 bp, Artificial Sequence
  Synthetic
cacgtttgtgttgtgacttgacgcgaacaccgctgtgctgtaagacccgtcggtaaatgaaaacgtaatagattc

SEQ ID NO: 158643 - DNA, 75 bp, Artificial Sequence
  Synthetic
aacaccgctgtgctgtaagacccgtcggtaaatgaaaacgtaatagattcgccttttacatgatccacgtaattt

SEQ ID NO: 158644 - DNA, 75 bp, Artificial Sequence
  Synthetic
acttgataccctcaaacacgggttccgttgctttgcgtatatgagccgtataacccactttaattcctctaaacg

SEQ ID NO: 158645 - DNA, 75 bp, Artificial Sequence
  Synthetic
cgttgctttgcgtatatgagccgtataacccactttaattcctctaaacgtggccattactaaagctattaatgg

SEQ ID NO: 158646 - DNA, 75 bp, Artificial Sequence
  Synthetic
ctacgtggtaccaaaaacacagttgatttttgtttgaagtgttctaaaacactgtcagaaacacttggcatgtta

SEQ ID NO: 158647 - DNA, 75 bp, Artificial Sequence
  Synthetic
atttttgtttgaagtgttctaaaacactgtcagaaacacttggcatgttaaacactgtacgcagaaagcagtcaa

SEQ ID NO: 158648 - DNA, 75 bp, Artificial Sequence
  Synthetic
caccgatgaaataaaatgcgtggtgtgcatgaggatcattttttgaaacagttccaacgtccccttatatctgcc

SEQ ID NO: 158649 - DNA, 75 bp, Artificial Sequence
  Synthetic
tgcatgaggatcattttttgaaacagttccaacgtccccttatatctgccatagattggaacgtcaacctttgcg

SEQ ID NO: 158650 - DNA, 75 bp, Artificial Sequence
  Synthetic
caatactctcaaaagatgtttccacaaggtacgaaaaccgttgtgtaaaggtagacaactgacagaaactatccg

SEQ ID NO: 158651 - DNA, 75 bp, Artificial Sequence
  Synthetic
aaggtacgaaaaccgttgtgtaaaggtagacaactgacagaaactatccgacagagaaaacgcgcgaaatgtgtt

SEQ ID NO: 158652 - DNA, 75 bp, Artificial Sequence
  Synthetic
tgaggtgctgcttcttccggtgaatattcataaaactgtacactactgacagccttttttaattcagggcttacg

SEQ ID NO: 158653 - DNA, 75 bp, Artificial Sequence
  Synthetic
attcataaaactgtacactactgacagccttttttaattcagggcttacgtttgcatttaccgaatatcgccatg

SEQ ID NO: 158654 - DNA, 75 bp, Artificial Sequence
  Synthetic
gttgtaccctgttgacgatagaaacgcgccaaacattgcccgtcgagcagtagccgagaacagtggaatatattc

SEQ ID NO: 158655 - DNA, 75 bp, Artificial Sequence
  Synthetic
gcgccaaacattgcccgtcgagcagtagccgagaacagtggaatatattcacaacagttgtgaagcgttccaatt

SEQ ID NO: 158656 - DNA, 75 bp, Artificial Sequence
  Synthetic
gggttacatctatagcaaaattcagaaacgggatttgggttgcgtttcccagagacccttgccgcgtggaacacg

SEQ ID NO: 158657 - DNA, 75 bp, Artificial Sequence
  Synthetic
aaacgggatttgggttgcgtttcccagagacccttgccgcgtggaacacggggtaggggactccaacgtcccaaa

SEQ ID NO: 158658 - DNA, 75 bp, Artificial Sequence
  Synthetic
cgttcaaaatatcttacagattcttcaccaagcgtacgaccaaacattatcaatgacatttaacatcaattcacg

SEQ ID NO: 158659 - DNA, 75 bp, Artificial Sequence
  Synthetic
caccaagcgtacgaccaaacattatcaatgacatttaacatcaattcacggaatccgcctcatctcttgtaagca

SEQ ID NO: 158660 - DNA, 75 bp, Artificial Sequence
  Synthetic
acgtactcgttacgtatatatcataaacattttcagggccgcattcattcactttggtcatgtcaggccacactc

SEQ ID NO: 158661 - DNA, 75 bp, Artificial Sequence
  Synthetic
aacattttcagggccgcattcattcactttggtcatgtcaggccacactccaacctacgcttctcataggcgtaa

SEQ ID NO: 158662 - DNA, 75 bp, Artificial Sequence
  Synthetic
aaccgcgcggggttatttaaagaacggaccctcgatctaatccgtgggggtgcgagtgtacaagatccagcattt

SEQ ID NO: 158663 - DNA, 75 bp, Artificial Sequence
  Synthetic
ggaccctcgatctaatccgtgggggtgcgagtgtacaagatccagcatttgtgtatgcctttactgctgcaaaag

SEQ ID NO: 158664 - DNA, 75 bp, Artificial Sequence
  Synthetic
gctccgctctgcagctcgcatagcttcagttgaacagaagattcgtgatatacaatccaaggttgaggaacaaac

SEQ ID NO: 158665 - DNA, 75 bp, Artificial Sequence
  Synthetic
tcagttgaacagaagattcgtgatatacaatccaaggttgaggaacaaacaagtattcaacagattttaaataca

SEQ ID NO: 158666 - DNA, 75 bp, Artificial Sequence
  Synthetic
ttattcgcggtttggataaaacagaagacgataataccgataatatagacagactggaagacgcggtaggaccga

SEQ ID NO: 158667 - DNA, 75 bp, Artificial Sequence
  Synthetic
agacgataataccgataatatagacagactggaagacgcggtaggaccgaacatcgaacacgaaaatcatacttg

SEQ ID NO: 158668 - DNA, 75 bp, Artificial Sequence
  Synthetic
cttacacaatggatgctgacgacacaccccccaacctccaaatatctccaactgcaggacctttgcgttcccacc

SEQ ID NO: 158669 - DNA, 75 bp, Artificial Sequence
  Synthetic
accccccaacctccaaatatctccaactgcaggacctttgcgttcccaccacaataccgacggacatgaaccaaa

SEQ ID NO: 158670 - DNA, 75 bp, Artificial Sequence
  Synthetic
cgagaatccaccaaccccacacacggatgtgtaaatcatccatgggccaatccgtcaactgcaacatgcatggaa

SEQ ID NO: 158671 - DNA, 75 bp, Artificial Sequence
  Synthetic
gatgtgtaaatcatccatgggccaatccgtcaactgcaacatgcatggaatcaccagaacgatcacaacagacaa

SEQ ID NO: 158672 - DNA, 75 bp, Artificial Sequence
  Synthetic
aacgagagatccaatacatcaacgcgaaagggtggacgtttttccacaatttaacaaacccccatgggtttttag

SEQ ID NO: 158673 - DNA, 75 bp, Artificial Sequence
  Synthetic
gaaagggtggacgtttttccacaatttaacaaacccccatgggtttttagaatttccaaattatcccgtttaatt

SEQ ID NO: 158674 - DNA, 75 bp, Artificial Sequence
  Synthetic
agttatgtttttctaaattacagattcgagatagacccaggtttgcgggacggggaacgtatgggcgtgttcata

SEQ ID NO: 158675 - DNA, 75 bp, Artificial Sequence
  Synthetic
tcgagatagacccaggtttgcgggacggggaacgtatgggcgtgttcatatatacccatcgtcaaaaatagctgt

SEQ ID NO: 158676 - DNA, 75 bp, Artificial Sequence
  Synthetic
aatagagagttaattaacgcgattttagcgagtgagggttctatacgagcaggggaaaggctaggtatttctagc

SEQ ID NO: 158677 - DNA, 75 bp, Artificial Sequence
  Synthetic
tagcgagtgagggttctatacgagcaggggaaaggctaggtatttctagcatagtttgccttttaggtttttcgt

SEQ ID NO: 158678 - DNA, 75 bp, Artificial Sequence
  Synthetic
ggcatacgacatggatatggatgaatacattgttcgcctgtccagacggttgacaatacctgatcacatagacag

SEQ ID NO: 158679 - DNA, 75 bp, Artificial Sequence
  Synthetic
tacattgttcgcctgtccagacggttgacaatacctgatcacatagacagaaaaattgcccatgtatttttagat

SEQ ID NO: 158680 - DNA, 75 bp, Artificial Sequence
  Synthetic
atcgaacgtgcggcctgacccacctagatgtgaaatgtggcaatatttttcttaacgtcgacaactttgcctcgt

SEQ ID NO: 158681 - DNA, 75 bp, Artificial Sequence
  Synthetic
agatgtgaaatgtggcaatatttttcttaacgtcgacaactttgcctcgttggaaataaccacagcagtaatcgg

SEQ ID NO: 158682 - DNA, 75 bp, Artificial Sequence
  Synthetic
acgtattccctttgtactcgagcgatatttgaagttggaaatccatcccacccggagcacgtactacgcgtaccc

SEQ ID NO: 158683 - DNA, 75 bp, Artificial Sequence
  Synthetic
tatttgaagttggaaatccatcccacccggagcacgtactacgcgtaccccgggatgcatcgcagatgtcatttc

SEQ ID NO: 158684 - DNA, 75 bp, Artificial Sequence
  Synthetic
ccaaccccctgaaatcttgcttgattatattaatggaacgggccttactaaatatactggaaccttgccccaaag

SEQ ID NO: 158685 - DNA, 75 bp, Artificial Sequence
  Synthetic
tatattaatggaacgggccttactaaatatactggaaccttgccccaaagagttggacttgcgattgatctttat

SEQ ID NO: 158686 - DNA, 75 bp, Artificial Sequence
  Synthetic
ttatcctgctaggacgtcttcccggacaactgcccatttcagtacatcggaccccgcattatcactactacggtc

SEQ ID NO: 158687 - DNA, 75 bp, Artificial Sequence
  Synthetic
acaactgcccatttcagtacatcggaccccgcattatcactactacggtcataagttatcaccagatttggcgct

SEQ ID NO: 158688 - DNA, 75 bp, Artificial Sequence
  Synthetic
ctggcgccatatatactcccatctgacatccccggggacttaaattataatccctttatacacgccggagagctg

SEQ ID NO: 158689 - DNA, 75 bp, Artificial Sequence
  Synthetic
acatccccggggacttaaattataatccctttatacacgccggagagctgaacacccgtatttcccggaattctt

SEQ ID NO: 158690 - DNA, 75 bp, Artificial Sequence
  Synthetic
agtgcgttacggcgtaacgcactcaaagcttttcgaaggcatacgcattccggcctcattatacccagccactgt

SEQ ID NO: 158691 - DNA, 75 bp, Artificial Sequence
  Synthetic
aagcttttcgaaggcatacgcattccggcctcattatacccagccactgttgttacgtcgttgttgtgtcacgat

SEQ ID NO: 158692 - DNA, 75 bp, Artificial Sequence
  Synthetic
ctttattatggcacgatcgggattggataggatcgacataagcccccagccagccaaaaaaattgcccgtgtggg

SEQ ID NO: 158693 - DNA, 75 bp, Artificial Sequence
  Synthetic
gataggatcgacataagcccccagccagccaaaaaaattgcccgtgtgggaggtctacagcacccttttgtaaaa

SEQ ID NO: 158694 - DNA, 75 bp, Artificial Sequence
  Synthetic
aacaccattttatagacacgctacagaagacatcaccgaacatggactgtcgcgggatgacagcgggtattttta

SEQ ID NO: 158695 - DNA, 75 bp, Artificial Sequence
  Synthetic
gaagacatcaccgaacatggactgtcgcgggatgacagcgggtatttttattcgtttatcccacatgtataaaat

SEQ ID NO: 158696 - DNA, 75 bp, Artificial Sequence
  Synthetic
gatgtaacctacacaacacccggttctaccaacgcactgttctttaagacgtccacacagcctcaggagccgcgt

SEQ ID NO: 158697 - DNA, 75 bp, Artificial Sequence
  Synthetic
ctaccaacgcactgttctttaagacgtccacacagcctcaggagccgcgtccggaagagttagcatccaaattaa

SEQ ID NO: 158698 - DNA, 75 bp, Artificial Sequence
  Synthetic
attaacaatagaatcggagactcgtggtcagggcgacaatgccatttggacactactcagacgaaatttaatcac

SEQ ID NO: 158699 - DNA, 75 bp, Artificial Sequence
  Synthetic
cactactcagacgaaatttaatcaccgcatcaactcttaaatggagtgtatctggacccgtcattccacctcagt

SEQ ID NO: 158700 - DNA, 75 bp, Artificial Sequence
  Synthetic
cacatacggtgatgcggcggcaatggcgtttggaaaaaccaacgaaccggcggcacgagcgatagttgaagcatt

SEQ ID NO: 158701 - DNA, 75 bp, Artificial Sequence
  Synthetic
gcgtttggaaaaaccaacgaaccggcggcacgagcgatagttgaagcattgtttatagatccggctgatatccgt

SEQ ID NO: 158702 - DNA, 75 bp, Artificial Sequence
  Synthetic
ctacaactaagttttttaattttgacatgctcaataccaaatctccaagtctccttgtgggtacaccaagaatcg

SEQ ID NO: 158703 - DNA, 75 bp, Artificial Sequence
  Synthetic
catgctcaataccaaatctccaagtctccttgtgggtacaccaagaatcggaacgtatgaatgtggacttttaat

SEQ ID NO: 158704 - DNA, 75 bp, Artificial Sequence
  Synthetic
gcgtcgttggacgttcttgtatgtgacagggaccctttaactggcaccctaaatccccaccctgcagaaaccgac

SEQ ID NO: 158705 - DNA, 75 bp, Artificial Sequence
  Synthetic
aaatccccaccctgcagaaaccgacatttcattttttgaaattaaatgtcgtgctaaatacctctttgatccaga

SEQ ID NO: 158706 - DNA, 75 bp, Artificial Sequence
  Synthetic
acgtacaccacgttaataaatagacctacaatggcaaatctacgggactttttatatactataaaaaacccatgt

SEQ ID NO: 158707 - DNA, 75 bp, Artificial Sequence
  Synthetic
ctacaatggcaaatctacgggactttttatatactataaaaaacccatgtgtaagcttctttggaccctcagcaa

SEQ ID NO: 158708 - DNA, 75 bp, Artificial Sequence
  Synthetic
aacggatcacgttgaatggaaacgtttaggatttaaaggtgggagggcccttacagaactcgacgcccatcattt

SEQ ID NO: 158709 - DNA, 75 bp, Artificial Sequence
  Synthetic
ttaggatttaaaggtgggagggcccttacagaactcgacgcccatcatttgggcctcaatcggacaatctcatcc

SEQ ID NO: 158710 - DNA, 75 bp, Artificial Sequence
  Synthetic
acatacaaaaggggacaattacaaccattgcatgggccactggagatacggctcttcaaattcctgtatttgcca

SEQ ID NO: 158711 - DNA, 75 bp, Artificial Sequence
  Synthetic
cattgcatgggccactggagatacggctcttcaaattcctgtatttgccaatccgcggcacgctaactttaaaca

SEQ ID NO: 158712 - DNA, 75 bp, Artificial Sequence
  Synthetic
tccggttactttccagcgctaaaactacggcccttccttgtcacctttataggacgtgtgcgccgaccacacgag

SEQ ID NO: 158713 - DNA, 75 bp, Artificial Sequence
  Synthetic
tacggcccttccttgtcacctttataggacgtgtgcgccgaccacacgaggtgggagtcccattgcgcgtcgata

SEQ ID NO: 158714 - DNA, 75 bp, Artificial Sequence
  Synthetic
taactggccgactatcccaccccactgtgcggttccggttatagccgttctaacgcctatcgaagttgatgtgcc

SEQ ID NO: 158715 - DNA, 75 bp, Artificial Sequence
  Synthetic
tgtgcggttccggttatagccgttctaacgcctatcgaagttgatgtgcctagagtgacacaaatacttaaagac

SEQ ID NO: 158716 - DNA, 75 bp, Artificial Sequence
  Synthetic
cattgcggtcattgcgatgggacaatcttcatccagcggtcgaggaggaatctgtggattgtgcaaacggtacaa

SEQ ID NO: 158717 - DNA, 75 bp, Artificial Sequence
  Synthetic
tcttcatccagcggtcgaggaggaatctgtggattgtgcaaacggtacaacgagcttgttacgtgcaacggagaa

SEQ ID NO: 158718 - DNA, 75 bp, Artificial Sequence
  Synthetic
ttgaagactttgactttgatgagaatgtaacagaggacgccgataaatccacacaacgccgcccacgagtgatcg

SEQ ID NO: 158719 - DNA, 75 bp, Artificial Sequence
  Synthetic
acacaacgccgcccacgagtgatcgatgtaacaccaaaacgaaaaccttcgggaaagagctcccattccaaatgc

SEQ ID NO: 158720 - DNA, 75 bp, Artificial Sequence
  Synthetic
ctgataaacgttctaataaaaacatcaaatcatggttggttactgtgaatgtttgttttattgcttgggggttta

SEQ ID NO: 158721 - DNA, 75 bp, Artificial Sequence
  Synthetic
caagtacaacccacgctactcccacccactgtttgatcgctcgtataacagctcatcctcacggtccgtttcata

SEQ ID NO: 158722 - DNA, 75 bp, Artificial Sequence
  Synthetic
ccttgtgatgggtaatttgtgcggcgagaatttctatgtgcaggttttacttttcgtatgtatccccgtacccgc

SEQ ID NO: 158723 - DNA, 75 bp, Artificial Sequence
  Synthetic
gagaatttctatgtgcaggttttacttttcgtatgtatccccgtacccgctcgggtactcttcttacggcaccgt

SEQ ID NO: 158724 - DNA, 75 bp, Artificial Sequence
  Synthetic
atacacatatgcacgcatcaatctgagaagcaacatgacaacggaaaacacggccaggcaagccaaggttccccg

SEQ ID NO: 158725 - DNA, 75 bp, Artificial Sequence
  Synthetic
agaagcaacatgacaacggaaaacacggccaggcaagccaaggttccccgagttgtgggaattaaccgtggagat

SEQ ID NO: 158726 - DNA, 75 bp, Artificial Sequence
  Synthetic
ggtccatatacgagtgcgcggcggttcccaacgtagcacaggccacgagcgttcccagggacggtcctattaaca

SEQ ID NO: 158727 - DNA, 75 bp, Artificial Sequence
  Synthetic
tcccaacgtagcacaggccacgagcgttcccagggacggtcctattaacacgtgtatataatgcgccaaaattaa

SEQ ID NO: 158728 - DNA, 75 bp, Artificial Sequence
  Synthetic
gacaatgtactaaatgtagacatggccacggacaccgatgaccacagtcccgtatgtagatgattcgccaccaca

SEQ ID NO: 158729 - DNA, 75 bp, Artificial Sequence
  Synthetic
ccacggacaccgatgaccacagtcccgtatgtagatgattcgccaccacaagttccagcattaatgatacaaata

SEQ ID NO: 158730 - DNA, 75 bp, Artificial Sequence
  Synthetic
catcaaattcacgaacactgcgcgcgtaggccccgcaaggcgatataaaaagacgctctgctgtcgtaaatttgc

SEQ ID NO: 158731 - DNA, 75 bp, Artificial Sequence
  Synthetic
gtaggccccgcaaggcgatataaaaagacgctctgctgtcgtaaatttgcgaccgcttttatgttcgtttcgtcc

SEQ ID NO: 158732 - DNA, 75 bp, Artificial Sequence
  Synthetic
ttgtaaatattacacttgtcgcaaaatgtccaagatataatgtagcagccacgccgatttgcttgtaagctaata

SEQ ID NO: 158733 - DNA, 75 bp, Artificial Sequence
  Synthetic
atgtccaagatataatgtagcagccacgccgatttgcttgtaagctaataataacacaacggcgtttaataacca

SEQ ID NO: 158734 - DNA, 75 bp, Artificial Sequence
  Synthetic
gttgtgggatctacaactaaccatgcaacaccggagctttgccggacacgttgatttttcgtttctcggtgtata

SEQ ID NO: 158735 - DNA, 75 bp, Artificial Sequence
  Synthetic
caacaccggagctttgccggacacgttgatttttcgtttctcggtgtataatcgcggccgtgatcagtgtatata

SEQ ID NO: 158736 - DNA, 75 bp, Artificial Sequence
  Synthetic
cgtgtagtaagtaaatgccacaacgctatgtggttccaaaaacaaaaccggggcgctgtatccacctctatttcc

SEQ ID NO: 158737 - DNA, 75 bp, Artificial Sequence
  Synthetic
ctatgtggttccaaaaacaaaaccggggcgctgtatccacctctatttccggaccatacccccccatctagggtg

SEQ ID NO: 158738 - DNA, 75 bp, Artificial Sequence
  Synthetic
cggcagcataaaaacaagggatcccggtatattcagaagaggcggcaattaacgtagccaggagcattaccgcac

SEQ ID NO: 158739 - DNA, 75 bp, Artificial Sequence
  Synthetic
ggtatattcagaagaggcggcaattaacgtagccaggagcattaccgcacccaaagtgaacatcatcacctgaat

SEQ ID NO: 158740 - DNA, 75 bp, Artificial Sequence
  Synthetic
tccatttgatgatctaacgcttccacctcgggtgtcgtggtgtcgtacggtgagactttttcagaacgcggcccc

SEQ ID NO: 158741 - DNA, 75 bp, Artificial Sequence
  Synthetic
cctcgggtgtcgtggtgtcgtacggtgagactttttcagaacgcggccccttcttttgagttcccatgtctccca

SEQ ID NO: 158742 - DNA, 75 bp, Artificial Sequence
  Synthetic
gcgggcgggcgacgggcgggctggtcggacccccccccccgaaaataaccccccccggtttctgggcgcccggcg

SEQ ID NO: 158743 - DNA, 75 bp, Artificial Sequence
  Synthetic
ctatgcgtccagtacacagctcgcgcgggcgttatatggaggggatctggtttcgtggattaaacacacccaccc

SEQ ID NO: 158744 - DNA, 75 bp, Artificial Sequence
  Synthetic
cgggcgttatatggaggggatctggtttcgtggattaaacacacccacccgggaattagcctggaactgcaattg

SEQ ID NO: 158745 - DNA, 75 bp, Artificial Sequence
  Synthetic
ctggtatgtcacaaactcgcccggtaaccgtcgtacgtgcccctatgggctctggtaaaacaacagccttgcttg

SEQ ID NO: 158746 - DNA, 75 bp, Artificial Sequence
  Synthetic
aaccgtcgtacgtgcccctatgggctctggtaaaacaacagccttgcttgagtggcttcaacacgcgttaaaggc

SEQ ID NO: 158747 - DNA, 75 bp, Artificial Sequence
  Synthetic
acgagggagaggcggaggagggagaggcggaggaggacgcgattgacgacgagggagaggcggaggagggagagg

SEQ ID NO: 158748 - DNA, 75 bp, Artificial Sequence
  Synthetic
tgtcgccgtagctttacccagacgttgattcaacggtttaacgatgcaggcctctccggattcgtaacatatttg

SEQ ID NO: 158749 - DNA, 75 bp, Artificial Sequence
  Synthetic
tgattcaacggtttaacgatgcaggcctctccggattcgtaacatatttgacatccgagacatatattatgggtt

SEQ ID NO: 158750 - DNA, 75 bp, Artificial Sequence
  Synthetic
gaggcggaggaggacgcgatcgacgacgagggagaggcggaggaggattatttttctgtaagtcaagtttgcagt

SEQ ID NO: 158751 - DNA, 75 bp, Artificial Sequence
  Synthetic
aagcctacaccgcgtatccagcgaagctatcgacagctacgacgtattaatactggatgaggtaatgtcagtgat

SEQ ID NO: 158752 - DNA, 75 bp, Artificial Sequence
  Synthetic
gctatcgacagctacgacgtattaatactggatgaggtaatgtcagtgattggacaattatactcccccacaatg

SEQ ID NO: 158753 - DNA, 75 bp, Artificial Sequence
  Synthetic
tattatatcgtcttttaaatcgctgttctcaaattatcgcgatggatgctacagtaaactctcagtttattgatt

SEQ ID NO: 158754 - DNA, 75 bp, Artificial Sequence
  Synthetic
ttctcaaattatcgcgatggatgctacagtaaactctcagtttattgatttaatctccggattgcgtggagatga

SEQ ID NO: 158755 - DNA, 75 bp, Artificial Sequence
  Synthetic
tacgcgggagttgggttctccggaagaacttgcacgatcctgcgtgatatgggcatcgacacgcttgtgcgagtc

SEQ ID NO: 158756 - DNA, 75 bp, Artificial Sequence
  Synthetic
gaacttgcacgatcctgcgtgatatgggcatcgacacgcttgtgcgagtcattaaacgatctcctgaacacgagg

SEQ ID NO: 158757 - DNA, 75 bp, Artificial Sequence
  Synthetic
tggaacattttttgacgaactagcactacgattacaatgtgggcataacatctgtatattttcatcaactttatc

SEQ ID NO: 158758 - DNA, 75 bp, Artificial Sequence
  Synthetic
ctacgattacaatgtgggcataacatctgtatattttcatcaactttatcgttttcggagctagttgctcagttt

SEQ ID NO: 158759 - DNA, 75 bp, Artificial Sequence
  Synthetic
ttattttaaactcaactcggcccctatgtaatgtaaacgaatggaaacattttcgcgtgttggtgtacactaccg

SEQ ID NO: 158760 - DNA, 75 bp, Artificial Sequence
  Synthetic
catggctcattttcatagcatgtttgcttacataaagccaatgtcatatgggccggatatggtatcggtctacca

SEQ ID NO: 158761 - DNA, 75 bp, Artificial Sequence
  Synthetic
ctacttaatgaagttttgatgtacgtcgatggctcaaggaccagatgcggacccctgttctcgccaatgttacta

SEQ ID NO: 158762 - DNA, 75 bp, Artificial Sequence
  Synthetic
tcgatggctcaaggaccagatgcggacccctgttctcgccaatgttactaaactttaccatcgcaaataaatttc

SEQ ID NO: 158763 - DNA, 75 bp, Artificial Sequence
  Synthetic
aactaacaaactgtgctgtgcatttaggcaacgatgtgcaaatgcatttacacgctcgaacacccatctcttctc

SEQ ID NO: 158764 - DNA, 75 bp, Artificial Sequence
  Synthetic
aggcaacgatgtgcaaatgcatttacacgctcgaacacccatctcttctcaagatttaaatacaaacaccttttc

SEQ ID NO: 158765 - DNA, 75 bp, Artificial Sequence
  Synthetic
ccgatagcattaatatcttacaaactcttttggcctctaaccaaattttggttgtattggatggcatgggtccaa

SEQ ID NO: 158766 - DNA, 75 bp, Artificial Sequence
  Synthetic
tcttttggcctctaaccaaattttggttgtattggatggcatgggtccaataacggacgtttccccagttcaatt

SEQ ID NO: 158767 - DNA, 75 bp, Artificial Sequence
  Synthetic
catagcgctaacgccgtagcttcctgtatgcgttctcttagacaggacaatgacagctgcttgaccgattttggc

SEQ ID NO: 158768 - DNA, 75 bp, Artificial Sequence
  Synthetic
gtatgcgttctcttagacaggacaatgacagctgcttgaccgattttggcccttccggatttatggccgataaca

SEQ ID NO: 158769 - DNA, 75 bp, Artificial Sequence
  Synthetic
tatggagtcaattaataccgaagaacaaattaaagtatttaaagcccttgcatgtccaatagaacagcctagact

SEQ ID NO: 158770 - DNA, 75 bp, Artificial Sequence
  Synthetic
tgtatacgaatacctgaagcgttggaagcatttgacgtatttcaaaaaatatacacgcactacgcttccggttgg

SEQ ID NO: 158771 - DNA, 75 bp, Artificial Sequence
  Synthetic
aagcatttgacgtatttcaaaaaatatacacgcactacgcttccggttggtttcccgtcctggacaaaaccgggg

SEQ ID NO: 158772 - DNA, 75 bp, Artificial Sequence
  Synthetic
atacacgcactacgcttccggttggtttcccgtcctggacaaaaccggggaatttagcatcgcgactataactac

SEQ ID NO: 158773 - DNA, 75 bp, Artificial Sequence
  Synthetic
gagctgtttcgccgttgtgcctatattgcaaaaacactcaagtggaatccgtccaccgaaggctgtgtaacacaa

SEQ ID NO: 158774 - DNA, 75 bp, Artificial Sequence
  Synthetic
ttgcaaaaacactcaagtggaatccgtccaccgaaggctgtgtaacacaagttttggatacggacattaatacac

SEQ ID NO: 158775 - DNA, 75 bp, Artificial Sequence
  Synthetic
ggctcaactaatatttgaggttatgcgctgtaacgttactgacgctaagattatattaaaccgcccggtttggcg

SEQ ID NO: 158776 - DNA, 75 bp, Artificial Sequence
  Synthetic
cgctgtaacgttactgacgctaagattatattaaaccgcccggtttggcgaacaaccggattcttagatggatgc

SEQ ID NO: 158777 - DNA, 75 bp, Artificial Sequence
  Synthetic
taaggctacttgggtaaaatggcaatgggggattccggggcgggagaccttcgattgggttgcctttataacacc

SEQ ID NO: 158778 - DNA, 75 bp, Artificial Sequence
  Synthetic
ctacaaaacacgaatataacattgctctatttcgtttaatttgggaacaattatttggcgcccgcgtaactaaaa

SEQ ID NO: 158779 - DNA, 75 bp, Artificial Sequence
  Synthetic
tctatttcgtttaatttgggaacaattatttggcgcccgcgtaactaaaagtacccagacctttccgggaagtac

SEQ ID NO: 158780 - DNA, 75 bp, Artificial Sequence
  Synthetic
gatctagaaactttacttgattcaattaacgtggatcgttctgcatgtcgtacctaccgccagttgtataacctg

SEQ ID NO: 158781 - DNA, 75 bp, Artificial Sequence
  Synthetic
ttaacgtggatcgttctgcatgtcgtacctaccgccagttgtataacctgcttatgagccatcgccattcgttct

SEQ ID NO: 158782 - DNA, 75 bp, Artificial Sequence
  Synthetic
ccccgcttgggcacgccacgtgtattttcaagcacatcaaatgcacttggccccgcatgccgaagccatgctaca

SEQ ID NO: 158783 - DNA, 75 bp, Artificial Sequence
  Synthetic
attagcgctatcggaactgtccccgggatcgtggccgcggataaacggggcggtaaattttgaaagtttataacc

SEQ ID NO: 158784 - DNA, 75 bp, Artificial Sequence
  Synthetic
tgggggggttacataaatactaagcctctgtacaacacaaagggcctctaacaatgcactgaaccacaaccaagc

SEQ ID NO: 158785 - DNA, 75 bp, Artificial Sequence
  Synthetic
ctctgtacaacacaaagggcctctaacaatgcactgaaccacaaccaagctatggacgcaacgcagattaccttg

SEQ ID NO: 158786 - DNA, 75 bp, Artificial Sequence
  Synthetic
ccgcaagcatatacacatcctggacacagtccggacaattaacacagaacggtctttccgtgttatactacttat

SEQ ID NO: 158787 - DNA, 75 bp, Artificial Sequence
  Synthetic
acagtccggacaattaacacagaacggtctttccgtgttatactacttattatgcaaaaactcatgtgggaaata

SEQ ID NO: 158788 - DNA, 75 bp, Artificial Sequence
  Synthetic
gtacaacaagaggatttatgtcgctactccaggcatggggggagtgtttctgcggcaacgtttgcgtctatctgc

SEQ ID NO: 158789 - DNA, 75 bp, Artificial Sequence
  Synthetic
actccaggcatggggggagtgtttctgcggcaacgtttgcgtctatctgcagggcggcgtcctcggctgcgttag

SEQ ID NO: 158790 - DNA, 75 bp, Artificial Sequence
  Synthetic
taacgcagacacctggcgttgtctccatggcactgccctggccactttacggcgcgtattagggtttaaatcgtt

SEQ ID NO: 158791 - DNA, 75 bp, Artificial Sequence
  Synthetic
catggcactgccctggccactttacggcgcgtattagggtttaaatcgttttattcgccagtaacattcgagact

SEQ ID NO: 158792 - DNA, 75 bp, Artificial Sequence
  Synthetic
aaacaatccccgatgaacacgcgttgaataatgacaacacgccatctaccggagtattgagggctaattttcccg

SEQ ID NO: 158793 - DNA, 75 bp, Artificial Sequence
  Synthetic
gaataatgacaacacgccatctaccggagtattgagggctaattttcccgtggccattgatgtttcagcagtcag

SEQ ID NO: 158794 - DNA, 75 bp, Artificial Sequence
  Synthetic
acgtcgctagcctacgcccgcctgaccgcacttaaatctaacggtgacacccagcaacaaacacctttagacgtg

SEQ ID NO: 158795 - DNA, 75 bp, Artificial Sequence
  Synthetic
ccgcacttaaatctaacggtgacacccagcaacaaacacctttagacgtggaggtaattacaccaaaggcctaca

SEQ ID NO: 158796 - DNA, 75 bp, Artificial Sequence
  Synthetic
ttccccccctatagagcgggaaggccaaacctccgatttgtttaaccttgaagaacgccgcttggttcttagtgg

SEQ ID NO: 158797 - DNA, 75 bp, Artificial Sequence
  Synthetic
caaacctccgatttgtttaaccttgaagaacgccgcttggttcttagtggcaatcgcgcaattgtggtaagggta

SEQ ID NO: 158798 - DNA, 75 bp, Artificial Sequence
  Synthetic
taacaacggattccaccgttacatcttccctttcaatattagcaacatatagactgtggtacgcggcggcgtttg

SEQ ID NO: 158799 - DNA, 75 bp, Artificial Sequence
  Synthetic
ttccctttcaatattagcaacatatagactgtggtacgcggcggcgtttggaaaacccggggttgtccgtccaat

SEQ ID NO: 158800 - DNA, 75 bp, Artificial Sequence
  Synthetic
aatccgaagggtgaagacagagactacttttgtactgtcggatttcccggatggaccactcttcggacacaaact

SEQ ID NO: 158801 - DNA, 75 bp, Artificial Sequence
  Synthetic
acttttgtactgtcggatttcccggatggaccactcttcggacacaaactccagccgtcgaatctattcgcacgg

SEQ ID NO: 158802 - DNA, 75 bp, Artificial Sequence
  Synthetic
tgggttgtggccagtaaccggtattcaggcctttcattatctagccccctggggacagcatccccccttacctcc

SEQ ID NO: 158803 - DNA, 75 bp, Artificial Sequence
  Synthetic
caggcctttcattatctagccccctggggacagcatccccccttacctccgcgggtgcaggatcttattgggcaa

SEQ ID NO: 158804 - DNA, 75 bp, Artificial Sequence
  Synthetic
atgcaactgtcaattgggacgcgggccggatatctaccgtcttcaaacagcctgtacaactacaagatcgttgga

SEQ ID NO: 158805 - DNA, 75 bp, Artificial Sequence
  Synthetic
ccggatatctaccgtcttcaaacagcctgtacaactacaagatcgttggatggcaaagtttgatttcagcgcctt

SEQ ID NO: 158806 - DNA, 75 bp, Artificial Sequence
  Synthetic
ttccccatgcattttagattaggcaaaatcgtcctggctagaatgcgtcgaggaatggggtgcctaaaacccgcg

SEQ ID NO: 158807 - DNA, 75 bp, Artificial Sequence
  Synthetic
aaatcgtcctggctagaatgcgtcgaggaatggggtgcctaaaacccgcgttggtgtctttttttggggggttac

SEQ ID NO: 158808 - DNA, 75 bp, Artificial Sequence
  Synthetic
agctattatttttatagccaatgaaattagcctttgcgtcgaacaaacggccttggaacagggctttgctatatg

SEQ ID NO: 158809 - DNA, 75 bp, Artificial Sequence
  Synthetic
attagcctttgcgtcgaacaaacggccttggaacagggctttgctatatgtacttatataaaagatggattttgg

SEQ ID NO: 158810 - DNA, 75 bp, Artificial Sequence
  Synthetic
gcaatgtatgttcagatcaggcacgttgttcggccttaaatttagcggccgcctgcgaaagagcagtcacgggct

SEQ ID NO: 158811 - DNA, 75 bp, Artificial Sequence
  Synthetic
ttgttcggccttaaatttagcggccgcctgcgaaagagcagtcacgggcttattacgaattcaactaggtcttaa

SEQ ID NO: 158812 - DNA, 75 bp, Artificial Sequence
  Synthetic
ctccgggtcgagggtgtgtacactcacgcatttacctggtgtaccacgggaagctggctgtggaatttacaaaca

SEQ ID NO: 158813 - DNA, 75 bp, Artificial Sequence
  Synthetic
acgcatttacctggtgtaccacgggaagctggctgtggaatttacaaacaaacacgcctccggatttagttggcg

SEQ ID NO: 158814 - DNA, 75 bp, Artificial Sequence
  Synthetic
agatttaaaggagcgtctttcaggactcctatgtaccgcaacaaaaattcgagaacggatacaggaaaattgcat

SEQ ID NO: 158815 - DNA, 75 bp, Artificial Sequence
  Synthetic
ctcctatgtaccgcaacaaaaattcgagaacggatacaggaaaattgcatatgggaccatgtcctatacgacata

SEQ ID NO: 158816 - DNA, 75 bp, Artificial Sequence
  Synthetic
ccagaaaaacatacgtcgatttttttgaacatgtttttgatcgccgttatactccggtatactggagtcttcagg

SEQ ID NO: 158817 - DNA, 75 bp, Artificial Sequence
  Synthetic
tgaacatgtttttgatcgccgttatactccggtatactggagtcttcaggagcaaaattcggaaacaaaagcaat

SEQ ID NO: 158818 - DNA, 75 bp, Artificial Sequence
  Synthetic
cacatgcaagataaggattataaaccaagacagataattatggttcgtaatcccaacccacatggacctcctact

SEQ ID NO: 158819 - DNA, 75 bp, Artificial Sequence
  Synthetic
caagacagataattatggttcgtaatcccaacccacatggacctcctactgttgtttactgggaattgctaccat

SEQ ID NO: 158820 - DNA, 75 bp, Artificial Sequence
  Synthetic
ctgcgctgctcatctcaagccccttatacacacgtttgtcactattattaaccatcttctagatgctcataatga

SEQ ID NO: 158821 - DNA, 75 bp, Artificial Sequence
  Synthetic
atacacacgtttgtcactattattaaccatcttctagatgctcataatgatttttcaagtccatcattgaaattt

SEQ ID NO: 158822 - DNA, 75 bp, Artificial Sequence
  Synthetic
acttcttgtttttatgacaaaaaaacacgccgcaacaacccatccttaaaataaaaggtttatttactttacaac

SEQ ID NO: 158823 - DNA, 75 bp, Artificial Sequence
  Synthetic
cacgccgcaacaacccatccttaaaataaaaggtttatttactttacaacccgtggtgaatttttatacgtttca

SEQ ID NO: 158824 - DNA, 75 bp, Artificial Sequence
  Synthetic
ccatggtgcgatttaaccaccaaaaatatacgctcttctgatattccgaatctcgtaaaggtccatttaacaatc

SEQ ID NO: 158825 - DNA, 75 bp, Artificial Sequence
  Synthetic
atatacgctcttctgatattccgaatctcgtaaaggtccatttaacaatcccgggggcacttgcaccacaccatc

SEQ ID NO: 158826 - DNA, 75 bp, Artificial Sequence
  Synthetic
aggtcaaaacgctgacccaccccacatgaatatatagcctttataatattgggggccgttccaggctgagggttc

SEQ ID NO: 158827 - DNA, 75 bp, Artificial Sequence
  Synthetic
atgaatatatagcctttataatattgggggccgttccaggctgagggttcagtaacttaacaaacatataatgcg

SEQ ID NO: 158828 - DNA, 75 bp, Artificial Sequence
  Synthetic
gttgttatcaacgacatacattagagtgtttaacaaccataaaactccctcatataaaaaccgacgcattttttc

SEQ ID NO: 158829 - DNA, 75 bp, Artificial Sequence
  Synthetic
gtgtttaacaaccataaaactccctcatataaaaaccgacgcattttttccaaaggtcctatttgacactcaacg

SEQ ID NO: 158830 - DNA, 75 bp, Artificial Sequence
  Synthetic
caaacagcgatggagatgccccggagggcccaatgccttccagatacattaaaataacacataaggtaaaatcta

SEQ ID NO: 158831 - DNA, 75 bp, Artificial Sequence
  Synthetic
catccgatagattaacaggcgcggaggcacccccaccgtatacaccctatcttcaaccgcagttaatacggaaaa

SEQ ID NO: 158832 - DNA, 75 bp, Artificial Sequence
  Synthetic
ggcacccccaccgtatacaccctatcttcaaccgcagttaatacggaaaaaataaatccgcggaacgctggttga

SEQ ID NO: 158833 - DNA, 75 bp, Artificial Sequence
  Synthetic
cttcaaccgcagttaatacggaaaaaataaatccgcggaacgctggttgagtaacacactccatgtagtaacgat

SEQ ID NO: 158834 - DNA, 75 bp, Artificial Sequence
  Synthetic
attcaacactactaaaacggtctcttggtgttccggttttacgcgcagtgatacaacagagtttgccaaaaagcg

SEQ ID NO: 158835 - DNA, 75 bp, Artificial Sequence
  Synthetic
tggtgttccggttttacgcgcagtgatacaacagagtttgccaaaaagcgtggcttcaaaccggttacctcccgc

SEQ ID NO: 158836 - DNA, 75 bp, Artificial Sequence
  Synthetic
cttgtattctaagatcttcgatcacgtcgctcacatccaacccctcttcggctcgtgttagtaagttgtcgatcg

SEQ ID NO: 158837 - DNA, 75 bp, Artificial Sequence
  Synthetic
gtcgctcacatccaacccctcttcggctcgtgttagtaagttgtcgatcgttacgctgcaacctaaaatgctggg

SEQ ID NO: 158838 - DNA, 75 bp, Artificial Sequence
  Synthetic
gccatccccgcgcctccggtttgctcgaattttatccagtaaggtcgaatccgctgcatttaccttgtgtacccg

SEQ ID NO: 158839 - DNA, 75 bp, Artificial Sequence
  Synthetic
cgaattttatccagtaaggtcgaatccgctgcatttaccttgtgtacccgtaacctctcaggggggtgtcctttc

SEQ ID NO: 158840 - DNA, 75 bp, Artificial Sequence
  Synthetic
caacatgcatgtattggttatttattttattgggttccgggattctttcgtcatcttctgtagggtcaggcaaac

SEQ ID NO: 158841 - DNA, 75 bp, Artificial Sequence
  Synthetic
tttattgggttccgggattctttcgtcatcttctgtagggtcaggcaaaccccaggaaggacttggtgttctccg

SEQ ID NO: 158842 - DNA, 75 bp, Artificial Sequence
  Synthetic
cgaacctgcatttcatataatattcggatttgggataaataggactctgttctcgcctttttaaaaatagcctgg

SEQ ID NO: 158843 - DNA, 75 bp, Artificial Sequence
  Synthetic
ggatttgggataaataggactctgttctcgcctttttaaaaatagcctggcataactcttcctctgacctatgta

SEQ ID NO: 158844 - DNA, 75 bp, Artificial Sequence
  Synthetic
taatcgggtggcccgtaatatgaatgaaaaatacggcgcaactagtaatgagattgacgcatttgaatatgatac

SEQ ID NO: 158845 - DNA, 75 bp, Artificial Sequence
  Synthetic
gaaaaatacggcgcaactagtaatgagattgacgcatttgaatatgatacagaaatttcctggccttgattattg

SEQ ID NO: 158846 - DNA, 75 bp, Artificial Sequence
  Synthetic
gaacaagttcctgtttccatagctcagacaaacgttttatatcatctccataaggggggatataacgagattgaa

SEQ ID NO: 158847 - DNA, 75 bp, Artificial Sequence
  Synthetic
agacaaacgttttatatcatctccataaggggggatataacgagattgaaaactattggcaatatatgcatcatc

SEQ ID NO: 158848 - DNA, 75 bp, Artificial Sequence
  Synthetic
acctcgtgatttaaatcggcaatacgtgtttcttctgccattgtaatatgtgaccctttagatggctttattttt

SEQ ID NO: 158849 - DNA, 75 bp, Artificial Sequence
  Synthetic
gtgtttcttctgccattgtaatatgtgaccctttagatggctttatttttaccctctcttcccgtaaccgtttca

SEQ ID NO: 158850 - DNA, 75 bp, Artificial Sequence
  Synthetic
ttcggtcagatcgctgttcacatccttgagaccctcaatggttttgaataaattattcacataaccctcgagcat

SEQ ID NO: 158851 - DNA, 75 bp, Artificial Sequence
  Synthetic
gttttaaacgcactttgaacgtttgttgttccggacattgcccccccgttaaaggattggttggccttgccaaac

SEQ ID NO: 158852 - DNA, 75 bp, Artificial Sequence
  Synthetic
ttgttccggacattgcccccccgttaaaggattggttggccttgccaaaccccggttgtgatgtgtccaccgatc

SEQ ID NO: 158853 - DNA, 75 bp, Artificial Sequence
  Synthetic
aaaggattggttggccttgccaaaccccggttgtgatgtgtccaccgatccacttccttccagaatgtgattgcc

SEQ ID NO: 158854 - DNA, 75 bp, Artificial Sequence
  Synthetic
gtttcggtaatatctccaacatgtctcatgttttttaagttaactattagctttacaagtctagacgcggccgat

SEQ ID NO: 158855 - DNA, 75 bp, Artificial Sequence
  Synthetic
tcatgttttttaagttaactattagctttacaagtctagacgcggccgatccagcccgtgttgtatcgttctcgc

SEQ ID NO: 158856 - DNA, 75 bp, Artificial Sequence
  Synthetic
gctgtgagatctatcatcttcattccggcgacctattaacacgcgcaaaggggctgtatttaaaacttggcagac

SEQ ID NO: 158857 - DNA, 75 bp, Artificial Sequence
  Synthetic
cggcgacctattaacacgcgcaaaggggctgtatttaaaacttggcagacgcgagcatgttcacgtaatgcataa

SEQ ID NO: 158858 - DNA, 75 bp, Artificial Sequence
  Synthetic
gctgtaagggtgagtcaaatactacaccctccccacatacaacgggcggccacacgaccaaacactctcccttca

SEQ ID NO: 158859 - DNA, 75 bp, Artificial Sequence
  Synthetic
accctccccacatacaacgggcggccacacgaccaaacactctcccttcatgcccgttacatcatcctttgccat

SEQ ID NO: 158860 - DNA, 75 bp, Artificial Sequence
  Synthetic
taaagacgcgtcctatcataatccataatagcaacattttgcatacactcaactaggcttgtgacaaccgccgct

SEQ ID NO: 158861 - DNA, 75 bp, Artificial Sequence
  Synthetic
aactaggcttgtgacaaccgccgctcctctggccaacgttgcatcggcaacttttaacatctgggacagttctgc

SEQ ID NO: 158862 - DNA, 75 bp, Artificial Sequence
  Synthetic
ggtgcaggggttccattctgttctgatcgtacctttcttacaacgggcacaatacctacacaggctatccagtcc

SEQ ID NO: 158863 - DNA, 75 bp, Artificial Sequence
  Synthetic
atcgtacctttcttacaacgggcacaatacctacacaggctatccagtccacgtatttggcaaaaccgacccttc

SEQ ID NO: 158864 - DNA, 75 bp, Artificial Sequence
  Synthetic
accggttattccacgcagaaactcaagtaacgatgactgtaatgtttgacgccaggtttcaaaaacctgatgtgc

SEQ ID NO: 158865 - DNA, 75 bp, Artificial Sequence
  Synthetic
agtaacgatgactgtaatgtttgacgccaggtttcaaaaacctgatgtgcaagccgtacggcttctgattctcca

SEQ ID NO: 158866 - DNA, 75 bp, Artificial Sequence
  Synthetic
ccccggcatgcaggttacattgttggatgtggtgttcccaatctgctgctaggtcctcataccgagttgcatcca

SEQ ID NO: 158867 - DNA, 75 bp, Artificial Sequence
  Synthetic
aggtcctcataccgagttgcatccaacgcgttcatcaaaacggttgcctgaacttggcgaattacagtttccgta

SEQ ID NO: 158868 - DNA, 75 bp, Artificial Sequence
  Synthetic
gtccatcggtatatccaaagtcaccggctaggatttttcgaaacaacatactttgcgtggttgggtgtattaaca

SEQ ID NO: 158869 - DNA, 75 bp, Artificial Sequence
  Synthetic
ggctaggatttttcgaaacaacatactttgcgtggttgggtgtattaacatccagccatcttcctccggaaatgt

SEQ ID NO: 158870 - DNA, 75 bp, Artificial Sequence
  Synthetic
tcattccagtatatatcgaacatgttcttgtattggtcatttgggttacttccattcaagccctggtcaatagaa

SEQ ID NO: 158871 - DNA, 75 bp, Artificial Sequence
  Synthetic
tcttgtattggtcatttgggttacttccattcaagccctggtcaatagaaacagaacttgctatccttttttctt

SEQ ID NO: 158872 - DNA, 75 bp, Artificial Sequence
  Synthetic
agacgttatttcggccattgaaaaccacgatgaaaagatcaatttctgtagacagttcttcacccaaaaacgttt

SEQ ID NO: 158873 - DNA, 75 bp, Artificial Sequence
  Synthetic
cacgatgaaaagatcaatttctgtagacagttcttcacccaaaaacgtttttaatccagagacgcccaatggatt

SEQ ID NO: 158874 - DNA, 75 bp, Artificial Sequence
  Synthetic
acctctatgcatagcattcaacctatcctctcacggattcgagaacttgccgcaattacgattccaaaagaacgt

SEQ ID NO: 158875 - DNA, 75 bp, Artificial Sequence
  Synthetic
tcctctcacggattcgagaacttgccgcaattacgattccaaaagaacgtgttccgcggttgtgttggtttaaac

SEQ ID NO: 158876 - DNA, 75 bp, Artificial Sequence
  Synthetic
tgaaatgcagaggaatgagctccccttctccgtttatttaattagcggaaatgccggctccggaaaaagcacgtg

SEQ ID NO: 158877 - DNA, 75 bp, Artificial Sequence
  Synthetic
ttctccgtttatttaattagcggaaatgccggctccggaaaaagcacgtgtatccaaacgcttaacgaagctatc

SEQ ID NO: 158878 - DNA, 75 bp, Artificial Sequence
  Synthetic
gagggaagctaatgaggaaatcaacatcaatacggacgcgatcgacgacgagggagaggcggaggagggagaggc

SEQ ID NO: 158879 - DNA, 75 bp, Artificial Sequence
  Synthetic
gggttgctgcccaaaatgttcatgctaagttatcaacggcttatgcgagtcgtccgataaacacaatctttcatg

SEQ ID NO: 158880 - DNA, 75 bp, Artificial Sequence
  Synthetic
taagttatcaacggcttatgcgagtcgtccgataaacacaatctttcatgaatttggttttcgcggaaatcacat

SEQ ID NO: 158881 - DNA, 75 bp, Artificial Sequence
  Synthetic
tataactggactacgacccccccttctattgaggacctgcaaaaaagagatattgtatactactgggaagtttta

SEQ ID NO: 158882 - DNA, 75 bp, Artificial Sequence
  Synthetic
ctattgaggacctgcaaaaaagagatattgtatactactgggaagttttaattgatataacaaaacgagtgtttc

SEQ ID NO: 158883 - DNA, 75 bp, Artificial Sequence
  Synthetic
aacatcgacatttaaaaccctgtgggcaattgaacgtttgcttaataaacctacaggctcaatgtccggaaccgc

SEQ ID NO: 158884 - DNA, 75 bp, Artificial Sequence
  Synthetic
gcaattgaacgtttgcttaataaacctacaggctcaatgtccggaaccgcgtttatcgcatgcggttcccttccg

SEQ ID NO: 158885 - DNA, 75 bp, Artificial Sequence
  Synthetic
ttattgatgaagcaggattgctagggcgtcatattctcacggccgttgtttactgttggtggcttttgaatgcta

SEQ ID NO: 158886 - DNA, 75 bp, Artificial Sequence
  Synthetic
gcgtcatattctcacggccgttgtttactgttggtggcttttgaatgctatatatcaaagccctcagtacataaa

SEQ ID NO: 158887 - DNA, 75 bp, Artificial Sequence
  Synthetic
gcggaggaggacgcgatcgacgacgagggagaggcggaggaggacgcggcggaggaggacgcgatcgacgacgag

SEQ ID NO: 158888 - DNA, 75 bp, Artificial Sequence
  Synthetic
gtcggttcgcccacccaaactgactcgttagaatctcattttcaacatgacatgcagcgttcacacgtaactcct

SEQ ID NO: 158889 - DNA, 75 bp, Artificial Sequence
  Synthetic
cgttagaatctcattttcaacatgacatgcagcgttcacacgtaactcctagtgaaaatatactcacgtatataa

SEQ ID NO: 158890 - DNA, 75 bp, Artificial Sequence
  Synthetic
tactaacatctcacataactgggcaatctttattaataacaaacgatgtcaagaggacgattttggaaatctttt

SEQ ID NO: 158891 - DNA, 75 bp, Artificial Sequence
  Synthetic
atctttattaataacaaacgatgtcaagaggacgattttggaaatcttttaaaaacgcttgagtacgggctacct

SEQ ID NO: 158892 - DNA, 75 bp, Artificial Sequence
  Synthetic
tcgatacatttgttgtacctgcatcctatattaacaatcctgctaatcttcccggatggacgcgtctgtattcgt

SEQ ID NO: 158893 - DNA, 75 bp, Artificial Sequence
  Synthetic
ctatattaacaatcctgctaatcttcccggatggacgcgtctgtattcgtcgcataaggaggtgagcgcgtatat

SEQ ID NO: 158894 - DNA, 75 bp, Artificial Sequence
  Synthetic
ctatcgaaaaatgaccatttttctgtgtttgccttaccgacttatacattcatccggctaacggcatttgatgaa

SEQ ID NO: 158895 - DNA, 75 bp, Artificial Sequence
  Synthetic
tgtttgccttaccgacttatacattcatccggctaacggcatttgatgaataccgcaaattaacgggacaacccg

SEQ ID NO: 158896 - DNA, 75 bp, Artificial Sequence
  Synthetic
ggcaaactccggtcgtttgcacaattattcccaaagccgagatcatgacatgggaacagttaaatacgaaacaca

SEQ ID NO: 158897 - DNA, 75 bp, Artificial Sequence
  Synthetic
tattcccaaagccgagatcatgacatgggaacagttaaatacgaaacacattcaaatcgcgacttaattgtagcc

SEQ ID NO: 158898 - DNA, 75 bp, Artificial Sequence
  Synthetic
atagtctcgtagttgtaaccacaagactacgtaagttagttattggattcagtggtacatttcaatcgtttgcaa

SEQ ID NO: 158899 - DNA, 75 bp, Artificial Sequence
  Synthetic
actacgtaagttagttattggattcagtggtacatttcaatcgtttgcaaaggttttacgtgacgactcctttgt

SEQ ID NO: 158900 - DNA, 75 bp, Artificial Sequence
  Synthetic
gaatatgcttaccggtttctgtcaaacctaatctttggaggcttgattaacttttacaattttttgttaaataaa

SEQ ID NO: 158901 - DNA, 75 bp, Artificial Sequence
  Synthetic
acctaatctttggaggcttgattaacttttacaattttttgttaaataaaaacctacatcccgataaggtatcgt

SEQ ID NO: 158902 - DNA, 75 bp, Artificial Sequence
  Synthetic
aaccctggagttattgtctggaacaaacaaagcccccttacacgaagcagcggttaatggggcgggtgccgggat

SEQ ID NO: 158903 - DNA, 75 bp, Artificial Sequence
  Synthetic
cggttaatggggcgggtgccgggattgactgtgatggtgcagctacttctgccgataaagccttctgctttacca

SEQ ID NO: 158904 - DNA, 75 bp, Artificial Sequence
  Synthetic
aagcccccgagtccaaagtaacggcctccatacccgaagacccggatgatgtaatttttacggcacttaacgacg

SEQ ID NO: 158905 - DNA, 75 bp, Artificial Sequence
  Synthetic
ctccatacccgaagacccggatgatgtaatttttacggcacttaacgacgaggttattgacttggtatactgcca

SEQ ID NO: 158906 - DNA, 75 bp, Artificial Sequence
  Synthetic
tccaatgaggtccatgctcagtttctgttaatgaaagctatttacgatggtcgatatgccatattagcagagctt

SEQ ID NO: 158907 - DNA, 75 bp, Artificial Sequence
  Synthetic
tgttaatgaaagctatttacgatggtcgatatgccatattagcagagcttttcgaaagcagctttacaaccgccc

SEQ ID NO: 158908 - DNA, 75 bp, Artificial Sequence
  Synthetic
taatttcaacggaagcgagcttttgatcggcaatgtgcggggggggctgttatctttggcattacaaacagatac

SEQ ID NO: 158909 - DNA, 75 bp, Artificial Sequence
  Synthetic
atcggcaatgtgcggggggggctgttatctttggcattacaaacagatacgtatacccttttggggtatactttt

SEQ ID NO: 158910 - DNA, 75 bp, Artificial Sequence
  Synthetic
aactgacccgaaaaaagctgtaccgcgaaactaccgaaatgttatatgctctacacgtacctcttatggtcttac

SEQ ID NO: 158911 - DNA, 75 bp, Artificial Sequence
  Synthetic
cgaaactaccgaaatgttatatgctctacacgtacctcttatggtcttacaggatcaacatgggtttgtgtccat

SEQ ID NO: 158912 - DNA, 75 bp, Artificial Sequence
  Synthetic
accgagtctatagaggatgcagaattggcaatggccaccacggtggactatggccttagttctaaactagccatg

SEQ ID NO: 158913 - DNA, 75 bp, Artificial Sequence
  Synthetic
tggcaatggccaccacggtggactatggccttagttctaaactagccatgacaattgcacgctcacagggtctga

SEQ ID NO: 158914 - DNA, 75 bp, Artificial Sequence
  Synthetic
tacggcggataaactgcgcctaaatagtgtgtatgttgccatgtcgcgtacggtctcctctaggttcttaaaaat

SEQ ID NO: 158915 - DNA, 75 bp, Artificial Sequence
  Synthetic
agtgtgtatgttgccatgtcgcgtacggtctcctctaggttcttaaaaatgaatctaaaccctctacgggaacga

SEQ ID NO: 158916 - DNA, 75 bp, Artificial Sequence
  Synthetic
atcacattcttgccgctctacgtgatcccaacgtacacgttgtgtattaaagcattgtataaaaacacgcatgcg

SEQ ID NO: 158917 - DNA, 75 bp, Artificial Sequence
  Synthetic
tcccaacgtacacgttgtgtattaaagcattgtataaaaacacgcatgcgggcttgctgttctcatttctaggtt

SEQ ID NO: 158918 - DNA, 75 bp, Artificial Sequence
  Synthetic
catctctggacccccaacgacgtttattttatataggttacatggggttaggcgggttcttcactggactttacc

SEQ ID NO: 158919 - DNA, 75 bp, Artificial Sequence
  Synthetic
ggcgggttcttcactggactttaccggatcatgaacaaacactctacgcatttacgggtgggtcaagatcaatgg

SEQ ID NO: 158920 - DNA, 75 bp, Artificial Sequence
  Synthetic
ctgtatgggttttcatgttttggcatgtgtccaaccaccgttcgcactttctttctatatatatatatatatata

SEQ ID NO: 158921 - DNA, 75 bp, Artificial Sequence
  Synthetic
cggtgaagacggacgctcgatgtgatacaatgagcggtggtatgatcgtccttcaacacacccatacagtgaccc

SEQ ID NO: 158922 - DNA, 75 bp, Artificial Sequence
  Synthetic
tacaatgagcggtggtatgatcgtccttcaacacacccatacagtgaccctgctaaccatagactgttctactga

SEQ ID NO: 158923 - DNA, 75 bp, Artificial Sequence
  Synthetic
ttccaaatgtaaaaaaatgcccgtccggcccgcgcagcccgcgcagcccgcgcagcccgcgcagcccgcgcagac

SEQ ID NO: 158924 - DNA, 75 bp, Artificial Sequence
  Synthetic
cgggatttccacttacaggacaaaccccacgcaacatttgcgatgccgtttatgtcctgggtcggttctgaccca

SEQ ID NO: 158925 - DNA, 75 bp, Artificial Sequence
  Synthetic
ggcttttcacagaatatatatattccaaatggagcggcaggctttttaaaatcgatttgacgtgataaaaaaaaa

SEQ ID NO: 158926 - DNA, 75 bp, Artificial Sequence
  Synthetic
cccacgcaacatttgcgatgccgtttatgtcctgggtcggttctgacccaacatctcagctgtacagtaatgtgg

SEQ ID NO: 158927 - DNA, 75 bp, Artificial Sequence
  Synthetic
agatgacctatccatgtgtatctcaattgttatatacggtttacgggtaaacagacctgacgatcagaccacacc

SEQ ID NO: 158928 - DNA, 75 bp, Artificial Sequence
  Synthetic
acagacctgacgatcagaccacaccaacaccaaccccgcaccagtatacatcgcaaaggcggcagcctgaaacca

SEQ ID NO: 158929 - DNA, 75 bp, Artificial Sequence
  Synthetic
aacaccaaccccgcaccagtatacatcgcaaaggcggcagcctgaaaccaactgtccttcttcaccacaaccggc

SEQ ID NO: 158930 - DNA, 75 bp, Artificial Sequence
  Synthetic
ctttttcacatcagacgacgacgttctttcgttaatattacgggacgccgcaaacgcgtaaagacagattcaaga

SEQ ID NO: 158931 - DNA, 75 bp, Artificial Sequence
  Synthetic
ctttcgttaatattacgggacgccgcaaacgcgtaaagacagattcaagactaacatttatcccaactgattaca

SEQ ID NO: 158932 - DNA, 75 bp, Artificial Sequence
  Synthetic
aaaatttatatttaacggcttttaatttgaagacacctatcctcttaacgttgatgagccttgcaggttgggtgc

SEQ ID NO: 158933 - DNA, 75 bp, Artificial Sequence
  Synthetic
tttgaagacacctatcctcttaacgttgatgagccttgcaggttgggtgccgcgcttcaccggtattatacataa

SEQ ID NO: 158934 - DNA, 75 bp, Artificial Sequence
  Synthetic
tgaccatttaccagtgtatgtctgtaatacgacgttgttgtgtcccgacaaaattaactcgcgtacaaatttctg

SEQ ID NO: 158935 - DNA, 75 bp, Artificial Sequence
  Synthetic
aatacgacgttgttgtgtcccgacaaaattaactcgcgtacaaatttctgatgttcccccggcgtggcaacgctg

SEQ ID NO: 158936 - DNA, 75 bp, Artificial Sequence
  Synthetic
gtacgtccatgaccgctattttcagtattaattggttggtcggtcaaagtattttccttatgtaaaaggacacga

SEQ ID NO: 158937 - DNA, 75 bp, Artificial Sequence
  Synthetic
tattaattggttggtcggtcaaagtattttccttatgtaaaaggacacgatctaaagccgtaaactcgtacacaa

SEQ ID NO: 158938 - DNA, 75 bp, Artificial Sequence
  Synthetic
tccgtccgttgagcgggtgtaatatcggcgaggtcttcttgcacgaatactctcgtacagtaggtttctgacacg

SEQ ID NO: 158939 - DNA, 75 bp, Artificial Sequence
  Synthetic
cggcgaggtcttcttgcacgaatactctcgtacagtaggtttctgacacggggtgcatgggttttttgacacaac

SEQ ID NO: 158940 - DNA, 75 bp, Artificial Sequence
  Synthetic
tggatggattgaatttatttttagatagggtcacgtgtttttgtcgtgacacgcctcgaccagaaaaggctgcgg

SEQ ID NO: 158941 - DNA, 75 bp, Artificial Sequence
  Synthetic
tagggtcacgtgtttttgtcgtgacacgcctcgaccagaaaaggctgcggttttcgtacacgcgaccgttatttc

SEQ ID NO: 158942 - DNA, 75 bp, Artificial Sequence
  Synthetic
cggatggtgtcggttaattgtctccgcccaagttcgtcaatagatgataccatgaacaacgtatcaaatggtaca

SEQ ID NO: 158943 - DNA, 75 bp, Artificial Sequence
  Synthetic
tagtcgtctttggttttctcaatacagcccgcgtgcccaatcggaaatttttcatttgcatcaacgctattttct

SEQ ID NO: 158944 - DNA, 75 bp, Artificial Sequence
  Synthetic
ggctggctacctgtttaaaatttgggatcgaacacggtccacgatgcaatccccaaccccattgaagcaatgccg

SEQ ID NO: 158945 - DNA, 75 bp, Artificial Sequence
  Synthetic
gatcgaacacggtccacgatgcaatccccaaccccattgaagcaatgccgtcggtacggaaggaggcaactccga

SEQ ID NO: 158946 - DNA, 75 bp, Artificial Sequence
  Synthetic
gattggagtgttatataacactccaatcgatctcgggttcgcctttacgcgtaaaatactcattggcttgaacga

SEQ ID NO: 158947 - DNA, 75 bp, Artificial Sequence
  Synthetic
atcgatctcgggttcgcctttacgcgtaaaatactcattggcttgaacgaaatgtcgacaattccgaaatggaac

SEQ ID NO: 158948 - DNA, 75 bp, Artificial Sequence
  Synthetic
tgtgttagcaccagatgacatcttgaattcggttgggttgtcttctgtgcatgcgcaccccacagcataaaaact

SEQ ID NO: 158949 - DNA, 75 bp, Artificial Sequence
  Synthetic
aattcggttgggttgtcttctgtgcatgcgcaccccacagcataaaaactaaccctgtacggttctcgcataacc

SEQ ID NO: 158950 - DNA, 75 bp, Artificial Sequence
  Synthetic
cccccagcctaagtatacatgcgaccccggagtcccgcgacgaaccgtaagcgtggtattcagcaataacacccc

SEQ ID NO: 158951 - DNA, 75 bp, Artificial Sequence
  Synthetic
cccggagtcccgcgacgaaccgtaagcgtggtattcagcaataacaccccctgccttgcccaactctccaggcat

SEQ ID NO: 158952 - DNA, 75 bp, Artificial Sequence
  Synthetic
ggtatgattccatgagggccgcaaaaatatttttaagactagacggtggtgttatgccacgttttacactaaacg

SEQ ID NO: 158953 - DNA, 75 bp, Artificial Sequence
  Synthetic
aatatttttaagactagacggtggtgttatgccacgttttacactaaacgctagcccatgtgcatgtcccgcggt

SEQ ID NO: 158954 - DNA, 75 bp, Artificial Sequence
  Synthetic
acaacgcgaatgctctggggtccgcaaaatcgcgtccatgcaaaaatatcgcctgtagatggaagtatttcttcc

SEQ ID NO: 158955 - DNA, 75 bp, Artificial Sequence
  Synthetic
aaaatcgcgtccatgcaaaaatatcgcctgtagatggaagtatttcttcccctgaatttaaaagacgattgtatt

SEQ ID NO: 158956 - DNA, 75 bp, Artificial Sequence
  Synthetic
ctctttaagttcgtccgacaacaggtcataccactcaggggaaatgttaaacttgctgaaaacttcaaccgaatc

SEQ ID NO: 158957 - DNA, 75 bp, Artificial Sequence
  Synthetic
tcataccactcaggggaaatgttaaacttgctgaaaacttcaaccgaatccagttgcgaagagacgggggtgaac

SEQ ID NO: 158958 - DNA, 75 bp, Artificial Sequence
  Synthetic
tgttatttaacttgaaggttggggggtctagcttaacccccaaaggcagcccgcggggtcgcttgcgggtttttt

SEQ ID NO: 158959 - DNA, 75 bp, Artificial Sequence
  Synthetic
gtctagcttaacccccaaaggcagcccgcggggtcgcttgcgggtttttttggtaaccggatgggccaaaacata

SEQ ID NO: 158960 - DNA, 75 bp, Artificial Sequence
  Synthetic
atttcattggcatacgcgttggaacaaacggtcggctccccagacacatccattttccgggatatttgtggaaga

SEQ ID NO: 158961 - DNA, 75 bp, Artificial Sequence
  Synthetic
aaacggtcggctccccagacacatccattttccgggatatttgtggaagatggagtagagtctacccatacaccg

SEQ ID NO: 158962 - DNA, 75 bp, Artificial Sequence
  Synthetic
gtatgtccccgcttttatgttcttcaccaacagattgtgccagcccctttaaggtgacgtatggatttgtccagt

SEQ ID NO: 158963 - DNA, 75 bp, Artificial Sequence
  Synthetic
accaacagattgtgccagcccctttaaggtgacgtatggatttgtccagtacgccatttgtttgtctttaaacca

SEQ ID NO: 158964 - DNA, 75 bp, Artificial Sequence
  Synthetic
tttgtcttaaccacgattcccgatagcgcctcgctgaggtttgataccgggggtgccgcatagtcccacgcctca

SEQ ID NO: 158965 - DNA, 75 bp, Artificial Sequence
  Synthetic
gcgcctcgctgaggtttgataccgggggtgccgcatagtcccacgcctcatataccgatgacacgcacggttccg

SEQ ID NO: 158966 - DNA, 75 bp, Artificial Sequence
  Synthetic
cggtttggctccaaaaaacaacggagtgtcgtcttggagatgaagacaatacgcgattgtgatagtttttaaaaa

SEQ ID NO: 158967 - DNA, 75 bp, Artificial Sequence
  Synthetic
gatgccatgacgcttgtgttttcccttcactacgacgttgtcgtatcctttgaaaaacttgaccactctaatgga

SEQ ID NO: 158968 - DNA, 75 bp, Artificial Sequence
  Synthetic
ttcactacgacgttgtcgtatcctttgaaaaacttgaccactctaatggaagcatggacaagtatgagttttata

SEQ ID NO: 158969 - DNA, 75 bp, Artificial Sequence
  Synthetic
tgaaaaacttgaccactctaatggaagcatggacaagtatgagttttatatatacagttggcctttagttaaact

SEQ ID NO: 158970 - DNA, 75 bp, Artificial Sequence
  Synthetic
ggcccagcccttctcgcggcccccttcttgagagagagagagaaaaaaaaaagcgaccccacctctccccgcgcg

SEQ ID NO: 158971 - DNA, 75 bp, Artificial Sequence
  Synthetic
aaaagggcgatcttaatatgtcaaacgtcacggcgtgccgacaaagcgaatttccatgcaagatttggatgtagt

SEQ ID NO: 158972 - DNA, 75 bp, Artificial Sequence
  Synthetic
cgtcacggcgtgccgacaaagcgaatttccatgcaagatttggatgtagtatttatacacccaatcacatgtcac

SEQ ID NO: 158973 - DNA, 75 bp, Artificial Sequence
  Synthetic
atctgatataatcacttttcttaacacgtcatcgggaaaacagatgtttatattatacctctcgcggtcatttat

SEQ ID NO: 158974 - DNA, 75 bp, Artificial Sequence
  Synthetic
ccaacggccattatcccttggatctgagattgatttgcggtaacgtttgccaaacccacgcatttcagtttaaat

SEQ ID NO: 158975 - DNA, 75 bp, Artificial Sequence
  Synthetic
ttggcagcgtgcttaaaatatcaaccaatatccattatgctacacgtttccttctatccgtttcaatccattaaa

SEQ ID NO: 158976 - DNA, 75 bp, Artificial Sequence
  Synthetic
cttctatccgtttcaatccattaaaagtccattaacaaaaatgatgcatcatacctaattcacctaaaaacctga

SEQ ID NO: 158977 - DNA, 75 bp, Artificial Sequence
  Synthetic
ctcattgcagcagcgtttcctccttgcagactatccagttggcattttaaacgggtccggctgcctaaaccgaaa

SEQ ID NO: 158978 - DNA, 75 bp, Artificial Sequence
  Synthetic
gcagactatccagttggcattttaaacgggtccggctgcctaaaccgaaaacaccgttgcctttactgtaagtac

SEQ ID NO: 158979 - DNA, 75 bp, Artificial Sequence
  Synthetic
gttgcgcggacgcctttctccgggatcgtggccttgggacatcaaccagtggaataagaaccgccggtggtcttg

SEQ ID NO: 158980 - DNA, 75 bp, Artificial Sequence
  Synthetic
gtattttgtaacatatatgccttttatccccccgcaagtttgctttaccctcgccttcaccacccccgccacctt

SEQ ID NO: 158981 - DNA, 75 bp, Artificial Sequence
  Synthetic
atccccccgcaagtttgctttaccctcgccttcaccacccccgccaccttccggccattttaataactttaattg

SEQ ID NO: 158982 - DNA, 75 bp, Artificial Sequence
  Synthetic
atttttgccgctggaaaaacagcttctaattttcccgtctcaactcggccttggttgcatctccaagtatacctt

SEQ ID NO: 158983 - DNA, 75 bp, Artificial Sequence
  Synthetic
aatacaaacggtgacaagtattgagcgtaatctcaaatttttgtaatttagggcggagcgcttacgacagcacat

SEQ ID NO: 158984 - DNA, 75 bp, Artificial Sequence
  Synthetic
ttgtatttgcagagcaggatgccccggttactccgagaccggattgcgggcattccgaatcgtgtacggacttac

SEQ ID NO: 158985 - DNA, 75 bp, Artificial Sequence
  Synthetic
ggttactccgagaccggattgcgggcattccgaatcgtgtacggacttaccagggggcagtatttacaccttggg

SEQ ID NO: 158986 - DNA, 75 bp, Artificial Sequence
  Synthetic
caatagcaacactcaggtatttttaaaatgcacgtttaatgatcataatttacatacagttggtaataaagcaga

SEQ ID NO: 158987 - DNA, 75 bp, Artificial Sequence
  Synthetic
aaatgcacgtttaatgatcataatttacatacagttggtaataaagcagactgtggatgtttaaggcatttcctt

SEQ ID NO: 158988 - DNA, 75 bp, Artificial Sequence
  Synthetic
ttcatcttgtttggaatacctttacccgctttaccggcagagctttttttggtaaggtgtttcagtgaacctgat

SEQ ID NO: 158989 - DNA, 75 bp, Artificial Sequence
  Synthetic
ccgctttaccggcagagctttttttggtaaggtgtttcagtgaacctgatgttgatccggaggtggagggggtat

SEQ ID NO: 158990 - DNA, 75 bp, Artificial Sequence
  Synthetic
tttgcgggttttacttcccttacatgccgaatcagactcagatgtcaggtctattgttaagcatcgtttaacgtc

SEQ ID NO: 158991 - DNA, 75 bp, Artificial Sequence
  Synthetic
aatcgggtatccctttcatcgccacgagaggtctccccggttgaggtggtttctggtcttacaattggacctgta

SEQ ID NO: 158992 - DNA, 75 bp, Artificial Sequence
  Synthetic
gagaggtctccccggttgaggtggtttctggtcttacaattggacctgtaattagttggatggctgtatctttcc

SEQ ID NO: 158993 - DNA, 75 bp, Artificial Sequence
  Synthetic
ggttggatcggtacatcgatccaacaagaataacatgtttgttacaaacggtcctgttgaatcatgcaaaagaca

SEQ ID NO: 158994 - DNA, 75 bp, Artificial Sequence
  Synthetic
aagaataacatgtttgttacaaacggtcctgttgaatcatgcaaaagacaacgcagggatgtttttaatcccgcc

SEQ ID NO: 158995 - DNA, 75 bp, Artificial Sequence
  Synthetic
agtttaatatcaacatttttgtaggctctacaatttcgggttgatacagttccgcaagttgatcatcaagccatc

SEQ ID NO: 158996 - DNA, 75 bp, Artificial Sequence
  Synthetic
ctctacaatttcgggttgatacagttccgcaagttgatcatcaagccatccgagtaaaggttgcatgtaacacgg

SEQ ID NO: 158997 - DNA, 75 bp, Artificial Sequence
  Synthetic
ctatccgtggctcgaaaaggcagtctgtccatggttcgtgggtcttgattaattcccacagatactggacgatca

SEQ ID NO: 158998 - DNA, 75 bp, Artificial Sequence
  Synthetic
tgtccatggttcgtgggtcttgattaattcccacagatactggacgatcacggtagtcctgccccccggtccggg

SEQ ID NO: 158999 - DNA, 75 bp, Artificial Sequence
  Synthetic
atacaccaccggggtcgccgatcgaacagcaggttggtctttaaaaaataccttccgtaaaaatgatgcggtaga

SEQ ID NO: 159000 - DNA, 75 bp, Artificial Sequence
  Synthetic
acagcaggttggtctttaaaaaataccttccgtaaaaatgatgcggtagagcatgttttggttacaccagggctc

SEQ ID NO: 159001 - DNA, 75 bp, Artificial Sequence
  Synthetic
aatcctgttgagagtcacttggtgactctgctgtgggctctctagccgacgattgaaggggcccagggtttggtg

SEQ ID NO: 159002 - DNA, 75 bp, Artificial Sequence
  Synthetic
ctctgctgtgggctctctagccgacgattgaaggggcccagggtttggtgattgaatgggctcccgactcgatct

SEQ ID NO: 159003 - DNA, 75 bp, Artificial Sequence
  Synthetic
cgactcggtcctgggcttggtggcagaagatctatgacatctcccggtaggatgtcgatggaatcttcaaatgac

SEQ ID NO: 159004 - DNA, 75 bp, Artificial Sequence
  Synthetic
gaagatctatgacatctcccggtaggatgtcgatggaatcttcaaatgacggctcagaaaaaccatcgtcgtcgg

SEQ ID NO: 159005 - DNA, 75 bp, Artificial Sequence
  Synthetic
acttgtatcacttacgatcttatgcaggatggattgcactggacaccggcagagaggacactggacgctggtgga

SEQ ID NO: 159006 - DNA, 75 bp, Artificial Sequence
  Synthetic
aggatggattgcactggacaccggcagagaggacactggacgctggtggaggtccatgcccgaatacaaacaaag

SEQ ID NO: 159007 - DNA, 75 bp, Artificial Sequence
  Synthetic
tttttccgagatcggaaacggtgctcatgcatatggtgcaggtattatccgaagcgtcggaggtgccgctaccgc

SEQ ID NO: 159008 - DNA, 75 bp, Artificial Sequence
  Synthetic
catgcatatggtgcaggtattatccgaagcgtcggaggtgccgctaccgcccgctaatatggtatccatggtaac

SEQ ID NO: 159009 - DNA, 75 bp, Artificial Sequence
  Synthetic
catccaaacacgtagcagaactgccatgcgttctaaattgtgagttgtggcgagtacatttttataattggtacc

SEQ ID NO: 159010 - DNA, 75 bp, Artificial Sequence
  Synthetic
atgcgttctaaattgtgagttgtggcgagtacatttttataattggtaccaacgaagacacacccctatatccct

SEQ ID NO: 159011 - DNA, 75 bp, Artificial Sequence
  Synthetic
cactaaaacgtgggtataaaatgtgtattggggtaggcggacagtcccaacaaacagggaagttgattggtataa

SEQ ID NO: 159012 - DNA, 75 bp, Artificial Sequence
  Synthetic
tattggggtaggcggacagtcccaacaaacagggaagttgattggtataaccttgggccgggtatacagctaagt

SEQ ID NO: 159013 - DNA, 75 bp, Artificial Sequence
  Synthetic
agataaagagcgatacgaagacatttctccacccccctgtaatacccgtaaataaaggtaagtccacaaacaaaa

SEQ ID NO: 159014 - DNA, 75 bp, Artificial Sequence
  Synthetic
tctccacccccctgtaatacccgtaaataaaggtaagtccacaaacaaaagcactgtatataggaagtcgggtgt

SEQ ID NO: 159015 - DNA, 75 bp, Artificial Sequence
  Synthetic
cgtacagacaatactgggatagggtaatgcaagtcccccccgatggtcgccccgcaaacgcgcggggaggtgggg

SEQ ID NO: 159016 - DNA, 75 bp, Artificial Sequence
  Synthetic
gggggtccgaccagcccgcccgtcgcccgcccgcacagacagacagacacttttttcataaaaaccgttccgctt

SEQ ID NO: 159017 - DNA, 75 bp, Artificial Sequence
  Synthetic
gggactccgtcacccccgactctgcggggggctcctccccccgcgccctccccacacatcgtcctcgtcctcgga

SEQ ID NO: 159018 - DNA, 75 bp, Artificial Sequence
  Synthetic
ggggggctcctccccccgcgccctccccacacatcgtcctcgtcctcggaggacgaggacgaggacaacagctcc

SEQ ID NO: 159019 - DNA, 75 bp, Artificial Sequence
  Synthetic
cccggcggtctcgcagcacacccggggccaccgacacgatgctcaccccaaaggatgaccccggtgcgtccccgt

SEQ ID NO: 159020 - DNA, 75 bp, Artificial Sequence
  Synthetic
cgttccgagcccccgtggtgtccgaacacgaaccgtgttccgtcgctcccctccaacaccgtctccgcggcccca

SEQ ID NO: 159021 - DNA, 75 bp, Artificial Sequence
  Synthetic
acacgaaccgtgttccgtcgctcccctccaacaccgtctccgcggccccaaaaccgggcggccacattactctgg

SEQ ID NO: 159022 - DNA, 75 bp, Artificial Sequence
  Synthetic
ctcgtccgccgacgcatacagcgccaccgaccgaccggccacgggtggaagcacgagtggttctgcggcagggtc

SEQ ID NO: 159023 - DNA, 75 bp, Artificial Sequence
  Synthetic
accgaccgaccggccacgggtggaagcacgagtggttctgcggcagggtcgggttccagcagggcgtggcggcaa

SEQ ID NO: 159024 - DNA, 75 bp, Artificial Sequence
  Synthetic
cgccggcctccggcccggcggcccccggtctccgtccctcgggaaggaagacgggtcgaagcgcggcacccaggc

SEQ ID NO: 159025 - DNA, 75 bp, Artificial Sequence
  Synthetic
gtctcccgttcaagttgttagaagttccaaatgtaaaaaaatgcccgtccagcccgtccagcccgcgcagcccgc

SEQ ID NO: 159026 - DNA, 75 bp, Artificial Sequence
  Synthetic
cggtattcacggggcgacagggggacgcgggtcttggggcccgcgcgggtacacacggtgtatgcgacgttccca

SEQ ID NO: 159027 - DNA, 75 bp, Artificial Sequence
  Synthetic
cgcgggtcttggggcccgcgcgggtacacacggtgtatgcgacgttcccaccgcggcacaaacacaggggttgtt

SEQ ID NO: 159028 - DNA, 75 bp, Artificial Sequence
  Synthetic
agtctcgatacgagcaaaactcgctggcccaaaggtgcgcgacgatgcaaacacggcccgggcgagtccttctgt

SEQ ID NO: 159029 - DNA, 75 bp, Artificial Sequence
  Synthetic
ggcccaaaggtgcgcgacgatgcaaacacggcccgggcgagtccttctgtgaccgccgagtctggccatcggacg

SEQ ID NO: 159030 - DNA, 75 bp, Artificial Sequence
  Synthetic
gggcccggacgtacacgtgatactgagacaaagcgggtccatccctgggccacctctcgagggccaccgcgtcca

SEQ ID NO: 159031 - DNA, 75 bp, Artificial Sequence
  Synthetic
agacaaagcgggtccatccctgggccacctctcgagggccaccgcgtccaacaccagcaaccggcgccgggcaga

SEQ ID NO: 159032 - DNA, 75 bp, Artificial Sequence
  Synthetic
acggccccggcaaaggccaggtctcgggtcgacagtaataaaacgccccgggcgttcaaagcggacacgtccggc

SEQ ID NO: 159033 - DNA, 75 bp, Artificial Sequence
  Synthetic
gggtcgacagtaataaaacgccccgggcgttcaaagcggacacgtccggcgggccggtccagttcccggcccagg

SEQ ID NO: 159034 - DNA, 75 bp, Artificial Sequence
  Synthetic
gttactcagggctgccaggaccacagacagtccccctcgggatggactccatgacggtcccggatctgtcgcgag

SEQ ID NO: 159035 - DNA, 75 bp, Artificial Sequence
  Synthetic
gacagtccccctcgggatggactccatgacggtcccggatctgtcgcgagggtgctctcgagggggccgttgatg

SEQ ID NO: 159036 - DNA, 75 bp, Artificial Sequence
  Synthetic
tgatcagaagcctcacatcctccgggtctgggatctgccgcatccaggcgcacctccgtcgcagcgcctccactc

SEQ ID NO: 159037 - DNA, 75 bp, Artificial Sequence
  Synthetic
gtctgggatctgccgcatccaggcgcacctccgtcgcagcgcctccactccgctgggtggaccaaaccgtcggtc

SEQ ID NO: 159038 - DNA, 75 bp, Artificial Sequence
  Synthetic
atttccgccaaggcgccgggatcaaagcttagcgcagggcgccaggccgtgggaaacaatgggtcgtcgaccaga

SEQ ID NO: 159039 - DNA, 75 bp, Artificial Sequence
  Synthetic
agcttagcgcagggcgccaggccgtgggaaacaatgggtcgtcgaccagacgggcgatggtttcgggggtacagt

SEQ ID NO: 159040 - DNA, 75 bp, Artificial Sequence
  Synthetic
gaccggggtatgcagggccccccggggaatacgccgaaatcccccgtttggggccggtccgtcaagtggcatcgt

SEQ ID NO: 159041 - DNA, 75 bp, Artificial Sequence
  Synthetic
ggaatacgccgaaatcccccgtttggggccggtccgtcaagtggcatcgttattacggcggggggatccaccaca

SEQ ID NO: 159042 - DNA, 75 bp, Artificial Sequence
  Synthetic
cggatacccgcctcttggccttggaaaccacatgatcgtctgcaacccgggcgtccgcgacgggtgtctccctaa

SEQ ID NO: 159043 - DNA, 75 bp, Artificial Sequence
  Synthetic
aaccacatgatcgtctgcaacccgggcgtccgcgacgggtgtctccctaatcttgtcgaggaggcttctgctctc

SEQ ID NO: 159044 - DNA, 75 bp, Artificial Sequence
  Synthetic
ggagttcgtaaacgatcatccggtggacacacagaaagagagcgtgcggcggccgacggctgagggtcgggagtc

SEQ ID NO: 159045 - DNA, 75 bp, Artificial Sequence
  Synthetic
gacacacagaaagagagcgtgcggcggccgacggctgagggtcgggagtctgtgtggccggggttgttggagaag

SEQ ID NO: 159046 - DNA, 75 bp, Artificial Sequence
  Synthetic
cggactggagcccgttgcctcggggtatgccatgctggcaaaggctctgcggagactctgtaggataaagtgttt

SEQ ID NO: 159047 - DNA, 75 bp, Artificial Sequence
  Synthetic
ggagactctgtaggataaagtgtttttgggcccggtcgtatcgacggctcatagccacggccgcggccgcgtggg

SEQ ID NO: 159048 - DNA, 75 bp, Artificial Sequence
  Synthetic
ggagagcccagagggcctcccccgtggccatggcttcgcctacatgcggaacgggagacgctacgctccccgtaa

SEQ ID NO: 159049 - DNA, 75 bp, Artificial Sequence
  Synthetic
ggccatggcttcgcctacatgcggaacgggagacgctacgctccccgtaacggcggtacccgcccgtcccggtgg

SEQ ID NO: 159050 - DNA, 75 bp, Artificial Sequence
  Synthetic
agggccgagttgacaccggtcagcttggggttctggagccatgctatagggtctctgtctggacagtagatcagg

SEQ ID NO: 159051 - DNA, 75 bp, Artificial Sequence
  Synthetic
gtctctgtctggacagtagatcaggttaatcagcgcgcggtactgtctagccggatctcccaactccggcacgta

SEQ ID NO: 159052 - DNA, 75 bp, Artificial Sequence
  Synthetic
tcgtaacgagcccgcgccgctctcacagcctcatcctcccagtgaccctctctggtctccccggacggtccaaac

SEQ ID NO: 159053 - DNA, 75 bp, Artificial Sequence
  Synthetic
cagcctcatcctcccagtgaccctctctggtctccccggacggtccaaaccgcaccctgttggatgggaggggtg

SEQ ID NO: 159054 - DNA, 75 bp, Artificial Sequence
  Synthetic
gggcatcatgagcggccccgacaccgggggaattatcggggttctggatcgcggcagggaaaatgatttctgtct

SEQ ID NO: 159055 - DNA, 75 bp, Artificial Sequence
  Synthetic
gggggaattatcggggttctggatcgcggcagggaaaatgatttctgtctctggcgccccggttcccccgcaaga

SEQ ID NO: 159056 - DNA, 75 bp, Artificial Sequence
  Synthetic
cgggaccgctgatggatcgatatcccggttggatattttgtttcgtcgacccaccatcatttgagtccgaatcat

SEQ ID NO: 159057 - DNA, 75 bp, Artificial Sequence
  Synthetic
cggttggatattttgtttcgtcgacccaccatcatttgagtccgaatcatccgaatttgacggggaaggggcgtg

SEQ ID NO: 159058 - DNA, 75 bp, Artificial Sequence
  Synthetic
gtttcacttcccaccgaaacgcgccggggttcatcgtcttcatcctccgatgacgatccccacgacgaggaagag

SEQ ID NO: 159059 - DNA, 75 bp, Artificial Sequence
  Synthetic
ggggttcatcgtcttcatcctccgatgacgatccccacgacgaggaagaggatgaagacgaaacaaactcacgac

SEQ ID NO: 159060 - DNA, 75 bp, Artificial Sequence
  Synthetic
gtcatcctcaatcgggtctggtgcgtgggatcttcccggcagggccaaaaacgctctaggtttgccccccgacga

SEQ ID NO: 159061 - DNA, 75 bp, Artificial Sequence
  Synthetic
acgtccagggacgcgaggtgttataccccgggcatcatgtttccttgggcgggtatcatcggtctcaaacggcag

SEQ ID NO: 159062 - DNA, 75 bp, Artificial Sequence
  Synthetic
acgctgtccgaaaggacgtggtacaattgctcaaccgggccgggtacaggtccaccgggtttccgcgccgggagt

SEQ ID NO: 159063 - DNA, 75 bp, Artificial Sequence
  Synthetic
attgctcaaccgggccgggtacaggtccaccgggtttccgcgccgggagtgggaccttaaccttcaaagtctttt

SEQ ID NO: 159064 - DNA, 75 bp, Artificial Sequence
  Synthetic
ccgttgagttttctggagaactactccgtcccccgatgcatgcgcatgacccgcttgctcatcgcccggcttttt

SEQ ID NO: 159065 - DNA, 75 bp, Artificial Sequence
  Synthetic
ccgtcccccgatgcatgcgcatgacccgcttgctcatcgcccggctttttacccgagatggactgagtttgtctg

SEQ ID NO: 159066 - DNA, 75 bp, Artificial Sequence
  Synthetic
ctggtgaatttcctctcgtcgtttgtcggggtatagaccgctggtcttcccgttgatcgttcccggcggcgtctc

SEQ ID NO: 159067 - DNA, 75 bp, Artificial Sequence
  Synthetic
tcggggtatagaccgctggtcttcccgttgatcgttcccggcggcgtctccaacaggagacgcgggggatacagg

SEQ ID NO: 159068 - DNA, 75 bp, Artificial Sequence
  Synthetic
gtcgtacctctgcccgtttccccatcgttcatcggtggttttggagacctagcaagcttcgttccgagagagact

SEQ ID NO: 159069 - DNA, 75 bp, Artificial Sequence
  Synthetic
gtctcgagggagcgatcggctcctgttggttctcgcgcgccggcctccgagaatcgggtgtggaagacctcggcc

SEQ ID NO: 159070 - DNA, 75 bp, Artificial Sequence
  Synthetic
gaatcgggtgtggaagacctcggccagcgggattacaggcgagcccattagatcctgaccgtcctcgcatacgta

SEQ ID NO: 159071 - DNA, 75 bp, Artificial Sequence
  Synthetic
agcgggattacaggcgagcccattagatcctgaccgtcctcgcatacgtagtcgtcttgtgttagctcttcgcca

SEQ ID NO: 159072 - DNA, 75 bp, Artificial Sequence
  Synthetic
gaagtcccgatacggagggaattgaaacgatctcatgttcccgtcccaccatgaccccgttctctccaaatagta

SEQ ID NO: 159073 - DNA, 75 bp, Artificial Sequence
  Synthetic
aacgatctcatgttcccgtcccaccatgaccccgttctctccaaatagtagatcgtcaggctgactcgaggtgac

SEQ ID NO: 159074 - DNA, 75 bp, Artificial Sequence
  Synthetic
gcggcggccgcgtccaacaggtccattaactccaaagtatcaggcgaccccgcgcgttggggtgtagagcgctgc

SEQ ID NO: 159075 - DNA, 75 bp, Artificial Sequence
  Synthetic
ttaactccaaagtatcaggcgaccccgcgcgttggggtgtagagcgctgcatcggcggcgtatccatcgcactgg

SEQ ID NO: 159076 - DNA, 75 bp, Artificial Sequence
  Synthetic
tccaaacgctctcgcagccttcaaaggattgcgattgcggttggtgagggagttccaacagtacttaaaacgtgt

SEQ ID NO: 159077 - DNA, 75 bp, Artificial Sequence
  Synthetic
tcctccccgtgtcgtcaccgtgtaaatattcttaatgataagacgatgtagtgattggacgagactcgaggcggg

SEQ ID NO: 159078 - DNA, 75 bp, Artificial Sequence
  Synthetic
atattcttaatgataagacgatgtagtgattggacgagactcgaggcgggaagttcatggaccatagtatgcgtt

SEQ ID NO: 159079 - DNA, 75 bp, Artificial Sequence
  Synthetic
gtgattggacgagactcgaggcgggaagttcatggaccatagtatgcgtttaaggagagaccgctggttggcgat

SEQ ID NO: 159080 - DNA, 75 bp, Artificial Sequence
  Synthetic
accttacaacatcataacaagggataccagacatgtgaatttcatttacatatgtttaaataacaaccaatcatc

SEQ ID NO: 159081 - DNA, 75 bp, Artificial Sequence
  Synthetic
accagacatgtgaatttcatttacatatgtttaaataacaaccaatcatcgtgtgtctacagacgatatataata

SEQ ID NO: 159082 - DNA, 75 bp, Artificial Sequence
  Synthetic
cacatgcaaaacatcttatataacacgggttgtttccacccatccggcatctagttaatcaaatgcacgtcgacg

SEQ ID NO: 159083 - DNA, 75 bp, Artificial Sequence
  Synthetic
ccgcgataacccataaaatacacacggggttgtggtgttcacgtaaccccccgccgatggggagggggcgcggta

SEQ ID NO: 159084 - DNA, 75 bp, Artificial Sequence
  Synthetic
ccgccgatggggagggggcgcggtaccccgccgatggggagggggcgcggtaccccgccgatggggagggggcgc

SEQ ID NO: 159085 - DNA, 75 bp, Artificial Sequence
  Synthetic
gcggtaccccgccgatggggagggggcgcggtaccccgccgatgtttataaccataattctctaaaccgttgtag

SEQ ID NO: 159086 - DNA, 75 bp, Artificial Sequence
  Synthetic
aacaagtcgaagaacttcatatctgaggcatgtaaacccattcgcacttcctggggtggaatggggtggggtggg

SEQ ID NO: 159087 - DNA, 75 bp, Artificial Sequence
  Synthetic
ctggggtggaatggggtggggtgggggggtgaaaaagggggggggttaaattgggcgtccgcatgtctgtggtgt

SEQ ID NO: 159088 - DNA, 75 bp, Artificial Sequence
  Synthetic
tcgaaggtctcccgccccggaatcccccattgccattttacccaagtagccttattcatagatgtaaacgtttgg

SEQ ID NO: 159089 - DNA, 75 bp, Artificial Sequence
  Synthetic
cccattgccattttacccaagtagccttattcatagatgtaaacgtttgggtgtgtgttttgttgtgcagggttc

SEQ ID NO: 159090 - DNA, 75 bp, Artificial Sequence
  Synthetic
gagtcggttttaagggaaaaggttactacggccccaaggacatgttttgcacctcaccggctacgcggggcgact

SEQ ID NO: 159091 - DNA, 75 bp, Artificial Sequence
  Synthetic
ctacggccccaaggacatgttttgcacctcaccggctacgcggggcgactcgtccgagtcaaaacccggggcatc

SEQ ID NO: 159092 - DNA, 75 bp, Artificial Sequence
  Synthetic
tatggatctgcaccaggacccctgaacggccgggatacgtcgcggggccccggcgcgttttgtactccgggttgg

SEQ ID NO: 159093 - DNA, 75 bp, Artificial Sequence
  Synthetic
acggccgggatacgtcgcggggccccggcgcgttttgtactccgggttgggagatccacccggccaggctcgttg

SEQ ID NO: 159094 - DNA, 75 bp, Artificial Sequence
  Synthetic
tattgcacagtcgtcgggacgcgtcacgcgagattcacgaagattgcggcgcatatgcctcgacttttatctaat

SEQ ID NO: 159095 - DNA, 75 bp, Artificial Sequence
  Synthetic
acgcgagattcacgaagattgcggcgcatatgcctcgacttttatctaatgggtcgcaccagacagcgtcccacg

SEQ ID NO: 159096 - DNA, 75 bp, Artificial Sequence
  Synthetic
agcttcaacccacccagacgcagtgcttacgcgctactttaatggaagtgtcccatcgaccccctcggggggaag

SEQ ID NO: 159097 - DNA, 75 bp, Artificial Sequence
  Synthetic
cttacgcgctactttaatggaagtgtcccatcgaccccctcggggggaagacgggttcattgaggcgccgaatgt

SEQ ID NO: 159098 - DNA, 75 bp, Artificial Sequence
  Synthetic
tgtgacgtatctgatgatggtggtgaagacgatagcgacgatgatgggtctacgccatcggatgtaattgaattt

SEQ ID NO: 159099 - DNA, 75 bp, Artificial Sequence
  Synthetic
aagacgatagcgacgatgatgggtctacgccatcggatgtaattgaatttcgggattccgacgcggaatcatcgg

SEQ ID NO: 159100 - DNA, 75 bp, Artificial Sequence
  Synthetic
agaatcagaggagagcaccgattcttgtgaaccagacggggtacccggcgattgttatcgagacggggatgggtg

SEQ ID NO: 159101 - DNA, 75 bp, Artificial Sequence
  Synthetic
tgtgaaccagacggggtacccggcgattgttatcgagacggggatgggtgcaacaccccgtccccaaagagaccc

SEQ ID NO: 159102 - DNA, 75 bp, Artificial Sequence
  Synthetic
gtgcagaaaccgcggaatatacagccgcgaaagcgctcaccgcgttgggcgaggggggtgtagattggaagcgac

SEQ ID NO: 159103 - DNA, 75 bp, Artificial Sequence
  Synthetic
cgcgaaagcgctcaccgcgttgggcgaggggggtgtagattggaagcgacgtcgacacgaagccccgcgccggca

SEQ ID NO: 159104 - DNA, 75 bp, Artificial Sequence
  Synthetic
tagtctttataaataaatacaatggtttggctcgtgtctttttttgatgtctgtctgtgggggagtggggtgttg

SEQ ID NO: 159105 - DNA, 75 bp, Artificial Sequence
  Synthetic
tttggctcgtgtctttttttgatgtctgtctgtgggggagtggggtgttgtggatattagagggtagagggtgct

SEQ ID NO: 159106 - DNA, 75 bp, Artificial Sequence
  Synthetic
ggggtccccacacgggccgtgtggtatgaatctctgcggatcccgcggtgagcacccgggcggtgaatatgccgg

SEQ ID NO: 159107 - DNA, 75 bp, Artificial Sequence
  Synthetic
atgaatctctgcggatcccgcggtgagcacccgggcggtgaatatgccggactttactgcacacgacacgatacc

SEQ ID NO: 159108 - DNA, 75 bp, Artificial Sequence
  Synthetic
acgccgaacggtacttcgccgccgcgctatgcgccatatctaccgaggcctacgaggcttttatacacagcccct

SEQ ID NO: 159109 - DNA, 75 bp, Artificial Sequence
  Synthetic
gctatgcgccatatctaccgaggcctacgaggcttttatacacagcccctccgagagaccgtgcgcgagtttgtg

SEQ ID NO: 159110 - DNA, 75 bp, Artificial Sequence
  Synthetic
cggatgtgcggggagctcgcagcggatagacaacgtccaccctcggttccgccgatccgcagagcggtgttatcg

SEQ ID NO: 159111 - DNA, 75 bp, Artificial Sequence
  Synthetic
atagacaacgtccaccctcggttccgccgatccgcagagcggtgttatcgttattacgcgagcaatgcatgccgg

SEQ ID NO: 159112 - DNA, 75 bp, Artificial Sequence
  Synthetic
cgagcggctgatattgatggcatattggtgctgtttgggacacgccggacttccgactattggattgtcgcccga

SEQ ID NO: 159113 - DNA, 75 bp, Artificial Sequence
  Synthetic
tggtgctgtttgggacacgccggacttccgactattggattgtcgcccgataataaatgcatccgcgccgaatta

SEQ ID NO: 159114 - DNA, 75 bp, Artificial Sequence
  Synthetic
acaggctttttgacgcgtacctgggctgcgggtcccttggagtcccaagaacctacgagagatcctgacacccca

SEQ ID NO: 159115 - DNA, 75 bp, Artificial Sequence
  Synthetic
aatttaaaacatacaccggataaaagcgtactgttttttatttaaatttacacgctcgacgttgccccggttcgg

SEQ ID NO: 159116 - DNA, 75 bp, Artificial Sequence
  Synthetic
accgtgtaactcgaacccccgtgactccctccaatcgcgttaccaaactcttcttccgtatccgtagattccgag

SEQ ID NO: 159117 - DNA, 75 bp, Artificial Sequence
  Synthetic
tcctcgaaatcgtccacttatccaacaaattgtgacgttatatatcccaaggcaaaggccgctcccgtcatagca

SEQ ID NO: 159118 - DNA, 75 bp, Artificial Sequence
  Synthetic
tataacagaattttttacgatgatatattttatgttgatattttccaattcgacgcaaaaattcatctgccgttt

SEQ ID NO: 159119 - DNA, 75 bp, Artificial Sequence
  Synthetic
tattttatgttgatattttccaattcgacgcaaaaattcatctgccgtttcattttcgctatcactataataaca

SEQ ID NO: 159120 - DNA, 75 bp, Artificial Sequence
  Synthetic
atggctgttatcgttgtattatttggttgcgctcgcggggttaccaccgcttccatcagtaaggccacggcctca

SEQ ID NO: 159121 - DNA, 75 bp, Artificial Sequence
  Synthetic
gttgcgctcgcggggttaccaccgcttccatcagtaaggccacggcctcaccctccatggtgttttgtccggcca

SEQ ID NO: 159122 - DNA, 75 bp, Artificial Sequence
  Synthetic
aggctagtttaaaagtgtttaataccacaccttttgatatttatatacatgcaagattctagattattcatcaat

SEQ ID NO: 159123 - DNA, 75 bp, Artificial Sequence
  Synthetic
aacattgtcagctataccgacattctcacaaagaggtaaagttaccttacgttattattaaataaaacatgtaga

SEQ ID NO: 159124 - DNA, 75 bp, Artificial Sequence
  Synthetic
tcacaaagaggtaaagttaccttacgttattattaaataaaacatgtagacattattaataatcctaggaacaat

SEQ ID NO: 159125 - DNA, 75 bp, Artificial Sequence
  Synthetic
caaatccatatttgtaagttatgtttaacccctcccctttttgtcattatctccgccctcttataatcggatcac

SEQ ID NO: 159126 - DNA, 75 bp, Artificial Sequence
  Synthetic
tttgtacagttgttggacaacaggtttttggttcattaacactatcaacataagtcggggtatacaagtataatg

SEQ ID NO: 159127 - DNA, 75 bp, Artificial Sequence
  Synthetic
ttttggttcattaacactatcaacataagtcggggtatacaagtataatgaacgacgttgatgcaacagacacct

SEQ ID NO: 159128 - DNA, 75 bp, Artificial Sequence
  Synthetic
cgccatctcaacatcaccgtcacatattatgcaaacatgtgggtttatacaacagatgtttccagttgaaatgtc

SEQ ID NO: 159129 - DNA, 75 bp, Artificial Sequence
  Synthetic
attatgcaaacatgtgggtttatacaacagatgtttccagttgaaatgtcgcccggcatagaatctgaggatgat

SEQ ID NO: 159130 - DNA, 75 bp, Artificial Sequence
  Synthetic
tacagtcttttaatatatttgatggtgtccacgaaactgaagccgaagcctctgtggcattgtgcgcagaagcac

SEQ ID NO: 159131 - DNA, 75 bp, Artificial Sequence
  Synthetic
gcgttggaattaataaagcgggatttgtaatattaaaaacgtttacaccaggggcggaaggttttgcgtttgcgt

SEQ ID NO: 159132 - DNA, 75 bp, Artificial Sequence
  Synthetic
tgtggtcattaaagcgggtcaacgtcaaggaacggccaccgaggcaaccgtgttaagagcgttaacccacccatc

SEQ ID NO: 159133 - DNA, 75 bp, Artificial Sequence
  Synthetic
caaggaacggccaccgaggcaaccgtgttaagagcgttaacccacccatccgttgtacagcttaaaggaacgttt

SEQ ID NO: 159134 - DNA, 75 bp, Artificial Sequence
  Synthetic
tattaccacgttaccgaacagatttatactgctatctagctgcaaagcgcaacctccccatatgtgacattttag

SEQ ID NO: 159135 - DNA, 75 bp, Artificial Sequence
  Synthetic
atactgctatctagctgcaaagcgcaacctccccatatgtgacattttagcaattcagcgatctgtattacgcgc

SEQ ID NO: 159136 - DNA, 75 bp, Artificial Sequence
  Synthetic
attattcaccgtgatataaaatctgaaaatatatttattaaccacccaggtgatgtttgtgtgggagactttgga

SEQ ID NO: 159137 - DNA, 75 bp, Artificial Sequence
  Synthetic
aaaatatatttattaaccacccaggtgatgtttgtgtgggagactttggagcagcgtgtttccccgtggatatta

SEQ ID NO: 159138 - DNA, 75 bp, Artificial Sequence
  Synthetic
tggaacaatcaccacaaactctcctgagttattggctagagatccatatggacctgccgtggacatatggagtgc

SEQ ID NO: 159139 - DNA, 75 bp, Artificial Sequence
  Synthetic
gagttattggctagagatccatatggacctgccgtggacatatggagtgccgggattgtattatttgaaatggct

SEQ ID NO: 159140 - DNA, 75 bp, Artificial Sequence
  Synthetic
gagacggtttagatggcaattgtgacagtgagcgtcaaattaaacttattatacgacgatctggaactcatccca

SEQ ID NO: 159141 - DNA, 75 bp, Artificial Sequence
  Synthetic
cagtgagcgtcaaattaaacttattatacgacgatctggaactcatcccaatgaatttcccattaaccctacatc

SEQ ID NO: 159142 - DNA, 75 bp, Artificial Sequence
  Synthetic
ttggcaaaacggtcttctcgaaaacccggatccaggccattgtggacaaatctatatgagttgccaattgatttg

SEQ ID NO: 159143 - DNA, 75 bp, Artificial Sequence
  Synthetic
ccggatccaggccattgtggacaaatctatatgagttgccaattgatttggagtatttgatatgtaagatgttat

SEQ ID NO: 159144 - DNA, 75 bp, Artificial Sequence
  Synthetic
ggcagaggtgttgcttaaccactctgttttccaaactcttcccgatccatatccaaatccaatggaagttggaga

SEQ ID NO: 159145 - DNA, 75 bp, Artificial Sequence
  Synthetic
gttttccaaactcttcccgatccatatccaaatccaatggaagttggagattaaaattcattaagcctgttaata

SEQ ID NO: 159146 - DNA, 75 bp, Artificial Sequence
  Synthetic
acgtataacccgttaaggcaaatagggtacaaacgcgcaatgttttgaaatactaatataaataacataaccaat

SEQ ID NO: 159147 - DNA, 75 bp, Artificial Sequence
  Synthetic
ggtacaaacgcgcaatgttttgaaatactaatataaataacataaccaatagaaacttaatacagagtcacgccc

SEQ ID NO: 159148 - DNA, 75 bp, Artificial Sequence
  Synthetic
atcattttcttaacattgtagtagcgctgaaaagcgtcccctcccccggctcacagagctgctcttcggtgtagt

SEQ ID NO: 159149 - DNA, 75 bp, Artificial Sequence
  Synthetic
gctgaaaagcgtcccctcccccggctcacagagctgctcttcggtgtagttgggtatactggtgcgcctcattta

SEQ ID NO: 159150 - DNA, 75 bp, Artificial Sequence
  Synthetic
tgatatcggccgttatattttacatacaagtgaccaacgctttgatcttcaagggcgaccacgtgagcttgcaag

SEQ ID NO: 159151 - DNA, 75 bp, Artificial Sequence
  Synthetic
acaagtgaccaacgctttgatcttcaagggcgaccacgtgagcttgcaagttaacagcagtctcacgtctatcct

SEQ ID NO: 159152 - DNA, 75 bp, Artificial Sequence
  Synthetic
acagagataaaaggacagcttgtctttattggagagcaactacctaccgggacaaactatagcggaacactggaa

SEQ ID NO: 159153 - DNA, 75 bp, Artificial Sequence
  Synthetic
ttattggagagcaactacctaccgggacaaactatagcggaacactggaactgttatacgcggatacggtggcgt

SEQ ID NO: 159154 - DNA, 75 bp, Artificial Sequence
  Synthetic
aagatacgacggatgtccccggattagaacgagcgcttttatttcgtgtaggtacaaacattcgtggcattatgg

SEQ ID NO: 159155 - DNA, 75 bp, Artificial Sequence
  Synthetic
agaacgagcgcttttatttcgtgtaggtacaaacattcgtggcattatggtaactcaacggatcggatatcaaca

SEQ ID NO: 159156 - DNA, 75 bp, Artificial Sequence
  Synthetic
aaattaccaaaccgggaataaatgatgctggtgtgtatgtacttcttgttcggttagaccatagcagatccaccg

SEQ ID NO: 159157 - DNA, 75 bp, Artificial Sequence
  Synthetic
tgctggtgtgtatgtacttcttgttcggttagaccatagcagatccaccgatggtttcattcttggtgtaaatgt

SEQ ID NO: 159158 - DNA, 75 bp, Artificial Sequence
  Synthetic
attcacggggttatctacacttctccgtctctacagaatggatattctacaagagccctttttcaacaagctcgt

SEQ ID NO: 159159 - DNA, 75 bp, Artificial Sequence
  Synthetic
cgtctctacagaatggatattctacaagagccctttttcaacaagctcgtttgtgtgatttacccgcgacaccca

SEQ ID NO: 159160 - DNA, 75 bp, Artificial Sequence
  Synthetic
acatatgcttgatcttcgtgccggtaaatcgttagaggataacccttggttacatgaggacgttgttacgacaga

SEQ ID NO: 159161 - DNA, 75 bp, Artificial Sequence
  Synthetic
aaatcgttagaggataacccttggttacatgaggacgttgttacgacagaaactaagtccgttgttaaggagggg

SEQ ID NO: 159162 - DNA, 75 bp, Artificial Sequence
  Synthetic
atatgtccacgttacccgaaaagtcccttaatgatcctccagaaaatctacttataattattcctatagtagcgt

SEQ ID NO: 159163 - DNA, 75 bp, Artificial Sequence
  Synthetic
ccttaatgatcctccagaaaatctacttataattattcctatagtagcgtctgtcatgatcctcaccgccatggt

SEQ ID NO: 159164 - DNA, 75 bp, Artificial Sequence
  Synthetic
cgacgtagaattaaaaaacatccaatttatcgcccaaatacaaaaacaagaaggggcatacaaaatgcgacacca

SEQ ID NO: 159165 - DNA, 75 bp, Artificial Sequence
  Synthetic
tttatcgcccaaatacaaaaacaagaaggggcatacaaaatgcgacaccagaatccgatgtgatgttggaggccg

SEQ ID NO: 159166 - DNA, 75 bp, Artificial Sequence
  Synthetic
cgaagaatcccccccacattccgttgtaaacccgtttgttaaatagaactaattatcccggattttatattaaat

SEQ ID NO: 159167 - DNA, 75 bp, Artificial Sequence
  Synthetic
gtaaacccgtttgttaaatagaactaattatcccggattttatattaaataaactatatgcgttttatttagcgt

SEQ ID NO: 159168 - DNA, 75 bp, Artificial Sequence
  Synthetic
ggaaggattaagaatctcctaactataagttaacacgcccacatttgggcggggatgttttatgaagccttaaag

SEQ ID NO: 159169 - DNA, 75 bp, Artificial Sequence
  Synthetic
taagttaacacgcccacatttgggcggggatgttttatgaagccttaaaggccgagctggtatacacgagagcag

SEQ ID NO: 159170 - DNA, 75 bp, Artificial Sequence
  Synthetic
ttgcgtggttttaagtgactatattccgagggtcgcctgtaatatggggacagttaataaacctgtggtgggggt

SEQ ID NO: 159171 - DNA, 75 bp, Artificial Sequence
  Synthetic
ccgagggtcgcctgtaatatggggacagttaataaacctgtggtgggggtattgatggggttcggaattatcacg

SEQ ID NO: 159172 - DNA, 75 bp, Artificial Sequence
  Synthetic
tcagagcatccgtcttgcgatacgatgattttcacatcgatgaagacaaactggatacaaactccgtatatgagc

SEQ ID NO: 159173 - DNA, 75 bp, Artificial Sequence
  Synthetic
tgattttcacatcgatgaagacaaactggatacaaactccgtatatgagccttactaccattcagatcatgcgga

SEQ ID NO: 159174 - DNA, 75 bp, Artificial Sequence
  Synthetic
tcttcgcgaaaagcgtacgatcataactcaccttatatatggccacgtaatgattatgatggatttttagagaac

SEQ ID NO: 159175 - DNA, 75 bp, Artificial Sequence
  Synthetic
actcaccttatatatggccacgtaatgattatgatggatttttagagaacgcacacgaacaccatggggtgtata

SEQ ID NO: 159176 - DNA, 75 bp, Artificial Sequence
  Synthetic
ggaacggttaatgcaacccacacaaatgtctgcacaggaggatcttggggacgatacgggcatccacgttatccc

SEQ ID NO: 159177 - DNA, 75 bp, Artificial Sequence
  Synthetic
atgtctgcacaggaggatcttggggacgatacgggcatccacgttatccctacgttaaacggcgatgacagacat

SEQ ID NO: 159178 - DNA, 75 bp, Artificial Sequence
  Synthetic
aatacggtgacgtgtttaaaggagatcttaatccaaaaccccaaggccaaagactcattgaggtgtcagtggaag

SEQ ID NO: 159179 - DNA, 75 bp, Artificial Sequence
  Synthetic
tcttaatccaaaaccccaaggccaaagactcattgaggtgtcagtggaagaaaatcacccgtttactttacgcgc

SEQ ID NO: 159180 - DNA, 75 bp, Artificial Sequence
  Synthetic
cggtacaccgagacttggagctttttgccgtcattaacctgtacgggagacgcagcgcccgccatccagcatata

SEQ ID NO: 159181 - DNA, 75 bp, Artificial Sequence
  Synthetic
tgccgtcattaacctgtacgggagacgcagcgcccgccatccagcatatatgcttaaaacatacaacatgctttc

SEQ ID NO: 159182 - DNA, 75 bp, Artificial Sequence
  Synthetic
cgcggaaaatactaaagaggatcagttggccgaaatcagttaccgttttcaaggtaagaaggaagcggaccaacc

SEQ ID NO: 159183 - DNA, 75 bp, Artificial Sequence
  Synthetic
ttggccgaaatcagttaccgttttcaaggtaagaaggaagcggaccaaccgtggattgttgtaaacacgagcaca

SEQ ID NO: 159184 - DNA, 75 bp, Artificial Sequence
  Synthetic
cccccgagattgaaccgggtgtcttgaaagtacttcggacagaaaaacaatacttgggtgtgtacatttggaaca

SEQ ID NO: 159185 - DNA, 75 bp, Artificial Sequence
  Synthetic
gaaagtacttcggacagaaaaacaatacttgggtgtgtacatttggaacatgcgcggctccgatggtacgtctac

SEQ ID NO: 159186 - DNA, 75 bp, Artificial Sequence
  Synthetic
aaaggggatgaaaaaacaagaaaccctacgcccgcagtaactcctcaaccaagaggggctgagtttcatatgtgg

SEQ ID NO: 159187 - DNA, 75 bp, Artificial Sequence
  Synthetic
ctacgcccgcagtaactcctcaaccaagaggggctgagtttcatatgtggaattaccactcgcatgtattttcag

SEQ ID NO: 159188 - DNA, 75 bp, Artificial Sequence
  Synthetic
gcatcttcagtataagatacatgaagcgccatttgatttgctgttagagtggttgtatgtccccatcgatcctac

SEQ ID NO: 159189 - DNA, 75 bp, Artificial Sequence
  Synthetic
gcgccatttgatttgctgttagagtggttgtatgtccccatcgatcctacatgtcaaccaatgcggttatattct

SEQ ID NO: 159190 - DNA, 75 bp, Artificial Sequence
  Synthetic
cccaatgcctctctcatatgaattccggttgtacatttacctcgccacatttagcccagcgtgttgcaagcacag

SEQ ID NO: 159191 - DNA, 75 bp, Artificial Sequence
  Synthetic
cggttgtacatttacctcgccacatttagcccagcgtgttgcaagcacagtgtatcaaaattgtgaacatgcaga

SEQ ID NO: 159192 - DNA, 75 bp, Artificial Sequence
  Synthetic
atatctcatatggagcctagctttggtctaatcttacacgacgggggcaccacgttaaagtttgtagatacaccc

SEQ ID NO: 159193 - DNA, 75 bp, Artificial Sequence
  Synthetic
gtctaatcttacacgacgggggcaccacgttaaagtttgtagatacacccgagagtttgtcgggattatacgttt

SEQ ID NO: 159194 - DNA, 75 bp, Artificial Sequence
  Synthetic
tgaagccgtagcatacactgttgtatccacagtagatcattttgtaaacgcaattgaagagcgtggatttccgcc

SEQ ID NO: 159195 - DNA, 75 bp, Artificial Sequence
  Synthetic
tccacagtagatcattttgtaaacgcaattgaagagcgtggatttccgccaacggccggtcagccaccggcgact

SEQ ID NO: 159196 - DNA, 75 bp, Artificial Sequence
  Synthetic
taaaccccggaacgtcaccacttatacgatatgccgcatggaccggagggcttgcagcagtagtacttttatgtc

SEQ ID NO: 159197 - DNA, 75 bp, Artificial Sequence
  Synthetic
acgatatgccgcatggaccggagggcttgcagcagtagtacttttatgtctcgtaatatttttaatctgtacggc

SEQ ID NO: 159198 - DNA, 75 bp, Artificial Sequence
  Synthetic
agggtagacaagtccccgtataaccaaagcatgtattacgctggccttccagtggacgatttcgaggactcggaa

SEQ ID NO: 159199 - DNA, 75 bp, Artificial Sequence
  Synthetic
tctacggatacggaagaagagtttggtaacgcgattggagggagtcacgggggttcgagttacacggtgtatata

SEQ ID NO: 159200 - DNA, 75 bp, Artificial Sequence
  Synthetic
ggggcaacgtcgagcgtgtaaatttaaataaaaaacagtacgcttttatccggtgtatgttttaaatttattttt

SEQ ID NO: 159201 - DNA, 75 bp, Artificial Sequence
  Synthetic
tttttctatataaagggatggggtgtcaggatctctcgtaggttcttgggactccaagggacccgcagcccaggt

SEQ ID NO: 159202 - DNA, 75 bp, Artificial Sequence
  Synthetic
actccaagggacccgcagcccaggtacgcgtcaaaaagcctgtgacaaattcccccggggcggtcatataattcg

SEQ ID NO: 159203 - DNA, 75 bp, Artificial Sequence
  Synthetic
acgcgtcaaaaagcctgtgacaaattcccccggggcggtcatataattcggcgcggatgcatttattatcgggcg

SEQ ID NO: 159204 - DNA, 75 bp, Artificial Sequence
  Synthetic
gtgtcccaaacagcaccaatatgccatcaatatcagccgctcgctgagctccagatgcgattgtggatccggcat

SEQ ID NO: 159205 - DNA, 75 bp, Artificial Sequence
  Synthetic
atcaatatcagccgctcgctgagctccagatgcgattgtggatccggcatgcattgctcgcgtaataacgataac

SEQ ID NO: 159206 - DNA, 75 bp, Artificial Sequence
  Synthetic
agggtggacgttgtctatccgctgcgagctccccgcacatccgtccgaaggcgtcctttgccctcccccacaaac

SEQ ID NO: 159207 - DNA, 75 bp, Artificial Sequence
  Synthetic
gagctccccgcacatccgtccgaaggcgtcctttgccctcccccacaaactcgcgcacggtctctcggaggggct

SEQ ID NO: 159208 - DNA, 75 bp, Artificial Sequence
  Synthetic
gtagatatggcgcatagcgcggcggcgaagtaccgttcggcgtcgttcatgagagcctggtgcgcgggggtatcg

SEQ ID NO: 159209 - DNA, 75 bp, Artificial Sequence
  Synthetic
cgaagtaccgttcggcgtcgttcatgagagcctggtgcgcgggggtatcgtgtcgtgtgcagtaaagtccggcat

SEQ ID NO: 159210 - DNA, 75 bp, Artificial Sequence
  Synthetic
ggatccgcagagattcataccacacggcccgtgtggggaccccgtgggttaatggagacgttcaaaccagcaccc

SEQ ID NO: 159211 - DNA, 75 bp, Artificial Sequence
  Synthetic
ggcccgtgtggggaccccgtgggttaatggagacgttcaaaccagcaccctctaccctctaatatccacaacacc

SEQ ID NO: 159212 - DNA, 75 bp, Artificial Sequence
  Synthetic
aaaaagacacgagccaaaccattgtatttatttataaagactacacgccatgggggggcggtatatcatgccggc

SEQ ID NO: 159213 - DNA, 75 bp, Artificial Sequence
  Synthetic
atttatttataaagactacacgccatgggggggcggtatatcatgccggcgcggggcttcgtgtcgacgtcgctt

SEQ ID NO: 159214 - DNA, 75 bp, Artificial Sequence
  Synthetic
gcggtgagcgctttcgcggctgtatattccgcggtttctgcacccgcgtatcgctcgatggcacgctggggtctc

SEQ ID NO: 159215 - DNA, 75 bp, Artificial Sequence
  Synthetic
attccgcggtttctgcacccgcgtatcgctcgatggcacgctggggtctctttggggacggggtgttgcacccat

SEQ ID NO: 159216 - DNA, 75 bp, Artificial Sequence
  Synthetic
taccccgtctggttcacaagaatcggtgctctcctctgattcttcttccactataaagtcttccccgtccgatga

SEQ ID NO: 159217 - DNA, 75 bp, Artificial Sequence
  Synthetic
gtgctctcctctgattcttcttccactataaagtcttccccgtccgatgattccgcgtcggaatcccgaaattca

SEQ ID NO: 159218 - DNA, 75 bp, Artificial Sequence
  Synthetic
catcgtcgctatcgtcttcaccaccatcatcagatacgtcacattccagtgcgctcctatgcaaaggaacattcg

SEQ ID NO: 159219 - DNA, 75 bp, Artificial Sequence
  Synthetic
atcatcagatacgtcacattccagtgcgctcctatgcaaaggaacattcggcgcctcaatgaacccgtcttcccc

SEQ ID NO: 159220 - DNA, 75 bp, Artificial Sequence
  Synthetic
attaaagtagcgcgtaagcactgcgtctgggtgggttgaagctgtaacaattcctcccagcacgctaacgtggga

SEQ ID NO: 159221 - DNA, 75 bp, Artificial Sequence
  Synthetic
tctgggtgggttgaagctgtaacaattcctcccagcacgctaacgtgggacgctgtctggtgcgacccattagat

SEQ ID NO: 159222 - DNA, 75 bp, Artificial Sequence
  Synthetic
tcttcgtgaatctcgcgtgacgcgtcccgacgactgtgcaatacataaaaaaacacggttgatgtcctcaacgag

SEQ ID NO: 159223 - DNA, 75 bp, Artificial Sequence
  Synthetic
cccgacgactgtgcaatacataaaaaaacacggttgatgtcctcaacgagcctggccgggtggatctcccaaccc

SEQ ID NO: 159224 - DNA, 75 bp, Artificial Sequence
  Synthetic
gcgacgtatcccggccgttcaggggtcctggtgcagatccatattccatctttccgttaacatcaaccgatgccc

SEQ ID NO: 159225 - DNA, 75 bp, Artificial Sequence
  Synthetic
tcctggtgcagatccatattccatctttccgttaacatcaaccgatgccccgggttttgactcggacgagtcgcc

SEQ ID NO: 159226 - DNA, 75 bp, Artificial Sequence
  Synthetic
atgtccttggggccgtagtaaccttttcccttaaaaccgactcgacgctgtcgcgttatgaatcggacgaaccct

SEQ ID NO: 159227 - DNA, 75 bp, Artificial Sequence
  Synthetic
cacgtcaaatcgattttaaaaagcctgccgctttatttggaatatatatattctgtgaaaagcccgcccacaccc

SEQ ID NO: 159228 - DNA, 75 bp, Artificial Sequence
  Synthetic
agtgtatccgattggcgtacaccacagacatgcggacgcccaatttaaccccccccctttttcacccccccaccc

SEQ ID NO: 159229 - DNA, 75 bp, Artificial Sequence
  Synthetic
ccccccctttttcacccccccaccccaccccattccaccccaggaagtgcgaatgggtttacatgcctcagatat

SEQ ID NO: 159230 - DNA, 75 bp, Artificial Sequence
  Synthetic
caccccattccaccccaggaagtgcgaatgggtttacatgcctcagatatgaagttcttcgacttgtttttgaat

SEQ ID NO: 159231 - DNA, 75 bp, Artificial Sequence
  Synthetic
ggtttagagaattatggttataaacatcggcggggtaccgcgccccctccccatcggcggggtaccgcgccccct

SEQ ID NO: 159232 - DNA, 75 bp, Artificial Sequence
  Synthetic
atcggcggggtaccgcgccccctccccatcggcggggtaccgcgccccctccccatcggcggggtaccgcgcccc

SEQ ID NO: 159233 - DNA, 75 bp, Artificial Sequence
  Synthetic
agaggcggaggagggagaggcggaggagggagaggcggaggaggacgcgatcgacgacgagggagaggcggagga

SEQ ID NO: 159234 - DNA, 75 bp, Artificial Sequence
  Synthetic
ccccctccccatcggcggggggttacgtgaacaccacaaccccgtgtgtattttatgggttatcgcgggcttcgt

SEQ ID NO: 159235 - DNA, 75 bp, Artificial Sequence
  Synthetic
aggggtggtggtgtatacgcttgttgattgcgcgaacgtaatgacgacggagagggacccaaacacaccgtcgac

SEQ ID NO: 159236 - DNA, 75 bp, Artificial Sequence
  Synthetic
agagggacccaaacacaccgtcgacgtgcatttgattaactagatgccggatgggtggaaacaacccgtgttata

SEQ ID NO: 159237 - DNA, 75 bp, Artificial Sequence
  Synthetic
taagatgttttgcatgtgagacaaccccaattgtgtttatgtatattatatatcgtctgtagacacacgatgatt

SEQ ID NO: 159238 - DNA, 75 bp, Artificial Sequence
  Synthetic
cccaattgtgtttatgtatattatatatcgtctgtagacacacgatgattggttgttatttaaacatatgtaaat

SEQ ID NO: 159239 - DNA, 75 bp, Artificial Sequence
  Synthetic
gttatgatgttgtaaggtatgcggaaatagacaccgggcgtacatcgccaaccagcggtctctccttaaacgcat

SEQ ID NO: 159240 - DNA, 75 bp, Artificial Sequence
  Synthetic
cgagtctcgtccaatcactacatcgtcttatcattaagaatatttacacggtgacgacacggggaggaaatatgc

SEQ ID NO: 159241 - DNA, 75 bp, Artificial Sequence
  Synthetic
ttaagtactgttggaactccctcaccaaccgcaatcgcaatcctttgaaggctgcgagagcgtttggaaaactcg

SEQ ID NO: 159242 - DNA, 75 bp, Artificial Sequence
  Synthetic
gctgcgagagcgtttggaaaactcgggtacgtctaaattcaccccagtgcgatggatacgccgccgatgcagcgc

SEQ ID NO: 159243 - DNA, 75 bp, Artificial Sequence
  Synthetic
tctacaccccaacgcgcggggtcgcctgatactttggagttaatggacctgttggacgcggccgccgcggccgcc

SEQ ID NO: 159244 - DNA, 75 bp, Artificial Sequence
  Synthetic
ctgatactttggagttaatggacctgttggacgcggccgccgcggccgccgaacacagggcccgggtggtcacct

SEQ ID NO: 159245 - DNA, 75 bp, Artificial Sequence
  Synthetic
tggagagaacggggtcatggtgggacgggaacatgagatcgtttcaattccctccgtatcgggacttcaaccaga

SEQ ID NO: 159246 - DNA, 75 bp, Artificial Sequence
  Synthetic
cgggaacatgagatcgtttcaattccctccgtatcgggacttcaaccagaacccagaacggaagatgttggcgaa

SEQ ID NO: 159247 - DNA, 75 bp, Artificial Sequence
  Synthetic
gcgaggacggtcaggatctaatgggctcgcctgtaatcccgctggccgaggtcttccacacccgattctcggagg

SEQ ID NO: 159248 - DNA, 75 bp, Artificial Sequence
  Synthetic
ctcgcctgtaatcccgctggccgaggtcttccacacccgattctcggaggccggcgcgcgagaaccaacaggagc

SEQ ID NO: 159249 - DNA, 75 bp, Artificial Sequence
  Synthetic
ctcggaacgaagcttgctaggtctccaaaaccaccgatgaacgatggggaaacgggcagaggtacgacccctccg

SEQ ID NO: 159250 - DNA, 75 bp, Artificial Sequence
  Synthetic
caaaaccaccgatgaacgatggggaaacgggcagaggtacgacccctccgttcccgcaggccttctcccctgtat

SEQ ID NO: 159251 - DNA, 75 bp, Artificial Sequence
  Synthetic
cgccgggaacgatcaacgggaagaccagcggtctataccccgacaaacgacgagaggaaattcaccaggtttgcc

SEQ ID NO: 159252 - DNA, 75 bp, Artificial Sequence
  Synthetic
cagcggtctataccccgacaaacgacgagaggaaattcaccaggtttgccgtcggtggtccatcgagacagacaa

SEQ ID NO: 159253 - DNA, 75 bp, Artificial Sequence
  Synthetic
cgggcgatgagcaagcgggtcatgcgcatgcatcgggggacggagtagttctccagaaaactcaacggcccgctc

SEQ ID NO: 159254 - DNA, 75 bp, Artificial Sequence
  Synthetic
tttgaaggttaaggtcccactcccggcgcggaaacccggtggacctgtacccggcccggttgagcaattgtacca

SEQ ID NO: 159255 - DNA, 75 bp, Artificial Sequence
  Synthetic
aagggggcaaaggcggacctgccgtttgagaccgatgatacccgcccaaggaaacatgatgcccggggtataaca

SEQ ID NO: 159256 - DNA, 75 bp, Artificial Sequence
  Synthetic
ttgagaccgatgatacccgcccaaggaaacatgatgcccggggtataacacctcgcgtccctggacgttcgtcgg

SEQ ID NO: 159257 - DNA, 75 bp, Artificial Sequence
  Synthetic
cctgccgggaagatcccacgcaccagacccgattgaggatgacagcccagtggagaaaaagccaaagagtcgtga

SEQ ID NO: 159258 - DNA, 75 bp, Artificial Sequence
  Synthetic
gacccgattgaggatgacagcccagtggagaaaaagccaaagagtcgtgagtttgtttcgtcttcatcctcttcc

SEQ ID NO: 159259 - DNA, 75 bp, Artificial Sequence
  Synthetic
atgaagacgatgaaccccggcgcgtttcggtgggaagtgaaactacaggcagcaggtccggacgcgaacacgccc

SEQ ID NO: 159260 - DNA, 75 bp, Artificial Sequence
  Synthetic
ttcggtgggaagtgaaactacaggcagcaggtccggacgcgaacacgccccttccccgtcaaattcggatgattc

SEQ ID NO: 159261 - DNA, 75 bp, Artificial Sequence
  Synthetic
aaacaaaatatccaaccgggatatcgatccatcagcggtcccgatccgaggattcgtaagaccaaacgtcttgcg

SEQ ID NO: 159262 - DNA, 75 bp, Artificial Sequence
  Synthetic
gatccatcagcggtcccgatccgaggattcgtaagaccaaacgtcttgcgggggaaccggggcgccagagacaga

SEQ ID NO: 159263 - DNA, 75 bp, Artificial Sequence
  Synthetic
aaccccgataattcccccggtgtcggggccgctcatgatgcccgacggaagcccttggcccggatcggcacccct

SEQ ID NO: 159264 - DNA, 75 bp, Artificial Sequence
  Synthetic
ccgtccggggagaccagagagggtcactgggaggatgaggctgtgagagcggcgcgggctcgttacgaggcctca

SEQ ID NO: 159265 - DNA, 75 bp, Artificial Sequence
  Synthetic
cggagttgggagatccggctagacagtaccgcgcgctgattaacctgatctactgtccagacagagaccctatag

SEQ ID NO: 159266 - DNA, 75 bp, Artificial Sequence
  Synthetic
gtaccgcgcgctgattaacctgatctactgtccagacagagaccctatagcatggctccagaaccccaagctgac

SEQ ID NO: 159267 - DNA, 75 bp, Artificial Sequence
  Synthetic
ttctaccaaaagctgttgccaccgggacgggcgggtaccgccgttacggggagcgtagcgtctcccgttccgcat

SEQ ID NO: 159268 - DNA, 75 bp, Artificial Sequence
  Synthetic
gacgggcgggtaccgccgttacggggagcgtagcgtctcccgttccgcatgtaggcgaagccatggccacggggg

SEQ ID NO: 159269 - DNA, 75 bp, Artificial Sequence
  Synthetic
ggccgcggccgtggctatgagccgtcgatacgaccgggcccaaaaacactttatcctacagagtctccgcagagc

SEQ ID NO: 159270 - DNA, 75 bp, Artificial Sequence
  Synthetic
ttatcctacagagtctccgcagagcctttgccagcatggcataccccgaggcaacgggctccagtccggcggcgc

SEQ ID NO: 159271 - DNA, 75 bp, Artificial Sequence
  Synthetic
ggatctcccgcggtcacccttctccaacaaccccggccacacagactcccgaccctcagccgtcggccgccgcac

SEQ ID NO: 159272 - DNA, 75 bp, Artificial Sequence
  Synthetic
aacaaccccggccacacagactcccgaccctcagccgtcggccgccgcacgctctctttctgtgtgtccaccgga

SEQ ID NO: 159273 - DNA, 75 bp, Artificial Sequence
  Synthetic
cgcaagtcccagccagtcgagagcagaagcctcctcgacaagattagggagacacccgtcgcggacgcccgggtt

SEQ ID NO: 159274 - DNA, 75 bp, Artificial Sequence
  Synthetic
gaagcctcctcgacaagattagggagacacccgtcgcggacgcccgggttgcagacgatcatgtggtttccaagg

SEQ ID NO: 159275 - DNA, 75 bp, Artificial Sequence
  Synthetic
gaccatcacctcgggccctgtggtggatccccccgccgtaataacgatgccacttgacggaccggccccaaacgg

SEQ ID NO: 159276 - DNA, 75 bp, Artificial Sequence
  Synthetic
gatccccccgccgtaataacgatgccacttgacggaccggccccaaacgggggatttcggcgtattccccggggg

SEQ ID NO: 159277 - DNA, 75 bp, Artificial Sequence
  Synthetic
accaggctcgcaaggcgtactgtacccccgaaaccatcgcccgtctggtcgacgacccattgtttcccacggcct

SEQ ID NO: 159278 - DNA, 75 bp, Artificial Sequence
  Synthetic
ccccgaaaccatcgcccgtctggtcgacgacccattgtttcccacggcctggcgccctgcgctaagctttgatcc

SEQ ID NO: 159279 - DNA, 75 bp, Artificial Sequence
  Synthetic
cggcgtccgggcggaggagaccgacggtttggtccacccagcggagtggaggcgctgcgacggaggtgcgcctgg

SEQ ID NO: 159280 - DNA, 75 bp, Artificial Sequence
  Synthetic
ggtttggtccacccagcggagtggaggcgctgcgacggaggtgcgcctggatgcggcagatcccagacccggagg

SEQ ID NO: 159281 - DNA, 75 bp, Artificial Sequence
  Synthetic
tccgttgcccggagaggacatcaacggccccctcgagagcaccctcgcgacagatccgggaccgtcatggagtcc

SEQ ID NO: 159282 - DNA, 75 bp, Artificial Sequence
  Synthetic
ggccccctcgagagcaccctcgcgacagatccgggaccgtcatggagtccatcccgagggggactgtctgtggtc

SEQ ID NO: 159283 - DNA, 75 bp, Artificial Sequence
  Synthetic
gcctgccgagcactcatgcctgggccgggaactggaccggcccgccggacgtgtccgctttgaacgcccggggcg

SEQ ID NO: 159284 - DNA, 75 bp, Artificial Sequence
  Synthetic
cgggaactggaccggcccgccggacgtgtccgctttgaacgcccggggcgttttattactgtcgacccgagacct

SEQ ID NO: 159285 - DNA, 75 bp, Artificial Sequence
  Synthetic
ctaggctcgcggttggcctctgcccggcgccggttgctggtgttggacgcggtggccctcgagaggtggcccagg

SEQ ID NO: 159286 - DNA, 75 bp, Artificial Sequence
  Synthetic
ggcgccggttgctggtgttggacgcggtggccctcgagaggtggcccagggatggacccgctttgtctcagtatc

SEQ ID NO: 159287 - DNA, 75 bp, Artificial Sequence
  Synthetic
accggacgcccaggccgtcgtccgatggccagactcggcggtcacagaaggactcgcccgggccgtgtttgcatc

SEQ ID NO: 159288 - DNA, 75 bp, Artificial Sequence
  Synthetic
tggccagactcggcggtcacagaaggactcgcccgggccgtgtttgcatcgtcgcgcacctttgggccagcgagt

SEQ ID NO: 159289 - DNA, 75 bp, Artificial Sequence
  Synthetic
ccaacctgtacccgggcgaacaacccctgtgtttgtgccgcggtgggaacgtcgcatacaccgtgtgtacccgcg

SEQ ID NO: 159290 - DNA, 75 bp, Artificial Sequence
  Synthetic
tctggggctcggggcagccgactttgtggacgaggcggcacatagccaccgcgcagcaaaccgatggggcctggg

SEQ ID NO: 159291 - DNA, 75 bp, Artificial Sequence
  Synthetic
gtggacgaggcggcacatagccaccgcgcagcaaaccgatggggcctgggtgccgcgcttcgacccgtcttcctt

SEQ ID NO: 159292 - DNA, 75 bp, Artificial Sequence
  Synthetic
ccgggccggaggccggcgacgtacccacctgggcgagggtgttttgccgccacgccctgctggaacccgaccctg

SEQ ID NO: 159293 - DNA, 75 bp, Artificial Sequence
  Synthetic
cacctgggcgagggtgttttgccgccacgccctgctggaacccgaccctgccgcagaaccactcgtgcttccacc

SEQ ID NO: 159294 - DNA, 75 bp, Artificial Sequence
  Synthetic
tatgcgtcggcggacgaggctcggaatgccctccccccgattcccagagtaatgtggccgcccggttttggggcc

SEQ ID NO: 159295 - DNA, 75 bp, Artificial Sequence
  Synthetic
gcaccgcagacgacagagaacacgctttggagctggacgattgggaggtggggtgtgaagacgcgtgggacagcg

SEQ ID NO: 159296 - DNA, 75 bp, Artificial Sequence
  Synthetic
aggaggggggcggggacgacggggacgcaccggggtcatcctttggggtgagcatcgtgtcggtggccccgggtg

SEQ ID NO: 159297 - DNA, 75 bp, Artificial Sequence
  Synthetic
gcgcccggcggtcaaggtggagctgttgtcctcgtcctcgtcctccgaggacgaggacgatgtgtggggagggcg

SEQ ID NO: 159298 - DNA, 75 bp, Artificial Sequence
  Synthetic
atggtcgccccgcaaacgcgcggggaggtggggtcgctttttttttttctctctcgagggggccgcgagagggct

SEQ ID NO: 159299 - DNA, 75 bp, Artificial Sequence
  Synthetic
ctctcgagggggccgcgagagggctgggcccccctcccggggtccgccgggcgcccagaaaccggggggggttat

SEQ ID NO: 159300 - DNA, 75 bp, Artificial Sequence
  Synthetic
gggcccccctcccggggtccgccgggcgcccagaaaccggggggggttattttcgggggggggtccgaccagccc

SEQ ID NO: 159301 - DNA, 75 bp, Artificial Sequence
  Synthetic
ggcccagccctctcgcggccccctcgagagagaaaaaaaaaagcgaccccacctccccgcgcgtttgcggggcga

SEQ ID NO: 159302 - DNA, 75 bp, Artificial Sequence
  Synthetic
aaaggatccccccgtcaacagccggtctgtcaccgggttagatttgccgaacctacggagggcgtattgatgtaa

SEQ ID NO: 159303 - DNA, 75 bp, Artificial Sequence
  Synthetic
tcgctgtcccacgcgtcttcacaccccacctcccaatcgtccagctccaaagcgtgttctctgtcgtctgcggtg

SEQ ID NO: 159304 - DNA, 75 bp, Artificial Sequence
  Synthetic
aaattgccttttggaggcctgcccaacggccattatcccttggatctgagattgatttgcggtaacgtttgccaa

SEQ ID NO: 159305 - DNA, 75 bp, Artificial Sequence
  Synthetic
gcccgcgcagcccgtccagcccgcgcagcccgtccagcccgcgcagcccgtccagcccgcgcagcccgtccagcc

SEQ ID NO: 159306 - DNA, 75 bp, Artificial Sequence
  Synthetic
gagagagagagtttcttgttcgcgcgtgttcccgcgatgtcgcggttttatggggtgtgggcgggcttttcacag

SEQ ID NO: 159307 - DNA, 75 bp, Artificial Sequence
  Synthetic
cttttcacagaatatatatattccaaataaagcggcaggctttttaaaatcgatttgacgtgataaaaaaaaaaa

SEQ ID NO: 159308 - DNA, 75 bp, Artificial Sequence
  Synthetic
ggtgttataaaggcaacccaatcgaaggtctcccgccccggaatcccccattgccattttacccaagtagcctta

SEQ ID NO: 159309 - DNA, 75 bp, Artificial Sequence
  Synthetic
gggaagcggccgaggtgggcgcgacggcgggatcgggctttcgggtagcggccgaggtgggcgcgacggcgggat

SEQ ID NO: 159310 - DNA, 75 bp, Artificial Sequence
  Synthetic
cagaccgtccagcccgcgcagcccatagaaccgggcacacaaatagtggtacaaaattttaagaaaccccaaagc

SEQ ID NO: 159311 - DNA, 75 bp, Artificial Sequence
  Synthetic
agtgcgaatgcagattaaaagagtgtatccgattggcgtacaccacagacatgcggacgcccaatttaacccccc

SEQ ID NO: 159312 - DNA, 75 bp, Artificial Sequence
  Synthetic
ttcgcgcgtgttcccgcgatgtcgcggttttatggggtgtgggcgggcttttcacagaatatatatattccaaat

SEQ ID NO: 159313 - DNA, 75 bp, Artificial Sequence
  Synthetic
tggggccgcggagacggtgttggaggggagcgacggaacacggttcgtgttcggacaccacgggggctcggaacg

SEQ ID NO: 159314 - DNA, 75 bp, Artificial Sequence
  Synthetic
aagcggaacggtttttatgaaaaaagtgtctgtctgtctgtgcgggcgggcgacgggcgggctggtcggaccccc

SEQ ID NO: 159315 - DNA, 75 bp, Artificial Sequence
  Synthetic
cgacgggcgggctggtcggacccccccccgaaaataaccccccccggtttctgggcgcccggcggaccccgggag

SEQ ID NO: 159316 - DNA, 75 bp, Artificial Sequence
  Synthetic
ggcccagccctctcgcggccccctcgagagagaaaaaaaaagcgaccccacctccccgcgcgtttgcggggcgac

SEQ ID NO: 159317 - DNA, 75 bp, Artificial Sequence
  Synthetic
cctccccgcgcgtttgcggggcgaccatcgggggggatgggattttttgccgggaaacccccccccgccagcctt

SEQ ID NO: 159318 - DNA, 75 bp, Artificial Sequence
  Synthetic
ggcagattggaaacttgttaaaatgccacagaaaataacggatccttttgcgccatggcaactttcccccccccc

SEQ ID NO: 159319 - DNA, 75 bp, Artificial Sequence
  Synthetic
ggagaggcggaggagggagaggcggaggaggacgcgatcgacgacgagggagaggcggaggaggacgcggcggag

SEQ ID NO: 159320 - DNA, 75 bp, Artificial Sequence
  Synthetic
acgctcaaattgccttttggaggcctgcccaacggccattatcccttggatctaagattgatttgcggtaacgtt

SEQ ID NO: 159321 - DNA, 75 bp, Artificial Sequence
  Synthetic
taaatgtgtgaaaatagggtatggattgtattccgccgtgaacgcattgtatattttcatatagaaaaggtggtt

SEQ ID NO: 159322 - DNA, 75 bp, Artificial Sequence
  Synthetic
tttcgggtagcggccgaggtgggcgcgacggcgggatcgggctttcgggtagcggccgaggtgggcgcgacggcg

SEQ ID NO: 159323 - DNA, 75 bp, Artificial Sequence
  Synthetic
cgaacggtggttggacacatgccaaaacatgaaaacccatacagtgaaaaaacgggaagtgcgaatgcagattaa

SEQ ID NO: 159324 - DNA, 75 bp, Artificial Sequence
  Synthetic
gggcgacgggcgggctggtcggacccccccccgaaaataacccccccccggtttctgggcgcccggcggaccccg

SEQ ID NO: 159325 - DNA, 75 bp, Artificial Sequence
  Synthetic
gaggaggacgcgattgacgacgagggagaggcggaggagggagaggcggaggagggagaggcggaggagggagag

SEQ ID NO: 159326 - DNA, 75 bp, Artificial Sequence
  Synthetic
agcggccgaggtgggcgcgacggcgggatcgggctttcgggaagcggccgaggtgggcgcgacggcgggatcggg

SEQ ID NO: 159327 - DNA, 75 bp, Artificial Sequence
  Synthetic
ggggggttaaattgggcgtccgcatgtctgtggtgtacgccaatcggatacactcttttaatctgcattcgcact

SEQ ID NO: 159328 - DNA, 75 bp, Artificial Sequence
  Synthetic
gggcgggcgacgggcgggctggtcggaccccccccgaaaataaccccccccggtttctgggcgcccggcggaccc

SEQ ID NO: 159329 - DNA, 75 bp, Artificial Sequence
  Synthetic
aacggagccactatttaagtctcccgttcaagttgttagaagttccaaatgtaaaaaaatgcccgtccagcccgc

SEQ ID NO: 159330 - DNA, 75 bp, Artificial Sequence
  Synthetic
ttcttagtatgaatccagtatgcctgcctgtaattgttgcgccctacctgttttggctggcggctattgccgcct

SEQ ID NO: 159331 - DNA, 75 bp, Artificial Sequence
  Synthetic
cgacaatctttggcaggtcgggcctggccatgcagggtattctagtgaagccctgcaggtggcgccggggtgggg

SEQ ID NO: 159332 - DNA, 75 bp, Artificial Sequence
  Synthetic
gggcagggggtgggtatttaaggatctatatgcccttctctacctgcacctccaaatgagagatgactcggcgta

SEQ ID NO: 159333 - DNA, 75 bp, Artificial Sequence
  Synthetic
cgtgtttcacggcctcagttagtaccgttgtgaccgccaccggcttggccctctcacttctactcttggcagcag

SEQ ID NO: 159334 - DNA, 75 bp, Artificial Sequence
  Synthetic
tgggggtgcgctcccaggccggaccctggtgccaggcagggaccccgcgccacccgcttcatggggggggaggcc

SEQ ID NO: 159335 - DNA, 75 bp, Artificial Sequence
  Synthetic
ggtgcctcggcgccaacgcgccatagacaagaggcagagagccagtgtggctggggctggtgctcatgcacacct

SEQ ID NO: 159336 - DNA, 75 bp, Artificial Sequence
  Synthetic
cccccgccaccacggtgcagcctaccgccacgcgtcagcaaaccagctttcctttccgagtctgcgagctctcca

SEQ ID NO: 159337 - DNA, 75 bp, Artificial Sequence
  Synthetic
aaggaaactgctgacaccggtgacagttcttactgcggttgtcacttgtgagtacacacgcaccatttacaatgc

SEQ ID NO: 159338 - DNA, 75 bp, Artificial Sequence
  Synthetic
gcctgtaattgttgcgccctacctgttttggctggcggctattgccgcctcgtgtttcacggcctcagttagtac

SEQ ID NO: 159339 - DNA, 75 bp, Artificial Sequence
  Synthetic
cttcgtcccagtgtactcgataatgtcgactgctgcgaaggtttggaccgtcttccagtaggtgttgggggtccc

SEQ ID NO: 159340 - DNA, 75 bp, Artificial Sequence
  Synthetic
agtacacacgcaccatttacaatgcatgatgttcgtgagattgatctgtctctaacagttcacttcctctgcttt

SEQ ID NO: 159341 - DNA, 75 bp, Artificial Sequence
  Synthetic
cgccacgcgtcagcaaaccagctttcctttccgagtctgcgagctctccagccacggcgacctgttccgcttctc

SEQ ID NO: 159342 - DNA, 75 bp, Artificial Sequence
  Synthetic
cgttaactgagagtatcgcttaaaggttccctcgttgaagcactgtgcgtgggccaaatagacgtagcgcacgag

SEQ ID NO: 159343 - DNA, 75 bp, Artificial Sequence
  Synthetic
gcctgttgatggtgtttaaagacaacattattccctactcgtttaaggtccgctcctacaccaagatagtgacca

SEQ ID NO: 159344 - DNA, 75 bp, Artificial Sequence
  Synthetic
tttgcaaattggccttattattaatttcttgttaacactaattctgttctatgaccctgtgtttttcagatgccg

SEQ ID NO: 159345 - DNA, 75 bp, Artificial Sequence
  Synthetic
cccctgtaggcgtctatcgtccttgccacagtgcggatctctcgcgagtcccgccgcagcttctcgtgtgcaaag

SEQ ID NO: 159346 - DNA, 75 bp, Artificial Sequence
  Synthetic
gaggagaagttctccgttgagagctacgaaactgaccagatggataccatctaccagtgctacaacgcggtcaag

SEQ ID NO: 159347 - DNA, 75 bp, Artificial Sequence
  Synthetic
ttgaacgtgtcactgagctgaatttggacgcagctacttgacctttgcccccgtgcctccagcgctgataagtgc

SEQ ID NO: 159348 - DNA, 75 bp, Artificial Sequence
  Synthetic
gctatagatccctgaatgtagttatagtaaatgcatctgcgaaacttgcagagggccacagtccagagcaggacc

SEQ ID NO: 159349 - DNA, 75 bp, Artificial Sequence
  Synthetic
cttgtgctcctgatactagcgtacagaaggagatggcgccgtttgactgtttgtggcggcatcatgtttttggca

SEQ ID NO: 159350 - DNA, 75 bp, Artificial Sequence
  Synthetic
tgtatgtagaccgcgacggagttaacatcaccgtcaacctaaagcccaccgggggcctggccaacggggtgcgcc

SEQ ID NO: 159351 - DNA, 75 bp, Artificial Sequence
  Synthetic
gctacgccagccagacggagctctatgacgcccccgggtggttgatatggacttacagaacaagaactaccgtca

SEQ ID NO: 159352 - DNA, 75 bp, Artificial Sequence
  Synthetic
acttacagaacaagaactaccgtcaactgcctgataactgacatgatggccaagtccaacagccccttcgacttc

SEQ ID NO: 159353 - DNA, 75 bp, Artificial Sequence
  Synthetic
gagcgcgtccgagagggcgccggacgggccgggctctcgtgccccagccggccggggcacctccgggctctcccg

SEQ ID NO: 159354 - DNA, 75 bp, Artificial Sequence
  Synthetic
tgggcctccaccaccccacgacagctctcagggacgcggacggcgtcaaagcgcttcaggtgatccgtgatgcta

SEQ ID NO: 159355 - DNA, 75 bp, Artificial Sequence
  Synthetic
tctggccgccaatttcagcgggcccttttcccccttgttcaccccatagcaagaagggtaggttacatgggtatt

SEQ ID NO: 159356 - DNA, 75 bp, Artificial Sequence
  Synthetic
gcacacttaacttgactacaatgttccttctcatgctcctatggacacttggtaagttttcccttcctttaactc

SEQ ID NO: 159357 - DNA, 75 bp, Artificial Sequence
  Synthetic
ccttctcatgctcctatggacacttggtaagttttcccttcctttaactcattacttgttcttttgtaatcgcag

SEQ ID NO: 159358 - DNA, 75 bp, Artificial Sequence
  Synthetic
tggtgtcctccagcagcttgtgctgctgtacagcctgcaagactcttgccaggaacagccccctctgggctgtca

SEQ ID NO: 159359 - DNA, 75 bp, Artificial Sequence
  Synthetic
ttagggcctcctgagaaaacctcaggaggcccttagacttacggtttagatgatttgcgggttacatgatgaatg

SEQ ID NO: 159360 - DNA, 75 bp, Artificial Sequence
  Synthetic
gcacgaccagtctgggagatagaaggccatcgttctgtttagcccgccgttggggcctcccggtcttaaataatg

SEQ ID NO: 159361 - DNA, 75 bp, Artificial Sequence
  Synthetic
ttgcaaacaaacttcaagagtttaagcagcactgaatttatacccagtgagtatctatttgttactcctgtttag

SEQ ID NO: 159362 - DNA, 75 bp, Artificial Sequence
  Synthetic
tggcttcggggttgtcgtggttggcgggtgtcgcagagggagaggcgggagagatgggggcgcctggggccgagg

SEQ ID NO: 159363 - DNA, 75 bp, Artificial Sequence
  Synthetic
cgaggccgtccaggatcgttacacgaagggccaggaagccattacatattttataacgagcggaggattgttatt

SEQ ID NO: 159364 - DNA, 75 bp, Artificial Sequence
  Synthetic
ttgaagaaaacaagctattggattgtaacacacattttacgctttgttccttagatttgttctgcatgttattac

SEQ ID NO: 159365 - DNA, 75 bp, Artificial Sequence
  Synthetic
ctttaaattgtgatgcaagccctgggttatttatagaatgattatctaggtttgatagtctgaaggctgggcaga

SEQ ID NO: 159366 - DNA, 75 bp, Artificial Sequence
  Synthetic
ggattctgtaacacttcatgggtcccgtagtgacaactatgctgaatatcttgaatatgggaggaggggggcttt

SEQ ID NO: 159367 - DNA, 75 bp, Artificial Sequence
  Synthetic
ttagatttgttctgcatgttattactgattgtcgctggcatactcttcattcttgctatcctgaccgaatggggc

SEQ ID NO: 159368 - DNA, 75 bp, Artificial Sequence
  Synthetic
aggggggtgcggtgttggtgagtcacacttttgttgcagacaaaatggacaaggacaggccgggtcccccggccc

SEQ ID NO: 159369 - DNA, 75 bp, Artificial Sequence
  Synthetic
ctattactttagcggggtagcggccctgagcgcagctatgcgctacaagcttaagaagtttgtgaacggacccct

SEQ ID NO: 159370 - DNA, 75 bp, Artificial Sequence
  Synthetic
tttttatgtgcctcggtggcctgctcaccatggtagccggcgctgtgtggctgacggtgatgactaacacgcttt

SEQ ID NO: 159371 - DNA, 75 bp, Artificial Sequence
  Synthetic
agctgcatcttggggcctctgtgcttgcgttttttgggggcttggtgccaatgcaccaactggggtgtgcgcggg

SEQ ID NO: 159372 - DNA, 75 bp, Artificial Sequence
  Synthetic
ctgacggtgatgactaacacgcttttgtctgcctggattcttacagcaggattcctgattttcctcattggtaag

SEQ ID NO: 159373 - DNA, 75 bp, Artificial Sequence
  Synthetic
taacacacattttacgctttgttccttagatttgttctgcatgttattactgattgtcgctggcatactcttcat

SEQ ID NO: 159374 - DNA, 75 bp, Artificial Sequence
  Synthetic
tcctgtttgctggcaacttactggcagccgagcagattctaatggctggcaacttactggcagccgagcagattc

SEQ ID NO: 159375 - DNA, 75 bp, Artificial Sequence
  Synthetic
ctgtctgcgccgcatctaccgcgttaacatctcggccaggtggttcattagcacctttggctcccacgaggccca

SEQ ID NO: 159376 - DNA, 75 bp, Artificial Sequence
  Synthetic
ctgtaaactatggaggcccccggctggccgccgtggccaacgcaggcacggccgggctaatcagcttcgaggtct

SEQ ID NO: 159377 - DNA, 75 bp, Artificial Sequence
  Synthetic
gcaaacatacaggagcaaaggctatatgagctactctctgacccccgctccgcgctcggcctagacccggggccc

SEQ ID NO: 159378 - DNA, 75 bp, Artificial Sequence
  Synthetic
atgagctactctctgacccccgctccgcgctcggcctagacccggggcccctgattgctgagaacctgctgctag

SEQ ID NO: 159379 - DNA, 75 bp, Artificial Sequence
  Synthetic
tcgggtgtgtccttgtgtgaggtctcacctggaatatccctgacctcgatgactccgatgctgttttcgcacgca

SEQ ID NO: 159380 - DNA, 75 bp, Artificial Sequence
  Synthetic
gctgaccaccaacatctaccgagtgctacacagccgctccgtgctctcctatgagcgtttgtggatgggatctgc

SEQ ID NO: 159381 - DNA, 75 bp, Artificial Sequence
  Synthetic
tcaaagaagagggggggataaccatggacgaggacggggaagaggacgaggacgaggaggcggaagaccaggagc

SEQ ID NO: 159382 - DNA, 75 bp, Artificial Sequence
  Synthetic
ctggtgagacacgtgtctgggaggcggcagttggtcggggtggagacgacctccgccaggtgggatgagaagggg

SEQ ID NO: 159383 - DNA, 75 bp, Artificial Sequence
  Synthetic
caacaaattacttaccttgttgttgtgtgacgggtaaaaacacacatcacacacctaggccatagggatgctcac

SEQ ID NO: 159384 - DNA, 75 bp, Artificial Sequence
  Synthetic
ggcaaggccttccacatggtccgcggaaatccagcaattcctgcgactcctgggcgccacgtacgtgcttcgcgt

SEQ ID NO: 159385 - DNA, 75 bp, Artificial Sequence
  Synthetic
gacggactcatgcgggcctgggccgggctcagtgtggacgtggcccgggagctggtggagctcgcgcgctggcac

SEQ ID NO: 159386 - DNA, 75 bp, Artificial Sequence
  Synthetic
ccgccatttgccgcagttggtgcgggctccacgccctcgggcatgagccactggacgtggggatggggaaatgca

SEQ ID NO: 159387 - DNA, 75 bp, Artificial Sequence
  Synthetic
cgcaagtacgattccggccaggtggcggcgggcttccagagggcccttctggtggccgggccagagaccgctgac

SEQ ID NO: 159388 - DNA, 75 bp, Artificial Sequence
  Synthetic
tgaggacgaggatggttcggaggatggggaattttcagacctggatctgtctgacagcgaccatgaaggggatga

SEQ ID NO: 159389 - DNA, 75 bp, Artificial Sequence
  Synthetic
agcgcctctaccagaacattttcatgtgctaccgcacgctggagcatgccaagatctgccagctcctgaacacgg

SEQ ID NO: 159390 - DNA, 75 bp, Artificial Sequence
  Synthetic
gtcgggcatggacctctagcatctgctatgcgaatgctttggatggctaattatattgtaagacaatcacggggt

SEQ ID NO: 159391 - DNA, 75 bp, Artificial Sequence
  Synthetic
acttccagatgatgttttttctgttggccaggatggccacggtggggggcctggcctccttaggtttggcggccc

SEQ ID NO: 159392 - DNA, 75 bp, Artificial Sequence
  Synthetic
ggcagattgtgccgataggtgaaacacttccagatgatgttttttctgttggccaggatggccacggtggggggc

SEQ ID NO: 159393 - DNA, 75 bp, Artificial Sequence
  Synthetic
acatggaaggtgttgagcagggacacacgaaccgctcatagtttggagcacggattcattcatgccgcggggacc

SEQ ID NO: 159394 - DNA, 75 bp, Artificial Sequence
  Synthetic
gcagggcctgaagcccgggtctctggaggacggggacggaggggggcctgaagcccggggactagggaactgagg

SEQ ID NO: 159395 - DNA, 75 bp, Artificial Sequence
  Synthetic
ctatgacctgtgccggaccgtgcggcgtgaggtactgcgcctcatgcgccgcctgggtccagtgtccagggccca

SEQ ID NO: 159396 - DNA, 75 bp, Artificial Sequence
  Synthetic
actagaactgtcacaatctatggggtcgtagacagtgtgcttaccagacttccatggaagatgtgaatttgctgc

SEQ ID NO: 159397 - DNA, 75 bp, Artificial Sequence
  Synthetic
cccagtctattttttcaaatcagcttgtccacccgccgacccggataatatggaagatgtgctccccttttgcat

SEQ ID NO: 159398 - DNA, 75 bp, Artificial Sequence
  Synthetic
ccgccaccggccccggagcagatgccagggcggcggcccggcgtcaacaggcctttcagaccagggcggcggctg

SEQ ID NO: 159399 - DNA, 75 bp, Artificial Sequence
  Synthetic
tggaagatgtgctccccttttgcatatgcacgggaaaactgggctttcgcgtcatcacccccctacctagaggcc

SEQ ID NO: 159400 - DNA, 75 bp, Artificial Sequence
  Synthetic
ccaggcccctcctgagacagcaggctcgccaccccagacctcccagacccgggctcggccagcccagccgaccgg

SEQ ID NO: 159401 - DNA, 75 bp, Artificial Sequence
  Synthetic
tttgtgatagctaatgaatgtggcagctgttgtttgtactggaccctgaattggaaacagtaacttggattctct

SEQ ID NO: 159402 - DNA, 75 bp, Artificial Sequence
  Synthetic
gcccaagacccggctctctttactgcgaaatggggaaggtcctaagaaagccgtttgcaaaggctgtgccactgc

SEQ ID NO: 159403 - DNA, 75 bp, Artificial Sequence
  Synthetic
agggcccggccggtaacggtgccgtaggaagacggggtttcgcgggggacctcgaggccctccgccctgggaagc

SEQ ID NO: 159404 - DNA, 75 bp, Artificial Sequence
  Synthetic
agggcctacagcccactatgtttaacggggagctgggggccatcaagcaccaggcacttgacactgtgaggtatg

SEQ ID NO: 159405 - DNA, 75 bp, Artificial Sequence
  Synthetic
aggaagacggggtttcgcgggggacctcgaggccctccgccctgggaagctcttctccgcgtgtataggcctgct

SEQ ID NO: 159406 - DNA, 75 bp, Artificial Sequence
  Synthetic
atgcacgggaaaactgggctttcgcgtcatcacccccctacctagaggccatgctattgtgggaacaagcgcagt

SEQ ID NO: 159407 - DNA, 75 bp, Artificial Sequence
  Synthetic
agcggcgtgtatcacgcagggcggtgcatccggctgccgcatacctacaaggtggacaggggcggtggtcttagc

SEQ ID NO: 159408 - DNA, 75 bp, Artificial Sequence
  Synthetic
aaacgcgaccgggccctccagcgggcgcaatgagtgccagagctgctgaagggcctcgggggcgaagcaccggcg

SEQ ID NO: 159409 - DNA, 75 bp, Artificial Sequence
  Synthetic
tcggccctgtacccggccccgtgcatctcgggctacgcgcgccccccgggccccagtgctgtgatcgagcatctg

SEQ ID NO: 159410 - DNA, 75 bp, Artificial Sequence
  Synthetic
tctcgggctacgcgcgccccccgggccccagtgctgtgatcgagcatctggggtccctagtcccaaaggggggtc

SEQ ID NO: 159411 - DNA, 75 bp, Artificial Sequence
  Synthetic
tgcgaggagcagcatgcaggctcgggcgcgggccgtactttggttgtggaccaggcccaagaactcggggtgcgg

SEQ ID NO: 159412 - DNA, 75 bp, Artificial Sequence
  Synthetic
actacggccactatctcataatgttggggccattccagccatggagcggactgacggcccctccgtgcccttacg

SEQ ID NO: 159413 - DNA, 75 bp, Artificial Sequence
  Synthetic
gaaatggggccggccagggccacgggacctggaatgcagcagtttgtcagcagctacttcctcaaccccgcctgt

SEQ ID NO: 159414 - DNA, 75 bp, Artificial Sequence
  Synthetic
tccaacgtcttcattacagtgaggcagcgaggggaaaagatcaacggccgtaccgtcctccaagcgctcggacgc

SEQ ID NO: 159415 - DNA, 75 bp, Artificial Sequence
  Synthetic
taccgtcctccaagcgctcggacgcgcatgcgatatggcaggctgccagcactatgtgctgggctccacggttcc

SEQ ID NO: 159416 - DNA, 75 bp, Artificial Sequence
  Synthetic
gcatgcgatatggcaggctgccagcactatgtgctgggctccacggttcccctcggtggactcaactttgtcaac

SEQ ID NO: 159417 - DNA, 75 bp, Artificial Sequence
  Synthetic
ccagctgccggggggccctgcctgtctctgccccccggagggaccgggtgctgggacctcgggtgcccgccggct

SEQ ID NO: 159418 - DNA, 75 bp, Artificial Sequence
  Synthetic
gactatggtgtcccccgggtctgcggtaaacgtggccaaaacttgaataaagtcactataggagagaagctggct

SEQ ID NO: 159419 - DNA, 75 bp, Artificial Sequence
  Synthetic
attcaagaggagggcgcacgttctccggtacccttagatgtggacgagagcatggacatctctccgtcttacgag

SEQ ID NO: 159420 - DNA, 75 bp, Artificial Sequence
  Synthetic
ggagacctttgagtgcccggaccgctggcgagccgagatagatctgggcctgccccctggtgtgcaggtgggaga

SEQ ID NO: 159421 - DNA, 75 bp, Artificial Sequence
  Synthetic
catggacatctctccgtcttacgagttgccctggctctcgctggagtcatgcctcacaagcatcctgtcacaccc

SEQ ID NO: 159422 - DNA, 75 bp, Artificial Sequence
  Synthetic
gcctcacaagcatcctgtcacaccccaccgtgggaagcaaggagcacttggtcaggcacacggacagggtcagcg

SEQ ID NO: 159423 - DNA, 75 bp, Artificial Sequence
  Synthetic
ttcagaagaatgtccaaaaggtcaaagaacaaggccaagaaggagcgtgtccccgtggaggaccgcccaccgact

SEQ ID NO: 159424 - DNA, 75 bp, Artificial Sequence
  Synthetic
aaatagggctgaggccagtcaagacagcactacatcccagctagcccgtcgtagagacagacaagatggttcctt

SEQ ID NO: 159425 - DNA, 75 bp, Artificial Sequence
  Synthetic
gaggacgcgtggcacagcagcccggggtaggtcccctggacctgccgctggcggactacgccttcgttgcccaca

SEQ ID NO: 159426 - DNA, 75 bp, Artificial Sequence
  Synthetic
cctcgggtctcgccgctagttggtccagggtccaggagaaggcttcgtgccagaccaaaaagggccccgagtgct

SEQ ID NO: 159427 - DNA, 75 bp, Artificial Sequence
  Synthetic
gccccaccaggtcaaagccgctgccgttggcctcataaaagtcatacacgccatagtgttccagcataaagatgc

SEQ ID NO: 159428 - DNA, 75 bp, Artificial Sequence
  Synthetic
agactgcgatatggaccccatggagggcagcgaagaacactccacagatggagagatttcatcctcagaggagga

SEQ ID NO: 159429 - DNA, 75 bp, Artificial Sequence
  Synthetic
gctaacaggacatgtttgggggagttggcattggcgtcaggagacacggctctgtcagttatcaccgtaccatga

SEQ ID NO: 159430 - DNA, 75 bp, Artificial Sequence
  Synthetic
tggaggctatgacggcggcgagtgactacgcgcgtggcctgggcgtgaagctgacctttggctcggcctcctgcc

SEQ ID NO: 159431 - DNA, 75 bp, Artificial Sequence
  Synthetic
cagggacatccccagactcacccccagcctgtgccataccacaccccccattagtctcccgtgtaaccaaagcgc

SEQ ID NO: 159432 - DNA, 75 bp, Artificial Sequence
  Synthetic
ctacgcgcgtggcctgggcgtgaagctgacctttggctcggcctcctgccccgagaccggctcgtccgcctccag

SEQ ID NO: 159433 - DNA, 75 bp, Artificial Sequence
  Synthetic
gacctacaggacaagacggtcacgctgcatcgctcacccctgtgcagggacgaggacgagaaggaggagactggc

SEQ ID NO: 159434 - DNA, 75 bp, Artificial Sequence
  Synthetic
cgaggacgagaaggaggagactggcaactcctcttacaccagaggccacaaaaggcgacgcggagaggtccatgg

SEQ ID NO: 159435 - DNA, 75 bp, Artificial Sequence
  Synthetic
tccgccccaggggaattctcgggtcctctgatcacgccagtgcttcagaagacgggcagtctcctgattgcggtg

SEQ ID NO: 159436 - DNA, 75 bp, Artificial Sequence
  Synthetic
ctctgatcacgccagtgcttcagaagacgggcagtctcctgattgcggtgcgttgcggggatggcaagatccagg

SEQ ID NO: 159437 - DNA, 75 bp, Artificial Sequence
  Synthetic
aaaggcgacgcggagaggtccatggctgcaccgatgaaagttatggcaagcgccgacacctgcccccgggagcaa

SEQ ID NO: 159438 - DNA, 75 bp, Artificial Sequence
  Synthetic
ccccctcctggttcaaccctatggaggggaccctcctgaggctccgcctaccccaaatctcgcggacctctagcc

SEQ ID NO: 159439 - DNA, 75 bp, Artificial Sequence
  Synthetic
gagggtcgctgtttgagcagctctttagcgacgtggccacgaccccacgggcgcccgaggcgttgtctctgaaga

SEQ ID NO: 159440 - DNA, 75 bp, Artificial Sequence
  Synthetic
ctatcttgcgttacatgggggacaaacatatcatctaattgttgacacggatagtcttggaaacccgtcactctc

SEQ ID NO: 159441 - DNA, 75 bp, Artificial Sequence
  Synthetic
ccccctggctctttcacgactcctccccctggctctttcacgtcctctaccccggcggcctccactacctcctgc

SEQ ID NO: 159442 - DNA, 75 bp, Artificial Sequence
  Synthetic
caaccagaggtccccggtcagaatctagaggggccggcaggagcacaaggaagcaggcgaggcaagaacgcagcc

SEQ ID NO: 159443 - DNA, 75 bp, Artificial Sequence
  Synthetic
ggtcaagagcggcatcgtgctgtcagggcatgacatcagcgacgggggcctggtgacctgcctggtggagatggc

SEQ ID NO: 159444 - DNA, 75 bp, Artificial Sequence
  Synthetic
cgccgacacctgcccccgggagcaagaatgcccagagccccaagggcccccagggtgcctagagcaccgaggtct

SEQ ID NO: 159445 - DNA, 75 bp, Artificial Sequence
  Synthetic
tctgggcagggaataggacgaggccaaagatctccgccgagcggtatatgtgcacgcgcccaccgcccctcagga

SEQ ID NO: 159446 - DNA, 75 bp, Artificial Sequence
  Synthetic
gacgggcagtctcctgattgcggtgcgttgcggggatggcaagatccagggagggtcgctgtttgagcagctctt

SEQ ID NO: 159447 - DNA, 75 bp, Artificial Sequence
  Synthetic
gccatgccctcgacttccaggagccgtgttagctcatgaatttcaccgtcagccgcagcggctaggttcagccag

SEQ ID NO: 159448 - DNA, 75 bp, Artificial Sequence
  Synthetic
acctcccggagatgtttgcagagcaccccggcctggtgtttgaggtggaggagcgcagcgtgggtgaggtgctgc

SEQ ID NO: 159449 - DNA, 75 bp, Artificial Sequence
  Synthetic
gtgttagctcatgaatttcaccgtcagccgcagcggctaggttcagccaggcaccggcgcccccagctaaggcca

SEQ ID NO: 159450 - DNA, 75 bp, Artificial Sequence
  Synthetic
tgtcaggacacggatacagtaggcctcaaatgttccaacggagcagccaattctgaaggcgatgctttccccccc

SEQ ID NO: 159451 - DNA, 75 bp, Artificial Sequence
  Synthetic
cggggggtcgcagatgggtggccaccatggtggccccgagggtagatgatgtaattgttggtcgttgatgacccc

SEQ ID NO: 159452 - DNA, 75 bp, Artificial Sequence
  Synthetic
ggggcattcacatccatggtcctgattccgcgcacggggccggttccccgggtgcgctggctttgcccccagtcg

SEQ ID NO: 159453 - DNA, 75 bp, Artificial Sequence
  Synthetic
aggtgcagcacggcccagagacggtgttgcgccagtcgctgcgcctgctgctgggaacctggtcctcctttgcca

SEQ ID NO: 159454 - DNA, 75 bp, Artificial Sequence
  Synthetic
ttccataaccatcctacaaactcaataaatgaaactcggtttttcgtgcccagcccaatccatatagcatacagg

SEQ ID NO: 159455 - DNA, 75 bp, Artificial Sequence
  Synthetic
gttgcgccagtcgctgcgcctgctgctgggaacctggtcctcctttgccagcgagcagtacgagtgcctgcgacc

SEQ ID NO: 159456 - DNA, 75 bp, Artificial Sequence
  Synthetic
gcgagcagtacgagtgcctgcgaccagatcggattaaccggtccatgcacgtttccgactacggctataacgaag

SEQ ID NO: 159457 - DNA, 75 bp, Artificial Sequence
  Synthetic
cactggcagtctccccgttgacaggaaagaatctcagcccacgccggctggtgacagagcctgacccacgatgtc

SEQ ID NO: 159458 - DNA, 75 bp, Artificial Sequence
  Synthetic
aaagaatctcagcccacgccggctggtgacagagcctgacccacgatgtcaggtggccgtgctatgcgccccggg

SEQ ID NO: 159459 - DNA, 75 bp, Artificial Sequence
  Synthetic
gcctcgcccgagtcacattcttgtgcatggccttaatggcattttcatacacatgagtccagtaccgcatcggtt

SEQ ID NO: 159460 - DNA, 75 bp, Artificial Sequence
  Synthetic
aggtggccgtgctatgcgccccgggcaccaggggccatgaaagcctcctggcggccttcacgaatgccggatgcc

SEQ ID NO: 159461 - DNA, 75 bp, Artificial Sequence
  Synthetic
gcctgctggagcaacagcttgtcattctggaaggcgtagcgtatgtgtggacaggcctccatggtgatgatctaa

SEQ ID NO: 159462 - DNA, 75 bp, Artificial Sequence
  Synthetic
tccagccatgtgtccttgttggttgacttggtgaaaaactcacgtagtgtcttgtagctcctgcgcagctcgtgt

SEQ ID NO: 159463 - DNA, 75 bp, Artificial Sequence
  Synthetic
acaagtcaggaaggcacgcggggggccacgtcaccccggggtgctggggtgggggatgggctcaggcaaccgtaa

SEQ ID NO: 159464 - DNA, 75 bp, Artificial Sequence
  Synthetic
cctggcaggccgtgccaccgtggcgctgattaatcgttcccccgccctgcgtgacgctattctaaagttcctcaa

SEQ ID NO: 159465 - DNA, 75 bp, Artificial Sequence
  Synthetic
caggccagatacgttctcggtggccttgggggagctgggggtgcaagttttggctggcctgggggccgtggggtc

SEQ ID NO: 159466 - DNA, 75 bp, Artificial Sequence
  Synthetic
aacagataatccacccgcccctggcgtggaagttaatgtccagagatcacctctgattctggcccccaacgcctc

SEQ ID NO: 159467 - DNA, 75 bp, Artificial Sequence
  Synthetic
gtggaagttaatgtccagagatcacctctgattctggcccccaacgcctctggcatgtttgagtcccgctggctg

SEQ ID NO: 159468 - DNA, 75 bp, Artificial Sequence
  Synthetic
tggcatgtttgagtcccgctggctgaacattagcatcccggcgaccaccagctctgtcatgctgcgtggcctccg

SEQ ID NO: 159469 - DNA, 75 bp, Artificial Sequence
  Synthetic
gtgactcgctcacccaagaaagcggtgacagcctggccggcggccacgcaggaggccaacaggaggagctgagcg

SEQ ID NO: 159470 - DNA, 75 bp, Artificial Sequence
  Synthetic
gctctgtcatgctgcgtggcctccggggctgcgtcctgccttgttgggtgcaaggctcgtgcctgggcctgcaat

SEQ ID NO: 159471 - DNA, 75 bp, Artificial Sequence
  Synthetic
atgaacctggccattgctctggactctcctcacccaggcctcgcgtcttatactattctgccacgcccattttat

SEQ ID NO: 159472 - DNA, 75 bp, Artificial Sequence
  Synthetic
gtggcgggccaagcgtccagtctggccagagggccggtctcgatatccgtgaaccagccgggttccgcggcctcc

SEQ ID NO: 159473 - DNA, 75 bp, Artificial Sequence
  Synthetic
tactattctgccacgcccattttatcatataagcctgaagcccgtgagctggcctgacgagaccatgaggccagc

SEQ ID NO: 159474 - DNA, 75 bp, Artificial Sequence
  Synthetic
gacaggtggtgggcgggcgtctcgccggactatggcctcggcacgctcggcgtcgatggcgggtggctggaacag

SEQ ID NO: 159475 - DNA, 75 bp, Artificial Sequence
  Synthetic
gggctgcgtcctgccttgttgggtgcaaggctcgtgcctgggcctgcaatttactaacctcgggatgccatatgt

SEQ ID NO: 159476 - DNA, 75 bp, Artificial Sequence
  Synthetic
ccaggcatctttcagggtcacgagaccggggtccatgcttagaaaacagccctcccgggcggtgggcggcccggg

SEQ ID NO: 159477 - DNA, 75 bp, Artificial Sequence
  Synthetic
tccaagaaaccccacggagcagggcaacattgcagggctctgttcacgcgatggtcgtcatctggctctcctgtg

SEQ ID NO: 159478 - DNA, 75 bp, Artificial Sequence
  Synthetic
catataagcctgaagcccgtgagctggcctgacgagaccatgaggccagccaagtctacagattctgtgtttgtg

SEQ ID NO: 159479 - DNA, 75 bp, Artificial Sequence
  Synthetic
atggtcgtcatctggctctcctgtgtgacccctcactttgtacagacttttggcaatgggagcacattccccccg

SEQ ID NO: 159480 - DNA, 75 bp, Artificial Sequence
  Synthetic
agtagctgatcatgaaccggctctgtcgaagcgagctcatcactctctatgcctaggtcaccggtgtagacacaa

SEQ ID NO: 159481 - DNA, 75 bp, Artificial Sequence
  Synthetic
aggaccccggtcgaggcgtgggtcgcgccctcgccgccggacgacaaggtggctgagtccagctacctcatgttc

SEQ ID NO: 159482 - DNA, 75 bp, Artificial Sequence
  Synthetic
aaggcctccctgaggaaggataggaagctgtacgcagagctggcctgcaggacagccgacatcgggggcaaagac

SEQ ID NO: 159483 - DNA, 75 bp, Artificial Sequence
  Synthetic
tccactggggatctttgccagccttcatactagattcagcgatcccccggttgggaatcttcgccagccccccgt

SEQ ID NO: 159484 - DNA, 75 bp, Artificial Sequence
  Synthetic
ggccagggcccacctggcggcggcgtcccggcacacatcctggatgccctccacgacgctctttagcgtctggag

SEQ ID NO: 159485 - DNA, 75 bp, Artificial Sequence
  Synthetic
ccttttccttgcgcccggtctccataagctgccgcagcttcttctcatactgtcgcttgagctctttgttggggg

SEQ ID NO: 159486 - DNA, 75 bp, Artificial Sequence
  Synthetic
ccaggctcaggggaacacccttgccccataacctgtatgggctgcaaaatgggtgggtagaaaataggcgcccgc

SEQ ID NO: 159487 - DNA, 75 bp, Artificial Sequence
  Synthetic
ccgacattctatcaacctaacaaggagtgaaggtgtggggatcggcaaagattgcgcccaggatcacgcctgccc

SEQ ID NO: 159488 - DNA, 75 bp, Artificial Sequence
  Synthetic
tgaagccctggctgatgcaacttgaggcagcctaatcccacccagactagcccccaggttcctgtgaaaagcaag

SEQ ID NO: 159489 - DNA, 75 bp, Artificial Sequence
  Synthetic
ctgggggttcccggacaatacacccatctggagttcaacttaattacatggtagataaattaagagtccctcctc

SEQ ID NO: 159490 - DNA, 75 bp, Artificial Sequence
  Synthetic
cgactttggggatattcggagtctgccctcgccgctctcttctctcgtttaaacgagagaatagtagtagggtcc

SEQ ID NO: 159491 - DNA, 75 bp, Artificial Sequence
  Synthetic
ctataagataacgaggagagatgaggtgagggcagaggacattgggcaggtgtgggccacggggcagctggccat

SEQ ID NO: 159492 - DNA, 75 bp, Artificial Sequence
  Synthetic
gtgagggcagaggacattgggcaggtgtgggccacggggcagctggccatatcccccgcaccacagaagtgtaag

SEQ ID NO: 159493 - DNA, 75 bp, Artificial Sequence
  Synthetic
gcatctgggtgctcttgtaggctgagagcttgcggctgagctccgttgaaaagcagagctcccccatggggaccc

SEQ ID NO: 159494 - DNA, 75 bp, Artificial Sequence
  Synthetic
caaagtgaagggctcggaaggcaggcggggcctagcaatgtcacagctaaatgcccaccagggcacacactcaag

SEQ ID NO: 159495 - DNA, 75 bp, Artificial Sequence
  Synthetic
gggaggtagataggtggtcgcattgtatctcggtcttggcgtagttgaatcaccgccgtaatctgtggtgggctc

SEQ ID NO: 159496 - DNA, 75 bp, Artificial Sequence
  Synthetic
accaagcgtccccgcagcggggctcccaacacgggttcccagagagggtaaaagagggggccataaagcccaggg

SEQ ID NO: 159497 - DNA, 75 bp, Artificial Sequence
  Synthetic
ccaacacgggttcccagagagggtaaaagagggggccataaagcccagggtgtaaaacaccgaccgcgccaccag

SEQ ID NO: 159498 - DNA, 75 bp, Artificial Sequence
  Synthetic
caagttcaaagaacctttggtgtatagccgggcagatgtaaacaatctcgatggccagccggggccacaggcata

SEQ ID NO: 159499 - DNA, 75 bp, Artificial Sequence
  Synthetic
gtttgggtacgacgcctacagcgccctaccgagagaaagctccaagccgggggacttcttccccgaagggctaga

SEQ ID NO: 159500 - DNA, 75 bp, Artificial Sequence
  Synthetic
atggcacacgtgggggaaatgagggttagcataggcaacccccgcctacacaccaactatagcaaaccccgcccc

SEQ ID NO: 159501 - DNA, 75 bp, Artificial Sequence
  Synthetic
cctctgtctcctggttgacctggaggaagatgaggacgtagaagagcggcggcggttgcgcccgggtgatggcgt

SEQ ID NO: 159502 - DNA, 75 bp, Artificial Sequence
  Synthetic
caccaactatagcaaaccccgccccgtcacggtgacgtagtctgtcttgaggagatgtagacttgtagacactgc

SEQ ID NO: 159503 - DNA, 75 bp, Artificial Sequence
  Synthetic
agagaggcaggttggccagaaagagacagggggcagaaacccacgtgctggtcgagtagactctgagggagaaga

SEQ ID NO: 159504 - DNA, 75 bp, Artificial Sequence
  Synthetic
gcccaacattgcctcgatgtcgtccaggatggtgcggaggcgcttttcgttttctctggtggtctcgagctcctt

SEQ ID NO: 159505 - DNA, 75 bp, Artificial Sequence
  Synthetic
cattccatcgttaaaacaggaggtagcggtggggcagtctgcgagcgttagggtcccgctctacgacaaggaggt

SEQ ID NO: 159506 - DNA, 75 bp, Artificial Sequence
  Synthetic
aaccatccacctagcagctcagggaatggcatacacattacatgaacaacacggcatggccccgtgtccggtagc

SEQ ID NO: 159507 - DNA, 75 bp, Artificial Sequence
  Synthetic
aaaacctcaggacctacgctgccctagaggttttgctagggaggagacgtgtgtggctgtagccacccgtcccgg

SEQ ID NO: 159508 - DNA, 75 bp, Artificial Sequence
  Synthetic
gcgcgagggcctaggcctcggctctgactctagctccagttccaccgtctccgagacagggacatagtcagtgcc

SEQ ID NO: 159509 - DNA, 75 bp, Artificial Sequence
  Synthetic
gtcacggtgacgtagtctgtcttgaggagatgtagacttgtagacactgcaaaacctcaggacctacgctgccct

SEQ ID NO: 159510 - DNA, 75 bp, Artificial Sequence
  Synthetic
ttggctgagacaaagacggcctcgtacctgaccaagggcaggatcaggatgatggaggcgatgaacatgccgcag

SEQ ID NO: 159511 - DNA, 75 bp, Artificial Sequence
  Synthetic
acctgaccaagggcaggatcaggatgatggaggcgatgaacatgccgcagtagaagccaaagttgtgccgcatga

SEQ ID NO: 159512 - DNA, 75 bp, Artificial Sequence
  Synthetic
atgaacctgggacctattgatgcagatctcgcagtgagaccccagagtcaggctgtggccgaagggagacaggcg

SEQ ID NO: 159513 - DNA, 75 bp, Artificial Sequence
  Synthetic
aggcccccagggacaggtgctgcttgcacgagaacatggtgttaaatgagggggttaaaggcctgcttcactttc

SEQ ID NO: 159514 - DNA, 75 bp, Artificial Sequence
  Synthetic
aatgtaccagaagatgggcaggatgaggaagaggttcacggctcccagcaccatgtcccccaccataaagtaaaa

SEQ ID NO: 159515 - DNA, 75 bp, Artificial Sequence
  Synthetic
ccatgtcccccaccataaagtaaaagctgttgcccagggccaggaacacgctgagcgagaagaccagcgtctcca

SEQ ID NO: 159516 - DNA, 75 bp, Artificial Sequence
  Synthetic
gctgttgcccagggccaggaacacgctgagcgagaagaccagcgtctccagggcaaggcaccccaggtacaggtt

SEQ ID NO: 159517 - DNA, 75 bp, Artificial Sequence
  Synthetic
ttgcggcggcctccccccccatgaagcgggtggcgcggggtccctgcctggcaccagggtccggcctgggagcgc

SEQ ID NO: 159518 - DNA, 75 bp, Artificial Sequence
  Synthetic
cgtattccccgttttcacagagagaatgtcctccgtggctaaaagcgtagatgccgccgtaaatgagtcgggcca

SEQ ID NO: 159519 - DNA, 75 bp, Artificial Sequence
  Synthetic
tactctatcgctgtcaacagcgccaaaaagcggacgtcctcctcatctaccccagcctgttgtctggccacggcc

SEQ ID NO: 159520 - DNA, 75 bp, Artificial Sequence
  Synthetic
atttatgagattaagtgccgcttcaagtacctcttttccaagtcagagtttgaccccatctacccatcctacact

SEQ ID NO: 159521 - DNA, 75 bp, Artificial Sequence
  Synthetic
ggtcagggcaaggagagtctctttaacagtttctacatgacccacggcctggggaccctgcaggaggggacctgg

SEQ ID NO: 159522 - DNA, 75 bp, Artificial Sequence
  Synthetic
aaagtccaccaccagaaccggggagttgtagaatccggacaggggctggatgacggtggccccctggtagccgtc

SEQ ID NO: 159523 - DNA, 75 bp, Artificial Sequence
  Synthetic
agtacctcttttccaagtcagagtttgaccccatctacccatcctacactgcgctttacaagaggccatgcaaga

SEQ ID NO: 159524 - DNA, 75 bp, Artificial Sequence
  Synthetic
ccactaaccatccttttgccaatcaattctgtgacggggtttcctggacacccagtcttagttcaggtagacacc

SEQ ID NO: 159525 - DNA, 75 bp, Artificial Sequence
  Synthetic
ctgtttttttgtggctagttttgcacccacaacatgtaagggcccgctacccctacaacacaaaacaaactatct

SEQ ID NO: 159526 - DNA, 75 bp, Artificial Sequence
  Synthetic
cagcggctgtcattacaaagtagtgcctgtctgcaaaatggcagaggaagaccggtagccgctgcacccttcgaa

SEQ ID NO: 159527 - DNA, 75 bp, Artificial Sequence
  Synthetic
cccagtcttagttcaggtagacacccagttatgcagtgccaccaattccaaccatttttaaacctcctggaattc

SEQ ID NO: 159528 - DNA, 75 bp, Artificial Sequence
  Synthetic
cgcctgcaggggatgtgagcgatcttggcaatctctgccacctccacgtggatcacgaaatggtttagcagatcc

SEQ ID NO: 159529 - DNA, 75 bp, Artificial Sequence
  Synthetic
tgccagggacagaagagctctctgaccccggtgccggagacgggcagctacgtggcgggggcggccgccagcccc

SEQ ID NO: 159530 - DNA, 75 bp, Artificial Sequence
  Synthetic
tgccaacaggggggtggagtctatgctctacgtaatgacggacccaagcgaaaatgcggggcgcattggtattaa

SEQ ID NO: 159531 - DNA, 75 bp, Artificial Sequence
  Synthetic
gggtattatatgctgactgtatatgcattaggatagcatatgctacccagatatagattaggatagcatatgcta

SEQ ID NO: 159532 - DNA, 75 bp, Artificial Sequence
  Synthetic
atcgaggaagacctcgcactccaccgggcaggtaaacatggtcaccccgcccccatctcccccggttccccgcgc

SEQ ID NO: 159533 - DNA, 75 bp, Artificial Sequence
  Synthetic
cttctttaggctgagggaccgcttcccccccgtcatgtccacgcagcggagggacccctatgtgatctcgggggc

SEQ ID NO: 159534 - DNA, 75 bp, Artificial Sequence
  Synthetic
atcaatccacggcacaactacttctaccaggtgctcctccaatacaaaattgttggagactacgtccgccacagt

SEQ ID NO: 159535 - DNA, 75 bp, Artificial Sequence
  Synthetic
cgcctgagccttgctggcgtgcccacttctgcaacgaggaagccgtcttgggcatcaacagcacctgcccaatca

SEQ ID NO: 159536 - DNA, 75 bp, Artificial Sequence
  Synthetic
atatagattaggatagcatatgctacccggatatagattaggatagcatatactacccaaatagagattaggata

SEQ ID NO: 159537 - DNA, 75 bp, Artificial Sequence
  Synthetic
gactcggaaaggaaagctggtttgctgacgcgtggcggtaggctgcaccgtggtggcggggggtgcgggctgctc

SEQ ID NO: 159538 - DNA, 75 bp, Artificial Sequence
  Synthetic
ggccttctttcgaaaacggtcgcctctagacccggcgacctgcacgctcggctcagacctgcttctggacgcctc

SEQ ID NO: 159539 - DNA, 75 bp, Artificial Sequence
  Synthetic
gtccgcacctccttctgtgcacgaagttttgcggaaccaggagaaggggtctggcgtcttgctggggccacactc

SEQ ID NO: 159540 - DNA, 75 bp, Artificial Sequence
  Synthetic
agtgaaacgagcagtgatgaggacaccggtagacagggttcggacgtggagctagagtcctcggacgatgagctg

SEQ ID NO: 159541 - DNA, 75 bp, Artificial Sequence
  Synthetic
ggtggagattcccgtggcggtgctggtgacacccgtggtcctgccggactctgtcatccgtaagaccttgagcac

SEQ ID NO: 159542 - DNA, 75 bp, Artificial Sequence
  Synthetic
tcttcgatgatgcgccggtacgcggccgccagggcccgggtctctgcgatgagccgagagccgtccagcggatcg

SEQ ID NO: 159543 - DNA, 75 bp, Artificial Sequence
  Synthetic
caggctctgtcaccagccggcgtgggctgagattctttcctgtcaacggggagactgccagtgcttcgttatagc

SEQ ID NO: 159544 - DNA, 75 bp, Artificial Sequence
  Synthetic
gtgacacccgtggtcctgccggactctgtcatccgtaagaccttgagcaccgcggctggctcctggaaagcgtac

SEQ ID NO: 159545 - DNA, 75 bp, Artificial Sequence
  Synthetic
ctagacccggcgacctgcacgctcggctcagacctgcttctggacgcctcggtggagattcccgtggcggtgctg

SEQ ID NO: 159546 - DNA, 75 bp, Artificial Sequence
  Synthetic
gcatatgctatcctaatctctatctgggtagcatatactatcctaatctctatatgggtagcatatgctatccta

SEQ ID NO: 159547 - DNA, 75 bp, Artificial Sequence
  Synthetic
ctggagactactaagctaatagcggtcgaagaagggagggcctgcggggaaaccaacgaggggctcgaatatgat

SEQ ID NO: 159548 - DNA, 75 bp, Artificial Sequence
  Synthetic
tgtcttcatcctctgtggtggggatatcggaggctaagtcgctctccgcttcttcagagtcggacatggatagga

SEQ ID NO: 159549 - DNA, 75 bp, Artificial Sequence
  Synthetic
gaggactctgaaaatgatgaattgctgtttttgccaaataaaaaaccaaactaacatctcttgtaattaatgggt

SEQ ID NO: 159550 - DNA, 75 bp, Artificial Sequence
  Synthetic
gcatatgctatccatcgcaacattagcccaccgtgctctcaacgacctcgtgaatatgaggaccaacaaccctgt

SEQ ID NO: 159551 - DNA, 75 bp, Artificial Sequence
  Synthetic
gcggacgaggccagaacccccagatgcatcatccccaaaggagggctgctgcccgaagggaggtgatggggatat

SEQ ID NO: 159552 - DNA, 75 bp, Artificial Sequence
  Synthetic
cggtggcgtaggcttgactggaaccggtttgggcactggaggtggttgatggagaatcaccattggcatctccac

SEQ ID NO: 159553 - DNA, 75 bp, Artificial Sequence
  Synthetic
gtaacttgtcttccagatcgcagcaatcgcgcccctatcttggcccgcccacctacttatgcaggtattccccgg

SEQ ID NO: 159554 - DNA, 75 bp, Artificial Sequence
  Synthetic
ccgttaaaacagtagaagaactgcaagatatcacaccctcggagatcatcccactgggacggggtggtgcctggt

SEQ ID NO: 159555 - DNA, 75 bp, Artificial Sequence
  Synthetic
ccactgggacggggtggtgcctggtatgcagaaggggccctgtacatgtttttcgttaacatggacatgctgatg

SEQ ID NO: 159556 - DNA, 75 bp, Artificial Sequence
  Synthetic
cggctgatggcgggggctgctgctgaggaagaagtggagaaggagccggggcggctgattgcgggggctgctgct

SEQ ID NO: 159557 - DNA, 75 bp, Artificial Sequence
  Synthetic
tatgggccccattggcgtggagccccgtttaattttcgggggtgttagagacaaccagtggagtccgctgctgtc

SEQ ID NO: 159558 - DNA, 75 bp, Artificial Sequence
  Synthetic
gggcgctgaggactgcaaactccacgtccagaccctgaggcgcgctggcgtagaagtaggcctgctgcccaaaca

SEQ ID NO: 159559 - DNA, 75 bp, Artificial Sequence
  Synthetic
gctaaccagatgtgataacggggaatgtgtgacatgctatggtgccggggcccacgtgaacatcctgcgtggctg

SEQ ID NO: 159560 - DNA, 75 bp, Artificial Sequence
  Synthetic
tgtgtgacatgctatggtgccggggcccacgtgaacatcctgcgtggctggacggaggacgatagcccaggcaca

SEQ ID NO: 159561 - DNA, 75 bp, Artificial Sequence
  Synthetic
cagcgcggaggagtactctgacctggccctctttgtggacgggggctcccgggcccacgaagagagcaacgtcat

SEQ ID NO: 159562 - DNA, 75 bp, Artificial Sequence
  Synthetic
acaaatagagtgtaacaacatggttcacctgtcttggtccctgcctgggacacatcttaataaccccagtatcat

SEQ ID NO: 159563 - DNA, 75 bp, Artificial Sequence
  Synthetic
taaatatgacgcagcgggtcagcagtcatggtcgctctacggacgccgccctagaggaactccagcggcgggacc

SEQ ID NO: 159564 - DNA, 75 bp, Artificial Sequence
  Synthetic
aagaccgggaggccccaacggcgggctaaacagaacgatggccttctatctcccagactggtcgtgctgcgggct

SEQ ID NO: 159565 - DNA, 75 bp, Artificial Sequence
  Synthetic
cgtacccataactgggcatcgggctttgttgggtctgatgttcaaaccggaggatgccccctttgtggtgggact

SEQ ID NO: 159566 - DNA, 75 bp, Artificial Sequence
  Synthetic
caccccatggatttctattgttaaagatattcagaatgtttcattcctacactagtatttattgcccaaggagtt

SEQ ID NO: 159567 - DNA, 75 bp, Artificial Sequence
  Synthetic
aggatgccccctttgtggtgggactgagatttaacccacccaaaatgcacccggacatgtcacgcgtcctgcagg

SEQ ID NO: 159568 - DNA, 75 bp, Artificial Sequence
  Synthetic
ccggacatgtcacgcgtcctgcagggggttcttgctaatgggaaagaggtcccatgtacagcacaaccttggacc

SEQ ID NO: 159569 - DNA, 75 bp, Artificial Sequence
  Synthetic
attgtcattggtttcagcaatcggacctccggcccctaggcagtttattccttgagcaaaacctgaacatcgaag

SEQ ID NO: 159570 - DNA, 75 bp, Artificial Sequence
  Synthetic
ctgctgcgattttctgacctttacagccgggctatgctctacaattgccaagtactgaaacgtcaggtcttacat

SEQ ID NO: 159571 - DNA, 75 bp, Artificial Sequence
  Synthetic
gccgggctatgctctacaattgccaagtactgaaacgtcaggtcttacattcttattgaagcaggtggcacacat

SEQ ID NO: 159572 - DNA, 75 bp, Artificial Sequence
  Synthetic
cacatacaccttactgttcacaactcagcagttattctattagctaaacgaaggagaatgaagaagcaggcgaag

SEQ ID NO: 159573 - DNA, 75 bp, Artificial Sequence
  Synthetic
cagcagttattctattagctaaacgaaggagaatgaagaagcaggcgaagattcaggagagttcactgcccgctc

SEQ ID NO: 159574 - DNA, 75 bp, Artificial Sequence
  Synthetic
ccttgttgacctctacacgcttggagtcgaagctcttggtcaaggtgtcaataatttcagtgaaaacggcggacg

SEQ ID NO: 159575 - DNA, 75 bp, Artificial Sequence
  Synthetic
ataatttcagtgaaaacggcggacgcgacatgtttctggtgagccacgtagcctatttgcacgttggagagattc

SEQ ID NO: 159576 - DNA, 75 bp, Artificial Sequence
  Synthetic
accgtgacagctcatggggtgggagatatcgctgttccttaggacccttttactaaccctaattcgatagcatat

SEQ ID NO: 159577 - DNA, 75 bp, Artificial Sequence
  Synthetic
tactaaccctaattcgatagcatatgcttcccgttgggtaacatgtgctattgaattagggttagtctggatagt

SEQ ID NO: 159578 - DNA, 75 bp, Artificial Sequence
  Synthetic
gagaggatgaggctgatgatggccacgactatccaggtcttgccgtggcgcctggggataagaaacacgctggct

SEQ ID NO: 159579 - DNA, 75 bp, Artificial Sequence
  Synthetic
catcagggctggcctggaggccattatatcacaaaaacaggaggaagactgtgtgtttgatgtggtgtgcaacct

SEQ ID NO: 159580 - DNA, 75 bp, Artificial Sequence
  Synthetic
ttgagatcagaaaataaaaagaatgtaacactacttgtttctggaatgcttctaggcgggcgggcttgtgcttgt

SEQ ID NO: 159581 - DNA, 75 bp, Artificial Sequence
  Synthetic
cccagcattggtgtaagagcttcaaccaagagttacacataaaggcaatgttgtgttgcagtccacagactgcaa

SEQ ID NO: 159582 - DNA, 75 bp, Artificial Sequence
  Synthetic
aaaaagttggggtcctcaaggatggcacgggcagaggacacgctggtcttgaattccgtcaaggcctcggagtct

SEQ ID NO: 159583 - DNA, 75 bp, Artificial Sequence
  Synthetic
tggtaaggcccagcccattggtatggagcctggggagctggttgagcagcaacgtctggatgtaaacttaaatcc

SEQ ID NO: 159584 - DNA, 75 bp, Artificial Sequence
  Synthetic
ctgctgctgggtggaggagggcagggctccgggggcaggcgcaagcgccgtctggccaccgttctccccggactc

SEQ ID NO: 159585 - DNA, 75 bp, Artificial Sequence
  Synthetic
tttataaggatgtcaactacagtcagagaacccctttgtgtttggtcccccccccgtgtcacatgtggaacaggg

SEQ ID NO: 159586 - DNA, 75 bp, Artificial Sequence
  Synthetic
cccccgtgtcacatgtggaacagggcccagttggcaagttgtaccaaccaactgaagggattacatgcactgccc

SEQ ID NO: 159587 - DNA, 75 bp, Artificial Sequence
  Synthetic
cccagttggcaagttgtaccaaccaactgaagggattacatgcactgccccgcgggaaatacgtcctacccagga

SEQ ID NO: 159588 - DNA, 75 bp, Artificial Sequence
  Synthetic
gagcgactccattatttccctcgttgcctcatataattccgtcccgatactcctgatggtcctctcgtgccccaa

SEQ ID NO: 159589 - DNA, 75 bp, Artificial Sequence
  Synthetic
cgcgggaaatacgtcctacccaggaacccgaaacagtgtttcccagaagctgtaaaaatagaacgccctggaact

SEQ ID NO: 159590 - DNA, 75 bp, Artificial Sequence
  Synthetic
tagtggcggcagtatgctcgaagcattgggcaatataaattactggcgtgaattgtgcccaccagagggtgagcc

SEQ ID NO: 159591 - DNA, 75 bp, Artificial Sequence
  Synthetic
gttgtcagggtcctgtgggccattgtcaggaccacctccaggtgcgcctaggttttgagagcagagtgggggtcc

SEQ ID NO: 159592 - DNA, 75 bp, Artificial Sequence
  Synthetic
actgaggtgggagatgtggtgccctgggatcccatggaccctgggtgtgcccatgcacgggatcttgagaccatg

SEQ ID NO: 159593 - DNA, 75 bp, Artificial Sequence
  Synthetic
gtgcaggacctcggccagggactgaacaactgccgagtttgcgatctgggcagggaataggacgaggccaaagat

SEQ ID NO: 159594 - DNA, 75 bp, Artificial Sequence
  Synthetic
tccctatctcaggtaggcctgcacaccttaggtatggagcgaaggttagtggtcactctgcagtgcctggtgctg

SEQ ID NO: 159595 - DNA, 75 bp, Artificial Sequence
  Synthetic
acataatactcggggtctcggcacccaggcagccttgcgtggtgctgtcctgctgaagggcgtttcttaggttct

SEQ ID NO: 159596 - DNA, 75 bp, Artificial Sequence
  Synthetic
tgctgaagggcgtttcttaggttctcggtcagacggccgcgctgcgaggcatacagcatgttcaacgcggtcaag

SEQ ID NO: 159597 - DNA, 75 bp, Artificial Sequence
  Synthetic
cggggtactgggggtggttgatgggacccttgtcctcctccatctggggggtggcatatctgaaggcagccaggt

SEQ ID NO: 159598 - DNA, 75 bp, Artificial Sequence
  Synthetic
cccgcatatcctggatatgaagatgattggagcccgtgggccggcggctcctggtatccctggtatggagcctgg

SEQ ID NO: 159599 - DNA, 75 bp, Artificial Sequence
  Synthetic
attggagcccgtgggccggcggctcctggtatccctggtatggagcctggggggcaggacatggccaggatcagg

SEQ ID NO: 159600 - DNA, 75 bp, Artificial Sequence
  Synthetic
gccttcagtcgtgttaaaacctttttccagacaaaggacgaggtagataaccttttgctcaaggagtctctgcta

SEQ ID NO: 159601 - DNA, 75 bp, Artificial Sequence
  Synthetic
tcgcccgcaggtatgggcagtgtctggaactggcactggaggcctgccaggacacgcccgagcaatttaagctgg

SEQ ID NO: 159602 - DNA, 75 bp, Artificial Sequence
  Synthetic
agctgaaggacaccagggggcgcgagtagcacatggtctcggagccagggaccctcatgctcttgcgcagggtga

SEQ ID NO: 159603 - DNA, 75 bp, Artificial Sequence
  Synthetic
acccagttgacccaagtatcccctcagcaaccaatggaggggccgttggtaccagagcagcagatgttccctggt

SEQ ID NO: 159604 - DNA, 75 bp, Artificial Sequence
  Synthetic
ggtttcatttaagcaggtgagggtgccattgtttaccgccatcgcacttgttattgttctactcctggcatactt

SEQ ID NO: 159605 - DNA, 75 bp, Artificial Sequence
  Synthetic
ctagaccttcttgaaaaagacgatgaagtcatggagcagagggttatggcaaccctactgccaccagtaccacaa

SEQ ID NO: 159606 - DNA, 75 bp, Artificial Sequence
  Synthetic
tttgccacccagggtaagaggaggagggcgggtggcagccgcggccatcacctgggtacccaaaccaaatgtaga

SEQ ID NO: 159607 - DNA, 75 bp, Artificial Sequence
  Synthetic
ccaaagaccatgtaaattctttgggtgaaaatctaaagaccctacggctccgcctgcgcaggtgccacaggttcc

SEQ ID NO: 159608 - DNA, 75 bp, Artificial Sequence
  Synthetic
tgactatgacttctcgagcctggctttggagctcttgcccctcaacccccgtttaccagaagaatggcagtttgg

SEQ ID NO: 159609 - DNA, 75 bp, Artificial Sequence
  Synthetic
ggtctggccggtggatcctccaccgccggttaactttaacaagacggccgagcaggagtatggggacaaagaggt

SEQ ID NO: 159610 - DNA, 75 bp, Artificial Sequence
  Synthetic
aaaatgggatctgtctacaccatgtctggtgtgccgggaacatattgagcgggccacactgccaaccctttccat

SEQ ID NO: 159611 - DNA, 75 bp, Artificial Sequence
  Synthetic
gctcgtgtccaatatcctccctcaggacaacaggccctggcacgaggcccggagctccggccgtgtggccgagga

SEQ ID NO: 159612 - DNA, 75 bp, Artificial Sequence
  Synthetic
tgggtctgtgttttgaggtgtttgatggggaccttatgcgaattgcgctggcctggaacaaagatgaggttatag

SEQ ID NO: 159613 - DNA, 75 bp, Artificial Sequence
  Synthetic
acaaagccatgagtgaatttgacatttttattaactacatagaagcatacatgacaattaaagccaggtgataat

SEQ ID NO: 159614 - DNA, 75 bp, Artificial Sequence
  Synthetic
gcctggaacaaagatgaggttataggtcaggccttgcaaatattggcccactcccatacctggacctccctggtg

SEQ ID NO: 159615 - DNA, 75 bp, Artificial Sequence
  Synthetic
ctcccaacgttgcgcgccctacgcctctttgtgtggattacactgccgcttcccacaacactgctcactccccct

SEQ ID NO: 159616 - DNA, 75 bp, Artificial Sequence
  Synthetic
ccactgcgaagagcgtcactgtgtttacgctgcagcacggggcaagaggggccctattctgctacccactgcggt

SEQ ID NO: 159617 - DNA, 75 bp, Artificial Sequence
  Synthetic
gccctattctgctacccactgcggtttatacaccatgtgccaacatagaggcattcctggcacacctcaccaggt

SEQ ID NO: 159618 - DNA, 75 bp, Artificial Sequence
  Synthetic
ctctctcgtaggcggcctacataagcctctgtcactgctctgtcagcttctttcctcagttgccttgctcctgcc

SEQ ID NO: 159619 - DNA, 75 bp, Artificial Sequence
  Synthetic
tgttctaggtccatcttaggagcccgggccagcattctatcagcttaacgggaagagaagtggggagggcactcg

SEQ ID NO: 159620 - DNA, 75 bp, Artificial Sequence
  Synthetic
gggcacccgccaccatgaagacaccaccgagagcgcccactcccatgtcaccacctgaggtgccgcccgttcccc

SEQ ID NO: 159621 - DNA, 75 bp, Artificial Sequence
  Synthetic
tgaataaaatggcaaaacagctctgcctgctgcctcaggaacccttttgcatcactcgtgtgtgccttttgtgct

SEQ ID NO: 159622 - DNA, 75 bp, Artificial Sequence
  Synthetic
agcagccacctgcggacaaaaatcaggcgtttagatggggcatttatgtttgggacgctagccgcctgggcattc

SEQ ID NO: 159623 - DNA, 75 bp, Artificial Sequence
  Synthetic
cgccagatgtcgcagcagccggtgcagatgctctaccccgggatcgacgagctcgctcagcaacatgcctctggt

SEQ ID NO: 159624 - DNA, 75 bp, Artificial Sequence
  Synthetic
cctgctgcctcaggaacccttttgcatcactcgtgtgtgccttttgtgcttgctacataaacaaaacctaaacgc

SEQ ID NO: 159625 - DNA, 75 bp, Artificial Sequence
  Synthetic
gtttcttgggatgtaggcccggggggatttgcggggtctgccggaggcagtacgggtacagatttcccgaaagcg

SEQ ID NO: 159626 - DNA, 75 bp, Artificial Sequence
  Synthetic
tcagtataaaaggccggtggacacgtatgatccttgcctaattctaacgggagaggcagaaagatatatggtgga

SEQ ID NO: 159627 - DNA, 75 bp, Artificial Sequence
  Synthetic
gggcgggaaggggcacaagaatgacggcgaaactggaccacggtccaccccgccctcaagcgtccgggagccagg

SEQ ID NO: 159628 - DNA, 75 bp, Artificial Sequence
  Synthetic
cgctgtgggaaattaccgggaagcctccactggaactaccgtactctaccccacgtatgatctcggctccatagt

SEQ ID NO: 159629 - DNA, 75 bp, Artificial Sequence
  Synthetic
ggcgaaactggaccacggtccaccccgccctcaagcgtccgggagccaggcggttcggttaaggagggcggcctt

SEQ ID NO: 159630 - DNA, 75 bp, Artificial Sequence
  Synthetic
ggtccaaatcactaccagagattacctgttactgcacccgctttggggctgcctctcctggccttagatctggct

SEQ ID NO: 159631 - DNA, 75 bp, Artificial Sequence
  Synthetic
aaaagagagcggctgtgagcgcacgtgacagatttgggagggaccacgctctgtttgaaacacagtttacatctg

SEQ ID NO: 159632 - DNA, 75 bp, Artificial Sequence
  Synthetic
atattccactcttatttttaaattaatgtgtcccaattagaaacccaagcgcagaaattagttgagaggctagtg

SEQ ID NO: 159633 - DNA, 75 bp, Artificial Sequence
  Synthetic
gcgcgcaacgttgggaggtcgttggcggcaggcgggaggccgtgctttaggggggttcaggtgaggcaaggctgt

SEQ ID NO: 159634 - DNA, 75 bp, Artificial Sequence
  Synthetic
gccctgcgaatggtcgccagcctccggtctggtgatggccagggccaactccgccagctcatcgccactgtattc

SEQ ID NO: 159635 - DNA, 75 bp, Artificial Sequence
  Synthetic
ttttaaacatgcaccctaggccagccagagataatgtcacaagactatcaagttggtgtaaacacgccgtgggaa

SEQ ID NO: 159636 - DNA, 75 bp, Artificial Sequence
  Synthetic
aaacagctaatttctacctatcagagggtggtcaccgcgaccaagactcaatttccaaaaatcaactacaagcag

SEQ ID NO: 159637 - DNA, 75 bp, Artificial Sequence
  Synthetic
cttcaccagggtccggcaccagtgacaagattgtgcgggcgcctattttctacccacccgttttgcagcccatac

SEQ ID NO: 159638 - DNA, 75 bp, Artificial Sequence
  Synthetic
ggctcgctgaaagaggtagcgccccaggtgcctatagagggcctgggtcacgtcccactcggagctgaggtcggg

SEQ ID NO: 159639 - DNA, 75 bp, Artificial Sequence
  Synthetic
gatatgggaatttcagaatgaggtggcggattcaggcgaaaagggtgtgggctgtgcgagtgtcatgaggcaggc

SEQ ID NO: 159640 - DNA, 75 bp, Artificial Sequence
  Synthetic
cgtcccactcggagctgaggtcgggggtggtgaggatgcagctggccagagtggagttttccaccccggcaaagc

SEQ ID NO: 159641 - DNA, 75 bp, Artificial Sequence
  Synthetic
gctgcgacaggccctcgagccatttgaggaacatggatgtgaatatggctgcggagttgagcccgacgaactcct

SEQ ID NO: 159642 - DNA, 75 bp, Artificial Sequence
  Synthetic
cggatgttaaggtcccccctggcattgtagaactcagggacgttggtggccacgcagatggcgttatggcggttt

SEQ ID NO: 159643 - DNA, 75 bp, Artificial Sequence
  Synthetic
tggaggggccgtgggtacccgagcagtggatgttccaaggtgccccccctagccaaggcactgacgtggtccaac

SEQ ID NO: 159644 - DNA, 75 bp, Artificial Sequence
  Synthetic
gcggagttgagcccgacgaactcctccagcagtggcgagttgagtgtctccccagaaccccctcgagagacccag

SEQ ID NO: 159645 - DNA, 75 bp, Artificial Sequence
  Synthetic
gcaacgtctaaagtggtaataacaccaggcggggctgggcaaaggggtcctacgggcgggattaattacgccttg

SEQ ID NO: 159646 - DNA, 75 bp, Artificial Sequence
  Synthetic
tgaaccttgttggcgggagaaggcataacgccttatctgggaggagcgacggattatagccaataagagagctca

SEQ ID NO: 159647 - DNA, 75 bp, Artificial Sequence
  Synthetic
tacgggcgggattaattacgccttgcttacgcaagctcagttaattcgcccacgacttgaaaaatgtagccctta

SEQ ID NO: 159648 - DNA, 75 bp, Artificial Sequence
  Synthetic
ttgattacttcacctttcagcacaaacacctgaaggtgaccaacattgatgacatgacggaaaccctctatgtaa

SEQ ID NO: 159649 - DNA, 75 bp, Artificial Sequence
  Synthetic
ggtggtgaggatgcagctggccagagtggagttttccaccccggcaaagcgcataaagggcgtggagcagcacac

SEQ ID NO: 159650 - DNA, 75 bp, Artificial Sequence
  Synthetic
agctgccggagaacatgacgcgctgtgatcacctccccattacctgcgagtatctgctggggcgggggagctacg

SEQ ID NO: 159651 - DNA, 75 bp, Artificial Sequence
  Synthetic
tggcacaagatggaaagcaaagttgctgtagttactgggtgggagacaggtgtgtatgtggccccccgctggaat

SEQ ID NO: 159652 - DNA, 75 bp, Artificial Sequence
  Synthetic
tgtgttctgctgcaaattttagataagatggcatagagacaaggacaccgaagacccccagagccctcatcgcag

SEQ ID NO: 159653 - DNA, 75 bp, Artificial Sequence
  Synthetic
agccttccccccggtgttatattgtagaatttaagacggccatgagcaacacggccaacccgcaaagcgttactc

SEQ ID NO: 159654 - DNA, 75 bp, Artificial Sequence
  Synthetic
tctccagctcatcccggtgcatctggaagaattcctcatcgtagaatttgtcagagaagacctccagatattcgg

SEQ ID NO: 159655 - DNA, 75 bp, Artificial Sequence
  Synthetic
accaattggcggcccctaagggggggactaaggtcccactacaaaaactctgtgttctgctgcaaattttagata

SEQ ID NO: 159656 - DNA, 75 bp, Artificial Sequence
  Synthetic
cccacttaacactacaagacctacgcctctccattcatcatgtaacccacaaatcatctaaaccgtaagtctaag

SEQ ID NO: 159657 - DNA, 75 bp, Artificial Sequence
  Synthetic
gaaggccacggccgaggacgggcaggacaaggccctggtggactacctgtcggcctgcacgtcctgccacgccct

SEQ ID NO: 159658 - DNA, 75 bp, Artificial Sequence
  Synthetic
cgaccacgcttagcaccctacgccgagtcatctctcatttggaggtgcaggtagagaagggcatatagatcctta

SEQ ID NO: 159659 - DNA, 75 bp, Artificial Sequence
  Synthetic
cggcctgcacgtcctgccacgccctgtttatgcctcagttcagatgcagtctccaggattatggccactggcatg

SEQ ID NO: 159660 - DNA, 75 bp, Artificial Sequence
  Synthetic
ggcctcctgaggttttctcaggaggccctaatgtataattaatcatgcatttgattttaaaaaagtaggttacac

SEQ ID NO: 159661 - DNA, 75 bp, Artificial Sequence
  Synthetic
ttccgtcgccagagggatctgcaccctcccggtctctgcgtcgtacaggagcgggcgggagcacagcctccaagc

SEQ ID NO: 159662 - DNA, 75 bp, Artificial Sequence
  Synthetic
tcattttaggccagactttatttgcagattaataatttatgtgattctccttccctctaggactgaagaaacagc

SEQ ID NO: 159663 - DNA, 75 bp, Artificial Sequence
  Synthetic
atggtagtattgagcccctggtgcggggctttcagggcctcaaagatgccgtttactttttgaatcggcactgcg

SEQ ID NO: 159664 - DNA, 75 bp, Artificial Sequence
  Synthetic
gtacgtgaggtaaagcccatccgggggcagggcctggccggggctgaccgcgtccgcccggcgcaggatcaagga

SEQ ID NO: 159665 - DNA, 75 bp, Artificial Sequence
  Synthetic
cgcgcattcctggaaaaagtggagggggcgtggccttcccccgcggccccccagcccccccgcacagagcggcgc

SEQ ID NO: 159666 - DNA, 75 bp, Artificial Sequence
  Synthetic
acgagggggcgggtggttcaggtccatctgtccacatatggctgcttcctccttctggggaataacagtgtcagc

SEQ ID NO: 159667 - DNA, 75 bp, Artificial Sequence
  Synthetic
ttccctctaggactgaagaaacagcctcctgcacgtgagcatgtatctgaaataattattatgtcataagtgtaa

SEQ ID NO: 159668 - DNA, 75 bp, Artificial Sequence
  Synthetic
gcaaggcacagaggctagagggcaccgcccagttgtgtgactgtgccaattttcttcgcacgtcctgcccccccg

SEQ ID NO: 159669 - DNA, 75 bp, Artificial Sequence
  Synthetic
attttggggtacttctaaagactaacgtgttcgatttcggggtcacttccccttttataagtgtgtgaacagtga

SEQ ID NO: 159670 - DNA, 75 bp, Artificial Sequence
  Synthetic
agggccggcagctctatcgcctctattgccagagggaaccattttctatagccaaggacacctataagcccctct

SEQ ID NO: 159671 - DNA, 75 bp, Artificial Sequence
  Synthetic
cgatgccgggggggcatctggctccgaggacccaccagattatggagatcaaggtaatgtgacacaggtgggatc

SEQ ID NO: 159672 - DNA, 75 bp, Artificial Sequence
  Synthetic
cggggatcgggggggtcggggggcgccgcgcgggcgcagccatgcgtgaccgtgatgagggggcagggtcgcagg

SEQ ID NO: 159673 - DNA, 75 bp, Artificial Sequence
  Synthetic
cagaaaattttaaaattaaaattgaaatttctctcaaaataattccaatgaaaacttcaaagaatcttatgtatg

SEQ ID NO: 159674 - DNA, 75 bp, Artificial Sequence
  Synthetic
gaggggggctgggcacatccctgacccctcggcgtgtggccccgtgggggcgcagacggcccttcgcctggatct

SEQ ID NO: 159675 - DNA, 75 bp, Artificial Sequence
  Synthetic
ggctggtggcatttggggttggggtagtcactgctggggtggggctggtggcatttggggttggggtagtcactg

SEQ ID NO: 159676 - DNA, 75 bp, Artificial Sequence
  Synthetic
taattcttttgccccaaactgggcttcagatgccttctattgcactctcacaaaaacattctggacacatgtgcc

SEQ ID NO: 159677 - DNA, 75 bp, Artificial Sequence
  Synthetic
agggtctgggtaaacaggtgtgttttgatgtacttggaattctcaaaggcggcaccctcgccggcgcgcctgtcc

SEQ ID NO: 159678 - DNA, 75 bp, Artificial Sequence
  Synthetic
ccaggctccataccagggataccaggagccgccggccccccaggctccataccagggataccaggagccgccggc

SEQ ID NO: 159679 - DNA, 75 bp, Artificial Sequence
  Synthetic
ccgctctcctccgccaggggccccgtgatgaaggtgtacaggctgtgcgtcagcgcgtgcaggtgctccgagctc

SEQ ID NO: 159680 - DNA, 75 bp, Artificial Sequence
  Synthetic
ccctgacatgggatttgaccgatccgacccgctctactttttgcaatttgcagccccaaaggtggtgctgttgga

SEQ ID NO: 159681 - DNA, 75 bp, Artificial Sequence
  Synthetic
cgtggcgagggttaatctcctttcgggtcgggggccagatttgttgtaggagcagcgagccacgtcgttgccctg

SEQ ID NO: 159682 - DNA, 75 bp, Artificial Sequence
  Synthetic
gccccttggtcacgcttggctgggtacccccggagccccgggtcacgtttgccggggtcagccctggtcaccccg

SEQ ID NO: 159683 - DNA, 75 bp, Artificial Sequence
  Synthetic
gcagtcgctcggctactcgctgctctatggtatcatgcacctcgctgactccacccacaaaatcccctaccccaa

SEQ ID NO: 159684 - DNA, 75 bp, Artificial Sequence
  Synthetic
gacccgctctactttttgcaatttgcagccccaaaggtggtgctgttggaggtgctgtcgcagatgtggaacctg

SEQ ID NO: 159685 - DNA, 75 bp, Artificial Sequence
  Synthetic
cccaggttcaggtccagtagcaggagaccctcgctgtgtggcgcccggtgccagaaggccggcctcgcccgtccc

SEQ ID NO: 159686 - DNA, 75 bp, Artificial Sequence
  Synthetic
tagacccggccaagccccatccctgaagacccagcggccattctctctggtaacgagcagagaagaagtagaggc

SEQ ID NO: 159687 - DNA, 75 bp, Artificial Sequence
  Synthetic
gtgtctgccctcgttggagttagagtcagattcatggctagaatcatcggtagcttgttgagggtgcgggaggga

SEQ ID NO: 159688 - DNA, 75 bp, Artificial Sequence
  Synthetic
ccgtcctgtccaagtgctatgaccatgcccagactcatctcaagggaggagtgctgcaggtaaaccttctgtctg

SEQ ID NO: 159689 - DNA, 75 bp, Artificial Sequence
  Synthetic
tagcttgttgagggtgcgggagggagtcatcgtggtggtgttcatcactgtgtcgttgtccatggtaatacatcc

SEQ ID NO: 159690 - DNA, 75 bp, Artificial Sequence
  Synthetic
agaccagtccaggggcccgaggttggagccagcgggcacccgaggtcccagcacccggtccctccggggggcaga

SEQ ID NO: 159691 - DNA, 75 bp, Artificial Sequence
  Synthetic
aactcttggcagacgacttctttggtccagatggccgacgtggatgagctcgaggatcccatggaggagatgacc

SEQ ID NO: 159692 - DNA, 75 bp, Artificial Sequence
  Synthetic
cacggcggagcatatgagtcaattcttgcagtggtgccggagccttaaaaagaggttcaaggagagctacttctt

SEQ ID NO: 159693 - DNA, 75 bp, Artificial Sequence
  Synthetic
taacgagcagagaagaagtagaggcccgcggccattgggcccagattgagagaccagtccaggggcccgaggttg

SEQ ID NO: 159694 - DNA, 75 bp, Artificial Sequence
  Synthetic
gaggggttacggcgtcccaagggtccgccaccgcccccacacccacagccgtcgcggcgggcgtagaggggccgc

SEQ ID NO: 159695 - DNA, 75 bp, Artificial Sequence
  Synthetic
gccggtcggctgggctggccgagcccgggtctgggaggtctggggtggcgagcctgctgtctcaggaggggcctg

SEQ ID NO: 159696 - DNA, 75 bp, Artificial Sequence
  Synthetic
tggaatctcttaaaaatataccgcaaacactgccgtacaatccaacagtatacggcaggcccgcggtgtttgacc

SEQ ID NO: 159697 - DNA, 75 bp, Artificial Sequence
  Synthetic
gtcgccagagaatctccaataagtagatccagatacctaagactgcgttgaaaaaagagtgttagggttggaaaa

SEQ ID NO: 159698 - DNA, 75 bp, Artificial Sequence
  Synthetic
cccgatagactctctaggagggcggcggtggcctcgagccatctccaccgcgagcgggacacccggggcacagag

SEQ ID NO: 159699 - DNA, 75 bp, Artificial Sequence
  Synthetic
tccagatggccgacgtggatgagctcgaggatcccatggaggagatgacctcctacacgtttgcccgcttcctcc

SEQ ID NO: 159700 - DNA, 75 bp, Artificial Sequence
  Synthetic
gggaatgttagatcttaccaagtaagcacccgaagatgaacagcacaattccaaggtacaatgcctgtccgtgca

SEQ ID NO: 159701 - DNA, 75 bp, Artificial Sequence
  Synthetic
cccgggtctctgttggcagagtccgggcgatcctctgagaccctccgggcccggacggccgccctcggcccccca

SEQ ID NO: 159702 - DNA, 75 bp, Artificial Sequence
  Synthetic
ggactgttctctgctcgtacgtggagtccatgaccagggggcagtctgagaacctgatgtgggacatattgcgaa

SEQ ID NO: 159703 - DNA, 75 bp, Artificial Sequence
  Synthetic
ctccctgaaatccatttactgggggctacaggaggccaccgacgagcagaggactgttctctgctcgtacgtgga

SEQ ID NO: 159704 - DNA, 75 bp, Artificial Sequence
  Synthetic
atacttactcatcagtaggagtagacaaagggctccaagtggacagagaaggtctcttctgaagataaagatgat

SEQ ID NO: 159705 - DNA, 75 bp, Artificial Sequence
  Synthetic
atactgttattgccaagaaatcgtgacactggacgtggtgtcagacgcaggctgtatgcataccctgtaccaggt

SEQ ID NO: 159706 - DNA, 75 bp, Artificial Sequence
  Synthetic
accaagttcacacctgcagtccgccactcagcctacaacgcctcgcccatcatgggccccatcagtctgtgccct

SEQ ID NO: 159707 - DNA, 75 bp, Artificial Sequence
  Synthetic
tgtggggccatacgaggccttcactggccctgtggccaaggctcaggacgtgggggccgttgaggcccacgttgt

SEQ ID NO: 159708 - DNA, 75 bp, Artificial Sequence
  Synthetic
gaggacacggtcaaggacattgtctgtaagctcatctgcggggacgcatccgccaaccgtcaatttggctttatg

SEQ ID NO: 159709 - DNA, 75 bp, Artificial Sequence
  Synthetic
caaaattataattataagcatgagagcaaaggaatagaggacaaggagggctcctccagtccagtcactcataac

SEQ ID NO: 159710 - DNA, 75 bp, Artificial Sequence
  Synthetic
gagccagcccccggggttggttctgcccctctctctgtccttcagaggaaccagggacctcgggcaccccagagc

SEQ ID NO: 159711 - DNA, 75 bp, Artificial Sequence
  Synthetic
gtaagctcatctgcggggacgcatccgccaaccgtcaatttggctttatgattagtcccacggatggcatttttg

SEQ ID NO: 159712 - DNA, 75 bp, Artificial Sequence
  Synthetic
cgccccttccccgggcttcagagcccagggtgtcccccagaagggaccctaggcgtcccctctcctcccctccag

SEQ ID NO: 159713 - DNA, 75 bp, Artificial Sequence
  Synthetic
cgtggcggcggccttcctcggtcggcccctaactctctttgtctcctctcaatatctgtttaacctgaagaccct

SEQ ID NO: 159714 - DNA, 75 bp, Artificial Sequence
  Synthetic
gcactgcgtccacctggccaccacatcggacgggcaggcatttttggtgctgcctgggggctttgttattaaagg

SEQ ID NO: 159715 - DNA, 75 bp, Artificial Sequence
  Synthetic
gcccgagcctctccctcgcggagaggggcctcttcgagccctcaagtccagtcccaccgagacccgagtggcccg

SEQ ID NO: 159716 - DNA, 75 bp, Artificial Sequence
  Synthetic
actgcaggtgatgttaaatttgttgtctccgggcagaacttgtgaaatttcgccatcctccataatacactcaat

SEQ ID NO: 159717 - DNA, 75 bp, Artificial Sequence
  Synthetic
tgcctgggggctttgttattaaaggccaattggcactcacccccgaggagaggggatatattctggcacgtcatg

SEQ ID NO: 159718 - DNA, 75 bp, Artificial Sequence
  Synthetic
cagggtgtcccccagaagggaccctaggcgtcccctctcctcccctccaggcccgagcctctccctcgcggagag

SEQ ID NO: 159719 - DNA, 75 bp, Artificial Sequence
  Synthetic
gcatccgccgcgaacagtagccgggaacagcttcgcaagttcctcaacaaggagtgcctctgggtgctgagcgat

SEQ ID NO: 159720 - DNA, 75 bp, Artificial Sequence
  Synthetic
cccctactcctctccaaccttcgctccaccctagaccccagcttctggcctccccgggtccaccaggccagccgg

SEQ ID NO: 159721 - DNA, 75 bp, Artificial Sequence
  Synthetic
ccatccgcaggcaccggacacgcgagactcgccgtatgcgcgggagccattcacgggtggaacacgtgccccccg

SEQ ID NO: 159722 - DNA, 75 bp, Artificial Sequence
  Synthetic
gggtggtcttctacctgaagcccgtagttacaaacctgtacctggggtgccttgccctggagacgctggtcttct

SEQ ID NO: 159723 - DNA, 75 bp, Artificial Sequence
  Synthetic
agtgcggcaatcagaagggggagtgcgtagtgttgtgggaagcggcagtgtaatccgcacaaagaggcgcggggc

SEQ ID NO: 159724 - DNA, 75 bp, Artificial Sequence
  Synthetic
tgtgtacgtgcctcagatagccggacctcctaaaacctacatgaatgttaccctcattgtgctgaagcccaagaa

SEQ ID NO: 159725 - DNA, 75 bp, Artificial Sequence
  Synthetic
aaattcagtgctacttaaactcttgaagtttgtttgcaaaatactgccaccggcggttagcgcggaggctagcaa

SEQ ID NO: 159726 - DNA, 75 bp, Artificial Sequence
  Synthetic
tatggggtgtcagctggccaaagtcaagatcaagttgatgctttttgcccccgacatcgaaattgatagttacat

SEQ ID NO: 159727 - DNA, 75 bp, Artificial Sequence
  Synthetic
gaagcccacctatgtgaccgtctacatcaatggaaccctagccaccgtggccaggcccgaggttctcttcactaa

SEQ ID NO: 159728 - DNA, 75 bp, Artificial Sequence
  Synthetic
ccgcccagtctctgcctccaggcaagggcgccagcttttctccccccagcctgaggcccaggctcctgtgcactg

SEQ ID NO: 159729 - DNA, 75 bp, Artificial Sequence
  Synthetic
aagtttgtttgcaaaatactgccaccggcggttagcgcggaggctagcaacaagagtgctagagcatataggaac

SEQ ID NO: 159730 - DNA, 75 bp, Artificial Sequence
  Synthetic
ggcagtccaggggccacacagcctgactctcatgtactttggggtattctcagatgcagtgggtgaggcggtgcc

SEQ ID NO: 159731 - DNA, 75 bp, Artificial Sequence
  Synthetic
caggggacctaccccgggctgctgtgccacgcgtcctccgctgaccctgtccgtgtgcctgaccaagtgctcctt

SEQ ID NO: 159732 - DNA, 75 bp, Artificial Sequence
  Synthetic
cagatgcagtgggtgaggcggtgcctgtggagattaggggtaaccctgtagtcacctgcacagatctgaccacgg

SEQ ID NO: 159733 - DNA, 75 bp, Artificial Sequence
  Synthetic
cgtccacccctccccacgttggacaggccctctgtccacccgggccatccccgcccccctgtgtccaccccagtc

SEQ ID NO: 159734 - DNA, 75 bp, Artificial Sequence
  Synthetic
ataggtacaaggggggtgcggtgttggtgagtcacacttttgttgcagacaaaatggacaaggacaggccgggtc

SEQ ID NO: 159735 - DNA, 75 bp, Artificial Sequence
  Synthetic
tttttagcccccacgctctctatgttgtcacatatccagagctgagtgcccagggcagactgcacaggatgacag

SEQ ID NO: 159736 - DNA, 75 bp, Artificial Sequence
  Synthetic
cacgccaaaaaggcctcgagtagaagaaagttctcacggacccgcccggtgttcccaagctactgctgaagcaca

SEQ ID NO: 159737 - DNA, 75 bp, Artificial Sequence
  Synthetic
gacggagaagcggcccaataagtactccgcgtcgtccctagtcagcgaggcgcatgcctcgcccatggcatccac

SEQ ID NO: 159738 - DNA, 75 bp, Artificial Sequence
  Synthetic
ggctgacgttccggggatcgggggggccggggggcgctgcgcgggcgcagccatgcgtgaccgtgaggagggggc

SEQ ID NO: 159739 - DNA, 75 bp, Artificial Sequence
  Synthetic
agatcttgctgaggtttcaattttgggagctccagagagggagtttcgcttcctcatttcagtggccctcagaat

SEQ ID NO: 159740 - DNA, 75 bp, Artificial Sequence
  Synthetic
cccggtccccccagaagcccccaaaagtagaggctcaggccatgcgcgccctgtcaccaggcctgccaaagagcc

SEQ ID NO: 159741 - DNA, 75 bp, Artificial Sequence
  Synthetic
tgcctccagagccccttttgcccccctggcggcccagcccgacccccgggcgcccccaaactttgtccagatgtc

SEQ ID NO: 159742 - DNA, 75 bp, Artificial Sequence
  Synthetic
tcctcatttcagtggccctcagaatttctgctagcttcagggaaaaactggccatgcaggcctggacagcacaac

SEQ ID NO: 159743 - DNA, 75 bp, Artificial Sequence
  Synthetic
agatctaaggccgggagaggcagccccaaagcgggtgcagtaacaggtaatctctggtagtgatttggacccgaa

SEQ ID NO: 159744 - DNA, 75 bp, Artificial Sequence
  Synthetic
tgccccatccagttggtggtgccgaaatcgtgatgaggaggggcaggtggcctcctggatgatggcctccagtcg

SEQ ID NO: 159745 - DNA, 75 bp, Artificial Sequence
  Synthetic
aacggctctggcttctgtccgcaaagttaaatacaggagctgcctgaccgtcaccccccgcaggaccaccggccg

SEQ ID NO: 159746 - DNA, 75 bp, Artificial Sequence
  Synthetic
actttaaaactctaaaaatcaaaactttagaggcgaatgggcgccattttgtccccacgcgcgcataatggcgga

SEQ ID NO: 159747 - DNA, 75 bp, Artificial Sequence
  Synthetic
tcggcgggagattgggaaaacgtcctcatagagttatcagatagcagctcagaaaaggaagcagaagatgcccag

SEQ ID NO: 159748 - DNA, 75 bp, Artificial Sequence
  Synthetic
ttggtgacattcattaaatcctaacgaccggagtcctgtctctttgtgttcttgggggacttgagttagctgtct

SEQ ID NO: 159749 - DNA, 75 bp, Artificial Sequence
  Synthetic
agaaaaggaagcagaagatgcccagctggagccggcccagaagggtacgaagagaaagcgggtcgatcatgatgc

SEQ ID NO: 159750 - DNA, 75 bp, Artificial Sequence
  Synthetic
aaacttcttccgcatggaagagcccccggcctgcttgcgcagcccagccccgggggcctgcagcaggttcctgtc

SEQ ID NO: 159751 - DNA, 75 bp, Artificial Sequence
  Synthetic
ctatctttagaggggaaaagaggaataagcccccagacaggggagtgggcttgtttgtgacttcaccaaaggtca

SEQ ID NO: 159752 - DNA, 75 bp, Artificial Sequence
  Synthetic
tggggtaaggtgatcgactccaggtcccccggtgggctggttggggctgcttcccagctagtagcccttggaact

SEQ ID NO: 159753 - DNA, 75 bp, Artificial Sequence
  Synthetic
ctcctactcccgtatctataaaaattcagacctgatcagggaagcgttcttcactgtccagacacgggttagttg

SEQ ID NO: 159754 - DNA, 75 bp, Artificial Sequence
  Synthetic
agagatgtccatgctctcgtccacatctaagggtaccggagaacttgcgccctcctcttgaatcgggggaaactc

SEQ ID NO: 159755 - DNA, 75 bp, Artificial Sequence
  Synthetic
gcacagtaaacggcgtgatatgcatcgttgacactcttcaggtagccagcatccagtcctgactcatgtttcctc

SEQ ID NO: 159756 - DNA, 75 bp, Artificial Sequence
  Synthetic
cgtgggccccctggtggagaatataaagagcacctatctgaataaaatcaccacggtggtccacgggcctgtggt

SEQ ID NO: 159757 - DNA, 75 bp, Artificial Sequence
  Synthetic
gcctgccgggctgtcaaggtgagtatgcctctaactgggttcatgggggccatctaaggcccacgtgtgacccat

SEQ ID NO: 159758 - DNA, 75 bp, Artificial Sequence
  Synthetic
ccaccttcatcaccgtcgctgactccgccatccaagcctaggggagaccgaagtgaagtccctggaccagcccgg

SEQ ID NO: 159759 - DNA, 75 bp, Artificial Sequence
  Synthetic
cgccatccaagcctaggggagaccgaagtgaagtccctggaccagcccggcccgggccccccggtatcgggccag

SEQ ID NO: 159760 - DNA, 75 bp, Artificial Sequence
  Synthetic
agcgtgaccaaggggcccctgggtgacacaggcaaccctgacaaaggccccccaggaaagacccccggggggcat

SEQ ID NO: 159761 - DNA, 75 bp, Artificial Sequence
  Synthetic
gaggaagccgggccgcggtttacgtttttccagtcgtcccgcggccactgtcagatcatgaatatcttaagaatt

SEQ ID NO: 159762 - DNA, 75 bp, Artificial Sequence
  Synthetic
atttgtcctatatcaagaactttgtcagcgatgccctgggcaccactagtatccaaacaccgtggatcgatgaca

SEQ ID NO: 159763 - DNA, 75 bp, Artificial Sequence
  Synthetic
ggttcaccttcaggggtaagtaacctgacctctccagggctcacataaagggaggcttagtatacatgcttcttg

SEQ ID NO: 159764 - DNA, 75 bp, Artificial Sequence
  Synthetic
attccaacgtctctgactgggaggtgattctctagacttaacgggaggaaacaggaggaggaggggggacaagag

SEQ ID NO: 159765 - DNA, 75 bp, Artificial Sequence
  Synthetic
cttttcacaggaacctgggggctagtctgggtgggtttaggctgcctcaagttgcatcagccagggcttcatgcc

SEQ ID NO: 159766 - DNA, 75 bp, Artificial Sequence
  Synthetic
ctggcaaaacttgctccagaccgaggagaaccttttagatttcgtgcgtttcatgggtgtcatgtccagctgcaa

SEQ ID NO: 159767 - DNA, 75 bp, Artificial Sequence
  Synthetic
cggcggctgaatgccatgccaaaagcggggtgccggtcgtggccggcttctacaggaccatcaacgccacgctca

SEQ ID NO: 159768 - DNA, 75 bp, Artificial Sequence
  Synthetic
ggatgacccgccaaggtgtgcatgagcaccagccccagccacactggctctctgcctcttgtctatggcgcgttg

SEQ ID NO: 159769 - DNA, 75 bp, Artificial Sequence
  Synthetic
gttgcatcagccagggcttcatgccctcctcagttccctagtccccgggcttcaggccccctccgtccccgtcct

SEQ ID NO: 159770 - DNA, 75 bp, Artificial Sequence
  Synthetic
gggacgtcagaaataccaggtaactcctttgagcctcccgaaaaacatcattagggagattcacccgccctgggg

SEQ ID NO: 159771 - DNA, 75 bp, Artificial Sequence
  Synthetic
cccacctgcacaccagggggcaggcccagatctatctcggctcgccagcggtccgggcactcaaaggtctccggc

SEQ ID NO: 159772 - DNA, 75 bp, Artificial Sequence
  Synthetic
ttagggagattcacccgccctggggtccggcttggccgcccccgcgcacaccccagttggtgcattggcaccgcg

SEQ ID NO: 159773 - DNA, 75 bp, Artificial Sequence
  Synthetic
ctgctgctcccctcctgccaccccagcctccccccctccccgtcccccttcgctccttatcctcccccggtcccc

SEQ ID NO: 159774 - DNA, 75 bp, Artificial Sequence
  Synthetic
ggcgcggggcctcggccctggcctcttcccgctcgctctgctcggtgtcactgttgcccgagtcactgctgctgg

SEQ ID NO: 159775 - DNA, 75 bp, Artificial Sequence
  Synthetic
tagaggtggtctatgctctcctcgaaggaggcaatgtagttatcgatggtgtagggaagcttatggagaccgggc

SEQ ID NO: 159776 - DNA, 75 bp, Artificial Sequence
  Synthetic
ttcatcgataaggaggacgacgggcagcggccggacgacgagccccgctacacctactggcagctgaaccagaac

SEQ ID NO: 159777 - DNA, 75 bp, Artificial Sequence
  Synthetic
gcacttgacactgtgaggtatgactacggccactatctcataatgttggggccattccagccatggagcggactg

SEQ ID NO: 159778 - DNA, 75 bp, Artificial Sequence
  Synthetic
aggccccccaggaaagacccccggggggcatcgggggggtgttgggaggagcatggggggtcggatttcgccctt

SEQ ID NO: 159779 - DNA, 75 bp, Artificial Sequence
  Synthetic
ccgggcttggccagagccccccagagtggctaaagggtcactaccagacgctgtgcaccaactttaggagcctgg

SEQ ID NO: 159780 - DNA, 75 bp, Artificial Sequence
  Synthetic
tagaaggccatcgttctgtttagcccgccgttggggcctcccggtcttaaataatgtccacccccgtcgtcatca

SEQ ID NO: 159781 - DNA, 75 bp, Artificial Sequence
  Synthetic
gggcccgcctccaggcgccctcctggtctccgctcccctctgagccccgttaaacccaaagaatgtctgagggga

SEQ ID NO: 159782 - DNA, 75 bp, Artificial Sequence
  Synthetic
gactacctgcgcgactttgtgaagcaggcctatacacgcggagaagagcttcccagggcggagggcctcgaggtc

SEQ ID NO: 159783 - DNA, 75 bp, Artificial Sequence
  Synthetic
agtcgcaggaattgctggatttccgcggaccatgtggaaggccttgccatccagtctggtccgtaggcatacaca

SEQ ID NO: 159784 - DNA, 75 bp, Artificial Sequence
  Synthetic
cttcccacggtggggtgtgacaggatgcttgtgaggcatgactccagcgagagccagggcaactcgtaagacgga

SEQ ID NO: 159785 - DNA, 75 bp, Artificial Sequence
  Synthetic
cgcacgaagaacaaccccggtatgaggatcctgacgctcctctggatttaagtttacatccagacgttgctgctc

SEQ ID NO: 159786 - DNA, 75 bp, Artificial Sequence
  Synthetic
tcctgacagcccagagggggctgttcctggcaagagtcttgcaggctgtacagcagcacaagctgctggaagaca

SEQ ID NO: 159787 - DNA, 75 bp, Artificial Sequence
  Synthetic
taaccaggtcctcctctggactgtggccctctgcaagtttcgcagatgcatttactataactacattcagggatc

SEQ ID NO: 159788 - DNA, 75 bp, Artificial Sequence
  Synthetic
gtgtcaggatgacgagtttccggatctacaagatcctccagatgaggcctaagcaaaggtgtagaagtgtgtccc

SEQ ID NO: 159789 - DNA, 75 bp, Artificial Sequence
  Synthetic
gtacctcctgactaatgagaagtccaaggcctttgagaggctcatctacgcagtgaacacggccagcctttctgc

SEQ ID NO: 159790 - DNA, 75 bp, Artificial Sequence
  Synthetic
atgccaggaagcgactacacagccgtgtcgctgcagtactacgacggcatctccataggtatgaggaaggtaatc

SEQ ID NO: 159791 - DNA, 75 bp, Artificial Sequence
  Synthetic
agggatgggcttttcaattcacagtttatcgccctgatgcccacctcaggctgtgcccaggtgacgggctgttcg

SEQ ID NO: 159792 - DNA, 75 bp, Artificial Sequence
  Synthetic
caggggggactttatgtgacccttgggcctggctccccatagactcccatgtaagcctgcctcgagtaggtgcct

SEQ ID NO: 159793 - DNA, 75 bp, Artificial Sequence
  Synthetic
cttgtggctttacgtggtcatgtgcagcttgcatacgacgcccgtgtcctgacgcctgactttcatgaaatccct

SEQ ID NO: 159794 - DNA, 75 bp, Artificial Sequence
  Synthetic
catagagggtttccgtcatgtcatcaatgttggtcaccttcaggtgtttgtgctgaaaggtgaagtaatcaatga

SEQ ID NO: 159795 - DNA, 75 bp, Artificial Sequence
  Synthetic
ttcttggtggacatcattagcccagctgcaaatatcagaattagcattagaaaagtgagtcccacaaacaccagt

SEQ ID NO: 159796 - DNA, 75 bp, Artificial Sequence
  Synthetic
cagggggtaaaagtaccgctacctcctgttttaacgatggaatggccaccaggtttccgctgtcatataagcctg

SEQ ID NO: 159797 - DNA, 75 bp, Artificial Sequence
  Synthetic
acgctgcgcctgccggcggaggaggccttccccttcctgcgcggcctcacgccgctcaccgcggaccatctatcc

SEQ ID NO: 159798 - DNA, 75 bp, Artificial Sequence
  Synthetic
tcaggctgttctgtgaatagtacactggggtgtaggagagggccctggtgagacacgtgtctgggaggcggcagt

SEQ ID NO: 159799 - DNA, 75 bp, Artificial Sequence
  Synthetic
tttattccttgagcaaaacctgaacatcgaagaatttatatggatgtgcatgaccgtgcgtcacagatgtcaggc

SEQ ID NO: 159800 - DNA, 75 bp, Artificial Sequence
  Synthetic
gtggtccctcccaaatctgtcacgtgcgctcacagccgctctcttttctaccgaggctcttagttgctgggccac

SEQ ID NO: 159801 - DNA, 75 bp, Artificial Sequence
  Synthetic
ccagcctgagggaacctcccccgccgtctccccagtatgccccatcgcttccccagcggcctccaggtccaagca

SEQ ID NO: 159802 - DNA, 75 bp, Artificial Sequence
  Synthetic
atggagccgagatcatacgtggggtagagtacggtagttccagtggaggcttcccggtaatttcccacagcgtcc

SEQ ID NO: 159803 - DNA, 75 bp, Artificial Sequence
  Synthetic
gagaacccagaggccttttccctgaccccagccggacgcccccaagctattggtcccccgcaggatgaccaagag

SEQ ID NO: 159804 - DNA, 75 bp, Artificial Sequence
  Synthetic
ctccgagtgaccagtcaccttccagactatgcatacactgaatttagcctgatattgtccccctagccccgggcc

SEQ ID NO: 159805 - DNA, 75 bp, Artificial Sequence
  Synthetic
ggggcaggagccggaggggctggaggggctggaggggcaggagcaggaggggcaggaggggcaggagcaggaggg

SEQ ID NO: 159806 - DNA, 75 bp, Artificial Sequence
  Synthetic
gggcaggaggggcaggagccggaggggcaggaggggcaggagcaggaggggcaggaggggcaggagcaggagggg

SEQ ID NO: 159807 - DNA, 75 bp, Artificial Sequence
  Synthetic
gccacggccgatcgcatcctgggtgacattggtcaggctcccttgtatggcacaccaccccccaaggactgcccg

SEQ ID NO: 159808 - DNA, 75 bp, Artificial Sequence
  Synthetic
cgcgttaacatctcggccaggtggttcattagcacctttggctcccacgaggcccagttcgtgctagtcacggct

SEQ ID NO: 159809 - DNA, 75 bp, Artificial Sequence
  Synthetic
aggaggggcaggagccggaggggcaggaggggcaggagccggaggggcaggaggggcaggagccggaggggcagg

SEQ ID NO: 159810 - DNA, 75 bp, Artificial Sequence
  Synthetic
cagctgctggtttggagaaaacgggggtgggcggtgatcagggagaacaattccccggggacacctgcacgagac

SEQ ID NO: 159811 - DNA, 75 bp, Artificial Sequence
  Synthetic
gcccactgagtgtccaggctcggctggagccatggcaacctttgcctgggccccaagtgacagcagttctacttc

SEQ ID NO: 159812 - DNA, 75 bp, Artificial Sequence
  Synthetic
accatgtttacctgcccggtggagtgcgaggtcttcctcgatcccctggcccagtacaagaccctggtcggtctt

SEQ ID NO: 159813 - DNA, 75 bp, Artificial Sequence
  Synthetic
ctttaagaccaaggccctagccgtcctgtccaagtgctatgaccatgcccagactcatctcaagggaggagtgct

SEQ ID NO: 159814 - DNA, 75 bp, Artificial Sequence
  Synthetic
aggtctcgccaattggggtgatcctgtagcgccgcggtttcagcatcacaggttattttgcctgaagcttgctgg

SEQ ID NO: 159815 - DNA, 75 bp, Artificial Sequence
  Synthetic
gagcaggaggggcaggagcaggaggggcaggaggggcaggagcaggaggggcgggagcaggaggggcaggagggg

SEQ ID NO: 159816 - DNA, 75 bp, Artificial Sequence
  Synthetic
tcccggacctgctcttccagcgcccggacctcggccgcctcggcctcggtcagcagctccgagaagaagtccccc

SEQ ID NO: 159817 - DNA, 75 bp, Artificial Sequence
  Synthetic
ctacaatgtcacctacgtgaagcacagctcagtgtcagtcaactgcaagaccaaaaagtccatctgcggctatac

SEQ ID NO: 159818 - DNA, 75 bp, Artificial Sequence
  Synthetic
aggctgttcaggttccgccgcgttggaaggacatggagtttgaccacggttgggcctggatgtccggcgcgactt

SEQ ID NO: 159819 - DNA, 75 bp, Artificial Sequence
  Synthetic
agctgtttggctcggctgtggagcaggcttccctgcaattttacaagcggccacaagggggttcccggcctgaat

SEQ ID NO: 159820 - DNA, 75 bp, Artificial Sequence
  Synthetic
gccctcggccccccagacagaccccagggtctccaggcagggtccggcatctccaggggcagcaggctcaccacc

SEQ ID NO: 159821 - DNA, 75 bp, Artificial Sequence
  Synthetic
tcgcgccaggacggcggccgatgccatccgttcggccctcgcgcagacgcgccaggccctgcagtccccggacat

SEQ ID NO: 159822 - DNA, 75 bp, Artificial Sequence
  Synthetic
cgtccctcccgaggtcgtggggccggagccttataaaagacttccaccctctccccgctggccaagacacgccgc

SEQ ID NO: 159823 - DNA, 75 bp, Artificial Sequence
  Synthetic
agaccgggcgcaaggaaaaggagaagctccgagaacaggaagacaaggagaggcgggagcggcgagcgcgagagg

SEQ ID NO: 159824 - DNA, 75 bp, Artificial Sequence
  Synthetic
gctgtttaccagcatgtatagagttacggttcgctacatcaaacaggacagccgttgccctagtggtttcggaca

SEQ ID NO: 159825 - DNA, 75 bp, Artificial Sequence
  Synthetic
gggcgcctattttctacccacccgttttgcagcccatacaggttatggggcaagggggttccccaacggccatgg

SEQ ID NO: 159826 - DNA, 75 bp, Artificial Sequence
  Synthetic
atatcgagaccggccctctggccagactggacgcttggcccgccacccccgcggctaccgccaaagaaggaggag

SEQ ID NO: 159827 - DNA, 75 bp, Artificial Sequence
  Synthetic
aacaacgccccagacatacggtcagtccatctccttcacctccgccacctcctaggacccctacttgggagagtc

SEQ ID NO: 159828 - DNA, 75 bp, Artificial Sequence
  Synthetic
tagaggagattgttttgtgttgtaggggtagcgggcccttacatgttgtgggtgcaaaactaggcacaaaaacag

SEQ ID NO: 159829 - DNA, 75 bp, Artificial Sequence
  Synthetic
ttcagctcgcgaggaaaaggacatcgtcggaggccaggcagaagcagaagcaccccaagaaagtgaagcaggcct

SEQ ID NO: 159830 - DNA, 75 bp, Artificial Sequence
  Synthetic
caccccaagaaagtgaagcaggcctttaaccccctcatttaacaccatgttctcgtgcaagcagcacctgtccct

SEQ ID NO: 159831 - DNA, 75 bp, Artificial Sequence
  Synthetic
atgaggatagcatatgctacccggatacagattaggatagcatatactacccagatatagattaggatagcatat

SEQ ID NO: 159832 - DNA, 75 bp, Artificial Sequence
  Synthetic
ttctgaaacatcgaacgatgagtgatttcgcccatgtaacaagaactgggatgaaccctggggcaacagactgcg

SEQ ID NO: 159833 - DNA, 75 bp, Artificial Sequence
  Synthetic
caacacagcaggcctctcctcaccctctgggagagcgtggccgcaaatcaggaggtcacggatgccattaccctg

SEQ ID NO: 159834 - DNA, 75 bp, Artificial Sequence
  Synthetic
catatgctacccagatatagatttgggtagcatatgctacccagatatagattaggatagcatatgctacccaga

SEQ ID NO: 159835 - DNA, 75 bp, Artificial Sequence
  Synthetic
ggtagcatatgctacccagatatagattaggatagcatatgctacccagatatagatttgggtagcatatgctac

SEQ ID NO: 159836 - DNA, 75 bp, Artificial Sequence
  Synthetic
gcctgccaaagagccagatctaaggccgggagaggcagccccaaagcgggtgcagtaacaggtaatctctggtag

SEQ ID NO: 159837 - DNA, 75 bp, Artificial Sequence
  Synthetic
gtagccatacaaaccacatttgctcattgggtttattgtagtgtttgtaaatacagcacacaggtctgggggggg

SEQ ID NO: 159838 - DNA, 75 bp, Artificial Sequence
  Synthetic
atgaagatgcgcagaggggttacggcgtcccaagggtccgccgccgcccccacacccacagccgtcgcggcgggg

SEQ ID NO: 159839 - DNA, 75 bp, Artificial Sequence
  Synthetic
ccaaatctatatctgggtagcatatgctatccatcgcaacattagcccaccgtgctctcagcgacctcgtgaata

SEQ ID NO: 159840 - DNA, 75 bp, Artificial Sequence
  Synthetic
ggatgtccatctcacacgaatttattgctaagggcaacacataatcctagtgcaatatgatactggggttattaa

SEQ ID NO: 159841 - DNA, 75 bp, Artificial Sequence
  Synthetic
gggggtcgtcatcatctccaccggaaccagaagtacccaaaagcagcgtaggaaggtgtggatcaccgccgccac

SEQ ID NO: 159842 - DNA, 75 bp, Artificial Sequence
  Synthetic
tgctaagggcaacacataatcctagtgcaatatgatactggggttattaagatgtgtcccaggcagggaccaaga

SEQ ID NO: 159843 - DNA, 75 bp, Artificial Sequence
  Synthetic
gatgtgtcccaggcagggaccaagacaggtgaaccatgttgttacactctatttgtaacaaggggaaagagagtg

SEQ ID NO: 159844 - DNA, 75 bp, Artificial Sequence
  Synthetic
gtgtggaggttttgggctagctcttagtttctgggtgtgagagagggattaaagtgcttatgcgcaaagaatgtg

SEQ ID NO: 159845 - DNA, 75 bp, Artificial Sequence
  Synthetic
agacagcagccaattgtcagttctagggagggggaccactgcccctggtataaagtggtcctgcagctatttctg

SEQ ID NO: 159846 - DNA, 75 bp, Artificial Sequence
  Synthetic
ttccatctacaggggcccgcacgtggacgtccccttggtcctggacgacgagagctggaagcgcctcctatccct

SEQ ID NO: 159847 - DNA, 75 bp, Artificial Sequence
  Synthetic
gggctttatggccccctcttttaccctctctgggaacccgtgttgggagccccgctgcggggacgcttggtcatt

SEQ ID NO: 159848 - DNA, 75 bp, Artificial Sequence
  Synthetic
ttgggagacagggatgtatgtggtcccccgctggtatgccagtaccctgtggaagtaaggggcctcatctgcctg

SEQ ID NO: 159849 - DNA, 75 bp, Artificial Sequence
  Synthetic
gaaaactctgcatggagaagctggacgtgaacctcccccccagacctgtgtgctgtatttacaaacactacaata

SEQ ID NO: 159850 - DNA, 75 bp, Artificial Sequence
  Synthetic
gacagcacaacaagaaatcccagttgttattcccacctcctactcccgtatctataaaaattcagacctgatcag

SEQ ID NO: 159851 - DNA, 75 bp, Artificial Sequence
  Synthetic
gttattcccacctcctactcccgtatctataaaaattcagacctgatcagggaagcgttcttcactgtccagaca

SEQ ID NO: 159852 - DNA, 75 bp, Artificial Sequence
  Synthetic
ctacacacacccacccgtctcagggtcccctcggacagctcctaagaaggcaccggtcgcccagtcctaccagag

SEQ ID NO: 159853 - DNA, 75 bp, Artificial Sequence
  Synthetic
ggggacttgagttagctgtctttcctcttattacattgggctaacgggaggaaatgaacacagtggtggcagtgg

SEQ ID NO: 159854 - DNA, 75 bp, Artificial Sequence
  Synthetic
attggcgtcgggaaacacagctctggcagttataaccgcaccagctaacaggacatgtttgggggagttggcatt

SEQ ID NO: 159855 - DNA, 75 bp, Artificial Sequence
  Synthetic
agctgaaaatccgcatggagcccccggccccatacacgtgggaccccgaccccgatgacggactcatgcgggcct

SEQ ID NO: 159856 - DNA, 75 bp, Artificial Sequence
  Synthetic
gggcttcaggccctgcctctcctgttacccttttagaaccacagcctggacacatgtgccagacgcctgggcctc

SEQ ID NO: 159857 - DNA, 75 bp, Artificial Sequence
  Synthetic
acggacaggcattgtaccttggaattgtgctgttcatctttggctgcttacttggtaagatctaacattccctag

SEQ ID NO: 159858 - DNA, 75 bp, Artificial Sequence
  Synthetic
taaaaagggggccttataaacactcttgctaacgccctcttgagggtccgcttatcggtagctacacaggcccct

SEQ ID NO: 159859 - DNA, 75 bp, Artificial Sequence
  Synthetic
acgcagtcttaggtctctggatctacttcttggagattctctggcggcttggtgccaccatctggcagcttttgg

SEQ ID NO: 159860 - DNA, 75 bp, Artificial Sequence
  Synthetic
tgccgcccctccttgagccccaccgtccgctgccgcccctccttgagccccaccgtccgctgccgcccctccttg

SEQ ID NO: 159861 - DNA, 75 bp, Artificial Sequence
  Synthetic
agtcctagtgatccagtggccggagagagaatggccctgacaagtcggctgcatgatgcacttcggcagtcacgt

SEQ ID NO: 159862 - DNA, 75 bp, Artificial Sequence
  Synthetic
agactgcaaagtctgctccaggatgaaagccactcagtgttggcaaatgtgcacatccatttccaggatgaaagc

SEQ ID NO: 159863 - DNA, 75 bp, Artificial Sequence
  Synthetic
cccctccttgagcccctccttaccgattctggctgttgtggtttccgtgtgcgtcgtgccggggcagccactggt

SEQ ID NO: 159864 - DNA, 75 bp, Artificial Sequence
  Synthetic
atacatccagattaaaatcgccagaaacaggaggagccaaaggagatcaaccaatagagtccaccagttttgttg

SEQ ID NO: 159865 - DNA, 75 bp, Artificial Sequence
  Synthetic
tgaggtcattatatatgtttaacagggagcagaggggggcagaatttgcggccgggggagccagtactcgggcat

SEQ ID NO: 159866 - DNA, 75 bp, Artificial Sequence
  Synthetic
ggcgcggaaagtcgctgcggcttgctgaggcatggggggcgcattcctggaaaaagtggaggggggtgccgggcc

SEQ ID NO: 159867 - DNA, 75 bp, Artificial Sequence
  Synthetic
ctgtggcacctgcgcaggcggagccgtagggtctttagattttcacccaaagaatttacatggtctttggcttca

SEQ ID NO: 159868 - DNA, 75 bp, Artificial Sequence
  Synthetic
atccaggatatgcgggtccctggaccccaagatctcaacatccatgttataggcacccctgggcaccatggtctc

SEQ ID NO: 159869 - DNA, 75 bp, Artificial Sequence
  Synthetic
aggcacccctgggcaccatggtctcaagatcccgtgcatgggcacacccagggtccatgggatccaagggcacca

SEQ ID NO: 159870 - DNA, 75 bp, Artificial Sequence
  Synthetic
gacccagcacctcccggcagaggcctatggaggggctcttggcattctcaatcatcgagagcagggcgcacatct

SEQ ID NO: 159871 - DNA, 75 bp, Artificial Sequence
  Synthetic
ctcttgcctcacctgaacccccctaaagcacagcctcccgcctgccgacaacgacctcccaacgttgcgcgccct

SEQ ID NO: 159872 - DNA, 75 bp, Artificial Sequence
  Synthetic
gttttaacacgactgaaggcatctcttaggtccctcaacatttggggaaaattgtcacattggtctgtacctcca

SEQ ID NO: 159873 - DNA, 75 bp, Artificial Sequence
  Synthetic
ttaggtccctcaacatttggggaaaattgtcacattggtctgtacctccacactcaggtgccaggtaaagcagca

SEQ ID NO: 159874 - DNA, 75 bp, Artificial Sequence
  Synthetic
cgacatagaggcgcgcatcggcggggcacggctgcaggcccagccccccgacgaagcatcctccaccgccacccc

SEQ ID NO: 159875 - DNA, 75 bp, Artificial Sequence
  Synthetic
ttccctgtttgctttatggaatgccctcccaacatctggtagacaatcctccagggacgatttaatcccagccgc

SEQ ID NO: 159876 - DNA, 75 bp, Artificial Sequence
  Synthetic
aggggagtgggctaggtgccgacgccggggtgccaagataatggattgagtaagcatggtgctctgatcgggtcc

SEQ ID NO: 159877 - DNA, 75 bp, Artificial Sequence
  Synthetic
cgggtctccagctcatcccggtgcatctggaagaattcctcatcgtagaatttgtcagagcccggcctacgagcg

SEQ ID NO: 159878 - DNA, 75 bp, Artificial Sequence
  Synthetic
caatcaagaataaaaggttgcagggcagacggttaggctgacaaggggacaagtgtggccgtaagcaaggcgtaa

SEQ ID NO: 159879 - DNA, 75 bp, Artificial Sequence
  Synthetic
cctaggctttcctgcaaggcgtgaaagactcggaggatgccagccggctcgaccgggatgtgatgggcggagagg

SEQ ID NO: 159880 - DNA, 75 bp, Artificial Sequence
  Synthetic
tatccctgaggcccttcttccttttaacgggaggaagaaaggtgggctttgaggggtgggggaatatgggtctct

SEQ ID NO: 159881 - DNA, 75 bp, Artificial Sequence
  Synthetic
ggaggttccaacccgaaatttgagaacattgcagaaggtttaagagctctcctggctaggagtcacgtagaaagg

SEQ ID NO: 159882 - DNA, 75 bp, Artificial Sequence
  Synthetic
ggtttatgactttctcatcattacacttatgacataataattatttcagatacatgctcacgtgcaggaggctgt

SEQ ID NO: 159883 - DNA, 75 bp, Artificial Sequence
  Synthetic
cacgctgatggagaaatgggcggtcggttgattggccccacagcgaccggcgaagcactgactcatgaaggtgac

SEQ ID NO: 159884 - DNA, 75 bp, Artificial Sequence
  Synthetic
aggggcccctggtgactcaggcacagctgacaaagaaggccccccaggaaagacccccggggggcatcggggggg

SEQ ID NO: 159885 - DNA, 75 bp, Artificial Sequence
  Synthetic
ggcagacaaggccccgccatcccaccggaccagggtcaacaggcggtcgtgggatggcggggccttgtctgcctc

SEQ ID NO: 159886 - DNA, 75 bp, Artificial Sequence
  Synthetic
tccagatgtccaggggtccccgagggcgaggcccagccccctcccgcccctgtccactgccccggtccccccaga

SEQ ID NO: 159887 - DNA, 75 bp, Artificial Sequence
  Synthetic
tgacaaaggccccccaggaaagacccccgggggggatcgggggggggtgggggcaatggggggtcggatttcgcc

SEQ ID NO: 159888 - DNA, 75 bp, Artificial Sequence
  Synthetic
agcggcgtgtcttggccagcggggagagggtggaagtcttttataaggctccggccccacgacctcgggagggac

SEQ ID NO: 159889 - DNA, 75 bp, Artificial Sequence
  Synthetic
caggttctccccccgtaccacaaaagaagcatagctcgagggccccatgatctggttgtcggcctcctcacccag

SEQ ID NO: 159890 - DNA, 75 bp, Artificial Sequence
  Synthetic
cttaaaggtgccggcggaaaaggtcacgtgacacctacggccacctgtgcacccaagtgtcgcctggagatgtac

SEQ ID NO: 159891 - DNA, 75 bp, Artificial Sequence
  Synthetic
actcccatcattccccatgagctcctcgtccatcctgtcggctccggacacgaggataggagtttccactgcctt

SEQ ID NO: 159892 - DNA, 75 bp, Artificial Sequence
  Synthetic
acccagctatgccaatccatgccaatgggggaggagagaccaagaccaatacccaggatcagaatcagaatcaga

SEQ ID NO: 159893 - DNA, 75 bp, Artificial Sequence
  Synthetic
cattctccacggtggggggcagggtctcgcgggtcctctggattagatagtcacgcccatcatccgcgatgtggt

SEQ ID NO: 159894 - DNA, 75 bp, Artificial Sequence
  Synthetic
gtccgcccgtgcactcgagatatggtggcagttgcggccttaaaccaggacacgttgagaccgtcctggcaggac

SEQ ID NO: 159895 - DNA, 75 bp, Artificial Sequence
  Synthetic
cacgttgagaccgtcctggcaggacaccaccgagggaaagttggtagtccaaaagaccccgcttcggttctctct

SEQ ID NO: 159896 - DNA, 75 bp, Artificial Sequence
  Synthetic
aacggcgaataataccgtataacctcaggccactgccctctcgatctttcacatccgactcattccctgccgcca

SEQ ID NO: 159897 - DNA, 75 bp, Artificial Sequence
  Synthetic
taacatagctgtgcttgtcttcctcttccggatgacagacaaagaggcgcagctgccggctaagaccaccgcccc

SEQ ID NO: 159898 - DNA, 75 bp, Artificial Sequence
  Synthetic
gcgtgtttcatttatggaattcctaggatttttgcagagaacggatttgtcctatatcaagaactttgtcagcga

SEQ ID NO: 159899 - DNA, 75 bp, Artificial Sequence
  Synthetic
ttgacacggccgcgggataaatagcctccacaggcaggaagcaccgcagtgacgtcatggccaataggaagctca

SEQ ID NO: 159900 - DNA, 75 bp, Artificial Sequence
  Synthetic
gatgtctatgatggagaggcagagaccctagctgagcctccacgctgtttcatgcttagctttgtttttatctat

SEQ ID NO: 159901 - DNA, 75 bp, Artificial Sequence
  Synthetic
cccgccgccgtctccggcctctgcggctccggcctctgcggctccggcctctgcggctccggacgcactggatgc

SEQ ID NO: 159902 - DNA, 75 bp, Artificial Sequence
  Synthetic
aggtgaaccatgttgttacactctatttgtaacaaggggaaactgcctatgacaccaataaaaccctcacaaacc

SEQ ID NO: 159903 - DNA, 75 bp, Artificial Sequence
  Synthetic
gatggctaggttggcccccaccccgtccgtaaagaatagactgacggtgaacgccgtctctttcaccacgtactt

SEQ ID NO: 159904 - DNA, 75 bp, Artificial Sequence
  Synthetic
atgagcttctgcagcacagacacaaacccttgtactgcgcttgttcccacaatagcatggcctctaggtaggggt

SEQ ID NO: 159905 - DNA, 75 bp, Artificial Sequence
  Synthetic
ttggaagctggaatcgagcgggggtggaggggcgtctcgacgctcagactcctcgtcttcgctcttggccgggcc

SEQ ID NO: 159906 - DNA, 75 bp, Artificial Sequence
  Synthetic
ggaggggcgtctcgacgctcagactcctcgtcttcgctcttggccgggccgggcccccgggggtgtccaaacggt

SEQ ID NO: 159907 - DNA, 75 bp, Artificial Sequence
  Synthetic
accctgacaaaggccccccaggaaagacccccggggggcatcggggggggtgttggcgggggcatgggggggtcg

SEQ ID NO: 159908 - DNA, 75 bp, Artificial Sequence
  Synthetic
gttggcaaatgtgcacatccatttataaggatgtcaactacagtcagagaacccctttgtgtttggtcccccccc

SEQ ID NO: 159909 - DNA, 75 bp, Artificial Sequence
  Synthetic
gacctgacatccgtctgccttccctggcttctggacctgagcggagacagatcctggtgccccacggacacctcc

SEQ ID NO: 159910 - DNA, 75 bp, Artificial Sequence
  Synthetic
ctccctccgccgttactctgtagaatgatctccaggccccccggtctgtccccggccttgcactgctggatggag

SEQ ID NO: 159911 - DNA, 75 bp, Artificial Sequence
  Synthetic
tgatggccctcccaggtcctgatagactctggtagcttggtcaaaagcttgtacaaaaggcacctggtatgggtc

SEQ ID NO: 159912 - DNA, 75 bp, Artificial Sequence
  Synthetic
tgatctccaggccccccggtctgtccccggccttgcactgctggatggagatattgggcagggtgcagttgcaac

SEQ ID NO: 159913 - DNA, 75 bp, Artificial Sequence
  Synthetic
cggagtgtggcattgtttggccatgacagcatgaatgtgctccaggagaagaagtggaacttgagtctgggctcc

SEQ ID NO: 159914 - DNA, 75 bp, Artificial Sequence
  Synthetic
acagcatgaatgtgctccaggagaagaagtggaacttgagtctgggctcccgcccgctaaagggcggacaggggg

SEQ ID NO: 159915 - DNA, 75 bp, Artificial Sequence
  Synthetic
gcagcgctcaaattggtgatgagacaagtagcggatgataaggcgaaacattgagctcgtgcttatggaacccgg

SEQ ID NO: 159916 - DNA, 75 bp, Artificial Sequence
  Synthetic
gcagtcggtgtatgtgatgaccctgggcaccgggaggtgggcagcgtggtcagggtgggcagaggaccatatttc

SEQ ID NO: 159917 - DNA, 75 bp, Artificial Sequence
  Synthetic
cagctcggccagggacgtgacggcggccaggctctgaccagactcggaagtaaatagctccgtgaggtgcgccag

SEQ ID NO: 159918 - DNA, 75 bp, Artificial Sequence
  Synthetic
ggcctccctgcccagggccgtgtccaaccatttgattagaagggtagcatcctcgggaagcgcgggtgggctgcg

SEQ ID NO: 159919 - DNA, 75 bp, Artificial Sequence
  Synthetic
gttgcaggccagggcgtaaaagagacccagctgtgaagagaagccctcgagacctccccccatctccctcttacc

SEQ ID NO: 159920 - DNA, 75 bp, Artificial Sequence
  Synthetic
tccccctgtggctgcttcttggcgctcagtgtgagcagttccacgaggggcgtgagcgagcgcagggcccccgcg

SEQ ID NO: 159921 - DNA, 75 bp, Artificial Sequence
  Synthetic
tgacggtggatgccgacctgctctcgaacctgcggcagtcagcggccgaggggttgtttcatagctttgacctgc

SEQ ID NO: 159922 - DNA, 75 bp, Artificial Sequence
  Synthetic
accactgtggccatcaatgtggccatcatacctatcctgtgctcggtggccatgctcatcaggatatgccggatt

SEQ ID NO: 159923 - DNA, 75 bp, Artificial Sequence
  Synthetic
tggtgggcaaggatgccagagaggcgggcatcaagtttgaggtgctactcggggtctacacgaacgccatccaat

SEQ ID NO: 159924 - DNA, 75 bp, Artificial Sequence
  Synthetic
atgttcgcttcctggagacggcactggccgtgtcctgtgtgaacacggaattcaaagacctgagtcgtatgacgg

SEQ ID NO: 159925 - DNA, 75 bp, Artificial Sequence
  Synthetic
atggtaagattcaatttcgaatctccgtccccaccattgctcacggggacggaaggagacccagcaagcagagga

SEQ ID NO: 159926 - DNA, 75 bp, Artificial Sequence
  Synthetic
ggaaggagacccagcaagcagaggacatttattgtggtcaaaaattgccacaaacaccacattagtacggaaatg

SEQ ID NO: 159927 - DNA, 75 bp, Artificial Sequence
  Synthetic
cgaggccctgctctgggaccagacctacggcgtcccagactcggtcatcgaggctttcctggccgggatggcggc

SEQ ID NO: 159928 - DNA, 75 bp, Artificial Sequence
  Synthetic
ggtcgagtacgcagagtacgtgggggctgtcaagaccgtggcctcggccctacagtttggggtcgatgccctgga

SEQ ID NO: 159929 - DNA, 75 bp, Artificial Sequence
  Synthetic
acgatggccttctatctcccagactggtcgtgctgcgggctctggctctttggccggcccaggaatagatacagc

SEQ ID NO: 159930 - DNA, 75 bp, Artificial Sequence
  Synthetic
tggccagctttgagctaatgccatagtcacggatgctgcagaggttcagggacttgtcctctatcgtctcataca

SEQ ID NO: 159931 - DNA, 75 bp, Artificial Sequence
  Synthetic
gaggggcctcattaacaccgtcctgagtgtgaagcttcgccatgcccctcccatgtttatcctgcagaccctggc

SEQ ID NO: 159932 - DNA, 75 bp, Artificial Sequence
  Synthetic
ggatcccaccttcactgagagggggttctccaagactgtcaagtcagacctcattgccatgttcaagaggcatct

SEQ ID NO: 159933 - DNA, 75 bp, Artificial Sequence
  Synthetic
ttggcgatgagcacgttgctgacctgcgcggcgggggcattgcccagcttgggcacctgtcgcccgatgtcgtaa

SEQ ID NO: 159934 - DNA, 75 bp, Artificial Sequence
  Synthetic
ctctgagatggtagcggccgtgtccggggagagcgtgctcaagggggtcagtacctacacgaccgccaagggggg

SEQ ID NO: 159935 - DNA, 75 bp, Artificial Sequence
  Synthetic
cgcgtggcacagcagcccgacttgcacccccagctcccccaaggccaccgagaacgtatctggcctgttgaggaa

SEQ ID NO: 159936 - DNA, 75 bp, Artificial Sequence
  Synthetic
agcccgtcttcttaccctgttgtttcggagaatggcccaaaaattgcagatgttgagcgtggccattagcccgcc

SEQ ID NO: 159937 - DNA, 75 bp, Artificial Sequence
  Synthetic
aggtggagattcagtttaaccatttattgatttaatccaggaacaaaaaacagtcctagtgacccagtgcccgga

SEQ ID NO: 159938 - DNA, 75 bp, Artificial Sequence
  Synthetic
aactcattcacactcttggagaggcccgctatgtccttgcggtagcaaggccaagtctgtgtcagcccacctcaa

SEQ ID NO: 159939 - DNA, 75 bp, Artificial Sequence
  Synthetic
aacattagcatcccggcgaccaccagctctgtcatgctgcgtggcctccggggctgcgtcctgccttgttgggtg

SEQ ID NO: 159940 - DNA, 75 bp, Artificial Sequence
  Synthetic
tcgctgatgtcatgccctgacagcacgatcggtggcctccgactacctcccggagatgtttgcagagcacttgta

SEQ ID NO: 159941 - DNA, 75 bp, Artificial Sequence
  Synthetic
tcggtagcactaaatgtccccagacaggcaaccgccccgaaggtcagctcctctatatgtaggggctggaccaca

SEQ ID NO: 159942 - DNA, 75 bp, Artificial Sequence
  Synthetic
attaaagcctcctcgcaacttatgatagcagaagactcctgcctgaatcagatcgcccccttttccgcatcagaa

SEQ ID NO: 159943 - DNA, 75 bp, Artificial Sequence
  Synthetic
agagggggtcttctacctctccctagccctccgccccctccaaggactcgggcccagtttctaactttttcccct

SEQ ID NO: 159944 - DNA, 75 bp, Artificial Sequence
  Synthetic
cagcttctccatgcagagttttctgaggagggctgggcccggggctcgggggacaatatcaggctaaattcagtg

SEQ ID NO: 159945 - DNA, 75 bp, Artificial Sequence
  Synthetic
aggagggctgggcccggggctcgggggacaatatcaggctaaattcagtgtatgcatagtctggaaggtgactgg

SEQ ID NO: 159946 - DNA, 75 bp, Artificial Sequence
  Synthetic
aacactacaataaaccctatgtgcaaatgtggtttgtatggctactttgtgttcctaaaaaatgcaacaatagaa

SEQ ID NO: 159947 - DNA, 75 bp, Artificial Sequence
  Synthetic
ggagactcagagtgcctctgagcatgggggcatgtctgttccccctccacctcggacccgaagccatcaccaggt

SEQ ID NO: 159948 - DNA, 75 bp, Artificial Sequence
  Synthetic
cacccgggacttgtacccgggacgggtggctacagccacacacgtctcctccctagcaaaacctctagggcagcg

SEQ ID NO: 159949 - DNA, 75 bp, Artificial Sequence
  Synthetic
ctttgtccagatgtccaggggtccccgagggcgaggcccagccccctcccgcccaagctgctttgattcctggga

SEQ ID NO: 159950 - DNA, 75 bp, Artificial Sequence
  Synthetic
tatttttgggaatggtgttaactttctccccttgtatttgctattcaatcaacctgattccccctgctcatacct

SEQ ID NO: 159951 - DNA, 75 bp, Artificial Sequence
  Synthetic
gggttgcctatgctaaccctcatttcccccacgtgtgccatctggtggcgcgatcggtgttttacaccctgggct

SEQ ID NO: 159952 - DNA, 75 bp, Artificial Sequence
  Synthetic
ctccccttgtatttgctattcaatcaacctgattccccctgctcatacctccactcacaaccaagccactacggc

SEQ ID NO: 159953 - DNA, 75 bp, Artificial Sequence
  Synthetic
aagtgcttttccatttttagccccagccccgcctctataagttctaggcaaacctccaatcaccagccaccttcc

SEQ ID NO: 159954 - DNA, 75 bp, Artificial Sequence
  Synthetic
aacctccaatcaccagccaccttccaatgtagtctcttagagagtggctgctacgcattagcgagagatttgacc

SEQ ID NO: 159955 - DNA, 75 bp, Artificial Sequence
  Synthetic
gctgacctttcgtggtctgacctgggagctccgagaccccgcttgagtgtgtgccccggtgggcatttagctgtg

SEQ ID NO: 159956 - DNA, 75 bp, Artificial Sequence
  Synthetic
gatgaagactaagtcacaggcttagccaggtgatttgtgaatttcagtttatttactttcttccaatcaagcttt

SEQ ID NO: 159957 - DNA, 75 bp, Artificial Sequence
  Synthetic
ccaggtgatttgtgaatttcagtttatttactttcttccaatcaagctttcccagcctccgcttctcaggtccca

SEQ ID NO: 159958 - DNA, 75 bp, Artificial Sequence
  Synthetic
gcaagatactaaaattaaccaaggtcagcccaagtgacgcgtgttatgccaggctgcccaccctgaggatttccc

SEQ ID NO: 159959 - DNA, 75 bp, Artificial Sequence
  Synthetic
acgccacccgacgtgcccgctcccgctcccggggacgtgaagcaaagaaagtgcaaatttctgattaataaatct

SEQ ID NO: 159960 - DNA, 75 bp, Artificial Sequence
  Synthetic
ccaaaaatgggctgttagtagggtcctcctaccccctctttaggccaggtgtgttattttgttgtgttagtgcta

SEQ ID NO: 159961 - DNA, 75 bp, Artificial Sequence
  Synthetic
attcacctgtatccctttccctccacccgcagtaactcagcgctggcgtgtgacgtggtgtaaagttttgcctga

SEQ ID NO: 159962 - DNA, 75 bp, Artificial Sequence
  Synthetic
gttgcggacatggtgacttatgaagatgagtagttctaagcgagatctggtggcccagcaactaagagcctcggt

SEQ ID NO: 159963 - DNA, 75 bp, Artificial Sequence
  Synthetic
tgttgacactgatatgtctggaaacccgtcactctccgtaattcccacgaatccttaccaggaacaactatcaaa

SEQ ID NO: 159964 - DNA, 75 bp, Artificial Sequence
  Synthetic
ccgtcactctccgtaattcccacgaatccttaccaggaacaactatcaaataatccattaattcaactacaaatc

SEQ ID NO: 159965 - DNA, 75 bp, Artificial Sequence
  Synthetic
accccctccacctcctccacctgagcgcagggatgcctggacacaagagcccttaccactggatatgaatcccct

SEQ ID NO: 159966 - DNA, 75 bp, Artificial Sequence
  Synthetic
cgcagggatgcctggacacaagagcccttaccactggatatgaatcccctgggcagtgacgccagtcaaggccct

SEQ ID NO: 159967 - DNA, 75 bp, Artificial Sequence
  Synthetic
ctggtggtgcctgggcggggcgctggcgaactggtggacacatgatgtgtgctggtagaggctggtgtcacctgt

SEQ ID NO: 159968 - DNA, 75 bp, Artificial Sequence
  Synthetic
atgtatagagttacggttcgctacatcaaacaggacagccgttgccctcctaatctatatctgggtagcatatgc

SEQ ID NO: 159969 - DNA, 75 bp, Artificial Sequence
  Synthetic
cgcacggggccaacaaggccttcttaggccactaggaccacaaacacgctctcaggtcaccttggaacgtcaacc

SEQ ID NO: 159970 - DNA, 75 bp, Artificial Sequence
  Synthetic
aggccactaggaccacaaacacgctctcaggtcaccttggaacgtcaacctgtccacaaccctcgccaggaggca

SEQ ID NO: 159971 - DNA, 75 bp, Artificial Sequence
  Synthetic
ctgggtagcatatactacccaagtctatatctgggtagcatatgctatcctaatctatatctgggtagcatatgc

SEQ ID NO: 159972 - DNA, 75 bp, Artificial Sequence
  Synthetic
catggtagccttaggacatactcttcaacccacaccaccaccaaggcctactcttcctcaacccagaataccact

SEQ ID NO: 159973 - DNA, 75 bp, Artificial Sequence
  Synthetic
ctccagcaggaccagtttctggagaacgtagcgagcgtagctggcggctgtcatggtgacggctcgggaaaacat

SEQ ID NO: 159974 - DNA, 75 bp, Artificial Sequence
  Synthetic
gttggtggtatttgcctgtggacttgtttctcccacagtagggccggtggcatttggggttggggtagtcactgc

SEQ ID NO: 159975 - DNA, 75 bp, Artificial Sequence
  Synthetic
caacccacaccaccaccaaggcctactcttcctcaacccagaataccactgataataccaccaaggcatactaat

SEQ ID NO: 159976 - DNA, 75 bp, Artificial Sequence
  Synthetic
tgaggtggggctggtggcatttggggttggggtagtcactgctgaggtggggcttgtttttcccaaggtggggct

SEQ ID NO: 159977 - DNA, 75 bp, Artificial Sequence
  Synthetic
tcaactaagtctaccaccgcatcctcccccgcatcagagcaccccacattgtagttctgatagtacaggactccc

SEQ ID NO: 159978 - DNA, 75 bp, Artificial Sequence
  Synthetic
cccccgcatcagagcaccccacattgtagttctgatagtacaggactccctccacctcccacatcttacagcatt

SEQ ID NO: 159979 - DNA, 75 bp, Artificial Sequence
  Synthetic
aaaggcacaaatacagggtttatcaatgttagcaacgggaggtgaacccagaggtgatgctactagtgaaacgag

SEQ ID NO: 159980 - DNA, 75 bp, Artificial Sequence
  Synthetic
acacccccttccaggtgtcatttatgaccaacaagcacttcctccaactccagggccaccatggtggccacctgt

SEQ ID NO: 159981 - DNA, 75 bp, Artificial Sequence
  Synthetic
gaccaacaagcacttcctccaactccagggccaccatggtggccacctgtccgcgaccccacgccaaccactcag

SEQ ID NO: 159982 - DNA, 75 bp, Artificial Sequence
  Synthetic
tcggagatcatcccactgggacggggtggtgcctggtatgcagaaggggccctgtacatgtttttcgttaacatg

SEQ ID NO: 159983 - DNA, 75 bp, Artificial Sequence
  Synthetic
caggtggcggggcaggggcagaagcaagggcaggggcagaatgcacaaacttcctgaaccacggagaccagggcc

SEQ ID NO: 159984 - DNA, 75 bp, Artificial Sequence
  Synthetic
aagggcaggggcagaatgcacaaacttcctgaaccacggagaccagggccagacacttccagtcctagtatgcct

SEQ ID NO: 159985 - DNA, 75 bp, Artificial Sequence
  Synthetic
cattggctgcaaaggggcccacggtggaacaggaacaggaggggcaggaggggcaggagcaggaggggcaggagg

SEQ ID NO: 159986 - DNA, 75 bp, Artificial Sequence
  Synthetic
accaacccccggcccgtctacggccggccccgtctgtagagtgacaccttcagcaacccctgacatttcaccaat

SEQ ID NO: 159987 - DNA, 75 bp, Artificial Sequence
  Synthetic
gctcgcaaatgcaccagaaatattttcacaacccgaaggtgtccccgaggtgagagtccatttgcacttaaagtc

SEQ ID NO: 159988 - DNA, 75 bp, Artificial Sequence
  Synthetic
gggccacccggccgccccccgagctccagggctgggtcctgagacccaaagcgacagggggagactttcggggca

SEQ ID NO: 159989 - DNA, 75 bp, Artificial Sequence
  Synthetic
tgagagtccatttgcacttaaagtcagtttcagtgttgtttggccaggcccaaaaggcagtcactgtaacatttg

SEQ ID NO: 159990 - DNA, 75 bp, Artificial Sequence
  Synthetic
ggccccgtctgtagagtgacaccttcagcaacccctgacatttcaccaatacatgaaccagagtcctctgatagt

SEQ ID NO: 159991 - DNA, 75 bp, Artificial Sequence
  Synthetic
cctctggatttaagtttacatccagacgttgctgctcaaccagctccccaggctccataccagggataccaggag

SEQ ID NO: 159992 - DNA, 75 bp, Artificial Sequence
  Synthetic
acctgcagaattagatgaaagttgggagggcatttttgaaacaacagaatctcatagctctgatgaagagaatgt

SEQ ID NO: 159993 - DNA, 75 bp, Artificial Sequence
  Synthetic
gagggcatttttgaaacaacagaatctcatagctctgatgaagagaatgtaggggggcctagtaaaagacctcgc

SEQ ID NO: 159994 - DNA, 75 bp, Artificial Sequence
  Synthetic
cacacacagcaacccctaacgtttcaccaatacatgaaccggagctccggttcatgtattggtgaaacgttaggg

SEQ ID NO: 159995 - DNA, 75 bp, Artificial Sequence
  Synthetic
aataaatgttaatgattttgttcttaactattgacccgcctgtcattctattaattaaacaagggaagctatgtt

SEQ ID NO: 159996 - DNA, 75 bp, Artificial Sequence
  Synthetic
ctcggccatggccaggaacgtaaagaggaacttgtaaaactccaagtccctctcattgagtagcttgagacaccc

SEQ ID NO: 159997 - DNA, 75 bp, Artificial Sequence
  Synthetic
aactattgacccgcctgtcattctattaattaaacaagggaagctatgtttagctattccaccaacactgcacca

SEQ ID NO: 159998 - DNA, 75 bp, Artificial Sequence
  Synthetic
ccccaattttggcaagccttccttggggtcgtgttggtggaatagctaaacctttttcccttgtttaattgatag

SEQ ID NO: 159999 - DNA, 75 bp, Artificial Sequence
  Synthetic
tacagcccagtaggcagctcagaaaagtttagctattccaccaacccggccccaatgaatgcttgccaaaattgg

SEQ ID NO: 160000 - DNA, 75 bp, Artificial Sequence
  Synthetic
agtttagctattccaccaacccggccccaatgaatgcttgccaaaattggggccttgctctcagcactttgccag

SEQ ID NO: 160001 - DNA, 75 bp, Artificial Sequence
  Synthetic
atttgtgtttttacgctgaaattcgagtcttgagctgacgttggcaaacttaagggtagcgtgacatccagcccc

SEQ ID NO: 160002 - DNA, 75 bp, Artificial Sequence
  Synthetic
ctactctccacttccagtccatgttcgcactcctatgcatttccttccctcccacttttatcccagtcccaaccc

SEQ ID NO: 160003 - DNA, 75 bp, Artificial Sequence
  Synthetic
atgtcaaacatggtgtctgtaatctctaaagatttgattgagatcagaaaataaaaagaatgtaacactacttgt

SEQ ID NO: 160004 - DNA, 75 bp, Artificial Sequence
  Synthetic
ccactgcccttgtgactaaaatggttcactaccctcgtggaatcctgaccccatgtaaataaaaccgtgacagct

SEQ ID NO: 160005 - DNA, 75 bp, Artificial Sequence
  Synthetic
gcgggactccgctcattctgttcctcccgcggcaccgacagagccgcgctggccttacactccatcacccccaga

SEQ ID NO: 160006 - DNA, 75 bp, Artificial Sequence
  Synthetic
gcttgtgcttgtactgaccactcaggaagctggccaggctggtgacaaactctctcatctccaaaaagttggggt

SEQ ID NO: 160007 - DNA, 75 bp, Artificial Sequence
  Synthetic
gcattggacgtccctttggaggacagcgtgggggccaaggtggtagcgttggtaatccgggtagtagcactggcg

SEQ ID NO: 160008 - DNA, 75 bp, Artificial Sequence
  Synthetic
ttgtcgcgaatcagcatgttgttggtaaatgtgcagaaggggaggtccctgaactcccttccgccatagcggacg

SEQ ID NO: 160009 - DNA, 75 bp, Artificial Sequence
  Synthetic
cacatcttgaaagtagacatctacagattccaggcttacttgttgctcctctccagtggtgacgttaattggaag

SEQ ID NO: 160010 - DNA, 75 bp, Artificial Sequence
  Synthetic
gtaggtgagtagtgtaagaagcatggcgaagtagacaggttacttttagagtgtagtgtacagggccgggcgcaa

SEQ ID NO: 160011 - DNA, 75 bp, Artificial Sequence
  Synthetic
tggtagacagcctttgtatggggtgtcagctggccaaagtcaagatcaagttgatgctttttgcccccgacatcg

SEQ ID NO: 160012 - DNA, 75 bp, Artificial Sequence
  Synthetic
tcagctggccaaagtcaagatcaagttgatgctttttgcccccgacatcgaaattgatagttacattgacatctg

SEQ ID NO: 160013 - DNA, 75 bp, Artificial Sequence
  Synthetic
ttgaaaaaaccaggatcttcacccgtgagatggatcaggctctggatggtgtactgacacacaagcaaggctgcc

SEQ ID NO: 160014 - DNA, 75 bp, Artificial Sequence
  Synthetic
agccgggcggccgccggtgggtccgctgggccgctgccccgctccgggtggggggtggccccgctgggcaccgct

SEQ ID NO: 160015 - DNA, 75 bp, Artificial Sequence
  Synthetic
acctggcacctgagtgtggaggtacagaccaatgtgacaattttccccaaatgttgagggacctaagagatgcct

SEQ ID NO: 160016 - DNA, 75 bp, Artificial Sequence
  Synthetic
tggatgacaacatggaagaagaagtcccatctacctcggttgtgcaggaacaggtatcggcgggagattgggaaa

SEQ ID NO: 160017 - DNA, 75 bp, Artificial Sequence
  Synthetic
gggggtggccccgctgggcaccgctgcgccgccgccaggtcctggggcagccggggttcctggcgctccactgca

SEQ ID NO: 160018 - DNA, 75 bp, Artificial Sequence
  Synthetic
tcccctggaccccagccccgccgatccctcccccagggcgtacccggcttgcctggttctggggctcctctgggg

SEQ ID NO: 160019 - DNA, 75 bp, Artificial Sequence
  Synthetic
gtacgaagagaaagcgggtcgatcatgatgccggtgggtcagctccagcacgacccatgctcccaccccagccgg

SEQ ID NO: 160020 - DNA, 75 bp, Artificial Sequence
  Synthetic
cgacccatgctcccaccccagccggatctccctgggcgagaagccattctccgcaggtttccactagatctaaga

SEQ ID NO: 160021 - DNA, 75 bp, Artificial Sequence
  Synthetic
tccccaaatgttgagggacctaagagatgccttcagtcgtgttaaaacctttttccagacaaaggacgaggtaga

SEQ ID NO: 160022 - DNA, 75 bp, Artificial Sequence
  Synthetic
gctctcccacccagccccgcttctcacctgtgctagtggctcctctgaaggatgggcggaggttggtgccacaaa

SEQ ID NO: 160023 - DNA, 75 bp, Artificial Sequence
  Synthetic
ctccttctgttttttcgcgactgtctcaaactctggaaggggggcaatgctggggtcgtcctcctcaactcgctc

SEQ ID NO: 160024 - DNA, 75 bp, Artificial Sequence
  Synthetic
atttgagaaggtaaaagtggcactgaggcaagtagcctccggtgacacctggtgactagtggtgcgctggacact

SEQ ID NO: 160025 - DNA, 75 bp, Artificial Sequence
  Synthetic
gctgcatccgctagtccgacctgggtgggtgcggtccgctggccccaccctgggggtcgccgccgggtctgctgg

SEQ ID NO: 160026 - DNA, 75 bp, Artificial Sequence
  Synthetic
atttgttgccgttggtttcagcgcatcgacacacgagccatagaccagtttttcggatcccagatttcaaatacc

SEQ ID NO: 160027 - DNA, 75 bp, Artificial Sequence
  Synthetic
ctgtcatttacaataaaatgaaaccttttattcttgattgcttcttgtgttcttgccgcccaggtaccttcctgt

SEQ ID NO: 160028 - DNA, 75 bp, Artificial Sequence
  Synthetic
cgtcggtgcagcgcttgttgttgatgaagagggcccagttgcgggccacgtccacgtaggtcgcggccctggggt

SEQ ID NO: 160029 - DNA, 75 bp, Artificial Sequence
  Synthetic
cttctgcagaaggccattgacgcaagttttgcccgtggggattacccgacccagccacttacagcacattttgtt

SEQ ID NO: 160030 - DNA, 75 bp, Artificial Sequence
  Synthetic
ccctggccgccggatggcctatgggttaccaggcatacagcagctggatgtacagctacacagatcaccagacgg

SEQ ID NO: 160031 - DNA, 75 bp, Artificial Sequence
  Synthetic
gcgccccgttcacgggggaggaccgcggccgagccaccaggggcccggcgggggtggggggtgcgctcccaggcc

SEQ ID NO: 160032 - DNA, 75 bp, Artificial Sequence
  Synthetic
aggccgccgcaaggacgccgggccggctgggaggtgtgcaccccccgagcgtctggacgacgctggcgagccggg

SEQ ID NO: 160033 - DNA, 75 bp, Artificial Sequence
  Synthetic
gcacctttaagccgccgcgatgtacgcccggggatcgccagtggttgtatgttcagagctccgtgggtaacattg

SEQ ID NO: 160034 - DNA, 75 bp, Artificial Sequence
  Synthetic
acgcgcagtgagttgcgaaggcttggggcccacatgagttcggggcctgtgtccctgggcagtcgggcggggtct

SEQ ID NO: 160035 - DNA, 75 bp, Artificial Sequence
  Synthetic
acagcggatgtcaccagcccaacaccagccggcacaacgtcaggcgcatcaccggtgacaccaagtcccacgtga

SEQ ID NO: 160036 - DNA, 75 bp, Artificial Sequence
  Synthetic
gtccctgggcagtcgggcggggtctatcaagacgtgcccggagagcgccatcctgccagcgggagaggaggttta

SEQ ID NO: 160037 - DNA, 75 bp, Artificial Sequence
  Synthetic
cacaggagcctcacgaaaatctgggaggaagttttaacacctgaccagcgtgtttcatttatggaattcctagga

SEQ ID NO: 160038 - DNA, 75 bp, Artificial Sequence
  Synthetic
gcccggggatcgccagtggttgtatgttcagagctccgtgggtaacattgtacagagctgtaatccccgctacag

SEQ ID NO: 160039 - DNA, 75 bp, Artificial Sequence
  Synthetic
tctacctggagcgttctcagggatcgctggtttttaaataccaacgccgccaagacttccaggccctgactgccc

SEQ ID NO: 160040 - DNA, 75 bp, Artificial Sequence
  Synthetic
taactgccagagctgtgtttcccgacgccaatgctaactccccaaacatgtcctgtgagttttgcccataaatga

SEQ ID NO: 160041 - DNA, 75 bp, Artificial Sequence
  Synthetic
aggagggggaggattgggctccgccccgatatacctagtgggtggagcctagaggtaggtatccatagggttcca

SEQ ID NO: 160042 - DNA, 75 bp, Artificial Sequence
  Synthetic
ccgatatacctagtgggtggagcctagaggtaggtatccatagggttccattatcctggaggtatcctaagctcc

SEQ ID NO: 160043 - DNA, 75 bp, Artificial Sequence
  Synthetic
agaggtaggtatccatagggttccattatcctggaggtatcctaagctccgcccctatataccaggtgggtggag

SEQ ID NO: 160044 - DNA, 75 bp, Artificial Sequence
  Synthetic
acggagagcgatggagatgatgaagatcttccttgtatagtgtccagaggtggacctaaggtcaaacgaccccct

SEQ ID NO: 160045 - DNA, 75 bp, Artificial Sequence
  Synthetic
gctctatacccgcccctccagggggcccaggatctataggcatgggctgcatagccgcagcagactcctggaccc

SEQ ID NO: 160046 - DNA, 75 bp, Artificial Sequence
  Synthetic
cgttttaatggtagaataacctataggttattaacctagtggtggaatagggtattgcagctgggtatataccta

SEQ ID NO: 160047 - DNA, 75 bp, Artificial Sequence
  Synthetic
cacctaaggtgcgctcgcttacctgccgcctttctagccggggggagactgtgaaattttgccaggtcgtgcgtg

SEQ ID NO: 160048 - DNA, 75 bp, Artificial Sequence
  Synthetic
gtgcgcgccgccagcatggcagccgggtcgtgaaataaaagcttctggttgataatctcaaagagggtgtcaaac

SEQ ID NO: 160049 - DNA, 75 bp, Artificial Sequence
  Synthetic
gcacatttggtcagctgaccgatgctcgccacttcctgggtcatgacctggcctgtgccttgtcccgtggacaat

SEQ ID NO: 160050 - DNA, 75 bp, Artificial Sequence
  Synthetic
aatgggagggagcctgcccatccatcaacttcagctccagggccagcaaaaccagcccggggaaaagagagctga

SEQ ID NO: 160051 - DNA, 75 bp, Artificial Sequence
  Synthetic
gcctgtgccttgtcccgtggacaatgtccctccagcgtggtggctgcctttgggatgcatcactttgagccacta

SEQ ID NO: 160052 - DNA, 75 bp, Artificial Sequence
  Synthetic
gtatctccaggggatcaactcccaggtgtttctagcgacgggcgagtggcgtgtgcaccagtacccgccccggct

SEQ ID NO: 160053 - DNA, 75 bp, Artificial Sequence
  Synthetic
cgtgggcctcacgtagtgggcccagatgaagcggaagagctccccatggcggaaaagcgtctggactggataggc

SEQ ID NO: 160054 - DNA, 75 bp, Artificial Sequence
  Synthetic
tcgccacttcctgggtcatgacctggcctgtgccttgtcccgtggacaatgtccctccagcgtggtggctgcctt

SEQ ID NO: 160055 - DNA, 75 bp, Artificial Sequence
  Synthetic
ctcaccatgacacactaagcccctgctaatccatgagccccgcctttaggaagcaccacgtcccggggacggaag

SEQ ID NO: 160056 - DNA, 75 bp, Artificial Sequence
  Synthetic
ggcctttgcacccgttagaccacaacacatgccagtagaacccgtccctgtcccgacagtggcacttgagcggcc

SEQ ID NO: 160057 - DNA, 75 bp, Artificial Sequence
  Synthetic
ctaatccatgagccccgcctttaggaagcaccacgtcccggggacggaaggggacttggggtgattttctatgtg

SEQ ID NO: 160058 - DNA, 75 bp, Artificial Sequence
  Synthetic
cgcctccccattcatcatgtaacccgcaaatcatctaaaccgtaagtctaagggcctcctgaggttttctcagga

SEQ ID NO: 160059 - DNA, 75 bp, Artificial Sequence
  Synthetic
tcacacacttataaaaggggaagtgaccccgaaatcgaacacgttagtctttagaggtaccccaaaattcagtgc

SEQ ID NO: 160060 - DNA, 75 bp, Artificial Sequence
  Synthetic
acgcgcgcgggagcgttggaggcccgcaccttggacgccaaatccaccccgttctcccagtcagatgtccgtgcg

SEQ ID NO: 160061 - DNA, 75 bp, Artificial Sequence
  Synthetic
ccccaaagatctggttggcgatccggtacaccaggtcccggtcccgacccgccgccccgggcacgttcagcgcgg

SEQ ID NO: 160062 - DNA, 75 bp, Artificial Sequence
  Synthetic
aagactggcctaaaatgagtataacctactttttttaaatcaaatgcatgattaattatacattagggcctcctg

SEQ ID NO: 160063 - DNA, 75 bp, Artificial Sequence
  Synthetic
catttcgaaccggggtgtgcagatgcaggtctccgggtgggcaggcagtacgagatgtcacgttgtgttgtcttt

SEQ ID NO: 160064 - DNA, 75 bp, Artificial Sequence
  Synthetic
gtgctgtggtggctccggtgctcctcatcattatcatctcctgtctggggtggctggcgggctgggggaggcggc

SEQ ID NO: 160065 - DNA, 75 bp, Artificial Sequence
  Synthetic
tccgcgaatgtgccgggtggatatgccgcctgtcggttgagaggggctattgactggcgcgcttccttgtttccg

SEQ ID NO: 160066 - DNA, 75 bp, Artificial Sequence
  Synthetic
tggggtaccggcgatgcagccacagtactttgacctccccttaattcaacccattagccagggggcacccgtggc

SEQ ID NO: 160067 - DNA, 75 bp, Artificial Sequence
  Synthetic
gctccaacacaggatgcagggcaccatttccatgcacacgactgtcccgtatacacagggctaacagtatatccc

SEQ ID NO: 160068 - DNA, 75 bp, Artificial Sequence
  Synthetic
gtgggttatttcccccctcagtgttcgccagcttatttccccagtccccacgtactggggcctgtggacacctga

SEQ ID NO: 160069 - DNA, 75 bp, Artificial Sequence
  Synthetic
cccagctccagcagctcttcccgtgaggcagggagggggcgctgctggtgtgaggagcccccctggagtagcagg

SEQ ID NO: 160070 - DNA, 75 bp, Artificial Sequence
  Synthetic
cgtactggggcctgtggacacctgagggagcggccgttggtgggcatgtgttggaattgctcccaccctcaattt

SEQ ID NO: 160071 - DNA, 75 bp, Artificial Sequence
  Synthetic
ttggaattgctcccaccctcaattttcgcttgccttcttcccttgttaacctgatagcatagcctctaggtttcc

SEQ ID NO: 160072 - DNA, 75 bp, Artificial Sequence
  Synthetic
ccctcaagcaccgccaccacttctgtcatcagctttagggagacggagttggtaaagttcaggttgcccctcagc

SEQ ID NO: 160073 - DNA, 75 bp, Artificial Sequence
  Synthetic
acatttgtgccagatcttgtagagcaagatggcctattcaacaagggagatactgttagccctgtgtatacggga

SEQ ID NO: 160074 - DNA, 75 bp, Artificial Sequence
  Synthetic
tgcttagggaacacgcgccgctgcatggcattagccgacatggtccggtaccagggtccgaaggacggtacccac

SEQ ID NO: 160075 - DNA, 75 bp, Artificial Sequence
  Synthetic
tggcattagccgacatggtccggtaccagggtccgaaggacggtacccactggttgatgttcccgtacagattac

SEQ ID NO: 160076 - DNA, 75 bp, Artificial Sequence
  Synthetic
ttgcacccggggacttttatcttctggctcagaggccgtactggcggccgcctcttcggaggcgtggttaaataa

SEQ ID NO: 160077 - DNA, 75 bp, Artificial Sequence
  Synthetic
gctcaacacatgctcatctcccttctcggtcactcgcttgtaggtgcccatcagaaatttagaagtcatggcccc

SEQ ID NO: 160078 - DNA, 75 bp, Artificial Sequence
  Synthetic
gccagaggacactgtagttctgcgttatcatgtgttgcttgaggagataattgaacgaaattcagagacatttac

SEQ ID NO: 160079 - DNA, 75 bp, Artificial Sequence
  Synthetic
cccaaaacctactaccccatcgggcccacttccaaagaacaacacaggttcttcatcattaacatagcgtttatt

SEQ ID NO: 160080 - DNA, 75 bp, Artificial Sequence
  Synthetic
tcagtaaaacctaagagatatttggtgtcacttccgcattttaagtttcagaaaattttaaaattaaaattgaaa

SEQ ID NO: 160081 - DNA, 75 bp, Artificial Sequence
  Synthetic
cacaccgaacatgtggacctggattttaactcagtatttttagagatatttcaccgtggagacccaagccttggg

SEQ ID NO: 160082 - DNA, 75 bp, Artificial Sequence
  Synthetic
gatgaggatgagagtggcgaggggtccgatacctccgagccgtgtgaagctcttgatttgtcaatccatggcagg

SEQ ID NO: 160083 - DNA, 75 bp, Artificial Sequence
  Synthetic
tcaccgtggagacccaagccttgggcgcgcgttggcctggatggcctggtgcatgcatgcctgcaggacattgtg

SEQ ID NO: 160084 - DNA, 75 bp, Artificial Sequence
  Synthetic
tggttggattcatcaacagggcggctggtctacattaattgaagacaacattcctggatccagaaggtttagctg

SEQ ID NO: 160085 - DNA, 75 bp, Artificial Sequence
  Synthetic
cccaggaccgtaggaaggcgcggtggctattgcctggtgggaaaaggggggcagcggggccgcgtagggtagcgg

SEQ ID NO: 160086 - DNA, 75 bp, Artificial Sequence
  Synthetic
tggtctacattaattgaagacaacattcctggatccagaaggtttagctggactttgtttcttgctggactgact

SEQ ID NO: 160087 - DNA, 75 bp, Artificial Sequence
  Synthetic
tagccgccggccggggagaccgctccggccccaggaccgtaggaaggcgcggtggctattgcctggtgggaaaag

SEQ ID NO: 160088 - DNA, 75 bp, Artificial Sequence
  Synthetic
agttgatgatattgaattccacacctgcttgtgtttgtgattttatttcatattccatgagagagacctcgcata

SEQ ID NO: 160089 - DNA, 75 bp, Artificial Sequence
  Synthetic
gggacccctggacatctggacaacgtttgggggcgcccgggggtcgggctgggccgccaggggggcaaaaggggc

SEQ ID NO: 160090 - DNA, 75 bp, Artificial Sequence
  Synthetic
gcggggtttgcctcggcggtttgttgtccaggttggtctgaagcagtgtcataaaggtgttgcgggggacgctga

SEQ ID NO: 160091 - DNA, 75 bp, Artificial Sequence
  Synthetic
gtcctggcccgcggcggccgaacctccgcaggctgttgctccttctcctgcgttacctgatagcatggtggctgg

SEQ ID NO: 160092 - DNA, 75 bp, Artificial Sequence
  Synthetic
cttacatgggagtctatggggagccaggcccaagggtcacataaagtcccccctggacgggactggggtggacac

SEQ ID NO: 160093 - DNA, 75 bp, Artificial Sequence
  Synthetic
ccctggacgggactggggtggacacaggggggcggggatggcccgggtggacagagggcctgtccaacgtgggga

SEQ ID NO: 160094 - DNA, 75 bp, Artificial Sequence
  Synthetic
tacatcacctcccaggaagtccaaaactccatcttgagctccaactactttgattttgacaacctccacgttcac

SEQ ID NO: 160095 - DNA, 75 bp, Artificial Sequence
  Synthetic
ccacgcggtttctcagaaatccagcatcgattgccttagctatgagcttcgtgaggggcagagggtggtcttccg

SEQ ID NO: 160096 - DNA, 75 bp, Artificial Sequence
  Synthetic
gtgtcctaggtgggatatacgcctgtggtgttctaacgggaagtgtgtaagcacacacgtaatttgcaagcggtg

SEQ ID NO: 160097 - DNA, 75 bp, Artificial Sequence
  Synthetic
actttacagacagtgcacaggagcctgggcctcaggctggggggagaaaagctggcgcccttgcctggaggcaga

SEQ ID NO: 160098 - DNA, 75 bp, Artificial Sequence
  Synthetic
caaggacaagatactaaagaaataactgaggtgagtgtgggaagatgggaatactatgtgttatgttaacgggtg

SEQ ID NO: 160099 - DNA, 75 bp, Artificial Sequence
  Synthetic
gccggcctgatggacccggtggggaggcaagctgagggggctcgggtgggaggcgggaaggagaggccaggggag

SEQ ID NO: 160100 - DNA, 75 bp, Artificial Sequence
  Synthetic
agtgcttcaggacccacgcaaggtctgtaccgtagactgccgtggtgccgcgccggcgacccagggcacagatag

SEQ ID NO: 160101 - DNA, 75 bp, Artificial Sequence
  Synthetic
aggcgggaaggagaggccaggggagagggaaggcgactcgcccgggctgccggggtccctccggctggcctggtg

SEQ ID NO: 160102 - DNA, 75 bp, Artificial Sequence
  Synthetic
gcctccatctgcggtggtttggggtatgtctgggtggagggaggccagtgacagtgaggggagccaggcgtgcag

SEQ ID NO: 160103 - DNA, 75 bp, Artificial Sequence
  Synthetic
cggggtccctccggctggcctggtggacccggggaggccagaagctggggtctagggtggagaggagcaggggga

SEQ ID NO: 160104 - DNA, 75 bp, Artificial Sequence
  Synthetic
ccaactagtccacgctgtctatgattccatgttggtaagaggcacctagaacatttccagatgtttcacttggat

SEQ ID NO: 160105 - DNA, 75 bp, Artificial Sequence
  Synthetic
atagacacatggtcaaagaaggacagcttgcctccatctgcggtggtttggggtatgtctgggtggagggaggcc

SEQ ID NO: 160106 - DNA, 75 bp, Artificial Sequence
  Synthetic
tggcacacctaggccgcctgttccgaaaccaagaccagaggtcccacaaagcgacgagacagctaccagtcacgg

SEQ ID NO: 160107 - DNA, 75 bp, Artificial Sequence
  Synthetic
tatcgcaatcgtggtaaattgagtccagcagggacaggaagtccccagaggtaatcgaggctgcgctaaagagac

SEQ ID NO: 160108 - DNA, 75 bp, Artificial Sequence
  Synthetic
cgcaagacttccacaagcacctgttctgcgaccccctgtgtgccatcaaccacagcatcacgaatccgagcgtgc

SEQ ID NO: 160109 - DNA, 75 bp, Artificial Sequence
  Synthetic
atatggatgtgcatgaccgtgcgtcacagatgtcaggccatcagaaaaaaaccattaccaattgttaagcagagg

SEQ ID NO: 160110 - DNA, 75 bp, Artificial Sequence
  Synthetic
tagggtcccttctgggggacatcctgggctctgaagcccggggaaggggcgaggaaccggcctctggagccgccc

SEQ ID NO: 160111 - DNA, 75 bp, Artificial Sequence
  Synthetic
cggtggaagctcctgtcatcttgcagatcctggcgtatgggttaccgcacgcataacctcaaagtaaacagtttt

SEQ ID NO: 160112 - DNA, 75 bp, Artificial Sequence
  Synthetic
gcataacctcaaagtaaacagttttgagtcagggggggacaatgtccacccggtccttgtgactgctacgctagg

SEQ ID NO: 160113 - DNA, 75 bp, Artificial Sequence
  Synthetic
ccctccccgtcccccttcgctcctgatcctcccccggtccccagtagggccgcctgcccccctgcacccagtacc

SEQ ID NO: 160114 - DNA, 75 bp, Artificial Sequence
  Synthetic
cggtccttgtgactgctacgctaggatgtgatgagggcacgcggcatgcaacaacgtacagtgctggcattgtac

SEQ ID NO: 160115 - DNA, 75 bp, Artificial Sequence
  Synthetic
tgactcgtcgtcggcaaagagaccagagggcacccatggcgcggtgtcaaaagtattgtctgcgtacgctttcca

SEQ ID NO: 160116 - DNA, 75 bp, Artificial Sequence
  Synthetic
agcagcctccaagttttacaagacgtcccattgccctgcccttggtccaagtctcgcctgttttcagcagcctgt

SEQ ID NO: 160117 - DNA, 75 bp, Artificial Sequence
  Synthetic
ctcagacattctttgggtttaacggggctaagaggggagcggagaccaggagggcgcctggaggcgggcccgagg

SEQ ID NO: 160118 - DNA, 75 bp, Artificial Sequence
  Synthetic
ctaggtggataccacagtccaggcccccaaggctaccgtgctaattacctcctcatgtccacccccaccctgtgt

SEQ ID NO: 160119 - DNA, 75 bp, Artificial Sequence
  Synthetic
acaacgtacagtgctggcattgtacagataccacgaatatcagaccaaaaccaaaagatcgaaacagccttcctg

SEQ ID NO: 160120 - DNA, 75 bp, Artificial Sequence
  Synthetic
ggcgctccacgaagccgcagacgtatacagacggtgcctgcaccattgtgcccgctatgttaatgggactggggg

SEQ ID NO: 160121 - DNA, 75 bp, Artificial Sequence
  Synthetic
tgatttagtatcctccggaaacaccctgtatgctatatggattgggctgggcacgaaaaaccgagtttcatttat

SEQ ID NO: 160122 - DNA, 75 bp, Artificial Sequence
  Synthetic
gttcctctgaaggacagagagaggggcagaaccaaccccggcggctggccccgaggaggcgcccggcgcggggcc

SEQ ID NO: 160123 - DNA, 75 bp, Artificial Sequence
  Synthetic
acggcctcaaaggcctcggcgcatagcgtgaagtcggtgtccaggtgtggaaaatctcgctcagagctgggaaga

SEQ ID NO: 160124 - DNA, 75 bp, Artificial Sequence
  Synthetic
tgagtttgtaggatggttatgcaagaaggaccacactcatatacgcgaatggttccgccagtgcaccgggagacc

SEQ ID NO: 160125 - DNA, 75 bp, Artificial Sequence
  Synthetic
cctgaagatgctaaagaactggccgctttgcgctctgcgcgaggacgagctcaggtttttgcacctatccctgac

SEQ ID NO: 160126 - DNA, 75 bp, Artificial Sequence
  Synthetic
cctgctgcccctggagatgccggaccctgcctggagaccctggggtctgtctggggggctgagggcggccgtccg

SEQ ID NO: 160127 - DNA, 75 bp, Artificial Sequence
  Synthetic
caagctgctgaccctaagtgttaacttttacctgtggcgggaagccgtgataaatactggaaaccgcacgaatcg

SEQ ID NO: 160128 - DNA, 75 bp, Artificial Sequence
  Synthetic
ggcacgggtgggcttcccggcagaggccctgcgccccggtaaccgctcacggtctctttgtctgtttttgcatga

SEQ ID NO: 160129 - DNA, 75 bp, Artificial Sequence
  Synthetic
acatggtgtagacagatcccatttttcactacgggacttcttcaggggaatctctgccaactttgagctgggcag

SEQ ID NO: 160130 - DNA, 75 bp, Artificial Sequence
  Synthetic
tgatctggcctatgcccgtgggcaggccatgaatattgaggctcctagactgccagatgatcctataattgttga

SEQ ID NO: 160131 - DNA, 75 bp, Artificial Sequence
  Synthetic
aaggaccacactcatatacgcgaatggttccgccagtgcaccgggagacccaaagcagccaagccatggttaaga

SEQ ID NO: 160132 - DNA, 75 bp, Artificial Sequence
  Synthetic
tgtgcatgtgtgtgggcgcagcttggactgcgcagggcgccggacctgagccaggtcaccctggctgacggaaat

SEQ ID NO: 160133 - DNA, 75 bp, Artificial Sequence
  Synthetic
ctaggccgaccctctgcctcccagacgtaccccagggccacccggcggagccaggcccctcctgagacagcaggc

SEQ ID NO: 160134 - DNA, 75 bp, Artificial Sequence
  Synthetic
ggatgacgacgaaagtgaggaaattgaagctgaaagcgacgaggaggaagacaagagtggaatggaatctcttaa

SEQ ID NO: 160135 - DNA, 75 bp, Artificial Sequence
  Synthetic
ccaggtcaccctggctgacggaaatctgctcttcaaccttggcagtgtcctccctaaccgcctggtggtgggtgt

SEQ ID NO: 160136 - DNA, 75 bp, Artificial Sequence
  Synthetic
cctgcctggagaccctggggtctgtctggggggctgagggcggccgtccgggcccggagggtctcagaggatcgc

SEQ ID NO: 160137 - DNA, 75 bp, Artificial Sequence
  Synthetic
cctctactgccttgttcactggggggcagatgagcatgaaacccgggttcgggcccgccttcgccccctctttgt

SEQ ID NO: 160138 - DNA, 75 bp, Artificial Sequence
  Synthetic
tcagcttccaagcttcccggttggtgcccgtggggcctgggtttcgcctgctcgtgttcaacaccaatcgggtga

SEQ ID NO: 160139 - DNA, 75 bp, Artificial Sequence
  Synthetic
ctctgccccccggagggaccgggtgctgggacctcgggtgcccgccggctccaacctcgggcccctggactggtc

SEQ ID NO: 160140 - DNA, 75 bp, Artificial Sequence
  Synthetic
ggccttcctctgcctggccggctatctgcttctggaccgtgccatcctctcggatgcgcacgactacgagggcct

SEQ ID NO: 160141 - DNA, 75 bp, Artificial Sequence
  Synthetic
aggccattgaagaggaacacagaaagaagaaggcagccagaacagagcagccaagagccacgcctgaatcccagg

SEQ ID NO: 160142 - DNA, 75 bp, Artificial Sequence
  Synthetic
cggtgtttgaccgaaagtcagatgcaaaatcaaccaaaaaatgcagggccatattaactgactttagtgtaatca

SEQ ID NO: 160143 - DNA, 75 bp, Artificial Sequence
  Synthetic
ctggcacgccgtggccctgagcatggcggcctggcacggccttactcccctacccgaaacaagagacgagaagga

SEQ ID NO: 160144 - DNA, 75 bp, Artificial Sequence
  Synthetic
ccccactccgggcgcctcctcggggccagctgccggggggccctgcctgtctctgccccccggagggaccgggtg

SEQ ID NO: 160145 - DNA, 75 bp, Artificial Sequence
  Synthetic
tcagggatggggcttggccgggtctaaggtggcctggcccggggtgcgtggccaagaggggcaggtactgggtgc

SEQ ID NO: 160146 - DNA, 75 bp, Artificial Sequence
  Synthetic
tacccgaaacaagagacgagaaggaggcaaaacccccgtgcgatgactttatttacctctttgccaatgacccac

SEQ ID NO: 160147 - DNA, 75 bp, Artificial Sequence
  Synthetic
ctgggacctcgggtgcccgccggctccaacctcgggcccctggactggtctctcaatctgggcccaatggccgcg

SEQ ID NO: 160148 - DNA, 75 bp, Artificial Sequence
  Synthetic
gttcgggcccgccttcgccccctctttgtggccttcctctgcctggccggctatctgcttctggaccgtgccatc

SEQ ID NO: 160149 - DNA, 75 bp, Artificial Sequence
  Synthetic
tctcacgcagaaaatctttgcccagctcaaagttggcagagattcccctgaagaagtcccgtagtgaaaaatggg

SEQ ID NO: 160150 - DNA, 75 bp, Artificial Sequence
  Synthetic
accgggggaggatcaggagcgaagggggacggggagggggggaggctggggtggcaggaggggagcagcagggtt

SEQ ID NO: 160151 - DNA, 75 bp, Artificial Sequence
  Synthetic
gtggcaggaggggagcagcagggttgctgaggccggggtccagggggacccgagggccttagaggcccaggcgtc

SEQ ID NO: 160152 - DNA, 75 bp, Artificial Sequence
  Synthetic
cccagcgtcaggaagtacaaccggtcgtagtcatccgaggcggagaattgacgctccaggatctcccgcgccgca

SEQ ID NO: 160153 - DNA, 75 bp, Artificial Sequence
  Synthetic
agcgtgggaagtagccctggtgacacctggtgcctacgtgatgtgctaggcacttatttacagcacaccagcagc

SEQ ID NO: 160154 - DNA, 75 bp, Artificial Sequence
  Synthetic
ctgtggccgaagggagacaggcgaaggcagcgcccgggggagagagtgcacagtgacagtgggagaaacacggcc

SEQ ID NO: 160155 - DNA, 75 bp, Artificial Sequence
  Synthetic
ctaaaagggtaacaggagaggcagggcctgaagcccgggtctctggaggacggggacggagggggcctgaagccc

SEQ ID NO: 160156 - DNA, 75 bp, Artificial Sequence
  Synthetic
gtctacaccggtgacctaggcatagagagtgatgagctcgcttcgacagagccggttcatgatcagctactgcct

SEQ ID NO: 160157 - DNA, 75 bp, Artificial Sequence
  Synthetic
tggggccacaggggaggccaggtagcccagcgtcaggaagtacaaccggtcgtagtcatccgaggcggagaattg

SEQ ID NO: 160158 - DNA, 75 bp, Artificial Sequence
  Synthetic
agggcaacaccgacgccgtcctcgaaggctagacgcagctgtgtgcgcgccgccagcatggcagccgggtcgtga

SEQ ID NO: 160159 - DNA, 75 bp, Artificial Sequence
  Synthetic
ggggactagggaactgaggagggcatgaagccctggctgatgcaacttgaggcagcctaatcccacccagactag

SEQ ID NO: 160160 - DNA, 75 bp, Artificial Sequence
  Synthetic
ggtgcgctggacacttatttacagcacaacactaacactaggttccaccaaaggttaacgatgccttgttcttag

SEQ ID NO: 160161 - DNA, 75 bp, Artificial Sequence
  Synthetic
ttgtaggtatgcggcagccggatgcaccgcccggcgtgatacacgccgctgtcaaaaagcggggccccaatctct

SEQ ID NO: 160162 - DNA, 75 bp, Artificial Sequence
  Synthetic
tggttcagccaagtcagactccagatgacccaatgaaacagtcccggccaccggaaacagctgccccacgccagt

SEQ ID NO: 160163 - DNA, 75 bp, Artificial Sequence
  Synthetic
agattacataacacaagactccatgagcttgaagcaggccctcagtggtcattggatgtctgccacgggcaaccc

SEQ ID NO: 160164 - DNA, 75 bp, Artificial Sequence
  Synthetic
ggatgcgcaggaccacgtccagttccttagtgacatccacgaggattgttttgcccactctggccacttgtgtgg

SEQ ID NO: 160165 - DNA, 75 bp, Artificial Sequence
  Synthetic
ctaggataggggtaccctaggcacagcactcccactagttcccactaaagattaacaaagcacctaggtggaggc

SEQ ID NO: 160166 - DNA, 75 bp, Artificial Sequence
  Synthetic
ccatacgccaggatctgcaagatgacaggagcttccaacgcctctgcttaacaattggtaatggtttttttctga

SEQ ID NO: 160167 - DNA, 75 bp, Artificial Sequence
  Synthetic
acttacccctgaaggtgaaccgcttaccacctcctcttcttgctggacgaggacccttctacggactcgtctggg

SEQ ID NO: 160168 - DNA, 75 bp, Artificial Sequence
  Synthetic
cgtgtaggaggtcatctcctccatgggatcctcgagctcatccacgtcggccatctggaccaaagaagtcgtctg

SEQ ID NO: 160169 - DNA, 75 bp, Artificial Sequence
  Synthetic
agattctgaccggctgcaagcgctgccttaaaggcctggaagctgggtgggtaaatctgaccaaacagcacgctc

SEQ ID NO: 160170 - DNA, 75 bp, Artificial Sequence
  Synthetic
ggtgtgtgtagtgtgtgcctgggtgtggtggagtgttgggcttagcagaaaaaattaaagtccacttacctctgg

SEQ ID NO: 160171 - DNA, 75 bp, Artificial Sequence
  Synthetic
cccatagcagaggaggtgctgcagaagattctcctgtttaacgtgtactcccgggttgtcatgcaggctcccggg

SEQ ID NO: 160172 - DNA, 75 bp, Artificial Sequence
  Synthetic
actgcggaggaaggcgtagagcccgcccccggccatactccaagagttgacaagccaggactcgaatcccccagc

SEQ ID NO: 160173 - DNA, 75 bp, Artificial Sequence
  Synthetic
cccgataccggggggcccgggccgggctggtccagggacttcacttcggtctcccctaggcttggatggcggagt

SEQ ID NO: 160174 - DNA, 75 bp, Artificial Sequence
  Synthetic
accacctcctcttcttgctggacgaggacccttctacggactcgtctgggttcttggccccctctggtaggactg

SEQ ID NO: 160175 - DNA, 75 bp, Artificial Sequence
  Synthetic
attaacaaagcacctaggtggaggcccctactggttagaaagatgcacttgcatattccgggcctcagccatcgg

SEQ ID NO: 160176 - DNA, 75 bp, Artificial Sequence
  Synthetic
ggcatggcacatccagcagcgtgttttgggtcttgatgaggaacacgatcctgtctaggattttgatgttgttgc

SEQ ID NO: 160177 - DNA, 75 bp, Artificial Sequence
  Synthetic
ttgggtcttgatgaggaacacgatcctgtctaggattttgatgttgttgccgaacgagtcaagaatcaggctctt

SEQ ID NO: 160178 - DNA, 75 bp, Artificial Sequence
  Synthetic
cccgccaccatgcagacaccaccgagagcgcccactcccatgtcaccacctgaggtgccgcccgttccccggcag

SEQ ID NO: 160179 - DNA, 75 bp, Artificial Sequence
  Synthetic
agagtgggcagatggtccgtgaggcattcttgtgccttagtccaaacatgggggccaggaggcaggggccctgcg

SEQ ID NO: 160180 - DNA, 75 bp, Artificial Sequence
  Synthetic
aattgttaacggggggcgttaagaaagggagaccatcacttaagttacaggccgcccttgagcgtcaagccgctg

SEQ ID NO: 160181 - DNA, 75 bp, Artificial Sequence
  Synthetic
ggttgtaaatcttattgtccgcgaatgtgccgggtggatatgccgcctgtcggttgagaggggctattgactggc

SEQ ID NO: 160182 - DNA, 75 bp, Artificial Sequence
  Synthetic
agcgactgcagatccaggcgaagggccgtctgcgcccccacggggccacacgccgaggggtcagggatgtgccca

SEQ ID NO: 160183 - DNA, 75 bp, Artificial Sequence
  Synthetic
ggaccactttataccaggggcagtggtccccctccctagaactgacaattggctgctgtctggcttacgtaaacg

SEQ ID NO: 160184 - DNA, 75 bp, Artificial Sequence
  Synthetic
gactccctgctcctgccagtttcccttcgaggtctccatgttgctgaggagcttcttaggcctgctgccactcgt

SEQ ID NO: 160185 - DNA, 75 bp, Artificial Sequence
  Synthetic
aaccgatagcatggtggcctggccccccgagcaggtccgtcccctgccacgtacctaatagtagtccacagtagt

SEQ ID NO: 160186 - DNA, 75 bp, Artificial Sequence
  Synthetic
actcccctgtctgggggcttattcctcttttcccctctaaagatagcagcagcgcagccaaccatagacccgctt

SEQ ID NO: 160187 - DNA, 75 bp, Artificial Sequence
  Synthetic
gtccttggctatagaaaatggttccctctggcaatagaggcgatagagctgccggcccttagaagactttagccg

SEQ ID NO: 160188 - DNA, 75 bp, Artificial Sequence
  Synthetic
gcctcaacggtgacacaggaacccacggaatataccagggaaaggaggggagtggggcctatgcctcccaccgat

SEQ ID NO: 160189 - DNA, 75 bp, Artificial Sequence
  Synthetic
gtccccctccctagaactgacaattggctgctgtctggcttacgtaaacgcgctggactgagaaggtggcctagc

SEQ ID NO: 160190 - DNA, 75 bp, Artificial Sequence
  Synthetic
tcctaagcacaccccaccacgtatttaggcctgagaagcagggagttttaaaactgacagtttaggaatgactca

SEQ ID NO: 160191 - DNA, 75 bp, Artificial Sequence
  Synthetic
tcttttcccctctaaagatagcagcagcgcagccaaccatagacccgcttcctgggggttttaggcctaggtccg

SEQ ID NO: 160192 - DNA, 75 bp, Artificial Sequence
  Synthetic
gtacaggcccctgccgacgtcccctgggacatcctgggaatctttgcaggttctgggtccagggagggtaagaaa

SEQ ID NO: 160193 - DNA, 75 bp, Artificial Sequence
  Synthetic
aaactgacagtttaggaatgactcatttagtgcttctattgtgctgctgtgtggggtctgtttgtgcatttttct

SEQ ID NO: 160194 - DNA, 75 bp, Artificial Sequence
  Synthetic
tgatttttagagttttaaagtcctccagagctctaaagtgtcagatttcgggtccaaatcactaccagagattac

SEQ ID NO: 160195 - DNA, 75 bp, Artificial Sequence
  Synthetic
gccaggggcaacagcagactctggagtgcggaggaactgctaaacaggaaagggacgtgttggggctgggggaca

SEQ ID NO: 160196 - DNA, 75 bp, Artificial Sequence
  Synthetic
gacttgaagcagaagttggccggggactggccggtgaggatggatttcagaaactccaatttgtagtagccgagg

SEQ ID NO: 160197 - DNA, 75 bp, Artificial Sequence
  Synthetic
aggggctgtttgtgggccttgtggcaaaataaggccccggtcaccccgtgattgtcttacaatataattagccat

SEQ ID NO: 160198 - DNA, 75 bp, Artificial Sequence
  Synthetic
aaactccaatttgtagtagccgaggttggcatttctaatcatgtcagaagaggacacagggaggaagcaccggca

SEQ ID NO: 160199 - DNA, 75 bp, Artificial Sequence
  Synthetic
tgaaacatcgaacgatgagtgattttgcccatgtaacaagaactgggatgaaccctggggcaacagactgcgggg

SEQ ID NO: 160200 - DNA, 75 bp, Artificial Sequence
  Synthetic
atgagtcggtctctcggatcgagttgggccggggatacactcccggggatggacaactgcccttggccgtagcta

SEQ ID NO: 160201 - DNA, 75 bp, Artificial Sequence
  Synthetic
aatgtaaaagtgaagctggatgtcaatggcaagaatcctggagggcatgaagagggaatccaaccccccggccat

SEQ ID NO: 160202 - DNA, 75 bp, Artificial Sequence
  Synthetic
tgcccatgtaacaagaactgggatgaaccctggggcaacagactgcggggaggaggggggcagtgataagtcatg

SEQ ID NO: 160203 - DNA, 75 bp, Artificial Sequence
  Synthetic
acaattttagatgaggtagaaattttgcatattttcagacccaccatggaatcatttgaaggacagggggactct

SEQ ID NO: 160204 - DNA, 75 bp, Artificial Sequence
  Synthetic
taacgggggttacaattatagccttaccctagaatgggtaaatgactccaacacctccgtctctctgataatccc

SEQ ID NO: 160205 - DNA, 75 bp, Artificial Sequence
  Synthetic
tagagatccaggctcgtggggcatttagacagtagtagcagagcagggcatagtcctcaaagaaggccacggggg

SEQ ID NO: 160206 - DNA, 75 bp, Artificial Sequence
  Synthetic
gaaattgcagtgtggcctccggggtccactgcaattactctgcaggggaagaagacgaccaataccatgccaacc

SEQ ID NO: 160207 - DNA, 75 bp, Artificial Sequence
  Synthetic
ccactgcaattactctgcaggggaagaagacgaccaataccatgccaaccggacgctcactcagcgtatgcatct

SEQ ID NO: 160208 - DNA, 75 bp, Artificial Sequence
  Synthetic
catctgagtgattgaccagggtgtcgagcagatcacaaactcggcaggtgctggctggagagagggactcgtagg

SEQ ID NO: 160209 - DNA, 75 bp, Artificial Sequence
  Synthetic
gccaggtggtcacgcatgatgccgtccagctccacgcggagcagcctatttttgagcacctgggcacacctgtcc

SEQ ID NO: 160210 - DNA, 75 bp, Artificial Sequence
  Synthetic
aagagatcagcaaccttgggggcaaagcaggggtgatgaaaacagaggctggatgcagcgcatcaggcgaaggcg

SEQ ID NO: 160211 - DNA, 75 bp, Artificial Sequence
  Synthetic
gactgtatagagtccccctgtccttcaaatgattccatggtgggtctgaaaatatgcaaaatttctacctcatct

SEQ ID NO: 160212 - DNA, 75 bp, Artificial Sequence
  Synthetic
tccatctttggagttctgcccgcgatctgtgccacctctgttacgccactcctcgtgagggggcagctggacagt

SEQ ID NO: 160213 - DNA, 75 bp, Artificial Sequence
  Synthetic
taagaccacctgggtgcactgggccctgctcctaatcacttgtgctgtggtggctccggtgctcctcatcattat

SEQ ID NO: 160214 - DNA, 75 bp, Artificial Sequence
  Synthetic
ctggaacgctttccgtgcacattctaacagccgtggtcttttgctactggttcttcaacgcctggctgcgcaccc

SEQ ID NO: 160215 - DNA, 75 bp, Artificial Sequence
  Synthetic
ctttttccggtcagggggtttggctcgtttgcgctcgtgactttgtgagccatgacacatctgggtggcaaggtg

SEQ ID NO: 160216 - DNA, 75 bp, Artificial Sequence
  Synthetic
cgtgtgacccatgtttccattaattttagcaatcgcacctgcaagcgctatcaaacctgatactcgatagtgggt

SEQ ID NO: 160217 - DNA, 75 bp, Artificial Sequence
  Synthetic
aggtggggagggtcttttggcccagggctggaaactctacctggagcgttctcagggatcgctggtttttaaata

SEQ ID NO: 160218 - DNA, 75 bp, Artificial Sequence
  Synthetic
aggtcttctgggtttttaataccggggtcggcaccagtttctgggacaccgccacaaggacaaggtgggctagca

SEQ ID NO: 160219 - DNA, 75 bp, Artificial Sequence
  Synthetic
aagccacgcgtttattcagcaattcctcgcaaaagatggacttgaggtgggctgacacagacttggccttggggg

SEQ ID NO: 160220 - DNA, 75 bp, Artificial Sequence
  Synthetic
ctcgcaaaagatggacttgaggtgggctgacacagacttggccttgggggtggtgggctccttagactgagccac

SEQ ID NO: 160221 - DNA, 75 bp, Artificial Sequence
  Synthetic
catctcctgtctggggtggctggcgggctgggggaggcggcgcaagggctggatacccctgtgaatggacagtta

SEQ ID NO: 160222 - DNA, 75 bp, Artificial Sequence
  Synthetic
cgtttgcgctcgtgactttgtgagccatgacacatctgggtggcaaggtgaggtcttctgggtttttaataccgg

SEQ ID NO: 160223 - DNA, 75 bp, Artificial Sequence
  Synthetic
aaccgcctctaccctccccatgggatggcggcggttatgttttccccatgttgcgggtgccggcccttacaccag

SEQ ID NO: 160224 - DNA, 75 bp, Artificial Sequence
  Synthetic
ctaattgcgccatctgcctacgcgaggctgaacctcctgaatcactgcatctttcttgaggcgtttaaagaagag

SEQ ID NO: 160225 - DNA, 75 bp, Artificial Sequence
  Synthetic
gccacaaggacaaggtgggctagcaagttctcgagtctacgaagactccgggggcagtcttttgagtttctcgcc

SEQ ID NO: 160226 - DNA, 75 bp, Artificial Sequence
  Synthetic
aatagtggccagggcctcggtggggtccagcgtgaggtcttatttttgaaaagggatattataaaacaggtcatt

SEQ ID NO: 160227 - DNA, 75 bp, Artificial Sequence
  Synthetic
gatgccaaaatgcggcacgaactctaaacaccttctctgccaccgtgtggacaccaccccatgctggaccaagag

SEQ ID NO: 160228 - DNA, 75 bp, Artificial Sequence
  Synthetic
agcaagaaagatacgctcgggaagccgaggtgcgcttccttcgtggtaaatggcagaggcggtaccgaagaatct

SEQ ID NO: 160229 - DNA, 75 bp, Artificial Sequence
  Synthetic
ggctgaaatccgtaaggccccgagtgggtgtagcaggggccctgctgggggcagtatccgactccggtgtggccg

SEQ ID NO: 160230 - DNA, 75 bp, Artificial Sequence
  Synthetic
gctcaataacttaattgtgtcatttctgtgtgactctgggtctctggaagtggagagatgctccggggcgcatgt

SEQ ID NO: 160231 - DNA, 75 bp, Artificial Sequence
  Synthetic
gtcgtgcgtggagagggcacacagacctcgggtgggatccatggctggatttccaggaaaggaggccggcccgcc

SEQ ID NO: 160232 - DNA, 75 bp, Artificial Sequence
  Synthetic
taggacagcgtctcccggcgcagggcctgtagcgtgtgctgtaactcattcacactcttggagaggcccgctatg

SEQ ID NO: 160233 - DNA, 75 bp, Artificial Sequence
  Synthetic
ctctgcaccgtgaagctgcgccacggacagatttaccacctggagtttgtctacaagttcctggcctttaagctg

SEQ ID NO: 160234 - DNA, 75 bp, Artificial Sequence
  Synthetic
cggcggctggcgaaaatgtcaggaggatgagtcccctgaaaacgaaagacacgaaaacttttacgctgagattga

SEQ ID NO: 160235 - DNA, 75 bp, Artificial Sequence
  Synthetic
taagagactacattggaaggtggctggtgattggaggtttgcctagaacttatagaggaggggctggagataaaa

SEQ ID NO: 160236 - DNA, 75 bp, Artificial Sequence
  Synthetic
cccccgggaatagtcccccgccttcttcatcctcctcggggtctcttttccgcttgttggatcgcgagggagcgg

SEQ ID NO: 160237 - DNA, 75 bp, Artificial Sequence
  Synthetic
gatgagtcccctgaaaacgaaagacacgaaaacttttacgctgagattgatgactttgccccctcagttcttacc

SEQ ID NO: 160238 - DNA, 75 bp, Artificial Sequence
  Synthetic
tatcacgcgcggagaggcataaaagaacacgtaatccagaacgcatttcgaaaggcacaaatacagggtttatca

SEQ ID NO: 160239 - DNA, 75 bp, Artificial Sequence
  Synthetic
ccaggtgcccacccactggccccccttgatggctccgaccggactgtctggggagagggtgccgtgccggaccca

SEQ ID NO: 160240 - DNA, 75 bp, Artificial Sequence
  Synthetic
cgggccagagcggcccttgcctgggtctctcaacggatgttgacctaccaaagaactccatcattatgctgggcc

SEQ ID NO: 160241 - DNA, 75 bp, Artificial Sequence
  Synthetic
atctgagctaggagattctgttgtctcaaaaatgtaatcccaactttcgtctaagtctgcggggtctatagatgg

SEQ ID NO: 160242 - DNA, 75 bp, Artificial Sequence
  Synthetic
ggggggccaaagaggcccggcaagccaaagtaggccggaggggggtgtgggtgggggtggtaggtgtgagcgtcc

SEQ ID NO: 160243 - DNA, 75 bp, Artificial Sequence
  Synthetic
gcacacggctcacaaacatgacgggcctctgctgaaccggctccatattgggatcgatatatggcagctcatcgt

SEQ ID NO: 160244 - DNA, 75 bp, Artificial Sequence
  Synthetic
cgtgcccctttaccctacccaggggagcccagccaccggcacccgcacaccaaaagcctactgcccctaccccga

SEQ ID NO: 160245 - DNA, 75 bp, Artificial Sequence
  Synthetic
aggatgacttcattaagttcaaaagccccctggtcttccctgctgagcttgatctcctgaaatctatggtggtct

SEQ ID NO: 160246 - DNA, 75 bp, Artificial Sequence
  Synthetic
caaagtaggccggaggggggtgtgggtgggggtggtaggtgtgagcgtccatcgccaagaaggcacccgggtccc

SEQ ID NO: 160247 - DNA, 75 bp, Artificial Sequence
  Synthetic
gacgacgatgcagtttctggtgtttcaggccgccaacgcccagaaggcctcgcgggtcatggatatgattagtga

SEQ ID NO: 160248 - DNA, 75 bp, Artificial Sequence
  Synthetic
ctggtaaacggaccctggcggctgacagaccttgcgtcactttaggtgaacagcggcccaccggtttccagcgat

SEQ ID NO: 160249 - DNA, 75 bp, Artificial Sequence
  Synthetic
ttaccggggcgcagggcctctgccgggaagcccacccgggccagggcccggtaaagcaggtaccagtattcatcc

SEQ ID NO: 160250 - DNA, 75 bp, Artificial Sequence
  Synthetic
tatgtctcagcaactgtctcggtctggtcaagtcgaggatacgggcgccagagtcacaggtggaggaggtcccag

SEQ ID NO: 160251 - DNA, 75 bp, Artificial Sequence
  Synthetic
acgtcgatgggcagctatattcaccttgaggtgccacagagcatcagaggaggctttgtttaaacgagcccaaat

SEQ ID NO: 160252 - DNA, 75 bp, Artificial Sequence
  Synthetic
agcacaaagcacccctgaaaggccgggcccttccgaacaatcatcagtgaccgtggagcccgcccacccgacccc

SEQ ID NO: 160253 - DNA, 75 bp, Artificial Sequence
  Synthetic
gagcttcatgtaccagaaaggctttgaggagggcctggctggccttgggctcgatgacaaatctgactgtgagtc

SEQ ID NO: 160254 - DNA, 75 bp, Artificial Sequence
  Synthetic
gagtcacaggtggaggaggtcccaggcctggcgtcacgcactcggggtgtcttggggactcacacgttagggggc

SEQ ID NO: 160255 - DNA, 75 bp, Artificial Sequence
  Synthetic
ccagtgaagcgcacaaatgttaagacctctgatagatctgataaggcagaagcacaaagcacccctgaaaggccg

SEQ ID NO: 160256 - DNA, 75 bp, Artificial Sequence
  Synthetic
aggctttgtttaaacgagcccaaattctcccgtacccaccaccccctccccaacggggctggcagtccttgtgtc

SEQ ID NO: 160257 - DNA, 75 bp, Artificial Sequence
  Synthetic
actctcagtaattccctcgaatccctaccaggaacaactgtcagacactccattaattccactaacaatctttgt

SEQ ID NO: 160258 - DNA, 75 bp, Artificial Sequence
  Synthetic
gccttcccgtaggagaaggggagcgtgtgttgtgtacgacgatgatgtcatagaggtgattgatgttgaaaccac

SEQ ID NO: 160259 - DNA, 75 bp, Artificial Sequence
  Synthetic
ccttaggtatggagcgaaggttagtggtcactctgcagtgcctggtgctgctttacctggcacctgagtgtggag

SEQ ID NO: 160260 - DNA, 75 bp, Artificial Sequence
  Synthetic
tagaggtgattgatgttgaaaccaccgaagattcatcgtcagtgtcacagccaaataagccacatcggaaacatc

SEQ ID NO: 160261 - DNA, 75 bp, Artificial Sequence
  Synthetic
gcgggagccacagtcgagctcgtaggccgcgttgtgcggcagcactgcccggattcggggccgccagcccgagcg

SEQ ID NO: 160262 - DNA, 75 bp, Artificial Sequence
  Synthetic
gcgacatatagcccgggcgagacatagtggatagcggtgctatggacctgtattcacagcacgtcacttccacta

SEQ ID NO: 160263 - DNA, 75 bp, Artificial Sequence
  Synthetic
atccccccaccggcccttctctctgtccccctgctcctctccaaccttcgctccaccctagaccccagcttctgg

SEQ ID NO: 160264 - DNA, 75 bp, Artificial Sequence
  Synthetic
tattcacagcacgtcacttccactaagaccccccacgggtttgttaaccccttctccggtgaggagatgccgagg

SEQ ID NO: 160265 - DNA, 75 bp, Artificial Sequence
  Synthetic
cgaagattcatcgtcagtgtcacagccaaataagccacatcggaaacatcaagacggctttcaacgttcaggccg

SEQ ID NO: 160266 - DNA, 75 bp, Artificial Sequence
  Synthetic
cttctccggtgaggagatgccgaggcaagtagccctggtgacacctggtgcctacgtgatgtgctaggcacttat

SEQ ID NO: 160267 - DNA, 75 bp, Artificial Sequence
  Synthetic
gcgcgccacaccttatctggcacgggtgctggctgtcacggccgtggccctgctcctgatgtttctgaggtggac

SEQ ID NO: 160268 - DNA, 75 bp, Artificial Sequence
  Synthetic
gccgcgttgtgcggcagcactgcccggattcggggccgccagcccgagcgggcgctcggtggctcagccagcctc

SEQ ID NO: 160269 - DNA, 75 bp, Artificial Sequence
  Synthetic
gggggttctccaggctcctggatctggggctggcctgcctggatctgagctatgtggaaatgagggaatttgtgg

SEQ ID NO: 160270 - DNA, 75 bp, Artificial Sequence
  Synthetic
ctcgtataatggcgcctcccgtcgtacgtatgtttatgagggagcgacagctcccccagtccaccggccgtaaac

SEQ ID NO: 160271 - DNA, 75 bp, Artificial Sequence
  Synthetic
gggctgctatagtgagccaggctttctatgcctgaaacccaagtttccttgccatctaaagctgcaactttcagt

SEQ ID NO: 160272 - DNA, 75 bp, Artificial Sequence
  Synthetic
gccatctaaagctgcaactttcagtttagatctgtggttacatggtgcatttgcaggtgtgaaatgcttggcctt

SEQ ID NO: 160273 - DNA, 75 bp, Artificial Sequence
  Synthetic
tttggggcaggcccccagcttctgaggcggctgtggcctctacgccaggctcgcttttccgaagccactcgtccg

SEQ ID NO: 160274 - DNA, 75 bp, Artificial Sequence
  Synthetic
agattggcgctgggtggttactgggggtggctcaaatctgtctctaatgcgtagcagccactctctaagagacta

SEQ ID NO: 160275 - DNA, 75 bp, Artificial Sequence
  Synthetic
gagttactctaaggctagtccgatccccgggttttcacaaaagcctatggattggaccaaccttaaagtaccaac

SEQ ID NO: 160276 - DNA, 75 bp, Artificial Sequence
  Synthetic
gttcagcagacacgagagaacattgcggcttacgatcgccacgaaaacatcccggctcaggcagggcccccccgg

SEQ ID NO: 160277 - DNA, 75 bp, Artificial Sequence
  Synthetic
cccgggggccggcggctcctggtatccctggtatggagcccggggggccggcggctcctggtatccctggtatgg

SEQ ID NO: 160278 - DNA, 75 bp, Artificial Sequence
  Synthetic
tgaccctcgcgccccatcttggcccgtccctcttgtccctttcagtggtcaccggtggtgggtgtggagccgtgg

SEQ ID NO: 160279 - DNA, 75 bp, Artificial Sequence
  Synthetic
cttgagttccatgtcgcccacacagccgatatcgcacgaagaacaaccccggtatgaggatcctgacgctcctct

SEQ ID NO: 160280 - DNA, 75 bp, Artificial Sequence
  Synthetic
ttgcggccccgactatcgaccctgcatttgcgatgtacttttctatgacggggatggtgagggccgcggtgtcgg

SEQ ID NO: 160281 - DNA, 75 bp, Artificial Sequence
  Synthetic
ctcccatgtaagcctgcctcgagtaggtgcctccagagccccttttgcccccctggcggcccagcccgacccccg

SEQ ID NO: 160282 - DNA, 75 bp, Artificial Sequence
  Synthetic
gcaggagaggcggggggtatgtgctgcgttgggaactgagtaggcttgatagcagtgactggttgtaacctatgc

SEQ ID NO: 160283 - DNA, 75 bp, Artificial Sequence
  Synthetic
tttctgcgaaaacacccgggccgtggccaggggttaccgaggcctcgtgaagaggttcttggcattcgtgtttga

SEQ ID NO: 160284 - DNA, 75 bp, Artificial Sequence
  Synthetic
gcgtagtagctatgacccccccttgttgaggcaaaactctaggcctgtggagcgctgctttgccatcaagaatta

SEQ ID NO: 160285 - DNA, 75 bp, Artificial Sequence
  Synthetic
tcgggcttcacatttaacctgttttatcaagattctttattgaccaagcatttccagtgccagaccgtcctccag

SEQ ID NO: 160286 - DNA, 75 bp, Artificial Sequence
  Synthetic
acgtctagccacatagcaggtctccagagggcagacgttagtaacatttgtattgtgaggaaaggcctttagata

SEQ ID NO: 160287 - DNA, 75 bp, Artificial Sequence
  Synthetic
aacttggttcttgttgcatttgtgtaatttcaccaccagcccgcatttcccagaagcactgaggtttacggccgg

SEQ ID NO: 160288 - DNA, 75 bp, Artificial Sequence
  Synthetic
ggtgttgttggaagtttgtcttgcgttcacccgaacgctagcctaccttcagtttgtgcttgtggacctctcaga

SEQ ID NO: 160289 - DNA, 75 bp, Artificial Sequence
  Synthetic
tctattggcctccctccagaagaaggcctccgacaccccctgtgggaatcccattcagtggatgtggtaccgcct

SEQ ID NO: 160290 - DNA, 75 bp, Artificial Sequence
  Synthetic
gcctccgacaccccctgtgggaatcccattcagtggatgtggtaccgcctgttggtaaactcgtgcctgaggagt

SEQ ID NO: 160291 - DNA, 75 bp, Artificial Sequence
  Synthetic
tccatgttataggcacccctgggcaccatggtctcaagatcctgtgcatgggcacacccagggtccatgggatcc

SEQ ID NO: 160292 - DNA, 75 bp, Artificial Sequence
  Synthetic
cagggcaccacatctcccacctcagtgggatggatctgcaggacatggccaggatcaggtctcccagttcccaca

SEQ ID NO: 160293 - DNA, 75 bp, Artificial Sequence
  Synthetic
tgaagaatccggcaatacgatctcagtttttcgattgggctggtctgagcaaggtgatctctgattttgagaggg

SEQ ID NO: 160294 - DNA, 75 bp, Artificial Sequence
  Synthetic
ccgtctctgagggggggagaaagacgggcgggggcgtaggggaggatctcgtgggggccggggggccctgcctga

SEQ ID NO: 160295 - DNA, 75 bp, Artificial Sequence
  Synthetic
gcccactgtcttctgcctatacctgccgtctctgagggggggagaaagacgggcgggggcgtaggggaggatctc

SEQ ID NO: 160296 - DNA, 75 bp, Artificial Sequence
  Synthetic
gaaatcgggactaggatgcagttgctctgtgttttttgcctggtgttgctatgggaggtgggggctgccagcctt

SEQ ID NO: 160297 - DNA, 75 bp, Artificial Sequence
  Synthetic
tggtctcatcctctgcaccatcatggtcatctccccagccccgagcccccatacgccccattccaacaagattcc

SEQ ID NO: 160298 - DNA, 75 bp, Artificial Sequence
  Synthetic
aagccgcaatgttctctcgtgtctgctgaacgtgcctgccgcgggtccccgggcctacaagtgtttcagatccca

SEQ ID NO: 160299 - DNA, 75 bp, Artificial Sequence
  Synthetic
ctcaggacccagccctggagctcggggggcggccgggtggcccaccgggtccgctgggtccgctgccccgctcct

SEQ ID NO: 160300 - DNA, 75 bp, Artificial Sequence
  Synthetic
acaaatgtaattaagagggaactagaaaaccaaaaaattcaagttagcaccacgtgaaccaccaaacccaaacag

SEQ ID NO: 160301 - DNA, 75 bp, Artificial Sequence
  Synthetic
catcccatggaccgaactgatggcaaaggtcccaggccttagcccagaggcgctgtggagagaggcaaatgtcac

SEQ ID NO: 160302 - DNA, 75 bp, Artificial Sequence
  Synthetic
agaataagagttgggcaaaccccgggggccgcgctctcccacccagccccgcttctcacctgtgctagtggctcc

SEQ ID NO: 160303 - DNA, 75 bp, Artificial Sequence
  Synthetic
agcgaggttaagctgcacctggacatagaggggcatgcttcgcattacaccatcccatggaccgaactgatggca

SEQ ID NO: 160304 - DNA, 75 bp, Artificial Sequence
  Synthetic
ctgaacgtgcctgccgcgggtccccgggcctacaagtgtttcagatcccacgcctccagaccggtgtctggcccg

SEQ ID NO: 160305 - DNA, 75 bp, Artificial Sequence
  Synthetic
tttttcaatgttgagattccggaattcccattttaccccacatgcaatgtttgtacggcagatgtcaatgtaact

SEQ ID NO: 160306 - DNA, 75 bp, Artificial Sequence
  Synthetic
cgctacaagttaatttacaagacgtctggtacccttggtattgcgctggccgagcctgtcgatatccctgctgtc

SEQ ID NO: 160307 - DNA, 75 bp, Artificial Sequence
  Synthetic
ctctccagttttatccccgtgaccagaaggagaagcatgtgctgacctgccatgccagcggccgtgtgtactgct

SEQ ID NO: 160308 - DNA, 75 bp, Artificial Sequence
  Synthetic
ccggtgttcccaagctactgctgaagcacaggagattctcagtgacaattctgagatctccgtgttcccaaagga

SEQ ID NO: 160309 - DNA, 75 bp, Artificial Sequence
  Synthetic
tagcggcctgaattcccctgcctgcatgcttagtgccccccttgagaagcagctcttctactatattggcaccat

SEQ ID NO: 160310 - DNA, 75 bp, Artificial Sequence
  Synthetic
gtctaccaacctcgaggtgcatttggtggctcagaaaatgccaccaatctctttctactggagctccttggtgca

SEQ ID NO: 160311 - DNA, 75 bp, Artificial Sequence
  Synthetic
atgcttagtgccccccttgagaagcagctcttctactatattggcaccatgctgcccaacacgcggccacacagc

SEQ ID NO: 160312 - DNA, 75 bp, Artificial Sequence
  Synthetic
cgcggcctacgagctcgaccgtggctcccgcctcttggatgccatcatcccctgcttgggacccgaccgcacttg

SEQ ID NO: 160313 - DNA, 75 bp, Artificial Sequence
  Synthetic
ctgccagaggctggctgagccaccgagcgcccgctcgggctggcggccccgaatccgggcagtgctgccgcacaa

SEQ ID NO: 160314 - DNA, 75 bp, Artificial Sequence
  Synthetic
tcgaaatggcagctaaaggggctaaacctaatccccaaccttttaatggcaaacagttacccgaggtaagccgtt

SEQ ID NO: 160315 - DNA, 75 bp, Artificial Sequence
  Synthetic
cctgcttgggacccgaccgcacttgcatgcggccggtggtcctgcggggggtgacggtcaggcagctcctgtatt

SEQ ID NO: 160316 - DNA, 75 bp, Artificial Sequence
  Synthetic
ctggaatctgtagatgtctactttcaagatgtgtttggaaccatgtggtgccaccatgcagaaatgcaaaacccc

SEQ ID NO: 160317 - DNA, 75 bp, Artificial Sequence
  Synthetic
taactttgcggacagaggccagagccgtttgctccatctgtcagcaacgccaagctccagaggacgcccgcgacg

SEQ ID NO: 160318 - DNA, 75 bp, Artificial Sequence
  Synthetic
caagctccagaggacgcccgcgacgagcctcacctgttctcctcctgtttagaggtagaattgccacctggtgag

SEQ ID NO: 160319 - DNA, 75 bp, Artificial Sequence
  Synthetic
agcccaccacccccaaggccaagtctgtgtcagcccacctcaagtccatcttttgcgaggaattgctgaataaac

SEQ ID NO: 160320 - DNA, 75 bp, Artificial Sequence
  Synthetic
atttgcaaagggaggcgaggagatggagtgactgaaggagcgatagttgagactggcgcggggcggggtgtcggg

SEQ ID NO: 160321 - DNA, 75 bp, Artificial Sequence
  Synthetic
tccacccccacatagaaaatcaccccaagtccccttccgtccccgggacgtggtgcttcctaaaggcggggctca

SEQ ID NO: 160322 - DNA, 75 bp, Artificial Sequence
  Synthetic
ccaagcccaccctccaggggaggctggaggcggattttccagacagtcccctgcttcctaaatttcaagagctga

SEQ ID NO: 160323 - DNA, 75 bp, Artificial Sequence
  Synthetic
cggttgatacagctgggatccaggcgcaggagggaggcgcagtctagcaggccttccaggaaacgcttgtgcagc

SEQ ID NO: 160324 - DNA, 75 bp, Artificial Sequence
  Synthetic
gcatcctttatatgaaaatgtgtattctctggtgttgcagtatgtacagttagctttggtatagttttggggtac

SEQ ID NO: 160325 - DNA, 75 bp, Artificial Sequence
  Synthetic
accagaataatctccccaatgatgtttttcgggaggctcaaagaagttacctggtatttctgacatcccagttct

SEQ ID NO: 160326 - DNA, 75 bp, Artificial Sequence
  Synthetic
ctggggcagccggggttcctggcgctccgggggcagccgggcggccgccggtgggtccgctgggccgctgccccg

SEQ ID NO: 160327 - DNA, 75 bp, Artificial Sequence
  Synthetic
ctggtatttctgacatcccagttctgctacgaagagtacgtgcagaggacttttggggtgcctcggcgccaacgc

SEQ ID NO: 160328 - DNA, 75 bp, Artificial Sequence
  Synthetic
ccaggaccaggcaagcggggcacgccctgggggagggaaccgggtgggagcagggagggggcgtcccgggacccc

SEQ ID NO: 160329 - DNA, 75 bp, Artificial Sequence
  Synthetic
gttaaagttaaccggcggtggaggatccaccggccagacctctacatttggtttgggtacccaggtgatggccgc

SEQ ID NO: 160330 - DNA, 75 bp, Artificial Sequence
  Synthetic
ttggaaaagggcccagggtcactggcttatgcgtgggacgtttagaaacaggccgcctatggggcctgtgactgg

SEQ ID NO: 160331 - DNA, 75 bp, Artificial Sequence
  Synthetic
ctcaggacccagccctggagctcgggggcggccgggtggcccaccgggtccgctgggtccgctgccccgctccgg

SEQ ID NO: 160332 - DNA, 75 bp, Artificial Sequence
  Synthetic
accgggccagcagagcaagcggaccacgcccattcgaaccctaccggcggatgcagcgacccccagaggagcccc

SEQ ID NO: 160333 - DNA, 75 bp, Artificial Sequence
  Synthetic
gcaataaagtacaggattattgccaaaacaacgtgtgctctttcttcatacaggcccgcaatttccatgacagtc

SEQ ID NO: 160334 - DNA, 75 bp, Artificial Sequence
  Synthetic
cccgtccagcaggctcaggccgccgcatccgctgggaccggggccttggcatcatcagcgccgtccacggccgta

SEQ ID NO: 160335 - DNA, 75 bp, Artificial Sequence
  Synthetic
gtgtggctggggctggtgctcatgcacaccttggcgggtcatccgccacccccgtccagcaggctcaggccgccg

SEQ ID NO: 160336 - DNA, 75 bp, Artificial Sequence
  Synthetic
gcccagtccgcgaccccctctgtttcttcatctattagcagcctccgggccgcgacttcgggggcgactgccgcc

SEQ ID NO: 160337 - DNA, 75 bp, Artificial Sequence
  Synthetic
aaacaggagtacgcgctgaggttagccaccgtcggctaccccaaggccggggtttacagtggcctcattggaggc

SEQ ID NO: 160338 - DNA, 75 bp, Artificial Sequence
  Synthetic
cgaatggaagaggccgcagtgccgattcagaaagtaaacggcatctttgaggccctgaaagccccgcaccagggg

SEQ ID NO: 160339 - DNA, 75 bp, Artificial Sequence
  Synthetic
taagggtccctaaagagctaagtgcacctgcctaacctcatgattggggacccccaacacctactggaagacggc

SEQ ID NO: 160340 - DNA, 75 bp, Artificial Sequence
  Synthetic
ccaagacaccgccccgcgcggggcacgtaagaaacagtagagggcacgaaacatggtgtatgcactttattaata

SEQ ID NO: 160341 - DNA, 75 bp, Artificial Sequence
  Synthetic
ctataggagagaagctggctccggagcagcattagagggaaaaccacggaggccgacagcaaatggcgatcatgc

SEQ ID NO: 160342 - DNA, 75 bp, Artificial Sequence
  Synthetic
gtcggaggaggccggggtgttatctgctgactgaaacccgtccccgctgaccagtccgtgccccacccttggggg

SEQ ID NO: 160343 - DNA, 75 bp, Artificial Sequence
  Synthetic
atcgagtacactgggacgaagcccaaacttccgatacaaggctttaacactgtataggaagtgcgaacttgagcc

SEQ ID NO: 160344 - DNA, 75 bp, Artificial Sequence
  Synthetic
aacttccgatacaaggctttaacactgtataggaagtgcgaacttgagccaggacacccgtctttcaacggcaac

SEQ ID NO: 160345 - DNA, 75 bp, Artificial Sequence
  Synthetic
gtactcggctagcctgactaagggtgaggctataacgcaggtcctgttccggggcggcggtggatagagaggagg

SEQ ID NO: 160346 - DNA, 75 bp, Artificial Sequence
  Synthetic
aggacacccgtctttcaacggcaacaataccacttccattaggtcttcgttaccctacaacatttttgttataat

SEQ ID NO: 160347 - DNA, 75 bp, Artificial Sequence
  Synthetic
aacaattacagatacaaaaacttgagtctctcgaggtctgcgatgaggcggtgggtggaacgctccagcttgcgg

SEQ ID NO: 160348 - DNA, 75 bp, Artificial Sequence
  Synthetic
acctcagcctacgatttgacctcacacgagacaagctgctgagcatggccccccaggaggcaatgctggaccagg

SEQ ID NO: 160349 - DNA, 75 bp, Artificial Sequence
  Synthetic
tgggtaactctttagaacatacattttacccaggtggggctcttgagctcaacagccctaagcgctccctaccga

SEQ ID NO: 160350 - DNA, 75 bp, Artificial Sequence
  Synthetic
agtgttccacagtaatgttgtctggtcgctagatggcgcgggtgaggccacgctttgcgaaaacgaaagtgcttg

SEQ ID NO: 160351 - DNA, 75 bp, Artificial Sequence
  Synthetic
ataagttaacaaggggaagcaggggaaggcaggcgacaattggcaccccgcgagaccccctgttaaggggagggg

SEQ ID NO: 160352 - DNA, 75 bp, Artificial Sequence
  Synthetic
cgctttgcgaaaacgaaagtgcttgaaaaggcgcgggatagcgtgcgctaccggatggcgggtaatacatgctat

SEQ ID NO: 160353 - DNA, 75 bp, Artificial Sequence
  Synthetic
actctgatacacgggtaaaaatcaacaaaagcacaagtgctgctgccaaatccagcctcctgtgttctgtggtga

SEQ ID NO: 160354 - DNA, 75 bp, Artificial Sequence
  Synthetic
caaaagcacaagtgctgctgccaaatccagcctcctgtgttctgtggtgacatttgggaccggataaacaccagt

SEQ ID NO: 160355 - DNA, 75 bp, Artificial Sequence
  Synthetic
gcgcacctcgggccgcgcgccaggctccgagccggaatgcattgggggcaatgggattgcgggggattgttgctg

SEQ ID NO: 160356 - DNA, 75 bp, Artificial Sequence
  Synthetic
cgaccctgacctgtcccagggtcttcaggttaaacagatattgagaggagacaaagagagttaggggccgaccga

SEQ ID NO: 160357 - DNA, 75 bp, Artificial Sequence
  Synthetic
ctccaggatcatggaaccctatggatacctacctctaggctccacccactaggtatatcggggcggagcccaatc

SEQ ID NO: 160358 - DNA, 75 bp, Artificial Sequence
  Synthetic
ccagcccatactaacccaacacaaagctaacatctaaaaataaaggacaacactggaacctcttcctgacaacca

SEQ ID NO: 160359 - DNA, 75 bp, Artificial Sequence
  Synthetic
cgcggcggagatgcagccgacggcggggccgcggtgggctgcccccgaggacgggcgccggccgccagcgccccc

SEQ ID NO: 160360 - DNA, 75 bp, Artificial Sequence
  Synthetic
gctaacatctaaaaataaaggacaacactggaacctcttcctgacaaccagccccaccaaaaaagctaacatcct

SEQ ID NO: 160361 - DNA, 75 bp, Artificial Sequence
  Synthetic
acgggcgccggccgccagcgcccccgtggcctttggcacgggcctggcacccaccgctttaattgtgggggtggg

SEQ ID NO: 160362 - DNA, 75 bp, Artificial Sequence
  Synthetic
gaacagctgaggtgctgcataagcttgataagcattctcaggagcaggctgaggggcaggaaaccacgacccagt

SEQ ID NO: 160363 - DNA, 75 bp, Artificial Sequence
  Synthetic
atgggattgcgggggattgttgctgtctgctcctgacagggagagacacgcgcggcggagatgcagccgacggcg

SEQ ID NO: 160364 - DNA, 75 bp, Artificial Sequence
  Synthetic
gcagcccgggatatcaggagatcttctagaactggatactcgtggggggtaaagaaggtgaataaaaattacaaa

SEQ ID NO: 160365 - DNA, 75 bp, Artificial Sequence
  Synthetic
atgaagctccggctcgtggagtccgcacctccttctgtgcacgaagttttgcggaaccaggagaaggggtctggc

SEQ ID NO: 160366 - DNA, 75 bp, Artificial Sequence
  Synthetic
aaagaaggtgaataaaaattacaaacattctctgcccagccttcagactatcaaacctagataatcattctataa

SEQ ID NO: 160367 - DNA, 75 bp, Artificial Sequence
  Synthetic
ctgaggcgctgcgccgcccgacgcccttggtggcgtggagggagcggggaccccgggggtgtgacctaggccggg

SEQ ID NO: 160368 - DNA, 75 bp, Artificial Sequence
  Synthetic
caaaggtggccggcaaggtgcaatgtttagtgagttacctgtctaacatctcccctttaaagccaaggcaccagc

SEQ ID NO: 160369 - DNA, 75 bp, Artificial Sequence
  Synthetic
ggtgcaagaattggggctgggaatggagaggggagtgggctaggtgccgacaccggggtgccaagataatggatt

SEQ ID NO: 160370 - DNA, 75 bp, Artificial Sequence
  Synthetic
aacatttggtgggacctgatgctgctggtgtgctgtaaataagtgcctagcacatcacgtaggcaccaggtgtca

SEQ ID NO: 160371 - DNA, 75 bp, Artificial Sequence
  Synthetic
accttctaagaggaaatgacaagccacagacatccccacatatagcccggtgtccactgtctaatgtcagtaatt

SEQ ID NO: 160372 - DNA, 75 bp, Artificial Sequence
  Synthetic
ccaactcaatttggaatccagaaactatattgcacaccaacaccccctcctctgcacatgagcaagacaagacat

SEQ ID NO: 160373 - DNA, 75 bp, Artificial Sequence
  Synthetic
tatattgcacaccaacaccccctcctctgcacatgagcaagacaagacatctatgtttatctctaaatgtgccat

SEQ ID NO: 160374 - DNA, 75 bp, Artificial Sequence
  Synthetic
ggaacccggttgcccatgcagtggtgtcagacaggaaaatggttaattaaccacatcttaaattgccaccttagg

SEQ ID NO: 160375 - DNA, 75 bp, Artificial Sequence
  Synthetic
tccagacaaaggacgaggtagataaccttttgctcaaggagtctctgctagaggactttaagggctaccttggat

SEQ ID NO: 160376 - DNA, 75 bp, Artificial Sequence
  Synthetic
gatggggatgaagaggggagggctggaggccggggccgcggaggccggggccgcggaggccggggccgcggaggc

SEQ ID NO: 160377 - DNA, 75 bp, Artificial Sequence
  Synthetic
ccaggtgctcaaaaataggctgctccgcgtggagctggacggcatcatgcgtgaccacctggccagggcggagga

SEQ ID NO: 160378 - DNA, 75 bp, Artificial Sequence
  Synthetic
tgaagatggcctcaaagtcctgcactatattctccagattcagactctttagcactacgtgcttgaggtacaaat

SEQ ID NO: 160379 - DNA, 75 bp, Artificial Sequence
  Synthetic
gaatagaaacccaataccaacaggtgtgcaggtgtgcatgacaaatcttgggggtctcagaacccaggaccagac

SEQ ID NO: 160380 - DNA, 75 bp, Artificial Sequence
  Synthetic
gtgcaggtgtgcatgacaaatcttgggggtctcagaacccaggaccagactttgaagtctcaggtataggtcctg

SEQ ID NO: 160381 - DNA, 75 bp, Artificial Sequence
  Synthetic
ggccatggccttggggaggttcccggagaccggtctgggctctcggaagccctcgtttcggccccgaaatagggc

SEQ ID NO: 160382 - DNA, 75 bp, Artificial Sequence
  Synthetic
ccaagggtgttggcccctacaggctcccaaggcgggggttgggcccagggccaagctctgccaccacaggaggca

SEQ ID NO: 160383 - DNA, 75 bp, Artificial Sequence
  Synthetic
tatagtgtcgtatcggacccctcgccactctcatcctcatcaataggtaacccaaaggcagcctggctgagatga

SEQ ID NO: 160384 - DNA, 75 bp, Artificial Sequence
  Synthetic
gaggtaggagacagccagtccctgggcctgccaggggccaccttctctaagagggggctctgtgggctgggaggg

SEQ ID NO: 160385 - DNA, 75 bp, Artificial Sequence
  Synthetic
gcctgccaggggccaccttctctaagagggggctctgtgggctgggagggccagaggcctcagattcagcagtag

SEQ ID NO: 160386 - DNA, 75 bp, Artificial Sequence
  Synthetic
gagaccttgggaggtcgtcagcttaaccagcgccgccctcaccccattgccaacttccggctcacacaaaaccac

SEQ ID NO: 160387 - DNA, 75 bp, Artificial Sequence
  Synthetic
cagggcctgttgtcctgggggaggatattggacacgagcaggaagctcttgagtggcgtctccaccagcttaaat

SEQ ID NO: 160388 - DNA, 75 bp, Artificial Sequence
  Synthetic
gaggccggggccgcggaggccggggccgcagaggccggggccgcagaggccggggccgcagaggccggagacgac

SEQ ID NO: 160389 - DNA, 75 bp, Artificial Sequence
  Synthetic
atgctatcggtttaaacgcggaatacagtggcgatgagctggcggagttggccctggccatcaccagaccggagg

SEQ ID NO: 160390 - DNA, 75 bp, Artificial Sequence
  Synthetic
tccccaaaattgaagactggccaaaatccagcttccgtccccgggacgtggtgcttcctaaaggcggggctcatg

SEQ ID NO: 160391 - DNA, 75 bp, Artificial Sequence
  Synthetic
cgggtccaccaggccagccggagggaccccggcagcccgggcgagtcgccttccctctcccctggcctctccttc

SEQ ID NO: 160392 - DNA, 75 bp, Artificial Sequence
  Synthetic
gataagtgctgcgtccactttgtgttacaggtgggccaaacctccagaatatcaattggtggggccttggtgggc

SEQ ID NO: 160393 - DNA, 75 bp, Artificial Sequence
  Synthetic
gagggccgggatgggtacattttccccaggcagtcccagcgccgaggcaagagtggggctgtggatggtgtggaa

SEQ ID NO: 160394 - DNA, 75 bp, Artificial Sequence
  Synthetic
cggccctggcctcggtgagaagctcgcgtagccacacggcctggcgtgcaaagatggacatctctggctcgaaag

SEQ ID NO: 160395 - DNA, 75 bp, Artificial Sequence
  Synthetic
ttcgtatatggaggtagtaagacctccctttacaacctcaggcgaggaattgcccttgctgttccacaatgtcgt

SEQ ID NO: 160396 - DNA, 75 bp, Artificial Sequence
  Synthetic
aagatggacatctctggctcgaaagactcggagtagccgtccaggtcctgcagaaaattcagcgagatggtctcc

SEQ ID NO: 160397 - DNA, 75 bp, Artificial Sequence
  Synthetic
ggcggggagttggtctttgcaggactatacctggcggcagggaatgagtcggatgtgaaagatcgagagggcagt

SEQ ID NO: 160398 - DNA, 75 bp, Artificial Sequence
  Synthetic
ccaggcccagacgtcggcggatgtgcctcaggagggtcaggaaaataggtgactgtcttagattaacctgatgct

SEQ ID NO: 160399 - DNA, 75 bp, Artificial Sequence
  Synthetic
ttcaggttaaacagatattgagaggagacaaagagagttaggggccgaccgaggaaggccgccgccacggccgcc

SEQ ID NO: 160400 - DNA, 75 bp, Artificial Sequence
  Synthetic
agacaaagagagttaggggccgaccgaggaaggccgccgccacggccgcctcaaaaacggagacggggatggtgt

SEQ ID NO: 160401 - DNA, 75 bp, Artificial Sequence
  Synthetic
agactccgggggcagttttttgagtttctcgcctatgatccaccccaatctcgcccccataattgcgccatctgc

SEQ ID NO: 160402 - DNA, 75 bp, Artificial Sequence
  Synthetic
caccggagcccctcttaggaccggtaatgggagtgccataaggcataagatttctcagggcccggccggtaacgg

SEQ ID NO: 160403 - DNA, 75 bp, Artificial Sequence
  Synthetic
aatgggagtgccataaggcataagatttctcagggcccggccggtaacggtgccgtaggaagacggggtttcgcg

SEQ ID NO: 160404 - DNA, 75 bp, Artificial Sequence
  Synthetic
actggccggtgtaattagaggagagggcaacaacgcaaggctgttgttttatttgggttacaagacctgcggcgg

SEQ ID NO: 160405 - DNA, 75 bp, Artificial Sequence
  Synthetic
ggcctgaggttatacggtattattcgccgttcaaacggtagcatgacgggagggctgctatcagcaccgggcgtc

SEQ ID NO: 160406 - DNA, 75 bp, Artificial Sequence
  Synthetic
acagagaccccaaaaagaggataaaagaaggcgagctggcccggctcgccagcgtcgtccagacgctcggggggt

SEQ ID NO: 160407 - DNA, 75 bp, Artificial Sequence
  Synthetic
gcgcggtccacgcccagcaccttgctgtaggtgtaggcccgcacccgactgtgttttaggagcttgtacatagcg

SEQ ID NO: 160408 - DNA, 75 bp, Artificial Sequence
  Synthetic
ggtcccctggagatacagggggcaagggcgtaggtggggcctggtgcatctgactttcggtcaaacatcgcgggc

SEQ ID NO: 160409 - DNA, 75 bp, Artificial Sequence
  Synthetic
ccaccagctcttgatggcgtccgggcccagtgaggaaccgtgcgcctggcgcgggttctttaaccaggtcctcct

SEQ ID NO: 160410 - DNA, 75 bp, Artificial Sequence
  Synthetic
gtggcggttgtaggccgagagaagcacagatgtggcgcctccaatgaggccactgtaaaccccggccttggggta

SEQ ID NO: 160411 - DNA, 75 bp, Artificial Sequence
  Synthetic
tgtggaccaggcccaagaactcggggtgcggccagagggcggcccgggtatccatctcctcccaggcgtcctgga

SEQ ID NO: 160412 - DNA, 75 bp, Artificial Sequence
  Synthetic
catgggtcccgtagtgacaactatgctgaatatcttgaatatgggaggagggggggctttgggtttcattgtgtg

SEQ ID NO: 160413 - DNA, 75 bp, Artificial Sequence
  Synthetic
ttcttgagggctaatatcacgggtgaggcggttgtcacaggtgctagaccctggagttgaaccagtaccactcgg

SEQ ID NO: 160414 - DNA, 75 bp, Artificial Sequence
  Synthetic
gggggggagggattacactatagggttcccttcctctaggttctatatacctataggtatatacccagctgcaat

SEQ ID NO: 160415 - DNA, 75 bp, Artificial Sequence
  Synthetic
acaggaggtctcccaaacccccatctctcgctagagccgagaccaggccgagtcctgcgtagaacgatggggcgc

SEQ ID NO: 160416 - DNA, 75 bp, Artificial Sequence
  Synthetic
cagggaacgctgcaggacctggtcacccaggccaggggccacaccgacccgcgccagctcaagatcgtggtggag

SEQ ID NO: 160417 - DNA, 75 bp, Artificial Sequence
  Synthetic
ggcaaagattttctgcgtgagatgaacacccccatacatgtctcagaggccgtgtttctcccactgtcactgtgc

SEQ ID NO: 160418 - DNA, 75 bp, Artificial Sequence
  Synthetic
acacccccatacatgtctcagaggccgtgtttctcccactgtcactgtgcactctctcccccgggcgctgccttc

SEQ ID NO: 160419 - DNA, 75 bp, Artificial Sequence
  Synthetic
atctcccgttgttccaatagaataacttcccggtctgtggccggggctggataaggggggtgattcctagaggcg

SEQ ID NO: 160420 - DNA, 75 bp, Artificial Sequence
  Synthetic
acgcttgcggcgcgggagatcctggagcgtcaattctccgcctcggatgactacgaccggttgtacttcctgacg

SEQ ID NO: 160421 - DNA, 75 bp, Artificial Sequence
  Synthetic
ttgtacataaccatggagttggctgtggtgcactccatctggtaaggggggctggtgcggacgcctgtgtttagt

SEQ ID NO: 160422 - DNA, 75 bp, Artificial Sequence
  Synthetic
gccgctgccgttggcctcataaaagtcatacacgccatagtgttccagcataaagatgcgggggtcctctgtctc

SEQ ID NO: 160423 - DNA, 75 bp, Artificial Sequence
  Synthetic
tgcatcaataggtcccaggttcatgtgcctcaggagtttagctccacccagctctccttcttcaacaatgtccac

SEQ ID NO: 160424 - DNA, 75 bp, Artificial Sequence
  Synthetic
gcagagacgtattcccgaagcagctccccggcgttggactccacgtcgggccaggtgtcccagtaggagtcggcg

SEQ ID NO: 160425 - DNA, 75 bp, Artificial Sequence
  Synthetic
tgcctcaggagtttagctccacccagctctccttcttcaacaatgtccacaagataatacccaacaagaccttct

SEQ ID NO: 160426 - DNA, 75 bp, Artificial Sequence
  Synthetic
ccaggtgtcccagtaggagtcggcggcggcggcgctgaggcgggcggaagctacactggccagggttcttctcct

SEQ ID NO: 160427 - DNA, 75 bp, Artificial Sequence
  Synthetic
ttctcggcttttactgccacctggcttctgttgggtcagacagtttggtgcgctagttgtgtgcttagcagcaac

SEQ ID NO: 160428 - DNA, 75 bp, Artificial Sequence
  Synthetic
atcatctaccctcggggccaccatggtggccacccatctgcgaccccccccaggagttggtgagtccccagcccc

SEQ ID NO: 160429 - DNA, 75 bp, Artificial Sequence
  Synthetic
caacccagccttctctacgcttacctggtcaccggacacttttgtggcaccatctgccccatcttcagcacaaat

SEQ ID NO: 160430 - DNA, 75 bp, Artificial Sequence
  Synthetic
tggtcaccggacacttttgtggcaccatctgccccatcttcagcacaaatggaaaagggcgcctaatcatgcatc

SEQ ID NO: 160431 - DNA, 75 bp, Artificial Sequence
  Synthetic
gggtcagggaaaaggcctctgggttctccagcacggtgggcatgacatattccagaaagttgtggtagacgggga

SEQ ID NO: 160432 - DNA, 75 bp, Artificial Sequence
  Synthetic
tccagaaagttgtggtagacggggatgtagttgagcggctcctgggtgtctgcggagacgtaggccgggttaagg

SEQ ID NO: 160433 - DNA, 75 bp, Artificial Sequence
  Synthetic
ctgtcaatgtcgacgaagatgccatctacgaggccatcaaggacctggaatgtggggatgagctgcgcctacaga

SEQ ID NO: 160434 - DNA, 75 bp, Artificial Sequence
  Synthetic
ctacgaggccatcaaggacctggaatgtggggatgagctgcgcctacagatcatcaactatacccagctcatttt

SEQ ID NO: 160435 - DNA, 75 bp, Artificial Sequence
  Synthetic
tgtggggatgagctgcgcctacagatcatcaactatacccagctcattttggaaaataaacagtagttgctttta

SEQ ID NO: 160436 - DNA, 75 bp, Artificial Sequence
  Synthetic
caggaaactctgcttggccgaggcatagcgcagcagcttgtccttgaggagtgcatactgggagccagccgaggc

SEQ ID NO: 160437 - DNA, 75 bp, Artificial Sequence
  Synthetic
cgttggaatgctttggagccgagagggatgggcccgcttgtgcgcttatgtgttacacggtgccaataaccggcc

SEQ ID NO: 160438 - DNA, 75 bp, Artificial Sequence
  Synthetic
tagcgcagcagcttgtccttgaggagtgcatactgggagccagccgaggccccaagcgccaggcccctggcagcc

SEQ ID NO: 160439 - DNA, 75 bp, Artificial Sequence
  Synthetic
atcgtgagcgagtacgtggatcggacgctacccgaagccactaatgacccaggccaggctaacctgcctcctcct

SEQ ID NO: 160440 - DNA, 75 bp, Artificial Sequence
  Synthetic
cagcccgcagcggcttgacgctcaagggcggcctgtaacttaagtgatggtctccctttcttgacgccccccgtt

SEQ ID NO: 160441 - DNA, 75 bp, Artificial Sequence
  Synthetic
cgggtggaagcatgggggaaacctgcgaaacttgggggcaggctacaacaggctgctgaaaaccggcgagacttg

SEQ ID NO: 160442 - DNA, 75 bp, Artificial Sequence
  Synthetic
tccaccacgatcttgagctggcgcgggtcggtgtggcccctggcctgggtgaccagatcctgcagcgttccctgc

SEQ ID NO: 160443 - DNA, 75 bp, Artificial Sequence
  Synthetic
ccaggataatcaggcgacagtaacacagggtgggggtggacatgaggaggtaattagcacggtagccttgggggc

SEQ ID NO: 160444 - DNA, 75 bp, Artificial Sequence
  Synthetic
cagggtgggggtggacatgaggaggtaattagcacggtagccttgggggcctggactgtgggatccacctagaaa

SEQ ID NO: 160445 - DNA, 75 bp, Artificial Sequence
  Synthetic
ccggggaacgggcggcacctcaggtggtgacatgggagtgggcgctctcggtggtgtcttcatggtggcgggtgc

SEQ ID NO: 160446 - DNA, 75 bp, Artificial Sequence
  Synthetic
gggctgggcctcgccctcggggacccctggacatctggacaacgtttgggggcgcaaacctccaatcaccagcca

SEQ ID NO: 160447 - DNA, 75 bp, Artificial Sequence
  Synthetic
aggccagggctccttcggaaagaccccgcactgcctcgcagatgccccggatccacttggcggctgccagggatt

SEQ ID NO: 160448 - DNA, 75 bp, Artificial Sequence
  Synthetic
tccggtagggccacgagccgttcccggccgctgcccgggccagggcggcctcgaggggagcctggacaggggctt

SEQ ID NO: 160449 - DNA, 75 bp, Artificial Sequence
  Synthetic
ccggatgcccggaagaccaccctctgcccctcacgaagctcatagctaaggccatcgatgctggatttctgagaa

SEQ ID NO: 160450 - DNA, 75 bp, Artificial Sequence
  Synthetic
gagccgtgtgaaagccccgccgagtgcttgccgccatctcgtgggccttcgccatcagggtctggctctcccgga

SEQ ID NO: 160451 - DNA, 75 bp, Artificial Sequence
  Synthetic
agcccattcgccctctggggatgagatgttcaggggtggccggtaccctacgctgccgatttacataatataaat

SEQ ID NO: 160452 - DNA, 75 bp, Artificial Sequence
  Synthetic
ggaggagatcgtcccgctctcgccttgtcagcagctggggcttcttaggccagagcgccgagtccgaggccagcc

SEQ ID NO: 160453 - DNA, 75 bp, Artificial Sequence
  Synthetic
agaaagaaacaggcaccctcgagagtgcccccgacccgacccccacagtgccgccagtccctgctcggcctccgc

SEQ ID NO: 160454 - DNA, 75 bp, Artificial Sequence
  Synthetic
agttggaggaggaggcaggttagcctggcctgggtcattagtggcttcgggtagcgtccgatccacgtactcgct

SEQ ID NO: 160455 - DNA, 75 bp, Artificial Sequence
  Synthetic
ggagcaggagcgggaggggcaggagcaggaggggcaggagcaggaggaggggcaggagcaggaggaggggcagga

SEQ ID NO: 160456 - DNA, 75 bp, Artificial Sequence
  Synthetic
ggcggcaccgcattacatagcactaacacacgccaacaacacacatggcataaagagagggtaggaggattttgg

SEQ ID NO: 160457 - DNA, 75 bp, Artificial Sequence
  Synthetic
cacgatggccgtcagggcagcctcggctgatcgtcttttttccagaagcccggccagcccccgctcgtactccgc

SEQ ID NO: 160458 - DNA, 75 bp, Artificial Sequence
  Synthetic
gtagggggcctccagatccgtgttgaccaccgctgatttcatgtccggggactgcagggcctggcgcgtctgcgc

SEQ ID NO: 160459 - DNA, 75 bp, Artificial Sequence
  Synthetic
gccgtcctggcacgaaagagggccccggccgcttcctccgctcctcgccctcctcctccttctttggcggtagcc

SEQ ID NO: 160460 - DNA, 75 bp, Artificial Sequence
  Synthetic
aagtcccccatggaaaacccataactaggacctaacaagcggaggctcctctctttatgccatgtgtgttgttgg

SEQ ID NO: 160461 - DNA, 75 bp, Artificial Sequence
  Synthetic
tcctcctccttctttggcggtagccgcgggggtggcgggccaagcgtccagtctggccagagggccggtctcgat

SEQ ID NO: 160462 - DNA, 75 bp, Artificial Sequence
  Synthetic
tgctctggccggtcacgatcgttatggggttgttggaaatgttccggaccgtcagcttgagggtctggcccggct

SEQ ID NO: 160463 - DNA, 75 bp, Artificial Sequence
  Synthetic
aagcctcctctgatgctctgtggcacctcaaggtgaatatagctgcccatcgacgtatcgctggaaaccggtggg

SEQ ID NO: 160464 - DNA, 75 bp, Artificial Sequence
  Synthetic
catcgtccacgagcagggatcgcagtctctccctcctcaccctcgttattcccaatagcatagcggcaaggatct

SEQ ID NO: 160465 - DNA, 75 bp, Artificial Sequence
  Synthetic
gttactgcacagaacatcactgccaccgaggccggaacaggaacctccacgggcgtgactagcaatgtcaccacc

SEQ ID NO: 160466 - DNA, 75 bp, Artificial Sequence
  Synthetic
ctccgtgaaccagccgggttccacggcctccattctctccgccgcaccaccatcgtccacgagcagggatcgcag

SEQ ID NO: 160467 - DNA, 75 bp, Artificial Sequence
  Synthetic
gtttctggctactgccgccgctgctgccgcggctgagtccgtattgtctggcagcagggaggccagcagggtgtt

SEQ ID NO: 160468 - DNA, 75 bp, Artificial Sequence
  Synthetic
gacctgctggagctgggcccggagagcctagagaaaatcatcgctgacctcaaggccaagtcacccggcggaaat

SEQ ID NO: 160469 - DNA, 75 bp, Artificial Sequence
  Synthetic
gccgcggctgagtccgtattgtctggcagcagggaggccagcagggtgttccagtcatcgggcgaagtgggagcg

SEQ ID NO: 160470 - DNA, 75 bp, Artificial Sequence
  Synthetic
agctcacggcgaaacttgggccagcccggggggacctcccccgctgttcccccagtttgccccatcgtttccctg

SEQ ID NO: 160471 - DNA, 75 bp, Artificial Sequence
  Synthetic
tggaagtgacaccaaatatctcttaggttttactgaaatcactgttcacacacttataaaaggggaagtgacccc

SEQ ID NO: 160472 - DNA, 75 bp, Artificial Sequence
  Synthetic
tcctaattctggcccaggcctcattcgcctctcgcgctcgccgctcccgcctctccttgtcttcctgttctcgga

SEQ ID NO: 160473 - DNA, 75 bp, Artificial Sequence
  Synthetic
ccggggggacctcccccgctgttcccccagtttgccccatcgtttccctggcagcctcccgggccaagcaaaacc

SEQ ID NO: 160474 - DNA, 75 bp, Artificial Sequence
  Synthetic
gctcttgaccttcctgggtgaggaggccgacaaccagatcatggggccctcgagctatgcttcttttgtggtacg

SEQ ID NO: 160475 - DNA, 75 bp, Artificial Sequence
  Synthetic
ctggtctgtgacctggcccagcggacaaggcccccgggcctctccacctccgacaaccagtaggcggacgagtgg

SEQ ID NO: 160476 - DNA, 75 bp, Artificial Sequence
  Synthetic
cgacaaccagtaggcggacgagtggcttcggaaaagcgagcctggcgtagaggccacagccgcctcagaagctgg

SEQ ID NO: 160477 - DNA, 75 bp, Artificial Sequence
  Synthetic
cttcggaaaagcgagcctggcgtagaggccacagccgcctcagaagctgggggcctgccccaaaccacaaattcc

SEQ ID NO: 160478 - DNA, 75 bp, Artificial Sequence
  Synthetic
cctgcacctccttctgtctgagctgatcgttgttgttattcttcaatttctgcaggtaacttaggaagcgtttct

SEQ ID NO: 160479 - DNA, 75 bp, Artificial Sequence
  Synthetic
gcccccgaagcccactgtgtggccgagtccacgatccctgaggcgggagcagccgggaactctggaccccgggag

SEQ ID NO: 160480 - DNA, 75 bp, Artificial Sequence
  Synthetic
tggttaacaactcacggagatggctcgtgagggcggagctgcttcgcttcaggatggagataaagaaggagacca

SEQ ID NO: 160481 - DNA, 75 bp, Artificial Sequence
  Synthetic
atttgaggcctggcttgaggctcaggatgcaaatcttgaggatgttcagcgggagttttccgggctgcgagtaat

SEQ ID NO: 160482 - DNA, 75 bp, Artificial Sequence
  Synthetic
cctgacctgtgaccgtcgcatcatagaccgccagtagacctgggagcagattcaccgccgcggccgtctccttta

SEQ ID NO: 160483 - DNA, 75 bp, Artificial Sequence
  Synthetic
gggacaaccccaagacaccgccccgcgcggggcacgtaagaaacagtagagggcacgaaacatggtgtatgcact

SEQ ID NO: 160484 - DNA, 75 bp, Artificial Sequence
  Synthetic
ggcctaccgaacttcaacccacaccatcaccacaaagcatgcatctccctgtcttgcatgtgccagaccaatcaa

SEQ ID NO: 160485 - DNA, 75 bp, Artificial Sequence
  Synthetic
cgggtctcagggggcacgtgttccacccgtgaatggctcccgcgcatacggcgagtctcgcgtgtccggtgcctg

SEQ ID NO: 160486 - DNA, 75 bp, Artificial Sequence
  Synthetic
aggtgctgtgagtagcaaaattctgcaaggccactaggcgcgctggctccagcgtcagccggttgcccatctcga

SEQ ID NO: 160487 - DNA, 75 bp, Artificial Sequence
  Synthetic
cccgtgaatggctcccgcgcatacggcgagtctcgcgtgtccggtgcctgcggatggggtgcctcacgagttcct

SEQ ID NO: 160488 - DNA, 75 bp, Artificial Sequence
  Synthetic
agcgtcagccggttgcccatctcgaatgtgtgcagggcctctgagaccatggggtccaggatgcggtcaatgcca

SEQ ID NO: 160489 - DNA, 75 bp, Artificial Sequence
  Synthetic
tcctgcacctcagggtcaaggaccggcaagtcacgatagaggtggtctatgctctcctcgaaggaggcaatgtag

SEQ ID NO: 160490 - DNA, 75 bp, Artificial Sequence
  Synthetic
acaggacctggaaatggcctaggacagaaggaagactcatctggaccagaaggctccggcggcagtggacctcaa

SEQ ID NO: 160491 - DNA, 75 bp, Artificial Sequence
  Synthetic
tctcagcttctgaaaagttatccaagtcccaaccaccgcgccccctaacgtgtgagtccccaagacaccccgagt

SEQ ID NO: 160492 - DNA, 75 bp, Artificial Sequence
  Synthetic
gtcccaaccaccgcgccccctaacgtgtgagtccccaagacaccccgagtgcgtgacgctaggcctgggacctcc

SEQ ID NO: 160493 - DNA, 75 bp, Artificial Sequence
  Synthetic
ttcatgtaaagggaagtgggtttatgactttctcatcattacacttatgacataataattatttcagatacatgc

SEQ ID NO: 160494 - DNA, 75 bp, Artificial Sequence
  Synthetic
gcaagtcacgatagaggtggtctatgctctcctcgaaggaggcaatgtagttatcgatggtgtagaaggtgatgg

SEQ ID NO: 160495 - DNA, 75 bp, Artificial Sequence
  Synthetic
ggcggctcaggatcagggccaagacatagagatggtgtccggagaccccaaaaacgtccaagttgcattggctgc

SEQ ID NO: 160496 - DNA, 75 bp, Artificial Sequence
  Synthetic
gtgtcacgtaggcggatgtacgtggggttctttgcggccccgactatcgaccctgcatttgcgatgtacttttct

SEQ ID NO: 160497 - DNA, 75 bp, Artificial Sequence
  Synthetic
gttgctgagacatatcactaatcatatccatgacccgcgaggccttctgggcgttggcggcctgaaacaccagaa

SEQ ID NO: 160498 - DNA, 75 bp, Artificial Sequence
  Synthetic
ggttctttgcggccccgactatcgaccctgcatttgcgatgtacttttctatgacggggatggtgagggccgcgg

SEQ ID NO: 160499 - DNA, 75 bp, Artificial Sequence
  Synthetic
atgacggggatggtgagggccgcggtgtcggccagtggtggcgtggcttcggggttgtcgtggttggcgggtgtc

SEQ ID NO: 160500 - DNA, 75 bp, Artificial Sequence
  Synthetic
agcaggaggggcaggagcaggaggaggggcaggagcaggaggaggggcaggaggggcaggaggggcaggaggggc

SEQ ID NO: 160501 - DNA, 75 bp, Artificial Sequence
  Synthetic
gaggataccaatcatcggggaagagaatgggagcctctgggctattatgggactccggttcatgtattggtgaaa

SEQ ID NO: 160502 - DNA, 75 bp, Artificial Sequence
  Synthetic
aatgggagcctctgggctattatgggactccggttcatgtattggtgaaacgttaggggttgctgtgtgtgaatt

SEQ ID NO: 160503 - DNA, 75 bp, Artificial Sequence
  Synthetic
cgttaggggttgctgtgtgtgaatttctacaaacgggggcggcattggatgggccaggagttggtgagtccccag

SEQ ID NO: 160504 - DNA, 75 bp, Artificial Sequence
  Synthetic
tctacaaacgggggcggcattggatgggccaggagttggtgagtccccagccccttgtccctgatgaagaccgag

SEQ ID NO: 160505 - DNA, 75 bp, Artificial Sequence
  Synthetic
ctatccagccttcttctacgtagttgaggctatgatccacgggtttgaggaaaagtttgtcatgaacgtgccttt

SEQ ID NO: 160506 - DNA, 75 bp, Artificial Sequence
  Synthetic
atgatggagttctttggtaggtcaacatccgttgagagacccaggcaagggccgctctggcccgatctgagaccc

SEQ ID NO: 160507 - DNA, 75 bp, Artificial Sequence
  Synthetic
caggggccaggggataccgctcatatcactaagggcggtgcccaggtagaggagctcgcgatagtcccattcaat

SEQ ID NO: 160508 - DNA, 75 bp, Artificial Sequence
  Synthetic
tatcacaaacacaggcgaggaggggtagttgcagttcttcagcttaaaggccaggaacttgtagacaaactccag

SEQ ID NO: 160509 - DNA, 75 bp, Artificial Sequence
  Synthetic
ctgtctacttcgccatgcttcttacactactcacctacatgtcaaccgcctctaccctccccatgggatggcggc

SEQ ID NO: 160510 - DNA, 75 bp, Artificial Sequence
  Synthetic
aggaggggcaggagcaggaggggcaggaggggcaggaggggcaggagcaggaggggcaggagcaggaggaggggc

SEQ ID NO: 160511 - DNA, 75 bp, Artificial Sequence
  Synthetic
ctgaagtctgttaaccaggtcagtggttttgtttccttgatagagacacaaggactgccagccccgttggggagg

SEQ ID NO: 160512 - DNA, 75 bp, Artificial Sequence
  Synthetic
gcggcatactctcaagagaccctgacggccacttgctggttaagataaagggggtaccatggtcgatgaacaagt

SEQ ID NO: 160513 - DNA, 75 bp, Artificial Sequence
  Synthetic
gtcaaaatccatcaccgttgggaggcttgggtcctcaaggtaggagagataatcggaggccgccgaggccacctt

SEQ ID NO: 160514 - DNA, 75 bp, Artificial Sequence
  Synthetic
tgcccctggagaacacatgcgccccggagcatctctccacttccagagacccagagtcacacagaaatgacacaa

SEQ ID NO: 160515 - DNA, 75 bp, Artificial Sequence
  Synthetic
gagcaggaggggcaggagcaggaggggcaggaggggcaggagcaggaggggcaggaggggcaggagcaggagggg

SEQ ID NO: 160516 - DNA, 75 bp, Artificial Sequence
  Synthetic
gaggcggcgtccgcgggccgaggggatgtggccctgagtcagtcccgggctctgctctggcgcggcctcggctgg

SEQ ID NO: 160517 - DNA, 75 bp, Artificial Sequence
  Synthetic
gtccctgatgtccgccgtacacctgcgcacgtgcagggccgcattcttggaccggacgggcacgttgtggacaaa

SEQ ID NO: 160518 - DNA, 75 bp, Artificial Sequence
  Synthetic
cactagatctagggtgctatcggctgccacaatccgagcaatgacctgttttataatatcccttttcaaaaataa

SEQ ID NO: 160519 - DNA, 75 bp, Artificial Sequence
  Synthetic
tcggattcacgctttgcggcattggcgtcattctcaatctgggcggcgatagacggttccaggtcactaaagtgc

SEQ ID NO: 160520 - DNA, 75 bp, Artificial Sequence
  Synthetic
tcaggcctcacgatcttcaagagtctcgccatctacccaacagtcttcaggtctgacacccacgccttcgttctc

SEQ ID NO: 160521 - DNA, 75 bp, Artificial Sequence
  Synthetic
caggcctggccatgtcacgagacgcagcctccgggtccgtgcacctggacatacaggtggacagggccgaggagg

SEQ ID NO: 160522 - DNA, 75 bp, Artificial Sequence
  Synthetic
ccctggccactattctcttctttaaacgcctcgagaaagatgcagtgattcaggaggttcagcctcgcgtaggca

SEQ ID NO: 160523 - DNA, 75 bp, Artificial Sequence
  Synthetic
atctaccccagcctgttgtctggccacggccgttcgggcggcctccgccagggataggaggcgcttccagctctc

SEQ ID NO: 160524 - DNA, 75 bp, Artificial Sequence
  Synthetic
caggaggttcagcctcgcgtaggcagatggcgcaattatgggggcgagattggggtggatcataggcgagaaact

SEQ ID NO: 160525 - DNA, 75 bp, Artificial Sequence
  Synthetic
gctgaaggggggcgatggggcggaacgtgggtgcgtggcagctgcatcctctgtgtcagtggtggaggacagagg

SEQ ID NO: 160526 - DNA, 75 bp, Artificial Sequence
  Synthetic
gcgccaaaaagcggacgtcctcctcatctaccccagcctgttgtctggccacggccgttcgggcggcctccgcca

SEQ ID NO: 160527 - DNA, 75 bp, Artificial Sequence
  Synthetic
tagtggaggccgccggggtagaggacgtgaaagagccagggggaggagtcgtgaaagagccagggggagaggtcg

SEQ ID NO: 160528 - DNA, 75 bp, Artificial Sequence
  Synthetic
cttgtccttgtggcggtgtcccagaaactggtgccgaccccggtattaaaaacccagaagacctcaccttgccac

SEQ ID NO: 160529 - DNA, 75 bp, Artificial Sequence
  Synthetic
cactcccccttgtgattgccgcactgcctttccatttcctgctgcacttgcccaccacattcccacagcttgccc

SEQ ID NO: 160530 - DNA, 75 bp, Artificial Sequence
  Synthetic
catagggaaaagccagggagagcgatgtgggcgaggatgggctcaggcggccccagacacgcaatttgcccccct

SEQ ID NO: 160531 - DNA, 75 bp, Artificial Sequence
  Synthetic
ccgcctccaggtcaaattttccgtcgccgctctcggccagctggggaatttcagccagcatcttagcaccggcat

SEQ ID NO: 160532 - DNA, 75 bp, Artificial Sequence
  Synthetic
cacgagcgcaaacgagccaaaccccctgaccggaaaaagactgtccagctgccccctcacgaggagtggcgtaac

SEQ ID NO: 160533 - DNA, 75 bp, Artificial Sequence
  Synthetic
gccccctcacgaggagtggcgtaacagaggtggcacagaccgcgggcagaactccaaagatggaggagtttgtgc

SEQ ID NO: 160534 - DNA, 75 bp, Artificial Sequence
  Synthetic
aggtatatacccagctgcaataccctattccaccactaggttaataacctataggttattctaccattaaaacgg

SEQ ID NO: 160535 - DNA, 75 bp, Artificial Sequence
  Synthetic
agaggtggcacagaccgcgggcagaactccaaagatggaggagtttgtgccctggaccgtggacaatctgaaaag

SEQ ID NO: 160536 - DNA, 75 bp, Artificial Sequence
  Synthetic
aatacctccaagaaggtggcccagatggtgagcctgacgtgcccccgggagcgatagagcagggccccacagatg

SEQ ID NO: 160537 - DNA, 75 bp, Artificial Sequence
  Synthetic
acgggcagaaaactgataaggaccgcggagtttggccctccgcggtgtccggtggtcctcacacgtgccctcccc

SEQ ID NO: 160538 - DNA, 75 bp, Artificial Sequence
  Synthetic
accccggggtcagggtgatggaggcaggcgcaaaaaaggagggtggtttggaaagcatcgtggtcaaggaggttc

SEQ ID NO: 160539 - DNA, 75 bp, Artificial Sequence
  Synthetic
ctcgaggaccactgtcacaagaagatagtctatcatgctcaaggcatctgcctctggcacttccctgttagaggc

SEQ ID NO: 160540 - DNA, 75 bp, Artificial Sequence
  Synthetic
ttctttgaggactatgccctgctctgctactactgtctaaatgccccacgagcctggatctctagcctcatcacg

SEQ ID NO: 160541 - DNA, 75 bp, Artificial Sequence
  Synthetic
cgggtcgtagacgatggcctgttcctggtaggtatgtccggctattctcgcaatgttgctctcgaggggcacaaa

SEQ ID NO: 160542 - DNA, 75 bp, Artificial Sequence
  Synthetic
atcatcgggaaaggcggtgggatcatgaagcccccaggggagcgtggcccgtggatctgtgaaactcacagttta

SEQ ID NO: 160543 - DNA, 75 bp, Artificial Sequence
  Synthetic
gtccatctcaggagtctctatgtcaaaggtggtctgatagtattggctcctggcggtgtccagtgtgatggggga

SEQ ID NO: 160544 - DNA, 75 bp, Artificial Sequence
  Synthetic
tcgttatcccaatagaatgacctccaggtaccacccacctggtgacacaccttaatgaaacccaacgggctaaaa

SEQ ID NO: 160545 - DNA, 75 bp, Artificial Sequence
  Synthetic
aagccttcaaccggccagagcagctctttgcagagtaccgggagtggcaccgctcgcccatgggcaaatacgcgg

SEQ ID NO: 160546 - DNA, 75 bp, Artificial Sequence
  Synthetic
taaaatacttccccatggccggggggttggattccctcttcatgccctccaggattctggccattgacatccagc

SEQ ID NO: 160547 - DNA, 75 bp, Artificial Sequence
  Synthetic
tgaagcccccaggggagcgtggcccgtggatctgtgaaactcacagtttattttctccaaatcgctccttgcaac

SEQ ID NO: 160548 - DNA, 75 bp, Artificial Sequence
  Synthetic
agggaggtggcatgcaaaataactgactgcctgggcaagttcctcttttgctgcagacaccacccagtctggctc

SEQ ID NO: 160549 - DNA, 75 bp, Artificial Sequence
  Synthetic
ttgcccaggccaagctcaagatccacccaggggtggccatgaccgtggtcaggaccgatgagatcctctctgaaa

SEQ ID NO: 160550 - DNA, 75 bp, Artificial Sequence
  Synthetic
ctgcagacaccacccagtctggctctgaccagcaagatgctctccaccatggcccccgggtccaccgtggggacc

SEQ ID NO: 160551 - DNA, 75 bp, Artificial Sequence
  Synthetic
tttgaaggatgcgattaaggaccttgttatgacaaagcccgctcctacctgcaatatcaaggtgactgtgtgcag

SEQ ID NO: 160552 - DNA, 75 bp, Artificial Sequence
  Synthetic
ctttgcagagtaccgggagtggcaccgctcgcccatgggcaaatacgcggccgaatgtcttccttccctcgcttc

SEQ ID NO: 160553 - DNA, 75 bp, Artificial Sequence
  Synthetic
aactgggccatctcgtgccccttgaggatgccgctctggcgcatgagggcatccagccgcgccccctcgtccagg

SEQ ID NO: 160554 - DNA, 75 bp, Artificial Sequence
  Synthetic
cgccaggctcgcttttccgaagccactcgtccgcctactggttgtcggaggtggagaggcccgggggccttgtcc

SEQ ID NO: 160555 - DNA, 75 bp, Artificial Sequence
  Synthetic
atcctacagcgccttcctcagcggcatgacaagcctgctgctcgtcctgctgattctgctaacactggctggcat

SEQ ID NO: 160556 - DNA, 75 bp, Artificial Sequence
  Synthetic
ggagatgagggtgaggaagggcaggagtgatgtaacttgttaggagacgccctcaatcgtattaaaagccgtgta

SEQ ID NO: 160557 - DNA, 75 bp, Artificial Sequence
  Synthetic
ccctatataccaggtgggtggagctaggtaggattcagctaggttcctactggggtacccccctaccctacctta

SEQ ID NO: 160558 - DNA, 75 bp, Artificial Sequence
  Synthetic
aatgtcagccgccgggaggccagggtggacgcggtaacctttgaggtgcatcacgagatggcctccatcgacacc

SEQ ID NO: 160559 - DNA, 75 bp, Artificial Sequence
  Synthetic
tactgacatgggtatccacacccaagacttctttagcgtctttccggccgaggcctttggcaaccagcaagtcaa

SEQ ID NO: 160560 - DNA, 75 bp, Artificial Sequence
  Synthetic
acccctccttctacgagcacgaagatcctccactgccggttggataccagcttcccccgaatccacgcaacgtcc

SEQ ID NO: 160561 - DNA, 75 bp, Artificial Sequence
  Synthetic
gctctgggtgctgggaaaaatgattcaggagttctcgtctaccggtctctgccttttgacccagaacatgatgtt

SEQ ID NO: 160562 - DNA, 75 bp, Artificial Sequence
  Synthetic
atgacaagcctgctgctcgtcctgctgattctgctaacactggctggcatcttgtttatcatctttgtaagaaaa

SEQ ID NO: 160563 - DNA, 75 bp, Artificial Sequence
  Synthetic
caggagttctcgtctaccggtctctgccttttgacccagaacatgatgttcttgggcctgatgtgctccgtatgg

SEQ ID NO: 160564 - DNA, 75 bp, Artificial Sequence
  Synthetic
gtgtgcagggtgggtgtccaatgtggcagttttacctctttgtccccatactcctgctcggccgtcttgttaaag

SEQ ID NO: 160565 - DNA, 75 bp, Artificial Sequence
  Synthetic
tatgactaatgttaatggagctccaggactctgccacggccagcaggccacctgtgagattatcgtaacaccggt

SEQ ID NO: 160566 - DNA, 75 bp, Artificial Sequence
  Synthetic
gccggggcggctgattgcgggggctgctgctgagttggaggaggagaaagagtcgtggcggtgggggctgctgct

SEQ ID NO: 160567 - DNA, 75 bp, Artificial Sequence
  Synthetic
ggactctgccacggccagcaggccacctgtgagattatcgtaacaccggtcacggcagacgtggcttattttcaa

SEQ ID NO: 160568 - DNA, 75 bp, Artificial Sequence
  Synthetic
cctcggctgggacacgggacgtggtcggctggcaccaggcctggccatgtcacgagacgcagcctccgggtccgt

SEQ ID NO: 160569 - DNA, 75 bp, Artificial Sequence
  Synthetic
ttcgtgtttgagcgtagtagctatgacccccccttgttgaggcaaaactctaggcctgtggagcgctgctttgcc

SEQ ID NO: 160570 - DNA, 75 bp, Artificial Sequence
  Synthetic
tcagagggatttctgggttcgagggagctgcctgtggcagagggatgggtatttgcaaagggaggcgaggagatg

SEQ ID NO: 160571 - DNA, 75 bp, Artificial Sequence
  Synthetic
ctacaatcaggaggttgccgaggggctcatctatgaccattctcgcccggatgccgcctatgaataccggagcac

SEQ ID NO: 160572 - DNA, 75 bp, Artificial Sequence
  Synthetic
caggatgtggcaccctaagaggacgcaggcatacaaggttattacccagtccttgtatgcctggtgtccccttag

SEQ ID NO: 160573 - DNA, 75 bp, Artificial Sequence
  Synthetic
aggcatgcacacggccgtccaaggactgaaagccggctgctacctactggcggcagtcctgatcgtcctcctcac

SEQ ID NO: 160574 - DNA, 75 bp, Artificial Sequence
  Synthetic
cgcagcacataccccccgcctctcctgccatgaggacttatggcagtgtttactgttctgcttttactcttggac

SEQ ID NO: 160575 - DNA, 75 bp, Artificial Sequence
  Synthetic
tggggattactggagggggaaggcgagctgctgaaggggggcgatggggcggaacgtgggtgcgtggcagctgat

SEQ ID NO: 160576 - DNA, 75 bp, Artificial Sequence
  Synthetic
atgccgcctatgaataccggagcactgtgaatccctgggcatctcagctgggttctctgggcgacatcatgtaca

SEQ ID NO: 160577 - DNA, 75 bp, Artificial Sequence
  Synthetic
cccaggcctctacagcccctgccgggcatttttcaacaaggaggagcttctgcgcaacaacagggggctctacaa

SEQ ID NO: 160578 - DNA, 75 bp, Artificial Sequence
  Synthetic
gcctgatatgcaacgtcaccttcaccggactcatttgcgccttctcctggtttatgctgtccctgccgctgctct

SEQ ID NO: 160579 - DNA, 75 bp, Artificial Sequence
  Synthetic
cagagggaggcggcggccggaggtgggcttcttgtgggggctatctttgcccaatccctttttcctcttgggagt

SEQ ID NO: 160580 - DNA, 75 bp, Artificial Sequence
  Synthetic
cttcaggcccggggttagtgatgaaacaggcaactccggggctgatcaggttaataaggagccgtccttattctt

SEQ ID NO: 160581 - DNA, 75 bp, Artificial Sequence
  Synthetic
agcggcggcggcggcccagacagaggagaggcggaggcacacacgtaccccccttatctctcggcggctgccgca

SEQ ID NO: 160582 - DNA, 75 bp, Artificial Sequence
  Synthetic
acacagaggtgcagtttgtagtgattgctggcactgacgtgtttctggagcagccctgcagctttctgcaggagg

SEQ ID NO: 160583 - DNA, 75 bp, Artificial Sequence
  Synthetic
gcccgctactacccaggccccgccgcctgtttggccctgttgctcattatactatacgcctggagcttcagccat

SEQ ID NO: 160584 - DNA, 75 bp, Artificial Sequence
  Synthetic
cgcccgcccaccacctgtcttcacccccgcacccaggcggcttccgcaggggggagcagacaccccacctcccct

SEQ ID NO: 160585 - DNA, 75 bp, Artificial Sequence
  Synthetic
cagccctgcagctttctgcaggaggcattccccgcactctcagcctcctcccgggcactcatcgatgagtttatg

SEQ ID NO: 160586 - DNA, 75 bp, Artificial Sequence
  Synthetic
cagagtctccctgcgacccccttaacccggcctacgtctccgcagacacccaggagccgctcaactacatccccg

SEQ ID NO: 160587 - DNA, 75 bp, Artificial Sequence
  Synthetic
cggagagttgtattggggccgcaccgtcgcccgccccccaactctcaccttgcccgtcgacgagctccggccatg

SEQ ID NO: 160588 - DNA, 75 bp, Artificial Sequence
  Synthetic
agcctctatatctaaaggcctttcctcacaatacaaatgttactaacgtctgccctctggagacctgctatgtgg

SEQ ID NO: 160589 - DNA, 75 bp, Artificial Sequence
  Synthetic
cctgtttggccctgttgctcattatactatacgcctggagcttcagccattttatggactctctcaagaaccagg

SEQ ID NO: 160590 - DNA, 75 bp, Artificial Sequence
  Synthetic
acatacacacccgccatggacctaaatccggaacagatcacagtcacccccagaagcccctcggttctcgccgcc

SEQ ID NO: 160591 - DNA, 75 bp, Artificial Sequence
  Synthetic
ccccgggggtgtgacctaggccggggatggggatgaagaggggagggctggaggccggggccgcggaggccgggg

SEQ ID NO: 160592 - DNA, 75 bp, Artificial Sequence
  Synthetic
agtacgagatgtcacgttgtgttgtctttcctcccacccctgtcctggctgtggcaaatgcgaccctcatagaga

SEQ ID NO: 160593 - DNA, 75 bp, Artificial Sequence
  Synthetic
gggacagtaccacaagctccggctgcccgtctcggcctacgaggccctggccgtggccaggtacgggctggtggg

SEQ ID NO: 160594 - DNA, 75 bp, Artificial Sequence
  Synthetic
ggatgtgaaagatcgagagggcagtggcctgaggttatacggtattattcgccgttcaaacggtagcatgacggg

SEQ ID NO: 160595 - DNA, 75 bp, Artificial Sequence
  Synthetic
ccaagatgcaacagaggattggctgcatcttacccctggcttccactcacgggacgcagaatgtgcagggattgg

SEQ ID NO: 160596 - DNA, 75 bp, Artificial Sequence
  Synthetic
tcatagcctcgactacgtagaagaaggctggataggcagtgtcataggcagtatcctgcacagtctcaataacgg

SEQ ID NO: 160597 - DNA, 75 bp, Artificial Sequence
  Synthetic
catcttacccctggcttccactcacgggacgcagaatgtgcagggattgggcttgggtcaggtgtactctctaga

SEQ ID NO: 160598 - DNA, 75 bp, Artificial Sequence
  Synthetic
ggggccgccctctccgtcctccagaattttacagcccggccaccattctaagacccaaagtgagggggcctgaga

SEQ ID NO: 160599 - DNA, 75 bp, Artificial Sequence
  Synthetic
tgctttccaaagttcaagcagtaaccgcagtccatgcaaaacacctggcggccccgaatccgggcagtgctgccg

SEQ ID NO: 160600 - DNA, 75 bp, Artificial Sequence
  Synthetic
tggccgtgctggatgaggttagcgtggacagtttgatactcaccaagattgttccaggtcagacctacgccatta

SEQ ID NO: 160601 - DNA, 75 bp, Artificial Sequence
  Synthetic
ctggaccctactactattctctcgtttaaacgagagaagagagcggcgagagcagactccgaatatccccaaagt

SEQ ID NO: 160602 - DNA, 75 bp, Artificial Sequence
  Synthetic
gttccaggtcagacctacgccattaagaacaagtaccagccctttttccagtggcatgggaccgggagcctcagt

SEQ ID NO: 160603 - DNA, 75 bp, Artificial Sequence
  Synthetic
ctaaacaggaggagaacaggtgaggctcgtcgcgggcgtcctctggagcttggcgttgctgacagatggagcaaa

SEQ ID NO: 160604 - DNA, 75 bp, Artificial Sequence
  Synthetic
tgcacgcaagtgtactgggcccctggtgcccccacgtactgcaggatgtcgtgcgcataggtgctgactctgaca

SEQ ID NO: 160605 - DNA, 75 bp, Artificial Sequence
  Synthetic
gccctctccccggcatccctgccaatgtaaatatcataaagggggtgcagctccagccgcagctctgtcaccccc

SEQ ID NO: 160606 - DNA, 75 bp, Artificial Sequence
  Synthetic
accagatcctgcagcgttccctgcagctgggactcttcctgggcctcctggatgatggcctccagtcgggagagg

SEQ ID NO: 160607 - DNA, 75 bp, Artificial Sequence
  Synthetic
agcatgccaccgtgaagttagagtccaatgatgtggacattgttttccccatggtgctgcctacgcccatagcag

SEQ ID NO: 160608 - DNA, 75 bp, Artificial Sequence
  Synthetic
tatgagttccgttgttggaaggctacggccaagggcagttgtccatccccgggagtgtatccccggcccaactcg

SEQ ID NO: 160609 - DNA, 75 bp, Artificial Sequence
  Synthetic
gccagcgcgcctcagggtctggacgtggagtttgcagtcctcagcgccctcaaggccagcaccttcgaccgcagg

SEQ ID NO: 160610 - DNA, 75 bp, Artificial Sequence
  Synthetic
atgatggcccccgcgtagatgtcgcagatgtagaggatgaactgggccaccccgttgtaactgccgtgcaggacc

SEQ ID NO: 160611 - DNA, 75 bp, Artificial Sequence
  Synthetic
cgaggaggaagagacttcacagagcagcagctacactctggggtctcaggcctcccagtctatccaggaggagga

SEQ ID NO: 160612 - DNA, 75 bp, Artificial Sequence
  Synthetic
tggagtttgcagtcctcagcgccctcaaggccagcaccttcgaccgcaggaccccctgccgggtctcggtggaga

SEQ ID NO: 160613 - DNA, 75 bp, Artificial Sequence
  Synthetic
ctcgtcgcgggcgtcctctggagcttggcgttgctgacagatggagcaaacggctctggcctctgtccgcaaagt

SEQ ID NO: 160614 - DNA, 75 bp, Artificial Sequence
  Synthetic
catgggaggcgcggcgacgagcaggatagcaggacgggggggctggcgaagattcccaaccgggggatcgctgaa

SEQ ID NO: 160615 - DNA, 75 bp, Artificial Sequence
  Synthetic
ccttctggcagtgggggtcaaacaagtagaaggagccatctgtctcgatgatgatggcccccgcgtagatgtcgc

SEQ ID NO: 160616 - DNA, 75 bp, Artificial Sequence
  Synthetic
acagtgtgtgtcacgtggccacgtggctgcaagacaagcacgggtgtcagatctttgaggccaacgtggatgcca

SEQ ID NO: 160617 - DNA, 75 bp, Artificial Sequence
  Synthetic
ccctcaggaccacggagctgggcacgtccgtcaactgggccatctcgtgccccttgaggatgccgctctggcgca

SEQ ID NO: 160618 - DNA, 75 bp, Artificial Sequence
  Synthetic
tgagggcatccagccgcgccccctcgtccaggacctcgtccagctcagggcgggaggtcagggggcggccggcca

SEQ ID NO: 160619 - DNA, 75 bp, Artificial Sequence
  Synthetic
gctgattgtgtggctgacggtgccgtgttccaccgccacttgttcatcgaccatggtaccccctttatcttaacc

SEQ ID NO: 160620 - DNA, 75 bp, Artificial Sequence
  Synthetic
tgctgagcagagacacatagaaggtcttgttgggtattatcttgtggacattgttgaagaaggagagctgggtgg

SEQ ID NO: 160621 - DNA, 75 bp, Artificial Sequence
  Synthetic
ctctcggtccggcgtgaagacagctcctggccctcctaccaggccctggccttcgatatcgagtgtttgggggag

SEQ ID NO: 160622 - DNA, 75 bp, Artificial Sequence
  Synthetic
cttcgatatcgagtgtttgggggaggagggcttccccacggccaccaacgaggctgacctgatcctgcagatatc

SEQ ID NO: 160623 - DNA, 75 bp, Artificial Sequence
  Synthetic
aatttcatcacggagctggaatacaacaacacctacgaggcccccctgagctccaagattacggccgttgtcgtg

SEQ ID NO: 160624 - DNA, 75 bp, Artificial Sequence
  Synthetic
gcggcggaagcaccaccgcttgcctggcccacctccctcttttcactcctcttcaccctgagatacagcacgacg

SEQ ID NO: 160625 - DNA, 75 bp, Artificial Sequence
  Synthetic
aggctgacctgatcctgcagatatcctgcgtcctctggtcgacaggggaggaggccgggcgctataggcgcatcc

SEQ ID NO: 160626 - DNA, 75 bp, Artificial Sequence
  Synthetic
tgacggccacttgctggttaagataaagggggtaccatggtcgatgaacaagtggcggtggaacacggcaccgtc

SEQ ID NO: 160627 - DNA, 75 bp, Artificial Sequence
  Synthetic
catagagggggttgaggtctacgagttcccatcggagctggacatgctctacgccttcttccagctcatcagaga

SEQ ID NO: 160628 - DNA, 75 bp, Artificial Sequence
  Synthetic
gtcttttataaggctccggccccacgacctcgggagggacgggcctctaccttccacgacttcaccgtcccggcg

SEQ ID NO: 160629 - DNA, 75 bp, Artificial Sequence
  Synthetic
acgccttcttccagctcatcagagacctcagcgtggagattgtgaccggctacaacgtggccaactttgactggc

SEQ ID NO: 160630 - DNA, 75 bp, Artificial Sequence
  Synthetic
actaagcccccgttgctcgccttgcctgcctcaccatgacacactaagcccctgctaatccatgagccccgcctt

SEQ ID NO: 160631 - DNA, 75 bp, Artificial Sequence
  Synthetic
cctccgcctctcctctgtctgggccgccgccgccgcttgcccgccttgaaggagagggggtagtccgcggactgc

SEQ ID NO: 160632 - DNA, 75 bp, Artificial Sequence
  Synthetic
cgcgctcacgctgccagggaacattgttgtggagagctcctccctccccacctttgagagaatcaacaagacatt

SEQ ID NO: 160633 - DNA, 75 bp, Artificial Sequence
  Synthetic
ggagagggggtagtccgcggactgcgtctgcgggggcaggaggtctcaaccttctgggctcgggccgcggtgtcg

SEQ ID NO: 160634 - DNA, 75 bp, Artificial Sequence
  Synthetic
gcggtggggcggggaggacgccttgtcgccccccttctggtccggggtcttacgcggctggcggcggcagccgcc

SEQ ID NO: 160635 - DNA, 75 bp, Artificial Sequence
  Synthetic
tacaacgtggccaactttgactggccctacattctggacagagccaggcacatctacagcatcaacccagcctct

SEQ ID NO: 160636 - DNA, 75 bp, Artificial Sequence
  Synthetic
gtctgcgggggcaggaggtctcaaccttctgggctcgggccgcggtgtcgatatccgatggcctttccctgtctt

SEQ ID NO: 160637 - DNA, 75 bp, Artificial Sequence
  Synthetic
acggaccaatgccaaagctgaagaacggactgcggagatggatgacaccatggcctcgtcaggagggcagagagg

SEQ ID NO: 160638 - DNA, 75 bp, Artificial Sequence
  Synthetic
attcttttcattaacgggggaaggaaaggcctgctgtcatcgggatccgcaggggcgccgaaagcaggaatgcgg

SEQ ID NO: 160639 - DNA, 75 bp, Artificial Sequence
  Synthetic
tggcctcgtcaggagggcagagaggggcaccaatttccgcggacctactctctctctcctcgttaactggtagaa

SEQ ID NO: 160640 - DNA, 75 bp, Artificial Sequence
  Synthetic
ggcaccaatttccgcggacctactctctctctcctcgttaactggtagaatggcagccatggccccctcctggat

SEQ ID NO: 160641 - DNA, 75 bp, Artificial Sequence
  Synthetic
gaatggggaggagtccaaaacggcacgccacctgccgtggggcggtggtgacaggtcccggctggcccggcgctt

SEQ ID NO: 160642 - DNA, 75 bp, Artificial Sequence
  Synthetic
cgaggccttcctggccgggatggcggcagagatggaggccctggccgctcgtgtgcaggaggcggcggggagccg

SEQ ID NO: 160643 - DNA, 75 bp, Artificial Sequence
  Synthetic
catgtctacttgcctcctgtggtggcagagcttggccctgggcccaacccccgccttgggagcctgtaggggcca

SEQ ID NO: 160644 - DNA, 75 bp, Artificial Sequence
  Synthetic
gctcgcgttcctgccgttacccaggagaatggccgcgagttttttggcggggaggatgcggaatggcgggggcgt

SEQ ID NO: 160645 - DNA, 75 bp, Artificial Sequence
  Synthetic
gcctccacgctgtttcatgctgagctttgttttcatctattactgctgctatttggcgttcctggccctactcgc

SEQ ID NO: 160646 - DNA, 75 bp, Artificial Sequence
  Synthetic
gatctgctaaaccatttcgtgatccacgtggaggtggcagagattgccaagatcgctcacatcccctgcaggcgg

SEQ ID NO: 160647 - DNA, 75 bp, Artificial Sequence
  Synthetic
ttgtcccacgggtgagggggaatcgtcggttagggccggcacgaggtggtgggtctggacccgggccgtgcgagc

SEQ ID NO: 160648 - DNA, 75 bp, Artificial Sequence
  Synthetic
gatcgctcacatcccctgcaggcgggtgctggacgatgggcagcagatccgcgtgttctcctgcctcctggcggc

SEQ ID NO: 160649 - DNA, 75 bp, Artificial Sequence
  Synthetic
cccagctttatgccggtgggggccaaggtgcttcggggtaagggccgcgattttggggtgcccctgtcttatggg

SEQ ID NO: 160650 - DNA, 75 bp, Artificial Sequence
  Synthetic
gtggtggaggcgtagtccaggaggccgtgaaggagaggctcgtctgaggtgaactctatgttgtcgcgaatcagc

SEQ ID NO: 160651 - DNA, 75 bp, Artificial Sequence
  Synthetic
ctgagacccccaagatttgtcatgcacacctgcacacctgttggtattgggtttctattcttgagtgtgaaagtt

SEQ ID NO: 160652 - DNA, 75 bp, Artificial Sequence
  Synthetic
tttacacccttatcccggccgtggtcattaacaatgtgacttattaccccaacaacacggacagccatgggggtc

SEQ ID NO: 160653 - DNA, 75 bp, Artificial Sequence
  Synthetic
tgttttaataggggtggtctctggcgcggcaggatgatggtcgaggacgtccaccagggccttgcagatgctctt

SEQ ID NO: 160654 - DNA, 75 bp, Artificial Sequence
  Synthetic
atggtggatttgaggcggctgcccttcatgtagctgcactttttgagtctgggtgcccaaatctacaggctgtga

SEQ ID NO: 160655 - DNA, 75 bp, Artificial Sequence
  Synthetic
gcctagatacaggatgtcgtccatgctgaggggaggtggggtgtctgctcccccctgcggaagccgcctgggtgc

SEQ ID NO: 160656 - DNA, 75 bp, Artificial Sequence
  Synthetic
gccagtactcgggcatagaagacagcggcggggctccgctccccatcccaggcaacctccagcggcagttcgccc

SEQ ID NO: 160657 - DNA, 75 bp, Artificial Sequence
  Synthetic
tgtgtcctggggctggagcccaaaagtcgttaaagatgccgctgatggtgtgggagctatgcctcccgtcgactg

SEQ ID NO: 160658 - DNA, 75 bp, Artificial Sequence
  Synthetic
ccccctgcggaagccgcctgggtgcgggggtgaagacaggtggtgggcgggcgtctcgccggactatggcctcgg

SEQ ID NO: 160659 - DNA, 75 bp, Artificial Sequence
  Synthetic
gggggcgtctaccactttgtaaagaagcacgtgcacgagtccttcttggctagtctgttgacctcctggctggcc

SEQ ID NO: 160660 - DNA, 75 bp, Artificial Sequence
  Synthetic
aggcgccttgtacaagatatgcagagggtcctggcgagtgctgtggtggtgatgcatcatcactgccactatgag

SEQ ID NO: 160661 - DNA, 75 bp, Artificial Sequence
  Synthetic
ccagcctctacccgagcatcattcaggctcataatctctgttattctaccatgataacgccgggagaagagcaca

SEQ ID NO: 160662 - DNA, 75 bp, Artificial Sequence
  Synthetic
acatattatgtctttgatggggtgggccccgagtttggtaccattcctacgccctgcttcaaggatgtgttggcc

SEQ ID NO: 160663 - DNA, 75 bp, Artificial Sequence
  Synthetic
cgctcgttgagctcctcgagatccggacgcaggggctcgctggtgtgggcccagagggggtgatccgcgatgccc

SEQ ID NO: 160664 - DNA, 75 bp, Artificial Sequence
  Synthetic
cttggttcttgttgcatttgtgtaatttcaccaccagcccgcatttcccagaagcactgaggtttacggccggtg

SEQ ID NO: 160665 - DNA, 75 bp, Artificial Sequence
  Synthetic
cggctctccctgagggccggcaccaggaggcgccttctgagggtggccgtgtcggccgtggccagggcccacctg

SEQ ID NO: 160666 - DNA, 75 bp, Artificial Sequence
  Synthetic
gctggaggcatgaaacggaagcaatgtcgtgttgaccggctcacggaccgctcattccctgcatacctcgaggag

SEQ ID NO: 160667 - DNA, 75 bp, Artificial Sequence
  Synthetic
atcgccgagacggtgacgctgcagggccgcacgatgttggagcgggccaaggccttcgtggaggccctgagcccc

SEQ ID NO: 160668 - DNA, 75 bp, Artificial Sequence
  Synthetic
aaagaggccgggaggccttctgcgtccagacgcgatggcacacgccagagacaaggcaggcgctgtcctggccat

SEQ ID NO: 160669 - DNA, 75 bp, Artificial Sequence
  Synthetic
ctcctcttccgtcgccagagggatctgcaccctcccggtctctgcgtcgtacaggagcgggcgggagcacagcct

SEQ ID NO: 160670 - DNA, 75 bp, Artificial Sequence
  Synthetic
tcgagtgccgggggttttcagagagcgagaccctgcgctttgccgaggccctggccgcccacaccacccggagcc

SEQ ID NO: 160671 - DNA, 75 bp, Artificial Sequence
  Synthetic
attggaaaaggggcgttccagtggcctcggcgttgttgaaggagctggcgtgtatcagaaagtccccaaagactg

SEQ ID NO: 160672 - DNA, 75 bp, Artificial Sequence
  Synthetic
cacaacggctgtgactacaccatcaccatcggcatcgggtcctagcacaaaccagtctacgaccttgaccacgac

SEQ ID NO: 160673 - DNA, 75 bp, Artificial Sequence
  Synthetic
atgctgattacaaagaagagatatgtgggggtgctgacggacggcaagaccctgatgaagggggtggagctcgtc

SEQ ID NO: 160674 - DNA, 75 bp, Artificial Sequence
  Synthetic
cagcgcccctataaccacgactgctctcctgagcaccaacacaaccacggtgacatccactgggacaactgtcac

SEQ ID NO: 160675 - DNA, 75 bp, Artificial Sequence
  Synthetic
tgttcctcgaccagcccacgaacgtcccgcgcgaattcggacccccgggaaatatttagacgccgggccggaggg

SEQ ID NO: 160676 - DNA, 75 bp, Artificial Sequence
  Synthetic
cctgatgaagggggtggagctcgtccggaagacggcctgcaagtttgtgcagacacgctgccggcgcgtgctcga

SEQ ID NO: 160677 - DNA, 75 bp, Artificial Sequence
  Synthetic
gctgagatagtctcggagatgatgcctgagacctctcggacggcgtccatgatcctaaggactgcgtcgtgggac

SEQ ID NO: 160678 - DNA, 75 bp, Artificial Sequence
  Synthetic
ctgagacctctcggacggcgtccatgatcctaaggactgcgtcgtgggacgacagcccccaggggcccccgccct

SEQ ID NO: 160679 - DNA, 75 bp, Artificial Sequence
  Synthetic
aaggaggcggccagcctcctctcccaccggcccttccaagagtcatttacacaagggctacctgtgggctttttg

SEQ ID NO: 160680 - DNA, 75 bp, Artificial Sequence
  Synthetic
ggtcccactacaaaaactctgtgttctgctgcaaattttagatcagatggcatagagacaaggacaccgaagacc

SEQ ID NO: 160681 - DNA, 75 bp, Artificial Sequence
  Synthetic
cccgcgcgaattcggacccccgggaaatatttagacgccgggccggagggggcagcagccccgcgattcggcgtt

SEQ ID NO: 160682 - DNA, 75 bp, Artificial Sequence
  Synthetic
gatcctaaggactgcgtcgtgggacgacagcccccaggggcccccgccctcttcgtcttctgcaccctcggctcc

SEQ ID NO: 160683 - DNA, 75 bp, Artificial Sequence
  Synthetic
ggtccccatgggggagctctgcttttcaacggagctcagccgcaagctctcagcctacaagagcacccagatgcc

SEQ ID NO: 160684 - DNA, 75 bp, Artificial Sequence
  Synthetic
tctaagttgagggggcgcagtccgaccgcctggggggactccccaggcatcggaggggccccgtcatagatctcc

SEQ ID NO: 160685 - DNA, 75 bp, Artificial Sequence
  Synthetic
cggaggggccccgtcatagatctcccagacggtggcgtatatgagctcgagaggacggcgggcccgggtcagctc

SEQ ID NO: 160686 - DNA, 75 bp, Artificial Sequence
  Synthetic
ggcagaggtggacggggggctcgcccgcgtgacgcgtcagttgctgctgtctggggacgaccccgctgcccgcct

SEQ ID NO: 160687 - DNA, 75 bp, Artificial Sequence
  Synthetic
gtcgagcgcaacgaggaactgccccagatccacgaccgcatccagtacgtctttgtggagcccaaggggggagtg

SEQ ID NO: 160688 - DNA, 75 bp, Artificial Sequence
  Synthetic
gggtgggagagcccacgcagacgatgcagggaatgcggccccggcggtagagtggggtgcgcagccaggcgttga

SEQ ID NO: 160689 - DNA, 75 bp, Artificial Sequence
  Synthetic
gggggaagggagggccaggtcgctgccgaaggagaccagccagcgcagggcggccagagagcgggttttgggcag

SEQ ID NO: 160690 - DNA, 75 bp, Artificial Sequence
  Synthetic
aagggggcgagaaagacggagatggccgaggacccggcctacgccgagcggcacggcgttcccgtggccgtggat

SEQ ID NO: 160691 - DNA, 75 bp, Artificial Sequence
  Synthetic
ctcgttggagaggacccggcgaagggcgggccagatttggaactcgatgaaggcggccgggaagaaggggctgcg

SEQ ID NO: 160692 - DNA, 75 bp, Artificial Sequence
  Synthetic
gcgggccagatttggaactcgatgaaggcggccgggaagaaggggctgcggacataggccggatccgcgcgcgcc

SEQ ID NO: 160693 - DNA, 75 bp, Artificial Sequence
  Synthetic
gacataggccggatccgcgcgcgccgtttggccggccctcagggaccggcagtatgcctcgacgtctgtccgcgg

SEQ ID NO: 160694 - DNA, 75 bp, Artificial Sequence
  Synthetic
gggccagagactcccgagtagagccccctgggcttggttcgcctgaactcggcggcaatgtcggagagtaccggc

SEQ ID NO: 160695 - DNA, 75 bp, Artificial Sequence
  Synthetic
ccctgggcttggttcgcctgaactcggcggcaatgtcggagagtaccggccagtatttggccaggtcccgccgct

SEQ ID NO: 160696 - DNA, 75 bp, Artificial Sequence
  Synthetic
cggagccggggccggggcctgccacaggcggctgtagcggacccatagcagagacctgaggagttcggatgaaag

SEQ ID NO: 160697 - DNA, 75 bp, Artificial Sequence
  Synthetic
gacaaactccaggtggtaaatctgtccgtggcgcagcttcacggtgcagaggggcgttagggggcgcggtggttg

SEQ ID NO: 160698 - DNA, 75 bp, Artificial Sequence
  Synthetic
gagacctgaggagttcggatgaaaggtcccccgccacctgctcatactcggccgcgggaggagggacgatgaaga

SEQ ID NO: 160699 - DNA, 75 bp, Artificial Sequence
  Synthetic
aaacgtaaaccgcggcccggcttcctcataggtcagagcgacatagaggcgcgcatcggcggggcacggctgcag

SEQ ID NO: 160700 - DNA, 75 bp, Artificial Sequence
  Synthetic
tgcgcagaggggttacggcgtcccaagggtccgccgccgcccccacacccacagccgtcgcggcgggggcggcgg

SEQ ID NO: 160701 - DNA, 75 bp, Artificial Sequence
  Synthetic
tggctcccgtgaccaggcagtccatcgtgtggtggaggcagctaacgctggtgctcttgccagcccccgccgttc

SEQ ID NO: 160702 - DNA, 75 bp, Artificial Sequence
  Synthetic
gcccagccccccgacgaagcatcctccaccgccacccccggcgccgccggagagccacgcgtccagatccacaaa

SEQ ID NO: 160703 - DNA, 75 bp, Artificial Sequence
  Synthetic
cgggcgtagaggggccgctggtgcgccgggctcgtctgtccacggcctcggcctccgccctcaggtaggccgccc

SEQ ID NO: 160704 - DNA, 75 bp, Artificial Sequence
  Synthetic
gcctccgccctcaggtaggccgcccgggccacacgggcgaagcggctcgtggggctcgcggtgggcagcagtcgg

SEQ ID NO: 160705 - DNA, 75 bp, Artificial Sequence
  Synthetic
ttccaatagaataacttcccggtctgtggccggggctggataaggggggtgattcctagaggcgatgagactggc

SEQ ID NO: 160706 - DNA, 75 bp, Artificial Sequence
  Synthetic
cagatccaggcaggccagccccagatccaggagcctggagaactcccgctccccaagggccggcaacgtcagcac

SEQ ID NO: 160707 - DNA, 75 bp, Artificial Sequence
  Synthetic
ctcctccaagtgggggtgcagggtgacgatcgaggagacgagggccacgacgcaggtggcgatctggagggcagc

SEQ ID NO: 160708 - DNA, 75 bp, Artificial Sequence
  Synthetic
gggatgttttcacctattccaccgagactcccgacgacccctctcccgtcccctttagggacatcctgcgaccgg

SEQ ID NO: 160709 - DNA, 75 bp, Artificial Sequence
  Synthetic
ctcgagccacctccaccgcgagcgggacacccggggcacagaggccagcatcatggcgtagtcccccgccacggt

SEQ ID NO: 160710 - DNA, 75 bp, Artificial Sequence
  Synthetic
gtgtgcctgtacctgatgggcgtgttttgtctggtactcctgctgattatcatcctcctcattaccatgggcccc

SEQ ID NO: 160711 - DNA, 75 bp, Artificial Sequence
  Synthetic
gggccacacgggcgaagcggctcgtggggctcgcggtgggcagcagtcggaaaaagtgcagggcaaagcccgata

SEQ ID NO: 160712 - DNA, 75 bp, Artificial Sequence
  Synthetic
ctcgttgagcccggccgagagcagaaccgtggccacctgctcgatggcggctggagagaaggatgcccggctccc

SEQ ID NO: 160713 - DNA, 75 bp, Artificial Sequence
  Synthetic
ggcgttatccgaataaatgactgccaggagctgccacccggtttaataattctgagtccgggcaccgtccctggc

SEQ ID NO: 160714 - DNA, 75 bp, Artificial Sequence
  Synthetic
agtaggagtcggcggcggcggcgctgaggcgggcggaagctacactggccaggggtcctaccgttttcgttaagc

SEQ ID NO: 160715 - DNA, 75 bp, Artificial Sequence
  Synthetic
gtctgggacgccgtaagtctggtcccagagcagggcctcgtacacatagtcgtaaaagagggcccctgagggctc

SEQ ID NO: 160716 - DNA, 75 bp, Artificial Sequence
  Synthetic
aaggccaggacgggcacagccgcgacggggggcgtttgtcccccgctggcctccgcgtacacgcccaggatctct

SEQ ID NO: 160717 - DNA, 75 bp, Artificial Sequence
  Synthetic
ctccgcgtacacgcccaggatctctaccgcccgccgccgggccaggggcagtgaggccaccacgctggaaagtga

SEQ ID NO: 160718 - DNA, 75 bp, Artificial Sequence
  Synthetic
agccatctccccagcgtcgttttcgccgcgttaaaagcgtagaatgacagcccctcccgcgggaaggcgtcccac

SEQ ID NO: 160719 - DNA, 75 bp, Artificial Sequence
  Synthetic
ccgcgttaaaagcgtagaatgacagcccctcccgcgggaaggcgtcccaccgggccagataagtgtcggccacca

SEQ ID NO: 160720 - DNA, 75 bp, Artificial Sequence
  Synthetic
cgggccagataagtgtcggccaccagctcttccacgaaggcaaaggtggccgttgggccagagaccgcgagcacc

SEQ ID NO: 160721 - DNA, 75 bp, Artificial Sequence
  Synthetic
cgttgggccagagaccgcgagcacctccccgctgccctcttcgatgatgcgccggtacgtggccgccagggcccg

SEQ ID NO: 160722 - DNA, 75 bp, Artificial Sequence
  Synthetic
ggtctctgcgatgagccgagagccgtccagcggatcgtcggtggccggagaggctgtcgtggggggcagtgagga

SEQ ID NO: 160723 - DNA, 75 bp, Artificial Sequence
  Synthetic
tccagcggatcgtcggtggccggagaggctgtcgtggggggcagtgaggaggccagcacgtccagggccgcctcc

SEQ ID NO: 160724 - DNA, 75 bp, Artificial Sequence
  Synthetic
aggctgtcgtggggggcagtgaggaggccagcacgtccagggccgcctccagatggccgaggccgaagctgcgcc

SEQ ID NO: 160725 - DNA, 75 bp, Artificial Sequence
  Synthetic
gtagtaggcgtggtggcggaggaccgccgccgggtaagcgtggccgctcatgagggtgagagtatttaaaaaatc

SEQ ID NO: 160726 - DNA, 75 bp, Artificial Sequence
  Synthetic
gccgccgggtaagcgtggccgctcatgagggtgagagtatttaaaaaatcgcgcaccagcaccggctgggccaaa

SEQ ID NO: 160727 - DNA, 75 bp, Artificial Sequence
  Synthetic
catcccggctcaggcagggccccccggcccccacgagctcctcccctacgcccccgcccgtctttctccccccct

SEQ ID NO: 160728 - DNA, 75 bp, Artificial Sequence
  Synthetic
tctcccagtccaaagatccccagctccagaggcatcagcgcgcgcaggcgggcagcggggtcgtccccagacagc

SEQ ID NO: 160729 - DNA, 75 bp, Artificial Sequence
  Synthetic
ccagcgggacaagtgggagcctgaacaagtccagggcctggttaagactgtggtcaatcacctctatcactactt

SEQ ID NO: 160730 - DNA, 75 bp, Artificial Sequence
  Synthetic
caagtccagggcctggttaagactgtggtcaatcacctctatcactactttctgaatgagaatgtcatctccggg

SEQ ID NO: 160731 - DNA, 75 bp, Artificial Sequence
  Synthetic
gccccccgtccacctctgccaggggcggctgggcgtctgcccctccgctaccgccgccgctgtcactctccatag

SEQ ID NO: 160732 - DNA, 75 bp, Artificial Sequence
  Synthetic
agaagatccgctccatggagtctcagctgcaggcctccctgggtcccggcggcaacaacccagcggcgtcagccc

SEQ ID NO: 160733 - DNA, 75 bp, Artificial Sequence
  Synthetic
ctggaggccccctacgcggagtacgagcgggggctggccgggcttctggaaaaaagacgatcagccgaggctgcc

SEQ ID NO: 160734 - DNA, 75 bp, Artificial Sequence
  Synthetic
agcgggggctggccgggcttctggaaaaaagacgatcagccgaggctgccctgacggccatcgtgagcgagtacg

SEQ ID NO: 160735 - DNA, 75 bp, Artificial Sequence
  Synthetic
ggccctggtttcctttgtgttcccttgctgcctgatgctgtttaggggggcctcctccgagaaggtggtggatgt

SEQ ID NO: 160736 - DNA, 75 bp, Artificial Sequence
  Synthetic
gcttacccggcggcggtcctccgccaccacgcctactacctactccgggcggcctccttttccaggcgcagcttc

SEQ ID NO: 160737 - DNA, 75 bp, Artificial Sequence
  Synthetic
cggactcatttgcgccttctcctggtttatgctgtccctgccgctgctcttcctgggtgaggccgggagcctggg

SEQ ID NO: 160738 - DNA, 75 bp, Artificial Sequence
  Synthetic
cggacgccatgaaggtccaggggtccgtcgatcgccgccgtctgcaacgccgaatcgcggggctgctgccccctc

SEQ ID NO: 160739 - DNA, 75 bp, Artificial Sequence
  Synthetic
cgtgggctggttgaggaacacgcgcaggcctcctcgctgagtgcggcggccgtctggcgcgcagggctgctggcc

SEQ ID NO: 160740 - DNA, 75 bp, Artificial Sequence
  Synthetic
gctgtagccaaacgcatgagagagctatggatgtccacattgacaaccaagtgttgagtggcctcgggacccccc

SEQ ID NO: 160741 - DNA, 75 bp, Artificial Sequence
  Synthetic
tttggggactttctgatacacgccagctccttcaacaacgccgaggcaactggaacgccccttttccaattcaag

SEQ ID NO: 160742 - DNA, 75 bp, Artificial Sequence
  Synthetic
agagctttcaccggtggaactcgtgacagatgtctacgccaccctaggcatcgtggagatcatcgacgagctcta

SEQ ID NO: 160743 - DNA, 75 bp, Artificial Sequence
  Synthetic
acgcggtattcactcctctctccctgtttatcctaatgaatcacggccggggtgtagccgcccgggtcgaggcag

SEQ ID NO: 160744 - DNA, 75 bp, Artificial Sequence
  Synthetic
ggacccggaggctgcgtctcgtgacatggccaggcctggtgccagccgaccacgtcccgtgtcccagccgaggcc

SEQ ID NO: 160745 - DNA, 75 bp, Artificial Sequence
  Synthetic
ggtgtagccgcccgggtcgaggcaggtgggggcctgacgcggatggccaacctgctgtacgacagccccgcaacc

SEQ ID NO: 160746 - DNA, 75 bp, Artificial Sequence
  Synthetic
cacgtttaccagtgtgccagtgtactgcgaggagggccttccagagctctacaaccccttccacgtggccgccct

SEQ ID NO: 160747 - DNA, 75 bp, Artificial Sequence
  Synthetic
cgcgtgtttgctgctcggggcatgctgcccggacggcctagccatcggggcacgtttaccagtgtgccagtgtac

SEQ ID NO: 160748 - DNA, 75 bp, Artificial Sequence
  Synthetic
ctggctgacctggtcccggactttgggcggctggtggccgaccgccgcttccacaacttcatcacccctgtgggc

SEQ ID NO: 160749 - DNA, 75 bp, Artificial Sequence
  Synthetic
ccaagactccctgacggtggtggggggtgacgaggatggaaagggcatgtggtggcgccagcgtgcccaagaggg

SEQ ID NO: 160750 - DNA, 75 bp, Artificial Sequence
  Synthetic
ggatctggacgcgtggctctccggcggcgccgggggtggcggtggaggatgcttcgtcggggggctgggcctgca

SEQ ID NO: 160751 - DNA, 75 bp, Artificial Sequence
  Synthetic
gcgggtatagagcatatgccggtggccgcggcccaggtcgagcaccctaaaacgtatgacctcaagcaaattcta

SEQ ID NO: 160752 - DNA, 75 bp, Artificial Sequence
  Synthetic
ccgcggcccaggtcgagcaccctaaaacgtatgacctcaagcaaattctattggagataacgcaagaggagaata

SEQ ID NO: 160753 - DNA, 75 bp, Artificial Sequence
  Synthetic
gcttcgtcggggggctgggcctgcagccgtgccccgccgatgcgcgcctctatgtcgctctgacctatgaggaag

SEQ ID NO: 160754 - DNA, 75 bp, Artificial Sequence
  Synthetic
ggcgccgggggtggcggtggaggatgcttcgtcggggggctgggcctgcagccgtgccccgccgatgcgcgcctc

SEQ ID NO: 160755 - DNA, 75 bp, Artificial Sequence
  Synthetic
agaccgaccagggtcttgtactgggccaggggctcgaggaagacctcgcactccaccgggcaggtaaacatggtc

SEQ ID NO: 160756 - DNA, 75 bp, Artificial Sequence
  Synthetic
ctgctctcgatgattgagaatgccaagagcccctccataggcctctgccgggaggtgctgggtcgcctgaccctc

SEQ ID NO: 160757 - DNA, 75 bp, Artificial Sequence
  Synthetic
tctgggctgcagaatcagctctcccaaacgctcatcccagggaagctcaagaaacgcttcctaagttacctgcag

SEQ ID NO: 160758 - DNA, 75 bp, Artificial Sequence
  Synthetic
aaacgctcatcccagggaagctcaagaaacgcttcctaagttacctgcagaaattgaagaataacaacaacgatc

SEQ ID NO: 160759 - DNA, 75 bp, Artificial Sequence
  Synthetic
ttgcactccaagtgcaacaatctggactctctgtttctgtacaacggggccaggacgctgctgtccaccctggtc

SEQ ID NO: 160760 - DNA, 75 bp, Artificial Sequence
  Synthetic
actctctgtttctgtacaacggggccaggacgctgctgtccaccctggtcaagtaccacgacctggaggaggggg

SEQ ID NO: 160761 - DNA, 75 bp, Artificial Sequence
  Synthetic
cggttggaggaggtctgccttcaattaccgtggctctagcctccccgtggtggagattgacagcttttattccaa

SEQ ID NO: 160762 - DNA, 75 bp, Artificial Sequence
  Synthetic
aggcctttctggacactgcccccaacaaagagctcaagcgacagtatgagaagaagctgcggcagcttatggaga

SEQ ID NO: 160763 - DNA, 75 bp, Artificial Sequence
  Synthetic
gctgctgcgccggcggccaccacgggcgcacggggtcgcagcccgacggccgtggggaggcgggtggcggagggc

SEQ ID NO: 160764 - DNA, 75 bp, Artificial Sequence
  Synthetic
catcctggaccccatggtctcagaggccctgcacacattcgagatgggcaaccggctgacgctggagccagcgcg

SEQ ID NO: 160765 - DNA, 75 bp, Artificial Sequence
  Synthetic
cgaagtcaccctgggtcggagaatcgcagattgcgttgtggtagctctgcagccttccccccggtgttatattgt

SEQ ID NO: 160766 - DNA, 75 bp, Artificial Sequence
  Synthetic
cgtcctccagaccttgagacgcaagtgcctcgggagtgacacggtctcaaaaataattccctagaataaactgag

SEQ ID NO: 160767 - DNA, 75 bp, Artificial Sequence
  Synthetic
accggctgacgctggagccagcgcgcctagtggccttgcagaattttgctactcacagcaccttaaaggagacgg

SEQ ID NO: 160768 - DNA, 75 bp, Artificial Sequence
  Synthetic
ccgaatatctggaggtcttctctgacaaattctacgatgaggaattcttccagatgcaccgggatgagctggaga

SEQ ID NO: 160769 - DNA, 75 bp, Artificial Sequence
  Synthetic
cccgagtctctgctttcgcgcagagcccggcctacgagcgcatcgtctccagcggctacctgtcggccctgcgct

SEQ ID NO: 160770 - DNA, 75 bp, Artificial Sequence
  Synthetic
cccggcctacgagcgcatcgtctccagcggctacctgtcggccctgcgctactatgacacctatctgtatgtggg

SEQ ID NO: 160771 - DNA, 75 bp, Artificial Sequence
  Synthetic
aatctggatggtatgtttcttctgtgaccccgaggcagtcgatggtgtagagtgtggagacaatgtgtaaacgat

SEQ ID NO: 160772 - DNA, 75 bp, Artificial Sequence
  Synthetic
taaagtcgatgtaagtttgtgcctaataaatgacatagagattttaatgaagagaatcaatagcgtgttttattg

SEQ ID NO: 160773 - DNA, 75 bp, Artificial Sequence
  Synthetic
agcggctacctgtcggccctgcgctactatgacacctatctgtatgtggggcgcagcgggaagcaggagagtgtg

SEQ ID NO: 160774 - DNA, 75 bp, Artificial Sequence
  Synthetic
agagaatcaatagcgtgttttattgcatgtctcacaccatggggctggagagcctggaacgggccctggatctgc

SEQ ID NO: 160775 - DNA, 75 bp, Artificial Sequence
  Synthetic
agcctggaacgggccctggatctgctgggccgctttcggggcgtaagtcccatcccagacccgcgcctctacatc

SEQ ID NO: 160776 - DNA, 75 bp, Artificial Sequence
  Synthetic
ctacgcgggtctcagggcagccctgcagcgggccaggccggagattgagagtgacatggaggtgtttgattacta

SEQ ID NO: 160777 - DNA, 75 bp, Artificial Sequence
  Synthetic
caaaacctgtttcggcgccgcccgggggccagtctccgggtcaggtcgcggaccagggtcaacaggtggtcgtgg

SEQ ID NO: 160778 - DNA, 75 bp, Artificial Sequence
  Synthetic
aggagacacacgtggcttccagagaggcgcagcccagccctccgcagccgctgaagccaggctcgcggaagagcc

SEQ ID NO: 160779 - DNA, 75 bp, Artificial Sequence
  Synthetic
tgggcgagctgatggttctgcccaaccacggcaacccttccacggcagaggggacccacgtctcctgtaaccacc

SEQ ID NO: 160780 - DNA, 75 bp, Artificial Sequence
  Synthetic
cagcgggccaggccggagattgagagtgacatggaggtgtttgattactactttgagcacctaacctcccagacg

SEQ ID NO: 160781 - DNA, 75 bp, Artificial Sequence
  Synthetic
atgcctctacgccccagatgaaagtctatacggccacaaccgccgtgtcagctgtgtacgtgcctcagatagccg

SEQ ID NO: 160782 - DNA, 75 bp, Artificial Sequence
  Synthetic
tctggccagctgcatcctcaccacccccgacctcagctccgagtgggacgtgacccaggccctctataggcacct

SEQ ID NO: 160783 - DNA, 75 bp, Artificial Sequence
  Synthetic
aaagatggccatcagtaggcacccgggcccgcgtcgagccttcacccgaatgtgtctgcgggccacggtggcctc

SEQ ID NO: 160784 - DNA, 75 bp, Artificial Sequence
  Synthetic
ccagggtccccacggtggacccgggggccatggtggagagcatcttgctggtcagagccagactgggtggtgtct

SEQ ID NO: 160785 - DNA, 75 bp, Artificial Sequence
  Synthetic
ctggccaggatgggaaacacatcagcctcctgatgaggatgatcaacagccacgtggagtaccacaactacggct

SEQ ID NO: 160786 - DNA, 75 bp, Artificial Sequence
  Synthetic
gcaagcggccggtcagcgtggcggcctacatggagccctggcacagccagattttcaagtttttggaaacgaagc

SEQ ID NO: 160787 - DNA, 75 bp, Artificial Sequence
  Synthetic
cattcttggaccggacggccacgttgtggacaaaggggggcactgaggcggcgggaggggccccatactctatcg

SEQ ID NO: 160788 - DNA, 75 bp, Artificial Sequence
  Synthetic
gggcatctttacggggctctttgtccccgagctcttcttcaagctttttagggacactccctggtcggactggta

SEQ ID NO: 160789 - DNA, 75 bp, Artificial Sequence
  Synthetic
gtggacaaaggggggcactgaggcggcgggaggggccccatactctatcgctgtcggccaccttgtccctgatcg

SEQ ID NO: 160790 - DNA, 75 bp, Artificial Sequence
  Synthetic
gggacactccctggtcggactggtacctgtttgaccccaaggacgccggggacctggagaggctctacggggagg

SEQ ID NO: 160791 - DNA, 75 bp, Artificial Sequence
  Synthetic
aaacacccggcgcaccatacgggatattctggagatccccgtgactgtgctctcatccctgcaactgtctcccac

SEQ ID NO: 160792 - DNA, 75 bp, Artificial Sequence
  Synthetic
ccgccatcagccgcccgggctccttctcctcttcctcctcagcagcagcccctgccatcagctaccccggctcct

SEQ ID NO: 160793 - DNA, 75 bp, Artificial Sequence
  Synthetic
cgggtctccatcaagtccctgatgttctctatcgtcaactgcgccgtcaaggccggcagccccttcatccttttg

SEQ ID NO: 160794 - DNA, 75 bp, Artificial Sequence
  Synthetic
ggaggccacctcctcccttactgcgaccacggtggtctgcgcggccacagactgtcttagccaggtctgcaaggc

SEQ ID NO: 160795 - DNA, 75 bp, Artificial Sequence
  Synthetic
ctcctcttcctcctcagcagcagcccctgccatcagctaccccggctcctcctcctgctcagcagatcccaccat

SEQ ID NO: 160796 - DNA, 75 bp, Artificial Sequence
  Synthetic
aaggaggcctgcaacgcccacttttggcgcgacctgcagggcgaggccatgaacgctgccaacctgtgcgccgag

SEQ ID NO: 160797 - DNA, 75 bp, Artificial Sequence
  Synthetic
actgtcttagccaggtctgcaaggcccgtccggttgtcacgctgccagtgaccatcaacaagtacacgggggtca

SEQ ID NO: 160798 - DNA, 75 bp, Artificial Sequence
  Synthetic
gctggaacggagatatccccatcacctcccttcgggcagcagccctcctttggggaagatgcatctgggggtgct

SEQ ID NO: 160799 - DNA, 75 bp, Artificial Sequence
  Synthetic
gaggtggcagcgggccaattcgtagagccaccaagtggcatcagcctcaaggatggctgtggcctccgcgcgccc

SEQ ID NO: 160800 - DNA, 75 bp, Artificial Sequence
  Synthetic
tggccacctgcaatctggccaacatctgcctcccgcgctgcctggtgaatgcgcctctggcggtgcgggcacagc

SEQ ID NO: 160801 - DNA, 75 bp, Artificial Sequence
  Synthetic
aggcccccggggctgggctgcgcaagcaggccgggggctcttccatgcggaagaagtttgtctttgccaccccca

SEQ ID NO: 160802 - DNA, 75 bp, Artificial Sequence
  Synthetic
cctgctggccctccctcgactctcagtcaccctacctggagagggggcagtcggtgatggattctcgctagcccg

SEQ ID NO: 160803 - DNA, 75 bp, Artificial Sequence
  Synthetic
gcggccccaatacaactctccgctcgttagctggtagaatatccgcccggcgtctaggttgtcacttcgctcggc

SEQ ID NO: 160804 - DNA, 75 bp, Artificial Sequence
  Synthetic
attgagaacatcagggctggcctggaggccattatatcacaaaaacaggaggaagactgtgtgtttgatgtggtg

SEQ ID NO: 160805 - DNA, 75 bp, Artificial Sequence
  Synthetic
tgcaaccttgtggatgccatgggcgaggcatgcgcctcgctgactagggacgacgcggagtacttattgggccgc

SEQ ID NO: 160806 - DNA, 75 bp, Artificial Sequence
  Synthetic
attctgccactcggccacagcgtcaggggagacctcgaagctgattagcccggccgtgcctgcgttggccacggc

SEQ ID NO: 160807 - DNA, 75 bp, Artificial Sequence
  Synthetic
ttctccgtcctggcggacagcgtcctagaaaccctggcgaccattgcctccagcgggatagagtggacggcgggg

SEQ ID NO: 160808 - DNA, 75 bp, Artificial Sequence
  Synthetic
gaaagcccgggacatagggctggaaatctgagccccctgggcagagttcggggtccaggaggtagaagatgggct

SEQ ID NO: 160809 - DNA, 75 bp, Artificial Sequence
  Synthetic
atgccggggggtggtttcactggcacgattgggcaggaacagacctttctattcccagggaaatttggtctcgcc

SEQ ID NO: 160810 - DNA, 75 bp, Artificial Sequence
  Synthetic
aaatcccccagccggctcgagaattttcaggctgacgcggtgccgtcgggcgtccccaccacggccggtggcccc

SEQ ID NO: 160811 - DNA, 75 bp, Artificial Sequence
  Synthetic
caacctggtcacttacgccaagcagaggctcaacaacgccatcctgaaggcgtgcggccagacccagttctacat

SEQ ID NO: 160812 - DNA, 75 bp, Artificial Sequence
  Synthetic
ccaaatgtcacaacagaacacaggaggctggatttggcagcagcacttgtgcttttgttgatttttacccgtgta

SEQ ID NO: 160813 - DNA, 75 bp, Artificial Sequence
  Synthetic
ccttgagaggggctgtgttcaggagctggcagatcttggcatgctccagcgtgcggtagcacatgaaaatgttct

SEQ ID NO: 160814 - DNA, 75 bp, Artificial Sequence
  Synthetic
aggtgacgggctgttcggacgccttctaccccttctatgccaatgcgtccaccaaggtcaccaacaaggaggagg

SEQ ID NO: 160815 - DNA, 75 bp, Artificial Sequence
  Synthetic
gggggagctacggggccgtgtatgcacatgcagataatgccacagtcaaactctatgactctgtgacggagctgt

SEQ ID NO: 160816 - DNA, 75 bp, Artificial Sequence
  Synthetic
accaaggtcaccaacaaggaggaggcccttaggccaaaccggtctttttggcgtcatgtgcgtctggatgacagg

SEQ ID NO: 160817 - DNA, 75 bp, Artificial Sequence
  Synthetic
aggctcaacaacgccatcctgaaggcgtgcggccagacccagttctacatcagcctgattcagggactggtgccg

SEQ ID NO: 160818 - DNA, 75 bp, Artificial Sequence
  Synthetic
gcgtcatgtgcgtctggatgacagggaagctttgaatcttgtcgggggccgtgtctcctgcctcccggaggctct

SEQ ID NO: 160819 - DNA, 75 bp, Artificial Sequence
  Synthetic
aggacgcagtcggtgcccgcccgtgactacccccacgtactgggcacgcgggcggtggagtcggcagcggcctac

SEQ ID NO: 160820 - DNA, 75 bp, Artificial Sequence
  Synthetic
gggctggatgtcacgctacccttaagtttgccaacgtcagctcaagactcgaatttcagcgtaaaaacagaaatg

SEQ ID NO: 160821 - DNA, 75 bp, Artificial Sequence
  Synthetic
actggtcgcggctcagggtggtgctgtgctacacagtggtgtttgcggtgcgaaactacctggatgaccacaaga

SEQ ID NO: 160822 - DNA, 75 bp, Artificial Sequence
  Synthetic
acggcctttgattacaaccaggaggacctgattcagatgtcccgggacagggccccctttgtggaccagagccaa

SEQ ID NO: 160823 - DNA, 75 bp, Artificial Sequence
  Synthetic
ttggagactcaagtgtgaatttgttttggtgttcggcgccagggtatctcgacgttggaatgtcaactcaacttg

SEQ ID NO: 160824 - DNA, 75 bp, Artificial Sequence
  Synthetic
agactctggtttgcgaggctgggcggcatgccaagatcgctgagacgtcagttccccgtgacgtgggccctggcc

SEQ ID NO: 160825 - DNA, 75 bp, Artificial Sequence
  Synthetic
taaatgaaaggtcaaataggtccttctcggcggcatcagcgagcatagcaatgagccccccgctgcgcctgagct

SEQ ID NO: 160826 - DNA, 75 bp, Artificial Sequence
  Synthetic
ccctcccaaatctgtcacgtgcgctcacagccgctctcttttctaccgaggctcccctgtacttggacgtgcgtg

SEQ ID NO: 160827 - DNA, 75 bp, Artificial Sequence
  Synthetic
actattgtcgcattgagaaggccgccgatctgggggtgatggagtgtaaggccagcgcggctctgtcggtgccgc

SEQ ID NO: 160828 - DNA, 75 bp, Artificial Sequence
  Synthetic
ttcggtagtcgagggcgcgttgaccacggggggctccagggagcctccaagcggcggctggcaggcctgcaccac

SEQ ID NO: 160829 - DNA, 75 bp, Artificial Sequence
  Synthetic
gccagcgcggctctgtcggtgccgcgggaggaacagaatgagcggagtcccgctgagcagatgccgcctcgtccc

SEQ ID NO: 160830 - DNA, 75 bp, Artificial Sequence
  Synthetic
gcatgccaagatcgctgagacgtcagttccccgtgacgtgggccctggccagcctgactgacttcctgaaatctt

SEQ ID NO: 160831 - DNA, 75 bp, Artificial Sequence
  Synthetic
atggaaccggcgcaggttgcggggccggttgacatcatgagcaagggcccaggggagggaccaggtgggtggtgt

SEQ ID NO: 160832 - DNA, 75 bp, Artificial Sequence
  Synthetic
tattggcccactcccatacctggacctccctggtgcctgaagacccactcccttggatgtgggccctcttctacg

SEQ ID NO: 160833 - DNA, 75 bp, Artificial Sequence
  Synthetic
gaacacgcgcaggcctcctcgctgagtgcggcggccgtctgctgctggccccgggggaggtggcggtcgccgggg

SEQ ID NO: 160834 - DNA, 75 bp, Artificial Sequence
  Synthetic
acactggggaccggctacgcgggccacaggtgcctgacggtgccgctcctttgcggcatcaccgtggagccgggc

SEQ ID NO: 160835 - DNA, 75 bp, Artificial Sequence
  Synthetic
gccaataaacgtttattgccatgtccaagttgttgtacgtgcgtgatcatgagggctttgcctgcctaacggtcg

SEQ ID NO: 160836 - DNA, 75 bp, Artificial Sequence
  Synthetic
ctgagaccatcgcaatcatgaagtcctccaagaatgacacgttcgtctatagaacgtgggtcaaaacgcttgttg

SEQ ID NO: 160837 - DNA, 75 bp, Artificial Sequence
  Synthetic
agggacatctacgtgttccacaatgcccatatggttccccccatctttgaggggccgggtctcgaggccctctgt

SEQ ID NO: 160838 - DNA, 75 bp, Artificial Sequence
  Synthetic
tgcgggtgtctcaagctactcaatgagagggacttggagttttacaagttcctctttacgttcctggccatggcc

SEQ ID NO: 160839 - DNA, 75 bp, Artificial Sequence
  Synthetic
gggcggctacaccccggccgtgattcattaggatcccgggtcgaggcgggtgggggcctgacgcgcctgacgcgg

SEQ ID NO: 160840 - DNA, 75 bp, Artificial Sequence
  Synthetic
ttccccgaagggctagatccctctgcctacctgggggcggtggcaataaccgaggccttcaaggagcgactctac

SEQ ID NO: 160841 - DNA, 75 bp, Artificial Sequence
  Synthetic
tgtctacatcacactggtctttatcgcggactgcgtggctttcatctactacgcctgcggcgaggtggcgctaat

SEQ ID NO: 160842 - DNA, 75 bp, Artificial Sequence
  Synthetic
gagcagaaggccatggagaacgtccacggggagacttatgctaacattttaaacatgctctttgatggggacagg

SEQ ID NO: 160843 - DNA, 75 bp, Artificial Sequence
  Synthetic
gcggcgatgaacgcctacgcagaggccatcatggccgacgaggccctgcaagccaagatttcctggctccgtgac

SEQ ID NO: 160844 - DNA, 75 bp, Artificial Sequence
  Synthetic
tccttctacagcatagccctgctgcgggtccggggcctaatgcctggcatctgcctggccaataactacataagt

SEQ ID NO: 160845 - DNA, 75 bp, Artificial Sequence
  Synthetic
gcttcctgctcgtgtccaatatcctccctcaggacaacaggccctggcacgaggcccggagctccggccgtgtgg

SEQ ID NO: 160846 - DNA, 75 bp, Artificial Sequence
  Synthetic
gggtccggggcctaatgcctggcatctgcctggccaataactacataagtagggatgagctgctccacacccgcg

SEQ ID NO: 160847 - DNA, 75 bp, Artificial Sequence
  Synthetic
ctgggtggtcaaggcccaggacaactctattccccaggacaccttcttgtggtgggtggtcttctacctgaagcc

SEQ ID NO: 160848 - DNA, 75 bp, Artificial Sequence
  Synthetic
caaggagttcccagcctcaaccatcagtcacccggactcgggagccttaatgattgtggacagcgcggcctgcga

SEQ ID NO: 160849 - DNA, 75 bp, Artificial Sequence
  Synthetic
gagaagcagagcctgcaggaccaggccaaggtggccaaggtggcccccctcaaggagttcccagcctcaaccatc

SEQ ID NO: 160850 - DNA, 75 bp, Artificial Sequence
  Synthetic
gccacctggatccaggagctgtttcgcactgcggtggaggtagagactgccttcatcgaggctcgtggagagggg

SEQ ID NO: 160851 - DNA, 75 bp, Artificial Sequence
  Synthetic
ggtttcttaggccagagcgccgagtccgaggccagcctgggcggggcggttgcctgggggatagttggaggagga

SEQ ID NO: 160852 - DNA, 75 bp, Artificial Sequence
  Synthetic
gcactgcggtggaggtagagactgccttcatcgaggctcgtggagagggggttaccttggtggatgtgcgagcca

SEQ ID NO: 160853 - DNA, 75 bp, Artificial Sequence
  Synthetic
acctcttcctcatcctgcccatcttctggtacattctgacggaggtgtggctggcctccttcatgcggcacaact

SEQ ID NO: 160854 - DNA, 75 bp, Artificial Sequence
  Synthetic
caggctcccttgtatggcacaccaccccccaaggactgcccgctcacctacatgactagcatcaagcaaactaat

SEQ ID NO: 160855 - DNA, 75 bp, Artificial Sequence
  Synthetic
ccacgtgtccacgcagatctttgccaccaattccgtcctttacgtctcgggggtctcgaagtcaaccggtcaggg

SEQ ID NO: 160856 - DNA, 75 bp, Artificial Sequence
  Synthetic
gcccagagcccgctcccacttcgcccgatgactggaacaccctgctggcctccctgctgccagacaatacggact

SEQ ID NO: 160857 - DNA, 75 bp, Artificial Sequence
  Synthetic
ttctttgagcaagagagttccgattacaccatgctggtggtagatgacctttgagtcagggtggctacttgctca

SEQ ID NO: 160858 - DNA, 75 bp, Artificial Sequence
  Synthetic
caaggagagtctctttaacagtttctacatgacccacggcctggggaccctgcaggaggggacctgggacccctg

SEQ ID NO: 160859 - DNA, 75 bp, Artificial Sequence
  Synthetic
ggccgccacgctgaccggccgcttgcagccgtagttgtggtactccacgtggctgttgatcatcctcatcaggag

SEQ ID NO: 160860 - DNA, 75 bp, Artificial Sequence
  Synthetic
tcaggatatgccggattttcaaaagcatgcgccagggcactgactatgtccctgtctcggagacggtggaactgg

SEQ ID NO: 160861 - DNA, 75 bp, Artificial Sequence
  Synthetic
accactcagactctccgctttaagaccaaggccctagccgtcctgtccaagtgctatgaccatgcccagactcat

SEQ ID NO: 160862 - DNA, 75 bp, Artificial Sequence
  Synthetic
gcaggcacggccgggctaatcagcttcgaggtctcccctgacgctgtggccgagtggcagaatcaccagagccca

SEQ ID NO: 160863 - DNA, 75 bp, Artificial Sequence
  Synthetic
agcctccaacaggtgcccgagcccagcctgccggacttcattctcaaacagtcccgagaccggctccggattcac

SEQ ID NO: 160864 - DNA, 75 bp, Artificial Sequence
  Synthetic
agaaggtttagctggactttgtttcttgctggactgactttgagtcattaaggtgtgtcaccaggtgggtggtac

SEQ ID NO: 160865 - DNA, 75 bp, Artificial Sequence
  Synthetic
taggaaggaagcagggtgccagctctttgagcttggtcaggatcaccttgctaagactcatggcgcaggccagga

SEQ ID NO: 160866 - DNA, 75 bp, Artificial Sequence
  Synthetic
gctgaaccagaacctgctggagcggctgtctcggctgggcatagacgctgagggaaagctagagaaggagcccca

SEQ ID NO: 160867 - DNA, 75 bp, Artificial Sequence
  Synthetic
gggttcccggcctgaatttgttaagctcactatggaatatgatgataaggtgtccaagagccaccacacctgcgc

SEQ ID NO: 160868 - DNA, 75 bp, Artificial Sequence
  Synthetic
cctgatgccctatatgcccccggccagcgacaggctgaggaacgagcagatgattgggcaggtgctgttgatgcc

SEQ ID NO: 160869 - DNA, 75 bp, Artificial Sequence
  Synthetic
tggcccgcgtgactttgtcaagatgttcaaggacgtggatgcggcggtggacgccgaagtggtccagtttatgaa

SEQ ID NO: 160870 - DNA, 75 bp, Artificial Sequence
  Synthetic
caagacggcttcctcgttgcagaagtgggcacgccagcaaggctcaggcggcgttaaggtgacactcaatccgga

SEQ ID NO: 160871 - DNA, 75 bp, Artificial Sequence
  Synthetic
tacaaggacctggtcaagagctgctaccacgtgatgcagtactcgtgcaacccctttgcgcagcccgcctgcccc

SEQ ID NO: 160872 - DNA, 75 bp, Artificial Sequence
  Synthetic
tcctcctcctcctcctcccggcacgcccctgagatctgcctcccctccctctccctcgtcctggtcggaaaagtc

SEQ ID NO: 160873 - DNA, 75 bp, Artificial Sequence
  Synthetic
cactgctgaccatcctgcaggacatctccctgcccatctgtatgtgctatgagaatgacaaccccgggcttggcc

SEQ ID NO: 160874 - DNA, 75 bp, Artificial Sequence
  Synthetic
aggcccacgttgtctgctcggtagcagcggactcgctggcggcggcgcttagcctctgccgcattccggccgtta

SEQ ID NO: 160875 - DNA, 75 bp, Artificial Sequence
  Synthetic
agcctctgccgcattccggccgttagcgtgccaatcttgaggttttacaggtctggcatcatagctgtggtggcc

SEQ ID NO: 160876 - DNA, 75 bp, Artificial Sequence
  Synthetic
ttatacaggttgattattcccccgtccacgtcgcctatggagttgactcgtcgtcggcaaagagaccagagggca

SEQ ID NO: 160877 - DNA, 75 bp, Artificial Sequence
  Synthetic
ccctcgcttcttcaggcggcgcatgttctcctccacgtttaacttcatccagactatggtgtcccccgggtctgc

SEQ ID NO: 160878 - DNA, 75 bp, Artificial Sequence
  Synthetic
ggtggtgcatggggagcccacctgcgacctgccagacctcgacgcggccctgcagggccgggtgtacggccggcg

SEQ ID NO: 160879 - DNA, 75 bp, Artificial Sequence
  Synthetic
tttaggagcctggccatcgacaagggggtcctcacggccaaggaggccaaggtggtgcatggggagcccacctgc

SEQ ID NO: 160880 - DNA, 75 bp, Artificial Sequence
  Synthetic
gcgtgccaatcttgaggttttacaggtctggcatcatagctgtggtggccggcctgctgacgtcagcgggggacc

SEQ ID NO: 160881 - DNA, 75 bp, Artificial Sequence
  Synthetic
tccaccgaggcgtccagaagcaggtctgagccgagcgtgcaggtcgccgggtctagaggcgaccgttttcgaaag

SEQ ID NO: 160882 - DNA, 75 bp, Artificial Sequence
  Synthetic
cccagacatacggtcagtccatctccttcacctccgccacctcctaggacccctacttgggagagtccggcaagg

SEQ ID NO: 160883 - DNA, 75 bp, Artificial Sequence
  Synthetic
gggggagaacgccgccctccagaacagcttcatcaagtccactaccaggagggagaactacatcatcaacgggcc

SEQ ID NO: 160884 - DNA, 75 bp, Artificial Sequence
  Synthetic
gggagaactacatcatcaacgggccctacatgaaattcctcaacacctaccacaagaccctattcccggacacta

SEQ ID NO: 160885 - DNA, 75 bp, Artificial Sequence
  Synthetic
cacaagaccctattcccggacactaagctctcaagcctgtacctgtggcacaacttttccaggcggcgctcggtc

SEQ ID NO: 160886 - DNA, 75 bp, Artificial Sequence
  Synthetic
ggtgtgtatgttttaataggggtggtctctggcgcggcaggatgatggtcgaggacgtccaccagggccttgcag

SEQ ID NO: 160887 - DNA, 75 bp, Artificial Sequence
  Synthetic
gggggccgcggggggcaccggtgtggtggcattccccgcattccgcctccggcgcctcagaacggcggcggaggt

SEQ ID NO: 160888 - DNA, 75 bp, Artificial Sequence
  Synthetic
ctcccgtcccctttagggacatcctgcgaccgctttcgggggaacgaggggaggcgggaattgggttaagatagg

SEQ ID NO: 160889 - DNA, 75 bp, Artificial Sequence
  Synthetic
ggggaggcatgggtgacagacctcagcaagatctgttgctggggaggcatgggtgacagctgtcatccgcggctg

SEQ ID NO: 160890 - DNA, 75 bp, Artificial Sequence
  Synthetic
cagcacccccttcatttggtgctttgtctttgccaacctgctctctctggagatcttctcaccgtggcagacaca

SEQ ID NO: 160891 - DNA, 75 bp, Artificial Sequence
  Synthetic
acccgcaccccagtccacagccaccggccaaggtcctgggcctcccaccaccgttatgcctccccctttacccat

SEQ ID NO: 160892 - DNA, 75 bp, Artificial Sequence
  Synthetic
cgctggtacccgccaagcacgcggtgagggccgtcactccagccatcatgctgaatattgccagcgccttgatct

SEQ ID NO: 160893 - DNA, 75 bp, Artificial Sequence
  Synthetic
ctgaatattgccagcgccttgatcttcttctcccttagagtctactcgaccagcacgtgggtttctgccccctgt

SEQ ID NO: 160894 - DNA, 75 bp, Artificial Sequence
  Synthetic
tctctaagacccgtcgggccattcgtgagtccagggccctggtcaggggaattgctcatatttttagcccccacg

SEQ ID NO: 160895 - DNA, 75 bp, Artificial Sequence
  Synthetic
cccccgtgtacttgttgatggtcactggcagcgtgacaaccggacgggccttgcagacctggctaagacagtctg

SEQ ID NO: 160896 - DNA, 75 bp, Artificial Sequence
  Synthetic
gggccagggcctcggcaaagcgcagggtctcgctctctgaaaacccccggcactcgataaacagcgagtccgtgt

SEQ ID NO: 160897 - DNA, 75 bp, Artificial Sequence
  Synthetic
acgctgggagtccggccctttgcctgggactcagacttagggccggggccgagaccaaggcggctgctgagacct

SEQ ID NO: 160898 - DNA, 75 bp, Artificial Sequence
  Synthetic
tatgcctgtggccccggctggccatcgagattgtttacatctgcccggctatacaccaaaggttctttgaacttg

SEQ ID NO: 160899 - DNA, 75 bp, Artificial Sequence
  Synthetic
ggttgctcttggcctgcaccatctttgccctgtccgtggtctccagggccctggaggtgtcggctgtcttcatgt

SEQ ID NO: 160900 - DNA, 75 bp, Artificial Sequence
  Synthetic
gggctctggaagcctggccggtgctcggcgtaaccagatttacacctcgggtctcgagcggagacgcagcatttt

SEQ ID NO: 160901 - DNA, 75 bp, Artificial Sequence
  Synthetic
aatgcccgtgggatctgctggccatctctgccttgaccgttcttgtcgtctgtgtgatgattgtgttgcatgtgc

SEQ ID NO: 160902 - DNA, 75 bp, Artificial Sequence
  Synthetic
acttctggttccggtggagatgatgacgacccccacggcccagttcagctaagctactatgactaacctttcttt

SEQ ID NO: 160903 - DNA, 75 bp, Artificial Sequence
  Synthetic
tgtgtgatgattgtgttgcatgtgcacgcagaggtgttctttggactctctagatacctgcccctctttctctgt

SEQ ID NO: 160904 - DNA, 75 bp, Artificial Sequence
  Synthetic
acgacccccacggcccagttcagctaagctactatgactaacctttctttacttctaggcattaccatgtcatag

SEQ ID NO: 160905 - DNA, 75 bp, Artificial Sequence
  Synthetic
gcttgcctgactgactctccctccatttactgggaatgccttagctaatcaccttaactggcacacactccctta

SEQ ID NO: 160906 - DNA, 75 bp, Artificial Sequence
  Synthetic
acctgggccattccagcatcattgcatgtgtcatggccaccctctgcaccctgtcatctgttgtggtatatttcc

SEQ ID NO: 160907 - DNA, 75 bp, Artificial Sequence
  Synthetic
accttaactggcacacactcccttagccacactgtctgtctaggctgaaaagccacattcatattctatttcaaa

SEQ ID NO: 160908 - DNA, 75 bp, Artificial Sequence
  Synthetic
tccatgaaacccttggacccctgggcaagaccgtgctgtttatctcaatctttgtctattactttagcggggtag

SEQ ID NO: 160909 - DNA, 75 bp, Artificial Sequence
  Synthetic
ctctctgaccccggtgccggagacgggcagctacgtggcgggggcggccgccagccccatgtgctcgctctgcga

SEQ ID NO: 160910 - DNA, 75 bp, Artificial Sequence
  Synthetic
atgtggagtcacagggagactttatactgttcaccgaccggagctgcatttatgagattaagtgccgcttcaagt

SEQ ID NO: 160911 - DNA, 75 bp, Artificial Sequence
  Synthetic
caagcttaagaagtttgtgaacggacccctggtccatctccgtgtggtatacatgtgctgttttgtctttacttt

SEQ ID NO: 160912 - DNA, 75 bp, Artificial Sequence
  Synthetic
cccgaaagcggcgtagtgtgtgtgcatgtaagcgttaaaagaggaagtagaaagcgtgtgtctgtgttagaaaag

SEQ ID NO: 160913 - DNA, 75 bp, Artificial Sequence
  Synthetic
agcaactttgctttccatcttgtgccaatacacatttggattcagcccaagccacacctaactcatgccagcaga

SEQ ID NO: 160914 - DNA, 75 bp, Artificial Sequence
  Synthetic
gccacacctaactcatgccagcagaggcaggaacacctgttgttgacacattctttgcgcataagcactttaatc

SEQ ID NO: 160915 - DNA, 75 bp, Artificial Sequence
  Synthetic
agccctgtcagcggccgggggatggtttttttctggttcgagtgtcgtggctgatggtgggagctgctgagcagg

SEQ ID NO: 160916 - DNA, 75 bp, Artificial Sequence
  Synthetic
cctctctcacacccagaaactaagagctagcccaaaacctccacacctgtcctcgctcatctttccacattcctc

SEQ ID NO: 160917 - DNA, 75 bp, Artificial Sequence
  Synthetic
agacacggctctgtcagttatcaccgtaccatgagtgccatgtgtgtccagtgcctaatcaccgttcctcatttt

SEQ ID NO: 160918 - DNA, 75 bp, Artificial Sequence
  Synthetic
tataaaagtccacgaaaacagctgtgcctcactctcgagatggtacacgtcctggagcgtgctttgctagagcag

SEQ ID NO: 160919 - DNA, 75 bp, Artificial Sequence
  Synthetic
ccccacaagaagcccacctccggccgccgcctccctctgtcctccaccactgacacagaggatgatcagctgcca

SEQ ID NO: 160920 - DNA, 75 bp, Artificial Sequence
  Synthetic
gcagtactcgtgcaacccctttgcgcagcccgcctgccccatcttcacccagctgttttaccgctcactgctgac

SEQ ID NO: 160921 - DNA, 75 bp, Artificial Sequence
  Synthetic
accccccaccaccgtcagggagtcttggtagaagcacagggggggctgaggcccccgcacatccaccacccctgc

SEQ ID NO: 160922 - DNA, 75 bp, Artificial Sequence
  Synthetic
cctggagcgtgctttgctagagcagcagtcctctgcctgcggcctgcccggctcttctacggagaccaggcctag

SEQ ID NO: 160923 - DNA, 75 bp, Artificial Sequence
  Synthetic
gtgcctaatcaccgttcctcattttgtgtgcctcctcaaatgttccagaagtcggccacaggggaggtggctgaa

SEQ ID NO: 160924 - DNA, 75 bp, Artificial Sequence
  Synthetic
cttcgcgtgaggcatccgatatgactgaattttcgcagtctcttttccctcttcccttgttattcccatagaatt

SEQ ID NO: 160925 - DNA, 75 bp, Artificial Sequence
  Synthetic
gtcagcagactaagactactcctggtggtactctgtgtcctgtttggacttttatgcctgctcctcatctaagaa

SEQ ID NO: 160926 - DNA, 75 bp, Artificial Sequence
  Synthetic
ggcctccagggagatgggggccacaaacaggctccgggtggtgtgggcggccagggcatcggcaaagcgcagggt

SEQ ID NO: 160927 - DNA, 75 bp, Artificial Sequence
  Synthetic
tggtactctgtgtcctgtttggacttttatgcctgctcctcatctaagaagccaccatgcgaccgggtagaccac

SEQ ID NO: 160928 - DNA, 75 bp, Artificial Sequence
  Synthetic
aagcagtcccataatcagtcaggaccagcctccccatgccccacatggtgtctgtgaaatccaccaggatgttgc

SEQ ID NO: 160929 - DNA, 75 bp, Artificial Sequence
  Synthetic
aagatctccagagagagcaggttggcaaagacaaagcaccaaatgaagggggtgctggccaggaggccgagacag

SEQ ID NO: 160930 - DNA, 75 bp, Artificial Sequence
  Synthetic
gacccagtgcccggagagagaatggccctgacaagtcggctgcatgatgcacttcggcagtcacgtgtgtgagtc

SEQ ID NO: 160931 - DNA, 75 bp, Artificial Sequence
  Synthetic
gctgggggaggtctttggctcctcggcatgggcggagcagacagaggcttttgcccactttgcacacgagaagct

SEQ ID NO: 160932 - DNA, 75 bp, Artificial Sequence
  Synthetic
aggtcaaagaacaaggccaagaaggagcgtgtccccgtggaggaccgcccaccgactccgatgcccaccagccag

SEQ ID NO: 160933 - DNA, 75 bp, Artificial Sequence
  Synthetic
tccacggcctctgtcaaaagggagcttagcgtgccagggttgtaattcttgatgtagtggcccaggaattcaact

SEQ ID NO: 160934 - DNA, 75 bp, Artificial Sequence
  Synthetic
ggactgcatccaacgctgccaccccctggagccagcgctgggggtgtcaacaaagaactttgacctgttgtccct

SEQ ID NO: 160935 - DNA, 75 bp, Artificial Sequence
  Synthetic
cactttcttggggtgcttctgcttctgcctggcctccgacgatgtccttttcctcgcgagctgaacagccagagg

SEQ ID NO: 160936 - DNA, 75 bp, Artificial Sequence
  Synthetic
taacatctcccgctagatggcgcccttattattgatgtgacttgtgatgcaataaataaaagtacagatagatgg

SEQ ID NO: 160937 - DNA, 75 bp, Artificial Sequence
  Synthetic
tcaatgttctcgatgagggaggtgtttagtgagatgaaggtctgcagggtggcaatgccgtccagctcgatggtt

SEQ ID NO: 160938 - DNA, 75 bp, Artificial Sequence
  Synthetic
aataaataaaagtacagatagatggcactcttaccttcctctgcccgcttcttcatatatgtgttgagatgagtc

SEQ ID NO: 160939 - DNA, 75 bp, Artificial Sequence
  Synthetic
gtctggggcgttgttggagtcctgtgcccagtggttgcacccggggacttttatcttctggctcagaggccgtac

SEQ ID NO: 160940 - DNA, 75 bp, Artificial Sequence
  Synthetic
cttctagcatggccaccagggtgcagagccccgcgttctggatcgcctgcatgcgtgcatccagccatgtgtcct

SEQ ID NO: 160941 - DNA, 75 bp, Artificial Sequence
  Synthetic
ctcttcattagattcacgttcctcatcgttcggtggggtgggggtgttcccagaagagccagaagcagatggata

SEQ ID NO: 160942 - DNA, 75 bp, Artificial Sequence
  Synthetic
ggggaccctcatgctcttgcgcagggtgacggtggcctggttaacgggcacgcactgggagactgagatgacatc

SEQ ID NO: 160943 - DNA, 75 bp, Artificial Sequence
  Synthetic
gttcccccgaaagaatgacgggaaagtaacctcagtgttttaagtttttattgcattaggggaagatctcctcct

SEQ ID NO: 160944 - DNA, 75 bp, Artificial Sequence
  Synthetic
ttgggagttgtttccgccatcgtccccatccggatccccgccggggctagggggacccgcgcccattggcaccat

SEQ ID NO: 160945 - DNA, 75 bp, Artificial Sequence
  Synthetic
agctcgtgtctgggttgcactttctgccaggctccaatctctggatgggcggccaccgccagcatcgactgtagg

SEQ ID NO: 160946 - DNA, 75 bp, Artificial Sequence
  Synthetic
ggatgactacgaccggctgtacttcctgacgctgggctacctggcctccccggtggccccaagctgagccagttc

SEQ ID NO: 160947 - DNA, 75 bp, Artificial Sequence
  Synthetic
ttctagggaccccatagctgcagcagcgactgcaaaaccggcctgaaatgctctctgagaaacaaggcgagaggg

SEQ ID NO: 160948 - DNA, 75 bp, Artificial Sequence
  Synthetic
gcccacggccgcggacatcaaggccatggccgtggagctggtggagcacagtgggggtggggccggcgggggaga

SEQ ID NO: 160949 - DNA, 75 bp, Artificial Sequence
  Synthetic
catgcgccagagcggcatcctcaaggggcacgagatggcccagttgacggacgtgcccagctccgtggtcctgag

SEQ ID NO: 160950 - DNA, 75 bp, Artificial Sequence
  Synthetic
atttacgccccagcaagcttcaggcaaaataacctgtgatgctgaaaccgcggcgctacaggatcaccccaattg

SEQ ID NO: 160951 - DNA, 75 bp, Artificial Sequence
  Synthetic
ggcttaaccagactcatgtcaaaccacggtttgttgggcaggggcctctggctgcgttcttgcctcgcctgcttc

SEQ ID NO: 160952 - DNA, 75 bp, Artificial Sequence
  Synthetic
tggatctggacggtggcgggattgttgagggtgcccagggacttcccgggggccgcggggggcaccggtgtggtg

SEQ ID NO: 160953 - DNA, 75 bp, Artificial Sequence
  Synthetic
ctcggcagttgttcagtccctggccgaggtcctgcacggcagttacaacggggtggcccagttcatcctctacat

SEQ ID NO: 160954 - DNA, 75 bp, Artificial Sequence
  Synthetic
ggatgcggccccgggcacccccgcccatgtcagagtcagcacctatgcgcacgacatcctgcagtacgtgggggc

SEQ ID NO: 160955 - DNA, 75 bp, Artificial Sequence
  Synthetic
acggtttgttgggcaggggcctctggctgcgttcttgcctcgcctgcttccttgtgctcctgccggcccctcgag

SEQ ID NO: 160956 - DNA, 75 bp, Artificial Sequence
  Synthetic
tggatcactggagcctgcgttgggttcacatatgtcagctgttgttcacatgtgtcaggatgacgagtttccgga

SEQ ID NO: 160957 - DNA, 75 bp, Artificial Sequence
  Synthetic
gaggtcctgcacggcagttacaacggggtggcccagttcatcctctacatctgcgacatctacgcgggggccatc

SEQ ID NO: 160958 - DNA, 75 bp, Artificial Sequence
  Synthetic
catgtcagagtcagcacctatgcgcacgacatcctgcagtacgtgggggcaccaggggcccagtacacttgcgtg

SEQ ID NO: 160959 - DNA, 75 bp, Artificial Sequence
  Synthetic
agcccaggggtctcgtgcaggtgtccccggggaattgttctccctgatcaccgcccacccccgttttctccaaac

SEQ ID NO: 160960 - DNA, 75 bp, Artificial Sequence
  Synthetic
tatgctggaacactatggcgtgtatgacttttatgaggccaacggcagcggctttgacctggtggggcccgagct

SEQ ID NO: 160961 - DNA, 75 bp, Artificial Sequence
  Synthetic
gcggttagggaggacactgccaaggttgaagagcagatttccgtcagccagggtgacctggctcaggtccggcgc

SEQ ID NO: 160962 - DNA, 75 bp, Artificial Sequence
  Synthetic
actaaaacaaggtgaaataggcaagtgcgtttattgcgacaagtatccagaaacataaaccccgtgggcttcctc

SEQ ID NO: 160963 - DNA, 75 bp, Artificial Sequence
  Synthetic
catggacctctccgcgtcgccttttgtggcctctggtgtaagaggagttgccagtctcctccttctcgtcctcgt

SEQ ID NO: 160964 - DNA, 75 bp, Artificial Sequence
  Synthetic
tcccacgagtcgcgaggctatccacccgcaatgccaccccccaatgccacactaaaacaaggtgaaataggcaag

SEQ ID NO: 160965 - DNA, 75 bp, Artificial Sequence
  Synthetic
ctccgggcggcctccttttccaggcgcagcttcggcctcggccatctggaggcggccctggacgtgctggcctcg

SEQ ID NO: 160966 - DNA, 75 bp, Artificial Sequence
  Synthetic
actggcaggtgccagggcttgggaagtgacaggtcaacagcaacagagaggctcccatccttttccttcataaca

SEQ ID NO: 160967 - DNA, 75 bp, Artificial Sequence
  Synthetic
gcaggttggccatccgcgtcaggcccccacctgcctcgacccgggcggctacaccccggccgtgattcattagga

SEQ ID NO: 160968 - DNA, 75 bp, Artificial Sequence
  Synthetic
gctcccatccttttccttcataacaccgccatttgccgcagttggtgcgggctccacgccctcgggcatgagcca

SEQ ID NO: 160969 - DNA, 75 bp, Artificial Sequence
  Synthetic
ctccagggcaaggcaccccaggtacaggtttgtaactacgggcttcaggtagaagaccacccaccacaagaaggt

SEQ ID NO: 160970 - DNA, 75 bp, Artificial Sequence
  Synthetic
ccccggatgggctttacctcacgtacgactctgaccggcccctaattcttctgtataagggcagggggtgggtat

SEQ ID NO: 160971 - DNA, 75 bp, Artificial Sequence
  Synthetic
atctgtggagtgttcttcgctgccctccatagggtccatatcgcagtctgtgttggtgtctgagaccgcttcgag

SEQ ID NO: 160972 - DNA, 75 bp, Artificial Sequence
  Synthetic
cgcgtcgacgcccgagaacgggtcactctgcttgaattggaaaaggggcgttccagtggcctcggcgttgttgaa

SEQ ID NO: 160973 - DNA, 75 bp, Artificial Sequence
  Synthetic
ctggacgtggggatggggaaatgcattcacggtgcatgtcacagtaaggacagagaagtctgggaactgagacct

SEQ ID NO: 160974 - DNA, 75 bp, Artificial Sequence
  Synthetic
tgttggtgtctgagaccgcttcgagttccagaatgtggctctctgcagaggggagacaaaaggtggagactgcct

SEQ ID NO: 160975 - DNA, 75 bp, Artificial Sequence
  Synthetic
tcggcgtagggtgctaagcgtggtcgtgctgctagccgccctggcgtgccgcctcggtgcgcagaccccagagca

SEQ ID NO: 160976 - DNA, 75 bp, Artificial Sequence
  Synthetic
tgagcacctctgtctcaggcaccggatgcccccggctccacggccccggccactggccggtgtagcttcttacct

SEQ ID NO: 160977 - DNA, 75 bp, Artificial Sequence
  Synthetic
ggcttcaccacgctcaggtgttcctgcttggtgacctcggtctcgcccagtttcatgcggcacaggtagttgccg

SEQ ID NO: 160978 - DNA, 75 bp, Artificial Sequence
  Synthetic
gggacctggggccgtagaagagggcccacatccaagggagtgggtcttcaggcaccagggaggtccaggtatggg

SEQ ID NO: 160979 - DNA, 75 bp, Artificial Sequence
  Synthetic
tcatgggagatgttggcagcggtgactactaaaaagaaggtgttggcacttctgtggatatcaaagaagcccctg

SEQ ID NO: 160980 - DNA, 75 bp, Artificial Sequence
  Synthetic
tgctagttcgggagagtctctgagaaggaaccatcttgtctgtctctacgacgggctagctgggatgtagtgctg

SEQ ID NO: 160981 - DNA, 75 bp, Artificial Sequence
  Synthetic
aaaggccactctataaagatgacatcgtggtgcatgcgcccaataagcacctgctcctctcctgggcccagttta

SEQ ID NO: 160982 - DNA, 75 bp, Artificial Sequence
  Synthetic
ttccagtggcctcggcgttgttgaaggagctggcgtgtatcagaaagtccccaaagacagcagcggcggtagcgg

SEQ ID NO: 160983 - DNA, 75 bp, Artificial Sequence
  Synthetic
tcttgactggcctcagccctatttatgattctggaggcgggcacgctgatggagaaatgggcggtcggttgattg

SEQ ID NO: 160984 - DNA, 75 bp, Artificial Sequence
  Synthetic
ctgctcctctcctgggcccagtttaaaccagctgacctcaatctctggaccgaggctcaccctcctccagtagga

SEQ ID NO: 160985 - DNA, 75 bp, Artificial Sequence
  Synthetic
gccccacagcgaccggcgaagcactgactcatgaaggtgaccgtgatggcctgtgatgtgtagtagagtaccaga

SEQ ID NO: 160986 - DNA, 75 bp, Artificial Sequence
  Synthetic
gactcatgaaggtgaccgtgatggcctgtgatgtgtagtagagtaccagaaacaccctcacattcttggagctgg

SEQ ID NO: 160987 - DNA, 75 bp, Artificial Sequence
  Synthetic
gggctggcgggggcgtttgtcccacgggtgagggggaatcgtcggttagggccggcacgaggtggtgggtctgga

SEQ ID NO: 160988 - DNA, 75 bp, Artificial Sequence
  Synthetic
aaagttcctgccccgggcatggcacacctgaactaagtttggcccggtttgctcaaacgtgacatggagaaactg

SEQ ID NO: 160989 - DNA, 75 bp, Artificial Sequence
  Synthetic
aaggggccgctgggtgacacaggcaaccctgacaaaggccccccaggaaagacccccggggggtatcgggggggt

SEQ ID NO: 160990 - DNA, 75 bp, Artificial Sequence
  Synthetic
gctcaaacgtgacatggagaaactgggggaatttgtcttctggcacagctgttgccagggtgctcatgagcgagg

SEQ ID NO: 160991 - DNA, 75 bp, Artificial Sequence
  Synthetic
aggtggaggctctgcacgcctggctcccctcactgtcactggcctccctccacccagacataccccaaaccaccg

SEQ ID NO: 160992 - DNA, 75 bp, Artificial Sequence
  Synthetic
cggagctcaaaatccacctggctgccttcagatatgccaccccccagatggaggaggacaagggtcccatcaacc

SEQ ID NO: 160993 - DNA, 75 bp, Artificial Sequence
  Synthetic
gccagatgcaggagctgacccaggcgacgagatccaggcccagatgtccctctatcatggcgcagacattctcca

SEQ ID NO: 160994 - DNA, 75 bp, Artificial Sequence
  Synthetic
accctgacaaaggccccccaggaaagacccccggggggtatcgggggggtgttgatgggggcatgggggggtcgg

SEQ ID NO: 160995 - DNA, 75 bp, Artificial Sequence
  Synthetic
atattcggctactgtgtgtgtaactgactcggccttaaggcggtggagcaggcgcccggccaggacatcagcctc

SEQ ID NO: 160996 - DNA, 75 bp, Artificial Sequence
  Synthetic
ttttgggggccggccagcccacgtgcagtgagtgatgtaagaggttttgaatgttgagggcattcttaacatagc

SEQ ID NO: 160997 - DNA, 75 bp, Artificial Sequence
  Synthetic
tgtgcttgtcttcctcttccggatgacagacaaagaggcgcagctgccggctaagaccaccgcccctgtccacct

SEQ ID NO: 160998 - DNA, 75 bp, Artificial Sequence
  Synthetic
ccctcctcctcctgtttcctcccgttaagtctagagaatcacctcccagtcagagacgttggaataaaagctgtc

SEQ ID NO: 160999 - DNA, 75 bp, Artificial Sequence
  Synthetic
aatctccaccacggggaggctagagccacggtaattgaaggcagacctcctccaaccgtcagtagcactaaatgt

SEQ ID NO: 161000 - DNA, 75 bp, Artificial Sequence
  Synthetic
tagatacaggatgtcgtccatgctgaggggaggtggggtgtctgctcccccctgcggaagccgcctgggtgcggg

SEQ ID NO: 161001 - DNA, 75 bp, Artificial Sequence
  Synthetic
ccgcccggcgtgatacacgccgctgtcaaaaagcggggccccaatctctttgatcttgtgacgcatgcggcgcag

SEQ ID NO: 161002 - DNA, 75 bp, Artificial Sequence
  Synthetic
gttagctcctctatatgtaggggctggaccacagcatagcggtgcatgatggatggtgagtaataaattcttaag

SEQ ID NO: 161003 - DNA, 75 bp, Artificial Sequence
  Synthetic
gaagactccgaggccttgacggaattcaagaccagcgtgtcctctgcccgtgccatccttgaggaccccaacttt

SEQ ID NO: 161004 - DNA, 75 bp, Artificial Sequence
  Synthetic
cgcagtaaagagagccgggtcttgggctcttatatatagcgccgctcttctctgctcgttaaaccaatagcatgt

SEQ ID NO: 161005 - DNA, 75 bp, Artificial Sequence
  Synthetic
ctcccggacgccttcaagtgcatcgaagagcaggtgaacaagaccatgcatgaaaagtacgaggccgtccaggat

SEQ ID NO: 161006 - DNA, 75 bp, Artificial Sequence
  Synthetic
cgaaagcccagttttcccgtgcatatgcaaaaggggagcacatcttccatattatccgggtcggcgggtggacaa

SEQ ID NO: 161007 - DNA, 75 bp, Artificial Sequence
  Synthetic
cggcccggcttcctcataggtcagagcgacatagaggcgcgcatcggcggggcacggctacacacagtagccgaa

SEQ ID NO: 161008 - DNA, 75 bp, Artificial Sequence
  Synthetic
gctgatttgaaaaaatagactgggtgggccctggacactggacccaggcggcgcatgaggcgcagtacctcacgc

SEQ ID NO: 161009 - DNA, 75 bp, Artificial Sequence
  Synthetic
gagatgagtcatcccgtggagagtagggagggggagggagcccgtcattcccgtcgtgttgcaatcccaagtaca

SEQ ID NO: 161010 - DNA, 75 bp, Artificial Sequence
  Synthetic
aatcaaatctttagagattacagacaccatgtttgacatctttcaaagtgctttcgggttggaagaaatgacgct

SEQ ID NO: 161011 - DNA, 75 bp, Artificial Sequence
  Synthetic
tccatgtcactctcaatctccggcctggcccgctgcagggctgccctgagacccgcgtagaggcaggtggttgag

SEQ ID NO: 161012 - DNA, 75 bp, Artificial Sequence
  Synthetic
tggcccgctgcagggctgccctgagacccgcgtagaggcaggtggttgaggcacagaagccggctaaccgcatgt

SEQ ID NO: 161013 - DNA, 75 bp, Artificial Sequence
  Synthetic
cttgatctttagatccaggtccaggaccaggttgcagaccggaagccggggattaaagtattcatgccgggagac

SEQ ID NO: 161014 - DNA, 75 bp, Artificial Sequence
  Synthetic
agaacctgacggagcttaccactccgacttcctcaccccccagcagtccatcgccccccgccccacccgcggccc

SEQ ID NO: 161015 - DNA, 75 bp, Artificial Sequence
  Synthetic
ccacagcactgctcactcccccttgtgattgccgcactgcctttccatttcctgctacgctttaccaccgcattc

SEQ ID NO: 161016 - DNA, 75 bp, Artificial Sequence
  Synthetic
ggtagccgctggagacgatgcgctcgtaggccgggctctgcgcgaaagcagagactcgggtctccagctcatccc

SEQ ID NO: 161017 - DNA, 75 bp, Artificial Sequence
  Synthetic
tgggaggcggcagttggtcggggtggagacgacctccgccaggtgggacgagaaggggtcagcggctgtcattac

SEQ ID NO: 161018 - DNA, 75 bp, Artificial Sequence
  Synthetic
cttttctaacacaaacacacgctttctacttcctcttttaacgcttacatgcacacacactacgccgctttcggg

SEQ ID NO: 161019 - DNA, 75 bp, Artificial Sequence
  Synthetic
aaagtagtgcctgtctgcaaaatggcagaggaagaccggtagccgctgcacccttcgaaggacggtgggtgggag

SEQ ID NO: 161020 - DNA, 75 bp, Artificial Sequence
  Synthetic
cagaggaagaccggtagccgctgcacccttcgaaggacggtgggtgggaggaattgttccttgggattccactgg

SEQ ID NO: 161021 - DNA, 75 bp, Artificial Sequence
  Synthetic
gaatagtataagacgcgaggcctgggtgaggagagtccagagcaatggccaggttcatcgctcagctcctcctgt

SEQ ID NO: 161022 - DNA, 75 bp, Artificial Sequence
  Synthetic
ccccggcaggtggcctggccggccaagcatagaaacccttgaagcgtgggggggtatgtgggaccctcatccgcg

SEQ ID NO: 161023 - DNA, 75 bp, Artificial Sequence
  Synthetic
ggagccgagggtgcagaagacgaagagggcgggggcccctgggggctgtcgtcccacgacgcagtccttaggatc

SEQ ID NO: 161024 - DNA, 75 bp, Artificial Sequence
  Synthetic
tcctcagttgccttgctcctgccacactaccctgaccatggaacgcgaccttgagaggggcccaccgggcccgcc

SEQ ID NO: 161025 - DNA, 75 bp, Artificial Sequence
  Synthetic
tgccagcgcgcgagctccaccagctcccgggccacgtccacactgagcccggcccaagcccgcatgagtccgtca

SEQ ID NO: 161026 - DNA, 75 bp, Artificial Sequence
  Synthetic
atggagacccgcccacaaaacttgcccgctgtcaccagccgatagtactcgcgctcaaactcctccccgtagagc

SEQ ID NO: 161027 - DNA, 75 bp, Artificial Sequence
  Synthetic
tgaggtcagctggtttaaactgggcccaggagaggagcaggtgcttattgggcgcatgcaccacgatgtcatctt

SEQ ID NO: 161028 - DNA, 75 bp, Artificial Sequence
  Synthetic
agcgggcacgtcgggtggcgttggggtcgtttggtcgtgttccctcaccagggctgggttggccttttgcaccca

SEQ ID NO: 161029 - DNA, 75 bp, Artificial Sequence
  Synthetic
tttcactcctcttcaccctgagatacagcacgacggcggagtcgttgggcctggccacccgccgctttctggtct

SEQ ID NO: 161030 - DNA, 75 bp, Artificial Sequence
  Synthetic
cagctgctggacacgcacatgctcagccaggtaagtctcccgggtgaagtaggtgcgcatgtgctccgcaaagcc

SEQ ID NO: 161031 - DNA, 75 bp, Artificial Sequence
  Synthetic
gggcgtgtccctaaaaagcttgaagaagagctcggggacaaagagccccgtaaagatgcccgggcacctctcgtg

SEQ ID NO: 161032 - DNA, 75 bp, Artificial Sequence
  Synthetic
gtaagaatccaggcagacaaaagcgtgttagtcatcaccgtcagccacacagcgccggctaccatggtgagcagg

SEQ ID NO: 161033 - DNA, 75 bp, Artificial Sequence
  Synthetic
tttacattggcagggatgccggggagagggccaggcacagggccgtgcaccggctaatggtgggtaacctgccga

SEQ ID NO: 161034 - DNA, 75 bp, Artificial Sequence
  Synthetic
caggggaaggcgccccctgtaggcgtctatcgtccttgccacagcgcggatctctcgtgagtcccgccgcagctt

SEQ ID NO: 161035 - DNA, 75 bp, Artificial Sequence
  Synthetic
cccctggtcgctggaggaaatctatgacctgtgccggaccgtgcggcgtgaggtactgcgcctcatgcgccgcct

SEQ ID NO: 161036 - DNA, 75 bp, Artificial Sequence
  Synthetic
gccggccctcagggaccggcagtatgcctcgacgtctgtccgcggggccgccgccaccgctgccgtccactgcct

SEQ ID NO: 161037 - DNA, 75 bp, Artificial Sequence
  Synthetic
tcggtctgctccgcccatgccgaggagccaaagacctcccccagctcggccagggacgtgacggcggccaggctc

SEQ ID NO: 161038 - DNA, 75 bp, Artificial Sequence
  Synthetic
cagagctttgccccaatcgcgtgccaaactgcgagggggcctggtgccagactctcttcagtgaccggacgggtc

SEQ ID NO: 161039 - DNA, 75 bp, Artificial Sequence
  Synthetic
gggaaaaatgacaaggaggaagcccacggggtttatgtttctggatacttgtcgcaataaacgcacttgcctatt

SEQ ID NO: 161040 - DNA, 75 bp, Artificial Sequence
  Synthetic
ccgtgaggtgcgccagggtctcaatcgtacaaggaatgccccaaaaatagtaagcagccgtgactagcacgaact

SEQ ID NO: 161041 - DNA, 75 bp, Artificial Sequence
  Synthetic
cgtgttccatcctcagggcagtgtgtcaggagcaaggcagttgaggaaagaagggggcagagcagtgtgagaggc

SEQ ID NO: 161042 - DNA, 75 bp, Artificial Sequence
  Synthetic
caggaggcggcggggagccgggcatccttctctccagccgccatcgagcaggtggccacggttctgctctcggcc

SEQ ID NO: 161043 - DNA, 75 bp, Artificial Sequence
  Synthetic
ccttctctccagccgccatcgagcaggtggccacggttctgctctcggccgggctcaacgagaccgtggcggggg

SEQ ID NO: 161044 - DNA, 75 bp, Artificial Sequence
  Synthetic
gcagttccacgaggggcgtgagcgagcgcagggcccccgcgcgatctaggtaggtggatagacggtccgcggtga

SEQ ID NO: 161045 - DNA, 75 bp, Artificial Sequence
  Synthetic
cttgttgaggaacttgcgaagctgttcccggctactgttcgcggcggatgccatgacgtgccagaatatatcccc

SEQ ID NO: 161046 - DNA, 75 bp, Artificial Sequence
  Synthetic
agcgtcagaaccaggccgcagcggctctgtgaggtcagccgcttcttgggcaggtgaagctgcagttccacgaga

SEQ ID NO: 161047 - DNA, 75 bp, Artificial Sequence
  Synthetic
ctccgtctggctggcgtagcggcgcaccccgttggccaggcccccggtgggctttaggttgacggtgatgttaac

SEQ ID NO: 161048 - DNA, 75 bp, Artificial Sequence
  Synthetic
caggtgaagctgcagttccacgagagaacccgccacgtggtggaggggcgaggcgttgtggcacaaacaaaacag

SEQ ID NO: 161049 - DNA, 75 bp, Artificial Sequence
  Synthetic
tcgagagacagatttactgatgactgttctcagtttattctagggaattatttttgagaccgtgtcactcccgag

SEQ ID NO: 161050 - DNA, 75 bp, Artificial Sequence
  Synthetic
tcgcccttattgccctgtttagaattcgtcttgctctattcaccctaacttttcttcttgcccgttctctttctt

SEQ ID NO: 161051 - DNA, 75 bp, Artificial Sequence
  Synthetic
ggccttgatgacgacgggggcggacattatttaagaccgggaggccccaacggcgggctaaacagaacgatggcc

SEQ ID NO: 161052 - DNA, 75 bp, Artificial Sequence
  Synthetic
gccgtgggctgaccctgccctgcagccgcccaggggtagcggttggtctccgcgtatacggtgaccagccatctc

SEQ ID NO: 161053 - DNA, 75 bp, Artificial Sequence
  Synthetic
ttctatctcccagactggtcgtgctgcgggctctggctctttggccggcccaggaatagatacagccagctccct

SEQ ID NO: 161054 - DNA, 75 bp, Artificial Sequence
  Synthetic
caggaatagatacagccagctccctgaggagccggagacctttgagtgcccggaccgctggcgagccgagataga

SEQ ID NO: 161055 - DNA, 75 bp, Artificial Sequence
  Synthetic
tctgggcctgccccctggtgtgcaggtgggagatttgctaagaaatgagcagacgatgggctcactgagacaggt

SEQ ID NO: 161056 - DNA, 75 bp, Artificial Sequence
  Synthetic
cttcggatggggcgcgcttcagctccttgtgcagcttaaagagactcaggccctcattccacggcccgggggtgg

SEQ ID NO: 161057 - DNA, 75 bp, Artificial Sequence
  Synthetic
cgtggctgcggtggtgcgcaacgccggcctgctggccgagctggaggccatcctccttccccgtttgagacggca

SEQ ID NO: 161058 - DNA, 75 bp, Artificial Sequence
  Synthetic
tgacgggggggaagcggtccctcagcctaaagaagagcgtgttcaggcacacggccggggcccggccctcgcaga

SEQ ID NO: 161059 - DNA, 75 bp, Artificial Sequence
  Synthetic
tcagtctttgcaatttgcctaacatggaggattgaagacccaccttttaattctattctgtttgcattgctggcc

SEQ ID NO: 161060 - DNA, 75 bp, Artificial Sequence
  Synthetic
ttcctcacgcaaaaacaggctgtgagattctgagaagagctgacggtacttatagcacacttccaatcccccggg

SEQ ID NO: 161061 - DNA, 75 bp, Artificial Sequence
  Synthetic
cccgcctgcgcgcgctgatgcctctggagctggggatctttggactgggggatttggcccagccggtgctggtgc

SEQ ID NO: 161062 - DNA, 75 bp, Artificial Sequence
  Synthetic
cttctgaaggaacggcggagagtagcgtagaatccagccagtggtctacccggtcgcatggtggcttcttagatg

SEQ ID NO: 161063 - DNA, 75 bp, Artificial Sequence
  Synthetic
ccctcagcctcggcccctttcatcaactccgcctttgagcccgaggtgcccacccccgtccttgcaccgcctccc

SEQ ID NO: 161064 - DNA, 75 bp, Artificial Sequence
  Synthetic
ttgggcacagaggtctcagcagccgccttggtctcggccccggccctaagtctgagccccaggcaaagggccgga

SEQ ID NO: 161065 - DNA, 75 bp, Artificial Sequence
  Synthetic
gccccggacccgcagcagggctatgctgtagaaggagctaatgaagaagatgccttcaatcagcaggaacacaag

SEQ ID NO: 161066 - DNA, 75 bp, Artificial Sequence
  Synthetic
ggcccacggagctcgcgttaacgtagcaaccagactccacaccaaataaacattttattggtaaaacaagggata

SEQ ID NO: 161067 - DNA, 75 bp, Artificial Sequence
  Synthetic
ctcttggtgcagcccttttaacattggcagcaggtaagccacacgtgtgacattgcttgcctttttgccacatgt

SEQ ID NO: 161068 - DNA, 75 bp, Artificial Sequence
  Synthetic
ctccaatagaatttgcttgaggtcatacgttttagggtgctcggcctgggccgcggccaccggcatatgctctat

SEQ ID NO: 161069 - DNA, 75 bp, Artificial Sequence
  Synthetic
tcgtggacttttatacagtaaggacaaggaaagaaggccagaggaatgtggaaagatgagcgaggacaggtgtgg

SEQ ID NO: 161070 - DNA, 75 bp, Artificial Sequence
  Synthetic
caaaccccctcccctgtctcccctcgagcgcctcgctcagcccactatcacccatggccaggcccggcacctcct

SEQ ID NO: 161071 - DNA, 75 bp, Artificial Sequence
  Synthetic
ggctccctattgcgatgcatagttgctgcgtccctgctgccggaggtgtccgtggggcaccaggagctgtctccg

SEQ ID NO: 161072 - DNA, 75 bp, Artificial Sequence
  Synthetic
agaggagaaagtgcgttagagaaggaagcgtaagggaaagggggtggggggcaaagggtgtaatacttactcatc

SEQ ID NO: 161073 - DNA, 75 bp, Artificial Sequence
  Synthetic
gtgttgtgctgtaaataagtgtccagcgcaccactagtcaccaggtgtcaccggaggctacttgcctcagtgcca

SEQ ID NO: 161074 - DNA, 75 bp, Artificial Sequence
  Synthetic
tctgcccctccgctaccgccgctgctgtcactctccatagcggacgccatgaaggtccaggggtccgtcgatcgc

SEQ ID NO: 161075 - DNA, 75 bp, Artificial Sequence
  Synthetic
cggttaacttccagcaccaggcggggggtcacgcgcaggcttactttttgcatggtcaggctccgcgtccccccg

SEQ ID NO: 161076 - DNA, 75 bp, Artificial Sequence
  Synthetic
acaggaacctgctgcaggcccccggggctgggctgcgcaagcaggccgggggctcttccatgcggaagaagtttg

SEQ ID NO: 161077 - DNA, 75 bp, Artificial Sequence
  Synthetic
aacaagctgacagaagcgccggtacttgttaaggaacacggtctggtcactaaagttggtcaggctgacgtccac

SEQ ID NO: 161078 - DNA, 75 bp, Artificial Sequence
  Synthetic
ttgttaaggaacacggtctggtcactaaagttggtcaggctgacgtccaccccaccccggcgccacctgcagggc

SEQ ID NO: 161079 - DNA, 75 bp, Artificial Sequence
  Synthetic
gagagatctggggccaaggacccccgcgtcactgtgggggctgtagaaggaggtgaggtggtgcttgtgaaggta

SEQ ID NO: 161080 - DNA, 75 bp, Artificial Sequence
  Synthetic
cgaaggcgcagctggcccacctaaagagagatctggggccaaggacccccgcgtcactgtgggggctgtagaagg

SEQ ID NO: 161081 - DNA, 75 bp, Artificial Sequence
  Synthetic
ttcactagaataccctgcatggccaggcccgacctgccaaagattgtcggcctgtggtgagggatagaagggggg

SEQ ID NO: 161082 - DNA, 75 bp, Artificial Sequence
  Synthetic
aacgtgccccgatggctaggccgtccgggcagcatgccccgagcagcaaacacgcggcagaccctcgtgagaccc

SEQ ID NO: 161083 - DNA, 75 bp, Artificial Sequence
  Synthetic
cctgtggtgagggatagaaggggggggcacggtgagtgtcactgagacggtctgatgggggaagagggccaggtc

SEQ ID NO: 161084 - DNA, 75 bp, Artificial Sequence
  Synthetic
ggggggtacccagccaagcgtgaccaaggggcccctggtgacccaggcaaacctgacaaagaaggccccccagga

SEQ ID NO: 161085 - DNA, 75 bp, Artificial Sequence
  Synthetic
ttcaagcagagtgacccgttctcgggcgtcgacgcggtattcactcctctctccctgtttatcctaatgaatcac

SEQ ID NO: 161086 - DNA, 75 bp, Artificial Sequence
  Synthetic
ggcagagggatctagcccttcggggaagaagtcccccggcttggagctttccctcggtagggcgctgtaggcgtc

SEQ ID NO: 161087 - DNA, 75 bp, Artificial Sequence
  Synthetic
aatttcagcgtaaaaacacaaatgctcggtaatgagatagacagccttcgtatggggtgtcagctggccaaagtc

SEQ ID NO: 161088 - DNA, 75 bp, Artificial Sequence
  Synthetic
ggcacggtgagtgtcactgagacggtctgatgggggaagagggccaggtcctttggcaaagagacgtccaggccc

SEQ ID NO: 161089 - DNA, 75 bp, Artificial Sequence
  Synthetic
ctggggggtggcatatctgaaggcagccaggtggattttgagctccgatggacgcagcgtggagttgtagcgccg

SEQ ID NO: 161090 - DNA, 75 bp, Artificial Sequence
  Synthetic
gccaggtggattttgagctccgatggacgcagcgtggagttgtagcgccgctgattctggaggattagccggagt

SEQ ID NO: 161091 - DNA, 75 bp, Artificial Sequence
  Synthetic
agctgagactccatggagcggatcttctttagatagagctccctctccttctctaggccattaatctggtcaaat

SEQ ID NO: 161092 - DNA, 75 bp, Artificial Sequence
  Synthetic
tttgttctgcatgttattactgattgtcgctggcatactctttattcttgctatcctgaccgaatggggaagtgg

SEQ ID NO: 161093 - DNA, 75 bp, Artificial Sequence
  Synthetic
ggaggtgctgccccacagcatgagcccatgaccctcgggtgggcgggcatagaggcctaggtccacagttgtggt

SEQ ID NO: 161094 - DNA, 75 bp, Artificial Sequence
  Synthetic
caccaacaggtgttgccttgttatgtcactgttctgacacatgacttacatgggtttggcttttgtaggctttgc

SEQ ID NO: 161095 - DNA, 75 bp, Artificial Sequence
  Synthetic
ccccatcctgatcaaagagggcctcgctgaccccggagatgacattctcattcagaaagtagtgatagaggtgat

SEQ ID NO: 161096 - DNA, 75 bp, Artificial Sequence
  Synthetic
agggttatgaggcagcgggtcatgtgggccattgtcatcagtgttgtcagggtcctgtgggccattgtcatcagt

SEQ ID NO: 161097 - DNA, 75 bp, Artificial Sequence
  Synthetic
tgatctaacagacagggacggcggcgctatatataagagcccaagacccggctctctttactgcgaaatggggaa

SEQ ID NO: 161098 - DNA, 75 bp, Artificial Sequence
  Synthetic
gggccgggtgtacggccggcggctgccggtgcgcatgtccaaggtgctgatgctgtgccccaggaacatcaagat

SEQ ID NO: 161099 - DNA, 75 bp, Artificial Sequence
  Synthetic
atgctcttgcactcttgttgctagcctccgcgctaatcgccggtggcagtattttgcaaacaaacttcaagagtt

SEQ ID NO: 161100 - DNA, 75 bp, Artificial Sequence
  Synthetic
agatcttggcatgctccagcgtgcggtagcacatgaaaatgttctggtagaggcgctgcaccgggctgtcgaagg

SEQ ID NO: 161101 - DNA, 75 bp, Artificial Sequence
  Synthetic
gccggccggcgcttccagtcccacaaacgcggcggcggcttccctgactgaagcccaggaccagttctactccta

SEQ ID NO: 161102 - DNA, 75 bp, Artificial Sequence
  Synthetic
tcaccgttccggcaaagatggccggggggaagagcacatgcagcctgatgcggcggccaccgtagtaggccacgt

SEQ ID NO: 161103 - DNA, 75 bp, Artificial Sequence
  Synthetic
gggagggagtcatcgtggtggtgttcatcagtgtgtcgtggtccatgataatacatccagattaaaatggccata

SEQ ID NO: 161104 - DNA, 75 bp, Artificial Sequence
  Synthetic
ggggaagagcacatgcagcctgatgcggcggccaccgtagtaggccacgtactcgtcgctcctcggaaggtactc

SEQ ID NO: 161105 - DNA, 75 bp, Artificial Sequence
  Synthetic
gtaactcaaggccaagcatttcacacctgcaaatgcaccatgtaaccacagatctaaactgaaagttgcagcttt

SEQ ID NO: 161106 - DNA, 75 bp, Artificial Sequence
  Synthetic
tctgggcacttctgacgcttgtcttagtcattatagcctcagccatctacctgatgtacgtctgctttaacaagt

SEQ ID NO: 161107 - DNA, 75 bp, Artificial Sequence
  Synthetic
agtcattatagcctcagccatctacctgatgtacgtctgctttaacaagtttgtgaacacgctgctgacggatta

SEQ ID NO: 161108 - DNA, 75 bp, Artificial Sequence
  Synthetic
gggcgtgaattttcgctgcttgtccttttcctgcatgccgtttgatgatagaattccaggaggtttaaaaatgat

SEQ ID NO: 161109 - DNA, 75 bp, Artificial Sequence
  Synthetic
gatggggatatttaaaaggggcagcaatctcggctgtctgtacttcttctctgctcgttaaaccaatagcatgtc

SEQ ID NO: 161110 - DNA, 75 bp, Artificial Sequence
  Synthetic
ggcctcccaccgccacgtagacgcgggccaccgtccggggaaggtcagtggggtcccagctcagcaattctccaa

SEQ ID NO: 161111 - DNA, 75 bp, Artificial Sequence
  Synthetic
aatctcggctgtctgtacttcttctctgctcgttaaaccaatagcatgtcagctccacgcaaagtcagattgcct

SEQ ID NO: 161112 - DNA, 75 bp, Artificial Sequence
  Synthetic
ggcttcttaacggcgggcaccatgccggtggcgcagatccagtccacataacgctcataggagagcacggagcgg

SEQ ID NO: 161113 - DNA, 75 bp, Artificial Sequence
  Synthetic
tgttgaggaatttcatgtagggcccgttgatgatgtagttctccctcctggtagtggacttgatgaagctgttct

SEQ ID NO: 161114 - DNA, 75 bp, Artificial Sequence
  Synthetic
cagttccaggccatcaatcaccttgtcctgtttgacaacgcccttcgcaagtacgattccggccaggtggcggcg

SEQ ID NO: 161115 - DNA, 75 bp, Artificial Sequence
  Synthetic
ctgccttacactggaaagtgaggagcgcccaccgaccccatatcgcaacactgtataaaggtaagtattattacg

SEQ ID NO: 161116 - DNA, 75 bp, Artificial Sequence
  Synthetic
ctccaaagagagacgcccaagaaacccatccacagcatttgaaacggccgcctgaagaaacccatccacagcatt

SEQ ID NO: 161117 - DNA, 75 bp, Artificial Sequence
  Synthetic
aggtaatgattacgcaggccacgggccgtttggcgtctcaggctatgaagaagattgaagacaaggtgcggaaat

SEQ ID NO: 161118 - DNA, 75 bp, Artificial Sequence
  Synthetic
gacttcatatgtatgccttggcatgacgtcaactttacttttatttcagttctggtgatgcttgtgctcctgata

SEQ ID NO: 161119 - DNA, 75 bp, Artificial Sequence
  Synthetic
gccgtacacccggccctgcagggccgcgtccaggtctggcaggtcgcaggtgggctccccatgcaccaccttggc

SEQ ID NO: 161120 - DNA, 75 bp, Artificial Sequence
  Synthetic
aaagatcgtgtccgcgctgcgagacacttactcgggccacttggtccttcagcccacggagacccttgacacatg

SEQ ID NO: 161121 - DNA, 75 bp, Artificial Sequence
  Synthetic
tgttgggtgcaaaaggccaacccagccctggtgagggaacacgaccacgagaatcaaacgaccctaacgccaccc

SEQ ID NO: 161122 - DNA, 75 bp, Artificial Sequence
  Synthetic
cccctgtttgccgactgtgagggcccagaggcccgtatggctgcgttacaccgatataatgccagcctggccccc

SEQ ID NO: 161123 - DNA, 75 bp, Artificial Sequence
  Synthetic
agacacgctgccggcgcgtgctcgacctggtgctggcggatgcccgggtaaaggaggcggccagcctcctctccc

SEQ ID NO: 161124 - DNA, 75 bp, Artificial Sequence
  Synthetic
cagcgggggacctgccgttggatcttagtgttattttatttaaccacgcctccgaagaggcggccgccagtacgg

SEQ ID NO: 161125 - DNA, 75 bp, Artificial Sequence
  Synthetic
tcttttacagtggttctcctgatttgctcttcgtgctcttcatgtccactgagcaagatccttctggcacgactg

SEQ ID NO: 161126 - DNA, 75 bp, Artificial Sequence
  Synthetic
cagacgcctccgtgaggcgtatagtcaggaggatagggaccctggctaagcgccgcgtcctacaactcccggata

SEQ ID NO: 161127 - DNA, 75 bp, Artificial Sequence
  Synthetic
tgaaaagcccatccctcacaatgcgttcagagaggcgagaccaaatttccctgggaatagaaaggtctgttcctg

SEQ ID NO: 161128 - DNA, 75 bp, Artificial Sequence
  Synthetic
atgtcgacaagttacgcctgaaggcgcagtccgccatgaccagcagcagcagaagggtcagcacagccagagagg

SEQ ID NO: 161129 - DNA, 75 bp, Artificial Sequence
  Synthetic
gctgggcatcttctgcttccttttctgagctgctatctgataactctatgaggacgttttcccaatctcccgccg

SEQ ID NO: 161130 - DNA, 75 bp, Artificial Sequence
  Synthetic
tgctagcctccgcgctaatcgctggtggcagtattttgcacccggccaccagaagggccctctggaagcccgccg

SEQ ID NO: 161131 - DNA, 75 bp, Artificial Sequence
  Synthetic
cccactgcagtactagcatggagaggtttgagaatctgggctgggacgttggcgggacaggcacggtggcttggg

SEQ ID NO: 161132 - DNA, 75 bp, Artificial Sequence
  Synthetic
ggccaagcgctccagcccgtaggattgcatgcccttgaccgtggccccataagcccgtaggattgcatgcccttg

SEQ ID NO: 161133 - DNA, 75 bp, Artificial Sequence
  Synthetic
ggcgggacaggcacggtggcttgggctgtggtaaccggtgggctcgtaaaagtccagcggggccgcagtttgcta

SEQ ID NO: 161134 - DNA, 75 bp, Artificial Sequence
  Synthetic
ctgtggtaaccggtgggctcgtaaaagtccagcggggccgcagtttgctagaagtgctgggaggtagataggtgg

SEQ ID NO: 161135 - DNA, 75 bp, Artificial Sequence
  Synthetic
ccaatagaatgacctccaggtaccacccacctggttacacaccttaatgtaacccaacgggctaaaatcacacac

SEQ ID NO: 161136 - DNA, 75 bp, Artificial Sequence
  Synthetic
ccaatcttggatccggaagacgtcttgctcaccctgcatctacacctggatccgcgccgggcagacaactcggcc

SEQ ID NO: 161137 - DNA, 75 bp, Artificial Sequence
  Synthetic
gtgggctctgtacttgtccgggctccatgtcctgtggtgtgctttccaccggtggtagaattggcctttccacct

SEQ ID NO: 161138 - DNA, 75 bp, Artificial Sequence
  Synthetic
gcaacctggctaaagggggcaccggggaacatctgctgctctggtaccaacggcccctccattggttgctgaggg

SEQ ID NO: 161139 - DNA, 75 bp, Artificial Sequence
  Synthetic
gcgggtgaggcggctaagagggctaagggtcggcgggtgacgaagcagcagacgggggatatgggaatttcagaa

SEQ ID NO: 161140 - DNA, 75 bp, Artificial Sequence
  Synthetic
gctgagttcaggcgaaccaagcccagggggctctactcgggagtctctggccccgcctttgaggtcctgagagac

SEQ ID NO: 161141 - DNA, 75 bp, Artificial Sequence
  Synthetic
ggtggtagaattggcctttccacctgttgaggtgaccgtgggaaccgccgtcttttggccactgggggcctgggg

SEQ ID NO: 161142 - DNA, 75 bp, Artificial Sequence
  Synthetic
tccagcggcgggacctggccaaatactggccggtactctccgacattgccgctgagttcaggcgaaccaagccca

SEQ ID NO: 161143 - DNA, 75 bp, Artificial Sequence
  Synthetic
gtccgcgggctccgggggctgcgggcgttggacggcggcggacgttcaggggatgggggggtctgggggcgctgc

SEQ ID NO: 161144 - DNA, 75 bp, Artificial Sequence
  Synthetic
ctcccagatcagggccatcaagcccatccctctccgcgacgggacctacacctacaccggcaagcagcgcaacct

SEQ ID NO: 161145 - DNA, 75 bp, Artificial Sequence
  Synthetic
ggctggtgtcacctgtgttatattttcaccacctgttgggtgagcggaggttagtaaaggcatatgtgacgttga

SEQ ID NO: 161146 - DNA, 75 bp, Artificial Sequence
  Synthetic
ttagtaaaggcatatgtgacgttgaattgtcactggtggaggggctgagtgtctctgagattgaactgggtctca

SEQ ID NO: 161147 - DNA, 75 bp, Artificial Sequence
  Synthetic
cctcacccgggttattagccctcaagaaaactgccacgccctataacactaggaccctcacgttggccaggaaag

SEQ ID NO: 161148 - DNA, 75 bp, Artificial Sequence
  Synthetic
ggttggggtagtcactgctgaggtgggacttgtttttcccaaggtggggatggtggcatttggggttggggtagt

SEQ ID NO: 161149 - DNA, 75 bp, Artificial Sequence
  Synthetic
cctcctcccatattcaagatattcagcatagttgtcactacgggacccatgaagtgttacagaatccaagttact

SEQ ID NO: 161150 - DNA, 75 bp, Artificial Sequence
  Synthetic
cgcgctgcgagacacttactcgggccacttggtccttcagcccacggagacccttgacacatggaaggtgttgag

SEQ ID NO: 161151 - DNA, 75 bp, Artificial Sequence
  Synthetic
gaagtgttacagaatccaagttactgtttccaattcagggtccagtacaaacaacagctgccacattcattagct

SEQ ID NO: 161152 - DNA, 75 bp, Artificial Sequence
  Synthetic
tcctcgatcccctggcccagtacaagaccctggtcggtcttccgggcctcacggcccacacctggctccaaaaga

SEQ ID NO: 161153 - DNA, 75 bp, Artificial Sequence
  Synthetic
acggcccacacctggctccaaaagaattatgcacgcctcggtaactactcgcagttcgccgaccaagacatggtc

SEQ ID NO: 161154 - DNA, 75 bp, Artificial Sequence
  Synthetic
cggtgatgcgcctgacgttgtgccggctggtgttgggctggtgacatccgcggtggatacagtggggcctgtgct

SEQ ID NO: 161155 - DNA, 75 bp, Artificial Sequence
  Synthetic
cggtggatacagtggggcctgtgcttgcaggtgcggtgaggttggtaggcacgtgagtagagctgggtagacctg

SEQ ID NO: 161156 - DNA, 75 bp, Artificial Sequence
  Synthetic
tcggtcaactgcaagaccaaaaagtccatctgtggctataccggcaccttcggggactttatggacacgctcgag

SEQ ID NO: 161157 - DNA, 75 bp, Artificial Sequence
  Synthetic
cctctcctctaattgcaccggccagtcaggtgctgatgggaaaatacccatgtaacctacccttcttgctatggg

SEQ ID NO: 161158 - DNA, 75 bp, Artificial Sequence
  Synthetic
tcaggtgctgatgggaaaatacccatgtaacctacccttcttgctatggggtgaacaagggggaaaagggcccgc

SEQ ID NO: 161159 - DNA, 75 bp, Artificial Sequence
  Synthetic
ttacattgggctaacgggaggaaatgaacccaggggtggcagtggatggggtcatttatgggcaaaactcacagg

SEQ ID NO: 161160 - DNA, 75 bp, Artificial Sequence
  Synthetic
cctcgcgaaagaacacccgtcggcacaggcatccggcattcgtgaaggccgccaggaggctttcatggcccctgg

SEQ ID NO: 161161 - DNA, 75 bp, Artificial Sequence
  Synthetic
gtgcccctgcccgggcgtacgtgggatccggaggtgactgctgggatggagctgggcgaactgccgctggaggtt

SEQ ID NO: 161162 - DNA, 75 bp, Artificial Sequence
  Synthetic
aaagtcagtttcagtgttgtttggccaggcccaaaaggcagtcactgtaacatttggcgagtttgcgtcctcaga

SEQ ID NO: 161163 - DNA, 75 bp, Artificial Sequence
  Synthetic
catagtcaaggtccaggatcaggacactggatccacatggtccaagtaggtcacctcaaacctactgccttatgc

SEQ ID NO: 161164 - DNA, 75 bp, Artificial Sequence
  Synthetic
ccgctgtcttctatgcccgagtactggctcccccggccgcaaattctgcccccctctgctccctgttaaacatat

SEQ ID NO: 161165 - DNA, 75 bp, Artificial Sequence
  Synthetic
agtgaccattggcactgaataggtagcattgtcacccacatatgtgatgtctgtggtgtttgtcggcatgtcctg

SEQ ID NO: 161166 - DNA, 75 bp, Artificial Sequence
  Synthetic
agcccaccaaggccccaccaattgatattctggaggtttggcccacctgtaacacaaagtggacgcagcacttat

SEQ ID NO: 161167 - DNA, 75 bp, Artificial Sequence
  Synthetic
cccctctgctccctgttaaacatatataatgacctcagggcctatttcaggcaatgcctggatgtggccgtccgc

SEQ ID NO: 161168 - DNA, 75 bp, Artificial Sequence
  Synthetic
tgaagctggaatctcatcagagaacacaatgttggactgaatgcagtaatctcccccgctcgccttcggtccatt

SEQ ID NO: 161169 - DNA, 75 bp, Artificial Sequence
  Synthetic
tcgccgccctgtccccatcaaagagcatgtttaaaatgttagcataagtctccccgtggacgttctccatggcct

SEQ ID NO: 161170 - DNA, 75 bp, Artificial Sequence
  Synthetic
tccccttctgcacatttaccaacaacatgctgattcgcgacaacatagagttcacctcagacgagcctctccttc

SEQ ID NO: 161171 - DNA, 75 bp, Artificial Sequence
  Synthetic
tattctggaggtttggcccacctgtaacacaaagtggacgcagcacttatcagcgctggaggcacgggggcaaag

SEQ ID NO: 161172 - DNA, 75 bp, Artificial Sequence
  Synthetic
gaaaaacacagggtcatagaacagaattagtgttaacaagaaattaataataaggccaatttgcaaaaaaaaggg

SEQ ID NO: 161173 - DNA, 75 bp, Artificial Sequence
  Synthetic
cccagagtaaaacacgtacagtatactgttattgccaagaaatcgtgacactggacgtggtgtcagacgcaggct

SEQ ID NO: 161174 - DNA, 75 bp, Artificial Sequence
  Synthetic
gcactacattgtctggcttaagggtccctcctaaagagccaagtgcacctgcctaacctcgtgatttgggacccc

SEQ ID NO: 161175 - DNA, 75 bp, Artificial Sequence
  Synthetic
cagagctaccacaacgcaatctgcgattctccgacccagggtgacttcgaaaaatagtctaaagtccgtaaacgt

SEQ ID NO: 161176 - DNA, 75 bp, Artificial Sequence
  Synthetic
tactaacaagctgtatgagactatagaggacaagtccctgaacctctgcagcatccgtgactatggcattagctc

SEQ ID NO: 161177 - DNA, 75 bp, Artificial Sequence
  Synthetic
tgagaattccgccgctgggaacatggctctcgtatccactgcaggtgatgttaaatttgttgtctccgggcagaa

SEQ ID NO: 161178 - DNA, 75 bp, Artificial Sequence
  Synthetic
agttctacaatgccaggggggaccttaacatccgagacctccgggcccacgtcaaggcccggatgatctcgtccc

SEQ ID NO: 161179 - DNA, 75 bp, Artificial Sequence
  Synthetic
caaacttaagggtagcgtgacatccagcccctgtgcccttactactgccgttatattggtagaattacagttatc

SEQ ID NO: 161180 - DNA, 75 bp, Artificial Sequence
  Synthetic
agcccctgtgcccttactactgccgttatattggtagaattacagttatcccactttatgtatggcactgtttct

SEQ ID NO: 161181 - DNA, 75 bp, Artificial Sequence
  Synthetic
ctaacgggtgcaaaggcctgccccgcagcctgtgtcagggatggctcccagggccggacaataggcccagccggg

SEQ ID NO: 161182 - DNA, 75 bp, Artificial Sequence
  Synthetic
tcccctatccgagatgatcactggggaggggaaccccgcgagcggctacatcgtggatgccctaaagaactcacg

SEQ ID NO: 161183 - DNA, 75 bp, Artificial Sequence
  Synthetic
gaggggaaccccgcgagcggctacatcgtggatgccctaaagaactcacgcgcactactggtttactgaataaaa

SEQ ID NO: 161184 - DNA, 75 bp, Artificial Sequence
  Synthetic
tcagcgatgattttctctaggctctccgggcccagctccagcagctcttcccgtgaggcagggagggggcgctgc

SEQ ID NO: 161185 - DNA, 75 bp, Artificial Sequence
  Synthetic
tgcccacagtcaggtctggaccaggcccggtggggctcctcccttgccctatcgtacctgggatcgaatgacaga

SEQ ID NO: 161186 - DNA, 75 bp, Artificial Sequence
  Synthetic
tctacagattccaggcttacttgttgctcctctccggtggtgatgttaattggaagcttcttagaccgcatagtt

SEQ ID NO: 161187 - DNA, 75 bp, Artificial Sequence
  Synthetic
aattgtagttgttattgcccttaatggggggggtggtttccatcatgtgtttattgtatgtattgggacttgaag

SEQ ID NO: 161188 - DNA, 75 bp, Artificial Sequence
  Synthetic
agagccaattctcctgcaccaaggagctccagtagaaagagattggtggcattttctgagccaccaaatgcacct

SEQ ID NO: 161189 - DNA, 75 bp, Artificial Sequence
  Synthetic
ggcagcctggaggtctggcaggtgcctgacgtctgagaaaaagtcctgggtggtgccctcaagcaccgccaccac

SEQ ID NO: 161190 - DNA, 75 bp, Artificial Sequence
  Synthetic
ccaaaagatggtctcttctagcatggccaccagggtgcagagccccgcgttctggatcgcctgcatgcgtgcatc

SEQ ID NO: 161191 - DNA, 75 bp, Artificial Sequence
  Synthetic
tgggtagcatatgctatcctaatctatatctgggtagcatatactacccaagtctatatctgggtagcatatgct

SEQ ID NO: 161192 - DNA, 75 bp, Artificial Sequence
  Synthetic
cacaggtcaaacaggctagtgttgaggtgcagccaccccagttgacccaagtatcccctcagcaaccaatggagg

SEQ ID NO: 161193 - DNA, 75 bp, Artificial Sequence
  Synthetic
gctccagtagaaagagattggtggcattttctgagccaccaaatgcacctcgaggttggtagacagcctttgtat

SEQ ID NO: 161194 - DNA, 75 bp, Artificial Sequence
  Synthetic
acatcgaaattgatagttgcattgacatctgccgtgcaaacattgcacgctgggtaaaatgggaattccagaatc

SEQ ID NO: 161195 - DNA, 75 bp, Artificial Sequence
  Synthetic
ggggggggtggtttccatcatgtgtttattgtatgtattgggacttgaaggtggaggggggcggcgtggagctgg

SEQ ID NO: 161196 - DNA, 75 bp, Artificial Sequence
  Synthetic
tcaacattgaaaaaaccaggatcatcacgcgtgagttggataaggctctggatggtgtactgacacacaagcaag

SEQ ID NO: 161197 - DNA, 75 bp, Artificial Sequence
  Synthetic
cccccaccagtcaccccgtccgtgtccactcacatattccactcttatttttaaattcatgtgtcccaattagaa

SEQ ID NO: 161198 - DNA, 75 bp, Artificial Sequence
  Synthetic
ctcttgaagatcgtgaggcctgagagccgggggttgcttcatcctcgtcgctctcgctgtagtcagactcgtctg

SEQ ID NO: 161199 - DNA, 75 bp, Artificial Sequence
  Synthetic
gagtcacactttcgttgcagacaaaatggacaaggacaggccgggtctcccggccccggatgacaacatagaaga

SEQ ID NO: 161200 - DNA, 75 bp, Artificial Sequence
  Synthetic
caatctcctctaaccaaccttttcccaatcaattctgtgacagagtttcctggacacccagtcttagttcagata

SEQ ID NO: 161201 - DNA, 75 bp, Artificial Sequence
  Synthetic
tcatcactggggtactcttcctccaaatcaatctcctcgtcttcatctgagtagtcagactcatcagtgtcactc

SEQ ID NO: 161202 - DNA, 75 bp, Artificial Sequence
  Synthetic
aatcaatctcctcgtcttcatctgagtagtcagactcatcagtgtcactcacgtcctcctcctggatagactggg

SEQ ID NO: 161203 - DNA, 75 bp, Artificial Sequence
  Synthetic
gtatatctttctgccgaaagtgacctagcacgacgtgccatcaagaaggctgtttcgatcttttggttttggtct

SEQ ID NO: 161204 - DNA, 75 bp, Artificial Sequence
  Synthetic
aaaatgtcctcatagagatatcagatagcagctcagaagaggaagcagaagatgcccacctggagccatcccaga

SEQ ID NO: 161205 - DNA, 75 bp, Artificial Sequence
  Synthetic
ggaaaaggacaagcagcgaaaattcacgcccccttgggaggtggcggcatatgcaaaggatagcactcccactct

SEQ ID NO: 161206 - DNA, 75 bp, Artificial Sequence
  Synthetic
tgcaagaccggaccccacgcgacttcagaaacatggccatagttatgacccctctacagcctccaatctatctca

SEQ ID NO: 161207 - DNA, 75 bp, Artificial Sequence
  Synthetic
agctccccatggcggaaaagcgtctggactggataggcgcccggcatgccagctgacgccacggcaggcttgcgc

SEQ ID NO: 161208 - DNA, 75 bp, Artificial Sequence
  Synthetic
cctctacagcctccaatctatctcaccgagccccttctcacgcaaaaagttgttagcgaggacaaagtggttgtt

SEQ ID NO: 161209 - DNA, 75 bp, Artificial Sequence
  Synthetic
tggatcaccctggtcgagaagccattctctacaggtttccgctagatttaagaaggtttattcaagcaattggag

SEQ ID NO: 161210 - DNA, 75 bp, Artificial Sequence
  Synthetic
agccggcagctgcgcctctttgtctgtcatccggaagaggaagacaagcacagctatgttaagaatgccctcaac

SEQ ID NO: 161211 - DNA, 75 bp, Artificial Sequence
  Synthetic
ccgagccccttctcacgcaaaaagttgttagcgaggacaaagtggttgttgcccaggaacttctgctgggcactc

SEQ ID NO: 161212 - DNA, 75 bp, Artificial Sequence
  Synthetic
cagctatgttaagaatgccctcaacattcaaaacctcttacatcactcactgcacgtgggctggccggcccccaa

SEQ ID NO: 161213 - DNA, 75 bp, Artificial Sequence
  Synthetic
ggtgctgcagaccctgcgctccatgaacatgtacccggcagtcctcggtcgagtgggcgagcaaggtccagatca

SEQ ID NO: 161214 - DNA, 75 bp, Artificial Sequence
  Synthetic
cagatgcttcttggagttgattagtgaagctttgtctcccgccttcgcaccccacagcataaacacgcacgcttt

SEQ ID NO: 161215 - DNA, 75 bp, Artificial Sequence
  Synthetic
atttgttgccgttggtttcagcaccccgacacgcgagccatagaccagtttttcggatcccagatttcaaatacc

SEQ ID NO: 161216 - DNA, 75 bp, Artificial Sequence
  Synthetic
ccctgacaacactgatgacaatggcccacaggaccctgacaacactgatgacaatggcccacatgacccgctgcc

SEQ ID NO: 161217 - DNA, 75 bp, Artificial Sequence
  Synthetic
ggacccgcgagaccctgccccccaccgtggagaatgtctgcgccatgatagagggacatctgggcctggatctcg

SEQ ID NO: 161218 - DNA, 75 bp, Artificial Sequence
  Synthetic
taaccgctcagagagcaatgaaattacgtggtcagtaaaccacgcccagccaatgtctgcgtgcgagccgggctt

SEQ ID NO: 161219 - DNA, 75 bp, Artificial Sequence
  Synthetic
gggccagtgggggggcatctggctccgaggacccaccagattatggagatcaaggtaatgtgacacaggtgggat

SEQ ID NO: 161220 - DNA, 75 bp, Artificial Sequence
  Synthetic
gcccttttgcacggtcaggatggtgttgagtagcaacaccccctgggaggcccacgcgtctagacagccgtgatc

SEQ ID NO: 161221 - DNA, 75 bp, Artificial Sequence
  Synthetic
agtcaggtcaaatggagaatgaccaccctggccgctggttggcctatgggttaccaggcatacagtagctggatg

SEQ ID NO: 161222 - DNA, 75 bp, Artificial Sequence
  Synthetic
cgtggagaatgtctgcgccatgatagagggacatctgggcctggatctcgtcgcctgggtcagctcctgcatctg

SEQ ID NO: 161223 - DNA, 75 bp, Artificial Sequence
  Synthetic
cccagtttctccatgtcacgtttgagcaaaccgggccaaacttagttcaggtgtgccatgcccggggcaggaact

SEQ ID NO: 161224 - DNA, 75 bp, Artificial Sequence
  Synthetic
cccagtgtctcttccatgccattcctttccatatgttttacggggacccgcgagtggctgccaccatgcaccagg

SEQ ID NO: 161225 - DNA, 75 bp, Artificial Sequence
  Synthetic
tcaggctgggggggactggaaagccgtatgcgacgctgaatgccaggccgtttgcttgacccccgtgataggggt

SEQ ID NO: 161226 - DNA, 75 bp, Artificial Sequence
  Synthetic
ttcctggaaaaagtggagggggcgtggccttcccccgcggtcccctggcccccccgcacagagaggcgcaacggg

SEQ ID NO: 161227 - DNA, 75 bp, Artificial Sequence
  Synthetic
aggtgtcatgtgaccttttctgccggcacctttaggccgccgcgatgtagtcccggggatcgccagtggttgtat

SEQ ID NO: 161228 - DNA, 75 bp, Artificial Sequence
  Synthetic
ggacccggggaggccagaagctggggtctagggtggagaaaacctaagagatatttggtgtcacttccgcatttt

SEQ ID NO: 161229 - DNA, 75 bp, Artificial Sequence
  Synthetic
ggctcccctgtgattattcctcctaatttcatcacggagctggaatacaacaacacctacgaggcccccctgagc

SEQ ID NO: 161230 - DNA, 75 bp, Artificial Sequence
  Synthetic
gcaaacaggaacacaaacaaaccaagggtgttggcccctacaggctcccaaggcgggggttgggcccagggccaa

SEQ ID NO: 161231 - DNA, 75 bp, Artificial Sequence
  Synthetic
cgcctaggttttgagagcagagtgggggtccgtcgccggctccactcacgagcaggtggtgtctgccctcgttgg

SEQ ID NO: 161232 - DNA, 75 bp, Artificial Sequence
  Synthetic
gcaaaccgggccaaacttagttcaggtgtgccatgcccggggcaggaactttgcgtgcctgaggcatacccacag

SEQ ID NO: 161233 - DNA, 75 bp, Artificial Sequence
  Synthetic
cataggagcctcacgaaaatctgggatgaagtggtaacacctgatcagcgtgttacatttatggaattcctgggc

SEQ ID NO: 161234 - DNA, 75 bp, Artificial Sequence
  Synthetic
gacagcactacatcccagctagcccgtcgtagagacagacaagatggttccttctcagagactctcccgaactag

SEQ ID NO: 161235 - DNA, 75 bp, Artificial Sequence
  Synthetic
tcagtgcttcgccggtcgctgtggggccaatcaaccgaccgcccatttctccatcagcgtgcccgcctccagaat

SEQ ID NO: 161236 - DNA, 75 bp, Artificial Sequence
  Synthetic
gcacctttaggccgccgcgatgtagtcccggggatcgccagtggttgtatgttcagagccgcgtgggtgaccttg

SEQ ID NO: 161237 - DNA, 75 bp, Artificial Sequence
  Synthetic
atgaagtggtaacacctgatcagcgtgttacatttatggaattcctgggctttttgcaacgcacggagttggtct

SEQ ID NO: 161238 - DNA, 75 bp, Artificial Sequence
  Synthetic
agcttccgtccccgggacgtggtgcttcctaaaggcggggctcatggattagcaccctggagttgaaccagtacc

SEQ ID NO: 161239 - DNA, 75 bp, Artificial Sequence
  Synthetic
ccgtggatggatgagaatcctagcacagagacggcacaggcttggaatgccggcttgctccgggggcgtgcgtac

SEQ ID NO: 161240 - DNA, 75 bp, Artificial Sequence
  Synthetic
cagagacggcacaggcttggaatgccggcttgctccgggggcgtgcgtacgggcaagacttgcttagaactgaag

SEQ ID NO: 161241 - DNA, 75 bp, Artificial Sequence
  Synthetic
aaagatatactttgttctttgatttagtatcctccggaaacaccctgtatgctatatggattgggctgggcacga

SEQ ID NO: 161242 - DNA, 75 bp, Artificial Sequence
  Synthetic
caaggcagtctccaccttttgtctcccctctgcagagagccacattctggaactcgaagcggtctcagacaccaa

SEQ ID NO: 161243 - DNA, 75 bp, Artificial Sequence
  Synthetic
gtgcctgcatggtggcgggtgcccactggcacaagagcttggtaggaggacccgttggtgtgggctgatatggaa

SEQ ID NO: 161244 - DNA, 75 bp, Artificial Sequence
  Synthetic
gggctgctccagaaacacgtcagttccagcaatcactacaaactgcacctctgtgttgctggtggctgggtgccc

SEQ ID NO: 161245 - DNA, 75 bp, Artificial Sequence
  Synthetic
acagagagcgatggggatgatgaagaacttcctcgtgtagtgtccagggatggaactaagcacagacgaccccct

SEQ ID NO: 161246 - DNA, 75 bp, Artificial Sequence
  Synthetic
acatgggtatccacacccaagacttctttagcgtctttccggccgaggcctttggcaaccagcaagtcaacgact

SEQ ID NO: 161247 - DNA, 75 bp, Artificial Sequence
  Synthetic
agtggagggggcgtggccttcccccgcggtcccctggcccccccgcacagagaggcgcaacggggggcgggcggc

SEQ ID NO: 161248 - DNA, 75 bp, Artificial Sequence
  Synthetic
gcgcaatgggacactgcttcgggaccccaggacatacctggcaggtatgactaatgttaatggagctccaggact

SEQ ID NO: 161249 - DNA, 75 bp, Artificial Sequence
  Synthetic
gggggctggtgcggacgcctgtgtttagtctatgccaatgtttacctgccttgggttactattccaaacgaccac

SEQ ID NO: 161250 - DNA, 75 bp, Artificial Sequence
  Synthetic
aaaggaacgggccagggagacactggcgaaggcccctaggcgcacttatggcacacctaggccgccagttcagaa

SEQ ID NO: 161251 - DNA, 75 bp, Artificial Sequence
  Synthetic
aaggccccctttttaaccctaaacgggtagcatatgcttcccgggtagtagcatatactatccagactaacccta

SEQ ID NO: 161252 - DNA, 75 bp, Artificial Sequence
  Synthetic
gcgaaggcccctaggcgcacttatggcacacctaggccgccagttcagaaaccaagaccagaggtcccgcaaagc

SEQ ID NO: 161253 - DNA, 75 bp, Artificial Sequence
  Synthetic
cccaggacatacctggcaggtatgactaatgttaatggagctccaggactctgccacggccagcaggccacctgt

SEQ ID NO: 161254 - DNA, 75 bp, Artificial Sequence
  Synthetic
cacacaggcctggcgggtggagatagggaccagaggactaatgttctctaactgtgtcccactccacctgccgga

SEQ ID NO: 161255 - DNA, 75 bp, Artificial Sequence
  Synthetic
gtcatgaggcaggcgcggaaagtcgctgcggcttgctggggcatggggggccgcgcattcctggaaaaagtggag

SEQ ID NO: 161256 - DNA, 75 bp, Artificial Sequence
  Synthetic
cacccacccattacatcagcaacacagcatggccccgtgtatggtagctcagaacccacgtgcacccttagggga

SEQ ID NO: 161257 - DNA, 75 bp, Artificial Sequence
  Synthetic
agcatggccccgtgtatggtagctcagaacccacgtgcacccttaggggaccaactcccaggtgttcctaaagat

SEQ ID NO: 161258 - DNA, 75 bp, Artificial Sequence
  Synthetic
catcttccatattatccatactttaatccccggcttccggtctgcaacctggtcctggacctggatctagaccgg

SEQ ID NO: 161259 - DNA, 75 bp, Artificial Sequence
  Synthetic
atgaatcttcgcctgcttcttcattctccttcgtttagctaatagaataactgctgagttgtgaacagtaagggg

SEQ ID NO: 161260 - DNA, 75 bp, Artificial Sequence
  Synthetic
atgattggaattggtggcactgcataactgggtgtctatctgaactaagactgggtgtccaggaaactctgtcac

SEQ ID NO: 161261 - DNA, 75 bp, Artificial Sequence
  Synthetic
gcctcagagtctccacgcggtttctcagaaatccagcatcgattgccttagctatgagcttcgtgaggggcagag

SEQ ID NO: 161262 - DNA, 75 bp, Artificial Sequence
  Synthetic
gccctgggagtcatccctgttacagtctccgggaagggcctttgcacccgttagcccacaacccatgccagtaga

SEQ ID NO: 161263 - DNA, 75 bp, Artificial Sequence
  Synthetic
acccgtccctgtccctactgtggcacttgagcgaccagtttgtcccgcacctcctgagattgctatgcagggccc

SEQ ID NO: 161264 - DNA, 75 bp, Artificial Sequence
  Synthetic
cgtgggttcctgtgtcaccgttgaggcggccatggccgttggggaacccccttgccccataacctgtatgggctg

SEQ ID NO: 161265 - DNA, 75 bp, Artificial Sequence
  Synthetic
gagggattagagaatcctgacttgcaaatgctctaggcgggaagccgctcttctcctcccccgggacttgacctc

SEQ ID NO: 161266 - DNA, 75 bp, Artificial Sequence
  Synthetic
ttctcctcccccgggacttgacctcgggacggcagcaccgcacagcgcgttggcggtgtgtccgaaaccactagg

SEQ ID NO: 161267 - DNA, 75 bp, Artificial Sequence
  Synthetic
tcctcggtagtcctttctacgtgactcctagccaggagaactcttaaaccttctgcaatgttctcaaatttcggg

SEQ ID NO: 161268 - DNA, 75 bp, Artificial Sequence
  Synthetic
tttaatggcaaacagttacccgaggtaagccgttccagatgcacccaacagcccctgcccttcaacacacagacg

SEQ ID NO: 161269 - DNA, 75 bp, Artificial Sequence
  Synthetic
gtgccagctgcatgggagtgggcagcacctgaggaggtggcgtgggagtgggcgccccccgaggcctctgcatgg

SEQ ID NO: 161270 - DNA, 75 bp, Artificial Sequence
  Synthetic
gtatcccctcagcaaccaatggagaggccgttggaaccagagcagcagatgttccctggttccccctttagccag

SEQ ID NO: 161271 - DNA, 75 bp, Artificial Sequence
  Synthetic
ctttgacctccccttaactcaacccattagccagggggcacccgcggccccgttgagggctagtatgggcccggt

SEQ ID NO: 161272 - DNA, 75 bp, Artificial Sequence
  Synthetic
ggaactgcgggataatggatgcataaatcctaaaactaaagtttggatcaaaacatgcggaccaccagctggtac

SEQ ID NO: 161273 - DNA, 75 bp, Artificial Sequence
  Synthetic
cagtattttgacatccccttaactgaacccattaaccagggggcatccgcggcccattttctccctcagcaacca

SEQ ID NO: 161274 - DNA, 75 bp, Artificial Sequence
  Synthetic
attgcgcataacaaaggtggcaacatcctggtgcatggtggcagccactcgcgggtccccgtaaaacatatggaa

SEQ ID NO: 161275 - DNA, 75 bp, Artificial Sequence
  Synthetic
ggtgaagtaggtgcgcatgtgctccgcaaagcccctgtccaggagcgaggggagcacgacgccccccgaaggcag

SEQ ID NO: 161276 - DNA, 75 bp, Artificial Sequence
  Synthetic
gctcctccagtccagttactcataacgatatacagccagaacagtagcgccaagagcaggagaaggagagcaagg

SEQ ID NO: 161277 - DNA, 75 bp, Artificial Sequence
  Synthetic
gagccagagtgttaggccaggggtagcgcagtcacaatattttgacctccccttaactcaacccattaaccatgg

SEQ ID NO: 161278 - DNA, 75 bp, Artificial Sequence
  Synthetic
tacttgcgggctacaaagttgttgatgaggcgggggacattgcaaactcgcatcttcaccaggggctctgagcac

SEQ ID NO: 161279 - DNA, 75 bp, Artificial Sequence
  Synthetic
caagacagaccacgtcaccgtgacggggcggggtttgctatagttggtgtgtaggcgggggttgcctatgctaac

SEQ ID NO: 161280 - DNA, 75 bp, Artificial Sequence
  Synthetic
ccttaactcaacccattaaccatggggcacccgcagcccatttcctccatcagccaccaatggaggggccgtggg

SEQ ID NO: 161281 - DNA, 75 bp, Artificial Sequence
  Synthetic
ctacctcctcgaccccggcctccactgcctcctcgaccccggcctccactgcctcctcgaccccggcctccacct

SEQ ID NO: 161282 - DNA, 75 bp, Artificial Sequence
  Synthetic
cgtctcctccctagcaaaacctctagggcagcgtaggtcctgaggttttgcagtgtctacaagtctacatctcct

SEQ ID NO: 161283 - DNA, 75 bp, Artificial Sequence
  Synthetic
acacccaatttctcccacgctcgttaactgagagtatcgcttaaaggttccctcgttgaagcactgtgcgtgggc

SEQ ID NO: 161284 - DNA, 75 bp, Artificial Sequence
  Synthetic
accctctctgggaacccgtgttgggagccccgctgcggggacgcttggtcatttcgacacattccagggtctctc

SEQ ID NO: 161285 - DNA, 75 bp, Artificial Sequence
  Synthetic
ccatcccggggttcccgtgtctcctgccgttaaccaatatcatttcagccaggctgcctttgggttacctattga

SEQ ID NO: 161286 - DNA, 75 bp, Artificial Sequence
  Synthetic
ttgcgtttccctgcccctctcctccatccttgcacgtcaagttacacgtgatagtgtctctaaaatttaataata

SEQ ID NO: 161287 - DNA, 75 bp, Artificial Sequence
  Synthetic
acggtcccagaggggggtccttaggtgccccatcttcccttcgcaggagggccaccagcctccgtgccgggtccg

SEQ ID NO: 161288 - DNA, 75 bp, Artificial Sequence
  Synthetic
agtagcggcagcatctaatgaccccaaagagggcaaagcctacaaaagccaaacccatgtaagtcatgtgtcaga

SEQ ID NO: 161289 - DNA, 75 bp, Artificial Sequence
  Synthetic
ctgccctcaggcccccgaatggcctgttcaaggggagggtggccaggatgccaccgaggttcttgatttgtcaat

SEQ ID NO: 161290 - DNA, 75 bp, Artificial Sequence
  Synthetic
gtgggcattggtgcaggtcgggaggaaaacgtagtaaaagatcttttccagcacatccgcatgcccctcatctac

SEQ ID NO: 161291 - DNA, 75 bp, Artificial Sequence
  Synthetic
tgacctgggagctccgagaccccgcttgagtgtgtgccccggtgggcatttagctgtgacattgctaggccccgc

SEQ ID NO: 161292 - DNA, 75 bp, Artificial Sequence
  Synthetic
ggggaggaggggaactggaagctcgcaggcctccctccgccgttactctgtagaatgatctccaggtcccccggt

SEQ ID NO: 161293 - DNA, 75 bp, Artificial Sequence
  Synthetic
tggccagctgccccgtggcccacacctgcccaatgtcctctgccctcacctcatctctcctcgttatcttataga

SEQ ID NO: 161294 - DNA, 75 bp, Artificial Sequence
  Synthetic
tccacccccgtcgtcatcaaggcccttgtggcctcaaacactgacattgcggaggccatcctggatgccatcctc

SEQ ID NO: 161295 - DNA, 75 bp, Artificial Sequence
  Synthetic
atgtctgccatagtttcgagtggtgaggagggactcttaatttatctaccatgtaattaggttgaactccagatg

SEQ ID NO: 161296 - DNA, 75 bp, Artificial Sequence
  Synthetic
agtttccggatctacaagatcctccagatgaggcctaagcaaaggtgtagaagtgtgtccccctccattccaccc

SEQ ID NO: 161297 - DNA, 75 bp, Artificial Sequence
  Synthetic
tcgcggcctgacgagggcttccgcctgttttgtttgtgccacaacgcctcgcccctccaccacgtggcgggttct

SEQ ID NO: 161298 - DNA, 75 bp, Artificial Sequence
  Synthetic
gtcacccgacaatgagcggggagataatgtacagactaccggcgagcatgatcaggaccctgggccggggcctcc

SEQ ID NO: 161299 - DNA, 75 bp, Artificial Sequence
  Synthetic
catctcccagccaatcctggcccatgggatatcgtacagcaatctttcttgctctcttggtccagcatggggtgg

SEQ ID NO: 161300 - DNA, 75 bp, Artificial Sequence
  Synthetic
gttactttctccaacccccattttgtggttgaggttaatgtcccgtgactgagggtttccacttctattgttgca

SEQ ID NO: 161301 - DNA, 75 bp, Artificial Sequence
  Synthetic
aggagggactcttaatttatctaccatgtaattaggttgaactccagatgggtgtattgtccgggaacccccagc

SEQ ID NO: 161302 - DNA, 75 bp, Artificial Sequence
  Synthetic
acgggagttaatgtgcgtagtgttgctgtacgatatcccatgggccaggattggctgggagatgtcagaagccaa

SEQ ID NO: 161303 - DNA, 75 bp, Artificial Sequence
  Synthetic
cttaaaacagttacacctgaaaaatgaagaaagcgtggctcagcagagcacagcaagccgatgccgggggggcat

SEQ ID NO: 161304 - DNA, 75 bp, Artificial Sequence
  Synthetic
gtccccgcccccctgtcattccaccctccaacggcgtgcaggctcccgcgccgccccccgctcccgcccccacca

SEQ ID NO: 161305 - DNA, 75 bp, Artificial Sequence
  Synthetic
ccgccccccgctcccgcccccaccagacacgccccccgcgcgccagcccccctcctcacggtcacgcatggctgc

SEQ ID NO: 161306 - DNA, 75 bp, Artificial Sequence
  Synthetic
gccctcgtcaggccgcgagaggatggcatcgaggatggcctccgcaatgtcagtgtttgaggccacaagggcctt

SEQ ID NO: 161307 - DNA, 75 bp, Artificial Sequence
  Synthetic
aacatgtaagggcccgctacccctacaacacaaaacaaactatctcccctaaccatccttttgccaatcaattct

SEQ ID NO: 161308 - DNA, 75 bp, Artificial Sequence
  Synthetic
gagcgtgacgaacggccccagggcaaacgtgacgcggggctccggggtgaccagggctgaccccggcaaacgtga

SEQ ID NO: 161309 - DNA, 75 bp, Artificial Sequence
  Synthetic
ggccagtgaggatgatcctcaatctgggccagtggaagagaatttagatgccgctgcaagagaggaagaggaacc

SEQ ID NO: 161310 - DNA, 75 bp, Artificial Sequence
  Synthetic
gggccagtggaagagaatttagatgccgctgcaagagaggaagaggaacctgatgagcaggagcacaatggtggt

SEQ ID NO: 161311 - DNA, 75 bp, Artificial Sequence
  Synthetic
ctggctccgaggacccaccagattatggagatcaaggtaatgtgcaacaggtgggatctgatcctatttcacctg

SEQ ID NO: 161312 - DNA, 75 bp, Artificial Sequence
  Synthetic
acacaacacatcttgtgcttcgtgatggcagccaggcagcgtcttcaggacattcgacgtggacccttggttgtg

SEQ ID NO: 161313 - DNA, 75 bp, Artificial Sequence
  Synthetic
gttacacacacttgcgcctgagcgccaagcacagggttgttggtcctcatattcacgaggtcgctgagagcacgg

SEQ ID NO: 161314 - DNA, 75 bp, Artificial Sequence
  Synthetic
aacctgaacatcgaagagtttatatggatgtgcatgacagtgcgtcacagatgtcaggccatcagacaaaaacca

SEQ ID NO: 161315 - DNA, 75 bp, Artificial Sequence
  Synthetic
ggatagcatatgctacccagatatagattaggatagcatatgctacccagatatagattaggatagcatatgcta

SEQ ID NO: 161316 - DNA, 75 bp, Artificial Sequence
  Synthetic
ttcgtcacgctccattgcccgctccccgccccccttgggggcttggctgccgcggccgggggcgcgaccgcctct

SEQ ID NO: 161317 - DNA, 75 bp, Artificial Sequence
  Synthetic
ccaggggccggggccgtggagccgggggcatccggtgcctgagatagaggtgctcaaggcagtctccaccttttg

SEQ ID NO: 161318 - DNA, 75 bp, Artificial Sequence
  Synthetic
ctggcgtatgggttaccgtacgcaaaccctcaatgtaaacagttttgagacagggggagataaagtccacccact

SEQ ID NO: 161319 - DNA, 75 bp, Artificial Sequence
  Synthetic
tgctatcctaatctatatctgggtagcatatgctatcctaatgcatatacagtcagcatatgatacccagtagta

SEQ ID NO: 161320 - DNA, 75 bp, Artificial Sequence
  Synthetic
ctggaactcgaagcggtctcagacaccaacacagactgcgatatggaccctatggacggcagcgaagaacactcc

SEQ ID NO: 161321 - DNA, 75 bp, Artificial Sequence
  Synthetic
cagggggagataaagtccacccactccttgtgactgctacgctaggatgtgaagagggcctgcggcatgcaataa

SEQ ID NO: 161322 - DNA, 75 bp, Artificial Sequence
  Synthetic
gatggaggaggacaagggtcccatcaaccacccccagtaccccggggacgtgggcctggacgtctctttgccaaa

SEQ ID NO: 161323 - DNA, 75 bp, Artificial Sequence
  Synthetic
aagatagaaacagccttcttgatggcacgtcgtgctaggtcactttcggcagaaagatatactttgttctttgat

SEQ ID NO: 161324 - DNA, 75 bp, Artificial Sequence
  Synthetic
cccccccttctatccctcaccacaggccgacaatctttggcaggtcgggcctggccatgcagggtattctagtga

SEQ ID NO: 161325 - DNA, 75 bp, Artificial Sequence
  Synthetic
ggtggcactgcataactgggtgtctacctgaactaagactgggtgtccaggaaaccatgtcacagaattgattgg

SEQ ID NO: 161326 - DNA, 75 bp, Artificial Sequence
  Synthetic
ttagtatcctctggaaacaccctgtatgccatatggattgggctgggcacgagaaaccgagttgcatttgtcgag

SEQ ID NO: 161327 - DNA, 75 bp, Artificial Sequence
  Synthetic
caaaaggatggttaggggagatagtttgttttgtgttgtaggggtagcgggcccttacatgttgtgggtgcaaaa

SEQ ID NO: 161328 - DNA, 75 bp, Artificial Sequence
  Synthetic
ttcaaaaaaaagagtggccacttgtctttgtttatgggccccattggcggggagccccgtttaattttcgggggt

SEQ ID NO: 161329 - DNA, 75 bp, Artificial Sequence
  Synthetic
ccgccagtgcaccgggagaccctcaccatccaagccatggatgagagcgcatcccgtcgccgttccttatgacga

SEQ ID NO: 161330 - DNA, 75 bp, Artificial Sequence
  Synthetic
ccgcatttcccagaagcactgaggtttacggccggtggactgggggagctgtcgctccctcataaacatacgtac

SEQ ID NO: 161331 - DNA, 75 bp, Artificial Sequence
  Synthetic
agaggcgtgtggaagtacgagatcttcccctcatacgttcgcgtcaccaacaagcaggtattgcagctggacgcg

SEQ ID NO: 161332 - DNA, 75 bp, Artificial Sequence
  Synthetic
agatgatccaataattgttgaggatgacgatgaaagtgaggaaattgaagataaatgtgataaggatgaagagga

SEQ ID NO: 161333 - DNA, 75 bp, Artificial Sequence
  Synthetic
caagttaccttctttctccttcaacacgaccacctacggcagccgctactttacggttgcgttcttgttctttgg

SEQ ID NO: 161334 - DNA, 75 bp, Artificial Sequence
  Synthetic
caacagtatacggcaggccctcggtgttttaccgaaagccagatactaaatcaaccaaaaaatgcagggccatag

SEQ ID NO: 161335 - DNA, 75 bp, Artificial Sequence
  Synthetic
ttacggttgcgttcttgttctttggagcggaagacaacgaggtattcctcaagcccttcttcgttatgcactctg

SEQ ID NO: 161336 - DNA, 75 bp, Artificial Sequence
  Synthetic
cccggtccaggaagaaggagtgctccagcagatgcctcttgaacatggcaatgaggtcagacttgacagtcttgg

SEQ ID NO: 161337 - DNA, 75 bp, Artificial Sequence
  Synthetic
gggtagtatatgctacccagatataaattaggatagcatatactaccctaatctctattaggatagcatatgcta

SEQ ID NO: 161338 - DNA, 75 bp, Artificial Sequence
  Synthetic
gggcacctcgggctcaaaggcggagttgatgaaaggggccgaggctgagggggctactgggggtggttgatggga

SEQ ID NO: 161339 - DNA, 75 bp, Artificial Sequence
  Synthetic
gaatccgcgcagcctgttcatagagaaagggaagtttacctggtacattgtgcccatcagattggtcaagaaccc

SEQ ID NO: 161340 - DNA, 75 bp, Artificial Sequence
  Synthetic
gagccaagcctgattcccctgcccccacagtggtccttcggcgaccacccacgcaaaaggtgactggccctgccg

SEQ ID NO: 161341 - DNA, 75 bp, Artificial Sequence
  Synthetic
ccttccagaatgacaagctgttgctccagcaggctagtgtagggcggctcaccttggtcaacaagaccaccatcc

SEQ ID NO: 161342 - DNA, 75 bp, Artificial Sequence
  Synthetic
tgttggcatgtacctgcccaaccacaggttcaggcaaaactttacaccacgtcacacgccagtgctgggttactg

SEQ ID NO: 161343 - DNA, 75 bp, Artificial Sequence
  Synthetic
gaattcccctggggcggagacagaggccaccacggtcatgaagctggaggcggacgagccggtctcggggcagga

SEQ ID NO: 161344 - DNA, 75 bp, Artificial Sequence
  Synthetic
gggcagagcgacattcagctgacacgctcctgcacccagagtggggacaagctaaacaccagcgagccccagatc

SEQ ID NO: 161345 - DNA, 75 bp, Artificial Sequence
  Synthetic
acggaccacccacgcagggtgaccaagcacacggttccatgctagaccttcttgaaaaggacgaccagcacatgg

SEQ ID NO: 161346 - DNA, 75 bp, Artificial Sequence
  Synthetic
cggtttagatgatttgcgggttacatgatgaatggggaggcgtaggtcttgtagtgttaagtgggcctacatggc

SEQ ID NO: 161347 - DNA, 75 bp, Artificial Sequence
  Synthetic
ttggtgtcatagcacaatgccaccactgaaccccccgtccaaattttattctgggggcgtcacctgaaaccttgt

SEQ ID NO: 161348 - DNA, 75 bp, Artificial Sequence
  Synthetic
gctggcgcagcacacgcccccatttctaaagtcatacgcccgtattcacacattcccggggaaggtgtgtccggt

SEQ ID NO: 161349 - DNA, 75 bp, Artificial Sequence
  Synthetic
cacatggtaagaaccctgcgatgagggctctgggggtcttcggtgtccttgtctctatgccatctgatctaaaat

SEQ ID NO: 161350 - DNA, 75 bp, Artificial Sequence
  Synthetic
ccagggctgggttggccttttgcacccaacatagatacttgaatgcggagggtcagattttgcaatatattttcc

SEQ ID NO: 161351 - DNA, 75 bp, Artificial Sequence
  Synthetic
acaccgctgacctagacatagaaagtgatgagcccgccacgtcagagccggttcttgatcagctactgcccgccc

SEQ ID NO: 161352 - DNA, 75 bp, Artificial Sequence
  Synthetic
tgtggacctaggcctctatgcccgcccacccgagggtcatgggctcatgctgtggggcccgggagcgggagcggg

SEQ ID NO: 161353 - DNA, 75 bp, Artificial Sequence
  Synthetic
atttcattgcgggtagttacaccgtcaactgatttccgcaccttgtcttcaatcttcttcatagcctgagacgcc

SEQ ID NO: 161354 - DNA, 75 bp, Artificial Sequence
  Synthetic
gccaggacgagtgcctgccttacctgctggcgcagcacacgcccccatttctaaagtcatacgcccgtattcaca

SEQ ID NO: 161355 - DNA, 75 bp, Artificial Sequence
  Synthetic
agcacacggttccatgctagaccttcttgaaaaggacgaccagcacatggagcagcaggttatggcaaccctact

SEQ ID NO: 161356 - DNA, 75 bp, Artificial Sequence
  Synthetic
tctctccggcaccccagcctggtcagccgcagaggaagcatgaccttggggtgggacggggcaggcgtgatcctg

SEQ ID NO: 161357 - DNA, 75 bp, Artificial Sequence
  Synthetic
acgcacaaactccatggccggttacccacccaagtcagactccaggtggcccaacgacacagtccctggcaccgg

SEQ ID NO: 161358 - DNA, 75 bp, Artificial Sequence
  Synthetic
cggctcaggcggaggcactggagcagaaggaacagaggtagacgaggcacaggcaccccccctgaggacctgttg

SEQ ID NO: 161359 - DNA, 75 bp, Artificial Sequence
  Synthetic
ctcattcagcttgcggaggtccggcctcgtgtcagcggtctctggcccggccaccagaagggccctctggaagcc

SEQ ID NO: 161360 - DNA, 75 bp, Artificial Sequence
  Synthetic
aggtcccacggggccactatactttgcgagccctgcgtcttgagctctcttattggctataatccgtcgctcctc

SEQ ID NO: 161361 - DNA, 75 bp, Artificial Sequence
  Synthetic
ggcgcaatctttgccgatccccacaccttcactccttgttaggttgatagaatgtcggtaccacgccacgggggg

SEQ ID NO: 161362 - DNA, 75 bp, Artificial Sequence
  Synthetic
tgaccatgatggtgcagaggatgagaccagtggcaccgatgaaagttgaagacgtggtgggcctgtctccgattg

SEQ ID NO: 161363 - DNA, 75 bp, Artificial Sequence
  Synthetic
tattggctataatccgtcgctcctcccagataaggcgttatgccttctcccgccaacaaggttcaattttctact

SEQ ID NO: 161364 - DNA, 75 bp, Artificial Sequence
  Synthetic
ctttgggatgcatcactttgagccactaagcccccgttgctcgccttgcctgcctcaccatgacacactaagtgc

SEQ ID NO: 161365 - DNA, 75 bp, Artificial Sequence
  Synthetic
gttccaaagatagcactcgacgcactgaaccataaattttttcccacggcgtgtttacaccaacttgatagtctt

SEQ ID NO: 161366 - DNA, 75 bp, Artificial Sequence
  Synthetic
catttaatcctgcagtgagacccactccccatcagccacctcaggtggagcccactttctatcagtccacttggg

SEQ ID NO: 161367 - DNA, 75 bp, Artificial Sequence
  Synthetic
agcacctccgccgccgttctgaggcgccggaggcgggatgcggggaatgccaccacaccggtgccccccgcggcc

SEQ ID NO: 161368 - DNA, 75 bp, Artificial Sequence
  Synthetic
cccatctaatccgtcagcagcgtgttcacaaacttgttaaagcagacgtacatcaggtagatggctgaggctata

SEQ ID NO: 161369 - DNA, 75 bp, Artificial Sequence
  Synthetic
tgaaaccccctcaacaataccagcctcagatggggcacattccatatcagccccgaccaacgggtcactctacta

SEQ ID NO: 161370 - DNA, 75 bp, Artificial Sequence
  Synthetic
atggtgcccaggggtgcctataacatggatgttgagaccttggggtccagggacccgcatatcctggatatgaag

SEQ ID NO: 161371 - DNA, 75 bp, Artificial Sequence
  Synthetic
ctaattgggacacatgaatttaaaaataagagtggaatatgtgagtggacacggacggggtgactggtgggggca

SEQ ID NO: 161372 - DNA, 75 bp, Artificial Sequence
  Synthetic
gggcagccgcggcccagcgcgccccgttcacgggggaggaccgcggccgagccaccaggggcccggcgggggtgg

SEQ ID NO: 161373 - DNA, 75 bp, Artificial Sequence
  Synthetic
agaaggcgagaatgtgtccgcattacatgtgtaggagtagaactggtcctgggcttcagtcagggaagccgccgc

SEQ ID NO: 161374 - DNA, 75 bp, Artificial Sequence
  Synthetic
catgtgtaggagtagaactggtcctgggcttcagtcagggaagccgccgccgcgtttgtgggactggaagcgccg

SEQ ID NO: 161375 - DNA, 75 bp, Artificial Sequence
  Synthetic
atcaacaagacatttaacgggaatatcgtagcctccgagggcactctgtaaactgaataaagctgtccttctgtc

SEQ ID NO: 161376 - DNA, 75 bp, Artificial Sequence
  Synthetic
ccttggccgagccgcccggctcccggacgcttgagggcggggtggaccgtggtccagtttcgccggcattcttgt

SEQ ID NO: 161377 - DNA, 75 bp, Artificial Sequence
  Synthetic
cggtggactcaactttgtcaacgacctggcgtccccggtttccaccgccgagatgatggatgatttctctccctt

SEQ ID NO: 161378 - DNA, 75 bp, Artificial Sequence
  Synthetic
aacataacaatcttgtgaaccagaaagatacccagagcaaaagcaataaagtacaggattattgccaaaacaacg

SEQ ID NO: 161379 - DNA, 75 bp, Artificial Sequence
  Synthetic
cacagcctttgcaaacggctttcttaggaccttccccatttcgcagtaaagagagccgggtcttgggctcttata

SEQ ID NO: 161380 - DNA, 75 bp, Artificial Sequence
  Synthetic
ctgggaggtgatgtaggttgtagtttccaggccttccttttcatcataactgagcagggcaaagccacaaaaaat

SEQ ID NO: 161381 - DNA, 75 bp, Artificial Sequence
  Synthetic
tgccctgcaaggcctgggcccgggcctgtagtttcgcattttggcggtctctagtggcgaatagagcaaacagct

SEQ ID NO: 161382 - DNA, 75 bp, Artificial Sequence
  Synthetic
tgccgccacctcaggggacacccaccgccatgcagaggcctcagggggcgcccactcccatgccgccacctcagg

SEQ ID NO: 161383 - DNA, 75 bp, Artificial Sequence
  Synthetic
gagagccgggtcttgggctcttatatatagcgccgccgtccctgtctgttagatcatcaccatggaggcctgtcc

SEQ ID NO: 161384 - DNA, 75 bp, Artificial Sequence
  Synthetic
tcgcgagagatccgcactgtggcaaggacgatagacgcctacagggggcgccttcccctggcctcggccgatctc

SEQ ID NO: 161385 - DNA, 75 bp, Artificial Sequence
  Synthetic
ttaaggttagtgggcgagtgccctccccacttctcttcccgttaagctgatagaatgctggcccgggctcctaag

SEQ ID NO: 161386 - DNA, 75 bp, Artificial Sequence
  Synthetic
agatcatcaccatggaggcctgtccacacatacgctacgccttccagaatgacaagctgtttctatgttgggtgc

SEQ ID NO: 161387 - DNA, 75 bp, Artificial Sequence
  Synthetic
gccccttcccgcccacctgccacacttgtccacttgtcagcctaaccgtctgccctgcaaggcctgggcccgggc

SEQ ID NO: 161388 - DNA, 75 bp, Artificial Sequence
  Synthetic
atggacctagaacaaaatgtgctgtaagtggctgggtcgggtaatccccacgggcaaaacttgcgtcaatggcct

SEQ ID NO: 161389 - DNA, 75 bp, Artificial Sequence
  Synthetic
aagtggctgggtcgggtaatccccacgggcaaaacttgcgtcaatggccttctgcagaagctattctttttcccg

SEQ ID NO: 161390 - DNA, 75 bp, Artificial Sequence
  Synthetic
ggacacccaccgccatgcagaggcctcagggggcgcccactcccatgccgccacctcaggggccacccaccgcca

SEQ ID NO: 161391 - DNA, 75 bp, Artificial Sequence
  Synthetic
tcacgagatggcctccatcgacaccgggcttagttatagctcgaccatgactccggccagggtggcggccatcac

SEQ ID NO: 161392 - DNA, 75 bp, Artificial Sequence
  Synthetic
gctttaattgtcatgtatgcttctatgtagttaataaaaatgtcaaattcactcatggctttgtaaattcctttt

SEQ ID NO: 161393 - DNA, 75 bp, Artificial Sequence
  Synthetic
attctgcgccagttgttaacggggggcgtcaagagtgggagaccatcacttaagtttaaggctgcccttgagcgt

SEQ ID NO: 161394 - DNA, 75 bp, Artificial Sequence
  Synthetic
cccccaggccagccaaaacttgcacccccagctcccccaaggccaccgagaacgtatctggcctgttgaggaact

SEQ ID NO: 161395 - DNA, 75 bp, Artificial Sequence
  Synthetic
gcgtcaagagtgggagaccatcacttaagtttaaggctgcccttgagcgtcaagccgctgcgggcttgcgacctt

SEQ ID NO: 161396 - DNA, 75 bp, Artificial Sequence
  Synthetic
cagggggaggggcaggaaccgaggcttacccctccacaaccactcatgatgccaccaaggcctacccctcctacc

SEQ ID NO: 161397 - DNA, 75 bp, Artificial Sequence
  Synthetic
ccacccgtcctacagcccatacaagttatgtggcaagtgggttcctcaaaggccgtggccgcctcaacggtgaca

SEQ ID NO: 161398 - DNA, 75 bp, Artificial Sequence
  Synthetic
ttatgtggcaagtgggttcctcaaaggccgtggccgcctcaacggtgacacaggcacccacggaatataccgggg

SEQ ID NO: 161399 - DNA, 75 bp, Artificial Sequence
  Synthetic
tgacagggcctggcatccaaggtagcccttaaagtcctctagcagagactccttgagcaaaaggttatctacctc

SEQ ID NO: 161400 - DNA, 75 bp, Artificial Sequence
  Synthetic
cgatacaagaatcgggtggcttccagaaaatgccgggccaagtttaagcaactgctgcagcactaccgtgaggtc

SEQ ID NO: 161401 - DNA, 75 bp, Artificial Sequence
  Synthetic
ccccatctaaacgcctgatttttgtccgcaggtggctgctgccaaatcatctgaaaatgacaggctgcgcctcct

SEQ ID NO: 161402 - DNA, 75 bp, Artificial Sequence
  Synthetic
cgggtgaagaaaaaggcctatccagagcgcaagacgccgcatggggggccctcacactcttccaccgttatgtgg

SEQ ID NO: 161403 - DNA, 75 bp, Artificial Sequence
  Synthetic
agcgcaagacgccgcatggggggccctcacactcttccaccgttatgtgggagaatgtcagccagggacaacagc

SEQ ID NO: 161404 - DNA, 75 bp, Artificial Sequence
  Synthetic
gatctcggccgttgtctcatcggtgaccgccccctcagcctcggcccctttcatcaactccgcctttgagcccga

SEQ ID NO: 161405 - DNA, 75 bp, Artificial Sequence
  Synthetic
gggcccatccctctcggctccaaagcattccaacgtactcctgcgtaccccaaaaccacaccaaacaccacagga

SEQ ID NO: 161406 - DNA, 75 bp, Artificial Sequence
  Synthetic
gacctaataaaggccttctgaaaaagcctgacaaggagtacctgcgtctcattcccaagtgtttccagacaccag

SEQ ID NO: 161407 - DNA, 75 bp, Artificial Sequence
  Synthetic
caccagatgttttacacgaggatctcttaaatttctaattcccgttattgaaaccacgcctgcttcacgcctcgt

SEQ ID NO: 161408 - DNA, 75 bp, Artificial Sequence
  Synthetic
ctccatacctaaggtgtgcaggcctacctgagataggggagtgatttatagagcatggcatggctaaaagctgca

SEQ ID NO: 161409 - DNA, 75 bp, Artificial Sequence
  Synthetic
acgcggaacgttccctcaaagttgccaaatctaggaaacctctcttacatgctattggataaacgggcggaaaag

SEQ ID NO: 161410 - DNA, 75 bp, Artificial Sequence
  Synthetic
gttctatttttacagcttctgggaaacactgtttcgggttcctgggtaggacgtatttcccgcggggcagtgcat

SEQ ID NO: 161411 - DNA, 75 bp, Artificial Sequence
  Synthetic
atgggggacattgcagtttcttccccttcctcttctgaaacatcgaatgatgagtgatttcaaccacgtaacaag

SEQ ID NO: 161412 - DNA, 75 bp, Artificial Sequence
  Synthetic
acactgtttcgggttcctgggtaggacgtatttcccgcggggcagtgcatgtaatcccttcagttggttggtaca

SEQ ID NO: 161413 - DNA, 75 bp, Artificial Sequence
  Synthetic
agaggccaaagggagacacaagggtgggctaactctatggccagagctaggatgtacaaattggcgctccctcat

SEQ ID NO: 161414 - DNA, 75 bp, Artificial Sequence
  Synthetic
ctatcacccatggccaggcccggcacctcctcgaaggcgcagctggcccacctaaagagagatctggggccaagg

SEQ ID NO: 161415 - DNA, 75 bp, Artificial Sequence
  Synthetic
cacaaaggggttctctgactgtagttgacatccttataaatggatgtgcacatttgccaacactgagtggctttc

SEQ ID NO: 161416 - DNA, 75 bp, Artificial Sequence
  Synthetic
tggcccatccaatgccgcccccgtttgtagaaattcacacacggcaacccctaacgtttcacagaatctcctagc

SEQ ID NO: 161417 - DNA, 75 bp, Artificial Sequence
  Synthetic
actggtgagcatattcaggaccccgggccggggccttcaaccggcggggcttctgagggattggtgcagaacgag

SEQ ID NO: 161418 - DNA, 75 bp, Artificial Sequence
  Synthetic
tacacgcacgagaaatgcgccgtcattccatcggataaacaggggtatgtggtgccatgcggcatcgtcatcaag

SEQ ID NO: 161419 - DNA, 75 bp, Artificial Sequence
  Synthetic
aggaccacactgctaaggcagtcagcctggtgtgcgttgctgctaagcacacaactagcgcaccaaactgtctga

SEQ ID NO: 161420 - DNA, 75 bp, Artificial Sequence
  Synthetic
ctactgggccggcgcaaggccgatggggccagcgtgtgtgtgaacgtgtttgggcagcaggcctacttctacgcc

SEQ ID NO: 161421 - DNA, 75 bp, Artificial Sequence
  Synthetic
tacaccaatgctgggggacatgtacctcccaggggcccaggaagactatgggaggctacaccaacgtcaatcaga

SEQ ID NO: 161422 - DNA, 75 bp, Artificial Sequence
  Synthetic
cgaaggcggagaagacgggccgcattgtccggccatcttttagacatggaagacaatgtgccgccgtggtttcct

SEQ ID NO: 161423 - DNA, 75 bp, Artificial Sequence
  Synthetic
gcaaatccagttgtattcaaggtaggggaggtggtggtgctctcgggtgccttggagaatataaccttgtgggtt

SEQ ID NO: 161424 - DNA, 75 bp, Artificial Sequence
  Synthetic
cagtctccgacataacccagaatcaacagactaaccaagccgggggagaagcacctcaacctggagacaattcta

SEQ ID NO: 161425 - DNA, 75 bp, Artificial Sequence
  Synthetic
atgatgaatgtctgctgcatgccatgcatatttcaactgggctgtctatttttgacaccagcttattttagacac

SEQ ID NO: 161426 - DNA, 75 bp, Artificial Sequence
  Synthetic
ctggcgtgatcagaggacccgagaattcccctggggcggagacagaggccaccacggtcatgaagctggaggcgg

SEQ ID NO: 161427 - DNA, 75 bp, Artificial Sequence
  Synthetic
tagccgggagtgtggccccagcaagacgccagaccccttctcctggttccgcaaaacttcgtgcacagaaggagg

SEQ ID NO: 161428 - DNA, 75 bp, Artificial Sequence
  Synthetic
aaggaacagcgatatctcccaccccatgagctgtcacggttttatttacatggggtcaggattccacgagggtag

SEQ ID NO: 161429 - DNA, 75 bp, Artificial Sequence
  Synthetic
cctgtctgcttgtcaaccaaagtccctggctgctcatccccacgtagctttgcagggtcacaactactagaccat

SEQ ID NO: 161430 - DNA, 75 bp, Artificial Sequence
  Synthetic
tgcagggtcacaactactagaccatgactttgtaaccgagtggtactggttcaactccagggtctagcacctgtg

SEQ ID NO: 161431 - DNA, 75 bp, Artificial Sequence
  Synthetic
tggggtcaggattccacgagggtagtgaaccattttagtcacaagggcagtggctgaagatcaaggagcgggcag

SEQ ID NO: 161432 - DNA, 75 bp, Artificial Sequence
  Synthetic
agcgtcttcaggacattcgacgtggacccttggttgtagagggaggtgttggttggcgacattggcttctgacat

SEQ ID NO: 161433 - DNA, 75 bp, Artificial Sequence
  Synthetic
acaaccgcctcacccgtgatattagccctcaagaaacactgccacgccctataacactagaaccctcacgttgga

SEQ ID NO: 161434 - DNA, 75 bp, Artificial Sequence
  Synthetic
ctccacctcaaacaccaggccggggtgctctgcaaacatctccgggaggtagtcggaggccaccggcatagtgat

SEQ ID NO: 161435 - DNA, 75 bp, Artificial Sequence
  Synthetic
ctgcttgaaactgttatgtgaaaacataggccccacctacgagctggccgtggacctagtaggggacgccttctg

SEQ ID NO: 161436 - DNA, 75 bp, Artificial Sequence
  Synthetic
aagcacactgtctacgaccccatagattgtgacagttctagttcatctgtacaatctaggaaaccgtaatcagta

SEQ ID NO: 161437 - DNA, 75 bp, Artificial Sequence
  Synthetic
tgaatcctacctagctccacccacctggtatataggggcggagcttaggatacctccaggatcatggaaccctat

SEQ ID NO: 161438 - DNA, 75 bp, Artificial Sequence
  Synthetic
catctgtgaattactggtttcacaagacaatcggaaactttaagccatattacccgtggaatgcaccacctaatg

SEQ ID NO: 161439 - DNA, 75 bp, Artificial Sequence
  Synthetic
ggtgggctggttggggctgcttcccagctagtagcccttggaactgacgggcactgcgtccacctggccaccaca

SEQ ID NO: 161440 - DNA, 75 bp, Artificial Sequence
  Synthetic
ccggggctaaccaaggacaacagctagcagacattggtgttccacagcctgcaccagtggctgccccggcacgac

SEQ ID NO: 161441 - DNA, 75 bp, Artificial Sequence
  Synthetic
taagccagacaatgtagtgcccctttttttgcaaattggccttattattaatttcttgttaacactaattctgtt

SEQ ID NO: 161442 - DNA, 75 bp, Artificial Sequence
  Synthetic
gctattgggttaacgggtggaagcatgggggaaacctgcgaaacttgggggcaggctacaacaggctgctgaaaa

SEQ ID NO: 161443 - DNA, 75 bp, Artificial Sequence
  Synthetic
cacaggagtggccgtactggccacactaaacacacaaacggagatgatgagacttccgagtgcactgtccctgga

SEQ ID NO: 161444 - DNA, 75 bp, Artificial Sequence
  Synthetic
tatatcgatcccaacatggagccagttcagcagaggcccgtcatgtttgtgagccgtgtgcctgtaaggaaaccg

SEQ ID NO: 161445 - DNA, 75 bp, Artificial Sequence
  Synthetic
cctagaatgtggtaacaggtgggacaaaatggggtctgtggcagttgaaatatctagcacggcaccctcccaaaa

SEQ ID NO: 161446 - DNA, 75 bp, Artificial Sequence
  Synthetic
tgttaagacctcctatagatctgatgaggcagaagaagcacagagcacccctgaaaggccgggcccttccaaaca

SEQ ID NO: 161447 - DNA, 75 bp, Artificial Sequence
  Synthetic
aggtcagcaacgtgctcatcgccaaccgctcccacaactctctaaggctggtgcccaatccggacttgctgcctc

SEQ ID NO: 161448 - DNA, 75 bp, Artificial Sequence
  Synthetic
gtgcccaatccggacttgctgcctctccagcatttgtacctcaagcacgtagtgctaaagagtctgaatctggag

SEQ ID NO: 161449 - DNA, 75 bp, Artificial Sequence
  Synthetic
gaggcagaagaagcacagagcacccctgaaaggccgggcccttccaaacaaccatcagagcccgtggagcccgcc

SEQ ID NO: 161450 - DNA, 75 bp, Artificial Sequence
  Synthetic
ccaaattcagctcagtgacacgcccaatggcatctgaaaaacacggggtcatagaacagaattagtgttaacaag

SEQ ID NO: 161451 - DNA, 75 bp, Artificial Sequence
  Synthetic
agagcccgaagctgtttccttcaagcctccgccaccaccttcccggaggagaaggggagcgtgtgttgtatatga

SEQ ID NO: 161452 - DNA, 75 bp, Artificial Sequence
  Synthetic
cctccgccaccaccttcccggaggagaaggggagcgtgtgttgtatatgacgatgatatcatagaggtgattgat

SEQ ID NO: 161453 - DNA, 75 bp, Artificial Sequence
  Synthetic
cgggatgccatatattttgcagaatgcccaccagatcgcctgccacttccacagcaatggcacggacgcctggcg

SEQ ID NO: 161454 - DNA, 75 bp, Artificial Sequence
  Synthetic
cgggcaacaaccgcccccccccgtgatttctaccgggagtgccatgtcttccagtcacacggatccatcagtaac

SEQ ID NO: 161455 - DNA, 75 bp, Artificial Sequence
  Synthetic
cctccctcaggcaccattatgagaaatgtcagattcgccacccccatcgtccggctcttgtgccaaggggctgag

SEQ ID NO: 161456 - DNA, 75 bp, Artificial Sequence
  Synthetic
cctcaagacggatttcaacgttcaggccgacgtcaaaaacgagccatgcctcccccagtgagtccttctgacgct

SEQ ID NO: 161457 - DNA, 75 bp, Artificial Sequence
  Synthetic
acaataccacttccattaggtcttcgttaccctacaacatttttgttataattgggtaactctttagaacataca

SEQ ID NO: 161458 - DNA, 75 bp, Artificial Sequence
  Synthetic
ctcctgtgcactgtctgtaaagtccagcctcccacgcccgtccacggctcccgggcccagccccgtccacccctc

SEQ ID NO: 161459 - DNA, 75 bp, Artificial Sequence
  Synthetic
tcgtgtcatggcgactccttccaccgggcctcgtgacatggcgcctccttccaccgggcctcgtgacatggcgcc

SEQ ID NO: 161460 - DNA, 75 bp, Artificial Sequence
  Synthetic
gaggaaggatcacccaccaggcttccacgttgggtgacctacctatcatgctataagttaacaaggggaagcagg

SEQ ID NO: 161461 - DNA, 75 bp, Artificial Sequence
  Synthetic
gattgggaaaaggttggttagaggagattgcccaaatctatatctgggtagcatatgctaccgcctagagcattt

SEQ ID NO: 161462 - DNA, 75 bp, Artificial Sequence
  Synthetic
tccttccaccgggcctcgtgacatggcgcctccttccaccgggcctcgtgacatggcgcctaccgtcgtacatat

SEQ ID NO: 161463 - DNA, 75 bp, Artificial Sequence
  Synthetic
ccctgggcgagaagccattctccgcaggtttccactagatctaagaacacttcttcaagcgattggagccgcggc

SEQ ID NO: 161464 - DNA, 75 bp, Artificial Sequence
  Synthetic
gcttctgggaaatgcgggccggccgtgatgctcccaaaattcaacaagaaccaagttcacaacagcagccagcca

SEQ ID NO: 161465 - DNA, 75 bp, Artificial Sequence
  Synthetic
tgatgctcccaaaattcaacaagaaccaagttcacaacagcagccagccactcagtctacaccgccttgccaatc

SEQ ID NO: 161466 - DNA, 75 bp, Artificial Sequence
  Synthetic
cttcgggatagtgtttcaggtaaagctcatggaggaaagattttaatggtcgggcatttcctctgttactactag

SEQ ID NO: 161467 - DNA, 75 bp, Artificial Sequence
  Synthetic
ggagtgcctctgggtgctgagcgatgcctctacgccccagatgaaagtctatacggccacaaccgccgtgtcagc

SEQ ID NO: 161468 - DNA, 75 bp, Artificial Sequence
  Synthetic
tgttgttacactctatttgtaacaaggggaaagagagtggacgccgacagcagcggatagcatatgctacccgga

SEQ ID NO: 161469 - DNA, 75 bp, Artificial Sequence
  Synthetic
tgtacataatgtatgccatggccattcgacaggccattagagatcgtcggagaaatccagcttctcgtagagatc

SEQ ID NO: 161470 - DNA, 75 bp, Artificial Sequence
  Synthetic
agcccctacaaatatcacacttgagctccatgtcgcccacgcagccgatatcgcatgaagaacaaccccggtatg

SEQ ID NO: 161471 - DNA, 75 bp, Artificial Sequence
  Synthetic
gagtttacatccagatactgcaactctgccgcccacccaggatttataccctggacgcgaggatctgcaggccac

SEQ ID NO: 161472 - DNA, 75 bp, Artificial Sequence
  Synthetic
aatgttcggtgtgtgttataaatctgttccaagtttctgtaaatgtctctgaatttcgttcaattatctcctcaa

SEQ ID NO: 161473 - DNA, 75 bp, Artificial Sequence
  Synthetic
cttgggtgcacaggtggccgtaggtgtcacgtgaccttttccgccggcacctttaagccgccgcgatgtaccccc

SEQ ID NO: 161474 - DNA, 75 bp, Artificial Sequence
  Synthetic
aattccctcggctcaatgggagccacacccctctcagggcacataccagggccacattgatccccagcttccggc

SEQ ID NO: 161475 - DNA, 75 bp, Artificial Sequence
  Synthetic
gccacattgatccccagcttccggctgctctagatttagggccagagcagccccggttcccacaagatccatatg

SEQ ID NO: 161476 - DNA, 75 bp, Artificial Sequence
  Synthetic
ccgagcacagggcggtggacagcagttggtatagggcaaggttgggcccctgggtagtcacgttcagccgcaact

SEQ ID NO: 161477 - DNA, 75 bp, Artificial Sequence
  Synthetic
ccctcgaggcctcaacatccaagatataggcacaccttggcattgtggcctcgagaacccaggcatgggcactct

SEQ ID NO: 161478 - DNA, 75 bp, Artificial Sequence
  Synthetic
tctgtcacagaattgattgggaaaaggttggttagaggagattgttttgtgttgtaggggtagcgggcccttaca

SEQ ID NO: 161479 - DNA, 75 bp, Artificial Sequence
  Synthetic
atgtcgaaggtgctaccggtgaaacgcgggaagaaagtgaggacgcggagagcgatggagatgatgaagatcttc

SEQ ID NO: 161480 - DNA, 75 bp, Artificial Sequence
  Synthetic
agctcctccatcttgaccgtggccatcagcatggcggccaagcgctccagcccgtaggattgcatgcccttgacc

SEQ ID NO: 161481 - DNA, 75 bp, Artificial Sequence
  Synthetic
gccccgagcccccatacgccccattccaacaagattcccccctccccctatgccgttacaagatagcatggccgt

SEQ ID NO: 161482 - DNA, 75 bp, Artificial Sequence
  Synthetic
ggctgtcctgtttgatgtagcgaaccgtaactctatacatgctggtaaacagctacgtcacggttgtaggcgggg

SEQ ID NO: 161483 - DNA, 75 bp, Artificial Sequence
  Synthetic
actggttacaacacaatgtcctgcaggcatgcatgcaccaggccatccaggccaacgcgcgcccaaggcttgggt

SEQ ID NO: 161484 - DNA, 75 bp, Artificial Sequence
  Synthetic
tgcccaagcatgccctttgccagtgattacagtcaaggtgcatttaccccactggacattaatgcccccacgcca

SEQ ID NO: 161485 - DNA, 75 bp, Artificial Sequence
  Synthetic
tgactatgatgcatccactgaaagtgagctagattaaggggatccaaggtgacccctgttagctatttgatcttt

SEQ ID NO: 161486 - DNA, 75 bp, Artificial Sequence
  Synthetic
acgatttaatcccagccgccgtgcaggccttaaccacggcccacaacttatgtctgggtgttattccaggtgaga

SEQ ID NO: 161487 - DNA, 75 bp, Artificial Sequence
  Synthetic
gactgacacataaacatggtttaaggaatgaacactcatggtgtgagactggaactgtactaaatttgctgacat

SEQ ID NO: 161488 - DNA, 75 bp, Artificial Sequence
  Synthetic
agtggacatgaagagcacgaagagcaaatcaggagaaccactgtaaaagagatgccaagttagagctgcgattac

SEQ ID NO: 161489 - DNA, 75 bp, Artificial Sequence
  Synthetic
cccgctttgggcactggttaaggatgggtaactaaaaggccccctcagatccggcaggtccttcgtcttgccaaa

SEQ ID NO: 161490 - DNA, 75 bp, Artificial Sequence
  Synthetic
ataaaccttaaaagtccccccatctaatgatgtccagttcccttctcccaccctgtacaccccgacccaaaggga

SEQ ID NO: 161491 - DNA, 75 bp, Artificial Sequence
  Synthetic
aatgatgtccagttcccttctcccaccctgtacaccccgacccaaagggactcaatggcattcagatttctagtt

SEQ ID NO: 161492 - DNA, 75 bp, Artificial Sequence
  Synthetic
ggcccccgtgtactgaaacttgtccccgttgatggacagggccacataagacaagtgacagcgcagctgataaaa

SEQ ID NO: 161493 - DNA, 75 bp, Artificial Sequence
  Synthetic
aaacttctggcattagacgcgcgcgggagcgttggaggcccgcaccttggacgccaaatccaccccgttctccca

SEQ ID NO: 161494 - DNA, 75 bp, Artificial Sequence
  Synthetic
acaacatggaagaagaagtcccattggtgagtcacacttttgttgcagacaaaatggacaaggacaggccgggtc

SEQ ID NO: 161495 - DNA, 75 bp, Artificial Sequence
  Synthetic
acgccaaatccaccccgttctcccagtcagatgtccgtgcgtgaccgtctggctcgtttgcgtgctgaggcacag

SEQ ID NO: 161496 - DNA, 75 bp, Artificial Sequence
  Synthetic
ccattccaggtgtgcttctttttggtgaaataaaaacagcgttctttatatgaaaatgtgtattctcttgtgttg

SEQ ID NO: 161497 - DNA, 75 bp, Artificial Sequence
  Synthetic
gcccataaaaataagtgcatggatatagctctgcacaggcttggaaacacccattccaggtgtgcttctttttgg

SEQ ID NO: 161498 - DNA, 75 bp, Artificial Sequence
  Synthetic
ccgcggcccccgggaagtccctgggcaccctcaacaatcccgccaccgtccagatccaatttgcctacgactccc

SEQ ID NO: 161499 - DNA, 75 bp, Artificial Sequence
  Synthetic
atttatctccagaggaagacactaatctatacattttctcagcactttatatgaatcagggtcattgggcctgta

SEQ ID NO: 161500 - DNA, 75 bp, Artificial Sequence
  Synthetic
ctgctgcatgccatgcatatttcaactgggctgtctatttttgacaccagcttattttagacacttctgaaaact

SEQ ID NO: 161501 - DNA, 75 bp, Artificial Sequence
  Synthetic
ccctcctcctcttaccctgggtggcaaaaagtatgccaggagtagaacaataacaagtgcgatggcggtaaacaa

SEQ ID NO: 161502 - DNA, 75 bp, Artificial Sequence
  Synthetic
aaagtactgtggctgcatcgccggtaccccaggtgcccggaccacatcagcaacctggctaaagggggcaccagg

SEQ ID NO: 161503 - DNA, 75 bp, Artificial Sequence
  Synthetic
ccaacaggaagatatttattaatattccattagtaaacgaggcgtgaagcaggcgtggtttcaataacgggagtt

SEQ ID NO: 161504 - DNA, 75 bp, Artificial Sequence
  Synthetic
tccattagtaaacgaggcgtgaagcaggcgtggtttcaataacgggagttagaaatttaagagatcctcgtgtaa

SEQ ID NO: 161505 - DNA, 75 bp, Artificial Sequence
  Synthetic
aacatctggtgtccgggggataatggagtcaacatccaggcttgggcacatctgcttcaacaggaggcgcagcct

SEQ ID NO: 161506 - DNA, 75 bp, Artificial Sequence
  Synthetic
gtcgctagaaacacctgggagttggtcccctggagatacagggggcaagggcgtaggtggggcctgggctaccgg

SEQ ID NO: 161507 - DNA, 75 bp, Artificial Sequence
  Synthetic
tcccctggagatacagggggcaagggcgtaggtggggcctgggctaccggacacggggccatgccgtgttgttca

SEQ ID NO: 161508 - DNA, 75 bp, Artificial Sequence
  Synthetic
acacggggccatgccgtgttgttcatgtaatgtgtatgccattccctgagctgctaggtggatggttgggggttc

SEQ ID NO: 161509 - DNA, 75 bp, Artificial Sequence
  Synthetic
tgctgcagcagatgcttaaacttggcccggcattttctggaagccacccgattcttgtatcgctttatatctagt

SEQ ID NO: 161510 - DNA, 75 bp, Artificial Sequence
  Synthetic
cccggcattttctggaagccacccgattcttgtatcgctttatatctagttcagaatcacattcctccagctgcg

SEQ ID NO: 161511 - DNA, 75 bp, Artificial Sequence
  Synthetic
tgccctgttccgttcgtttgcccgctctcatcagcaacaacctgtgcagacgtcttataaatatagggggtcgtt

SEQ ID NO: 161512 - DNA, 75 bp, Artificial Sequence
  Synthetic
ccaccgtccgctgccgccctccttgagccccaccatccgctgccaccctctttgagccccaccgtccgctgccac

SEQ ID NO: 161513 - DNA, 75 bp, Artificial Sequence
  Synthetic
cttcccgcgtttcaccggtagcaccttcgacatgttccccttcagttctaagcaagtctagcccatacgcacgac

SEQ ID NO: 161514 - DNA, 75 bp, Artificial Sequence
  Synthetic
ggcatgctcattctggtcctggtggtgggggtggtgatcctggttatttccctcacgaggcgcacgcgccagatg

SEQ ID NO: 161515 - DNA, 75 bp, Artificial Sequence
  Synthetic
gtcgtgccggggcagccgctggtgcaggctgtggagcaccaatgtctgctagctgttgtccttggttagccccgg

SEQ ID NO: 161516 - DNA, 75 bp, Artificial Sequence
  Synthetic
aatctctattaggatagcatatgctacccggatacagattaggatagcatatactacccagatatagattaggat

SEQ ID NO: 161517 - DNA, 75 bp, Artificial Sequence
  Synthetic
ctataaagacaagcctgcgttgcctaaatcctcacgacctgtgtctgtgtctcatttgtgtaggtgcggctatcc

SEQ ID NO: 161518 - DNA, 75 bp, Artificial Sequence
  Synthetic
tcatcgatccacggtgtttggatactagtggtgcccagggcatcgctgacaaagttcttgatataggacaaatcc

SEQ ID NO: 161519 - DNA, 75 bp, Artificial Sequence
  Synthetic
acctggcaccagactcggtaaccagcaagctccgcttcctagaggccaagactctgaaaggggtagtaaatttca

SEQ ID NO: 161520 - DNA, 75 bp, Artificial Sequence
  Synthetic
ttatcctagggatttcataaaggccgggcttaattgccttcaatcccttaagacattgtaggcactctggacatc

SEQ ID NO: 161521 - DNA, 75 bp, Artificial Sequence
  Synthetic
tggttgaacagtagaattgtctccaggttgaggtgcttctcccccggcttggttagtctgttgattctgggttat

SEQ ID NO: 161522 - DNA, 75 bp, Artificial Sequence
  Synthetic
ctcatttgtgtaggtgcggctatcctagatatacccctcctatgcgccccccgtgacggagctggggcacgggcc

SEQ ID NO: 161523 - DNA, 75 bp, Artificial Sequence
  Synthetic
gcattagagggaaaaccacggaggccgacagcaaatggcgatcatgcaaaatccaacaatccaggggcgcgactg

SEQ ID NO: 161524 - DNA, 75 bp, Artificial Sequence
  Synthetic
acatgataggcagtgagctggccttgtggcagaggctctggcagcaccggccacagcacacaaggcaaaggagct

SEQ ID NO: 161525 - DNA, 75 bp, Artificial Sequence
  Synthetic
agcgcagggccgacaggtagccgctggagacgatgcgctcgtaggccgggctctgcgcgaaagcagagactcggg

SEQ ID NO: 161526 - DNA, 75 bp, Artificial Sequence
  Synthetic
ggaggcagagactgagttttaaccatgtctgggggactcttctataaccctttcctaagacctaataaaggcctt

SEQ ID NO: 161527 - DNA, 75 bp, Artificial Sequence
  Synthetic
ccacagcacacaaggcaaaggagcttgtgatggccctcccaggtcctgatagactctggtagcttggtcaaaagc

SEQ ID NO: 161528 - DNA, 75 bp, Artificial Sequence
  Synthetic
gcaagagaggaagaggaacctcatgagcaggagcacaatggtggtgacgatcccttggatgtccatactcgccag

SEQ ID NO: 161529 - DNA, 75 bp, Artificial Sequence
  Synthetic
gaccccaggcgccgcaggggtggtggatgtgcgagggcctcagccccccctgtgtttctaccaagactccctgac

SEQ ID NO: 161530 - DNA, 75 bp, Artificial Sequence
  Synthetic
cgcaggctccagtgatccaactagtccacgctgtctatgattccatgttggtaagaggcacctagaacatttcca

SEQ ID NO: 161531 - DNA, 75 bp, Artificial Sequence
  Synthetic
caaggtgcaatgtttagtgagttacctgtctaacatctcccctttaaagccaaggcaccagcctcctctgtgatg

SEQ ID NO: 161532 - DNA, 75 bp, Artificial Sequence
  Synthetic
gttaatgggttcagttaaggggatgtcaaaatactgtggctgtgttgccggtaccggaggtaccgggcccatact

SEQ ID NO: 161533 - DNA, 75 bp, Artificial Sequence
  Synthetic
aatgcctgtggctcatgcatagtttccaaaagaggaggaggcagttttcagaagtgtctaaaataagctggtgtc

SEQ ID NO: 161534 - DNA, 75 bp, Artificial Sequence
  Synthetic
ccaaaagaggaggaggcagttttcagaagtgtctaaaataagctggtgtcaaaaatagacagcccagttgaaata

SEQ ID NO: 161535 - DNA, 75 bp, Artificial Sequence
  Synthetic
tcatcaagctactgggccggcgcaaggccgatggggccagcgtgtgtgtgaacgtgtttgggcagcaggcctact

SEQ ID NO: 161536 - DNA, 75 bp, Artificial Sequence
  Synthetic
attaagttcgggggtcaggggggagtccagattcaaatcctctgtcatggactctagtgttgtggtcagttcgtc

SEQ ID NO: 161537 - DNA, 75 bp, Artificial Sequence
  Synthetic
atgccagcactgtacgttgttgcatgccgcgtgccctcatcacatcctagcgtagcagtcacaaggaccgggtgg

SEQ ID NO: 161538 - DNA, 75 bp, Artificial Sequence
  Synthetic
aggaggggcaggagcaggaggaggggcaggaggggcaggaggggcaggagcaggaggaggggcaggagcaggagg

SEQ ID NO: 161539 - DNA, 75 bp, Artificial Sequence
  Synthetic
aggagcaggaggtggaggccggggtcgaggaggcagtggaggccggggtcgaggaggtagtggaggccggggtcg

SEQ ID NO: 161540 - DNA, 75 bp, Artificial Sequence
  Synthetic
aagcagcgctccacaggcctagagttttgcctcaacaagggggggtcatagctactacgctcaaacacgaatgcc

SEQ ID NO: 161541 - DNA, 75 bp, Artificial Sequence
  Synthetic
ttcaggtccatctgtccacatatggctgcttcctccttctggggaataacagtgtcagccatctcccttagggcc

SEQ ID NO: 161542 - DNA, 75 bp, Artificial Sequence
  Synthetic
agtgtcagccatctcccttagggccttcacggcctgactggtttcctcatcagggtcctccaacagatgacttgc

SEQ ID NO: 161543 - DNA, 75 bp, Artificial Sequence
  Synthetic
gcccccaccaccaccaccaccaccaccaccaccaccaccaccaccaccaccaccaccaccaccaccaccaccacc

SEQ ID NO: 161544 - DNA, 75 bp, Artificial Sequence
  Synthetic
tctccccagacagtccggtcggagccatcaaggggggccagtgggtgggcacctggtagagtccgtcatcatctt

SEQ ID NO: 161545 - DNA, 75 bp, Artificial Sequence
  Synthetic
cttcgatgttcaggttttgctcaaggaataaactgcctaggggccggaggtccgattgctgaaaccaatgacaat

SEQ ID NO: 161546 - DNA, 75 bp, Artificial Sequence
  Synthetic
gcgttagggatccgaccggttcatggacaggtcctgtgggggtgggagccaaagaggcaggcaggggccggttgg

SEQ ID NO: 161547 - DNA, 75 bp, Artificial Sequence
  Synthetic
tgatagtcttgtgaaattatctctggctggcctagagtgcatgtttaaaacactagcctctcaactaatttctgc

SEQ ID NO: 161548 - DNA, 75 bp, Artificial Sequence
  Synthetic
cccacggggatccgggtggatggaagggcctgatcctctttggctgacacacctctcgcccctcgaacacgtcag

SEQ ID NO: 161549 - DNA, 75 bp, Artificial Sequence
  Synthetic
gggcctgatcctctttggctgacacacctctcgcccctcgaacacgtcagatatggcactgcccgcttccggctt

SEQ ID NO: 161550 - DNA, 75 bp, Artificial Sequence
  Synthetic
gtgcctcttaccaacatggaatcatagacagcgtggactagttggatcactggagcctgcgttgggttcacatcc

SEQ ID NO: 161551 - DNA, 75 bp, Artificial Sequence
  Synthetic
cgggaggaagaaaggtgggctttgaggggtgggggaatatgggtctctcatcgctctcttggtggaccgctgcta

SEQ ID NO: 161552 - DNA, 75 bp, Artificial Sequence
  Synthetic
gccgagtccacgatccctgaggcgggagcagccggggactcctcatcattatcatctcctgtctggggtggctgg

SEQ ID NO: 161553 - DNA, 75 bp, Artificial Sequence
  Synthetic
ggggtgggggaatatgggtctctcatcgctctcttggtggaccgctgctatccaaggctgttcaggttcctccgc

SEQ ID NO: 161554 - DNA, 75 bp, Artificial Sequence
  Synthetic
aacatagagttcacctcagacgagcctctccttaacggcctcctggactacgcctccaccactgagaactacacg

SEQ ID NO: 161555 - DNA, 75 bp, Artificial Sequence
  Synthetic
cggttactgcttgaactttggaaagcagacaggtgtaggaggcaggctcaattcctttagacccactctccagtt

SEQ ID NO: 161556 - DNA, 75 bp, Artificial Sequence
  Synthetic
aacacagaaagaagaaggcagccagaacagagcagggcgctctcggtggtatcttcatggtggcgggtgcccact

SEQ ID NO: 161557 - DNA, 75 bp, Artificial Sequence
  Synthetic
gggccaacaccaaggtccgcatcaccggcctcatccccatcgacatgtacgccgtgtgccgggacaagctcagcc

SEQ ID NO: 161558 - DNA, 75 bp, Artificial Sequence
  Synthetic
atggggcccataaacaaagacaagtggccactctttttttgaaattgtggagtgggggcacgagtcagcccccac

SEQ ID NO: 161559 - DNA, 75 bp, Artificial Sequence
  Synthetic
aaggtacctgggcggcaagaacacaagaagcaatcaagaataaaaggtttcattttattgtaaatgacagtcgaa

SEQ ID NO: 161560 - DNA, 75 bp, Artificial Sequence
  Synthetic
gagtataacctcgctaaccactgcggtcaaaccacttgcccacaaaaccactaatggcaccccggggaatacctg

SEQ ID NO: 161561 - DNA, 75 bp, Artificial Sequence
  Synthetic
tgccctatctgagcccaagtgggcttatatggtgttatttccacttgaggtgtctgatggggagtgggtcccact

SEQ ID NO: 161562 - DNA, 75 bp, Artificial Sequence
  Synthetic
aaggaggatgtgcattacaaggagattcctcgcctctttgcagcgggccccgaggggcgcaggcggctcggcatg

SEQ ID NO: 161563 - DNA, 75 bp, Artificial Sequence
  Synthetic
gcaggggcaggggcaggggcaagggcaagtccagggacaagcaacgcaagcccggtggaccatggagaccagagc

SEQ ID NO: 161564 - DNA, 75 bp, Artificial Sequence
  Synthetic
cccggggcagtgtcttaatcagagccctgacatccttaacatcgtccgtcagatggcctgtcttggacgagacca

SEQ ID NO: 161565 - DNA, 75 bp, Artificial Sequence
  Synthetic
cctgacatccttaacatcgtccgtcagatggcctgtcttggacgagaccatagtctggaacatctcctcgaggac

SEQ ID NO: 161566 - DNA, 75 bp, Artificial Sequence
  Synthetic
atagccaaggcccagggtctgtccctaaacaaagttgccatctgcttcggcagccacagaaacatcaaacccggc

SEQ ID NO: 161567 - DNA, 75 bp, Artificial Sequence
  Synthetic
agatggcctgtcttggacgagaccatagtctggaacatctcctcgaggacgggataggtgaacacccacttgcaa

SEQ ID NO: 161568 - DNA, 75 bp, Artificial Sequence
  Synthetic
actgtttcgttgggtcatctggagtctgacttggctgaaccaccggccatggagtttgtgcgcagcttggtgccg

SEQ ID NO: 161569 - DNA, 75 bp, Artificial Sequence
  Synthetic
gccaccctcctcttgaacaggccactcgggggcctgagggcagggcctgccatggattgacaaatcaagagcttc

SEQ ID NO: 161570 - DNA, 75 bp, Artificial Sequence
  Synthetic
atagcatatgctacccacctagagatttgggtagtatatgctacccagatatgaattaggatagcatatgctacc

SEQ ID NO: 161571 - DNA, 75 bp, Artificial Sequence
  Synthetic
gtgttccactacctgcttgccggaggccatgatggccgcgcggtccacgcccagcaccttgctgtaggtgtaggc

SEQ ID NO: 161572 - DNA, 75 bp, Artificial Sequence
  Synthetic
ggcattttgggcagctgggaggcggcggatgggggtgcttcttttcgcacggtgtatgtttggggacccgcatgc

SEQ ID NO: 161573 - DNA, 75 bp, Artificial Sequence
  Synthetic
aggtcaccggtgaagacacaagggcctcttctgccagcccggggctgttgtggtactggtggcagtagggttgcc

SEQ ID NO: 161574 - DNA, 75 bp, Artificial Sequence
  Synthetic
catggagtgcataccccaaagcatccagctgatgttggaccacgtcagtgccttggctagggggggcaccttgga

SEQ ID NO: 161575 - DNA, 75 bp, Artificial Sequence
  Synthetic
ggtcaggtccccctccacgggagggcgctctgcgccagccccgccctccccatccccagcccagccgttcactcg

SEQ ID NO: 161576 - DNA, 75 bp, Artificial Sequence
  Synthetic
cgtctttttcaagaaggtctagcatcgaaccatgtacttggacaccctgcatggattcttcgtgaagtagaactg

SEQ ID NO: 161577 - DNA, 75 bp, Artificial Sequence
  Synthetic
ctttggtggattgcggaactggggctggtggcctgggaggtgctgaggcccgtcccctgaccggcgcgggagccg

SEQ ID NO: 161578 - DNA, 75 bp, Artificial Sequence
  Synthetic
ttgtcacttggggcccaggcaaaggttgccatggctccagccgagcctggacactcagtgggccggcggggccag

SEQ ID NO: 161579 - DNA, 75 bp, Artificial Sequence
  Synthetic
cctcatttataaatgccttgcatattttgtaggatctcagagtaatctccacactcccggctgtaaattccttgt

SEQ ID NO: 161580 - DNA, 75 bp, Artificial Sequence
  Synthetic
tttgtaggatctcagagtaatctccacactcccggctgtaaattccttgttgaggacgttgcagtagtcagagac

SEQ ID NO: 161581 - DNA, 75 bp, Artificial Sequence
  Synthetic
gtgccgcccgttccccggcagaggcctcggggggcgcccactcccacgccacctcctcaggtgctgcccactccc

SEQ ID NO: 161582 - DNA, 75 bp, Artificial Sequence
  Synthetic
cagcctcaggacgctggcagttcacgcatgcccaggctaatggtcaaggatgaggcaggcttcgtgtgctgcctg

SEQ ID NO: 161583 - DNA, 75 bp, Artificial Sequence
  Synthetic
cggtggctcagccagcctctggcagcccaccgccgcagagccgcagttggagcagtacacacggccgctggcatg

SEQ ID NO: 161584 - DNA, 75 bp, Artificial Sequence
  Synthetic
cgaccattaaaatctttcctccatgagctttacctgaaacactatcccgaagtgggggatgtggtgcatctactg

SEQ ID NO: 161585 - DNA, 75 bp, Artificial Sequence
  Synthetic
gccccgccaacctgcaggccctggccccgtccccagacgcctgggcgcccctcaaccccgagggccagcttcgag

SEQ ID NO: 161586 - DNA, 75 bp, Artificial Sequence
  Synthetic
atgcagctggcactaagggctcctgctggtcagcaggggccgacaaagcaaattttgcgccaattgttaacgggg

SEQ ID NO: 161587 - DNA, 75 bp, Artificial Sequence
  Synthetic
tggtggcatcgtgagtggttgtggaggggtaagcctcggtcgtgacagaggtgacaaaatggtgggtgctgtcgg

SEQ ID NO: 161588 - DNA, 75 bp, Artificial Sequence
  Synthetic
aggccctggccgcccacaccacccggagcctgtttgtggcccccatctccctggaggccgagaagaccttctcct

SEQ ID NO: 161589 - DNA, 75 bp, Artificial Sequence
  Synthetic
actcccccaaggatgaacagcgtgacatcgccgaggttcttgaccacctcaagacgaatcgggacctggggctgg

SEQ ID NO: 161590 - DNA, 75 bp, Artificial Sequence
  Synthetic
catcgccgaggttcttgaccacctcaagacgaatcgggacctggggctggacgacagactctgggccctgattag

SEQ ID NO: 161591 - DNA, 75 bp, Artificial Sequence
  Synthetic
cccggcctcgccttctcctcagcctccaacaggtgcccgagcccagcctgccggacttcattctcaaacagtccc

SEQ ID NO: 161592 - DNA, 75 bp, Artificial Sequence
  Synthetic
acgagcgaagatcgaggcctatacagagcccgagatgccgcacggggggggctcgcactctcccgtcgttatctt

SEQ ID NO: 161593 - DNA, 75 bp, Artificial Sequence
  Synthetic
tccaggcatccctgcgctgaggtggtgggggtggtggaggtggtggaggtggtggaggtggtggaggtggtggag

SEQ ID NO: 161594 - DNA, 75 bp, Artificial Sequence
  Synthetic
tgcgcgtaggtttagccgcactcgaggccctgatgctcgtctacacgctctgcgagaccgccaacctggccgagg

SEQ ID NO: 161595 - DNA, 75 bp, Artificial Sequence
  Synthetic
gaagcgactacacagccgtgtcgctgcagtactacgacggcatctccataggtatgaggaaggtaatcgcggatg

SEQ ID NO: 161596 - DNA, 75 bp, Artificial Sequence
  Synthetic
gcggtgtcttggggttgtcccccgccacctgacccggtatcgacggctgcggcggcggaggcggcggcagtcgcc

SEQ ID NO: 161597 - DNA, 75 bp, Artificial Sequence
  Synthetic
tttcttccccttcctctagggtcctgatcatgctcaccggtagtctgtacatcatctccccgctcattgtcgggt

SEQ ID NO: 161598 - DNA, 75 bp, Artificial Sequence
  Synthetic
taatagatgaagaaacagagggggtcgcggactgggctacggccgtggacggcgctgatgatgccaaggccccgg

SEQ ID NO: 161599 - DNA, 75 bp, Artificial Sequence
  Synthetic
gagcagccaagagccacgcctgaatcccaggcccccacagtggtcctccagcgaccacccacgaccacccacgca

SEQ ID NO: 161600 - DNA, 75 bp, Artificial Sequence
  Synthetic
agcaggctcaccaccacaggccccccagacccgggtctcggccagccgagccgaccggccccgcgcctggcgcct

SEQ ID NO: 161601 - DNA, 75 bp, Artificial Sequence
  Synthetic
ctggagctcatccggggatgctgcatccgctagtccgacctgggtgggtgcggtccgctggccccaccctggggg

SEQ ID NO: 161602 - DNA, 75 bp, Artificial Sequence
  Synthetic
atgacaggcgtgtcaatggtcaagagcaaaagaagtaacatttatttgggatacattggttgctggagagggcaa

SEQ ID NO: 161603 - DNA, 75 bp, Artificial Sequence
  Synthetic
atcccaggatggcatgcgcctctttcaacacagcaggcctctcctcaccctctgggagagcgtggccgcaaatca

SEQ ID NO: 161604 - DNA, 75 bp, Artificial Sequence
  Synthetic
actaccgcagccacgtccagactccgggggtccagccgggcgcacacgctcagctcaaccgccagggcgtacacc

SEQ ID NO: 161605 - DNA, 75 bp, Artificial Sequence
  Synthetic
ctcgtctgaatctgaaggatgccacgaggggtcgctatcactgccctcagatgggtcttcgtcactggggtactc

SEQ ID NO: 161606 - DNA, 75 bp, Artificial Sequence
  Synthetic
agaggaaggggaagaaactgcaatgtcccccagccccaacatgtccctttcctgtttagcagttcctccgcactc

SEQ ID NO: 161607 - DNA, 75 bp, Artificial Sequence
  Synthetic
gattagaagacgatgcataaaattttattctacatcatgcctggttcggtggggtcgtgactatacaggggaggt

SEQ ID NO: 161608 - DNA, 75 bp, Artificial Sequence
  Synthetic
tgacctggttaacagacttcaggtggtcatgtttccctccaagcggcacagattagaagacgatgcataaaattt

SEQ ID NO: 161609 - DNA, 75 bp, Artificial Sequence
  Synthetic
aaatgagtataacctactttttttaaatcaaatgcatgattacccagtagggccgcctgcccccctgcacccagt

SEQ ID NO: 161610 - DNA, 75 bp, Artificial Sequence
  Synthetic
aaataaatttctcttacctgcgtctgtttgtgtagtgaggtgttgtgtcctgtatggtattctactttaaaaatg

SEQ ID NO: 161611 - DNA, 75 bp, Artificial Sequence
  Synthetic
gagtcccggtgctggaggcgggggatggcgcggcggcagctgtaccagccaaaggtgacaaagtcattgtccagg

SEQ ID NO: 161612 - DNA, 75 bp, Artificial Sequence
  Synthetic
ctcgggctctgtataggcctcgatcttcgctcgtttagacggcggaatatcggtgggaggcataggccccactcc

SEQ ID NO: 161613 - DNA, 75 bp, Artificial Sequence
  Synthetic
gtttgtgtagtgaggtgttgtgtcctgtatggtattctactttaaaaatgccggctgacatggattactggtctt

SEQ ID NO: 161614 - DNA, 75 bp, Artificial Sequence
  Synthetic
gggggcaggccacgccccctccactttttccaggaatgcgcggcccccatggcccccgacccccccgttcccctg

SEQ ID NO: 161615 - DNA, 75 bp, Artificial Sequence
  Synthetic
ttcgctcgtttagacggcggaatatcggtgggaggcataggccccactcccctcctttccctggtatattccgtg

SEQ ID NO: 161616 - DNA, 75 bp, Artificial Sequence
  Synthetic
cacacccttttcgcctgaatccgccacctcattctgaaattcccatatccgccgtctgctgcttcgtcacccgcc

SEQ ID NO: 161617 - DNA, 75 bp, Artificial Sequence
  Synthetic
tgctcaggagtgggggcttcttattggttaattcaggtgtgtcattttagcccgttgggtttcattaaggtgtgt

SEQ ID NO: 161618 - DNA, 75 bp, Artificial Sequence
  Synthetic
ggttcctgaacatctggctggggcattaactaagcttatgagcgattttatcacaggacaagatgtcactctttc

SEQ ID NO: 161619 - DNA, 75 bp, Artificial Sequence
  Synthetic
cactgccgcttcccacaacactacgcactcccccttgtgattgccgcactgcctttccatttcctgctgcacttg

SEQ ID NO: 161620 - DNA, 75 bp, Artificial Sequence
  Synthetic
gacccttagccctcttagccgcctcacccacctcccctacggtgaacccacatccttgcctcacctgaacccccc

SEQ ID NO: 161621 - DNA, 75 bp, Artificial Sequence
  Synthetic
tggaggaaatattgcagtcaaaattcgcgatgctataaaccagacccccgggggtggtgatgtagctatactttc

SEQ ID NO: 161622 - DNA, 75 bp, Artificial Sequence
  Synthetic
gcacaatcttgtcactggtgccggaccctggtgaaggctgccagcccgcagcggcttgacgctcaagggcggcct

SEQ ID NO: 161623 - DNA, 75 bp, Artificial Sequence
  Synthetic
cttgacgccccccgttaacaattggcgcaaaatttgctttgtcggcccctgctgaccagcaggagcccttagtgc

SEQ ID NO: 161624 - DNA, 75 bp, Artificial Sequence
  Synthetic
ggccgggaagaagccgcggagattcggccctccgccacccgcctccccacggccgtcgggctgcgaccccgtgcg

SEQ ID NO: 161625 - DNA, 75 bp, Artificial Sequence
  Synthetic
ttacgcttacatgcacacacacaccgccgctttcgggaaatctgcacccgtactgcctccggcagaccccgcaaa

SEQ ID NO: 161626 - DNA, 75 bp, Artificial Sequence
  Synthetic
gcaccccagtggacaaggcagtagaggacacccaccaccaggcggttagggaggacactgccaaggttgaagagc

SEQ ID NO: 161627 - DNA, 75 bp, Artificial Sequence
  Synthetic
cagccacgtatcaataaactgtttaaactaacaattctatgtgttgtgtgtggttttgggttgggactggggtaa

SEQ ID NO: 161628 - DNA, 75 bp, Artificial Sequence
  Synthetic
cctccgctactccagcgttcgacccgggagaagcgccgtccggccttcccatcccccaggcacccgccctggggt

SEQ ID NO: 161629 - DNA, 75 bp, Artificial Sequence
  Synthetic
gtgagacctcacacaaggacacacccgagtcattgctccgggctatcgtgacgggtctccaaaaattgtgggtgg

SEQ ID NO: 161630 - DNA, 75 bp, Artificial Sequence
  Synthetic
gagcagttccccctgcagccgcccagtctctgcctccaggcaagggcgccagcttttctcccccccagcctgagg

SEQ ID NO: 161631 - DNA, 75 bp, Artificial Sequence
  Synthetic
ggtcatgcaaaaacagacaaagagaccgtgagcggttaccggggcgcagggcctctgccgggaagcccacccggg

SEQ ID NO: 161632 - DNA, 75 bp, Artificial Sequence
  Synthetic
acgggtctccaaaaattgtgggtggattcgtgcggatgtccagagtgcctacaatgtcttaagggattgaaggca

SEQ ID NO: 161633 - DNA, 75 bp, Artificial Sequence
  Synthetic
cctacataagcctctcacactactctgcccccttctttcctcaactgcctggctcctgacacactgccctgagca

SEQ ID NO: 161634 - DNA, 75 bp, Artificial Sequence
  Synthetic
cgagtcattgctccgggctatcgtgacgggtctccaaaaattgtgggtggattcgtgcggatgtccagagtgcct

SEQ ID NO: 161635 - DNA, 75 bp, Artificial Sequence
  Synthetic
ctaggataataccacacactaagcagtgtagtcctgtcaatctcctgaacatgttggtccacaagcttgtggctt

SEQ ID NO: 161636 - DNA, 75 bp, Artificial Sequence
  Synthetic
tgtcctcatcgctgctcgtctcactagtagcatcacctctgggttcacctcccgttgctaacattgataaaccct

SEQ ID NO: 161637 - DNA, 75 bp, Artificial Sequence
  Synthetic
ggaccccccctctcctcttccataggccttgctctccttctcctgctcttggcgctactgttttggctgtacatc

SEQ ID NO: 161638 - DNA, 75 bp, Artificial Sequence
  Synthetic
attatgagtaactggactggaggagccctccttgtcctctatgcctttgctctcatgcttgtgattatcattttg

SEQ ID NO: 161639 - DNA, 75 bp, Artificial Sequence
  Synthetic
agtggcattggccactggcgtggggcagctgtttccggtggccgggactgtttcgttgggtcatctggagtctga

SEQ ID NO: 161640 - DNA, 75 bp, Artificial Sequence
  Synthetic
tccacgtccgaaccctgtctaccggtgtcctcatcgctgctcgtctcactagtagcatcacctctgggttcacct

SEQ ID NO: 161641 - DNA, 75 bp, Artificial Sequence
  Synthetic
cttattggcagccttatttcacctcaatatgttctttattctcaaagattacataacacaagactccatgagctt

SEQ ID NO: 161642 - DNA, 75 bp, Artificial Sequence
  Synthetic
cagtccctgggcctgcctggggccaccttctctaagagagggctctgtgggctgggagggccagaggcctcagat

SEQ ID NO: 161643 - DNA, 75 bp, Artificial Sequence
  Synthetic
gggccattccaaaggggagacgactcaatggtgtaatacgacattgtggaacagcaagggcaattcctcgcctga

SEQ ID NO: 161644 - DNA, 75 bp, Artificial Sequence
  Synthetic
gtgtcattcgcgcgtcatccccgcgaacccccagtcccattaacatagcgggcacaatggtgcaggcaccgtctg

SEQ ID NO: 161645 - DNA, 75 bp, Artificial Sequence
  Synthetic
gaaacgcacgaaatctaaaaggttctcctcggtctggagcaagttttgccagatgtggtgcagagagccacacag

SEQ ID NO: 161646 - DNA, 75 bp, Artificial Sequence
  Synthetic
actttctcctctttccccagtcaccctcctgctcatcgctctctggaatttgcacggacaggcattgtaccttgg

SEQ ID NO: 161647 - DNA, 75 bp, Artificial Sequence
  Synthetic
gaggcctcagattcagccgtagtgctcccctcttccccctggtccgtctcccctcctcccaactgctggagccgg

SEQ ID NO: 161648 - DNA, 75 bp, Artificial Sequence
  Synthetic
gataatcacttttatctcccgacgacagggcctttaaacaccttcaaatttcccgaagagcttctggggcgcgtt

SEQ ID NO: 161649 - DNA, 75 bp, Artificial Sequence
  Synthetic
ttacttggtaagatctaacattccctaggaattatttaccacacccccacttttccaaccctaacactctttttt

SEQ ID NO: 161650 - DNA, 75 bp, Artificial Sequence
  Synthetic
gtgtcgaggccatagtccggcgagacgcccgcccaccacctgtcttcacccccgcacccaggcggcttccgcagg

SEQ ID NO: 161651 - DNA, 75 bp, Artificial Sequence
  Synthetic
ccacgcagtcttaggtctctggatctacttattggagattctctggcgacttggtgccaccatctggcagctttt

SEQ ID NO: 161652 - DNA, 75 bp, Artificial Sequence
  Synthetic
gtagaactgcacgtttggcagattgtgccgataggtgaaacacttccagatgatgttttttctgttggccaggat

SEQ ID NO: 161653 - DNA, 75 bp, Artificial Sequence
  Synthetic
gcagacatgctctcagttaacgagcagaggaaatgaaagctcacggcgaaacttgggccagcccggggggacctc

SEQ ID NO: 161654 - DNA, 75 bp, Artificial Sequence
  Synthetic
atagaatgacagcctggtccaagagtaaaagcagaacagtaaacactgccataagtcctcatggcaggagaggcg

SEQ ID NO: 161655 - DNA, 75 bp, Artificial Sequence
  Synthetic
ggatgtattaccatggacaacgacacagtgatgaacaccaccacgatgactccctcccgcaccctcaacaagcta

SEQ ID NO: 161656 - DNA, 75 bp, Artificial Sequence
  Synthetic
ccatcaaccacctccagtgcccaaaccggttccagtcaagcctacgccaccgccttcccgtaggagaaggggagc

SEQ ID NO: 161657 - DNA, 75 bp, Artificial Sequence
  Synthetic
ctcctgctcgtgagtggagccggcgacggacccccactctgctctcaaaacctaggcgcacctggaggtggtcct

SEQ ID NO: 161658 - DNA, 75 bp, Artificial Sequence
  Synthetic
gggttagacacacaacacgtcttgtgcttcgtgatggcagccagtgcggcacgaactctaaacaccttctctcca

SEQ ID NO: 161659 - DNA, 75 bp, Artificial Sequence
  Synthetic
agcatctctgtctggtgaccttgaagaggaagaggaggggtcccgagaatccccatccctaccgtccagcaaaaa

SEQ ID NO: 161660 - DNA, 75 bp, Artificial Sequence
  Synthetic
ggagccccccttcctgcccttttcagcctatgtaattacgggaacggcgggggctggcaagagcaccagcgttag

SEQ ID NO: 161661 - DNA, 75 bp, Artificial Sequence
  Synthetic
aaactgacacacaggcctggcgggtggagatagggaccagaggactaatgttctctaactgtgtcccactccacc

SEQ ID NO: 161662 - DNA, 75 bp, Artificial Sequence
  Synthetic
gaggaagaggaggggtcccgagaatccccatccctaccgtccagcaaaaagggggccgatgaatttgaggcctgg

SEQ ID NO: 161663 - DNA, 75 bp, Artificial Sequence
  Synthetic
ggtaagcggttcaccttcaggggtaagtaacctgacctctccagggctcacataaagggaggcttagtatacatg

SEQ ID NO: 161664 - DNA, 75 bp, Artificial Sequence
  Synthetic
gtggaaaacaaaggaggtgaccagggcccgcctttgatgacagacggtggcggcggtcatagtcatgattccggc

SEQ ID NO: 161665 - DNA, 75 bp, Artificial Sequence
  Synthetic
cgccgtgaactctgcccttcagtgtctggcggctgctgcgccctgtaaagatgtaaagatctaccccagctgcat

SEQ ID NO: 161666 - DNA, 75 bp, Artificial Sequence
  Synthetic
tttcagacctggatctgtctgacagcgaccatgaaggggatgagggtgggggggctgttggagggggcaggagtc

SEQ ID NO: 161667 - DNA, 75 bp, Artificial Sequence
  Synthetic
catctaataaagatgtctattgatctcttttagtgtgaatcatgtctgacgagggaccaggtacaggacctggaa

SEQ ID NO: 161668 - DNA, 75 bp, Artificial Sequence
  Synthetic
aggacgaggacgaggaggcggaagaccaggagctccgggcggctcaggatcagggccaagacatagagatggtgt

SEQ ID NO: 161669 - DNA, 75 bp, Artificial Sequence
  Synthetic
caaagaggcccctctccgcgagggagaggctcgagcctggaggggaggagaggggacgcctagggtcccttctgg

SEQ ID NO: 161670 - DNA, 75 bp, Artificial Sequence
  Synthetic
acgtcccggggacggaagctggattttggccagtcttcaattttggggagtggttttgtgtgagccggaagttgg

SEQ ID NO: 161671 - DNA, 75 bp, Artificial Sequence
  Synthetic
cacacatcagacctctggacaacacaactacagggcagatgaggccccttacttccacagggtactggcattcca

SEQ ID NO: 161672 - DNA, 75 bp, Artificial Sequence
  Synthetic
caaaacttgctccagaccgaggagaaccttttagatttcgtgcgtttcatgggtgtcatgtccagctgcaataat

SEQ ID NO: 161673 - DNA, 75 bp, Artificial Sequence
  Synthetic
ctggacaccgacttcacgctatgtgccgaggcctttgaggccgtgtagtttctgtggtgcggatgcattaggcgg

SEQ ID NO: 161674 - DNA, 75 bp, Artificial Sequence
  Synthetic
ctcccacctcagtgggatggatctgcaggacatggccaggatcaggtctcccagttcccacatctgcaatcggag

SEQ ID NO: 161675 - DNA, 75 bp, Artificial Sequence
  Synthetic
agagaactcgagagaggcctctgccgcgctgctcgcccctggtagaaagggtacccgggtcccgcctctccgcac

SEQ ID NO: 161676 - DNA, 75 bp, Artificial Sequence
  Synthetic
cagacactccattaattccactaacaatctttgttggggaaaacacgggggtgggccctcaagtccagccccacc

SEQ ID NO: 161677 - DNA, 75 bp, Artificial Sequence
  Synthetic
tgaggtgcccctgacctctggactctggggcctgggccccgaaggtggctcccctcagacattctttgggtttaa

SEQ ID NO: 161678 - DNA, 75 bp, Artificial Sequence
  Synthetic
accaaccctcagcagcccaccaccgagggccaccaccgcggaaagaaactggtgcaggcctctgcatccggagtg

SEQ ID NO: 161679 - DNA, 75 bp, Artificial Sequence
  Synthetic
tcgccgccccaggggtctctagacctcgagtccggggagaacggtggccagacggcgcttgcgcctgcccccgga

SEQ ID NO: 161680 - DNA, 75 bp, Artificial Sequence
  Synthetic
aggggcaggagcaggaggtggaggccggggtcgaggaggcagtggaggccggggtcgaggaggtagtggaggccg

SEQ ID NO: 161681 - DNA, 75 bp, Artificial Sequence
  Synthetic
ggtggtgggggcacccccgtgttttccccaacaaagattgttagtggaattaatggagtgtctgacagttgttcc

SEQ ID NO: 161682 - DNA, 75 bp, Artificial Sequence
  Synthetic
ccttgcgccgcctcccccagcccgccagccaccccagacaggagatgataatgatgaggagcaccggagccacca

SEQ ID NO: 161683 - DNA, 75 bp, Artificial Sequence
  Synthetic
gggggggaagtcgtgaaagagccagggggagaggtcgtggacgtggtgaaaagaggcccaggagtcccagtagtc

SEQ ID NO: 161684 - DNA, 75 bp, Artificial Sequence
  Synthetic
agggttcttctcctcctctcttggtcatcctgcgggggaccaatagcttgggggcgtccggctggggtcagggaa

SEQ ID NO: 161685 - DNA, 75 bp, Artificial Sequence
  Synthetic
agagtgacgggtttccacgactatccgtgtcaacaattagatgatatgtttgtcccccatgtaacgcaagataga

SEQ ID NO: 161686 - DNA, 75 bp, Artificial Sequence
  Synthetic
acctggctaagcctgtgacttagtcttcatcctcttcttcttctatgtagacagattggcgctgggtggttactg

SEQ ID NO: 161687 - DNA, 75 bp, Artificial Sequence
  Synthetic
aagaggcccaggagtcccagtagtcagtcatcatcatccgggtctccaccgcgcaggccccctccaggtagaagg

SEQ ID NO: 161688 - DNA, 75 bp, Artificial Sequence
  Synthetic
gccccgcagatgacccaggagaaggcccaagcactggaccccggggtcagggtgatggaggcaggcgcaaaaaag

SEQ ID NO: 161689 - DNA, 75 bp, Artificial Sequence
  Synthetic
ggggcctcctgccgcggggcctcctgccgcggggcctcctgccgcggggcctcctgccgcggggcctcctgccgc

SEQ ID NO: 161690 - DNA, 75 bp, Artificial Sequence
  Synthetic
aggcttacccctccacaaccactcacgatgccaccaaggcctactcctcctacccctctgccacctgcaacacta

SEQ ID NO: 161691 - DNA, 75 bp, Artificial Sequence
  Synthetic
ccaccaccacccccaccacccccaccacccccaccacccccaccacccccaccacctccaccaccttcaccacca

SEQ ID NO: 161692 - DNA, 75 bp, Artificial Sequence
  Synthetic
accacctccaccaccttcaccaccacccccgcccccaccacccccaccacctcagcgcagggatgcctggacaca

SEQ ID NO: 161693 - DNA, 75 bp, Artificial Sequence
  Synthetic
ctcacggtgccaccaaggcctacccgtcctaccactctgccacccacaccactactcacggtactacaaaggcct

SEQ ID NO: 161694 - DNA, 75 bp, Artificial Sequence
  Synthetic
tcctcagggtgggcagcctgggataacacgcgtcccttggctgcccttggttaagtttagcgtcttgcacgttaa

SEQ ID NO: 161695 - DNA, 75 bp, Artificial Sequence
  Synthetic
ccaacaacacacatggcataaagagagggtaggaggattttggggggaaatcctcagggtgggcagcctgggata

SEQ ID NO: 161696 - DNA, 75 bp, Artificial Sequence
  Synthetic
ttaagtttagcgtcttgcacgttaatctaatagaacggatactaagtcccccatggaaaacccataactaggacc

SEQ ID NO: 161697 - DNA, 75 bp, Artificial Sequence
  Synthetic
tggggagctggttgagcagcaacgtctggatgtaaacttaaatccagaggagcgtcaggatcctcataccggggt

SEQ ID NO: 161698 - DNA, 75 bp, Artificial Sequence
  Synthetic
ccatggaaaacccataactaggacctaacaagcggaggctgggaaagcttgattggaagaaagtaaacaaactga

SEQ ID NO: 161699 - DNA, 75 bp, Artificial Sequence
  Synthetic
tgattgtggacagcgcggcctgcgagctggcggtgagctacgcgcccgccatgctggaggcctcgcacgagaccc

SEQ ID NO: 161700 - DNA, 75 bp, Artificial Sequence
  Synthetic
tgggcgacatggaactcaagtgtgaactttgtatgggctgggccttaccagcatccatcaccgagagggcacaga

SEQ ID NO: 161701 - DNA, 75 bp, Artificial Sequence
  Synthetic
ccgctcctacctgcaatatcaaggtgactgtgtgcagctttgacgatggagtagatttgcctccctggtttccac

SEQ ID NO: 161702 - DNA, 75 bp, Artificial Sequence
  Synthetic
gcagcacaatagaagcactaaatgagtcattcctaaactgtcagttttaaaactccctgcttctcaggcctaaat

SEQ ID NO: 161703 - DNA, 75 bp, Artificial Sequence
  Synthetic
gatcgttgttgttattcttcaatttctgcaggtaacttaggaagcgtttcttgagcttccctgggatgagcgttt

SEQ ID NO: 161704 - DNA, 75 bp, Artificial Sequence
  Synthetic
gtagatttgcctccctggtttccacctatggtggaaggggctgccgcggagggtgatgacggagatgacggagat

SEQ ID NO: 161705 - DNA, 75 bp, Artificial Sequence
  Synthetic
cacaccaaacaccacaggacaagttcagaatctgtccggtggtgatgggcgggtcttaggtcaccagctacgcgg

SEQ ID NO: 161706 - DNA, 75 bp, Artificial Sequence
  Synthetic
aacttatagaggaggggctggggctaaaaatgaaaaagcacttacccgagcgggaggccggggacgtggccgtag

SEQ ID NO: 161707 - DNA, 75 bp, Artificial Sequence
  Synthetic
aggaagggcaggagtgatgtaacttgttaggagacgccctcaatcgtattaaaagccgtgtattcccccgcacta

SEQ ID NO: 161708 - DNA, 75 bp, Artificial Sequence
  Synthetic
ggctggtgattggaggtttgcctagaacttatagaggaggggctggggctaaaaatgaaaaagcacttacccgag

SEQ ID NO: 161709 - DNA, 75 bp, Artificial Sequence
  Synthetic
ttagatggggggacttttaaggtttatcaaatttttggctctcattgtacatatgtcagcaaatttagtacagtt

SEQ ID NO: 161710 - DNA, 75 bp, Artificial Sequence
  Synthetic
cacctgtcttgtcaccattttcgtcctcccaacatggggcaattgggcatacccatgttgtcacgtcactcagct

SEQ ID NO: 161711 - DNA, 75 bp, Artificial Sequence
  Synthetic
ctcccaacatggggcaattgggcatacccatgttgtcacgtcactcagctccgcgctcaacaccttctcgcgttg

SEQ ID NO: 161712 - DNA, 75 bp, Artificial Sequence
  Synthetic
ccagtctcacaccatgagtgttcattccttaaaccatgtttatgtgtcagtcaaagatcaaatagctaacagggg

SEQ ID NO: 161713 - DNA, 75 bp, Artificial Sequence
  Synthetic
gggggaaggagctgacacgattgagtagaaagggccaaaaatacaccagctataaggaattgctcaggccaaagt

SEQ ID NO: 161714 - DNA, 75 bp, Artificial Sequence
  Synthetic
tcaccttggatccccttaatctagctcactttcagtggatgcatcgtagtcagtctgcttcgcgtcctttgggaa

SEQ ID NO: 161715 - DNA, 75 bp, Artificial Sequence
  Synthetic
gcgcccgggggtcgggctgggccgccaggggggcaaaaggggctccgcgagggagaggctcgggcctggagggga

SEQ ID NO: 161716 - DNA, 75 bp, Artificial Sequence
  Synthetic
tagcctggcctccttaaattcacctaagaatgggagcaaccagctggtcatcagccgctgcgcaaacggactcaa

SEQ ID NO: 161717 - DNA, 75 bp, Artificial Sequence
  Synthetic
aagaatgggagcaaccagctggtcatcagccgctgcgcaaacggactcaacgtggtctccttctttatctccatc

SEQ ID NO: 161718 - DNA, 75 bp, Artificial Sequence
  Synthetic
ggatggtgagccagacacggcgggtgggggaaggagctgacacgattgagtagaaagggccaaaaatacaccagc

SEQ ID NO: 161719 - DNA, 75 bp, Artificial Sequence
  Synthetic
agaactttcttctactcgaggcctttttggcgtggtggcattaatgtccagtggggtaaatgcaccttgactgta

SEQ ID NO: 161720 - DNA, 75 bp, Artificial Sequence
  Synthetic
caccctggagactctttacggttcattctcagtggaagacctgtttggtgccaacttaaacagatacgcatggca

SEQ ID NO: 161721 - DNA, 75 bp, Artificial Sequence
  Synthetic
ggaagatggggtgcctggccaggtcacccaaggattactgcgcggatctaaacaaggaggaagatgccaactcgg

SEQ ID NO: 161722 - DNA, 75 bp, Artificial Sequence
  Synthetic
tggctcggttgagccgcgtgtacagctcgttcctcttttgcaggatggcccggtactgggggtgcgccgtgaagg

SEQ ID NO: 161723 - DNA, 75 bp, Artificial Sequence
  Synthetic
tcgcgggggctagacctctggctggatgagcacgtgtggaagaggaaacaggagattggtgtgaaaggagaaaat

SEQ ID NO: 161724 - DNA, 75 bp, Artificial Sequence
  Synthetic
catgctgtacctgatgagtcgcaccccacggccatgctatcttgtaacggcatagggggaggtgggaatcttgtt

SEQ ID NO: 161725 - DNA, 75 bp, Artificial Sequence
  Synthetic
aagaatgcggccctgcacgtgcgcaggtgtacggcggacatcagggacaaggtggcctcggcggcctccgattat

SEQ ID NO: 161726 - DNA, 75 bp, Artificial Sequence
  Synthetic
ggtgccgaggacgcagtcggtgcccgcccgtgactacccccacgtactgggcacgcgggcggtggagtcggcagc

SEQ ID NO: 161727 - DNA, 75 bp, Artificial Sequence
  Synthetic
cggcatctacacggaccgcgtccttcgtggccagggacggcaggcaggcctccagctttgcggccaggtgctcat

SEQ ID NO: 161728 - DNA, 75 bp, Artificial Sequence
  Synthetic
ttattttgggccaggacccctatcacgggggtcaagcaaacggcctggcattcagcatcgcatacggctttccag

SEQ ID NO: 161729 - DNA, 75 bp, Artificial Sequence
  Synthetic
ttgcaccgatagcatggccgccagagttccaatagaggagctccgagagctccgccacctccgggggcactgtcg

SEQ ID NO: 161730 - DNA, 75 bp, Artificial Sequence
  Synthetic
tagtcaccaggtgtcaccggaggctacttgcctcagtgccacttttaccttctcaaatctatacggggggggggg

SEQ ID NO: 161731 - DNA, 75 bp, Artificial Sequence
  Synthetic
catataaaggatgctgtttttatttcaccaaaaagaagcacacctggaatgggtgtttccaagcctgtgcagagc

SEQ ID NO: 161732 - DNA, 75 bp, Artificial Sequence
  Synthetic
cgggggtcaagcaaacggcctggcattcagcatcgcatacggctttccagtcccccccagcctgaggaacatcta

SEQ ID NO: 161733 - DNA, 75 bp, Artificial Sequence
  Synthetic
gggtgtttccaagcctgtgcagagctatatccatgcacttatttttatgggccaacgcccgatattctacctgtg

SEQ ID NO: 161734 - DNA, 75 bp, Artificial Sequence
  Synthetic
gccccgggcccgggaccgcgccctcctctgggccgcccggcctcgccttctcctcagcctccaacaggtgcccga

SEQ ID NO: 161735 - DNA, 75 bp, Artificial Sequence
  Synthetic
ggtgttgctactcaacaccatcctgaccgtgcaaaagggcaagcccggctcgcacgcagacattggctgggcgtg

SEQ ID NO: 161736 - DNA, 75 bp, Artificial Sequence
  Synthetic
gccaacgcccgatattctacctgtggtaactagaaatctgaatgccattgagtccctttgggtcggggtgtacag

SEQ ID NO: 161737 - DNA, 75 bp, Artificial Sequence
  Synthetic
accgtgcaaaagggcaagcccggctcgcacgcagacattggctgggcgtggtttactgaccacgtaatttcattg

SEQ ID NO: 161738 - DNA, 75 bp, Artificial Sequence
  Synthetic
gtttactgaccacgtaatttcattgctctctgagcggttaaaagcgtgcgtgtttatgctgtggggtgcgaaggc

SEQ ID NO: 161739 - DNA, 75 bp, Artificial Sequence
  Synthetic
tgtttatgctgtggggtgcgaaggcgggagacaaagcttcactaatcaactccaagaagcatctggttctgacct

SEQ ID NO: 161740 - DNA, 75 bp, Artificial Sequence
  Synthetic
cccatctgcgaccccccgcaaccctctaagactcaaggccagagccggggacagagcagggggaggggcaggggc

SEQ ID NO: 161741 - DNA, 75 bp, Artificial Sequence
  Synthetic
ctcagcatccctctcccctggcccagaacagcacccgaaagagtgcccagcagaagttcctgggcaacaaccact

SEQ ID NO: 161742 - DNA, 75 bp, Artificial Sequence
  Synthetic
cagggcgtacccggcttgcctggttctggggctcctctgggggtcgctgcatccgccggtagggttcgaatgggc

SEQ ID NO: 161743 - DNA, 75 bp, Artificial Sequence
  Synthetic
tggaggctgtagaggggtcatcactatggccatgtttctgaagtcgcgtggggtccggtcttgcagggaccggcg

SEQ ID NO: 161744 - DNA, 75 bp, Artificial Sequence
  Synthetic
gggtccggtcttgcagggaccggcgcctcttgtcggacgaggaggaagagacttcacagagcagcagctacactc

SEQ ID NO: 161745 - DNA, 75 bp, Artificial Sequence
  Synthetic
ggcagcccaggacaactttatcagcgtggccgagccggtcagcaccgcgtcgcaggcctcggccgggctgctgct

SEQ ID NO: 161746 - DNA, 75 bp, Artificial Sequence
  Synthetic
atagctgcccatcgacgtatcgctggaaaccggtgggccgctgttcacctaaagtgacgcaaggtctgtcagccg

SEQ ID NO: 161747 - DNA, 75 bp, Artificial Sequence
  Synthetic
ccaggaggaggacgtgagtgacactgatgagtctgactactcagatgaagacgaggagattgatttggaggaaga

SEQ ID NO: 161748 - DNA, 75 bp, Artificial Sequence
  Synthetic
ggccacctaccctcttagggaggtggccacactggggaccggctacgcgggccacaggtgcctgacggtgccgct

SEQ ID NO: 161749 - DNA, 75 bp, Artificial Sequence
  Synthetic
agcagatgtgcccaagcctggatgttgactccattatcccccggacaccagatgttttacacgaggatctcttaa

SEQ ID NO: 161750 - DNA, 75 bp, Artificial Sequence
  Synthetic
gagggcagtgatagcgacccctcgtggcatccttcagattcagacgagtctgactacagcgagagcgacgaggat

SEQ ID NO: 161751 - DNA, 75 bp, Artificial Sequence
  Synthetic
ggaaggtatgttcctgccaaagccggaagcgggcagtgccatatctgacgtgttcgaggggcgagaggtgtgtca

SEQ ID NO: 161752 - DNA, 75 bp, Artificial Sequence
  Synthetic
ggggacccagtaaaagacctcgcccctccacccagtaaaaaaccttgccctctccagcaaccaatgtatcccaaa

SEQ ID NO: 161753 - DNA, 75 bp, Artificial Sequence
  Synthetic
gcgcttgcgtctgcccccggagccctccactttttccaggaatgcgcccccatctatcccccccagcaagccgca

SEQ ID NO: 161754 - DNA, 75 bp, Artificial Sequence
  Synthetic
ccacccggatccccgtgggccaaccggcccctgcctgcctctttggctcccacccccacaggacctgtccatgaa

SEQ ID NO: 161755 - DNA, 75 bp, Artificial Sequence
  Synthetic
gcctaggtagcatcattgacactaaaagcagtgaccttgttggtactttaaggttggtccaatccataggctttt

SEQ ID NO: 161756 - DNA, 75 bp, Artificial Sequence
  Synthetic
gggcggcagcggacggtggggctcaaggagggcggcagcggacggtggggctcaaggagggcggcagcggacggt

SEQ ID NO: 161757 - DNA, 75 bp, Artificial Sequence
  Synthetic
gcacccgggcacctccgaggccgccggctcccgcgccggtcaggggacgggcctcagcacctcccaggccaccag

SEQ ID NO: 161758 - DNA, 75 bp, Artificial Sequence
  Synthetic
aagcagtgaccttgttggtactttaaggttggtccaatccataggctttttttgtgaaaacccggggatcggact

SEQ ID NO: 161759 - DNA, 75 bp, Artificial Sequence
  Synthetic
tactccagccacgccggacagaggagctacgtgagcggcgtgcttcccgcgtgcctgctgtcaaccaagtccaag

SEQ ID NO: 161760 - DNA, 75 bp, Artificial Sequence
  Synthetic
ggggcctgtttcaactgactaggcaccacttgtagtaacgcattcccttgctcgcagctggaggaatgcgattct

SEQ ID NO: 161761 - DNA, 75 bp, Artificial Sequence
  Synthetic
gaactagaaataaagcgatacaagaatcgggtggcttccagaaaatgccgggccaagtttaagcatctgctgcag

SEQ ID NO: 161762 - DNA, 75 bp, Artificial Sequence
  Synthetic
gccgcccccctccaccttcaagtcccaatacatacaataaacacatgatggaaaccaccccccccattaagggca

SEQ ID NO: 161763 - DNA, 75 bp, Artificial Sequence
  Synthetic
caatacatacaataaacacatgatggaaaccaccccccccattaagggcaataacaactacaattggccatggct

SEQ ID NO: 161764 - DNA, 75 bp, Artificial Sequence
  Synthetic
tctcacaccgaggcccgctactcggagtccggacagtttcatgcttttacagatgaactcgaaagtctcccgagc

SEQ ID NO: 161765 - DNA, 75 bp, Artificial Sequence
  Synthetic
cctgtacttagaggcccagctccacgccgcccccctccaccttcaagtcccaatacatacaataaacacatgatg

SEQ ID NO: 161766 - DNA, 75 bp, Artificial Sequence
  Synthetic
ctattgtgttgggagagcctctatatctaaaggcctttcctcacaatacaaatgttactaacgtctgccctctgg

SEQ ID NO: 161767 - DNA, 75 bp, Artificial Sequence
  Synthetic
gctcatggggaatgatgggggtgcctctcacaccgaggcccgctactcggagtccggacagtttcatgcttttac

SEQ ID NO: 161768 - DNA, 75 bp, Artificial Sequence
  Synthetic
taaaccagtagtgcgcgtgagttctttagggcatccacgatgtagccgctcgcggggttcccctccccagtgatc

SEQ ID NO: 161769 - DNA, 75 bp, Artificial Sequence
  Synthetic
agatgaactcgaaagtctcccgagcccgaccatgcccctgaagcccggtgcccaaagcgccgactgcggtgacag

SEQ ID NO: 161770 - DNA, 75 bp, Artificial Sequence
  Synthetic
ggccaagtttaagcatctgctgcagcactaccgtgaggtcagtatacagtaacacgaatgcccaggtggctaatg

SEQ ID NO: 161771 - DNA, 75 bp, Artificial Sequence
  Synthetic
cctacaacaaatctggcccccgacccgaaaggagattaaccctcgccacgtttgcacgcgggagggcggcgaggg

SEQ ID NO: 161772 - DNA, 75 bp, Artificial Sequence
  Synthetic
agacctgctatgtggctagacgtatggcctacccaagacgttgggggtctcgggtaggccatgattcttccaggc

SEQ ID NO: 161773 - DNA, 75 bp, Artificial Sequence
  Synthetic
cggacatccaggcccaaccgtggtcaaactccatgtccttccaacgcggaggaacctgaacagccttggatagca

SEQ ID NO: 161774 - DNA, 75 bp, Artificial Sequence
  Synthetic
ccgggtttgatgtttctgtggctgccgaagcagatggcgactttgtttagggacagaccctgggccttggctatg

SEQ ID NO: 161775 - DNA, 75 bp, Artificial Sequence
  Synthetic
gggcggcgcgggagcctgcacgccgttggagggtagaatgacagggggcggggacagagaggcggtcgcgccccc

SEQ ID NO: 161776 - DNA, 75 bp, Artificial Sequence
  Synthetic
cgaagcagatggcgactttgtttagggacagaccctgggccttggctatggtcatggccagctttgagctaatgc

SEQ ID NO: 161777 - DNA, 75 bp, Artificial Sequence
  Synthetic
atctcggataggggattcctgtccatgaccacgcaattagagtgccgggcccgggacagcgccacatacacatgg

SEQ ID NO: 161778 - DNA, 75 bp, Artificial Sequence
  Synthetic
gttaagttcggaagtgagcagttgctccaggtccagcgtggggacctgcagatgtcccgaccagtcctttaagaa

SEQ ID NO: 161779 - DNA, 75 bp, Artificial Sequence
  Synthetic
gcctcagagacacacctaaatttagcacgtcccaaaccatgacatcacagaggaggctggtgccttggctttaaa

SEQ ID NO: 161780 - DNA, 75 bp, Artificial Sequence
  Synthetic
tacagcttgttagtattgtgttccaggcagcacacgaagcctgcctcatccttgaccattagcctgggcatgcgt

SEQ ID NO: 161781 - DNA, 75 bp, Artificial Sequence
  Synthetic
ggggagatgttagacaggtaactcactaaacattgcaccttgccggccacctttgctatctttgctgaagatgat

SEQ ID NO: 161782 - DNA, 75 bp, Artificial Sequence
  Synthetic
tcgggtcccaagcaggggatgatggcatccaagaggcgggagccacagtcgagctcgtaggccgcgttgtgcggc

SEQ ID NO: 161783 - DNA, 75 bp, Artificial Sequence
  Synthetic
gtatgctgcatgaaaaaccacatacacgtgatgtaagtttagccagtttattgttacaccaatgccccgaaagtc

SEQ ID NO: 161784 - DNA, 75 bp, Artificial Sequence
  Synthetic
ggacccaaactcgacttctgaagatgtaaaatttacacctgacccataccaggtgccttttgtacaagcttttga

SEQ ID NO: 161785 - DNA, 75 bp, Artificial Sequence
  Synthetic
tcctgctcttggcgctactgttctggctgtatatcgttatgagtaactggactggaggagcgctccttgtcctct

SEQ ID NO: 161786 - DNA, 75 bp, Artificial Sequence
  Synthetic
acacgtgtttctagaatctcggagccaataactacctgcccctctaatctgtatgctgcatgaaaaaccacatac

SEQ ID NO: 161787 - DNA, 75 bp, Artificial Sequence
  Synthetic
agtccaggaggccgtgaaggagaggctcgtctgaggtgaactctatgttgtcgcgaatcagcatgttgttggtaa

SEQ ID NO: 161788 - DNA, 75 bp, Artificial Sequence
  Synthetic
cttgaccattagcctgggcatgcgtgaactgccagcgtcctgaggctgctgctttcctcggatgccaaagaagac

SEQ ID NO: 161789 - DNA, 75 bp, Artificial Sequence
  Synthetic
acctccgtgaaggcagggtccccatgggggagctctgcttttcaacggagctcagccgcaagctctcagcctaca

SEQ ID NO: 161790 - DNA, 75 bp, Artificial Sequence
  Synthetic
caccaactgggtcgtggtttcctgcccctcagcctgctcctgagaatgcttatcaagcttatgcagcacctcagc

SEQ ID NO: 161791 - DNA, 75 bp, Artificial Sequence
  Synthetic
tcccccagggcgtgccccgcttgcctggtcctggagctcatccggggatgctgcatccgctagtccgaccacgcc

SEQ ID NO: 161792 - DNA, 75 bp, Artificial Sequence
  Synthetic
ggagaagcacctcaacctggagacaattctactgttcaaccagcagcagcagtggtgttggcttgccccggggct

SEQ ID NO: 161793 - DNA, 75 bp, Artificial Sequence
  Synthetic
ctccccatcccaggcaacctccagcggcagttcacccagctccatcccagcagtcacctccggatcccacgtacg

SEQ ID NO: 161794 - DNA, 75 bp, Artificial Sequence
  Synthetic
acacacctgaattaaccaataagaagcccccactcctgagcaaaccttaaagtattacacagagaccccaaaaag

SEQ ID NO: 161795 - DNA, 75 bp, Artificial Sequence
  Synthetic
gtgcccaagccacttgacccggcccccgcagtaacccccgaggcaagtcatctgttggaggaccctgatgaggaa

SEQ ID NO: 161796 - DNA, 75 bp, Artificial Sequence
  Synthetic
tccgccacgtattccccgttttcacagagagaatgtcctccgtggctaaaagcgtagatgccgccgtagatgagt

SEQ ID NO: 161797 - DNA, 75 bp, Artificial Sequence
  Synthetic
agcgtagatgccgccgtagatgagtcgggccaggaagctgtagacatactcgggctgctcatgcccgtgggcctc

SEQ ID NO: 161798 - DNA, 75 bp, Artificial Sequence
  Synthetic
cgggctgctcatgcccgtgggcctccacgaagctgtccgcctcgagcgtgtccataaagtccccgaaggtgccgg

SEQ ID NO: 161799 - DNA, 75 bp, Artificial Sequence
  Synthetic
accagtcaggccgtgaaggccctaagggagatggctgacactgttattccccagaaggaggaagcagccatatgt

SEQ ID NO: 161800 - DNA, 75 bp, Artificial Sequence
  Synthetic
accacgatgactccctcccgcaccctcaacaagctaccgacgattctagccatgaatctgactctaactccaacg

SEQ ID NO: 161801 - DNA, 75 bp, Artificial Sequence
  Synthetic
tccataaagtccccgaaggtgccggtatagccacagatggactttttggtcttgcagttgaccgacactgagctg

SEQ ID NO: 161802 - DNA, 75 bp, Artificial Sequence
  Synthetic
ttgtgcgtggccgtcatggagggcatggaggcatagccactgcggcagacatccgcgattaccttcctcatacct

SEQ ID NO: 161803 - DNA, 75 bp, Artificial Sequence
  Synthetic
ggggggtcggggtccgcgggctccgggggctgcgggcggtggatggcggcggacgttccggggatcgggggggtc

SEQ ID NO: 161804 - DNA, 75 bp, Artificial Sequence
  Synthetic
tgaccttgacccgttcttcatcctgctcggttcccaccgggaccatgtcttggtcggcgaactgcgagtagttac

SEQ ID NO: 161805 - DNA, 75 bp, Artificial Sequence
  Synthetic
gtgctcgcggtctctggcccaacggccacctttgccttcgtggaagagctggtggccgacacttatctggcccgg

SEQ ID NO: 161806 - DNA, 75 bp, Artificial Sequence
  Synthetic
ggccaggtgtctcaccatggctctttctaggtggataccacagtccaggcccccaaggctaccgtgctaattacc

SEQ ID NO: 161807 - DNA, 75 bp, Artificial Sequence
  Synthetic
gcgacacggctgtgtagtcgcttcctggcatgaggacatttacagaggcatggtgtctgtcttggcgcagtttcc

SEQ ID NO: 161808 - DNA, 75 bp, Artificial Sequence
  Synthetic
gaaaacgacgctggggagatggctggtcaccgtatacgcggagaccaaccgctacccctgggcggctgcagggca

SEQ ID NO: 161809 - DNA, 75 bp, Artificial Sequence
  Synthetic
gaggtggtcctgacaatggcccacaggaccctgacaacactgatgacaatggcccacaggaccctgacaacactg

SEQ ID NO: 161810 - DNA, 75 bp, Artificial Sequence
  Synthetic
cccctcgtggccatttggacgaactgaccacaacactagagtccatgacagaggatttgaatctatggacaggtc

SEQ ID NO: 161811 - DNA, 75 bp, Artificial Sequence
  Synthetic
caacagtgacaccgagcagagcgagcgggaagaggccagggccgaggccccgcgcctgcgggccccaaagtcgcg

SEQ ID NO: 161812 - DNA, 75 bp, Artificial Sequence
  Synthetic
tggtcggcgaactgcgagtagttaccgaggcgtgcataattcttttggagccaggtgtgggccgtgaggcccgga

SEQ ID NO: 161813 - DNA, 75 bp, Artificial Sequence
  Synthetic
ggaccctgacaacactgatgacaatggcccacaggaccctgacaacactgatgacaatggcccacaggaccctga

SEQ ID NO: 161814 - DNA, 75 bp, Artificial Sequence
  Synthetic
agcattgttcagccgaacgcccaagcgaacctcccacagaaatgtgtgcctgtacctgatgggcgtgttttgtct

SEQ ID NO: 161815 - DNA, 75 bp, Artificial Sequence
  Synthetic
gtgaggaaggtcttgacctcggcgtgggagaggaagagccgggtccagcccacgtactgcgtggggtccattatg

SEQ ID NO: 161816 - DNA, 75 bp, Artificial Sequence
  Synthetic
gctgggtccgctgccccgctccggcggggggtggccggctgcagccgggtccggggttccggccctggagctcgg

SEQ ID NO: 161817 - DNA, 75 bp, Artificial Sequence
  Synthetic
gccaggaacagccccctctgggctgtcaggagtgggtggctaggtgggaggtcgcagtcgaccccgatggtgttc

SEQ ID NO: 161818 - DNA, 75 bp, Artificial Sequence
  Synthetic
ctcattaccatgggccccgacgccaatctcaacagaggccccaacatgtgcagggaaggccccaccaaaggcatg

SEQ ID NO: 161819 - DNA, 75 bp, Artificial Sequence
  Synthetic
cacgtactgcgtggggtccattatggccgccctggggacgacgaagcggtcgacgtaggccaggatgtccggcga

SEQ ID NO: 161820 - DNA, 75 bp, Artificial Sequence
  Synthetic
gattaggatagcatatgctacccagatatagattaggatagcatatgctatcctcatatatattaggatagcata

SEQ ID NO: 161821 - DNA, 75 bp, Artificial Sequence
  Synthetic
ctcagagacggcaggtataggcaaaagacagtgggcgctcctcaggcacgagtttaccaacaggcggtaccacat

SEQ ID NO: 161822 - DNA, 75 bp, Artificial Sequence
  Synthetic
cggaaagcttccaagtagtttcgcagggtctccggtgctgcaggcagggggttgcccgtggcagacatccaatga

SEQ ID NO: 161823 - DNA, 75 bp, Artificial Sequence
  Synthetic
tccctcaccaatcacgacccgcctccccgacaccccgccccgcgccagtctcaactatcgctccttcagtcactc

SEQ ID NO: 161824 - DNA, 75 bp, Artificial Sequence
  Synthetic
cacctccggccgccgcctccctctgtcctccaccactgacacagaggatgatcagctgccacgcccccccggtcc

SEQ ID NO: 161825 - DNA, 75 bp, Artificial Sequence
  Synthetic
ccaccaggaaggtgaggatgttgtcgcactcgcgaatcttgtttacctgggtctcgtggctaaaggaggactgaa

SEQ ID NO: 161826 - DNA, 75 bp, Artificial Sequence
  Synthetic
cccgtggcagacatccaatgaccactaagggcctgcttcaagctcatggagtcttgtgttatgtaatctttgaga

SEQ ID NO: 161827 - DNA, 75 bp, Artificial Sequence
  Synthetic
agaaccatcagctcgcccacacagcgccagcagggcacagaggggatgtagaggcgcgggtctgggatgggactt

SEQ ID NO: 161828 - DNA, 75 bp, Artificial Sequence
  Synthetic
acttacatcgactttatgccccccgtaaaactccacagagtacgcgactgagggggtgcggagaggcgggacccg

SEQ ID NO: 161829 - DNA, 75 bp, Artificial Sequence
  Synthetic
aggctgccaataaggtgcgtgcgaaaacagcatcggagtcatcgaggtcagggatttcatgaaagtcaggcgtca

SEQ ID NO: 161830 - DNA, 75 bp, Artificial Sequence
  Synthetic
cgccccctgacctcccgccctgagctggacgaggtcctggacgagggggcgcggctggatgccctcatgcgccag

SEQ ID NO: 161831 - DNA, 75 bp, Artificial Sequence
  Synthetic
acggaaagcgttccagcttcgtccaccacgatcacattggtggtccatagctgcccctggtgcatgtctctcagg

SEQ ID NO: 161832 - DNA, 75 bp, Artificial Sequence
  Synthetic
cgggtggcggagggccgaatctccgcggcttcttcccggcccccctgctgtttcttctcccgttgcatgatagaa

SEQ ID NO: 161833 - DNA, 75 bp, Artificial Sequence
  Synthetic
cacatgaccacgtaaagccacaagcttgtggaccaacatgttcaggagattgacaggactacactgcttagtgtg

SEQ ID NO: 161834 - DNA, 75 bp, Artificial Sequence
  Synthetic
tttcttctcccgttgcatgatagaatggccatagggtgggtcctgagaggaggcttgtgtgtcctggggctggag

SEQ ID NO: 161835 - DNA, 75 bp, Artificial Sequence
  Synthetic
aggccgggcttaattgccttcaatcccttaagacattgtaggcactctggacatccgcacgaatccacccacaat

SEQ ID NO: 161836 - DNA, 75 bp, Artificial Sequence
  Synthetic
accatgcttactcaatccattatcttggcaccccggcgtcggcacctagcccactcccctctccattcccagccc

SEQ ID NO: 161837 - DNA, 75 bp, Artificial Sequence
  Synthetic
acatccgcacgaatccacccacaatttttggagacccgtcacgatagcccggagcaatgactcgggcgtgtcctt

SEQ ID NO: 161838 - DNA, 75 bp, Artificial Sequence
  Synthetic
ggcggcgtccgtagagcgaccatgactgctgacccgctgcgtcatatttatgtggcggctcttgaacccaaaggc

SEQ ID NO: 161839 - DNA, 75 bp, Artificial Sequence
  Synthetic
cggcctacgaggccctggctgtggccaggtacgggctggtgggctccctctgggaggtgcccgccgtgaactctg

SEQ ID NO: 161840 - DNA, 75 bp, Artificial Sequence
  Synthetic
gtgtgaggtctcacctggaataacacccagacataagttgtgggccgtggttaaggcctgcacggcggctgggat

SEQ ID NO: 161841 - DNA, 75 bp, Artificial Sequence
  Synthetic
cccagacataagttgtgggccgtggttaaggcctgcacggcggctgggattaaatcgtccctggaggattgtcta

SEQ ID NO: 161842 - DNA, 75 bp, Artificial Sequence
  Synthetic
cggagtgtctgggagaggttctgtgcggccacggttgtggctcccgtgaccaggcagtccatcgtgtggtggagg

SEQ ID NO: 161843 - DNA, 75 bp, Artificial Sequence
  Synthetic
ccagatgttgggagggcattccataaagcaaacagggaagaaagtatagctacatcaccacccccgggggtctgg

SEQ ID NO: 161844 - DNA, 75 bp, Artificial Sequence
  Synthetic
gggagaacgtctccatatccgggagttgttggacgcggcgcttagccagggtccctatcctcctgactatacgcc

SEQ ID NO: 161845 - DNA, 75 bp, Artificial Sequence
  Synthetic
atcttgtcctgtgataaaatcgctcataagcttagttaatgccccagccagatgttcaggaaccaaaataaccga

SEQ ID NO: 161846 - DNA, 75 bp, Artificial Sequence
  Synthetic
gcgacggaagaggaggaggaggcggtggtagcggtgaaggaaaagagcgtttcatcctccccccgccactacccg

SEQ ID NO: 161847 - DNA, 75 bp, Artificial Sequence
  Synthetic
ataagcttagttaatgccccagccagatgttcaggaaccaaaataaccgagcctctctgctgcccactcatactt

SEQ ID NO: 161848 - DNA, 75 bp, Artificial Sequence
  Synthetic
gttaattcaggtgtgtgattttagcccgttgggtttcattaaggtgtgtaaccaggtgggtggtacctggaggtc

SEQ ID NO: 161849 - DNA, 75 bp, Artificial Sequence
  Synthetic
ttgttggacgcggcgcttagccagggtccctatcctcctgactatacgcctcacggaggcgtctgaggtcatgtt

SEQ ID NO: 161850 - DNA, 75 bp, Artificial Sequence
  Synthetic
ttcctgtgcaccccacgccggcctcggtccgactttttgagatcctgcagggaaagtacgcctacgtccagggac

SEQ ID NO: 161851 - DNA, 75 bp, Artificial Sequence
  Synthetic
ttatattgcgattgtcccgcccatgccaatggctcataaaagaccagtaatccatgtcagccggcatttttaaag

SEQ ID NO: 161852 - DNA, 75 bp, Artificial Sequence
  Synthetic
cccgaggcccttcagcagctctggcactcattgcgcccgctggagggcccggtcgcgtttcaggactacctgcgc

SEQ ID NO: 161853 - DNA, 75 bp, Artificial Sequence
  Synthetic
ccaatggctcataaaagaccagtaatccatgtcagccggcatttttaaagtagaataccatacaggacacaacac

SEQ ID NO: 161854 - DNA, 75 bp, Artificial Sequence
  Synthetic
ggtatgatggccacattgatggccacagtggtgtgcagcttggctgagacaaagacggcctcgtacctgaccaag

SEQ ID NO: 161855 - DNA, 75 bp, Artificial Sequence
  Synthetic
ccccggagtcttctcgaggcaggtgtttacccatttgtttaaacgagccatctctcattgcacgtacgatgacgt

SEQ ID NO: 161856 - DNA, 75 bp, Artificial Sequence
  Synthetic
cagaacagttttctaagacatgttttgtgtgctttagtaggtctatgtattcagcgcagtcaggcagggtaatgg

SEQ ID NO: 161857 - DNA, 75 bp, Artificial Sequence
  Synthetic
tgtgtcctgttttgcggtgggttatttcccccctcagtgttcgccagcttatttccccagtccccacgtactggg

SEQ ID NO: 161858 - DNA, 75 bp, Artificial Sequence
  Synthetic
gcctgcatccagaagcgatggccgagcgatgactcgtgtgcgagccggtttcgtgagtccaccttcgagtcgtgg

SEQ ID NO: 161859 - DNA, 75 bp, Artificial Sequence
  Synthetic
tgtgtgctttagtaggtctatgtattcagcgcagtcaggcagggtaatggcatccgtgacctcctgatttgcggc

SEQ ID NO: 161860 - DNA, 75 bp, Artificial Sequence
  Synthetic
tgccatcctgggatattatccagctgcagagggccttgatctcgaggtgcagaagctgggagatggtggctatag

SEQ ID NO: 161861 - DNA, 75 bp, Artificial Sequence
  Synthetic
agcgacctggccctcccttcccccgagctgacccgggcccgccgtcctctcgagctcatatacgccaccgtctgg

SEQ ID NO: 161862 - DNA, 75 bp, Artificial Sequence
  Synthetic
acaggtcagggtcgttgctcccctcctctactgcgacgggcactccgagcccttccggtccctggtggagaccat

SEQ ID NO: 161863 - DNA, 75 bp, Artificial Sequence
  Synthetic
ctctcctatgagcgttatgtggactggatctgcgccaccggcatggtgcccgccgttaagaagcccataacccaa

SEQ ID NO: 161864 - DNA, 75 bp, Artificial Sequence
  Synthetic
ttaaagaacccgcgccaggcgcacggttcctcactgggcccggacgccatcaagagctggtgggagaggttgtgc

SEQ ID NO: 161865 - DNA, 75 bp, Artificial Sequence
  Synthetic
gagctccactccaagataaagagcctgagggacaggtgcgtctgtcgggaattggggcatgagaggaccatcagg

SEQ ID NO: 161866 - DNA, 75 bp, Artificial Sequence
  Synthetic
aaacgatggggcaaactgggggaacagcgggggaggtccccccgggctggcccaagtttcgccgtgagctttcat

SEQ ID NO: 161867 - DNA, 75 bp, Artificial Sequence
  Synthetic
agtatcgggacggaattatatgaggcaacgagggaaataatagagtcgctcaactccacgttcatcccccagttt

SEQ ID NO: 161868 - DNA, 75 bp, Artificial Sequence
  Synthetic
tccctctgctcgttaactgagagcatgtctgctggggctcacgggatggggccgggggcagggccaaaaacctag

SEQ ID NO: 161869 - DNA, 75 bp, Artificial Sequence
  Synthetic
gacgaggaacacccgccccaccaccacgggtgataacgtcctgaacgtgactggcggcacacaaagaggaatcaa

SEQ ID NO: 161870 - DNA, 75 bp, Artificial Sequence
  Synthetic
ctactgtggccgccgcatcaggctgcatgtgctcttccccccggccatctttgccggaacggtgaccttcgacag

SEQ ID NO: 161871 - DNA, 75 bp, Artificial Sequence
  Synthetic
ccggaccctcagtggccagcagagcattgcaggcagccagggaccgttttccaggcctacgcagaagacgctatc

SEQ ID NO: 161872 - DNA, 75 bp, Artificial Sequence
  Synthetic
caatggggtgagggcggcgctggttaagctgacgacctcccaaggtctctcaccctgggtacacaggtggggcgg

SEQ ID NO: 161873 - DNA, 75 bp, Artificial Sequence
  Synthetic
gaacacggcccctctcaaggccatcgtgggccacggggggcgagacatgtacaaggacatcctggcccatctgga

SEQ ID NO: 161874 - DNA, 75 bp, Artificial Sequence
  Synthetic
ttcgggaaatttgaaggtgtttaaaggccctgtcgttgggagataaaagtgattatccgaatttcggaaagcttc

SEQ ID NO: 161875 - DNA, 75 bp, Artificial Sequence
  Synthetic
gcagaactcacagcgcaaggaccccaagaaggagctgctgaacctgctggtcaagctctcggagaacaagaccat

SEQ ID NO: 161876 - DNA, 75 bp, Artificial Sequence
  Synthetic
gggtagcatatactacccaaatagagattaggatagcatatgctacccggatatagattaggatagcatatgcta

SEQ ID NO: 161877 - DNA, 75 bp, Artificial Sequence
  Synthetic
tggccagcccggggagacggctgcgcagggcctaaagaaaaaggtctccaacacggtggtcaagtgtctgactga

SEQ ID NO: 161878 - DNA, 75 bp, Artificial Sequence
  Synthetic
ctaaaaaggatggcttggaagactttctgaggctaactcctgaaatcaaaaagcagctgggctctctggtctctg

SEQ ID NO: 161879 - DNA, 75 bp, Artificial Sequence
  Synthetic
cagggcctaaagaaaaaggtctccaacacggtggtcaagtgtctgactgatcagataaacgagcaatttgaccag

SEQ ID NO: 161880 - DNA, 75 bp, Artificial Sequence
  Synthetic
aagcagctgggctctctggtctctgactactgcaacgtcctcaacaaggaatttacagccgggagtgtggagatt

SEQ ID NO: 161881 - DNA, 75 bp, Artificial Sequence
  Synthetic
cccggatatagattaggatagcatatgctacccggatatagattaggatagcatatgctatcctaatctatatgc

SEQ ID NO: 161882 - DNA, 75 bp, Artificial Sequence
  Synthetic
ggtgacacagtgcccatgcattataatttaaccaaacagtggtcgtgagttttaggccggccatgggggcttaca

SEQ ID NO: 161883 - DNA, 75 bp, Artificial Sequence
  Synthetic
tgccacccccggcgaccgccacctcccccggggccagcagccctgcgcgccagacggccgccgcactcagcgagg

SEQ ID NO: 161884 - DNA, 75 bp, Artificial Sequence
  Synthetic
aggcatttataaatgaggccaaggcccacgggcgagaatggggcgggctaatggccacgctcaacatctgcaatt

SEQ ID NO: 161885 - DNA, 75 bp, Artificial Sequence
  Synthetic
ctgggtcccggcggcaacaacccagcggcgtcagcccccgccgcagttgcggcagaagccgcgtctgtagatata

SEQ ID NO: 161886 - DNA, 75 bp, Artificial Sequence
  Synthetic
tgctacccggatatagattaggatagcatatgctacccggatatagattagggtagcatatgctatcctaatcta

SEQ ID NO: 161887 - DNA, 75 bp, Artificial Sequence
  Synthetic
acggtgaaatatctctaaaaatactgagttaaaatccaggtccaaatgttcggtgtgtgttataaatctgttcca

SEQ ID NO: 161888 - DNA, 75 bp, Artificial Sequence
  Synthetic
acgcagacaatacttttgacaccgcgccatgggtgccctctggtctctttgccgacgacgagtcaactccatagg

SEQ ID NO: 161889 - DNA, 75 bp, Artificial Sequence
  Synthetic
ggcaacgacgcatgttccatcgcgtgccctatagtgatgcgctacgtgttagaccacctgatagtggtcactgac

SEQ ID NO: 161890 - DNA, 75 bp, Artificial Sequence
  Synthetic
tctgtggccggggctggataaggggggtgattcctagaggcgatgagactggcgtgcgctaaaagtgtcatggcc

SEQ ID NO: 161891 - DNA, 75 bp, Artificial Sequence
  Synthetic
cccccacccgcctcgacccgggcggctacaccccggccgtgattcattaggataaacagggagagaggagtgaat

SEQ ID NO: 161892 - DNA, 75 bp, Artificial Sequence
  Synthetic
agattcttcatccaggcccccagcaaccgggtgatgattcctgccaccataggcaccgctatgtacaagctccta

SEQ ID NO: 161893 - DNA, 75 bp, Artificial Sequence
  Synthetic
actgaactttgggaaagcgagctgtttaacaccttcaagttaacacccgtggttgataatcaggggcagcgtctc

SEQ ID NO: 161894 - DNA, 75 bp, Artificial Sequence
  Synthetic
acaccatgtggggcatggggaggctggtcctgactgattatgggactgcttccctccacgaccgcaacaagatgt

SEQ ID NO: 161895 - DNA, 75 bp, Artificial Sequence
  Synthetic
ggtgctattttcactatggaattaaattactgacattagacagtggacaccgggctatatgtggggatgtctgtg

SEQ ID NO: 161896 - DNA, 75 bp, Artificial Sequence
  Synthetic
agagagattaggatagcatatgctatccgaatatatatttgggtagcatatgctatcctaatctatatctgggta

SEQ ID NO: 161897 - DNA, 75 bp, Artificial Sequence
  Synthetic
ccgcgcggccatcatggcctccggcaagcaggtagtggaacacctgaacaggatggagaaggaaggcctcctaag

SEQ ID NO: 161898 - DNA, 75 bp, Artificial Sequence
  Synthetic
ttaacaccttcaagttaacacccgtggttgataatcaggggcagcgtctctacgtcagatactcgtcagacacga

SEQ ID NO: 161899 - DNA, 75 bp, Artificial Sequence
  Synthetic
ggtcacaatgaaagcatcctaaacagtttcgtttctcaatacatccccccttcgcgggaaatgactaaggatctg

SEQ ID NO: 161900 - DNA, 75 bp, Artificial Sequence
  Synthetic
cgacgagctctaccggagcagtcgcctggccatctacatcgaggacctcggtcgaaaatactgccccgcgagcgc

SEQ ID NO: 161901 - DNA, 75 bp, Artificial Sequence
  Synthetic
aggagatgttccagactatggtctcgtccaagacaggccatctgacggacgatgttaaggatgtcagggctctga

SEQ ID NO: 161902 - DNA, 75 bp, Artificial Sequence
  Synthetic
ctggccatctacatcgaggacctcggtcgaaaatactgccccgcgagcgcgaccgggggagatcatggcatccgg

SEQ ID NO: 161903 - DNA, 75 bp, Artificial Sequence
  Synthetic
cggagcctgaccatgcaaaaagtaagcctgcgcgtgaccccccgcctggtgctggaagttaaccgccataacgcc

SEQ ID NO: 161904 - DNA, 75 bp, Artificial Sequence
  Synthetic
atctgcgtggccaccaacgtccctgagttctacaatgccaggggggaccttaacatccgagacctccgggcccac

SEQ ID NO: 161905 - DNA, 75 bp, Artificial Sequence
  Synthetic
tccagccaacgcggaagaaggcatagcctacccaccactcgtccacacctacgagtccctctctccagccagcac

SEQ ID NO: 161906 - DNA, 75 bp, Artificial Sequence
  Synthetic
taacatccgagacctccgggcccacgtcaaggcccggatgatctcgtcccagttttgcggctacgtcctcgtgag

SEQ ID NO: 161907 - DNA, 75 bp, Artificial Sequence
  Synthetic
ttgtgttgggttagtatgggctgggtattcactagtgaaggcaactaacacagttagacgtgctagttgtgccca

SEQ ID NO: 161908 - DNA, 75 bp, Artificial Sequence
  Synthetic
acttggcggctgccagggatttccggtagggccacgaactctgcttggccgaggcatagcgcagcagcttgtcct

SEQ ID NO: 161909 - DNA, 75 bp, Artificial Sequence
  Synthetic
agcccggaagagaggctcctagacgagctcaataacgtaattgtgtcatttctgtgtgactctgggtctctggaa

SEQ ID NO: 161910 - DNA, 75 bp, Artificial Sequence
  Synthetic
gaccacctcaacatattcccccacgtgttctccgagaggatgatcctgtacaaacccaacaatgtgaaccttatg

SEQ ID NO: 161911 - DNA, 75 bp, Artificial Sequence
  Synthetic
cagagaagacctccagatattcggctactgtgtgtgtaactgactcggccttaaggcggtggagcaggcgcccgg

SEQ ID NO: 161912 - DNA, 75 bp, Artificial Sequence
  Synthetic
ttggcagcagcacttgtgcttttgttgatttttacccgtgtatcagagtgggggatgctagccaatttagcttcc

SEQ ID NO: 161913 - DNA, 75 bp, Artificial Sequence
  Synthetic
tagcatgacagccaatccaacacgaggcaagtttcaagagttaaaagcaactactgtttattttccaaaatgagc

SEQ ID NO: 161914 - DNA, 75 bp, Artificial Sequence
  Synthetic
gttggccttgacctttaactcatcaatcaatttggagaggagctcatgctcgacatgactggtcgttgccatgct

SEQ ID NO: 161915 - DNA, 75 bp, Artificial Sequence
  Synthetic
tgttctccgagaggatgatcctgtacaaacccaacaatgtgaaccttatggagatgtgcgccctgctctcgatga

SEQ ID NO: 161916 - DNA, 75 bp, Artificial Sequence
  Synthetic
cgcctgaccctcttgcactccaagtgcaacaatctggactctctgtttctgtacaatggggccaggacgctgctg

SEQ ID NO: 161917 - DNA, 75 bp, Artificial Sequence
  Synthetic
cgtcgacgcggtattcactcctctctccctgtttatcctaatgaagccctgccaggacatcagcctcggggtctg

SEQ ID NO: 161918 - DNA, 75 bp, Artificial Sequence
  Synthetic
gaagcctggtgggtgatccttcctcggtagggagcgcttagggctgttgagctcaagagccccacctgggtaaaa

SEQ ID NO: 161919 - DNA, 75 bp, Artificial Sequence
  Synthetic
gtacaatggggccaggacgctgctgtccaccctggtcaagtaccacgacctggaggagggggctgccacccccgg

SEQ ID NO: 161920 - DNA, 75 bp, Artificial Sequence
  Synthetic
tttaagctgcacaaggagctgaagcgcgccccatccgaagcccgggacctcatgcagagcctctttctgacctcg

SEQ ID NO: 161921 - DNA, 75 bp, Artificial Sequence
  Synthetic
ctcaagttcgcacttcctatacagtgttaaagccttgtatcggaagtttgggcttcgtcccagtgtactcgataa

SEQ ID NO: 161922 - DNA, 75 bp, Artificial Sequence
  Synthetic
cacccaaggattactgcgcggatctaaacaaggaggaagatgccaactcgggcttcacatttaacctgttttatc

SEQ ID NO: 161923 - DNA, 75 bp, Artificial Sequence
  Synthetic
tgtcgactgctgcgaaggtttgggccgtcttccagtaggtgtcgggggtccccaatcacgaggttaggcaggtgc

SEQ ID NO: 161924 - DNA, 75 bp, Artificial Sequence
  Synthetic
ccagtgccagaccgtcctccagaccttgagacgcaagtgcctcgggagtgacacggtctcaaaaataattcccta

SEQ ID NO: 161925 - DNA, 75 bp, Artificial Sequence
  Synthetic
ccgggcttcagcatcaatgtcaaggctctgcacaggaggcccgaccccaactgcgggctcctacgcgctacctcc

SEQ ID NO: 161926 - DNA, 75 bp, Artificial Sequence
  Synthetic
taggaatggtgtagccggggtggagggccgatatcacatcaagcagaaaggccataatctctcgaaagtaggcgg

SEQ ID NO: 161927 - DNA, 75 bp, Artificial Sequence
  Synthetic
gccataatctctcgaaagtaggcggtggggctgagaccatgctcagtggccgtctggcagggggccgggcgcgct

SEQ ID NO: 161928 - DNA, 75 bp, Artificial Sequence
  Synthetic
aggtgatcacagcgcgtcatgttctccggcagctttacatagagggtctccgtcatgcacaccatgagctcgtga

SEQ ID NO: 161929 - DNA, 75 bp, Artificial Sequence
  Synthetic
ggtcaggtcgcggaccagggtcaacaggtggtcgtgggatggcggggccttgtctgcctcgggtctcgccgctag

SEQ ID NO: 161930 - DNA, 75 bp, Artificial Sequence
  Synthetic
tcgtgccaaaccaaaaagggccccgagtgctccctacatccacccacgtaaagatccccctgaaagatggccatc

SEQ ID NO: 161931 - DNA, 75 bp, Artificial Sequence
  Synthetic
tcccggtcgagccggctggcatcctccgagtctttcacgccttgcaggaaagcctaggagatacagcaacagaaa

SEQ ID NO: 161932 - DNA, 75 bp, Artificial Sequence
  Synthetic
ccgagtctttcacgccttgcaggaaagcctaggagatacagcaacagaaagctattagccggtggttcccccacc

SEQ ID NO: 161933 - DNA, 75 bp, Artificial Sequence
  Synthetic
agcctaggagatacagcaacagaaagctattagccggtggttcccccaccatcattcttcctgttaacgggaaga

SEQ ID NO: 161934 - DNA, 75 bp, Artificial Sequence
  Synthetic
tctcacctgtgctagtggctcctctgaaggatgggcggaggttggtgccacaaagcccaggatgaactcgtctgc

SEQ ID NO: 161935 - DNA, 75 bp, Artificial Sequence
  Synthetic
gatgtagccgctcgcggggttcccctccccagtgatcatctcggataggggattcctgtccatgaccacgcaatt

SEQ ID NO: 161936 - DNA, 75 bp, Artificial Sequence
  Synthetic
ataagcccaggtcagtcctaggtcagcggccgcgtgtaggagaacccgggtgacggcggtgtagaggcccccgag

SEQ ID NO: 161937 - DNA, 75 bp, Artificial Sequence
  Synthetic
gggggtcgcagaacaggtgcttgtggaagtcttgcggggtgcacatctgcagccaggcccttagcctggggcatg

SEQ ID NO: 161938 - DNA, 75 bp, Artificial Sequence
  Synthetic
tgacggcggtgtagaggcccccgagtgcccgtcgcgtgtctgaggtgccatagcggtgaagggcccgcagccagg

SEQ ID NO: 161939 - DNA, 75 bp, Artificial Sequence
  Synthetic
gacctataacctcatctttgttccaggccagcgcaatttccccatcaaacacctcaaaacacagacccatgccca

SEQ ID NO: 161940 - DNA, 75 bp, Artificial Sequence
  Synthetic
gccatcaggcgttcccacgggggcgcccctggcagagaggtggcagcgggccaattcgtagagccaccaagtggc

SEQ ID NO: 161941 - DNA, 75 bp, Artificial Sequence
  Synthetic
caggtgctagaccctggagttgaaccagtaccactcggttacaaagtcatggtctagtagttgtgaccctgcaaa

SEQ ID NO: 161942 - DNA, 75 bp, Artificial Sequence
  Synthetic
tccgcgcgcccgaccaccgtcgtctcgtcctccccccctccctcgccgccttcccgcgtgcaaacgtggcgaggg

SEQ ID NO: 161943 - DNA, 75 bp, Artificial Sequence
  Synthetic
gctacgtggggatgagcagccagggactttggttgacaagcagacaggcggcgcattggaaccccagaggagtgt

SEQ ID NO: 161944 - DNA, 75 bp, Artificial Sequence
  Synthetic
gcctgcctcatccttgaccattagcctgggcatgcgtgctacgcctccaccaccgagaactacacgcttctgggc

SEQ ID NO: 161945 - DNA, 75 bp, Artificial Sequence
  Synthetic
tcacggccgtggccctgctcctgatgtttctgaggtggacctgacgttgccggcccttggggagcgggagttctc

SEQ ID NO: 161946 - DNA, 75 bp, Artificial Sequence
  Synthetic
tgtggcgcccggtgccagaaggccggcctcgcccgtcccacataatggatgggcaggaagggaaagcccgggaca

SEQ ID NO: 161947 - DNA, 75 bp, Artificial Sequence
  Synthetic
taatatcagaggggtcgcaaaagcgggcccaggccatgcacatgtcctcctccgggtagacggtggcctgagtcc

SEQ ID NO: 161948 - DNA, 75 bp, Artificial Sequence
  Synthetic
agtttaccaacaggcggtaccacatccactgaatgggattcccacagggggtgtcggaggccttcttctggaggg

SEQ ID NO: 161949 - DNA, 75 bp, Artificial Sequence
  Synthetic
ggcagagttcggggtccaggaggtagaagatgggcttggtgcctctgtggttggcgtagcaggaggcatagatac

SEQ ID NO: 161950 - DNA, 75 bp, Artificial Sequence
  Synthetic
cttagcagcaacgcacaccaggctgactgccttagcagtgtggccctttattgtggcatcctaaggagggattct

SEQ ID NO: 161951 - DNA, 75 bp, Artificial Sequence
  Synthetic
gggctgagttgtaggaaatctagccataagtcggggagaagcagattttctcctttcacaccaatctcctgtttc

SEQ ID NO: 161952 - DNA, 75 bp, Artificial Sequence
  Synthetic
ctcttccacacgtgctcatccagccagaggtctagcccccgcgatgccatgcgtatctgtttaagttggcaccaa

SEQ ID NO: 161953 - DNA, 75 bp, Artificial Sequence
  Synthetic
ttggcggcgttcatggcctcgccctgcaggtcgcgccaaaagtgggcgttgcaggcctccttcagaaggatgaag

SEQ ID NO: 161954 - DNA, 75 bp, Artificial Sequence
  Synthetic
agccaggactcgaatcccccagccggctcaagaattttcaggctgacgcggtgccgtcgggcgtccccaccacgg

SEQ ID NO: 161955 - DNA, 75 bp, Artificial Sequence
  Synthetic
gaggggtcgtcgggagtctcggtggaataggtgaaaacatccccacgcggtgtcctgatgtatacgtccaactgt

SEQ ID NO: 161956 - DNA, 75 bp, Artificial Sequence
  Synthetic
cggagctgcttcgcttcaggatggagataaagaaggagaccacgttgagtccgtttgcgcagcggctgatgacca

SEQ ID NO: 161957 - DNA, 75 bp, Artificial Sequence
  Synthetic
aataggtgaaaacatccccacgcggtgtcctgatgtatacgtccaactgtccgggagactcagagtgcctctgag

SEQ ID NO: 161958 - DNA, 75 bp, Artificial Sequence
  Synthetic
atttaaggaggccagactaaagccgtcgcatgtctgattgctcaccaggtaaatgtcgctaatgttttccaacgc

SEQ ID NO: 161959 - DNA, 75 bp, Artificial Sequence
  Synthetic
catcccccgagcagctttggcagaccacctgtgctggaaagagaggctggaagatgaggccctgctcatcctcca

SEQ ID NO: 161960 - DNA, 75 bp, Artificial Sequence
  Synthetic
tggagccgagagggatgggcccgcttgtgcgcttatgtgttacacggtgccaataaccggcccggtgcggctgcc

SEQ ID NO: 161961 - DNA, 75 bp, Artificial Sequence
  Synthetic
aattgccccatgttgggaggacgaaaatggtgacaagacaggtggccagaaatacaccaacagcacgcatgatgt

SEQ ID NO: 161962 - DNA, 75 bp, Artificial Sequence
  Synthetic
aatggtgacaagacaggtggccagaaatacaccaacagcacgcatgatgtctactggggatttattctttagtgc

SEQ ID NO: 161963 - DNA, 75 bp, Artificial Sequence
  Synthetic
ccctggcggcggacaagagtctgcggtctcgggttctaaatgaaaggtcaaataggtccttctcggcggcatcgg

SEQ ID NO: 161964 - DNA, 75 bp, Artificial Sequence
  Synthetic
aatacaccaacagcacgcatgatgtctactggggatttattctttagtgcgggggaatacacggcttttaatacg

SEQ ID NO: 161965 - DNA, 75 bp, Artificial Sequence
  Synthetic
cgagcatagcaatgagccccccgctgcgcctgagctcccgctcccatcgcaaaaagttgagttcggtagtcgagg

SEQ ID NO: 161966 - DNA, 75 bp, Artificial Sequence
  Synthetic
catctccatcacctccttcatctccgtcatctccgtcatcaccctccgcggcagccccttccaccataggtggaa

SEQ ID NO: 161967 - DNA, 75 bp, Artificial Sequence
  Synthetic
tgacggtacttatagcacacttccaatcccccgggcacacaccacccacctggtccctcccctgggcccttgctc

SEQ ID NO: 161968 - DNA, 75 bp, Artificial Sequence
  Synthetic
aggccggagccgcagaggccggagacggcggcggggagttggtctttgcaggactatacctggcggcagggaatg

SEQ ID NO: 161969 - DNA, 75 bp, Artificial Sequence
  Synthetic
gcctgcaccacgatcagagtctcaacgtcctcccttttgatgggcacgatgcccacgacccaaatcgcccaccac

SEQ ID NO: 161970 - DNA, 75 bp, Artificial Sequence
  Synthetic
tcgggggggccggggggccctgcctgagccgggatgttttcgtggcgatcgtaagccgcaatgttctctcgtgtc

SEQ ID NO: 161971 - DNA, 75 bp, Artificial Sequence
  Synthetic
gaggagccgagggcgccagaggcgctctcgtccacgttcatgttaaacatgacctcagacgcctccgtgaggcgt

SEQ ID NO: 161972 - DNA, 75 bp, Artificial Sequence
  Synthetic
ttctgttcctcccgcggcaccgacagagccgcgctggccttacactccatcacccccagatcggcggccttctca

SEQ ID NO: 161973 - DNA, 75 bp, Artificial Sequence
  Synthetic
cctgacgctctccgcgggtgtttccatcattgtttgagatctgaggaggactggaccctttaaaacatccggtca

SEQ ID NO: 161974 - DNA, 75 bp, Artificial Sequence
  Synthetic
atagtcaggaggatagggaccctggctaagcgccgcgtcctacaactcccggatatggagacgttctcccccgag

SEQ ID NO: 161975 - DNA, 75 bp, Artificial Sequence
  Synthetic
gtttgtaaaaagaccatgaaataacagacaatggactcccttagtgggccaggttgtgggccgggtccaggggcc

SEQ ID NO: 161976 - DNA, 75 bp, Artificial Sequence
  Synthetic
gatgtagaggcgcgggtctgggatgggacttacgccccgaaagcggcccagcagatccagggcccgttccaggct

SEQ ID NO: 161977 - DNA, 75 bp, Artificial Sequence
  Synthetic
aacgcttgttgtgtactttgtgatgtttgtcatgtcggcggtggtccccatcaccgccatgttccccaacctggg

SEQ ID NO: 161978 - DNA, 75 bp, Artificial Sequence
  Synthetic
accacacgatggactgcctggtctcgggagccacaaccgtggccgcacagaacctctcccagacactccgagcct

SEQ ID NO: 161979 - DNA, 75 bp, Artificial Sequence
  Synthetic
tcaccgccatgttccccaacctggggtacccctgctactttaacgcactggttgattacggggcacttaacctga

SEQ ID NO: 161980 - DNA, 75 bp, Artificial Sequence
  Synthetic
tcattaaaatctctatgtcatttattaggcacaaacttacatcgactttatgccccccgtaaaactccacagagt

SEQ ID NO: 161981 - DNA, 75 bp, Artificial Sequence
  Synthetic
ccagttatccaccctcagccccctacaagcccggccagtcgacgggaggcatagctcccacaccatcagcggcgt

SEQ ID NO: 161982 - DNA, 75 bp, Artificial Sequence
  Synthetic
ccaattacaacctggcccaccacctgacccccacgctctatctggagccgccggagatgtttgtctacatcacac

SEQ ID NO: 161983 - DNA, 75 bp, Artificial Sequence
  Synthetic
cgggttggaacctccttgaccacgatgctttccaaaccaccctccttttttgcgcctgcctccatcaccctgacc

SEQ ID NO: 161984 - DNA, 75 bp, Artificial Sequence
  Synthetic
tgcgcctgcctccatcaccctgaccccggggtccagtgcttgggccttctcctgggtcatctgtggggccctgct

SEQ ID NO: 161985 - DNA, 75 bp, Artificial Sequence
  Synthetic
accagagcagaggcaggcaggagaatttatgcccagaaacctgagcaagtagccaccctgactcaaaggtcatct

SEQ ID NO: 161986 - DNA, 75 bp, Artificial Sequence
  Synthetic
aagctgtgtagcactcggtagatgttggtggtcagcaggtcacgcacggtcagcttcatggtcgtggaccacgac

SEQ ID NO: 161987 - DNA, 75 bp, Artificial Sequence
  Synthetic
tcattggggagattattctggttcagctcttgaaatttaggaagcaggggactgtctggaaaatccgcctccagc

SEQ ID NO: 161988 - DNA, 75 bp, Artificial Sequence
  Synthetic
gggagccacaaccgtggccgcacagaacctctcccagacactccgagcctactgcccaaccgtctatagcgcctt

SEQ ID NO: 161989 - DNA, 75 bp, Artificial Sequence
  Synthetic
ggcctgggtctcggcagtgggctccccgaccgtgctgtttttggccatcctcaagctctggtccatacaggtctt

SEQ ID NO: 161990 - DNA, 75 bp, Artificial Sequence
  Synthetic
ctacagggtggaaaaatggccttctacctggagggggcctgcgcggtggagacccggatgatgatgactgactac

SEQ ID NO: 161991 - DNA, 75 bp, Artificial Sequence
  Synthetic
tcgaaggtggactcacgaaaccggctcgcacacgagtcatcgctcggccatcgcttctggatgcaggcctcgaac

SEQ ID NO: 161992 - DNA, 75 bp, Artificial Sequence
  Synthetic
catccaggtcctttcctacaagcacgtctttctctcggcctttgtgtactttttgcactttctggcctcagttct

SEQ ID NO: 161993 - DNA, 75 bp, Artificial Sequence
  Synthetic
ttgttccagtcatgtagcacgtcatcgtacgtgcaatgagagatggctcgtttaaacaaatgggtaaacacctgc

SEQ ID NO: 161994 - DNA, 75 bp, Artificial Sequence
  Synthetic
aaaagaatgacagtgaggttgtgacagaaggacagctttattcagtttacagagtgccctcggaggctacgatat

SEQ ID NO: 161995 - DNA, 75 bp, Artificial Sequence
  Synthetic
gcgggagtggaggctcggccctccgcatcctaggcacggcctcgtgcaaccaggcccactgcaagtttggccgcc

SEQ ID NO: 161996 - DNA, 75 bp, Artificial Sequence
  Synthetic
cgtacgtgcaatgagagatggctcgtttaaacaaatgggtaaacacctgcctcgagaagactccggggttacgga

SEQ ID NO: 161997 - DNA, 75 bp, Artificial Sequence
  Synthetic
actgtctggaaaatccgcctccagcctcccctggagggtgggcttgggcagccggcgtgccataacgcgtctgat

SEQ ID NO: 161998 - DNA, 75 bp, Artificial Sequence
  Synthetic
tcatcagcgccgtccacggccgtagcccagtccgcgaccccctctgtttcttcatctattagcagcctccgggcc

SEQ ID NO: 161999 - DNA, 75 bp, Artificial Sequence
  Synthetic
ttcctggccctgggcaacagcttttactttatggtgggggacatggtgctgggagccgtgaacctcttcctcgtc

SEQ ID NO: 162000 - DNA, 75 bp, Artificial Sequence
  Synthetic
cggtgggcgcgtgcacatataccgctcggcggagatctttggcctcgtcctagctgacgcactggatgccggcaa

SEQ ID NO: 162001 - DNA, 75 bp, Artificial Sequence
  Synthetic
ggcatgttcatcgcctccatcatcctgatcctgcccttggtcaggtacgaggccgtctttgtctccgccaagctg

SEQ ID NO: 162002 - DNA, 75 bp, Artificial Sequence
  Synthetic
tttacggaggtgaccatcgagtaccttccgaggagcgacgagtatgtggcctactactgtggccgccgcatcagg

SEQ ID NO: 162003 - DNA, 75 bp, Artificial Sequence
  Synthetic
ccgaggtgcgcctatcccagtaccggcatgcgggtccccaaacatacaccgtgcaaaaagaagcacccccatccg

SEQ ID NO: 162004 - DNA, 75 bp, Artificial Sequence
  Synthetic
gattgaccacagtctggaccaggccctggacttgttcaggctcccacttgtcccgctggtcctgtgtgtcttgtc

SEQ ID NO: 162005 - DNA, 75 bp, Artificial Sequence
  Synthetic
ctgatggtcttgttctccgagagcttgaccagcaggttcagcagctccttcttggggtccttgcgctgcgagttc

SEQ ID NO: 162006 - DNA, 75 bp, Artificial Sequence
  Synthetic
tccagtgcggtgttgctggagtggctgggaatggcaggcgagggtgtctctggccttgccggactctcccaagta

SEQ ID NO: 162007 - DNA, 75 bp, Artificial Sequence
  Synthetic
aaaatgtaaggatagcatgtattacccgccatccggtagcgcacgctatcccgcgccttttgaagcactttcgtt

SEQ ID NO: 162008 - DNA, 75 bp, Artificial Sequence
  Synthetic
ctgactatgtccctgtctcggagacggtggaactggagctagagtcagagccgaggcctaggccctcgcgcacgc

SEQ ID NO: 162009 - DNA, 75 bp, Artificial Sequence
  Synthetic
ccgaggcctaggccctcgcgcacgccatcacccgggcgcaaccgccgccgctcttctacgtcctcatcttcctcc

SEQ ID NO: 162010 - DNA, 75 bp, Artificial Sequence
  Synthetic
catcacccgggcgcaaccgccgccgctcttctacgtcctcatcttcctccaggtcaaccaggagacagaggcccg

SEQ ID NO: 162011 - DNA, 75 bp, Artificial Sequence
  Synthetic
ataaaaacttaaaacactgaggttactttcccgtcattctttcgggggaacgaggggaggcgggaattgggttaa

SEQ ID NO: 162012 - DNA, 75 bp, Artificial Sequence
  Synthetic
accctgttagggtccgccctgtcgtgagtcacggcggcgattccggtgcctgatgcagatgtgttgttggtatag

SEQ ID NO: 162013 - DNA, 75 bp, Artificial Sequence
  Synthetic
cccccgcggccccccagcccccccgcacagagcggcgctacggcgggcgggcggcggggggtcggggtccgcggg

SEQ ID NO: 162014 - DNA, 75 bp, Artificial Sequence
  Synthetic
atgctacccagatatagatttgggtagcatatgctacccagatatagatttgggtagcatatgctacccagatat

SEQ ID NO: 162015 - DNA, 75 bp, Artificial Sequence
  Synthetic
aggatagcatatgctacccagatatagattaggatagtatatgctacccaaatatagatttggatagcatatgct

SEQ ID NO: 162016 - DNA, 75 bp, Artificial Sequence
  Synthetic
cgcaaagcgtggcctcacccgcgccatctagcgaccagacaacattactgtggaacactccctcagtggtcaccc

SEQ ID NO: 162017 - DNA, 75 bp, Artificial Sequence
  Synthetic
agcctcacccttagtcaggctagccgagtcctgtctcgcttcgtgagccagcttcgccgcaagctggagcgttcc

SEQ ID NO: 162018 - DNA, 75 bp, Artificial Sequence
  Synthetic
acccaccgcctcatcgcagacctcgagagactcaagtttttgtatctgtaattgtttattaataaagtgcataca

SEQ ID NO: 162019 - DNA, 75 bp, Artificial Sequence
  Synthetic
tttatttggcaaaaacagcaattcatcattttcagagtcctcatcatattcgagcccctcgttggtttccccgca

SEQ ID NO: 162020 - DNA, 75 bp, Artificial Sequence
  Synthetic
ctggtccacaaccaaagcacggcccgcgcccgagcctgcatgctgctcctcgcacgccggtgcttcgcccccgag

SEQ ID NO: 162021 - DNA, 75 bp, Artificial Sequence
  Synthetic
acacatcctggatgccctccacgacgctctttagcgtctggaggtccgtggagtagtggcggggggggggtgaaa

SEQ ID NO: 162022 - DNA, 75 bp, Artificial Sequence
  Synthetic
ttcgggggcgactgccgccgcctccgccgccgcagccgtcgataccgggtcaggtggcgggggacaaccccacga

SEQ ID NO: 162023 - DNA, 75 bp, Artificial Sequence
  Synthetic
taaccctcgccacgtttgcacgcgggagggcggcgagggagggggggaggacgagacgacggtggttgggcgcgc

SEQ ID NO: 162024 - DNA, 75 bp, Artificial Sequence
  Synthetic
ctggccgcaccccgagttcttgggcctggtccacaaccaaagcacggcccgcgcccgagcctgcatgctgctcct

SEQ ID NO: 162025 - DNA, 75 bp, Artificial Sequence
  Synthetic
tcattttcagagtcctcatcatattcgagcccctcgttggtttccccgcaggccctcccttcttcggccgctatt

SEQ ID NO: 162026 - DNA, 75 bp, Artificial Sequence
  Synthetic
ccccccgggctgatggtgcttgccggatgccatgatctcccccggtcgcgcttgcggggcagtattttcgaccga

SEQ ID NO: 162027 - DNA, 75 bp, Artificial Sequence
  Synthetic
tacgcccgccgcgacggctgtgggtgtgggggcggtggcggacccttgggacgccgtaacccctctgcgcatctt

SEQ ID NO: 162028 - DNA, 75 bp, Artificial Sequence
  Synthetic
cttgcggggcagtattttcgaccgaggtcctcgatgtagatggccaggcgactgctccggtagagctcgtcgatg

SEQ ID NO: 162029 - DNA, 75 bp, Artificial Sequence
  Synthetic
aggaccacgggtgtcaccagcaccgccacgggaatctccaccgaggcgtccagaagcaggtctgagccgagcgtg

SEQ ID NO: 162030 - DNA, 75 bp, Artificial Sequence
  Synthetic
gttttcgaaagaaggccgtcacaatgttcacccggggtgagcagtctctcccgggcttgccacccccactgtggc

SEQ ID NO: 162031 - DNA, 75 bp, Artificial Sequence
  Synthetic
tgtctgacgagtatctgacgtagagacgctgcccctgattatcaaccacgggtgttaacttgaaggtgttaaaca

SEQ ID NO: 162032 - DNA, 75 bp, Artificial Sequence
  Synthetic
ggtgttaacttgaaggtgttaaacagctcgctttcccaaagttcagtcagatccttagtcatttcccgcgaaggg

SEQ ID NO: 162033 - DNA, 75 bp, Artificial Sequence
  Synthetic
ggacgtagtctccaacaattttgtattggaggagcacctggtagaagtagttgtgccgtggattgatgaagatgt

SEQ ID NO: 162034 - DNA, 75 bp, Artificial Sequence
  Synthetic
ggtccctggtggagaccatctcgctgaattttctgcaggacctggacggctactccgagtctttcgagccggaga

SEQ ID NO: 162035 - DNA, 75 bp, Artificial Sequence
  Synthetic
ttgtgccgtggattgatgaagatgttgactgggacccggtctttaataccaatgcgccccgcattttcgcttggg

SEQ ID NO: 162036 - DNA, 75 bp, Artificial Sequence
  Synthetic
gaattttctgcaggacctggacggctactccgagtctttcgagccggagatgtccatctttgcacgccaggccgt

SEQ ID NO: 162037 - DNA, 75 bp, Artificial Sequence
  Synthetic
caccctggcacccaggctggcggacggggagttgaacagcttttcgattgcggaggcggtgctgcccgtcagtat

SEQ ID NO: 162038 - DNA, 75 bp, Artificial Sequence
  Synthetic
gtctgccaccaggtcatgaccggggcccagtttgcgcttacggacatctttaagattccaggcctcatcctgcgt

SEQ ID NO: 162039 - DNA, 75 bp, Artificial Sequence
  Synthetic
gtccgcggggccgccgccaccgccgccgtccactgccttctcccctgctcgccggggagtagggggggcttacag

SEQ ID NO: 162040 - DNA, 75 bp, Artificial Sequence
  Synthetic
gtgtacagcgcctcgtgcatgcagcggctgaggtccgagttgtaaaactggcggagctggggcacgccctctggg

SEQ ID NO: 162041 - DNA, 75 bp, Artificial Sequence
  Synthetic
ccgtccactgccttctcccctgctcgccggggagtagggggggcttacaggggagggccggagccggggccgggg

SEQ ID NO: 162042 - DNA, 75 bp, Artificial Sequence
  Synthetic
catcctgctcggttcccaccgggaccatgtcttggtcggcgaactgcgagtagttactctacccgggagtctctg

SEQ ID NO: 162043 - DNA, 75 bp, Artificial Sequence
  Synthetic
ggttggataccagcttcccccgaatccacgcaacgtccaggagctgttctccggtttccccccaagggtggggca

SEQ ID NO: 162044 - DNA, 75 bp, Artificial Sequence
  Synthetic
aaatctgataaatgacctcttgcatggcctcttgtaaagcgcagtgtaggatgggtagatggggtcaaattctga

SEQ ID NO: 162045 - DNA, 75 bp, Artificial Sequence
  Synthetic
ccggccccgcgccgggcgcctcctcggggccagccgccggggttggttctgcccctctctctgtccttcagagga

SEQ ID NO: 162046 - DNA, 75 bp, Artificial Sequence
  Synthetic
cagtcagcagataacaccccggcctcctccgaccggctccagcagttgggaggaggggagacagaccagggggaa

SEQ ID NO: 162047 - DNA, 75 bp, Artificial Sequence
  Synthetic
accaatgtgatcgtggtggacgaagctggaacgctttccgtgcacattctaacagccgtggtcttttgctactgg

SEQ ID NO: 162048 - DNA, 75 bp, Artificial Sequence
  Synthetic
cacttaatctcataaatgcagctccggtcggtgaacagtataaagtctccctgtgactccacattgacgcaaaga

SEQ ID NO: 162049 - DNA, 75 bp, Artificial Sequence
  Synthetic
ctgtgactccacattgacgcaaagatccagagacaccccaaaaatgccatccgtgggactaatcataaagccaaa

SEQ ID NO: 162050 - DNA, 75 bp, Artificial Sequence
  Synthetic
tccagagacaccccaaaaatgccatccgtgggactaatcataaagccaaattgacggttggcggatgcgtccccg

SEQ ID NO: 162051 - DNA, 75 bp, Artificial Sequence
  Synthetic
aaggggagcactacggctgaatctgaggcctctggccctcccagcccacagagccctctcttagagaaggtggcc

SEQ ID NO: 162052 - DNA, 75 bp, Artificial Sequence
  Synthetic
acccagacagacgcctttcagtcctcctttagccacgagacccaggtaaacaagattcgcgagtgcgacaacatc

SEQ ID NO: 162053 - DNA, 75 bp, Artificial Sequence
  Synthetic
cactctaccgccggggccgcattccctgcatcgtctgcgtgggctctcccacccagacagacgcctttcagtcct

SEQ ID NO: 162054 - DNA, 75 bp, Artificial Sequence
  Synthetic
gacagttaccccgggattggccgcccccatcactctcccaggcccccgattgatggcaaggccctatttcggggc

SEQ ID NO: 162055 - DNA, 75 bp, Artificial Sequence
  Synthetic
aaaggccacaggtcccccaaagtagtgatttgtggagatgggagctggctcaaacaccttggtgggtccattctt

SEQ ID NO: 162056 - DNA, 75 bp, Artificial Sequence
  Synthetic
tgatttgtggagatgggagctggctcaaacaccttggtgggtccattcttaatggtggagagcagcttggaagag

SEQ ID NO: 162057 - DNA, 75 bp, Artificial Sequence
  Synthetic
ctcaccttcctggtgggcaaccccagggccgcgacctacgtggacgtggcccgcaactgggccctcttcatcaac

SEQ ID NO: 162058 - DNA, 75 bp, Artificial Sequence
  Synthetic
aacaagcgctgcaccgacgtccagtttggacatctcatgaagaccctcgagtacggcctcgagctctcgccggac

SEQ ID NO: 162059 - DNA, 75 bp, Artificial Sequence
  Synthetic
gaccggtctccgggaaggtccccaaggccatggcccaaagattccctggagctccttccccaaccagcaccacaa

SEQ ID NO: 162060 - DNA, 75 bp, Artificial Sequence
  Synthetic
tgatggcaaggccctatttcggggccgaaacgagggcttccgagagcccagaccggtctccgggaaggtccccaa

SEQ ID NO: 162061 - DNA, 75 bp, Artificial Sequence
  Synthetic
cctggtcatggactccacgtacgagcagagaacagtcctctgctcgtcggtggcctcctgtagcccccagtaaat

SEQ ID NO: 162062 - DNA, 75 bp, Artificial Sequence
  Synthetic
gagcctggcagaaagtgcaacccagacacgagctgcgcaggagctacaagacactacgtgagtttttcaccaagt

SEQ ID NO: 162063 - DNA, 75 bp, Artificial Sequence
  Synthetic
atcgactgcctcggggtcacagaagaaacataccatccagattccagggttggtgccttcacagaagcccagtta

SEQ ID NO: 162064 - DNA, 75 bp, Artificial Sequence
  Synthetic
tggcctcctgtagcccccagtaaatggatttcagggagggaccgtcctggctgtcattctcttggactaacgagg

SEQ ID NO: 162065 - DNA, 75 bp, Artificial Sequence
  Synthetic
atcctggcctacgtcgaccgcttcgtcgtccccagggcggccataatggaccccacgcagtacgtgggctggacc

SEQ ID NO: 162066 - DNA, 75 bp, Artificial Sequence
  Synthetic
cgccacgctcaagactgccgggcaggggcgcgccgcgcggggaactgggggagatgggggcggggtgaccatgtt

SEQ ID NO: 162067 - DNA, 75 bp, Artificial Sequence
  Synthetic
ttcaggaagtcagtcaggctggccagggcccacgtcacggggaactgacgtctcagcgatcttggcatgccgccc

SEQ ID NO: 162068 - DNA, 75 bp, Artificial Sequence
  Synthetic
cagaggcaatagagatagacatagcgcatggccggcatctgaggtggacggtcaaggttacggacaaaggcctca

SEQ ID NO: 162069 - DNA, 75 bp, Artificial Sequence
  Synthetic
acacattgtctccacactctacaccatcgactgcctcggggtcacagaagaaacataccatccagattccagggt

SEQ ID NO: 162070 - DNA, 75 bp, Artificial Sequence
  Synthetic
ctgtcattctcttggactaacgaggagacaaagtcacagaagccagtttcaccagagaactcttgtatttgttca

SEQ ID NO: 162071 - DNA, 75 bp, Artificial Sequence
  Synthetic
cgggcacaatttctggcggcggcagggccggcgaaatacgccggcaccctctggctggaaacagagtctccctgc

SEQ ID NO: 162072 - DNA, 75 bp, Artificial Sequence
  Synthetic
ctacatccccgtctaccacaactttctggaatatgtcatgcccaccgtgctggagaacccagaggccttttccct

SEQ ID NO: 162073 - DNA, 75 bp, Artificial Sequence
  Synthetic
tgggcgacagttgaagaagtagctctccttgaacctctttttaaggctccggcaccactgcaagaattgactcat

SEQ ID NO: 162074 - DNA, 75 bp, Artificial Sequence
  Synthetic
cctccaccacacgatggactgcctggtctcgggagccacaaccgtggccgcacagaacctctcccagacactccg

SEQ ID NO: 162075 - DNA, 75 bp, Artificial Sequence
  Synthetic
ggcaccactgcaagaattgactcatatgctccgccgtgacatccacgcacggactctcgccacacgaggtcaggc

SEQ ID NO: 162076 - DNA, 75 bp, Artificial Sequence
  Synthetic
ggggtccccgagggcgaggcccagccccctcccacccctgtccactgccccggtccccccagaagcccccaaaag

SEQ ID NO: 162077 - DNA, 75 bp, Artificial Sequence
  Synthetic
acctttggggctgcaaattgcaaaaagtagagcgggtcggatcggtcaaatcccatgtcagggttggggtagggg

SEQ ID NO: 162078 - DNA, 75 bp, Artificial Sequence
  Synthetic
acctggcagacaaccccattgtggccatgacgcttttagcgcacgccagtctcatcgcctctaggaatcaccccc

SEQ ID NO: 162079 - DNA, 75 bp, Artificial Sequence
  Synthetic
cactgggtcactaggactgttttttgttcctggattaaatcaataaatggttaaactgaatctccacctgtgtaa

SEQ ID NO: 162080 - DNA, 75 bp, Artificial Sequence
  Synthetic
catgacgcttttagcgcacgccagtctcatcgcctctaggaatcaccccccttatccagccccggccacagaccg

SEQ ID NO: 162081 - DNA, 75 bp, Artificial Sequence
  Synthetic
ggaagttattctattggaacaacgggagataatggcgctgctggtcggcacacatccggcctacgctgccgcctt

SEQ ID NO: 162082 - DNA, 75 bp, Artificial Sequence
  Synthetic
gtgcccgtcgcgtgtctgaggtgccatagcggtgaagggcccgcagccaggtttgcgcgtcgccacacagcgagg

SEQ ID NO: 162083 - DNA, 75 bp, Artificial Sequence
  Synthetic
gcatgatggctggagtgacggccctcaccgcgtgcttggcgggtaccagcgtccagaggacggccattaggcatg

SEQ ID NO: 162084 - DNA, 75 bp, Artificial Sequence
  Synthetic
gacgacggggaagacgcgcgccgcctcacccgccaccgcatcgccggtccacccaccggcttcatcttcttccag

SEQ ID NO: 162085 - DNA, 75 bp, Artificial Sequence
  Synthetic
cgagagatgggggtttgggagacctcctgtcggactcggtcctcacctacaggctggtcaggagtccagcctccg

SEQ ID NO: 162086 - DNA, 75 bp, Artificial Sequence
  Synthetic
accatccatcatgcaccgctacgctgtggtccagcccctacatatagaggagctgaccttcggggcggttgcctg

SEQ ID NO: 162087 - DNA, 75 bp, Artificial Sequence
  Synthetic
ggccggcgaaatacgccggcaccctctggctggagtcgcgcaggtagtcctgaaatgcgaccgggccctcccctg

SEQ ID NO: 162088 - DNA, 75 bp, Artificial Sequence
  Synthetic
ggctcccctcgaggccgccctggcccgggcagcggccgggaacggctcgtggccctaccggaaatccctggcagc

SEQ ID NO: 162089 - DNA, 75 bp, Artificial Sequence
  Synthetic
cgccaagtggatccggggcatctgcgaggccgtgcggggtctttccgaaggagccctggccttagctgggggtgt

SEQ ID NO: 162090 - DNA, 75 bp, Artificial Sequence
  Synthetic
gggagggggggaggacgagacgacggtggttgggcgcgcggaggccacagccatccttgaggctgatgccacttg

SEQ ID NO: 162091 - DNA, 75 bp, Artificial Sequence
  Synthetic
gccctgaaagccccgcaccaggggctcaatactaccatcatgccagtggccataatcctggagactgcatctgaa

SEQ ID NO: 162092 - DNA, 75 bp, Artificial Sequence
  Synthetic
gggtgcctggctgaacctagccgctgcggctgacggtgaaattcatgagctaacacggctcctggaagtcgaggg

SEQ ID NO: 162093 - DNA, 75 bp, Artificial Sequence
  Synthetic
gggggttaaaggcctgcttcactttcttggggtgcttctgcttctgcctggcctccgacgatgtccttttcctct

SEQ ID NO: 162094 - DNA, 75 bp, Artificial Sequence
  Synthetic
cacctctctgccaggggcgcccctgtgggaacgcctgatggcggagggcaggcgcgggacgcgcaaacctggctg

SEQ ID NO: 162095 - DNA, 75 bp, Artificial Sequence
  Synthetic
gcatgagctcctctccaaattgattgatgaattaaaggtcaaggccaacgcagaccccgaggctgatgtcctggc

SEQ ID NO: 162096 - DNA, 75 bp, Artificial Sequence
  Synthetic
gtgttagcagaatcagcaggacgagcagcaggcttgtcatgccgctgaggaaggcgctgtaggatttagtgcacg

SEQ ID NO: 162097 - DNA, 75 bp, Artificial Sequence
  Synthetic
ggccgtggccttcccaatctgaatcatgtcacacaccatgagctcgtgatacagctccgtcacagagtcatagag

SEQ ID NO: 162098 - DNA, 75 bp, Artificial Sequence
  Synthetic
agactggaaaaggcgcctctcccgactggaggccatcatccaggaggcccaggaagagtcccagctgcagggaac

SEQ ID NO: 162099 - DNA, 75 bp, Artificial Sequence
  Synthetic
gatagcatatgctacccggatacagattaggatagcatatactacccagatatagattaggatagcatatgctac

SEQ ID NO: 162100 - DNA, 75 bp, Artificial Sequence
  Synthetic
gcatacacggccccgtagctcccccgccccagcagatactcgcaggtaatggggaggtgatcacagcgcgtcatg

SEQ ID NO: 162101 - DNA, 75 bp, Artificial Sequence
  Synthetic
caggacctggtcacccaggccaggggccacaccgacccgcgccagctcaagatcgtggtggaggctgccaggggc

SEQ ID NO: 162102 - DNA, 75 bp, Artificial Sequence
  Synthetic
ttctccggcagctttacatagagggtctccgtcatgtcatcaatgttggtcaccttcaggtgtttgtgctgaaag

SEQ ID NO: 162103 - DNA, 75 bp, Artificial Sequence
  Synthetic
cccagtatgcactcctcaaggacaagctgctgcgctatgcctcggccaagcagagtttcctggctttttacgaga

SEQ ID NO: 162104 - DNA, 75 bp, Artificial Sequence
  Synthetic
ctgggccgggctcagtgtggatgtggcccgggagctggtggagctcgcacgctggcacgcggatgagtcacaggt

SEQ ID NO: 162105 - DNA, 75 bp, Artificial Sequence
  Synthetic
cagagtttcctggctttttacgagaccgcccagcctaccgttttcgttaagcatcccttgaccaacaacctgccc

SEQ ID NO: 162106 - DNA, 75 bp, Artificial Sequence
  Synthetic
tcgccactgctggaggagttcgtcgggctcaactccgcagccatattcacatccatgttcctcaaatggctcgag

SEQ ID NO: 162107 - DNA, 75 bp, Artificial Sequence
  Synthetic
gcctagggtggcgtagacatctgtcacgagttccaccggtgaaagctctgccaccagataggtgaaggggcccaa

SEQ ID NO: 162108 - DNA, 75 bp, Artificial Sequence
  Synthetic
ccctatgtcccgggctttcccttcctgccgatgatgggcgggaccaacaacccccacctggtgatggcttcgggt

SEQ ID NO: 162109 - DNA, 75 bp, Artificial Sequence
  Synthetic
aggggagacaaaaggtggagactgccttgagcacctctatctcaggcaccggatgcccccggctccacggccccg

SEQ ID NO: 162110 - DNA, 75 bp, Artificial Sequence
  Synthetic
ggcctgtcgcagctcgtctctggcctcaagctcctgctcacggagctcctccacccgctctagctgcttgtagtt

SEQ ID NO: 162111 - DNA, 75 bp, Artificial Sequence
  Synthetic
tccagatatttgggtagtatatgctacccatggcaacattagcccaccgtgctctcagcgacctcgtgaatatga

SEQ ID NO: 162112 - DNA, 75 bp, Artificial Sequence
  Synthetic
ccacccgctctagctgcttgtagttgatttttggaaattgagtcttggtcgcggtgaccaccctctgataggtag

SEQ ID NO: 162113 - DNA, 75 bp, Artificial Sequence
  Synthetic
gcggtgaccaccctctgataggtagaaattagctgtttggactcaaacgtctcccttgcgcggcgcagggactct

SEQ ID NO: 162114 - DNA, 75 bp, Artificial Sequence
  Synthetic
gagcgggacgatctcctccaggccacgggggacttcttctcggagctgctgaccgaggccgaggcggccgaggtc

SEQ ID NO: 162115 - DNA, 75 bp, Artificial Sequence
  Synthetic
ctcccttgcgcggcgcagggactctaaggcaccccgagcagatgtaaactgtgtttcaaacagagcgtggtccct

SEQ ID NO: 162116 - DNA, 75 bp, Artificial Sequence
  Synthetic
ccgagtagagccccctgggcttggttcgcctgaactcggcggcaatgtcggagagtaccgagagccccctgggct

SEQ ID NO: 162117 - DNA, 75 bp, Artificial Sequence
  Synthetic
ttagttgctgggccaccagatctcgcttagaactactcatcttcataagtcaccatgtccgcaactatggagccc

SEQ ID NO: 162118 - DNA, 75 bp, Artificial Sequence
  Synthetic
accacccccaccacctcagcgcagggatgcctggacacaagagccatcacctcttgatagggatccgctaggata

SEQ ID NO: 162119 - DNA, 75 bp, Artificial Sequence
  Synthetic
tagttccagtggaggcttcccggtaatttcccacagcgtccaccatatatctttctgcctctcccgttagaatta

SEQ ID NO: 162120 - DNA, 75 bp, Artificial Sequence
  Synthetic
ggcaaggatcatacgtgtccaccggccttttatactgagcgtttaggttttgtttatgtagcaagcacaaaaggc

SEQ ID NO: 162121 - DNA, 75 bp, Artificial Sequence
  Synthetic
ccttttatactgagcgtttaggttttgtttatgtagcaagcacaaaaggcacacacgagtgatgcaaaagggttc

SEQ ID NO: 162122 - DNA, 75 bp, Artificial Sequence
  Synthetic
cacgcccccgtagcaagccagcattccaagcctgtgccgtctctgtgctaggattctcatccatccacggtgttt

SEQ ID NO: 162123 - DNA, 75 bp, Artificial Sequence
  Synthetic
caaagggaggagctatatcctcacccttccagtcacgcacgtccaagtacagggcatacacacacctggtgaggt

SEQ ID NO: 162124 - DNA, 75 bp, Artificial Sequence
  Synthetic
ccacgccatacctgcacagccctccagcgtggtcataacccctacctcggcatcgtttgtgattcccagaaagaa

SEQ ID NO: 162125 - DNA, 75 bp, Artificial Sequence
  Synthetic
ccaagcctgtgccgtctctgtgctaggattctcatccatccacggtgtttcgatactagtggtgcccaaggcata

SEQ ID NO: 162126 - DNA, 75 bp, Artificial Sequence
  Synthetic
catagctcgagggccccatgatctggttgtcggcctcctcaccctcacccaggaaggtcaagagctggcgcagaa

SEQ ID NO: 162127 - DNA, 75 bp, Artificial Sequence
  Synthetic
ctttgttccaggccagcgcaattcgcataaggtccccatcaaacacctcaaaacacagacccatgcccatttcag

SEQ ID NO: 162128 - DNA, 75 bp, Artificial Sequence
  Synthetic
tcttctggtaaacggggattgaggggcaagagctccaaagccaggctcgagaagtcatagtcatcctcggccaca

SEQ ID NO: 162129 - DNA, 75 bp, Artificial Sequence
  Synthetic
tccaagggggccagggacggtgcccggactcagaattattaaaccgggtggcagctcctggcagtcatttattcg

SEQ ID NO: 162130 - DNA, 75 bp, Artificial Sequence
  Synthetic
gaagtcatagtcatcctcggccacacggccggagctccgggcctcgtgccagggcctgttgtcctgggggaggat

SEQ ID NO: 162131 - DNA, 75 bp, Artificial Sequence
  Synthetic
agggaggacgttgagactctgatcgtggtgcaggcctgccagccgccgcttggaggctccctggagccccccgtg

SEQ ID NO: 162132 - DNA, 75 bp, Artificial Sequence
  Synthetic
aaattctgcaaggccactaggcgcgctggctccagcgtcagccggttgcccatctcgaatgtgtgcagggcctct

SEQ ID NO: 162133 - DNA, 75 bp, Artificial Sequence
  Synthetic
agtggcgtctccaccagcttaaattgctcgggcgtgtcctggcaggcctccagtgccagttccagacactgccca

SEQ ID NO: 162134 - DNA, 75 bp, Artificial Sequence
  Synthetic
aaggaccggcaagtcacgatagaggtggtctatgctctcctcgaaggaggcaatgtagttatcgatggtgtagaa

SEQ ID NO: 162135 - DNA, 75 bp, Artificial Sequence
  Synthetic
gaacatgctgtatgcctcgcagcgcggccgtctgaccgagaacctaagaaacgccctgcagcaggatagcaccac

SEQ ID NO: 162136 - DNA, 75 bp, Artificial Sequence
  Synthetic
atcaggtgttaccacttcatcccagattttcgtgaggctcctatgtatggccatgtagtcaaagaaaatactgta

SEQ ID NO: 162137 - DNA, 75 bp, Artificial Sequence
  Synthetic
aaagtggtagacgccccccgtgagcctgaaggactcatagtcttctcccgggcgcaggccggctagcctgtgctc

SEQ ID NO: 162138 - DNA, 75 bp, Artificial Sequence
  Synthetic
agtcagacaggtgggctcaccctctggtgggcacaattcacgccagtaatttatattgcccaatgcttcgagcat

SEQ ID NO: 162139 - DNA, 75 bp, Artificial Sequence
  Synthetic
atcatgactatgaccgccgccaccgtctgtcatcgaaggcgggccccggtcacctcctttgttttcaacctcttc

SEQ ID NO: 162140 - DNA, 75 bp, Artificial Sequence
  Synthetic
gcagactgttttggtgaacgggctggtggcctttgccttctccgagaggacccgggccgtcacccagtgtctctt

SEQ ID NO: 162141 - DNA, 75 bp, Artificial Sequence
  Synthetic
ttgtgttgtgcagaggtctgatgtgtgtaggaggggtgggttcaacgcaggggcgttggtggcggagtctggcaa

SEQ ID NO: 162142 - DNA, 75 bp, Artificial Sequence
  Synthetic
actgccgccactatggccccaggcccgtgtttgtagcttctgatgaatcattacccatgttcggtgcgagccccg

SEQ ID NO: 162143 - DNA, 75 bp, Artificial Sequence
  Synthetic
cctccagtaatccccatccctcaccaatcaccacccgcctccccgacaccccaccccgcgccagtctcaactatc

SEQ ID NO: 162144 - DNA, 75 bp, Artificial Sequence
  Synthetic
actatcgaccctgcatttgcgatgtacttttctatgacggggatggtgagggccgctcctcgccctcctcctcct

SEQ ID NO: 162145 - DNA, 75 bp, Artificial Sequence
  Synthetic
ccaaaattggtgccttgctctcagcactttgccagcaacttatagcatggtaggcagctcaactcggcccgtctt

SEQ ID NO: 162146 - DNA, 75 bp, Artificial Sequence
  Synthetic
tctgccaattctcgcatgtcctcctttccccttgttttgaaatagaatatgaatgtggcttttcagcctagacag

SEQ ID NO: 162147 - DNA, 75 bp, Artificial Sequence
  Synthetic
cttgacggaattcaagaccagcgtgtcctctgcccgtgccatccttgaggaccccaactttttggagatgagaga

SEQ ID NO: 162148 - DNA, 75 bp, Artificial Sequence
  Synthetic
acatccggtacacgtccattgaatgggactatcgcgagctcctctacctgggcaccgcccttagtgatatgagcg

SEQ ID NO: 162149 - DNA, 75 bp, Artificial Sequence
  Synthetic
acatagaattgttagtttaaacagtttattgatacatggctgcttttagcctaattgtgtattgctctcgttgcc

SEQ ID NO: 162150 - DNA, 75 bp, Artificial Sequence
  Synthetic
ccgcccgcctagaagcattccagaaacaagtagtgttacattctttttattttctgatctcaatcaaatctttag

SEQ ID NO: 162151 - DNA, 75 bp, Artificial Sequence
  Synthetic
tttttaagcaaaaagccagcgtgtttcttatccccaggcgccacggcaagacctggatagtcgtggccatcatca

SEQ ID NO: 162152 - DNA, 75 bp, Artificial Sequence
  Synthetic
cttctaggcattaccatgtcataggcttgcctgactgactctccctccatttactgggaatgccttagctaatca

SEQ ID NO: 162153 - DNA, 75 bp, Artificial Sequence
  Synthetic
agattcttgtgttcctgctgattgaaggcatcttcttcattagctccttctacagcatagccctgctgcgggtcc

SEQ ID NO: 162154 - DNA, 75 bp, Artificial Sequence
  Synthetic
tctcagtacgtgcgaagccgtctctctgagatggtagcggccgtgtccggggagagcgtgctcaagggggtcagt

SEQ ID NO: 162155 - DNA, 75 bp, Artificial Sequence
  Synthetic
cgagtccaaggcccaacagcaccgcggcaaaaatatgcaatgcccacccactacacccccgagaacccggcggac

SEQ ID NO: 162156 - DNA, 75 bp, Artificial Sequence
  Synthetic
tcactgaaattattgacaccttgaccaagagcttcgactccaagcgtgtagaggtcaacaaggagaccagcacca

SEQ ID NO: 162157 - DNA, 75 bp, Artificial Sequence
  Synthetic
tcgcggcggcctaaaggtgccggcagaaaaggtcacatgacacctacggccacttgcgcacccaagagtcgcctg

SEQ ID NO: 162158 - DNA, 75 bp, Artificial Sequence
  Synthetic
gccactagcacaggtgaggagcggggctgggtgggagagcgcggcccccggggtttgcccaactcttattcttcc

SEQ ID NO: 162159 - DNA, 75 bp, Artificial Sequence
  Synthetic
tgcttcaataagaatgtaagacctgacgtttcagtacttggcaattgtagagcatagcccggctgtaaaggtcag

SEQ ID NO: 162160 - DNA, 75 bp, Artificial Sequence
  Synthetic
agcatagcccggctgtaaaggtcagaaaatcgcagcagggtccaaggttgtgctgtacatgggacctctttccca

SEQ ID NO: 162161 - DNA, 75 bp, Artificial Sequence
  Synthetic
gtcgaccagaggacgcaggatatctgcaggatcaggtcagcctcgttggtggccgtggggaagccctcctcccct

SEQ ID NO: 162162 - DNA, 75 bp, Artificial Sequence
  Synthetic
gtgacatgtccgggtgcattttgggtgggttaaatctcagtcccaccacaaagggggcatcctccggtttgaaca

SEQ ID NO: 162163 - DNA, 75 bp, Artificial Sequence
  Synthetic
gacaggtgccagatgtgcctgggctatcgtcctccgtccagccacgcaggatgttcacgtgggccccggcaccat

SEQ ID NO: 162164 - DNA, 75 bp, Artificial Sequence
  Synthetic
tgggtcagtgatggaaaggttggcatattggggcagcacatcagcatgtccatgttaacgaaaaacatgtacagg

SEQ ID NO: 162165 - DNA, 75 bp, Artificial Sequence
  Synthetic
tattggggcagcacatcagcatgtccatgttaacgaaaaacatgtacagggccccttctgcataccaggcaccac

SEQ ID NO: 162166 - DNA, 75 bp, Artificial Sequence
  Synthetic
acactacgccgctttcgggaaagcggcgcccgtactgcctccggcagaccccgcaaatccccccgggcctccatc

SEQ ID NO: 162167 - DNA, 75 bp, Artificial Sequence
  Synthetic
gacgctaaagagcgtcgtggagggcatccaggatgtgtgccgggacgccgccgccaggtgggccctggccacggc

SEQ ID NO: 162168 - DNA, 75 bp, Artificial Sequence
  Synthetic
gcgagccgggccagctcgccttcttttatcctctttttggggtctctgtgtaataccttaaggtttgctcaggag

SEQ ID NO: 162169 - DNA, 75 bp, Artificial Sequence
  Synthetic
gccggggcatcgcggatcaccccctctgggcccacaccagcgagcccctgcgtccggacctcgaggagctcaacg

SEQ ID NO: 162170 - DNA, 75 bp, Artificial Sequence
  Synthetic
aactggtcaccagcttcgagagccacgacattgatcactactacaccgagcagaaggccatggagaacgtccacg

SEQ ID NO: 162171 - DNA, 75 bp, Artificial Sequence
  Synthetic
ctaatctccacaggcaccgcctcacccacggcatctgagaataccccaaagtacatgagagtcaggctgtgtggc

SEQ ID NO: 162172 - DNA, 75 bp, Artificial Sequence
  Synthetic
gtacatgagagtcaggctgtgtggcccctggactgccttagtgaagagaacctcgggcctggccacggtggctag

SEQ ID NO: 162173 - DNA, 75 bp, Artificial Sequence
  Synthetic
aggcgcagcgtcgcctaccggttccgggattacacattcgcccgcctgttccagccacccgccatcgacgccgag

SEQ ID NO: 162174 - DNA, 75 bp, Artificial Sequence
  Synthetic
aggccaaccagcggccagggtggtcattctccatttgacctgacttctacgagaagctggattcctccgacgatc

SEQ ID NO: 162175 - DNA, 75 bp, Artificial Sequence
  Synthetic
tcccacccccacaggacctgtccatgaaccggtcggatccctaacgccagccccggtgcccaagccacttgaccc

SEQ ID NO: 162176 - DNA, 75 bp, Artificial Sequence
  Synthetic
cacacacgctggccccatcggccttgcgccggcccagtagcttgatgacgatgccacatggcaccacatacccct

SEQ ID NO: 162177 - DNA, 75 bp, Artificial Sequence
  Synthetic
cggcatcggcgagcatagcaatgagccccccgctgcgcctgagcccgctgcgcctgagctcccgctcccatcgca

SEQ ID NO: 162178 - DNA, 75 bp, Artificial Sequence
  Synthetic
ggcacgtacacagctgacacggcggttgtggccgtatagactttcatctggggcgtagaggcatcgctcagcacc

SEQ ID NO: 162179 - DNA, 75 bp, Artificial Sequence
  Synthetic
ttgtggccgtatagactttcatctggggcgtagaggcatcgctcagcacccagaggcactccttgttgaggaact

SEQ ID NO: 162180 - DNA, 75 bp, Artificial Sequence
  Synthetic
tgcgaagctgttcccggctactgttcgcggcggatgccatgacgtgccagaatatatcccctctcctcgggggtg

SEQ ID NO: 162181 - DNA, 75 bp, Artificial Sequence
  Synthetic
gcgagcaaataaacctgtctcagtgagcccatcgtctgctcatttcttagcaaatctcccacctgcacaccaggg

SEQ ID NO: 162182 - DNA, 75 bp, Artificial Sequence
  Synthetic
ggagatttttgcctctcgatgcgtcacgatgggggtgatttcacggatcaggtgctgctccaatgtccgcccgtg

SEQ ID NO: 162183 - DNA, 75 bp, Artificial Sequence
  Synthetic
caaatctcccacctgcacaccagggggcaggcccagatctatctcggctcgccagcggtccgggcactcaaaggt

SEQ ID NO: 162184 - DNA, 75 bp, Artificial Sequence
  Synthetic
ctgcccgtccgatgtggtggccaggtggacgcagtgcccgtcagttccaagggctactagctgggaagcagcccc

SEQ ID NO: 162185 - DNA, 75 bp, Artificial Sequence
  Synthetic
acaaacgcccccgccattccgcatcctccccgccaaaaaactcgcggccattctcctgggtaacggcaggaacgc

SEQ ID NO: 162186 - DNA, 75 bp, Artificial Sequence
  Synthetic
cacctcgccgcaggcgtagtagatgaaagccacgcagtccgcgataaagaccagtgtgatgtagacaaacatctc

SEQ ID NO: 162187 - DNA, 75 bp, Artificial Sequence
  Synthetic
gggctactagctgggaagcagccccaaccagcccaccggggggcctggagtcgatcaccttaccccaggccgagg

SEQ ID NO: 162188 - DNA, 75 bp, Artificial Sequence
  Synthetic
ctgttggagaacacttcatcttcgaacatgtcttcatcctctgtggtggggatatcggaggctaagttgctctcc

SEQ ID NO: 162189 - DNA, 75 bp, Artificial Sequence
  Synthetic
atctatccataggcaggcatccggcgtctttggtgcattggagatagctttcacccaacaactttcccaactaac

SEQ ID NO: 162190 - DNA, 75 bp, Artificial Sequence
  Synthetic
attctccttctcctcctcagacttttccgaccaggacgagggagagggaggggaggcagatctcaggggcgtgcc

SEQ ID NO: 162191 - DNA, 75 bp, Artificial Sequence
  Synthetic
agcatctgcaccggctgctgcgacatctggcgcgtgcgcctcgtgagggaaataaccaggatcaccacccccgcc

SEQ ID NO: 162192 - DNA, 75 bp, Artificial Sequence
  Synthetic
agatacgggagtaggaggtgggaataacaactgggatttcttgttgtgctgtccaggcctgcatggccagttttt

SEQ ID NO: 162193 - DNA, 75 bp, Artificial Sequence
  Synthetic
tgagcatgtatctgaaataattattatgtcataagtgtaatgattagaaagtcataaacccacttccctttacat

SEQ ID NO: 162194 - DNA, 75 bp, Artificial Sequence
  Synthetic
aacaactgggatttcttgttgtgctgtccaggcctgcatggccagtttttccctgaagctagcagaaattctgag

SEQ ID NO: 162195 - DNA, 75 bp, Artificial Sequence
  Synthetic
gtctatggctcgcgtgtcggcgtgctgaaaccaacggcaacaaatcacttaccttgttgtgcgatgggcaaaaac

SEQ ID NO: 162196 - DNA, 75 bp, Artificial Sequence
  Synthetic
ggccactgaaatgaggaagcgaaactccctctctggagctcccaaaattgaaacctcagcaagatctgttgctgg

SEQ ID NO: 162197 - DNA, 75 bp, Artificial Sequence
  Synthetic
tctgagcacaccaatttagtgttgatcaccctattggtgttgaacacgagcaggcgaaacccaggccccacgggg

SEQ ID NO: 162198 - DNA, 75 bp, Artificial Sequence
  Synthetic
aaacctcagcaagatctgttgctggggaggcatgggtgacagctgtcatcctgtgcagtctgccctgggcactca

SEQ ID NO: 162199 - DNA, 75 bp, Artificial Sequence
  Synthetic
cgatagttgagactggcgcggggtggggtgtcggggaggcgggtggtgattggtgagggatggggattactggag

SEQ ID NO: 162200 - DNA, 75 bp, Artificial Sequence
  Synthetic
gctctggatatgtgacaacatagagagcgtgggggctaaaaatatgagcaattcccctgaccagggccctggact

SEQ ID NO: 162201 - DNA, 75 bp, Artificial Sequence
  Synthetic
agaggttgacaagaagggtcaaggtttcgtctgtgtgttgaagggcaggggctgttgggtgcatctggaacggct

SEQ ID NO: 162202 - DNA, 75 bp, Artificial Sequence
  Synthetic
attcccctgaccagggccctggactcacgaatggcccgacgggtcttagagaaagaaacaggcaccctcgagagt

SEQ ID NO: 162203 - DNA, 75 bp, Artificial Sequence
  Synthetic
cgatagagctgccggcccttagaagactttagccgcacatccagcatcttgttgcggtcgtggagggaagcagtc

SEQ ID NO: 162204 - DNA, 75 bp, Artificial Sequence
  Synthetic
agcagccgccttggtctcggccccggccctaagtctgagccccaggcaaagggccggactcccagcgtggcccaa

SEQ ID NO: 162205 - DNA, 75 bp, Artificial Sequence
  Synthetic
aaggtggcctccctgcccagggccgtgtccaaccatttgattcgggttccataaacacgagctcaatgtttcgcc

SEQ ID NO: 162206 - DNA, 75 bp, Artificial Sequence
  Synthetic
gacctgggccgcggccatcggcatatgctctatacccgcccctccggggggcccaggatctataggtatgggctg

SEQ ID NO: 162207 - DNA, 75 bp, Artificial Sequence
  Synthetic
gacagggacatagtcagtgccctggcgcatgcttttgaaaatccggcatatcctgatgagcatggccaccgagca

SEQ ID NO: 162208 - DNA, 75 bp, Artificial Sequence
  Synthetic
ccttgttaacctgatagcatagcctctaggtttccttgtaggtctgtttgggtttggtggttcacgtggtgctaa

SEQ ID NO: 162209 - DNA, 75 bp, Artificial Sequence
  Synthetic
ctcaaagagagacaggtaataaatctgtagctccccaaccagccctccttcatcgtaaaatcgaagggcggccac

SEQ ID NO: 162210 - DNA, 75 bp, Artificial Sequence
  Synthetic
ctagcggaaacctgtagataatggcttctcgaccagggtgatccagctgaggggggggcacgtgttgtgctggag

SEQ ID NO: 162211 - DNA, 75 bp, Artificial Sequence
  Synthetic
catcgtaaaatcgaagggcggccacgtggaaggggttgtagagctctggaaggccctcctcgcagtacactggca

SEQ ID NO: 162212 - DNA, 75 bp, Artificial Sequence
  Synthetic
aggccgtccgggcagcatgccccgagcagcaaacacgcggcagaccctcgtgagacccgtccggtcactgaagag

SEQ ID NO: 162213 - DNA, 75 bp, Artificial Sequence
  Synthetic
ggcgaagggtggggtgggtgcaagaattggggctggggagggagaggggagtggcctcggtgccgacgccggggt

SEQ ID NO: 162214 - DNA, 75 bp, Artificial Sequence
  Synthetic
agtctggcaccaggccccctcgcagtttggcacgcgattggggcaaagctctgccataaccgtgtcgggaacaaa

SEQ ID NO: 162215 - DNA, 75 bp, Artificial Sequence
  Synthetic
ggtaagctccgtcaggttcttgacggtggccaacgagcgcggggtcagaggtagccaagctaataacaatcctcc

SEQ ID NO: 162216 - DNA, 75 bp, Artificial Sequence
  Synthetic
taggtgcacgaggaggggggtcccgaggccactcaacacttggttgtcaatgtggacatccatagctctctcatg

SEQ ID NO: 162217 - DNA, 75 bp, Artificial Sequence
  Synthetic
cgtttggctacagcatcatagcgcttgtttctggtggatttaaataacagggccccgtagacagtcttttgtgag

SEQ ID NO: 162218 - DNA, 75 bp, Artificial Sequence
  Synthetic
ggccaccgccagcatcgactgtaggaacgggtcttggatgggctctagggtcagagaggccagggggctgggcaa

SEQ ID NO: 162219 - DNA, 75 bp, Artificial Sequence
  Synthetic
tccagcataaagatgcgggggtcctctgtctcaaaggcctcgggtagaaaatagagatgcacgcaagtgtactgg

SEQ ID NO: 162220 - DNA, 75 bp, Artificial Sequence
  Synthetic
agcatcaggcagcaagggaacacaaaggaaaccagggccgggatgtgaggcctcagcgccccctcctgatcaaag

SEQ ID NO: 162221 - DNA, 75 bp, Artificial Sequence
  Synthetic
cgcggtggaggtggctcgaggccaccgccgccctcctagagagtctatcgggctttgccctgcactttttccgac

SEQ ID NO: 162222 - DNA, 75 bp, Artificial Sequence
  Synthetic
agggcctcgctgaccccggagatgacattctcattcagaaagtagtgatagaggtgattgaccacagtcttaacc

SEQ ID NO: 162223 - DNA, 75 bp, Artificial Sequence
  Synthetic
gggcctgggtttcgcctgctcgtgttcaacaccaatcgggtgggtgggggccaacctagccatcaatgtcaatat

SEQ ID NO: 162224 - DNA, 75 bp, Artificial Sequence
  Synthetic
tgctgcccaccgcgagccccacgagccgcttcgcccgtgtggcccgggcggcctacctgcgggcggaggccgagg

SEQ ID NO: 162225 - DNA, 75 bp, Artificial Sequence
  Synthetic
ttgtcggatctcggtccagggcctcagcgccggctggaaatgcggccccatgtagttgcctgtaagggcgcacac

SEQ ID NO: 162226 - DNA, 75 bp, Artificial Sequence
  Synthetic
ccggccatgggggcttacaagaataacatgccaatgacccggcccccacttttaaattctgttgcagcagatagc

SEQ ID NO: 162227 - DNA, 75 bp, Artificial Sequence
  Synthetic
agcgccggctggaaatgcggccccatgtagttgcctgtaagggcgcacaccactccctcatgggtctcaatcagg

SEQ ID NO: 162228 - DNA, 75 bp, Artificial Sequence
  Synthetic
cttcctcttctgagctgctatctgatatctctatgaggacattttcccaatctccctcagacgcccgttcctgaa

SEQ ID NO: 162229 - DNA, 75 bp, Artificial Sequence
  Synthetic
ggtgacaaatgtaatcttggagacaggcttaaccagactcatgtcaaaccacggtttgttgggcaggggcctctg

SEQ ID NO: 162230 - DNA, 75 bp, Artificial Sequence
  Synthetic
tcggctcatcgcagagacccgggccctggcggccgcgtaccggcgcatcatcgaagagggcagcggggaggtgct

SEQ ID NO: 162231 - DNA, 75 bp, Artificial Sequence
  Synthetic
ggcaaacacggaggccatgctctcaggtaacgggagatggaactccagcttactatacgagcacaggtggcgagg

SEQ ID NO: 162232 - DNA, 75 bp, Artificial Sequence
  Synthetic
gcatacacacacctggtgaggtgtgccaggaatgcctctatgttggcacatggtgtataaaccgcagtgggttgg

SEQ ID NO: 162233 - DNA, 75 bp, Artificial Sequence
  Synthetic
cctgatttgctcttcgtgctcttcatgtccactgagcaaggttcttctggcacgactgttcctatatgctctagc

SEQ ID NO: 162234 - DNA, 75 bp, Artificial Sequence
  Synthetic
cccctcagcatggacgacatcctgtatctaggcaagcgcatctgcaaggccctggtggacgtcctcgaccatcat

SEQ ID NO: 162235 - DNA, 75 bp, Artificial Sequence
  Synthetic
tggtgtataaaccgcagtgggttggcacatggtgtataaaccgcagtgggtagcagaatagggccccttttgccc

SEQ ID NO: 162236 - DNA, 75 bp, Artificial Sequence
  Synthetic
ggaggaacaagtcccaccccagtagttaccagcccaccaaaaaatgcaaccagtgatgttaccacaggccaacat

SEQ ID NO: 162237 - DNA, 75 bp, Artificial Sequence
  Synthetic
ctacgttctccagaaactggtcctgctggagatgaagggaggctgccgggagccagaactggacacggaaacgct

SEQ ID NO: 162238 - DNA, 75 bp, Artificial Sequence
  Synthetic
ggcgctgcacctcagagacctcctgctcaaagaggcctcccaccgccacgtagacgcgggccaccgtccggggaa

SEQ ID NO: 162239 - DNA, 75 bp, Artificial Sequence
  Synthetic
attctatagctcgtcctaccgtggagtacgtcccggatgggcggttgccctcggagggtgactatctgttgacgc

SEQ ID NO: 162240 - DNA, 75 bp, Artificial Sequence
  Synthetic
ctgcctttgctcgcacggcccgggtccagacccaccacctcgtgccggccctaaccgacgattccccctcacccg

SEQ ID NO: 162241 - DNA, 75 bp, Artificial Sequence
  Synthetic
gtgactcgcttcttatcctgtctttcagagcatccgggggcagacatttcacctcttgtttgtggacgaggctaa

SEQ ID NO: 162242 - DNA, 75 bp, Artificial Sequence
  Synthetic
cagagcatccgggggcagacatttcacctcttgtttgtggacgaggctaactttatcaagaaggaggccctgccg

SEQ ID NO: 162243 - DNA, 75 bp, Artificial Sequence
  Synthetic
tgtccgtaagcgcaaactgggccccggtcatgacctggtggcagacagcctagctgccaacaggggggtggagtc

SEQ ID NO: 162244 - DNA, 75 bp, Artificial Sequence
  Synthetic
tctctttcaccgccccgagtcactttccagcgtggtggcctcgctgcccctggcccggcggcgggcggtagagat

SEQ ID NO: 162245 - DNA, 75 bp, Artificial Sequence
  Synthetic
ccatcaacaggccctccgtgtgattctcccgcgtgccaaacgagggacactggatgtccgaggagaagcggaaca

SEQ ID NO: 162246 - DNA, 75 bp, Artificial Sequence
  Synthetic
gtctgtgaactcggctgaccaggccaccagctttctttataagctgaaggatgctcaggagcggctgctgaacgt

SEQ ID NO: 162247 - DNA, 75 bp, Artificial Sequence
  Synthetic
accagctttctttataagctgaaggatgctcaggagcggctgctgaacgtggtaagttatgtgtgtcaggagcat

SEQ ID NO: 162248 - DNA, 75 bp, Artificial Sequence
  Synthetic
tggggtctgcgcaccgaggcggcacgccagggcggctagcagcacgaccacgcttagcaccctacgccgagtcat

SEQ ID NO: 162249 - DNA, 75 bp, Artificial Sequence
  Synthetic
aggcgggtcttgcgctcgtttaccacaagctttgtcacgttcgccgaatgtctgtgacccagaagcgcgcactcg

SEQ ID NO: 162250 - DNA, 75 bp, Artificial Sequence
  Synthetic
atacgaggaagagagggaaaggccatcggatatcgacaccgcggcccgagcccagaaggttgagacctcctgccc

SEQ ID NO: 162251 - DNA, 75 bp, Artificial Sequence
  Synthetic
cctgcacatcccgtcctacatcaccatggacagtaacatccgagcaaccaccaacctctttctggacggggcctt

SEQ ID NO: 162252 - DNA, 75 bp, Artificial Sequence
  Synthetic
tcggatatcgacaccgcggcccgagcccagaaggttgagacctcctgcccccgcagacgcagtccgcggactacc

SEQ ID NO: 162253 - DNA, 75 bp, Artificial Sequence
  Synthetic
ggtggggggtgacgaggatggaaagggcatgtggtggcgccagcgtgcccaagagggcacggcgcatcccgcctc

SEQ ID NO: 162254 - DNA, 75 bp, Artificial Sequence
  Synthetic
tagcaccgagctgatgggtgacacctcctcgctgagccagggtagcctgagccgcactgtgcgtgacgatgccat

SEQ ID NO: 162255 - DNA, 75 bp, Artificial Sequence
  Synthetic
caaccagctggagctctgccgggttgacaccctcaacccccgagtagccggacgcctagcctcctccctctacgt

SEQ ID NO: 162256 - DNA, 75 bp, Artificial Sequence
  Synthetic
ggaccctaacagggtcatcgtcctgggcctggaacacttcttcctcaaggacctaacaggggacgctgccctcca

SEQ ID NO: 162257 - DNA, 75 bp, Artificial Sequence
  Synthetic
ctcccgccgatacctgttcctgcacaaccgaggaaataccgagatgtacataatgtatgccatggccattcgaca

SEQ ID NO: 162258 - DNA, 75 bp, Artificial Sequence
  Synthetic
cccacttggaggaggtgaaggtagccgtggagggcaacagcagtcaggactctgcggtggccattgcctcaatca

SEQ ID NO: 162259 - DNA, 75 bp, Artificial Sequence
  Synthetic
tcggcacgctcggcgtcgatggcgggtggctggaacaggcgggcgaatgtgtaatcccggaaccggtaggcgacg

SEQ ID NO: 162260 - DNA, 75 bp, Artificial Sequence
  Synthetic
cgtggagggcaacagcagtcaggactctgcggtggccattgcctcaatcattggggaatcctgccccctcccctg

SEQ ID NO: 162261 - DNA, 75 bp, Artificial Sequence
  Synthetic
ctgcgcctgagggcgcccgtcaggctgtatcccagctccagggcgtgctccacccgctcgttgagctcctcgagg

SEQ ID NO: 162262 - DNA, 75 bp, Artificial Sequence
  Synthetic
tagagcagcgagtagccgagcgactgcagatccaggcgaagggccgtctgcgcccccacggggccacacgccgag

SEQ ID NO: 162263 - DNA, 75 bp, Artificial Sequence
  Synthetic
cgcaacctctctgacgacgtgctggttgcgctagtcatggctcattttctcgcaacaacacagaagcacacgttc

SEQ ID NO: 162264 - DNA, 75 bp, Artificial Sequence
  Synthetic
ccgtgcgtggatgtcacggcggagcatatgagtcaattcttgcagtggtgccggagccttaaaaagaggttcaag

SEQ ID NO: 162265 - DNA, 75 bp, Artificial Sequence
  Synthetic
gtcatgggctcatgctgtggggcagcacctcccgtccggtcacgtctcatgttggcatcatcgatcccggctaca

SEQ ID NO: 162266 - DNA, 75 bp, Artificial Sequence
  Synthetic
aagaaagttcattaaactttattgactacaccagtcccttgtaaagcgacgggtctcgcgtgacggcattcgtga

SEQ ID NO: 162267 - DNA, 75 bp, Artificial Sequence
  Synthetic
ccagtctcctccttctcgtcctcgtccctgcacaggggtgagcgatgcaatgtgactgtcttgtcctgtaggtcc

SEQ ID NO: 162268 - DNA, 75 bp, Artificial Sequence
  Synthetic
aagtgagccccacaaacaccagtgtccagagaggaagaccgtaagataaagatggctgcctctcatctggaacgg

SEQ ID NO: 162269 - DNA, 75 bp, Artificial Sequence
  Synthetic
gtggccccgggagccacggcatcaaacaggtgagtcagccttgcccccgccagcgcctcctcgcaggcccgccgc

SEQ ID NO: 162270 - DNA, 75 bp, Artificial Sequence
  Synthetic
ctgcctcactgtaatgaagacgttggaacaggcggggttgaggaagtagctgctgacaaactgctgcattccagg

SEQ ID NO: 162271 - DNA, 75 bp, Artificial Sequence
  Synthetic
accgtccacctcagatgccggccatgcgctatgtctatctctattgcctctgtaaacaaatacaagagttctctg

SEQ ID NO: 162272 - DNA, 75 bp, Artificial Sequence
  Synthetic
catcagaccgtctcagtgacactcaccgtgccccccccttctatccctcaccacaggccgacaatctttggcagg

SEQ ID NO: 162273 - DNA, 75 bp, Artificial Sequence
  Synthetic
tgacggggcccctccgatgcctggggagtccccccaggcggtcggactgcgccccctcaacttagatggggacgg

SEQ ID NO: 162274 - DNA, 75 bp, Artificial Sequence
  Synthetic
acccgctctctggccgccctgcgctggctggtctccttcggcagcgacctggccctcccttcccccgagctgacc

SEQ ID NO: 162275 - DNA, 75 bp, Artificial Sequence
  Synthetic
ctgttccggcctcggtggcagtgatgttctgtgcagtaaccttagtggtgacattgatggtggatgcgttggaag

SEQ ID NO: 162276 - DNA, 75 bp, Artificial Sequence
  Synthetic
ggtgcagaagacgaagagggcgggggcccctgggggctgtcgtcccacgacgcagtccttaggatcatggacgcc

SEQ ID NO: 162277 - DNA, 75 bp, Artificial Sequence
  Synthetic
acattgatggtggatgcgttggaagttgttgggactggtgtgacagttgtcccagtggatgtcaccgtggttgtg

SEQ ID NO: 162278 - DNA, 75 bp, Artificial Sequence
  Synthetic
ggtcgtagactggtttgtgctaggacccgatgccgacggtgatggtgtagtcacagccgttgtgcctgtcacgtt

SEQ ID NO: 162279 - DNA, 75 bp, Artificial Sequence
  Synthetic
cccgatgccgacggtgatggtgtagtcacagccgttgtgcctgtcacgttccccgccgaggccgtcgaactgcca

SEQ ID NO: 162280 - DNA, 75 bp, Artificial Sequence
  Synthetic
atgccgaggtaggggttatgaccacgctggagggccgtgcaggtatggtgtgggccggagttggatcttcatcct

SEQ ID NO: 162281 - DNA, 75 bp, Artificial Sequence
  Synthetic
acgtcgaggcatactgccggtccctgagggccggccaaacggcgcgcgcggatccggcctatgtccgcagcccct

SEQ ID NO: 162282 - DNA, 75 bp, Artificial Sequence
  Synthetic
cgcgggtctgggatgggacttacgccccgaaagcggcccagcagatccagggcccgttccaggctctccagcccc

SEQ ID NO: 162283 - DNA, 75 bp, Artificial Sequence
  Synthetic
gccatcgcgtctggacgcagaaggcctcccggcctcttttatagctagtctccacacccaatactctactgaacc

SEQ ID NO: 162284 - DNA, 75 bp, Artificial Sequence
  Synthetic
ggggaggttttgcgggggctagccctggggacggagagcgggctcttctcaccgtgctacctcagcctacgattt

SEQ ID NO: 162285 - DNA, 75 bp, Artificial Sequence
  Synthetic
cttctttctgggaatcacaaacgatgccgaggtaggggttatgaccacgctggagggctgtgcaggtatggcgtg

SEQ ID NO: 162286 - DNA, 75 bp, Artificial Sequence
  Synthetic
atcacatacatgacctcctcgaggtatgcagggaatgagcggtccgtgagccggtcaacacgacattgcttccgt

SEQ ID NO: 162287 - DNA, 75 bp, Artificial Sequence
  Synthetic
cttacatcgactttatgccccccgtaaaactccacagagtacgcgactgagggggtgcggagaggcgggacccgg

SEQ ID NO: 162288 - DNA, 75 bp, Artificial Sequence
  Synthetic
ttcagataggtgctctttatattctccaccagggggcccacaggggtgatgaagttgtggaagcggcggtcggcc

SEQ ID NO: 162289 - DNA, 75 bp, Artificial Sequence
  Synthetic
agttaggacccttgacggatgtctttaacggcgcggtgcagttggtcaccaatgacggcctaaaggccaacacat

SEQ ID NO: 162290 - DNA, 75 bp, Artificial Sequence
  Synthetic
taacggcgcggtgcagttggtcaccaatgacggcctaaaggccaacacatccttgaagcagggcgtaggaatggt

SEQ ID NO: 162291 - DNA, 75 bp, Artificial Sequence
  Synthetic
gtaccctttctaccaggggcgagcagcgcggcagaggcctctctcgagttctctagcaggtgcaccagctccagg

SEQ ID NO: 162292 - DNA, 75 bp, Artificial Sequence
  Synthetic
tgggccggagttggatcttcatcctcctcctctgaggatgaaatctctccatctgtggagtgttcttcgctgccc

SEQ ID NO: 162293 - DNA, 75 bp, Artificial Sequence
  Synthetic
cagactatgcatacactgaatttagcctgatattgtcccccgagccccgggcccagcctgggatcgaatgacaga

SEQ ID NO: 162294 - DNA, 75 bp, Artificial Sequence
  Synthetic
agtgatgatgcatcaccaccacagcactcgccaggaccctctgcatatcttgtacaaggcgcctttcaactcggc

SEQ ID NO: 162295 - DNA, 75 bp, Artificial Sequence
  Synthetic
actcgccaggaccctctgcatatcttgtacaaggcgcctttcaactcggccactggctctggtgacgttaaatgt

SEQ ID NO: 162296 - DNA, 75 bp, Artificial Sequence
  Synthetic
tgtacaaggcgcctttcaactcggccactggctctggtgacgttaaatgtcctgttcctattagtcacagcctgt

SEQ ID NO: 162297 - DNA, 75 bp, Artificial Sequence
  Synthetic
gccgggtggccgcctcggccaggttggcggtctcgcagagcgtgtagacgagcatcagggcctcgagtgcggcta

SEQ ID NO: 162298 - DNA, 75 bp, Artificial Sequence
  Synthetic
ccgccagcagccccgacatcgccgccccaggggtctctagacctcgagtccggggagaacggtggccagacggcg

SEQ ID NO: 162299 - DNA, 75 bp, Artificial Sequence
  Synthetic
gtgcagctacatgaagggcagccgcctcaaatccaccatgacccccatggctgtccgtgttgttggggtaataag

SEQ ID NO: 162300 - DNA, 75 bp, Artificial Sequence
  Synthetic
aaatcctgcattttttgtggctttgccctgctcagttatgatgaaaaggaaggcctggaaactacaacctacatc

SEQ ID NO: 162301 - DNA, 75 bp, Artificial Sequence
  Synthetic
tcccacatacccccccacgcttcaagggtttctatgcttggccggccaggccacctgccggggccagtggaatcc

SEQ ID NO: 162302 - DNA, 75 bp, Artificial Sequence
  Synthetic
accccgaagcaccttggcccccaccggcataaagctgggcaaaaagagtgggttaaaaccaaaggcgagtagggc

SEQ ID NO: 162303 - DNA, 75 bp, Artificial Sequence
  Synthetic
atgagcgcagggccgacaggtagccgctggagacgatgcgctcgtaggccgggctctgcgcgaaagcagagactc

SEQ ID NO: 162304 - DNA, 75 bp, Artificial Sequence
  Synthetic
ggcataaagctgggcaaaaagagtgggttaaaaccaaaggcgagtagggccaggaacgccaaatagcagcagtaa

SEQ ID NO: 162305 - DNA, 75 bp, Artificial Sequence
  Synthetic
aaccccagcaacatccggggcagcgccggtggggaaggcggcggaggccgagcagggactggcggcactgtgggt

SEQ ID NO: 162306 - DNA, 75 bp, Artificial Sequence
  Synthetic
ctctgcctctccatcatagacatcttccttgaatctcattctctcaccgcatacctcgctcttcatccaggaggg

SEQ ID NO: 162307 - DNA, 75 bp, Artificial Sequence
  Synthetic
cgacggggggcgtttgtcccccgctggcccctcgtacacatagtcgtaaaagagggcccctgagggctccaaaag

SEQ ID NO: 162308 - DNA, 75 bp, Artificial Sequence
  Synthetic
cggaaattggtgcccctctctgccctcctgacgaggccatggtgtcatccatctccgcagtccgttcttcagctt

SEQ ID NO: 162309 - DNA, 75 bp, Artificial Sequence
  Synthetic
caccgccgctttcttcaccctctcccccgccggccctgcccccactgtgctccaccagctccacggccatggcct

SEQ ID NO: 162310 - DNA, 75 bp, Artificial Sequence
  Synthetic
agagacgtccaggcccacgtccccggggtactgggggtggttcccagcacttctagcgaactgcggccccgctgg

SEQ ID NO: 162311 - DNA, 75 bp, Artificial Sequence
  Synthetic
atctccgcagtccgttcttcagctttggcattggtccgggtccgggtggtctgattttgattctgatcctgggta

SEQ ID NO: 162312 - DNA, 75 bp, Artificial Sequence
  Synthetic
agaaatttgcactttctttgcttcacgtccccgggagcgggagcgggcacgtcgggtggcgttggggtcgtttga

SEQ ID NO: 162313 - DNA, 75 bp, Artificial Sequence
  Synthetic
tccctcccgaggtcgtggggccggagccttataaaagacttccaccctctccccgctggccaagacacgccgctc

SEQ ID NO: 162314 - DNA, 75 bp, Artificial Sequence
  Synthetic
cctaacggcctgcctgcgccgcatgcgtcacaagatcaaagagattggggccccgctttttgacagcggcgtgta

SEQ ID NO: 162315 - DNA, 75 bp, Artificial Sequence
  Synthetic
gtggaccacgccatcttcctcccggctgattgtgtggctgacggtgccgtgttccaccgccacttgttcatcgac

SEQ ID NO: 162316 - DNA, 75 bp, Artificial Sequence
  Synthetic
catggtaccccctttatcttaaccagcaagtggccgtcagggtctcttgagagtatgccgctgtggccaagcgag

SEQ ID NO: 162317 - DNA, 75 bp, Artificial Sequence
  Synthetic
ggttgccaggcaccacatctatgacgttgctctcttcgtgggcccgggagcccccgtccacaaagagagccaggt

SEQ ID NO: 162318 - DNA, 75 bp, Artificial Sequence
  Synthetic
gctcatgccggataaggcctcggaccaggcgcatactggccctgggcagcagggtcaccatgatgcaaaagtaga

SEQ ID NO: 162319 - DNA, 75 bp, Artificial Sequence
  Synthetic
gccccctccggcccggcgtctaaatatttcccgggggtccgaattcacgcgggacgttcgtgggctggttgagga

SEQ ID NO: 162320 - DNA, 75 bp, Artificial Sequence
  Synthetic
agggccaactcgtagtggtgccccaggtatgaaacagagccaagatgcatgtgtacatcgagcatgtctgcgttc

SEQ ID NO: 162321 - DNA, 75 bp, Artificial Sequence
  Synthetic
atcaacggggacaagtttcagtacacgggggccatgacttctaaatttctgatgggcacctacaagcgagtgacc

SEQ ID NO: 162322 - DNA, 75 bp, Artificial Sequence
  Synthetic
gtgtacatcgagcatgtctgcgttcccgggagcctgcatgacaacccgggagtacacgttaaacaggagaatctt

SEQ ID NO: 162323 - DNA, 75 bp, Artificial Sequence
  Synthetic
ggggtcggggtcccacgtgtatggggccgggggctccatgcggattttcagctgctggacacgcacatgctcagc

SEQ ID NO: 162324 - DNA, 75 bp, Artificial Sequence
  Synthetic
gctggtcttgaattccgtcaaggcctcggagtcttcaagattgggtgggggcagcaggcgcagtaacgtgtcgcg

SEQ ID NO: 162325 - DNA, 75 bp, Artificial Sequence
  Synthetic
gcctgatctttggcaagacgaaggacctgccggatctgagggggccttttagttacccatccttaaccagtgccc

SEQ ID NO: 162326 - DNA, 75 bp, Artificial Sequence
  Synthetic
ctacacatcacaggccatcacggtcaccttcatgagtcagtgcttcgccggtcgctgtggggccaatcaaccgac

SEQ ID NO: 162327 - DNA, 75 bp, Artificial Sequence
  Synthetic
cggggggaggggggcacggatgagcccaatcctcgccacctgtgctcgtatagtaagctggagttccatctcccg

SEQ ID NO: 162328 - DNA, 75 bp, Artificial Sequence
  Synthetic
cacggtggcatgctctcgtccaaataccgggggcataacactgaggctcccggtcccatgccactggaaaaaggg

SEQ ID NO: 162329 - DNA, 75 bp, Artificial Sequence
  Synthetic
ccgggagcctgcatgacaacccgggagtacacgttaaacaggagaatcttctgcagcacctcctctgctatgggc

SEQ ID NO: 162330 - DNA, 75 bp, Artificial Sequence
  Synthetic
gtatcaaactgtccacgctaacctcatccagcacggccagggtgcaatcagacaggtagttgtacatggacacgt

SEQ ID NO: 162331 - DNA, 75 bp, Artificial Sequence
  Synthetic
atccagcacggccagggtgcaatcagacaggtagttgtacatggacacgtagtccgggaccgtctctagagagta

SEQ ID NO: 162332 - DNA, 75 bp, Artificial Sequence
  Synthetic
gcgctgaggccctggaccgagatccgacaagacacacaggaccagcgggacaagtgggagcctgaacaagtccag

SEQ ID NO: 162333 - DNA, 75 bp, Artificial Sequence
  Synthetic
ccaggggtaagatgcagccaatcctctgttgcatcttggcaatctcatcggtatacagacgagaggagagagaca

SEQ ID NO: 162334 - DNA, 75 bp, Artificial Sequence
  Synthetic
ctggtcctcggagtccagcagactcacgaggatgtagccgcaaaactgggacgagatcatccgggccttgacgtg

SEQ ID NO: 162335 - DNA, 75 bp, Artificial Sequence
  Synthetic
tgcgtagatgagcctctcaaaggccttggacttctcattagtcaggaggtacatgggccactgcaggctggacgt

SEQ ID NO: 162336 - DNA, 75 bp, Artificial Sequence
  Synthetic
tttccaaactttaatattcttcgtaccggcgccacctcttcaattatatagtgtccgtaatggatgggggcgtgg

SEQ ID NO: 162337 - DNA, 75 bp, Artificial Sequence
  Synthetic
acatgggccactgcaggctggacgtcttgtccttggtgtgcacgaaggcgcaggggagggggcaggattccccaa

SEQ ID NO: 162338 - DNA, 75 bp, Artificial Sequence
  Synthetic
gtgtccgtaatggatgggggcgtgggtctgtttgacagacataaactcatcgatgagtgcccgggaggaggctga

SEQ ID NO: 162339 - DNA, 75 bp, Artificial Sequence
  Synthetic
cgggcctgtggtcagcaaggccatccctcgcagcaccgtcaaggtgacggtgccccaggaggcctttgtggatct

SEQ ID NO: 162340 - DNA, 75 bp, Artificial Sequence
  Synthetic
tgccccaggaggcctttgtggatctggacgcgtggctctccggcggcgccgggggtggcggtggaggatgcttcg

SEQ ID NO: 162341 - DNA, 75 bp, Artificial Sequence
  Synthetic
gagtgcggggaatgcctcctgcagaaagctgcagggctgctccagaaacacgtcagtgccagcaatcactacaaa

SEQ ID NO: 162342 - DNA, 75 bp, Artificial Sequence
  Synthetic
gctaccttcacctcctccaagtgggggtgcagggtgacgatcgaggagacgagggccacgacgcaggtggcgatc

SEQ ID NO: 162343 - DNA, 75 bp, Artificial Sequence
  Synthetic
actcgttgaccatgttgtagagtcccctgttgttgcgcagaagctcctccttgttgaaaaatgcccggcaggggc

SEQ ID NO: 162344 - DNA, 75 bp, Artificial Sequence
  Synthetic
ccgcggccactgtcagatcatgaatatcttaagaatttattactcaccatccatcatgcaccgctatgctgtggt

SEQ ID NO: 162345 - DNA, 75 bp, Artificial Sequence
  Synthetic
gttggtataggccggatcaacgtacacgtagagggaggaggctaggcgtccggctactcgggggttgagggtgtc

SEQ ID NO: 162346 - DNA, 75 bp, Artificial Sequence
  Synthetic
actaagggctcctgctggtcagcaggggccgacaaaacaaatttttccggaaacaccctgtatgctatatggatt

SEQ ID NO: 162347 - DNA, 75 bp, Artificial Sequence
  Synthetic
ttcataggcggcatccgggcgagaatggtcatagatgagcccctcggcaacctcctgattgtagttttcacagga

SEQ ID NO: 162348 - DNA, 75 bp, Artificial Sequence
  Synthetic
tcaggctaccctggctcagcgaggaggtgtcacccatcagctcggtgctaaaggccccgtccagaaagaggttgg

SEQ ID NO: 162349 - DNA, 75 bp, Artificial Sequence
  Synthetic
ggagagttggacttttgaaaataagccacgtctgccgtgaccggtgttacgataatctcacaggtggcctgctgg

SEQ ID NO: 162350 - DNA, 75 bp, Artificial Sequence
  Synthetic
cagtggacacccaccacacagcatggcaacgaccaatcatgtcgagcatgagctcctctccaaattgattgatga

SEQ ID NO: 162351 - DNA, 75 bp, Artificial Sequence
  Synthetic
ccgtggcagagtcctggagctccattaacattagtcatacctgccaggtatgtcctggggtcccgaagcagcgtc

SEQ ID NO: 162352 - DNA, 75 bp, Artificial Sequence
  Synthetic
cattatatcggtgtaacgcagccacacgggcctctgggccctcacagtcggcaaacaggggccacgagtcgtagt

SEQ ID NO: 162353 - DNA, 75 bp, Artificial Sequence
  Synthetic
tgtcctgcatgtcaaaatcttgccgatgctcctgacacacataacttaccacgttcagcagccgctcctgagcat

SEQ ID NO: 162354 - DNA, 75 bp, Artificial Sequence
  Synthetic
taacattagtcatacctgccaggtatgtcctggggtcccgaagcagcgtcccattgcgctgagcgcccaccttgg

SEQ ID NO: 162355 - DNA, 75 bp, Artificial Sequence
  Synthetic
atgctcctgacacacataacttaccacgttcagcagccgctcctgagcatccttcagcttataaagaaagctggt

SEQ ID NO: 162356 - DNA, 75 bp, Artificial Sequence
  Synthetic
tcgagcccaaggccggccaggccctcctcaaagcctttctggtacatgaagctcctggggccacactcccggcta

SEQ ID NO: 162357 - DNA, 75 bp, Artificial Sequence
  Synthetic
acgctaaagaagtcttgggtgtggatacccatgtcagtagtgatggccgccaccctggccggcgtcatggtcgag

SEQ ID NO: 162358 - DNA, 75 bp, Artificial Sequence
  Synthetic
tctgaagcataaagcccaggatcgccggcagggcctccttcttgataaagttagcctcgtccacaaacaagaggt

SEQ ID NO: 162359 - DNA, 75 bp, Artificial Sequence
  Synthetic
ttggggaacccccttgccccataacctgtatgggctgcaaaacgggtgggtagaaaataggcgcccgcacaatct

SEQ ID NO: 162360 - DNA, 75 bp, Artificial Sequence
  Synthetic
tacccatgtcagtagtgatggccgccaccctggccggcgtcatggtcgagctataactaagcccggtgtcgatgg

SEQ ID NO: 162361 - DNA, 75 bp, Artificial Sequence
  Synthetic
taattcacagctggattattgcagctggacatgacacccatgaaacgcacgaaatctaaaaggttctcctcggtc

SEQ ID NO: 162362 - DNA, 75 bp, Artificial Sequence
  Synthetic
gtccgtaaacgtgggtcccgggggcagagacaaaaaagaggctagttgctcccagctcttaagagagagcagctt

SEQ ID NO: 162363 - DNA, 75 bp, Artificial Sequence
  Synthetic
cggcggctaacatttggggtcccaatgaacatggatgttgaggccctggagctaaacaatatgttttcagagagg

SEQ ID NO: 162364 - DNA, 75 bp, Artificial Sequence
  Synthetic
ttgctgagctgggaccccactgaccttccccggacggtggcccgcgtctacgtggcggtgggaggtctctttgag

SEQ ID NO: 162365 - DNA, 75 bp, Artificial Sequence
  Synthetic
tctaggcctgtggagcgctgctttgccatcaagaattatgtcccgggcctggactcacaaagctgtgtgacggtc

SEQ ID NO: 162366 - DNA, 75 bp, Artificial Sequence
  Synthetic
atctcatcggtcctgaccacggtcatggccacccctgggtggatcttgagcttggcctgggcaatataggccatg

SEQ ID NO: 162367 - DNA, 75 bp, Artificial Sequence
  Synthetic
tgccatttaccacgaaggaagcgtacctcggcttcccgagcgtatctttcttgctctcttggtccagcatggggt

SEQ ID NO: 162368 - DNA, 75 bp, Artificial Sequence
  Synthetic
taaaattgcagggaagcctgctccacagccgagccaaacagctccttgcccaggacacaggtgcgcccgtaggca

SEQ ID NO: 162369 - DNA, 75 bp, Artificial Sequence
  Synthetic
ctgctgagcttcccaccgttccagatgagaggcagccatctttatcttacggtcttcctctctggacactggtgt

SEQ ID NO: 162370 - DNA, 75 bp, Artificial Sequence
  Synthetic
tcattccactgattgaaacgagggaaggaagacattcggccgcgtatttgcccatgggcgagcggtgccactccc

SEQ ID NO: 162371 - DNA, 75 bp, Artificial Sequence
  Synthetic
cttcgacagagccggttcatgatcagctactgcctgccccaggacctgaccctcttgaaatccaaccactaacgt

SEQ ID NO: 162372 - DNA, 75 bp, Artificial Sequence
  Synthetic
aattctgatatttgcagctgggctaatgatgtccaccaagaacaagcccctggacgaagccctgctcacgaatgc

SEQ ID NO: 162373 - DNA, 75 bp, Artificial Sequence
  Synthetic
ccgacatgaccagccccacctcagcagtgactaccccaaccccaaatgccaccagccccaccccagcagtgacta

SEQ ID NO: 162374 - DNA, 75 bp, Artificial Sequence
  Synthetic
atgatgtccaccaagaacaagcccctggacgaagccctgctcacgaatgccgtcacgcgagacccatcgctttac

SEQ ID NO: 162375 - DNA, 75 bp, Artificial Sequence
  Synthetic
cccatgggcgagcggtgccactcccggtactctgcaaagagctgctctggccggttgaaggcttccacggcccgc

SEQ ID NO: 162376 - DNA, 75 bp, Artificial Sequence
  Synthetic
aaatgtgcagcttctccagcgtcatttcttccaacccgaaagcactttgaaagatgtcaaacatggtgtctgtaa

SEQ ID NO: 162377 - DNA, 75 bp, Artificial Sequence
  Synthetic
ttctgtgttgttgcgagaaaatgagccatgactagcgcaaccaacacgtcgtcagagaggttgcgctgcttgccg

SEQ ID NO: 162378 - DNA, 75 bp, Artificial Sequence
  Synthetic
ctcggagaaggcaaaggccaccagcccgttcaccaaaacagtctgctctgtccgcttgtcggcgggattcggggc

SEQ ID NO: 162379 - DNA, 75 bp, Artificial Sequence
  Synthetic
aaaggatagcactcccactctactactgggtatcatatgctgactgtatatgcatgaggatagcatatgctaccc

SEQ ID NO: 162380 - DNA, 75 bp, Artificial Sequence
  Synthetic
ccatgactagcgcaaccaacacgtcgtcagagaggttgcgctgcttgccggtgtaggtgtaggtcccgtcgcgga

SEQ ID NO: 162381 - DNA, 75 bp, Artificial Sequence
  Synthetic
aagtggggcaggtcatgaatgaggcgctgaggtccctgatcatgcccacggtggggcggaggtcggagatctcca

SEQ ID NO: 162382 - DNA, 75 bp, Artificial Sequence
  Synthetic
caccacagctatgatgccagacctgtaaaacctcaagattggcacgctaacggccggaatgcggcagaggctaag

SEQ ID NO: 162383 - DNA, 75 bp, Artificial Sequence
  Synthetic
gaaaaggccctaattcagccacctcccccgtggccgacttctggaacatttgaggaggcacacaaaatgaggaac

SEQ ID NO: 162384 - DNA, 75 bp, Artificial Sequence
  Synthetic
tatgctacccagatatagattaggatagcctatgctacccagatataaattaggatagcatatactacccagata

SEQ ID NO: 162385 - DNA, 75 bp, Artificial Sequence
  Synthetic
gctgaggtccctgatcatgcccacggtggggcggaggtcggagatctccagcagatccctgagcgtcccattctc

SEQ ID NO: 162386 - DNA, 75 bp, Artificial Sequence
  Synthetic
cggccggaatgcggcagaggctaagcgccgccgccagcgagtccgctgctaccgagcagacaacgtgggcctcaa

SEQ ID NO: 162387 - DNA, 75 bp, Artificial Sequence
  Synthetic
gcccgttgtaggccagggtctgggccacgtgctgaaagtccaccccgaggccgcacatgtgggcattggtgcagg

SEQ ID NO: 162388 - DNA, 75 bp, Artificial Sequence
  Synthetic
cacagggccagtgaaggcctcgtatggacccacactcagaggcttgtagtctagggtgaggcaggcctccccaga

SEQ ID NO: 162389 - DNA, 75 bp, Artificial Sequence
  Synthetic
ctagggtgaggcaggcctccccagaagtatacgtggtgacgtagagatccggattgagtgtcaccttaacgccgc

SEQ ID NO: 162390 - DNA, 75 bp, Artificial Sequence
  Synthetic
gccacctggtgagcggtgtgcgggctgccgtctctatcagacgcgttatggcacgccggctgcccaagcccaccc

SEQ ID NO: 162391 - DNA, 75 bp, Artificial Sequence
  Synthetic
gctcgttcctcagcctgtcgctggccgggggcatatagggcatcagggcgcaggtgtggtggctcttggacacct

SEQ ID NO: 162392 - DNA, 75 bp, Artificial Sequence
  Synthetic
gggcgcggccagggtgtcagcgtaaacctcatttccgataataatctggggggcccggtcactaacggtgagaag

SEQ ID NO: 162393 - DNA, 75 bp, Artificial Sequence
  Synthetic
atgattccatggtgggtctgaaaatatgcaaaatttctacctcatctaaaattgtcatgacttatcactgccccc

SEQ ID NO: 162394 - DNA, 75 bp, Artificial Sequence
  Synthetic
tgtttccaaccctctcaataaactggggcgcggccagggtgtcagcgtaaacctcatttccgataataatctggg

SEQ ID NO: 162395 - DNA, 75 bp, Artificial Sequence
  Synthetic
atgggtgaaaatgtctgtgtaggccaccggggggagcaggttagggtccaggagtgcgcagacatactgacccac

SEQ ID NO: 162396 - DNA, 75 bp, Artificial Sequence
  Synthetic
cgggggcatatagggcatcagggcgcaggtgtggtggctcttggacaccttatcatcatattccatagtgagctt

SEQ ID NO: 162397 - DNA, 75 bp, Artificial Sequence
  Synthetic
aagcctgctccacagccgagccaaacagctccttgcccaggacacaggtgcgcccgtaggcaaggtttctgaatg

SEQ ID NO: 162398 - DNA, 75 bp, Artificial Sequence
  Synthetic
ggccagctccgcgtacagcttcctatccttcctcagggaggccttgatgagccggcagaggaccagggctggcaa

SEQ ID NO: 162399 - DNA, 75 bp, Artificial Sequence
  Synthetic
tccctttcctgtttagcagttcctccgcactccagagtctgctgttgcccccggctgacattctccaagataacg

SEQ ID NO: 162400 - DNA, 75 bp, Artificial Sequence
  Synthetic
ggcggcagatgaacttgatcatggaaaagctgttcacaaaggcaagcctccctgcccgttcccagtaggtgttga

SEQ ID NO: 162401 - DNA, 75 bp, Artificial Sequence
  Synthetic
ccatagtttacagacagaaggtttacctgcagcactcctcccttgagatgagtctgggcatggtcatagcacttg

SEQ ID NO: 162402 - DNA, 75 bp, Artificial Sequence
  Synthetic
gacaggacggctagggccttggtcttaaagcggagagtctgagtggtttccatgatcacaagcagcagcagaagc

SEQ ID NO: 162403 - DNA, 75 bp, Artificial Sequence
  Synthetic
ggcagtatcctgcacagtctcaataacggcctgatccaccacgtgggccagagatgtggcggtctcaaactgctg

SEQ ID NO: 162404 - DNA, 75 bp, Artificial Sequence
  Synthetic
tttctttccgcgggggtggccctcggtggtgggctgctgagggttggtgtcctcccggggtccagagttcccggc

SEQ ID NO: 162405 - DNA, 75 bp, Artificial Sequence
  Synthetic
acggcctgatccaccacgtgggccagagatgtggcggtctcaaactgctgcccccgggcctcttggaatgcagct

SEQ ID NO: 162406 - DNA, 75 bp, Artificial Sequence
  Synthetic
tccagaggtggacctaaggtcaaacgaccccctatatttataagacgtctgcacaggttgctgctgatgagagcg

SEQ ID NO: 162407 - DNA, 75 bp, Artificial Sequence
  Synthetic
cggaactctcttgctcaaagaaattagtttgcttgatgctagtcatgtaggtgagcgggcagtccttggggggtg

SEQ ID NO: 162408 - DNA, 75 bp, Artificial Sequence
  Synthetic
agtttgcttgatgctagtcatgtaggtgagcgggcagtccttggggggtggtgtgccatacaagggagcctgacc

SEQ ID NO: 162409 - DNA, 75 bp, Artificial Sequence
  Synthetic
aatgtcacccaggatgcgatcggccgtggcctccagaaactgctttatggctcgcacatccaccaaggtaacccc

SEQ ID NO: 162410 - DNA, 75 bp, Artificial Sequence
  Synthetic
tcggtgggcagcccgcacttgagagctatatctgtcacgggggctgcatacttgttatcatagaactcgtccaca

SEQ ID NO: 162411 - DNA, 75 bp, Artificial Sequence
  Synthetic
gccctgatctgggagatgagatagaggaccggatcgaaggagagctggatggtgttggagacggtgacctgactg

SEQ ID NO: 162412 - DNA, 75 bp, Artificial Sequence
  Synthetic
cttgttatcatagaactcgtccacaataacaagcacattcatgtgattgggcctcctgtgttgcagggagtaggt

SEQ ID NO: 162413 - DNA, 75 bp, Artificial Sequence
  Synthetic
acagctcctggatccaggtggcccttggtcggtcagccttggctgtcatgctattgtataacagggaggcagcgc

SEQ ID NO: 162414 - DNA, 75 bp, Artificial Sequence
  Synthetic
ccgcggcaggaggccccgcggcaggaggcccagtatccgaaggactcacggtgggaggcgcggctcgtttttgac

SEQ ID NO: 162415 - DNA, 75 bp, Artificial Sequence
  Synthetic
gccgcgttgaggctgtttagggtatgggcgggtgtgtggagtcgggggtgacagagaaccttgagagcattctgt

SEQ ID NO: 162416 - DNA, 75 bp, Artificial Sequence
  Synthetic
gtcgtacacaacacacgctccccttctcctacgggaaggcggtggcgtaggcttgactggaaccggtttgggcac

SEQ ID NO: 162417 - DNA, 75 bp, Artificial Sequence
  Synthetic
acagagaaccttgagagcattctgtaggttaaacgcgaggagaaggttattcttgtttacgatccatgcctccac

SEQ ID NO: 162418 - DNA, 75 bp, Artificial Sequence
  Synthetic
ctattgtataacagggaggcagcgcgggtgtggagcagctcatccctacttatgtagttattggccaggcagatg

SEQ ID NO: 162419 - DNA, 75 bp, Artificial Sequence
  Synthetic
aggaacacaagaatcttctccggcagggtgacggcggccgccaccttgtcacggagccaggaaatcttggcttgc

SEQ ID NO: 162420 - DNA, 75 bp, Artificial Sequence
  Synthetic
tgtacttgggattgggcataaacaggcccactgggaaatagtagctgtactgcattcttctgttgagggggtatg

SEQ ID NO: 162421 - DNA, 75 bp, Artificial Sequence
  Synthetic
ttgcaggctttccacggccaccgcgtggttgcccagcttgatgacggcggctgagatcggcacccggggctgatc

SEQ ID NO: 162422 - DNA, 75 bp, Artificial Sequence
  Synthetic
gtccccatcaaagagcatgtttaaaatgttagcataagtctccccgtggacgttctccatggccttctgctcggt

SEQ ID NO: 162423 - DNA, 75 bp, Artificial Sequence
  Synthetic
gtagtagtgatcaatgtcgtggctctcgaagctggtgaccagttcatcaatgttaaagttcacaagcttctcggc

SEQ ID NO: 162424 - DNA, 75 bp, Artificial Sequence
  Synthetic
tttccggtgagtccacgatcctagccatgaaatgctcaaacgtacgcatcacgcgcccgtagctcacggcagtga

SEQ ID NO: 162425 - DNA, 75 bp, Artificial Sequence
  Synthetic
tgttaaagttcacaagcttctcggccatggccaggaacgtaaagaggaacttgtaaaactccaagtccctctcat

SEQ ID NO: 162426 - DNA, 75 bp, Artificial Sequence
  Synthetic
caactggggtgtgcgcgggggcggccaagccggaccccagggcgggtgcctgggggatgggaaggccggacggcg

SEQ ID NO: 162427 - DNA, 75 bp, Artificial Sequence
  Synthetic
ggggacacctgcacgagacccctgggctctcaggaactccgcccaggtctcgccaattggggtgatcctgtagcg

SEQ ID NO: 162428 - DNA, 75 bp, Artificial Sequence
  Synthetic
gcctcactctcgagatggtacacgtcctggagcgtgctttgctagagcagcagtcctctgcctgcggcctgcccg

SEQ ID NO: 162429 - DNA, 75 bp, Artificial Sequence
  Synthetic
ccgttaggcaggcaaagccctcatgatcacgcacgtacaacaacttggacatggcaataaacgtttattggcaag

SEQ ID NO: 162430 - DNA, 75 bp, Artificial Sequence
  Synthetic
gttgtcggtgacaataaacaccccccccactggctctccccccttggcggtcgtgtaggtactgacccccttgag

SEQ ID NO: 162431 - DNA, 75 bp, Artificial Sequence
  Synthetic
acaaccccggtatgaggatcctgacgctcctctggatttaagtttacatccagacgttgctgataccaggagccg

SEQ ID NO: 162432 - DNA, 75 bp, Artificial Sequence
  Synthetic
tcgtgtaggtactgacccccttgagcacgctctccccggacacggccgctaccatctcagagagacggcttcgca

SEQ ID NO: 162433 - DNA, 75 bp, Artificial Sequence
  Synthetic
ggccccgcggcaggagagcgatgaggacaccggtagacagggttcggacgtggagctagggtggggtgggcgggc

SEQ ID NO: 162434 - DNA, 75 bp, Artificial Sequence
  Synthetic
gtcagtctccaacagatcatcctctgagaagagctgacggtacttatagcacacttccaatcccccgggcacaca

SEQ ID NO: 162435 - DNA, 75 bp, Artificial Sequence
  Synthetic
cacgctctccccggacacggccgctaccatctcagagagacggcttcgcacgtactgagaaaacccggagcccat

SEQ ID NO: 162436 - DNA, 75 bp, Artificial Sequence
  Synthetic
catgcgtgataaatcatccgccactgacaggtcatccaggtctatccgggctatctcatcctctcctgtttaacg

SEQ ID NO: 162437 - DNA, 75 bp, Artificial Sequence
  Synthetic
ttgtgcttctgccttatcagatctatcagaggtcttaacatttgtgcgcttcactgggtgcgtcttgggcgtggg

SEQ ID NO: 162438 - DNA, 75 bp, Artificial Sequence
  Synthetic
ggataaacatgggaggggcgtggcgaagcttcacactcaggacggtgttaatgaggcccctctccagggcatcga

SEQ ID NO: 162439 - DNA, 75 bp, Artificial Sequence
  Synthetic
gtacacatgcatcttggctctgtttcatacctggggcaccactacgagttggccctcccggaggtgccggggccc

SEQ ID NO: 162440 - DNA, 75 bp, Artificial Sequence
  Synthetic
cctggtatccctggtatggagcctggggggccggcggctcctggtatccgacatggccaggatcaggtctcccag

SEQ ID NO: 162441 - DNA, 75 bp, Artificial Sequence
  Synthetic
tgatagtcttcaggcccagctcgtagctgcgcaccagtaggttggctagcgtgctggcccgcgcggcatcttcct

SEQ ID NO: 162442 - DNA, 75 bp, Artificial Sequence
  Synthetic
cttggcttggccctgctggacaatctgagtctctacttttgcatcatggtgaccctgctgcccagggcaagtatg

SEQ ID NO: 162443 - DNA, 75 bp, Artificial Sequence
  Synthetic
gtgctggcccgcgcggcatcttcctcacgcaaaaacaggctgtgagattggctctggtccacaaagggggccctg

SEQ ID NO: 162444 - DNA, 75 bp, Artificial Sequence
  Synthetic
tactatgcaggatctccagatccagcatggacagttccatttccgtactaatgtggtgtttgtggcaatttttga

SEQ ID NO: 162445 - DNA, 75 bp, Artificial Sequence
  Synthetic
catggacagttccatttccgtactaatgtggtgtttgtggcaatttttgaccacaatgaatgtccgctgcttgct

SEQ ID NO: 162446 - DNA, 75 bp, Artificial Sequence
  Synthetic
tcccgggacatctgaatcaggtcctcctggttgtaatcaaaggccgtttggaaacgcaggtagcgctgccgcaga

SEQ ID NO: 162447 - DNA, 75 bp, Artificial Sequence
  Synthetic
acactccatcacccccagatcggcggccttctcaatgcgacaatagtacatgatagtcttcaggcccagctcgta

SEQ ID NO: 162448 - DNA, 75 bp, Artificial Sequence
  Synthetic
ccccaaactgtagggccgaggccacggtcttgacagcccccacgtactctgcgtactcgaccggggtctcgggga

SEQ ID NO: 162449 - DNA, 75 bp, Artificial Sequence
  Synthetic
gaatcttgccatccgtcatacgactcaggtctttgaattccgtgttcacacaggacacggccagtgccgtctcca

SEQ ID NO: 162450 - DNA, 75 bp, Artificial Sequence
  Synthetic
gtcatccagacgcacatgacgccaaaaagaccggtttggcctaagggcctcctccttgttggtgaccttggtgga

SEQ ID NO: 162451 - DNA, 75 bp, Artificial Sequence
  Synthetic
cctccttgttggtgaccttggtggacgcattggcatagaaggggtagaaggcgtccgaacagcccgtcacctggg

SEQ ID NO: 162452 - DNA, 75 bp, Artificial Sequence
  Synthetic
tctcctgtgcttcagcagtagcttgggaacaccgggcgggtccgtgagaactttcttctactcgaggcctttttg

SEQ ID NO: 162453 - DNA, 75 bp, Artificial Sequence
  Synthetic
ggtggggctggtggcatttggggttggggtagtcactgctgaggtggggctggtcatgtcgggggccttactttc

SEQ ID NO: 162454 - DNA, 75 bp, Artificial Sequence
  Synthetic
ccgtgagtggcaagggcttcttcagagggagctggctcttgacggtgaggggatccaggtgaaggcaggcgtcct

SEQ ID NO: 162455 - DNA, 75 bp, Artificial Sequence
  Synthetic
aacttgatgcccgcctctctggcatccttgcccaccagcaggtcaaagctatgaaacagcccctcggccgctgac

SEQ ID NO: 162456 - DNA, 75 bp, Artificial Sequence
  Synthetic
tgccgcaggttcgagagcaggtcggcatccaccgtcagataggggaagggtctgttttccacaccctcatttgag

SEQ ID NO: 162457 - DNA, 75 bp, Artificial Sequence
  Synthetic
tgggtggggcgtccgggcgctccacgaagccgcagacgtatacagacggtgcctgcaccattgtgcccgctatgt

SEQ ID NO: 162458 - DNA, 75 bp, Artificial Sequence
  Synthetic
aaggtctgttcctgcccaatcgtgccagtgaaaccaccccccagcatacttgctctgtttgaaacccggaaaaat

SEQ ID NO: 162459 - DNA, 75 bp, Artificial Sequence
  Synthetic
catccaccgtcagataggggaagggtctgttttccacaccctcatttgaggccatgacacaaggtaagagggaga

SEQ ID NO: 162460 - DNA, 75 bp, Artificial Sequence
  Synthetic
cttcctggtgtgaagtccaatcagactactggtgcagagggccgtaaagtacatatgttcgaatatttccttgtt

SEQ ID NO: 162461 - DNA, 75 bp, Artificial Sequence
  Synthetic
acatatgttcgaatatttccttgtttaacgagcgagagggagggtcagtgtactgccagcccaggtccgcaaaga

SEQ ID NO: 162462 - DNA, 75 bp, Artificial Sequence
  Synthetic
aatcaaatggttggacacggccctgggcagggaggccaccttttacgcgtgtcgggctatgcgtcgtcttctact

SEQ ID NO: 162463 - DNA, 75 bp, Artificial Sequence
  Synthetic
gcccatggaggccatatccctggaatcataagtgggggatccctgaagaatggagcaggccaccacaaaggtggc

SEQ ID NO: 162464 - DNA, 75 bp, Artificial Sequence
  Synthetic
ggccgtgccaagacccgagacagtaatgtcaaatgtccgattgctcgcaaatgcaccagaaatattttcacaacc

SEQ ID NO: 162465 - DNA, 75 bp, Artificial Sequence
  Synthetic
tggagcaggccaccacaaaggtggcacactgggtggcatctctgaggcgggctagcgagaatccatcaccgactg

SEQ ID NO: 162466 - DNA, 75 bp, Artificial Sequence
  Synthetic
ctgcccaccctgaccacgctgcccacctcccggtgcccagggtcatcacatacaccgactgcccgggttccataa

SEQ ID NO: 162467 - DNA, 75 bp, Artificial Sequence
  Synthetic
gagacgagggagggccagcaggagttcatccccctgcgtgtcggcccgctgtgcccgcaccgccagaggcgcatt

SEQ ID NO: 162468 - DNA, 75 bp, Artificial Sequence
  Synthetic
tacaccgactgcccgggttccataagcacgagctcaatgtttcgccttatcatccgctacttgtctcatcaccaa

SEQ ID NO: 162469 - DNA, 75 bp, Artificial Sequence
  Synthetic
agattccattccactcttgtcttcctcctcgtcgctttcagcttcaatttcctcactttcgtcgtcatcctcaac

SEQ ID NO: 162470 - DNA, 75 bp, Artificial Sequence
  Synthetic
tcatccccctgcgtgtcggcccgctgtgcccgcaccgccagaggcgcattcaccaggcagcgcgggaggcagatg

SEQ ID NO: 162471 - DNA, 75 bp, Artificial Sequence
  Synthetic
tttgagcgctgcttcgagcagttctgccgcgtggtcccgcgtcgcttcctagggacctgtaagcaaaactctgca

SEQ ID NO: 162472 - DNA, 75 bp, Artificial Sequence
  Synthetic
acggcgcagttgacgatagagaacatcagggacttgatggagacccgcccacaaaacttgcccgccgtcaccagc

SEQ ID NO: 162473 - DNA, 75 bp, Artificial Sequence
  Synthetic
ggtggcggagtctggcaacgcccgggtccttgctacctgtgtggtgtgtgaagggctgggtaaaggtgtctgcca

SEQ ID NO: 162474 - DNA, 75 bp, Artificial Sequence
  Synthetic
acaaaacttgcccgccgtcaccagccgatagtactcgcgctcaaactcctccccgtagagcctctccaggtcccc

SEQ ID NO: 162475 - DNA, 75 bp, Artificial Sequence
  Synthetic
ccgcgtgtataggcctgcttcacaaagtcgcgcaggtagtcctgaaacgcgaccgggccctccagcgggcgcaat

SEQ ID NO: 162476 - DNA, 75 bp, Artificial Sequence
  Synthetic
agggccgccaccaacctcacccaccacccacatctagtggacactctgtaccacgcctctccgcagaccccattt

SEQ ID NO: 162477 - DNA, 75 bp, Artificial Sequence
  Synthetic
ggaactggctcagcttggggccacaggggaggccaggtagcccagcgtcaggaagtacaaccggtcgtagtcatc

SEQ ID NO: 162478 - DNA, 75 bp, Artificial Sequence
  Synthetic
acctggagatcattctacagagtaacggcggagggaggcctgcgagcttccagttcccctcctccccaaccggcg

SEQ ID NO: 162479 - DNA, 75 bp, Artificial Sequence
  Synthetic
cggtgggtggaccggcgatgcggtggcgggtgaggcggcgcgcgtcttccccgtcgtcgctgccgcgggtggttg

SEQ ID NO: 162480 - DNA, 75 bp, Artificial Sequence
  Synthetic
cgtagttgtggtactccacgtggctgttgatcatcctcatcaggaggctgatgtgtttcccatcctggccagccc

SEQ ID NO: 162481 - DNA, 75 bp, Artificial Sequence
  Synthetic
ccgtcacccctacacccaccccggctcgctgaaagaggtagcgccccaggtgcctatagagggcctgggtcacgt

SEQ ID NO: 162482 - DNA, 75 bp, Artificial Sequence
  Synthetic
agggcatgccccccctcccggaggctggactcctgaccagcctgtaggtgaggaccgagtccgacaggaggtctc

SEQ ID NO: 162483 - DNA, 75 bp, Artificial Sequence
  Synthetic
gccggccaccccccgccggagcggggcagcggacccagcggacccggtgggccacccggccgccccccgagctcc

SEQ ID NO: 162484 - DNA, 75 bp, Artificial Sequence
  Synthetic
gaagggaagatggggcacctaaggacccccctctgggaccgtttggacacccccgggggcccggcccggccaaga

SEQ ID NO: 162485 - DNA, 75 bp, Artificial Sequence
  Synthetic
ccatgaaaatacatccagattaaaatggccataaacaggaggagccaaaggagatcaaccaatagagtccaccag

SEQ ID NO: 162486 - DNA, 75 bp, Artificial Sequence
  Synthetic
ccccgggggcccggcccggccaagagcgaagacgaggagtctgagcgtcgagacgcccctccacccccgctcgat

SEQ ID NO: 162487 - DNA, 75 bp, Artificial Sequence
  Synthetic
aggcaagaacgcagccagaggcccctgcccaacaaaccgtggtttgacatgagtctggttaagcctgtctccaag

SEQ ID NO: 162488 - DNA, 75 bp, Artificial Sequence
  Synthetic
ccgggctggcagaagaggcccttgtgtctacaccggtggccctcggtggtgtctgcatggtggcgggtgcccact

SEQ ID NO: 162489 - DNA, 75 bp, Artificial Sequence
  Synthetic
ggctaggatgaaggccaaaagctgccagatggtggcaccaagccgccagaggatctccaagaagtagatccagag

SEQ ID NO: 162490 - DNA, 75 bp, Artificial Sequence
  Synthetic
attacatttgtcaccttgcccagccccctggcctctctgaccctagagcccatccaagacccgttcctacagtcg

SEQ ID NO: 162491 - DNA, 75 bp, Artificial Sequence
  Synthetic
ggatctccaagaagtagatccagagacctaagactgcgttgaaaaaaagagtgttagggctggaaaggtgagggt

SEQ ID NO: 162492 - DNA, 75 bp, Artificial Sequence
  Synthetic
tgcccgtggggcctgggtttcgcctgcttgtgttcaacaccaatcgggtgatcaacactaaattggtgtgctcag

SEQ ID NO: 162493 - DNA, 75 bp, Artificial Sequence
  Synthetic
acctaagactgcgttgaaaaaaagagtgttagggctggaaaggtgagggtgtggtaaataagtcctagggaatgt

SEQ ID NO: 162494 - DNA, 75 bp, Artificial Sequence
  Synthetic
caatgtcccccgcctcatcaacaactttgtagcccgcaagtacgtggtgaaagagacggcgttcaccgtcagtct

SEQ ID NO: 162495 - DNA, 75 bp, Artificial Sequence
  Synthetic
acccagacacgagctgcgcaggagctacaagacactacgtgagtttttcaccaagtcaaccaacaaggacacatg

SEQ ID NO: 162496 - DNA, 75 bp, Artificial Sequence
  Synthetic
ccaagtcaaccaacaaggacacatggctggatgcacgcatgcaggcgatccagaacgcggggctctgcaccctgg

SEQ ID NO: 162497 - DNA, 75 bp, Artificial Sequence
  Synthetic
aacctagccatcaatgtcaatatcagtggcacctatctgagcttcctattggccatgacgtcactgcggtgcttc

SEQ ID NO: 162498 - DNA, 75 bp, Artificial Sequence
  Synthetic
gctggatgcacgcatgcaggcgatccagaacgcggggctctgcaccctggtggccatgctagaagagaccatctt

SEQ ID NO: 162499 - DNA, 75 bp, Artificial Sequence
  Synthetic
atctgaccctccgcattcaagtatctatgttgggtgcaaaaggccaacccagccctggtgagggaacacgaccac

SEQ ID NO: 162500 - DNA, 75 bp, Artificial Sequence
  Synthetic
ctgcctgtagaggctatttatcccgcggccgtgtcaaactggaactcgactctagatctccatgggctggaaaat

SEQ ID NO: 162501 - DNA, 75 bp, Artificial Sequence
  Synthetic
tctagatctccatgggctggaaaatcagagcctagtcagagagaaccgaagcggggtcttttggactaccaactt

SEQ ID NO: 162502 - DNA, 75 bp, Artificial Sequence
  Synthetic
aagacatcctcctggcctgcgccatgagtcttagcaaggtgatcctgaccaagctcaaagagctggcaccctgct

SEQ ID NO: 162503 - DNA, 75 bp, Artificial Sequence
  Synthetic
cagagcctagtcagagagaaccgaagcggggtcttttggactaccaactttccctcggtggtgtcctgccaggac

SEQ ID NO: 162504 - DNA, 75 bp, Artificial Sequence
  Synthetic
ctgaagataaagatgatgagaatgataataataagcatgagagcaaaggaatagaggacaaggagcgctcctcca

SEQ ID NO: 162505 - DNA, 75 bp, Artificial Sequence
  Synthetic
ctttgtgaagcaactcttctacatcacctgtgccacggcccgtcaaaacaaggtggtggagaccctgagcagctc

SEQ ID NO: 162506 - DNA, 75 bp, Artificial Sequence
  Synthetic
ataagttctaggcaaacctccaatcaccagccaccttccaatgtagtctcttagagagtggctgctacgcattag

SEQ ID NO: 162507 - DNA, 75 bp, Artificial Sequence
  Synthetic
gcacgggcggacattggagcagcacctgatccgtgaaatcacccccatcgtgacgcatcgagaggcaaaaatctc

SEQ ID NO: 162508 - DNA, 75 bp, Artificial Sequence
  Synthetic
gccagaacagtagcgccaagagcaggagaaggagagcaaggcctatggaagaggagagggggggtcctagagggg

SEQ ID NO: 162509 - DNA, 75 bp, Artificial Sequence
  Synthetic
gccgtggcgggcccggtgggcccctctcaaggtcgcgttccatggtcagggtagtgtggcaggagcaaggcaact

SEQ ID NO: 162510 - DNA, 75 bp, Artificial Sequence
  Synthetic
cagcctacattaacgccaactgcagacggagacacgatgaagttgaattcctgggccactacatcaagaattaca

SEQ ID NO: 162511 - DNA, 75 bp, Artificial Sequence
  Synthetic
ccggattaaaaaccggctctttaccctgctagagctacgcaatcggagtcagattcaagtgctgcacaagcgttt

SEQ ID NO: 162512 - DNA, 75 bp, Artificial Sequence
  Synthetic
ctgggccactacatcaagaattacaaccctggcacgctaagctcccttttgacagaggccgtggagactcacaca

SEQ ID NO: 162513 - DNA, 75 bp, Artificial Sequence
  Synthetic
cctggaaggcctgctagactgcgcctccctcctgcgcctggatcccagctgtatcaaccgaatcgcctccgaggg

SEQ ID NO: 162514 - DNA, 75 bp, Artificial Sequence
  Synthetic
gtgatgtgtgtttttacccatcacacaacaacaaggtaagtaatttgttgccgttggtttcagcgcatcgacaca

SEQ ID NO: 162515 - DNA, 75 bp, Artificial Sequence
  Synthetic
acagaggcttatgtaggccgcctacgagagagtaacgcgtgtttctggggatggaggcccggggggatttgcggg

SEQ ID NO: 162516 - DNA, 75 bp, Artificial Sequence
  Synthetic
gccgacttgtcagggccattctctctccggccactggatcactaggactgttttttgttcctggattaaatcaat

SEQ ID NO: 162517 - DNA, 75 bp, Artificial Sequence
  Synthetic
ttaccagcccaccaaaaaatgcaaccagtgatgttaccacaggccaacataacagaacttcaagttcaacctctt

SEQ ID NO: 162518 - DNA, 75 bp, Artificial Sequence
  Synthetic
gtctgccggaggcagtacgggcgccgctttcccgaaagcggcgtagtgtgtgtgcatgtaagcgttaaaagagga

SEQ ID NO: 162519 - DNA, 75 bp, Artificial Sequence
  Synthetic
cgcattttggcatccaaatgtggcagttaacatgatgctgtcagccccaaccctgttaggcacgggagttaatgt

SEQ ID NO: 162520 - DNA, 75 bp, Artificial Sequence
  Synthetic
gaacctcggcgatgtcacgctgttcatccttgggggagtagtagcttagcagctctaagaaataagccagcttct

SEQ ID NO: 162521 - DNA, 75 bp, Artificial Sequence
  Synthetic
gtaaacgagcgcaagacccgcctggacatactgggccgtaacgctaactttttaacgaggtgtaagcatcaggtt

SEQ ID NO: 162522 - DNA, 75 bp, Artificial Sequence
  Synthetic
aaaagcgagtccccgaggggcaagctgtgggaatgcggtggtaaagcgtagcaggaaatggaaaggcagtgcggc

SEQ ID NO: 162523 - DNA, 75 bp, Artificial Sequence
  Synthetic
gactgcgaaaattcagtcatatcggacgcctcacgcgaagggaaacgtgggaggcgaatgtagcccctaggcctg

SEQ ID NO: 162524 - DNA, 75 bp, Artificial Sequence
  Synthetic
cgctctcatcccccacaacatctgacccggccaggcgcatcagggcctgctctagggctataagttccccataga

SEQ ID NO: 162525 - DNA, 75 bp, Artificial Sequence
  Synthetic
aatgttaggtctgctttagggctgccaggtggcgcaatctaggattaattcacctgtatccctttccctccaccc

SEQ ID NO: 162526 - DNA, 75 bp, Artificial Sequence
  Synthetic
agaccctggcggatcccaccttcactgagagggggttctccaagactgtcaagtctgacctcattgccatgttca

SEQ ID NO: 162527 - DNA, 75 bp, Artificial Sequence
  Synthetic
aggccctggaaacagttccacatccacaaaaccgggggaggttaatgtcaccaaaggcacgccccccaaaaatgc

SEQ ID NO: 162528 - DNA, 75 bp, Artificial Sequence
  Synthetic
ttgttggcttgtgttagtgctatgtaatgcgttgccgccaggtggcagcctgtttatagatgtgcagtacccctt

SEQ ID NO: 162529 - DNA, 75 bp, Artificial Sequence
  Synthetic
gtgtaagcagcccggggcccgcttcattcacggggccgtgcacctgccatcgggacagattgtcttccacaccat

SEQ ID NO: 162530 - DNA, 75 bp, Artificial Sequence
  Synthetic
cgtcgaatgtcctgaagacgctgcctggctgccatcacgaagcacaagatgtgttgtgtgtctaacccactatcg

SEQ ID NO: 162531 - DNA, 75 bp, Artificial Sequence
  Synthetic
gacagagccgtgtctcctgacgccaatgccaactcccccaaacatgtcctgttagctggtgcggttataactgcc

SEQ ID NO: 162532 - DNA, 75 bp, Artificial Sequence
  Synthetic
aatcacaagggggagtgagcagtgttgtgggaagcggcagtgtaatccacacaaagaggcgtagggcgcgcaacg

SEQ ID NO: 162533 - DNA, 75 bp, Artificial Sequence
  Synthetic
gaggcgaatgtagcccctaggcctgccacgtgggtctcatgggggaatgagggaaaaggccctaattcagccacc

SEQ ID NO: 162534 - DNA, 75 bp, Artificial Sequence
  Synthetic
ccaaggggggagagccagtggggggggtgtttattgtcaccgacaacgttctgcgccagctcttgaccttcctgg

SEQ ID NO: 162535 - DNA, 75 bp, Artificial Sequence
  Synthetic
gggcctcaacgtccgtgagagcctgcccatgaccaacatgagagcaccgatcatctcgctggctcgcctcatcct

SEQ ID NO: 162536 - DNA, 75 bp, Artificial Sequence
  Synthetic
gaggctgtgctttaggggggttcaggtgaggcaaggctgtggggtaaccgtaggggaggcgggtgaggcggataa

SEQ ID NO: 162537 - DNA, 75 bp, Artificial Sequence
  Synthetic
cactgccaccactgtgttcatttcctcccgttagcccaatgtaataagaggaaagacagctaactcaagtccccc

SEQ ID NO: 162538 - DNA, 75 bp, Artificial Sequence
  Synthetic
cctaccaggaacaactgtcagacactccattaattccactaacaatctttgttggggaaaacacgggggtgcccc

SEQ ID NO: 162539 - DNA, 75 bp, Artificial Sequence
  Synthetic
gaaagacagctaactcaagtcccccaagaacacaaagagacaggactccggtcgttaggatttaatgaatgtcac

SEQ ID NO: 162540 - DNA, 75 bp, Artificial Sequence
  Synthetic
aggacaacggcattcccgtgctttttgccaggcctgtcattgaggtaaaaagcgggcctgagtccaacattaaag

SEQ ID NO: 162541 - DNA, 75 bp, Artificial Sequence
  Synthetic
tccattaattccactaacaatctttgttggggaaaacacgggggtgcccccaccacccccaccacccccaccacc

SEQ ID NO: 162542 - DNA, 75 bp, Artificial Sequence
  Synthetic
ctccacttacaaccaagccactacggccacgtccccggcctcccgctcgggtaagtgctttttcatttttagccc

SEQ ID NO: 162543 - DNA, 75 bp, Artificial Sequence
  Synthetic
acaaaacagcacatgtataccacacggagatggaccaggggtccgttcacaaacttcttaagcttgtagcgcata

SEQ ID NO: 162544 - DNA, 75 bp, Artificial Sequence
  Synthetic
ggagatggaccaggggtccgttcacaaacttcttaagcttgtagcgcatagctgagctcagggccgctaccccgc

SEQ ID NO: 162545 - DNA, 75 bp, Artificial Sequence
  Synthetic
gtgaggaggccgacaaccagatcatggggccctcgagctatgcttcttttgtggtacggggggagaacctggtca

SEQ ID NO: 162546 - DNA, 75 bp, Artificial Sequence
  Synthetic
ccttctccatggttgagtccgtaaaacgagtccgggtcgatgagggagcaaacacccggcgcaccatccgggata

SEQ ID NO: 162547 - DNA, 75 bp, Artificial Sequence
  Synthetic
ggtggccgtggaaagcctgcaaaagatgtacaatgacactcagtccccataccccctcaacagaagaatgcagta

SEQ ID NO: 162548 - DNA, 75 bp, Artificial Sequence
  Synthetic
atgtacaatgacactcagtccccataccccctcaacagaagaatgcagtacagctactatttcccagtgggcctg

SEQ ID NO: 162549 - DNA, 75 bp, Artificial Sequence
  Synthetic
ccaagggtttcatggaggaaatataccacaacagatgtcagggtgcagagggtggccatgacacatgcaatgatg

SEQ ID NO: 162550 - DNA, 75 bp, Artificial Sequence
  Synthetic
caccttcgatgccgccccctatgcccgcatcttttacgacatcgggcgacaggtgcccaagctgggcaatgcccc

SEQ ID NO: 162551 - DNA, 75 bp, Artificial Sequence
  Synthetic
caaccccacacagcagctaccggtggaggcatggatcgtaaacaagaataaccttctcctcgcgtttaacctaca

SEQ ID NO: 162552 - DNA, 75 bp, Artificial Sequence
  Synthetic
gaggggcaggtatctagagagtccaaagaacacctctgcgtgcacatgcaacacaatcatcacacagacgacaag

SEQ ID NO: 162553 - DNA, 75 bp, Artificial Sequence
  Synthetic
gaggcatggatcgtaaacaagaataaccttctcctcgcgtttaacctacagaatgctctcaaggttctctgtcac

SEQ ID NO: 162554 - DNA, 75 bp, Artificial Sequence
  Synthetic
ccccgactccacacacccgcccataccctaaacagcctcaacgcggccccggccccgcgagacaggcgcgagacc

SEQ ID NO: 162555 - DNA, 75 bp, Artificial Sequence
  Synthetic
agatcccacgggcatttatggagggtctccttcagggatgccaccgaatgatccccccgggcgcagaaaatgctg

SEQ ID NO: 162556 - DNA, 75 bp, Artificial Sequence
  Synthetic
gggcatggggggcgcattcctggaaaaagtggagggggcgtggcctgccccccgcggcccccctagcccccccgc

SEQ ID NO: 162557 - DNA, 75 bp, Artificial Sequence
  Synthetic
tctccttcagggatgccaccgaatgatccccccgggcgcagaaaatgctgcgtctccgctcgagacccgaggtgt

SEQ ID NO: 162558 - DNA, 75 bp, Artificial Sequence
  Synthetic
aagcacgtagtgctaaagagtctgaatctggagaatatagtgcaggactttgaggccatcttcacctccccgtct

SEQ ID NO: 162559 - DNA, 75 bp, Artificial Sequence
  Synthetic
cgcatcttttacgacatcgggcgacaggtgcccaagctgggcaatgcccccgccgcgcaggtcagcaacgtgctc

SEQ ID NO: 162560 - DNA, 75 bp, Artificial Sequence
  Synthetic
gataccatcagtgaggctgaaaccaaggcctttgagaagctggtggagcaagccaaaaacaccgtagagaacata

SEQ ID NO: 162561 - DNA, 75 bp, Artificial Sequence
  Synthetic
aagatgaaaaatggagacatgaagacagccgacacctccagggccctggagaccacggacagggcaaagatggtg

SEQ ID NO: 162562 - DNA, 75 bp, Artificial Sequence
  Synthetic
ccccgatgtcaataacccaaacattagcctggctctagagaagtattttctcatgttccctccctcaggcaccat

SEQ ID NO: 162563 - DNA, 75 bp, Artificial Sequence
  Synthetic
acctgccgactcccctggccccagctgcattccaagaggcccgggggcagcagtttgagaccgccacatctctgg

SEQ ID NO: 162564 - DNA, 75 bp, Artificial Sequence
  Synthetic
cagcactttgccagcaacttatagcatggtaggcagctcaactcggcccgtcttactgcccagcctactctccac

SEQ ID NO: 162565 - DNA, 75 bp, Artificial Sequence
  Synthetic
cagtttgagaccgccacatctctggcccacgtggtggatcaggccgttattgagactgtgcaggatactgcctat

SEQ ID NO: 162566 - DNA, 75 bp, Artificial Sequence
  Synthetic
cagggctgaccccggcaaacgtgacccggggctccggggtgacccagccaagcgtgaccaaggggccgctgggtg

SEQ ID NO: 162567 - DNA, 75 bp, Artificial Sequence
  Synthetic
actctgagggagaagaagatcaaggcgctggcaatattcagcatgatggctggagtgacggccctcaccgcgtgc

SEQ ID NO: 162568 - DNA, 75 bp, Artificial Sequence
  Synthetic
aagaaggaaactggaatgtacacactggtcaagctttattacctgctgcgcatctaaaggaaaaacataacaatc

SEQ ID NO: 162569 - DNA, 75 bp, Artificial Sequence
  Synthetic
ttaggcctaaagccacctgaggaacaactttggcctgagcaattccttatagctggtgtatttttggaacctttg

SEQ ID NO: 162570 - DNA, 75 bp, Artificial Sequence
  Synthetic
tattcccccacccctcaaagcccacctttcttcctcccgttaaaaggaagaagggcctcagggatagccgggaag

SEQ ID NO: 162571 - DNA, 75 bp, Artificial Sequence
  Synthetic
atgatcaagttcatctgccgtcacctgggaaataacgccatctccaaggaggcctattccatgtatagaaaaatc

SEQ ID NO: 162572 - DNA, 75 bp, Artificial Sequence
  Synthetic
tcatacaggcccgcaatttccatgacagtcccgttggtggtcagcagcagatagtgaacgtggaggttgtcaaaa

SEQ ID NO: 162573 - DNA, 75 bp, Artificial Sequence
  Synthetic
atagtgaacgtggaggttgtcaaaatcaaagtagttggagctcaagatggagttttggacttcctgggaggtgat

SEQ ID NO: 162574 - DNA, 75 bp, Artificial Sequence
  Synthetic
gactaccccaaccccaaatggcaccagccccaccccagcagtgactaccccaaccccaaatgccaccagccccac

SEQ ID NO: 162575 - DNA, 75 bp, Artificial Sequence
  Synthetic
tatggggaacttatagccctagagcaggccctgatgcgcctggccgggtcagatgttgtgggggatgagagcgtg

SEQ ID NO: 162576 - DNA, 75 bp, Artificial Sequence
  Synthetic
tcccgtgcccccgcggttttgcttggcccgggaggctgccagggaaacgatggggcaaactgggggaacagcggg

SEQ ID NO: 162577 - DNA, 75 bp, Artificial Sequence
  Synthetic
ggtcagtatgtctgcgcactcctggaccctaacctgctccccccggtggcctacacagacattttcacccatctt

SEQ ID NO: 162578 - DNA, 75 bp, Artificial Sequence
  Synthetic
ctgcctgcctctttggctcccacccccacaggacctgtccatgaaccggtcggatccctaacgccagccccggtg

SEQ ID NO: 162579 - DNA, 75 bp, Artificial Sequence
  Synthetic
cgtcctggtaaaattctggatctttggaatctggcggggctccccagccacagcaccctgcgaacatttattcat

SEQ ID NO: 162580 - DNA, 75 bp, Artificial Sequence
  Synthetic
gcgagggtgtctctggccttgccggactctcccaagtaggggtcctaggaggtggcggaggtgaaggagatggac

SEQ ID NO: 162581 - DNA, 75 bp, Artificial Sequence
  Synthetic
ctacacagacattttcacccatcttctcaccgttagtgaccgggccccccagattattatcggaaatgaggttta

SEQ ID NO: 162582 - DNA, 75 bp, Artificial Sequence
  Synthetic
ttcaggccgacgtcaaaaacgagccgcgcctcccaccgtgagtccttcggatactgggcctcctgccgcggggcc

SEQ ID NO: 162583 - DNA, 75 bp, Artificial Sequence
  Synthetic
tgcgtactcgaccggggtctcggggatactatgcaggatctccagatccagcatggacagttccatttccgtact

SEQ ID NO: 162584 - DNA, 75 bp, Artificial Sequence
  Synthetic
ttactgcccagcctactctccactcccagtccatgttcgcactcctatgcatttccttccctcccacttttaccc

SEQ ID NO: 162585 - DNA, 75 bp, Artificial Sequence
  Synthetic
cttgtacggctaccgggttaacggggaccacgaccacgatttccgtctgcacctaggcccttatgtagatgaggg

SEQ ID NO: 162586 - DNA, 75 bp, Artificial Sequence
  Synthetic
gcacacaaagaggaatcaatcacaacaacgcgccccagaagctcttcgggaaatttgaaggtgtttaaaggccct

SEQ ID NO: 162587 - DNA, 75 bp, Artificial Sequence
  Synthetic
agattattatcggaaatgaggtttacgctgacaccctggccgcgccccagtttattgagagggttggaaacatgg

SEQ ID NO: 162588 - DNA, 75 bp, Artificial Sequence
  Synthetic
tttgtaggcggggagatgccacgcatccctgtcttctcgctccaaagagagacgcccaagaaacccatccacagc

SEQ ID NO: 162589 - DNA, 75 bp, Artificial Sequence
  Synthetic
ctcgtggccatttggacgaactgaccacaacactagagtccatgacagaggatttgaatctggactcccccctga

SEQ ID NO: 162590 - DNA, 75 bp, Artificial Sequence
  Synthetic
gcaccaatgcccacatgtgcggcctcggggtggactttcagcacgtggcccagaccctggcctacaacgggccag

SEQ ID NO: 162591 - DNA, 75 bp, Artificial Sequence
  Synthetic
ggggggggtcggggtccgcgggctccgggggctgcgggcggtggatggcggctggcgttcaggggaagggggggg

SEQ ID NO: 162592 - DNA, 75 bp, Artificial Sequence
  Synthetic
cgaggacatcctcgacaatttggagaatgggacgctcagggatctgctggagatctccgacctccgccccaccgt

SEQ ID NO: 162593 - DNA, 75 bp, Artificial Sequence
  Synthetic
aagagcccgctctccgtccccagggctagcccccgcaaaacctccccaatctctagggccgagcacagggcggtg

SEQ ID NO: 162594 - DNA, 75 bp, Artificial Sequence
  Synthetic
cgaggttcttgatttgtcaatccatggcaggccccgccctcggacccccgagtggcctgttcaaggggagagtgg

SEQ ID NO: 162595 - DNA, 75 bp, Artificial Sequence
  Synthetic
gacagcagttggtatagggcaaggttgggcccctgggtagtcacgttcagccgcaactcgcgtagcaccacgtgg

SEQ ID NO: 162596 - DNA, 75 bp, Artificial Sequence
  Synthetic
ggagcagccggccccccaggctccataccaatactgggcctcctgccgtggggcctcctgccgcggggcctcctg

SEQ ID NO: 162597 - DNA, 75 bp, Artificial Sequence
  Synthetic
ctccctgggcgagaagccattctccgcaggtttccactagatctaagaacacttcttcgatgtgagaattccgcc

SEQ ID NO: 162598 - DNA, 75 bp, Artificial Sequence
  Synthetic
gtagccgacggtggctaacctcagcgcgtactcctgtttctcagtcgtcaggtgaccaagctcctccatcttgac

SEQ ID NO: 162599 - DNA, 75 bp, Artificial Sequence
  Synthetic
cctcaactcgctccaggggccaggggataccgctcatatcactaagggcggtgcccaggtagaggagctcacgat

SEQ ID NO: 162600 - DNA, 75 bp, Artificial Sequence
  Synthetic
gctcctggtcttccgcctcctcgtcctcgtcctcttccccgtcctcgtccatggttatccccccctcttctttga

SEQ ID NO: 162601 - DNA, 75 bp, Artificial Sequence
  Synthetic
accatttgattagaagggtagcatcctcgggaagtgcaggtgggctgcggttgcaggccagggcgtaaaagagac

SEQ ID NO: 162602 - DNA, 75 bp, Artificial Sequence
  Synthetic
agctggccctgtgggtatgcctcaggcacgcaaagttcctgccccgggcatggcacacctgaactaagtttggcc

SEQ ID NO: 162603 - DNA, 75 bp, Artificial Sequence
  Synthetic
agaattcgtcttgctctattcacccttacttttcttcttgcccgttctctttcttagtatgaatccagtatgcct

SEQ ID NO: 162604 - DNA, 75 bp, Artificial Sequence
  Synthetic
atggttatccccccctcttctttgaggtccactgccgccggagccttctggtccagatgagtcttccttctgtcc

SEQ ID NO: 162605 - DNA, 75 bp, Artificial Sequence
  Synthetic
agcggaggtccacgcagccattgccagtctcacccacggcatgacccaccttaaagaaggccacagaaacctcaa

SEQ ID NO: 162606 - DNA, 75 bp, Artificial Sequence
  Synthetic
cagttctggctcccggcagcctcccttcatctccagcaggaccagtttctggagaacgtagcgagcgtagctggc

SEQ ID NO: 162607 - DNA, 75 bp, Artificial Sequence
  Synthetic
gtgctccacagcctgcaccagcggctgccccggcacgacgtacaaggaaaccactacagccagaatcggtaagga

SEQ ID NO: 162608 - DNA, 75 bp, Artificial Sequence
  Synthetic
cggacggtggggctcaaggagggcggcagcggacggtggggcctgtttcaactgactaggcaccacttgtagtaa

SEQ ID NO: 162609 - DNA, 75 bp, Artificial Sequence
  Synthetic
aagtgaggggtcacacaggagagccagatgacgaccatcgcgtgaacagagccctgcaatgttgccctgctccgt

SEQ ID NO: 162610 - DNA, 75 bp, Artificial Sequence
  Synthetic
gctcatctcccttctcggtcactcgcttgtaggtgcccatcagaaatttagaagtcatggcccccgtgtactgaa

SEQ ID NO: 162611 - DNA, 75 bp, Artificial Sequence
  Synthetic
ccagtgaccccgcggtgctgcttggacctggaggccgctggggaagcgatggggcatactggggagacggcgggg

SEQ ID NO: 162612 - DNA, 75 bp, Artificial Sequence
  Synthetic
ggggtttcttggataattcatagcaaagcgccaggcgtccgtgccattgctgtggaagtggcaggcgatctggtg

SEQ ID NO: 162613 - DNA, 75 bp, Artificial Sequence
  Synthetic
atctccgcccgagagcaggtcggtcaggcgtctgcgggccgcctccaggtcaaattttccgtcgtcgctctcggc

SEQ ID NO: 162614 - DNA, 75 bp, Artificial Sequence
  Synthetic
ggcacgagccttgcacccaacaaggcaggacgcagccccggaggccacgcagcatgacagagctggtggtcgccg

SEQ ID NO: 162615 - DNA, 75 bp, Artificial Sequence
  Synthetic
aggtgacgaagcggtatagagcaccgctgcgtgtcagaaatggggtctgcggagaggcgtggtacagagtgtcca

SEQ ID NO: 162616 - DNA, 75 bp, Artificial Sequence
  Synthetic
cgctcgaggggagacaggggagggggtttggatcctcgggtcaatgacaccttcatatcccttgttttaccaata

SEQ ID NO: 162617 - DNA, 75 bp, Artificial Sequence
  Synthetic
atggaaatggtaccctgcatcctgtgttggagctagcagcaagagaaacacctctccgcctttcgccagaggaca

SEQ ID NO: 162618 - DNA, 75 bp, Artificial Sequence
  Synthetic
tatcgacaggctcggccagcgcaataccaagggtaccagacgtcttgtaaattaacttgtagcggttaagcatag

SEQ ID NO: 162619 - DNA, 75 bp, Artificial Sequence
  Synthetic
cattaacttccacgccaggggcgggtggattatctgttgaccccacggcccccaggccagccaaaacttgcaccc

SEQ ID NO: 162620 - DNA, 75 bp, Artificial Sequence
  Synthetic
accaagggtaccagacgtcttgtaaattaacttgtagcggttaagcatagacgccaaatcttcggtgacatttgc

SEQ ID NO: 162621 - DNA, 75 bp, Artificial Sequence
  Synthetic
tatcgctcccgggggcacgtcaggctcaccatctgggccaccttcttggaggtattcaaaataatcggcatcccc

SEQ ID NO: 162622 - DNA, 75 bp, Artificial Sequence
  Synthetic
accacgggaggcggtgcaaggacgggggtgggtacctcgggctcaaaggcggagttgatgaaaggggccgaggct

SEQ ID NO: 162623 - DNA, 75 bp, Artificial Sequence
  Synthetic
acatcgtcagccgtccctggcaagttacagagccaaacaatcgtctgtacgagccacgagccggttatcgaggtg

SEQ ID NO: 162624 - DNA, 75 bp, Artificial Sequence
  Synthetic
gaggggcaggaggggcaggagcaggaggggcaggagcaggaggggcaggagcaggaggggcaggagcaggagggg

SEQ ID NO: 162625 - DNA, 75 bp, Artificial Sequence
  Synthetic
agcatgcccctctatgtccaggtgcagcttaacctcgctgagactggcagcccccacctcccatagcaacaccag

SEQ ID NO: 162626 - DNA, 75 bp, Artificial Sequence
  Synthetic
acggcctgccagggcagagtccctggccccatgaactcctccgatggccagacccacgtacttgtcgaggaacgt

SEQ ID NO: 162627 - DNA, 75 bp, Artificial Sequence
  Synthetic
agcttaacctcgctgagactggcagcccccacctcccatagcaacaccaggcaaaaaacacagagcaactgcatc

SEQ ID NO: 162628 - DNA, 75 bp, Artificial Sequence
  Synthetic
gtggccaccttctccatctccatcagggccaggctgtcgccagcctgtttgtctagcagggccttaagcccattc

SEQ ID NO: 162629 - DNA, 75 bp, Artificial Sequence
  Synthetic
ctgagggggcggtcaccgatgagacaacggccgagatctcttgcgcccaggcaccggtctcgtccatcttgagcg

SEQ ID NO: 162630 - DNA, 75 bp, Artificial Sequence
  Synthetic
ccccaccccagcaccccggggtgacgtggcaccccgcgtgccttactgacttgtcacctttgcacatttggtcag

SEQ ID NO: 162631 - DNA, 75 bp, Artificial Sequence
  Synthetic
cccaatcgaaaaactgagatcgtattgccggattcttcaatgcctgcatgtaaatctccgtccagcatccaggta

SEQ ID NO: 162632 - DNA, 75 bp, Artificial Sequence
  Synthetic
atggcccctggtgcccggggcgcagagcacggccacctgacatcgtgggtcaggctctgtcaccagccggcgtgg

SEQ ID NO: 162633 - DNA, 75 bp, Artificial Sequence
  Synthetic
ccagagagatcatggtattccagatgactgagcgcacggcctcaagcttggccacctgggcctccaccaccccac

SEQ ID NO: 162634 - DNA, 75 bp, Artificial Sequence
  Synthetic
aggaggggcaggagcaggaggaggggcaggagcaggaggggcaggagcaggaggtggaggccggggtcgaggagg

SEQ ID NO: 162635 - DNA, 75 bp, Artificial Sequence
  Synthetic
gagtcggacatggataggaaaggctcctctaggtcagacaggtagcggacgaggccagaacccccagatgcatca

SEQ ID NO: 162636 - DNA, 75 bp, Artificial Sequence
  Synthetic
cgtagtcggacacgtgcatggaccggttaatccgatctggtcgcaggcactcgtactgctcgctggcaaaggagg

SEQ ID NO: 162637 - DNA, 75 bp, Artificial Sequence
  Synthetic
aaaggaaggcctggaaactacaacctacatcacctcccaggaagtccaaaactccatcttgagctccaactactt

SEQ ID NO: 162638 - DNA, 75 bp, Artificial Sequence
  Synthetic
gaaaggctgtatgacttccttaagtacactaaagatgctgttcttatacagcttctcggccacaccacttcgaat

SEQ ID NO: 162639 - DNA, 75 bp, Artificial Sequence
  Synthetic
acactaaagatgctgttcttatacagcttctcggccacaccacttcgaattatgggggtgtggctttgatgacat

SEQ ID NO: 162640 - DNA, 75 bp, Artificial Sequence
  Synthetic
cggtccgggcactcaaaggtctccggctcctcagggagctggctgtatctattcctgggccggccaaagagccag

SEQ ID NO: 162641 - DNA, 75 bp, Artificial Sequence
  Synthetic
gttaatccgatctggtcgcaggcactcgtactgctcgctggcaaaggaggaccaggttcccagtagcaggcgcag

SEQ ID NO: 162642 - DNA, 75 bp, Artificial Sequence
  Synthetic
ctggaccttgctcgcccactcgaccgaggactgccgggtacatgttcatggagcgcagggtctgcagcacctcac

SEQ ID NO: 162643 - DNA, 75 bp, Artificial Sequence
  Synthetic
tgaagaaagagcacacgttgttttggcaataatcctgtactttattgcttttgctctgggtatctttctggttca

SEQ ID NO: 162644 - DNA, 75 bp, Artificial Sequence
  Synthetic
ggcaaaatactgtgttaggagccaggcacagtaaacggcgtgatatgcatcgttgacactcttcaggtagccagc

SEQ ID NO: 162645 - DNA, 75 bp, Artificial Sequence
  Synthetic
gtcgtgtcccactcctccaacccggtcttctacgtctacccgcaggagtggaagccgggccagaccctcaagctg

SEQ ID NO: 162646 - DNA, 75 bp, Artificial Sequence
  Synthetic
atgcgcagcaggtaataaagcttgaccagtgtgtacattccggtttccttcttgaccttgatgtactttcctaga

SEQ ID NO: 162647 - DNA, 75 bp, Artificial Sequence
  Synthetic
ccagtgtgtacattccggtttccttcttgaccttgatgtactttcctagaaactgtgccatggtgccaagctcag

SEQ ID NO: 162648 - DNA, 75 bp, Artificial Sequence
  Synthetic
ccggcatagtgatggtcactccccgctgcccggccagggccatctccaccaggcaggtcaccaggcccccgtcgc

SEQ ID NO: 162649 - DNA, 75 bp, Artificial Sequence
  Synthetic
tggcccaaaataaccaccttaatatcagaggggtcgcaaaagcgggcccaggccatgcacatgtcctcctccggg

SEQ ID NO: 162650 - DNA, 75 bp, Artificial Sequence
  Synthetic
ccccttggcacaagagccggacgatgggggtggcgaatctgacatttctcataatggtgcctgagggagggaaca

SEQ ID NO: 162651 - DNA, 75 bp, Artificial Sequence
  Synthetic
ctgcccggccagggccatctccaccaggcaggtcaccaggcccccgtcgctgatgtcatgccctgacagcacgat

SEQ ID NO: 162652 - DNA, 75 bp, Artificial Sequence
  Synthetic
gggggtggcgaatctgacatttctcataatggtgcctgagggagggaacatgagaaaatacttctctagagccag

SEQ ID NO: 162653 - DNA, 75 bp, Artificial Sequence
  Synthetic
atctccgggaggtagtcggaggccaccggcatagtgatggtcactccccgctgcccggccagggccatctccacc

SEQ ID NO: 162654 - DNA, 75 bp, Artificial Sequence
  Synthetic
acgcctcgggcgcccgtggggtcgtggccacgtcgctaaagagctgctcaaacagcgaccctccctggatcttgc

SEQ ID NO: 162655 - DNA, 75 bp, Artificial Sequence
  Synthetic
cacgagtgcgcgcttctgggtcacagacattcggcgaacgtgacaaagcttgttgtaaacgagcgcaagacccgc

SEQ ID NO: 162656 - DNA, 75 bp, Artificial Sequence
  Synthetic
tggaacagatgctgttgaggcaaaagactatgttctctacggtgtttttggcttgctccaccagcttctcaaagg

SEQ ID NO: 162657 - DNA, 75 bp, Artificial Sequence
  Synthetic
acagagccgctgcggcctggttctgacgctgcgcctgccggcggaggaggccttccccttcctgcgcggcctcac

SEQ ID NO: 162658 - DNA, 75 bp, Artificial Sequence
  Synthetic
actttttaacgaggtgtaagcatcaggttaatctaagacagtcacctattacttgagcatcacggcggtggatgg

SEQ ID NO: 162659 - DNA, 75 bp, Artificial Sequence
  Synthetic
tccgcctgttttgtttgtgccacaacgcctcgcccctccaccacgtggcgggttctctcgtggaactgcagcttc

SEQ ID NO: 162660 - DNA, 75 bp, Artificial Sequence
  Synthetic
tcagccgacgtgtcttcccttccatgcctcgcccgagtcacattcttgtgcatggccttaatggcattttcatac

SEQ ID NO: 162661 - DNA, 75 bp, Artificial Sequence
  Synthetic
tttccaccctgtaggggaagccgattattttgaataccaccaagaaggtggcccagatggtgagcctgacgtgcc

SEQ ID NO: 162662 - DNA, 75 bp, Artificial Sequence
  Synthetic
acctacctagatcgcgcgggggccctgcgctcgctcacgcccctcgtggaactgctcacactgagcgccaagaag

SEQ ID NO: 162663 - DNA, 75 bp, Artificial Sequence
  Synthetic
cacggtcatgaagctggaggcggacgagccggtctcggggcaggaggccgagccaaaggtcagcttcacgcccag

SEQ ID NO: 162664 - DNA, 75 bp, Artificial Sequence
  Synthetic
tccccaggcagtcccagcgccgaggcaagagtggggctgtggatggtgtggaagacaatctgtcccgatggcagg

SEQ ID NO: 162665 - DNA, 75 bp, Artificial Sequence
  Synthetic
aaagacagccttcaaatgattcagcatagtagtctttcccacaccaggggcaccttccaaaaatagggaacaggc

SEQ ID NO: 162666 - DNA, 75 bp, Artificial Sequence
  Synthetic
tgtctgcccggcgcggatccaggtgtagatgcagggtgagcaagacgtcttccggatccaagattggggcacatg

SEQ ID NO: 162667 - DNA, 75 bp, Artificial Sequence
  Synthetic
caatttatattatgtaaatcggcagcgtagggtaccggccacccctgaacatctcatccccagagggcgaatggg

SEQ ID NO: 162668 - DNA, 75 bp, Artificial Sequence
  Synthetic
ccccgggctgcttacacttgagcatcacggcggtggatgggggctgtctttttgcgcaggtgggccaggagaagt

SEQ ID NO: 162669 - DNA, 75 bp, Artificial Sequence
  Synthetic
gtcaggtgggtcacaattggaacccgcgtgctctccttcctctgagccttggcctggcgggtgtcttgggcatca

SEQ ID NO: 162670 - DNA, 75 bp, Artificial Sequence
  Synthetic
tagatgcagggtgagcaagacgtcttccggatccaagattggggcacatgctgcgttcagcagcgcctcagccat

SEQ ID NO: 162671 - DNA, 75 bp, Artificial Sequence
  Synthetic
cacggagctatttacttccgagtctggtcagagcctggccgccgtcacgtccctggccgagctgggggaggtctt

SEQ ID NO: 162672 - DNA, 75 bp, Artificial Sequence
  Synthetic
tccagattcagaacattcatcacactcccacttagccgcttcagctgggcagcatgcttggataacttactaaac

SEQ ID NO: 162673 - DNA, 75 bp, Artificial Sequence
  Synthetic
ctcccaatgtaatcacggtacctgaaaccttaacgttctctctgccgggttttgcggagacaagcagcttctctg

SEQ ID NO: 162674 - DNA, 75 bp, Artificial Sequence
  Synthetic
gaggcagcaagtccggattgggcaccagccttagagagttgtgggagcggttggcgatgagcacgttgctgacct

SEQ ID NO: 162675 - DNA, 75 bp, Artificial Sequence
  Synthetic
gagccgcagaggccggagccacagaggccggagccgcagaggccggagccgcagaggccggagccgcagaggccg

SEQ ID NO: 162676 - DNA, 75 bp, Artificial Sequence
  Synthetic
gatggcctggtgcatgcatgcctgcaggacattgtgttgtaaccagtctactccttactatgttgtggacctgtc

SEQ ID NO: 162677 - DNA, 75 bp, Artificial Sequence
  Synthetic
gccaccattcttttgttttaacgcggaatgagaagagggcctgcggaaattagactcatcctcagactcacagtc

SEQ ID NO: 162678 - DNA, 75 bp, Artificial Sequence
  Synthetic
aggcgtagtccgccagcggcaggtccaggggacctaccccgggctgctgtgccacgcgtcctccgctgaccctgt

SEQ ID NO: 162679 - DNA, 75 bp, Artificial Sequence
  Synthetic
atagacgcctacagggggcgccttcccctggcctcggccgatctcgtgcgctacgtctatttggcccacgcacag

SEQ ID NO: 162680 - DNA, 75 bp, Artificial Sequence
  Synthetic
aaccttaacgttctctctgccgggttttgcggagacaagcagcttctctgtcattcgatcccaggtacgataggg

SEQ ID NO: 162681 - DNA, 75 bp, Artificial Sequence
  Synthetic
gggatgagagcacagtcacggggatctccagaatatcccggatggtgcgccgggtgtttgctccctcatcgaccc

SEQ ID NO: 162682 - DNA, 75 bp, Artificial Sequence
  Synthetic
agatggcatcttcgtcgacattgacagccttctcatatactgtgtctctggggctgacctttatgcagaaggcgt

SEQ ID NO: 162683 - DNA, 75 bp, Artificial Sequence
  Synthetic
tgcttcaacgagggaacctttaagcgatactctcagttaacgagcgtgggagaaattgggtgtctgccttcgggg

SEQ ID NO: 162684 - DNA, 75 bp, Artificial Sequence
  Synthetic
caggtaggagcgggctttgtcataacaaggtccttaatcgcatccttcaaaacctcagcaaatatatgagtttgt

SEQ ID NO: 162685 - DNA, 75 bp, Artificial Sequence
  Synthetic
agagccagggcaactcgtaagacggagagatgtccatgctctcgtccacatctaagggtaccggagaacttgcgc

SEQ ID NO: 162686 - DNA, 75 bp, Artificial Sequence
  Synthetic
ggcgtcgtgctcccctcgctcctggacaggggctttgcggagcacatgcgcacctacttcacccgggagacttac

SEQ ID NO: 162687 - DNA, 75 bp, Artificial Sequence
  Synthetic
ggactcgttttacggactcaaccatggagaaggcggggtgttctgatgcggaaaagggggcgatctgattcaggc

SEQ ID NO: 162688 - DNA, 75 bp, Artificial Sequence
  Synthetic
gcagtaggcttttggtgtgcgggtgctggtggctgggctcccctgggtagggtaaaggggcacgatgtgtgccgg

SEQ ID NO: 162689 - DNA, 75 bp, Artificial Sequence
  Synthetic
cgaggaggctttaatgttggactcaggcccgctttttacctcaatgacaggcctggcaaaaagcacgggaatgcc

SEQ ID NO: 162690 - DNA, 75 bp, Artificial Sequence
  Synthetic
gggacgccaggtcgttgacaaagttgagtccaccgaggggaaccgtggagcccagcacatagtgctggcagcctg

SEQ ID NO: 162691 - DNA, 75 bp, Artificial Sequence
  Synthetic
tcaggctgtggccaaagggagacaggcgaaggcagcgcccgggggagagagtgcacagtgacagtgggagaaaca

SEQ ID NO: 162692 - DNA, 75 bp, Artificial Sequence
  Synthetic
agctgtccctctaggatataggggttgggggccaggatgaggcgagccagcgagatgatcggtgccctcatgttg

SEQ ID NO: 162693 - DNA, 75 bp, Artificial Sequence
  Synthetic
ggaattccataaatgtaacacgctgatcaggtgttaccacttcatcccagattttcgtgaggctcctatgtatgg

SEQ ID NO: 162694 - DNA, 75 bp, Artificial Sequence
  Synthetic
accactggcgatccccgggactacatcgcggcggcctaaaggtgccggcagaaaaggtcacatgacacctacggc

SEQ ID NO: 162695 - DNA, 75 bp, Artificial Sequence
  Synthetic
ctccagctgcgagcaagggaatgcgttactacaagtggtgcctagtcagttgaaacaagccccaccgtccgctgc

SEQ ID NO: 162696 - DNA, 75 bp, Artificial Sequence
  Synthetic
cccagcacatagtgctggcagcctgccatatcgcatgcgcgtccgagcgcttggaggacggtacggccgttgatc

SEQ ID NO: 162697 - DNA, 75 bp, Artificial Sequence
  Synthetic
agggggcaaagtcatcaatctcagcgtaaaagttttcgtgtctttcgttttcaggggactcatcctcctgacatt

SEQ ID NO: 162698 - DNA, 75 bp, Artificial Sequence
  Synthetic
aagggtgcagcggctaccggtcttcctctgccattttgcagacaggcactactttgtaatgacagccgctgaccc

SEQ ID NO: 162699 - DNA, 75 bp, Artificial Sequence
  Synthetic
agctactgtatgcctggtaacccataggccaaccagcggccagggtggtcattctccatttgacctgacttctac

SEQ ID NO: 162700 - DNA, 75 bp, Artificial Sequence
  Synthetic
ctctgccattttgcagacaggcactactttgtaatgacagccgctgaccccttctcgtcccacctggcggaggtc

SEQ ID NO: 162701 - DNA, 75 bp, Artificial Sequence
  Synthetic
ccgggagctggtggagctcgcgcgctggcacgcggatgagggtcccacatacccccccacgcttcaagggtttct

SEQ ID NO: 162702 - DNA, 75 bp, Artificial Sequence
  Synthetic
caagcagctcacctatggtcactcaggcacggtcgcccctccgagtgaccagtcaccttccagactatgcataca

SEQ ID NO: 162703 - DNA, 75 bp, Artificial Sequence
  Synthetic
tcaggggactcatcctcctgacattttcgccagccgccgggcgggccggcctcctttcctggaaatccagccatg

SEQ ID NO: 162704 - DNA, 75 bp, Artificial Sequence
  Synthetic
cctctcctacaccccagtgtactattcacagaacagcctgagcgagcagctctttgtctcccggcatgaatactt

SEQ ID NO: 162705 - DNA, 75 bp, Artificial Sequence
  Synthetic
ttgaaatctgggatccgaaaaactggtctatggctcgcgtgtcggcgtgctgaaaccaacggcaacaaatcactt

SEQ ID NO: 162706 - DNA, 75 bp, Artificial Sequence
  Synthetic
ggtgttactccaagctgctctctcttaagagctgggagcaactagcctcttttttgtctctgcccccgggaccca

SEQ ID NO: 162707 - DNA, 75 bp, Artificial Sequence
  Synthetic
taagagctgggagcaactagcctcttttttgtctctgcccccgggacccacgtttacggactttagactattttt

SEQ ID NO: 162708 - DNA, 75 bp, Artificial Sequence
  Synthetic
tacaacaagctttgtcacgttcgccgaatgtctgtgacccagaagcgcgcactcgtgtcggtttttggagtgggc

SEQ ID NO: 162709 - DNA, 75 bp, Artificial Sequence
  Synthetic
tggaatggccccaacattatgagatagtggccgtagtcatacctcacagtgtcaagtgcctggtgcttgatggcc

SEQ ID NO: 162710 - DNA, 75 bp, Artificial Sequence
  Synthetic
ctgaggcccttcttccttttaacgggaggaagaaaggtgggctttgaaaagaggaggaggcagttttcagaagtg

SEQ ID NO: 162711 - DNA, 75 bp, Artificial Sequence
  Synthetic
attgcttgaataaaccttcttaaatctagcggaaacctgtagataatggcttctcgaccagggtgatccagctga

SEQ ID NO: 162712 - DNA, 75 bp, Artificial Sequence
  Synthetic
gtcaagtgcctggtgcttgatggcccccagctccccgttaaacatagtgggctgtaggccctctcctcccttgag

SEQ ID NO: 162713 - DNA, 75 bp, Artificial Sequence
  Synthetic
ccttaacaagtaccggcgcttctgtcagcttgtttaccttcacaagcaccacctcacctccttctacagccccca

SEQ ID NO: 162714 - DNA, 75 bp, Artificial Sequence
  Synthetic
acggccaacccgcaaagcgttactcgcaaggcacagaggctagagggcaccgcccagttgtgtgactgtgccaat

SEQ ID NO: 162715 - DNA, 75 bp, Artificial Sequence
  Synthetic
gggtgcgtggtcgggagaacgaaggcgtgggtgtcagacctgaagactgttgggtagatggcgagactcttgaag

SEQ ID NO: 162716 - DNA, 75 bp, Artificial Sequence
  Synthetic
aatattcatggcctgcccacgggcataggccagatcaatctcctcgtttgttaacggatcatcataaggaatggc

SEQ ID NO: 162717 - DNA, 75 bp, Artificial Sequence
  Synthetic
cagtgacgcgggggtccttggccccagatctctctttaggtgggccagctgcgccttcgaggaggtgccgggcct

SEQ ID NO: 162718 - DNA, 75 bp, Artificial Sequence
  Synthetic
aggggcatggtcgggctcgggaggctttcgagttcatctgtaaaagcatgaaactgtccggactccgagtggcgg

SEQ ID NO: 162719 - DNA, 75 bp, Artificial Sequence
  Synthetic
tttcttcgcacgtcctgcccccccgtgctgggcagtcagggcctggaagtcttggcggcgttggtatttaaaaac

SEQ ID NO: 162720 - DNA, 75 bp, Artificial Sequence
  Synthetic
gatggctccaggtgggcatcttctgcttcctcttctgagctgctatctgatatctctatgaggacattttcccaa

SEQ ID NO: 162721 - DNA, 75 bp, Artificial Sequence
  Synthetic
cagtctacaactgcgggcacaaaccgctgcacatcggccccagcaccagacttggacttgcgctcttctggccgg

SEQ ID NO: 162722 - DNA, 75 bp, Artificial Sequence
  Synthetic
agggggccgggcgcgctccatccttgtccaggagacacacgtggcttccagagaggcgcagcccagccctccgca

SEQ ID NO: 162723 - DNA, 75 bp, Artificial Sequence
  Synthetic
gccttcttctttctgtgttcctcttcaatggcattgattacactaaagtcagttactatggccctgcattttttg

SEQ ID NO: 162724 - DNA, 75 bp, Artificial Sequence
  Synthetic
ccaatggccacggccccgcggatttttgtgccggtgcggagccaatttagcttcccctccccttagcagggggtc

SEQ ID NO: 162725 - DNA, 75 bp, Artificial Sequence
  Synthetic
gaggcgctcgaggggagacaggggagggggtttggatcctcgggtcaatgacaccttcttgttaaggaacacggt

SEQ ID NO: 162726 - DNA, 75 bp, Artificial Sequence
  Synthetic
gttgattttgcatctgactttcggttaaacaccgcgggcctgccgtatactgttggattgtacggcagtgtttgc

SEQ ID NO: 162727 - DNA, 75 bp, Artificial Sequence
  Synthetic
tagagtttccagccctgggccaaaagaccctccccacctccaccaccggcctgctaaacctcctctcccgctggc

SEQ ID NO: 162728 - DNA, 75 bp, Artificial Sequence
  Synthetic
ggctcttggctgctctgttctggctgccttcttctttctgtgttcctcttcaatggcattgattacactaaagtc

SEQ ID NO: 162729 - DNA, 75 bp, Artificial Sequence
  Synthetic
gccccaagccttcgcaactcactgcgcgtgtcccccgaagcgctcgagctggcagagcgggaggccgaaagggcc

SEQ ID NO: 162730 - DNA, 75 bp, Artificial Sequence
  Synthetic
tggaattcccattttacccagcgtgcaatgtttgcacggcagatgtcaatgcaactatcaatttcgatgtcgggg

SEQ ID NO: 162731 - DNA, 75 bp, Artificial Sequence
  Synthetic
ctctctttggagcgagaagacagggatgcgtggcatctccccgcctacaaatgcgtggacaggctcgacaaagtt

SEQ ID NO: 162732 - DNA, 75 bp, Artificial Sequence
  Synthetic
tcgtcatcctcaacaattataggatcatctggcagtctaggagcctcaatattcatggcctgcccacgggcatag

SEQ ID NO: 162733 - DNA, 75 bp, Artificial Sequence
  Synthetic
gagatacagcaacagaaagctattagccggtggttcccccaccatcattcttcctgttaacgggaagaataagag

SEQ ID NO: 162734 - DNA, 75 bp, Artificial Sequence
  Synthetic
atgcgtggacaggctcgacaaagttctgatgattatcccgctcatcaacgtgacattcataatctctagtgaccg

SEQ ID NO: 162735 - DNA, 75 bp, Artificial Sequence
  Synthetic
aacctcgtgattggggacccccaacacctactggaagacggtccaaaccttcgcagcagtcgacattatcgagta

SEQ ID NO: 162736 - DNA, 75 bp, Artificial Sequence
  Synthetic
agatccgccaggacctggatgctgtagtggccttctctgatggcctggagagcatgcaggtcaggtccccctcca

SEQ ID NO: 162737 - DNA, 75 bp, Artificial Sequence
  Synthetic
gccctccccatccccagcccagccgttcactcggctcaccgggaacgcccagtatgcagtctcaatctctcccac

SEQ ID NO: 162738 - DNA, 75 bp, Artificial Sequence
  Synthetic
gaggccagcaccacctatctcagcagctctctctttctctcccccgttataatgaataaatgttcgcagggtgct

SEQ ID NO: 162739 - DNA, 75 bp, Artificial Sequence
  Synthetic
ccccaaggtcatgcttcctctgcggctgaccaggctggggtgccggaaagaggtagaaagcgggcccatgaaggc

SEQ ID NO: 162740 - DNA, 75 bp, Artificial Sequence
  Synthetic
gcctcattggaggcgccacatctgtgcttctctcggcctacaaccgccacccccttttccagcccctgcataccg

SEQ ID NO: 162741 - DNA, 75 bp, Artificial Sequence
  Synthetic
tgatgagagagaccctgtttatcggcagccacgtggtgctacgcgagttgcggctgaacgtgactacccaggggc

SEQ ID NO: 162742 - DNA, 75 bp, Artificial Sequence
  Synthetic
ggtaccgtccttcggaccctggtacaggaccatgtcggctaatgccatgcagcggcgcgtgttccctaagcagct

SEQ ID NO: 162743 - DNA, 75 bp, Artificial Sequence
  Synthetic
ccaaccttgccctataccaactgctgtccaccgccctgtgctcggccctagagattggggaggttttgcgggggc

SEQ ID NO: 162744 - DNA, 75 bp, Artificial Sequence
  Synthetic
gaggggcaacctgaactttaccaactccgtctccctaaagctgatgacagaagtggtggcggtgcttgagggcac

SEQ ID NO: 162745 - DNA, 75 bp, Artificial Sequence
  Synthetic
tgctgagcttgatctcctgaaatctatggtggtctgccgggcctacatcacggaacaccggacgacgatgcagtt

SEQ ID NO: 162746 - DNA, 75 bp, Artificial Sequence
  Synthetic
cacccaagactttttctcagacgtcaggcacctgccagacctccaggctgccctgatcctctcggtggcctacct

SEQ ID NO: 162747 - DNA, 75 bp, Artificial Sequence
  Synthetic
agtgcccaaagcggggactattccctggtgattgttacaacctttgtgcattatgccaactttcacaactacttt

SEQ ID NO: 162748 - DNA, 75 bp, Artificial Sequence
  Synthetic
ccctgatcctctcggtggcctacctgctactccaggggggctcctcacaccagcagcgccccctccctgcctcac

SEQ ID NO: 162749 - DNA, 75 bp, Artificial Sequence
  Synthetic
ccgccgttcccgtaattacataggctgaaaagggcaggaaggggggctccgagagctccgggtcaaactcggggg

SEQ ID NO: 162750 - DNA, 75 bp, Artificial Sequence
  Synthetic
cccgagccgtcaccatgacagccgccagctacgctcgctacgttctccagaaactggtcctgctggagatgaagg

SEQ ID NO: 162751 - DNA, 75 bp, Artificial Sequence
  Synthetic
aaacaaggaagcgcgccagtcaatagcccctctcaaccgacaggcggcatatccacccggcacattcgcggacaa

SEQ ID NO: 162752 - DNA, 75 bp, Artificial Sequence
  Synthetic
cggaggcgtctgaggtcatgttcaacatgaacgtggacgagagcgcctctggcgccctcggctcctcggccattc

SEQ ID NO: 162753 - DNA, 75 bp, Artificial Sequence
  Synthetic
gaggtttctgtggccttctttaaggtgggtcatgccgtgggtgagactggcaatggctgcgtggacctccgctgg

SEQ ID NO: 162754 - DNA, 75 bp, Artificial Sequence
  Synthetic
ctgtcctgaaagacatcatcggcatatgttatggggccacggtcaagggcatgcaatcctacgggctggagcgct

SEQ ID NO: 162755 - DNA, 75 bp, Artificial Sequence
  Synthetic
cgctgaacgtgcccggggcggcgggtcgggaccgagacctggtgtaccggatcgccaaccagatctttggggagg

SEQ ID NO: 162756 - DNA, 75 bp, Artificial Sequence
  Synthetic
tgaggttagccaccgtcggctaccccaaggccggggtttacagtggcctcattggaggcgccacatctgtgcttc

SEQ ID NO: 162757 - DNA, 75 bp, Artificial Sequence
  Synthetic
cccgaggtcaagtcccgggggaggagaagagcggcttcccgcctagagcatttgcaagtcaggattctctaatcc

SEQ ID NO: 162758 - DNA, 75 bp, Artificial Sequence
  Synthetic
gaagagcggcttcccgcctagagcatttgcaagtcaggattctctaatccctctgggagaagggtattcggcttg

SEQ ID NO: 162759 - DNA, 75 bp, Artificial Sequence
  Synthetic
tttgcaagtcaggattctctaatccctctgggagaagggtattcggcttgtccgctgtttttgtgcctagttttg

SEQ ID NO: 162760 - DNA, 75 bp, Artificial Sequence
  Synthetic
ggcccactacgtgaggcccacggtggcggcagacccccaggcctccatcagctctcttttccccgggctggtttt

SEQ ID NO: 162761 - DNA, 75 bp, Artificial Sequence
  Synthetic
tctgggtagcatatactacccaaatctatatctgggtagcatatgctacccaaatctatatctgggtagcatatg

SEQ ID NO: 162762 - DNA, 75 bp, Artificial Sequence
  Synthetic
tgccaatatagtagaagagctgcttctcaaggggggcactaagcatgcaggcaggggaattcaggccgctaatga

SEQ ID NO: 162763 - DNA, 75 bp, Artificial Sequence
  Synthetic
ccataaacctgaccggacaaaagtttgacaccctctttgagattatcaaccagaagcttttatttcacgacccgg

SEQ ID NO: 162764 - DNA, 75 bp, Artificial Sequence
  Synthetic
ctgccatgctggcggcacgcacacagctgcgtctagccttcgaggacggcgtcggtgttgccctggggcgcccct

SEQ ID NO: 162765 - DNA, 75 bp, Artificial Sequence
  Synthetic
aacatttgtgcgcttcactgggtgcgtcttgggcgtgggccaaggcagtttcctcggtttttttgcaggcacacg

SEQ ID NO: 162766 - DNA, 75 bp, Artificial Sequence
  Synthetic
gtaaccgagtggtactggttcaactccagggtctagcacctgtgacaaccgcctcacccgtacctgccttgggtt

SEQ ID NO: 162767 - DNA, 75 bp, Artificial Sequence
  Synthetic
tgaaccggctccatattgggatcgatatatggcagctcatcgtccgaggactctagctccacgtccgaaccctgt

SEQ ID NO: 162768 - DNA, 75 bp, Artificial Sequence
  Synthetic
accatcacatggggcattaggcgactctgcatcagcatcgcttaagtatgagtgggcagcagagaggctcggtta

SEQ ID NO: 162769 - DNA, 75 bp, Artificial Sequence
  Synthetic
ggtggccccaagctgagccagttcctcgcactggagtgggtcattggcaaaaaggtaaataaagtcatcgcacgg

SEQ ID NO: 162770 - DNA, 75 bp, Artificial Sequence
  Synthetic
aaaggtaaataaagtcatcgcacgggggttttgcctccttctcgtctcttgtttcgggtaggggagtaaggccgt

SEQ ID NO: 162771 - DNA, 75 bp, Artificial Sequence
  Synthetic
gtttcgggtaggggagtaaggccgtgccaggccgccatgctcagggccacggcgtgccagaggccctcgtagtcg

SEQ ID NO: 162772 - DNA, 75 bp, Artificial Sequence
  Synthetic
gccctttattgtggcatcctaaggagggattcaactctatggccagagctaggatgtacaaattggcgctccctc

SEQ ID NO: 162773 - DNA, 75 bp, Artificial Sequence
  Synthetic
ccagaagcagatagccggccaggcagaggaaggccacgaagagggggcgaaggcgtgcccgaacccgggtttcat

SEQ ID NO: 162774 - DNA, 75 bp, Artificial Sequence
  Synthetic
gaggaaggccacgaagagggggcgaaggcgtgcccgaacccgggtttcatgctcgtctgcaccccagtggacaag

SEQ ID NO: 162775 - DNA, 75 bp, Artificial Sequence
  Synthetic
ttctgggccacatggacttgaagcagaagttggccggggactggccagtgaggatggatttcagaaactccaatt

SEQ ID NO: 162776 - DNA, 75 bp, Artificial Sequence
  Synthetic
agacaaacttccaacaacaccgcgtcggctcggaaaggcggctcggaaaggctgtatgacttccaggctgtcttt

SEQ ID NO: 162777 - DNA, 75 bp, Artificial Sequence
  Synthetic
ctgcgcagtccaagctgcgcccacacacatgcacagacggcccctgtgacatcaggccggtcatgcaaaaacaga

SEQ ID NO: 162778 - DNA, 75 bp, Artificial Sequence
  Synthetic
aaccccccggccatggggaagtattttatcaggatgtgtaaaaagtccatgcccgtgatgaggctagagatccag

SEQ ID NO: 162779 - DNA, 75 bp, Artificial Sequence
  Synthetic
gtatgaaaatgccattaaggccatgcacaagaatgtgactcgggcgaggcatggaagggaagacacgtcggctga

SEQ ID NO: 162780 - DNA, 75 bp, Artificial Sequence
  Synthetic
cacaagaatgtgactcgggcgaggcatggaagggaagacacgtcggctgaggttttagcatgccagatgaaattt

SEQ ID NO: 162781 - DNA, 75 bp, Artificial Sequence
  Synthetic
cacccgggccagggcccggtaaagcaggtaccagtattcatccggcaccttgcgcgccagcacacgattcgtgcg

SEQ ID NO: 162782 - DNA, 75 bp, Artificial Sequence
  Synthetic
cgagtctggtgccaggtcagttgcgcccctggattgttggattttgcatgatcgccatttgctgtcggcctccgt

SEQ ID NO: 162783 - DNA, 75 bp, Artificial Sequence
  Synthetic
cttggcccctgaggccgtcagggaaacgatggggcaaactgggggaacagcaggggaggtccccccgggctggcc

SEQ ID NO: 162784 - DNA, 75 bp, Artificial Sequence
  Synthetic
tagggcccggaagcttgtcattggagtttcctgaactacaggcgtagggcctattgtagcaggcatgtcttcatt

SEQ ID NO: 162785 - DNA, 75 bp, Artificial Sequence
  Synthetic
cgcagagcgcaaagcggccagttctttagcatcttcaggaggagcccgtgaatcccaggtgtcattcgcgcgtca

SEQ ID NO: 162786 - DNA, 75 bp, Artificial Sequence
  Synthetic
ttattcaagttttggccacgtttaccgcagacccgggggacaccatagtctggatgaagttaaacgtggaggaga

SEQ ID NO: 162787 - DNA, 75 bp, Artificial Sequence
  Synthetic
gcaggaggaggggcaggagcaggaggaggggcaggaggagcaggaggggcaggagcaggaggaggggcaggagca

SEQ ID NO: 162788 - DNA, 75 bp, Artificial Sequence
  Synthetic
acatagcgggcacaatggtgcaggcaccgtctgtatacgtctgcggctttgtggagcgcccggacgccccaccca

SEQ ID NO: 162789 - DNA, 75 bp, Artificial Sequence
  Synthetic
gaggaaacatgagtcaggactggatgctggctacctgaagagtgtcaacgatgcatatcacgccgtttactgtgc

SEQ ID NO: 162790 - DNA, 75 bp, Artificial Sequence
  Synthetic
tcctacactagtatttattgcccaaggggtttgtgagggttatattggtgtcatagcacaatgccaccactgaac

SEQ ID NO: 162791 - DNA, 75 bp, Artificial Sequence
  Synthetic
cccgaggacattgtgaaggtatgtgccggtctaacaacaatcacgacagtatgtcatcaaagccacacccccata

SEQ ID NO: 162792 - DNA, 75 bp, Artificial Sequence
  Synthetic
cggctcagtctttggcctttaccagagccgagcgggtctctttagcgcagcctcgattacctctggggtcttcct

SEQ ID NO: 162793 - DNA, 75 bp, Artificial Sequence
  Synthetic
gacaaggcagcccgtcttctccgccttcgcctgatgcgctgcatccagcctctgttttcatcacccctgctttgc

SEQ ID NO: 162794 - DNA, 75 bp, Artificial Sequence
  Synthetic
gtccctgctggactcaatttaccacgattgcgatattgcacagagtcagcgcctgcccctccctcgagaacccaa

SEQ ID NO: 162795 - DNA, 75 bp, Artificial Sequence
  Synthetic
gattgcgatattgcacagagtcagcgcctgcccctccctcgagaacccaagttggaggctctgcacgcctggctc

SEQ ID NO: 162796 - DNA, 75 bp, Artificial Sequence
  Synthetic
agaagccccactggatggaggccccggcccagggtcctgatcatgctcaccggtagtctgtacatcatctccccg

SEQ ID NO: 162797 - DNA, 75 bp, Artificial Sequence
  Synthetic
acccagacataccccaaaccaccgcagatggaggcaagctgtccttctttgaccacgtgtctatctgtgccctgg

SEQ ID NO: 162798 - DNA, 75 bp, Artificial Sequence
  Synthetic
ctacggtacagaccttgcgtgggtcctgaagcactttagtgacctggaaccgtctatcgccgcccagattgagaa

SEQ ID NO: 162799 - DNA, 75 bp, Artificial Sequence
  Synthetic
ccaccttgggaaaaacaagtcccacctcagcagtgactaccccaaccccaaatgccaccagccccagcctggctg

SEQ ID NO: 162800 - DNA, 75 bp, Artificial Sequence
  Synthetic
cgttaacaggaagaatgatggtgggggaaccaccggctaagagctttctgttgctgtatctcctaggctttcctg

SEQ ID NO: 162801 - DNA, 75 bp, Artificial Sequence
  Synthetic
ccagttcttgttacatgggcgaaatcactcatcgttcgatgtttcagaagaggaaggggaagaaactgcaatgtc

SEQ ID NO: 162802 - DNA, 75 bp, Artificial Sequence
  Synthetic
agaccccttctcctggttccgcaaaacttcgtgcacagaaggaggtgcggactccacgagccggagcttcatgta

SEQ ID NO: 162803 - DNA, 75 bp, Artificial Sequence
  Synthetic
ggcagccgatagcaccctagatctagtgaatcatggcgagcccggaagagaggctcctagacgagctcaataacg

SEQ ID NO: 162804 - DNA, 75 bp, Artificial Sequence
  Synthetic
aaccgcgtggagactctgaggcaggacaggggtgtggccaatatcccagccgagtcgtatttaaaggccagcgat

SEQ ID NO: 162805 - DNA, 75 bp, Artificial Sequence
  Synthetic
tccgcgttaaaacaaaagaatggtggcaagggtaagccttctggtctcttcgaacacctggccgcccatgggcgt

SEQ ID NO: 162806 - DNA, 75 bp, Artificial Sequence
  Synthetic
acaggggtgtggccaatatcccagccgagtcgtatttaaaggccagcgatgccccggacctacaaaagccggaca

SEQ ID NO: 162807 - DNA, 75 bp, Artificial Sequence
  Synthetic
gagtttagtaagttatccaagcatgctgcccagctgaagcggctaagtgggagtgtgatgaatgttctgaatctg

SEQ ID NO: 162808 - DNA, 75 bp, Artificial Sequence
  Synthetic
aggcacttcagagcccaccaccggcctccacagacccagacaccatgctatcaggtaacgcaggagaaggagcaa

SEQ ID NO: 162809 - DNA, 75 bp, Artificial Sequence
  Synthetic
ggttactgcttgaactttggaaagcagacaggtgtaggaggcaggctcaatctcgggctggcagccccgaatccg

SEQ ID NO: 162810 - DNA, 75 bp, Artificial Sequence
  Synthetic
atgtcccccagcattggtgtaagagcttcagccaagagttacacataaaggcaatgttgtgttgcagtccacaga

SEQ ID NO: 162811 - DNA, 75 bp, Artificial Sequence
  Synthetic
gcgggttccaattgtgacccacctgacaaatcatgtaccagtaatcaaacctgcctgttccctatttttggaagg

SEQ ID NO: 162812 - DNA, 75 bp, Artificial Sequence
  Synthetic
ctgcctgttccctatttttggaaggtgcccctggtgtgggaaagactactatgctgaatcatttgaaggctgtct

SEQ ID NO: 162813 - DNA, 75 bp, Artificial Sequence
  Synthetic
gaggctgctagactgccagatgatccaataattgttgaggatgacgatgaaagtgaggaaattgaagataaatgt

SEQ ID NO: 162814 - DNA, 75 bp, Artificial Sequence
  Synthetic
gccccgctgccccccttttcccaccaggcaatagccaccgcgccttcctacggtcctggggccggagcggtcgcc

SEQ ID NO: 162815 - DNA, 75 bp, Artificial Sequence
  Synthetic
aaggggatgtcaaaatactgtggctgtgttgccggtaccggaggtaccgggcccatactagccctcaacggggcc

SEQ ID NO: 162816 - DNA, 75 bp, Artificial Sequence
  Synthetic
caggaggttactacgccgggcccgcgggcggggacccgggtgccttcttggcgatggacgctcacacctaccacc

SEQ ID NO: 162817 - DNA, 75 bp, Artificial Sequence
  Synthetic
tcccgggccacatcagcgacctggctaaagggggaaccagggaacatctgctgctctggttccaacggcctctcc

SEQ ID NO: 162818 - DNA, 75 bp, Artificial Sequence
  Synthetic
caggcctcctcgctgagtgcggcggccgtctggcgcgcagggctgctggccccgggggaggtggcggtcgccggg

SEQ ID NO: 162819 - DNA, 75 bp, Artificial Sequence
  Synthetic
ctttggcttgccgggcctctttggcccccctccacccgtgcctccttactacggatcccacttgcgggcagacta

SEQ ID NO: 162820 - DNA, 75 bp, Artificial Sequence
  Synthetic
ccgtctggcgcgcagggctgctggccccgggggaggtggcggtcgccgggggtggcagtggaggggggagcttca

SEQ ID NO: 162821 - DNA, 75 bp, Artificial Sequence
  Synthetic
acggatcccacttgcgggcagactacgtccccgctccctcgcgatccaacaagcggaaaagagaccccgaggagg

SEQ ID NO: 162822 - DNA, 75 bp, Artificial Sequence
  Synthetic
actagcctgtttgacctgtgcctcagcacgcaaacgagccagacggtcacgcacggacatctgactgggagaacg

SEQ ID NO: 162823 - DNA, 75 bp, Artificial Sequence
  Synthetic
gcacggacatctgactgggagaacggggtggatttggcgtccaaggtgcgggcctccaacgctcccgcgtgcgtc

SEQ ID NO: 162824 - DNA, 75 bp, Artificial Sequence
  Synthetic
gggggaggatgccaccctctaccgcaaggacatagcgggcctctccaagagcgtgaatgagttacagcacacgct

SEQ ID NO: 162825 - DNA, 75 bp, Artificial Sequence
  Synthetic
ttaatcatccagtgggacccactccccatcagacacctcaagtggaaataacaccatataagcccacttgggctc

SEQ ID NO: 162826 - DNA, 75 bp, Artificial Sequence
  Synthetic
ctgcatagcaatcttaggaggtgccggacgaactggcatggggtaaactggtcgctcaagtgccactgtcgggac

SEQ ID NO: 162827 - DNA, 75 bp, Artificial Sequence
  Synthetic
aaggacatagcgggcctctccaagagcgtgaatgagttacagcacacgctacaggccctgcgccgggagacgctg

SEQ ID NO: 162828 - DNA, 75 bp, Artificial Sequence
  Synthetic
ctgttgcgccagtgggcacccgccaccatgcagacaccaccgagagcgcccactcccatgtcaccacctgaggtg

SEQ ID NO: 162829 - DNA, 75 bp, Artificial Sequence
  Synthetic
cacccacccggggccttacggatttcagcctcatcaaagctacgaagtgcccagatacgtccctcatccgccccc

SEQ ID NO: 162830 - DNA, 75 bp, Artificial Sequence
  Synthetic
agggacgggttctactggcatgtgttgtggtctaacgggtgcaaaggcctgccccacagcctgtgtcagggatgg

SEQ ID NO: 162831 - DNA, 75 bp, Artificial Sequence
  Synthetic
ggttcctgccgtgtgagaacaagagtaaagctgtggaacagataaaaaatgcctttaacaagctgcaggaaaaag

SEQ ID NO: 162832 - DNA, 75 bp, Artificial Sequence
  Synthetic
cagcctcatcaaagctacgaagtgcccagatacgtccctcatccgcccccaccaccaacttctcaccaggcagct

SEQ ID NO: 162833 - DNA, 75 bp, Artificial Sequence
  Synthetic
ccgcgagatttggggtaggcggagcctcaggagggtcccctccatagggttgaaccaggagggggaggattgggc

SEQ ID NO: 162834 - DNA, 75 bp, Artificial Sequence
  Synthetic
gcgggctccaatcatcttcatatccaggatatgcgggtccctggaccccaagatctcaacatccatgttataggc

SEQ ID NO: 162835 - DNA, 75 bp, Artificial Sequence
  Synthetic
ttgggggttctgggacttgcgccgacccgtgactggtagctgtctcgtcgctttgtgggacctcgggtcttggtt

SEQ ID NO: 162836 - DNA, 75 bp, Artificial Sequence
  Synthetic
cccctttcgactgtcatttacaataaaatgaaaccttttattcttgattgcttcttgtgttcttgccgcccaggt

SEQ ID NO: 162837 - DNA, 75 bp, Artificial Sequence
  Synthetic
agcacaggtggtctgccaaagctgctcgggggatgatgggcgggaccaacaacccccacctgttgatggcttcgg

SEQ ID NO: 162838 - DNA, 75 bp, Artificial Sequence
  Synthetic
aggcccggtggaaggaggcgccatgacacgaggcccggtggaaggaggcgccatgacacgaggcctggtggaagg

SEQ ID NO: 162839 - DNA, 75 bp, Artificial Sequence
  Synthetic
gttagtacctgtccattcacaggggtatccagcccttgcgccgcctcccccagcccgccagccaccccagacagg

SEQ ID NO: 162840 - DNA, 75 bp, Artificial Sequence
  Synthetic
cctgtgcagacgtcttataaatatagggggtcgtttgaccttaggtccatctctggacactatacaaggaagatc

SEQ ID NO: 162841 - DNA, 75 bp, Artificial Sequence
  Synthetic
gcagcctacaaaagtacactagctgtttgctctattcgccactagagaccgccaaaatgcgaaactacaggcccg

SEQ ID NO: 162842 - DNA, 75 bp, Artificial Sequence
  Synthetic
gaccacctggccagggcggaggagatccgccaggacctggatgctgtagtggccttctctgatggcctggagagc

SEQ ID NO: 162843 - DNA, 75 bp, Artificial Sequence
  Synthetic
tcctcactttcttcccgcgtttcaccgatagcaccttcgacatgttccccttcagttctaagcaagtcttgtcca

SEQ ID NO: 162844 - DNA, 75 bp, Artificial Sequence
  Synthetic
tcagggccacatcccctcggcccgcggacgccgcctcgccagcccccgggccttcatgggcccgctttctacctc

SEQ ID NO: 162845 - DNA, 75 bp, Artificial Sequence
  Synthetic
ggggctatggtagtggctgggataacagtaagatgcatacgctgagtgagcgtccggttggcatggtattggtcg

SEQ ID NO: 162846 - DNA, 75 bp, Artificial Sequence
  Synthetic
gccgggcggctcggccaaggagggcggccttgcgaacaatcattagtagctaccaacaagggcccccagatgccc

SEQ ID NO: 162847 - DNA, 75 bp, Artificial Sequence
  Synthetic
ggacaaatccgttctctgcaaaaatcctaggaattccataaatgaaacacactggtcaggtgttaaaacttcctc

SEQ ID NO: 162848 - DNA, 75 bp, Artificial Sequence
  Synthetic
gatccaaggtgacccctgttagctatttgatctttgactgacacataaacatggtttaaggaatgaacactcatg

SEQ ID NO: 162849 - DNA, 75 bp, Artificial Sequence
  Synthetic
atttctcagcgtcacattgcacgtgtagtaacctgcatgcgcaagggtcacattggggattatcagagagacgga

SEQ ID NO: 162850 - DNA, 75 bp, Artificial Sequence
  Synthetic
atagccatatagtcaaagaaaatcctgtagcggggattacagctctgtacaatgttacccacggagctctgaaca

SEQ ID NO: 162851 - DNA, 75 bp, Artificial Sequence
  Synthetic
gacagagccaggcacatctacagcatcaacccagcctctctgggcaaaattagggctgggggcgtctgcgaggtc

SEQ ID NO: 162852 - DNA, 75 bp, Artificial Sequence
  Synthetic
ttgtttggaagggcccggcctttcaggggtgctctgtgcttcttctgcctcatcagatctataggaggtcttaac

SEQ ID NO: 162853 - DNA, 75 bp, Artificial Sequence
  Synthetic
ttcctccgcagtatctatgcctcctgctacgccaaccacagaggcaccaagcccatcttctacctcctggacccc

SEQ ID NO: 162854 - DNA, 75 bp, Artificial Sequence
  Synthetic
cgttagttatatgagttccgttgttggaagtagctacggccaagggcagttgtccatccccgggagtgtatcccc

SEQ ID NO: 162855 - DNA, 75 bp, Artificial Sequence
  Synthetic
cagctggtgatcggtgtagctgtacatccagctgctgtatgcctggtaacccataggccatccggcggccagggt

SEQ ID NO: 162856 - DNA, 75 bp, Artificial Sequence
  Synthetic
agattcactctagcacctgcatgggcggtgacattttcaaatttaaccagatctgagaaaaatgcacaaacagac

SEQ ID NO: 162857 - DNA, 75 bp, Artificial Sequence
  Synthetic
atccagctgctgtatgcctggtaacccataggccatccggcggccagggtttgcagtctccatttggcctgatct

SEQ ID NO: 162858 - DNA, 75 bp, Artificial Sequence
  Synthetic
atctaaaatttgcagaagaacacagagtttttgtagtgggaccttagtcccccccttaggggccgccaattggtt

SEQ ID NO: 162859 - DNA, 75 bp, Artificial Sequence
  Synthetic
aagggctacatttttcaagtcgtgggcgaattaactgagcttgcgtaagcaaggcgtaattaatcccgcccgtag

SEQ ID NO: 162860 - DNA, 75 bp, Artificial Sequence
  Synthetic
ctacgggaagctggattcctccgacgatctctaatggcctgtcgaatggccatggcatacattatgtacatctcg

SEQ ID NO: 162861 - DNA, 75 bp, Artificial Sequence
  Synthetic
agttttaaaactccctgcttctcaggcctaaatacgtggtggggtgtgcttaggatcactttcatattctgcaac

SEQ ID NO: 162862 - DNA, 75 bp, Artificial Sequence
  Synthetic
cggtgtgctgctccacgccctttatgcgctttgccggggtggaaaactccactctggccagctgcatcctcacca

SEQ ID NO: 162863 - DNA, 75 bp, Artificial Sequence
  Synthetic
ggtaaggcggtggcggccaagcgcctgggggatgtcatctcagtctcccagtgcgtgcccgttaaccaggccacc

SEQ ID NO: 162864 - DNA, 75 bp, Artificial Sequence
  Synthetic
aacagccatacccggaagaggagctgccggttgccatttttcaagctgctaaaccacgagtggcagcaggcctaa

SEQ ID NO: 162865 - DNA, 75 bp, Artificial Sequence
  Synthetic
gccggttgccatttttcaagctgctaaaccacgagtggcagcaggcctaagaagctcctcagcaacatggagacc

SEQ ID NO: 162866 - DNA, 75 bp, Artificial Sequence
  Synthetic
gtatttgaaatctgggatccgaaaaactggtctatggctcgtgtgtcggtgcgctgaaaccaacggcaacaaatt

SEQ ID NO: 162867 - DNA, 75 bp, Artificial Sequence
  Synthetic
tggccgaggcggccacccggcgtctacacctatcgtccctgctcccccaggcgatgcagcggcgcaagcctgccg

SEQ ID NO: 162868 - DNA, 75 bp, Artificial Sequence
  Synthetic
agggacagctgggcaccgacaacgagatcttccttacaaaaaagatgacggaggtgtgccaggcgaccagccagt

SEQ ID NO: 162869 - DNA, 75 bp, Artificial Sequence
  Synthetic
ccatagggatgctcaccgtagccgcggctccaaccgcttgaagaagtgttcttagatctagtggaaacctgcgga

SEQ ID NO: 162870 - DNA, 75 bp, Artificial Sequence
  Synthetic
atgtgaggtaagagatcgctaaaaatgggatcagggtatgtaaaccgagttttgcgggggatggtgagccagaca

SEQ ID NO: 162871 - DNA, 75 bp, Artificial Sequence
  Synthetic
cggctggggtgggagcatgggtcgtgctggagctgacccaccggcatcatgatcgacccgctttctcttcgtacc

SEQ ID NO: 162872 - DNA, 75 bp, Artificial Sequence
  Synthetic
cacgcctgcttcacgcctcgtttactaatggaatattaataaatatcttcctgttggctctctttgaagtggttg

SEQ ID NO: 162873 - DNA, 75 bp, Artificial Sequence
  Synthetic
gaaatcgaacacgttagtctttagaggtaccccaaaattcagtgcccagattcatgtaaagggaagtgggtttat

SEQ ID NO: 162874 - DNA, 75 bp, Artificial Sequence
  Synthetic
tttgcgggggatggtgagccagacacggcgggtggggggaaggagctgacacgagtgcgtagaaagggccaaaaa

SEQ ID NO: 162875 - DNA, 75 bp, Artificial Sequence
  Synthetic
cataataattatttcagatacatgctcacgtgcaggaggctgtttcttcagtcctagagggaaggagaatcacat

SEQ ID NO: 162876 - DNA, 75 bp, Artificial Sequence
  Synthetic
ggctccaaccgcttgaagaagtgttcttagatctagtggaaacctgcggagaatggcttctcgcccagggagatc

SEQ ID NO: 162877 - DNA, 75 bp, Artificial Sequence
  Synthetic
ttcccaatctcccgccgatacctgttcctgcacaaccgaggtagatgggacttcttcttccatgttgtcatccag

SEQ ID NO: 162878 - DNA, 75 bp, Artificial Sequence
  Synthetic
ggtgccattgtttaccgccatcgcacttgttattgttctactcctggcatactttttgccacccagggtaagaat

SEQ ID NO: 162879 - DNA, 75 bp, Artificial Sequence
  Synthetic
gtgtttcctgccttcatgcaaatatcctacctcccccggcctggtgcaaaatgtctgcctcagaatactaacagc

SEQ ID NO: 162880 - DNA, 75 bp, Artificial Sequence
  Synthetic
ggccgggggacccggcctgtccttgtccattttgtctgcaacaaaagtgtgactcaccaacaccgcacccccctt

SEQ ID NO: 162881 - DNA, 75 bp, Artificial Sequence
  Synthetic
atgtctgcctcagaatactaacagctaatccaagctaacattctatcagtaaacgggcagaaaactgataaggac

SEQ ID NO: 162882 - DNA, 75 bp, Artificial Sequence
  Synthetic
ggttttgctggccctggagctgaagttgatggatgggcaggctccctcccattatgccataaacctgaccggaca

SEQ ID NO: 162883 - DNA, 75 bp, Artificial Sequence
  Synthetic
gactcaccaacaccgcaccccccttgtacctattaaagagggtgctgcctagaaatcggtgctgagacaatggag

SEQ ID NO: 162884 - DNA, 75 bp, Artificial Sequence
  Synthetic
agaaatcggtgctgagacaatggaggcagccttgcttgtgtgtcagtacaccatccagagcctgatccatctcac

SEQ ID NO: 162885 - DNA, 75 bp, Artificial Sequence
  Synthetic
gcagccttgcttgtgtgtcagtacaccatccagagcctgatccatctcacgggtgaagatcctggttttttcaat

SEQ ID NO: 162886 - DNA, 75 bp, Artificial Sequence
  Synthetic
cccccccgggccgatggctgaggcccggaatatgcaagtgcatctttctaaccagtaggggcctccacctaggtg

SEQ ID NO: 162887 - DNA, 75 bp, Artificial Sequence
  Synthetic
accagtaggggcctccacctaggtgctttgttaatctttagtgggaactagtgggagtgctgtgcctagggtacc

SEQ ID NO: 162888 - DNA, 75 bp, Artificial Sequence
  Synthetic
gtgggagtgctgtgcctagggtacccctatcctataggtcctaccggagctccttgccttgataatccctgtaaa

SEQ ID NO: 162889 - DNA, 75 bp, Artificial Sequence
  Synthetic
agatgtcaatgtaactatcaatttcgatgtcgggggcaaaaagcatcaacttgatcttgactttggccagctgac

SEQ ID NO: 162890 - DNA, 75 bp, Artificial Sequence
  Synthetic
aaaaagtaagcctgcgcgtgaccccccgcctggtgctggaagttaaccgccataacgccatctgcgtggccacca

SEQ ID NO: 162891 - DNA, 75 bp, Artificial Sequence
  Synthetic
gcgggccgacacgcagggggatgaactcctgctggccctccctcgtctctcagtcaccctacctggagagggggc

SEQ ID NO: 162892 - DNA, 75 bp, Artificial Sequence
  Synthetic
cacacaccacctaagaacaaggcatcgttaacctttggtggaacctagtgttagtgttgtgctgtaaataagtgt

SEQ ID NO: 162893 - DNA, 75 bp, Artificial Sequence
  Synthetic
gatgtcgggggcaaaaagcatcaacttgatcttgactttggccagctgacaccccatacgaaggctgtctaccaa

SEQ ID NO: 162894 - DNA, 75 bp, Artificial Sequence
  Synthetic
ggatgtgcattacaaggagattcctcgcctctttgcagcgggccccgaggggcgcaggcggctcggcatgtactg

SEQ ID NO: 162895 - DNA, 75 bp, Artificial Sequence
  Synthetic
ccctgcactagcttcgctccactggggatctttgccagccttccgtttaaacgagagaatagtagtagggtccag

SEQ ID NO: 162896 - DNA, 75 bp, Artificial Sequence
  Synthetic
ccacctttgtggtggcctgctccattcttcagggatcccccacttatgattccagggacatggcctccatgggcc

SEQ ID NO: 162897 - DNA, 75 bp, Artificial Sequence
  Synthetic
ggagcaacaagtaagcctggaatctgtagatgtctactttcaagatgtgtttggaaccatgtggtgccaccatgc

SEQ ID NO: 162898 - DNA, 75 bp, Artificial Sequence
  Synthetic
gcactttattaataaacaattacagatacaaaaacttgagtctctcgaggtctgcgatgaggcggtgggtggaac

SEQ ID NO: 162899 - DNA, 75 bp, Artificial Sequence
  Synthetic
ctgtaaataagtgcctagcacatcacgtaggcaccaggtgtcaccagggctacttgcctcggcatctcctcaccg

SEQ ID NO: 162900 - DNA, 75 bp, Artificial Sequence
  Synthetic
cacctgtccctcaggctctttatcttggagtggagctcttgggttatgggcttcttaacggcgggcaccatgccg

SEQ ID NO: 162901 - DNA, 75 bp, Artificial Sequence
  Synthetic
cgtaggcaccaggtgtcaccagggctacttgcctcggcatctcctcaccggagaaggggttaacaaacccgtggg

SEQ ID NO: 162902 - DNA, 75 bp, Artificial Sequence
  Synthetic
gtcagtacaagcacaagcccgcccgcctagaagcattccagaaacaagtagtgttacattctttttattttctga

SEQ ID NO: 162903 - DNA, 75 bp, Artificial Sequence
  Synthetic
tataacggcagtagtgagggcacaggggctggatgtcacgctacccttaagtttgccaacgtcagctcaagactc

SEQ ID NO: 162904 - DNA, 75 bp, Artificial Sequence
  Synthetic
tagccaataagagagctcaagacgcagggctcgcaaagtatagtggccccgtgggaccttagaggtggagcaacg

SEQ ID NO: 162905 - DNA, 75 bp, Artificial Sequence
  Synthetic
tccactatgtctcgcccgggctatatgtcgccttacctcccctatatagtcacgaccccaccgaaccaggcatga

SEQ ID NO: 162906 - DNA, 75 bp, Artificial Sequence
  Synthetic
tggctcccacccccacaggacctgtccatgaaccggtcggatccctaacgccagccccggtgcccaagcccagca

SEQ ID NO: 162907 - DNA, 75 bp, Artificial Sequence
  Synthetic
accctcctgtcaccacctccctgataatgtcttcaatagacagaaattgggtgaccactgagggagtgttccaca

SEQ ID NO: 162908 - DNA, 75 bp, Artificial Sequence
  Synthetic
ctcggtaatgagatagatattgagtgtattatggaggaaggcgaaatttcacaagttctgcccggagacaacaaa

SEQ ID NO: 162909 - DNA, 75 bp, Artificial Sequence
  Synthetic
ttactcaatccattatcttggtaccccggcgtcggcacctaggccactcccctctccctccccagccccaattcc

SEQ ID NO: 162910 - DNA, 75 bp, Artificial Sequence
  Synthetic
tgtagaataaaattttatgcatcatcttctaatctgtgccgcttggagggaaacatgaccacctgaagtctgtta

SEQ ID NO: 162911 - DNA, 75 bp, Artificial Sequence
  Synthetic
agagccatgttcccagcggcggaattctcacatcaacgagtcccgtggccaccccaatacctggtacagggtatg

SEQ ID NO: 162912 - DNA, 75 bp, Artificial Sequence
  Synthetic
tctcacatcaacgagtcccgtggccaccccaatacctggtacagggtatgcatacagcctgcgtctgacaccacg

SEQ ID NO: 162913 - DNA, 75 bp, Artificial Sequence
  Synthetic
gccgcgggtggggcggggggcgatggactgctggggggtgaggaagtcggagtggtaagctccgtcaggttcttg

SEQ ID NO: 162914 - DNA, 75 bp, Artificial Sequence
  Synthetic
atgtcgcgtccgccgttttcactgaaattattgacaccttgaccaagagcttcgactccaagcgtgtagaggtca

SEQ ID NO: 162915 - DNA, 75 bp, Artificial Sequence
  Synthetic
gtaatacatgctatccttacattttggcattttgggcagctgggaggcggcggatgggggtgcttcttttcgcac

SEQ ID NO: 162916 - DNA, 75 bp, Artificial Sequence
  Synthetic
cctcaaggtgaatatagctgcccatcgacgtatcgctggaaaccggtgggccgctgttcacctaaagtgacgcaa

SEQ ID NO: 162917 - DNA, 75 bp, Artificial Sequence
  Synthetic
ctgggaatggaccgaaggcgagcgggggagattactgcattcagtccaacattgtgttctctgatgagattccag

SEQ ID NO: 162918 - DNA, 75 bp, Artificial Sequence
  Synthetic
cccagagccctcatcgcagggttcttaccatgcggccatgtaggcccacttaacactacaagacctacgcctctc

SEQ ID NO: 162919 - DNA, 75 bp, Artificial Sequence
  Synthetic
ggtctgtcagccgccagggtccgtttaccaggctttcaggtgtggaatttagatagagtgggtgtgtgctcttgt

SEQ ID NO: 162920 - DNA, 75 bp, Artificial Sequence
  Synthetic
ggggtggagggccgatatcacatcaagcagaaaggccataatctctcgaaagtaggcggtggggctgagaccatg

SEQ ID NO: 162921 - DNA, 75 bp, Artificial Sequence
  Synthetic
gggagattactgcattcagtccaacattgtgttctctgatgagattccagcttcacaggacatgccgacaaacac

SEQ ID NO: 162922 - DNA, 75 bp, Artificial Sequence
  Synthetic
ttaattacaccaagatcaccaccctctatccatatcccacaattgataaacctccgcatgtccaaccaccacgtt

SEQ ID NO: 162923 - DNA, 75 bp, Artificial Sequence
  Synthetic
tcacttctgaggacgcaaactcgccaaatgttacagtgactgccttttgggcctggccaaacaacactgaaactg

SEQ ID NO: 162924 - DNA, 75 bp, Artificial Sequence
  Synthetic
aaatgttacagtgactgccttttgggcctggccaaacaacactgaaactgactttaagtgcaaatggactctcac

SEQ ID NO: 162925 - DNA, 75 bp, Artificial Sequence
  Synthetic
ctgaccgcgtccgcccggcgcaggatcaaggaccgcccccaggtcttgttgtagagggacacggttaggacggcc

SEQ ID NO: 162926 - DNA, 75 bp, Artificial Sequence
  Synthetic
acgcaggcatacaaggttattacccagtccttgtatgcctggtgtccccttagtgggacgcaggcctaggtagca

SEQ ID NO: 162927 - DNA, 75 bp, Artificial Sequence
  Synthetic
atcggacatttgacattactgtctcgggtcttggcacggcccccaagacactcattatcacacgaacggctacca

SEQ ID NO: 162928 - DNA, 75 bp, Artificial Sequence
  Synthetic
gggtcttggcacggcccccaagacactcattatcacacgaacggctaccaatgccaccacaacaacccacaaggt

SEQ ID NO: 162929 - DNA, 75 bp, Artificial Sequence
  Synthetic
tgcatggcagcagacaaggacaggtgccagatgtgcctgggctatcgtcctccgtccagccacgcaggatgttca

SEQ ID NO: 162930 - DNA, 75 bp, Artificial Sequence
  Synthetic
gcggcatgggagtgggcgccccccgaggcctctgcatggcggtgggcggcccctgaggcggcggcatgggagtgg

SEQ ID NO: 162931 - DNA, 75 bp, Artificial Sequence
  Synthetic
gccggttgacatcatgagcaagggcccaggggagggaccaggtgggtggtgtgtgcccgggggattggaagtgtg

SEQ ID NO: 162932 - DNA, 75 bp, Artificial Sequence
  Synthetic
tcccctcactgtcactggcctccctccacccagacataccccaaaccaccgcagatggaggcaagctgtcgtcta

SEQ ID NO: 162933 - DNA, 75 bp, Artificial Sequence
  Synthetic
taaactgaaagttgcagctttagatggcaaggaaacttgggtttcaggcatagaaagcctggctcactatagcag

SEQ ID NO: 162934 - DNA, 75 bp, Artificial Sequence
  Synthetic
caactggatttgctgctcccaatacaacgacaggtctacccagctctactcacgtgcctaccaacctcaccgcac

SEQ ID NO: 162935 - DNA, 75 bp, Artificial Sequence
  Synthetic
atcacccggttgctgggggcctggatgaagaatctgtcagtgaccactatcaggtggtctaacacgtagcgcatc

SEQ ID NO: 162936 - DNA, 75 bp, Artificial Sequence
  Synthetic
tagaaagcctggctcactatagcagcccatgtttgttccagggtgggggaaaggcacgtgcccttagaaaactta

SEQ ID NO: 162937 - DNA, 75 bp, Artificial Sequence
  Synthetic
gcggcatgggagtgggcgccccccgaggcctctgcatggcggtgactcagcctacaacgcctcgcccatcatggg

SEQ ID NO: 162938 - DNA, 75 bp, Artificial Sequence
  Synthetic
aggcctctgcatggcggtgggcggcccctgaggcggcggcatgggagtgggcgccccctgaggcctctggatggt

SEQ ID NO: 162939 - DNA, 75 bp, Artificial Sequence
  Synthetic
agagcctctatatctaaaggcctttcctcccaatacaaatgttactaacatctgccctctggagacctgctatgt

SEQ ID NO: 162940 - DNA, 75 bp, Artificial Sequence
  Synthetic
gatggatgctggtaaggcccagcccatagaaagttcacacttgagttccatgtcgcccacacagccgatatcgca

SEQ ID NO: 162941 - DNA, 75 bp, Artificial Sequence
  Synthetic
cagcagtgactaccccaaccccaaatgccaccagccccaccccagcagtgactaccagtagagtgacccgttggt

SEQ ID NO: 162942 - DNA, 75 bp, Artificial Sequence
  Synthetic
tcttccaggcataggttacaaccagtcactgctatcaagcctactcagttcccaacgcagcacataccccccgcc

SEQ ID NO: 162943 - DNA, 75 bp, Artificial Sequence
  Synthetic
tcactgctatcaagcctactcagttcccaacgcagcacataccccccgcctctcctgccatgaggactcatggca

SEQ ID NO: 162944 - DNA, 75 bp, Artificial Sequence
  Synthetic
tttcacccaagtggactgataaagagtgggctccacctgaggtggctgatggggagtgggtctcactgcaggatt

SEQ ID NO: 162945 - DNA, 75 bp, Artificial Sequence
  Synthetic
ggcccggcgtagtaacctcctggggaggtaaagtagccgccggccggggagaccgctccggccccaggaccgtag

SEQ ID NO: 162946 - DNA, 75 bp, Artificial Sequence
  Synthetic
gtgggctccacctgaggtggctgatggggagtgggtctcactgcaggattaaatgatattggctgcatccgcaag

SEQ ID NO: 162947 - DNA, 75 bp, Artificial Sequence
  Synthetic
atctcggagccaataactacctgcccctctaatctgtacgctgcatgaaaaaccacatacacgtgatgtaagttt

SEQ ID NO: 162948 - DNA, 75 bp, Artificial Sequence
  Synthetic
tgtttccggtgccagggactgtgtcattgggccacctggagtctgacttgggtgggcaaccggccatggagtttg

SEQ ID NO: 162949 - DNA, 75 bp, Artificial Sequence
  Synthetic
attgggccacctggagtctgacttgggtgggcaaccggccatggagtttgtgcgtggctcggtgctgaactgtgg

SEQ ID NO: 162950 - DNA, 75 bp, Artificial Sequence
  Synthetic
agccagtttattgttacaccaatgccccgaaagtccccccctgtccctttgggtctcaggacccagccctggagc

SEQ ID NO: 162951 - DNA, 75 bp, Artificial Sequence
  Synthetic
ctccttttgtaggtgactatggtgttgttcaaattccctcggctcaatgggagccacacccctctcagggcacat

SEQ ID NO: 162952 - DNA, 75 bp, Artificial Sequence
  Synthetic
tcctggggcgggcagtagctgatcaagaaccggctctgacgtggcgggctcatcactttctatgtctaggtcagc

SEQ ID NO: 162953 - DNA, 75 bp, Artificial Sequence
  Synthetic
gcagtggaggatcttcgtgctcgtagaaggaggggttgagtacatcggtcggccatcgtgaggccccggccgcgt

SEQ ID NO: 162954 - DNA, 75 bp, Artificial Sequence
  Synthetic
agaaccggctctgacgtggcgggctcatcactttctatgtctaggtcagcggtgtagacacaaggggctcttctc

SEQ ID NO: 162955 - DNA, 75 bp, Artificial Sequence
  Synthetic
ccgggtccggggttccggccctggagctcggggggcggccgggtggcccaccgggtccgctgggtccgctgcccc

SEQ ID NO: 162956 - DNA, 75 bp, Artificial Sequence
  Synthetic
ctgctccatgtgctggtcgtccttttcaagaaggtctagcatggaaccgtgtgcttggtcaccctgcgtgggtgg

SEQ ID NO: 162957 - DNA, 75 bp, Artificial Sequence
  Synthetic
tcaagaaggtctagcatggaaccgtgtgcttggtcaccctgcgtgggtggtccgtgaagtataactcttgtctca

SEQ ID NO: 162958 - DNA, 75 bp, Artificial Sequence
  Synthetic
ccaccgggtccgctgggtccgctgccccgctccggcggggggtggccggctgcagccgggtccggggttccggcc

SEQ ID NO: 162959 - DNA, 75 bp, Artificial Sequence
  Synthetic
tgaaccggcagggccagtcaccttttgcgtgggtggtcgccgaaggaccactgtgggggcaggggaatcaggctt

SEQ ID NO: 162960 - DNA, 75 bp, Artificial Sequence
  Synthetic
tgcgtgggtggtcgccgaaggaccactgtgggggcaggggaatcaggcttggctcttggttgctctgttctggct

SEQ ID NO: 162961 - DNA, 75 bp, Artificial Sequence
  Synthetic
accgcgccctcctctgggccgcccggcctcgccttctcctcagcctccaacaggtgccatatcagggaagtcagg

SEQ ID NO: 162962 - DNA, 75 bp, Artificial Sequence
  Synthetic
cgtcggtgttgccctggggcgcccctcgcccatgcttgcggcgcgggagatcctggagcgtcagttctcagcctc

SEQ ID NO: 162963 - DNA, 75 bp, Artificial Sequence
  Synthetic
agtcactatggccctgcattttttggttgatttagtatctggctttcggtaaaacaccgagggcctgccgtatac

SEQ ID NO: 162964 - DNA, 75 bp, Artificial Sequence
  Synthetic
ccggccctggagctcggggggcggccgggtggcccaccgggtccgctgggtccgctgccccgctccggcgggggg

SEQ ID NO: 162965 - DNA, 75 bp, Artificial Sequence
  Synthetic
gttgatttagtatctggctttcggtaaaacaccgagggcctgccgtatactgttggactgtgcggcagtgtttgc

SEQ ID NO: 162966 - DNA, 75 bp, Artificial Sequence
  Synthetic
tttatcttcaatttcctcactttcatcgtcatcctcaacaattattggatcatctggcagtctagcagcctcgat

SEQ ID NO: 162967 - DNA, 75 bp, Artificial Sequence
  Synthetic
acgcaggcacggctgggctaatcagcttcgaggtctcccctgacgctgtggccgagtggcagaatcaccagagcc

SEQ ID NO: 162968 - DNA, 75 bp, Artificial Sequence
  Synthetic
tcgtcatcctcaacaattattggatcatctggcagtctagcagcctcgatactcatggccagtccacgggcatag

SEQ ID NO: 162969 - DNA, 75 bp, Artificial Sequence
  Synthetic
ccagaccctcggtggccacctggcgcaggtactgctccttgcgcttgagcgcgtccgagagggcgccggacgggc

SEQ ID NO: 162970 - DNA, 75 bp, Artificial Sequence
  Synthetic
gggatgcgctctcatccatggcttggatggtgagggtcgcccggtgcactggcggaaccattcacgtatatgagt

SEQ ID NO: 162971 - DNA, 75 bp, Artificial Sequence
  Synthetic
cccacaccacaagcaccagtcacaggccccataggcggcctgtttctaaacgtcccacgcataagccagtgaccc

SEQ ID NO: 162972 - DNA, 75 bp, Artificial Sequence
  Synthetic
cctggaggattgtctaccagatgttgggagggcattccataaagcaaacagggaagaaagtatagctacatcacc

SEQ ID NO: 162973 - DNA, 75 bp, Artificial Sequence
  Synthetic
gactcagccgcggcagcagcggcggcagtagccagaaacacggacatcttggactccctcacacagatccttgcc

SEQ ID NO: 162974 - DNA, 75 bp, Artificial Sequence
  Synthetic
gaactcatataactaacgggggttacaattatagccttaccctagaatgggtaaatgactccaacacctccgtct

SEQ ID NO: 162975 - DNA, 75 bp, Artificial Sequence
  Synthetic
atcttttggttttggtctgacattcgtggtagctgtacaatgccagcactgtaagttattgcatgccgcaggccc

SEQ ID NO: 162976 - DNA, 75 bp, Artificial Sequence
  Synthetic
caaggagtgggtggactttatctccccctgtctcaaaactgtttacattgagggtttgcgtacggtaacccatac

SEQ ID NO: 162977 - DNA, 75 bp, Artificial Sequence
  Synthetic
ccctgtctcaaaactgtttacattgagggtttgcgtacggtaacccatacgccaggttctgtaaggtgacaggag

SEQ ID NO: 162978 - DNA, 75 bp, Artificial Sequence
  Synthetic
ggtgtcctcccggggtccagagttcccggctgctcccgcctcagggatcgtggactcggccacacagtgggcttc

SEQ ID NO: 162979 - DNA, 75 bp, Artificial Sequence
  Synthetic
ttagtctcccacaccacaagcaccagtcacaggccccataggcggcctgtttctaaacgtcccacgcataaggaa

SEQ ID NO: 162980 - DNA, 75 bp, Artificial Sequence
  Synthetic
ctgtcctaggccatttccaggtcctgtacctggcccctcgtcagacatgattcacactaaaagagatcaatagac

SEQ ID NO: 162981 - DNA, 75 bp, Artificial Sequence
  Synthetic
ggctgcgcctgagctgcctggtgagaagttggtggtgggggtggatgagggacgtatctgggcacttcgtagctt

SEQ ID NO: 162982 - DNA, 75 bp, Artificial Sequence
  Synthetic
gaggaggcccccctaaacagcatcaggcagcaagggaacacaaaggaaaccagggccgggatgtgaggcctcagg

SEQ ID NO: 162983 - DNA, 75 bp, Artificial Sequence
  Synthetic
cgagcggcccccgccgtccactctatcccgctggaggcaatggtcgccagggtttctaggacgctgtccgccagg

SEQ ID NO: 162984 - DNA, 75 bp, Artificial Sequence
  Synthetic
ctggagaggcctctggctgttcagctcgcgaggaaaaggacatcgtcggaggccaggcagaagcagaagcacccc

SEQ ID NO: 162985 - DNA, 75 bp, Artificial Sequence
  Synthetic
gtttcgccgtgagctttcattccctctgctcgttaactgagagcatgtctgctggggctcacgggatggggccgg

SEQ ID NO: 162986 - DNA, 75 bp, Artificial Sequence
  Synthetic
ttaagataaaatgtttcagtgaccctctgcaaatatgcgaggtctctctcatggaatatgaaataaaatcacaaa

SEQ ID NO: 162987 - DNA, 75 bp, Artificial Sequence
  Synthetic
gggcagggccaaaaacctaggacgaggaacacccgccccaccaccacgggtgataacgtcctgaacgtgactggc

SEQ ID NO: 162988 - DNA, 75 bp, Artificial Sequence
  Synthetic
ctccggtgctgcaggcagggggttgcccgtggcagacatccaatgacccctaagggcctgcttcaagctcatgga

SEQ ID NO: 162989 - DNA, 75 bp, Artificial Sequence
  Synthetic
aattccagcagatttagcacagcagatcggtccctactccttattagcccctgctcgaggaccactgtcacaaga

SEQ ID NO: 162990 - DNA, 75 bp, Artificial Sequence
  Synthetic
gacgtcggcctgaacgttgaaatccgtcttgaggtttccgatgtggcttacttggctgtgttactgatggatccg

SEQ ID NO: 162991 - DNA, 75 bp, Artificial Sequence
  Synthetic
gtcttgaggtttccgatgtggcttacttggctgtgttactgatggatccgtgtgactggaagacatggcactccc

SEQ ID NO: 162992 - DNA, 75 bp, Artificial Sequence
  Synthetic
ggtagaaatcacgggggggggcggttgttgcccgagcggaggctgtctttgcattgacgtcgtctcctcttcggt

SEQ ID NO: 162993 - DNA, 75 bp, Artificial Sequence
  Synthetic
ctccccttctcctccgggaaggtggtggcggaggcttgaaggaaacagcttcgggctctcgaggtggttcgtgga

SEQ ID NO: 162994 - DNA, 75 bp, Artificial Sequence
  Synthetic
ggccggctggggcacgagagcccggcccgtccggcgccctctcggacgcgctcaagcgcaaggagcagtacctgc

SEQ ID NO: 162995 - DNA, 75 bp, Artificial Sequence
  Synthetic
cccctctattctcctcttgcgttatctccaatagaatttgcttgaggtcatacgttttagggtgctcggcctggg

SEQ ID NO: 162996 - DNA, 75 bp, Artificial Sequence
  Synthetic
gcctttcaggggtgctctgtgcttcttctgcctcatcagatctataggaggtcttaacaattgtgcgcttcactg

SEQ ID NO: 162997 - DNA, 75 bp, Artificial Sequence
  Synthetic
cctcgggttctcctcctccttcccccgcctcctgatctccgcccgagagcaggtcggtcaggcgtctgcgggccg

SEQ ID NO: 162998 - DNA, 75 bp, Artificial Sequence
  Synthetic
cccgtccggcgccctctcggacgcgctcaagcgcaaggagcagtacctgcgccaggtggccaccgagggtctggc

SEQ ID NO: 162999 - DNA, 75 bp, Artificial Sequence
  Synthetic
tcttttatgcctctccgtgcgtgatatggattttcattaggtggtgcattccacgggtaatatggcttaaagttt

SEQ ID NO: 163000 - DNA, 75 bp, Artificial Sequence
  Synthetic
tcacagatgaactattgcagctggacatgacacccatgaaacgcacaaaatctaaaaggttctcctcggtctgca

SEQ ID NO: 163001 - DNA, 75 bp, Artificial Sequence
  Synthetic
gttggtactttaaggttggtccaatccataggcttttgtgaaaacccggggatcggactagccttagagtaactc

SEQ ID NO: 163002 - DNA, 75 bp, Artificial Sequence
  Synthetic
cttcgctccaccctagaccccagcttctggcctccccgggtccaccaggccagccggagggaccccggcagcccg

SEQ ID NO: 163003 - DNA, 75 bp, Artificial Sequence
  Synthetic
tcagctaggttcctactggggtacccccctaccctaccttaaggtgcgccacccttcctccttccgttttaatgg

SEQ ID NO: 163004 - DNA, 75 bp, Artificial Sequence
  Synthetic
cttgtgtgctgtggccggtgctgccagagcctctgccacaaggccagctcactgcctatcatgtttcagccgctc

SEQ ID NO: 163005 - DNA, 75 bp, Artificial Sequence
  Synthetic
gggagttaatgtgcgtagtgttgctgtgcgatatcccatggaccaggatcggctgggagatgtcagaagccaatg

SEQ ID NO: 163006 - DNA, 75 bp, Artificial Sequence
  Synthetic
ctgccgcatatgctgccaagagacagaggggctgcttcacatatgagctgctcagggtctccaccaccttgtttt

SEQ ID NO: 163007 - DNA, 75 bp, Artificial Sequence
  Synthetic
atagcgcttgcaggtgcgagtgctaaaattaatggaaacatgggtcacacgtgggccttagatggcccccatgaa

SEQ ID NO: 163008 - DNA, 75 bp, Artificial Sequence
  Synthetic
aaattaatggaaacatgggtcacacgtgggccttagatggcccccatgaacccagttagaggcatgctcaccttg

SEQ ID NO: 163009 - DNA, 75 bp, Artificial Sequence
  Synthetic
cccagttagaggcatgctcaccttgacggcctggcaggcagcgtccctgatattccttgcgacatatggtgtgat

SEQ ID NO: 163010 - DNA, 75 bp, Artificial Sequence
  Synthetic
actttgagccactaagcccccgttgctcgccttgcctgcctcaccatgacacactaagcccctgctaatccatga

SEQ ID NO: 163011 - DNA, 75 bp, Artificial Sequence
  Synthetic
gggaggcataacggtggtgggaggcccaggaccttggccggtggctgtggactggggtgcgggtgcgggtgatca

SEQ ID NO: 163012 - DNA, 75 bp, Artificial Sequence
  Synthetic
acactaagcccctgctaatccatgagccccgcctttaggaagcaccacgtcccggggacggaagctggattttgg

SEQ ID NO: 163013 - DNA, 75 bp, Artificial Sequence
  Synthetic
tgagtccggctcgttctgcaccaatccctcagaagccccgccggttgaaggccccggcccggggtcctgaatatg

SEQ ID NO: 163014 - DNA, 75 bp, Artificial Sequence
  Synthetic
cccccgagctccagggccggaaccccggacccggctgcagccggccaccccccgccggagcggggcagcggaccc

SEQ ID NO: 163015 - DNA, 75 bp, Artificial Sequence
  Synthetic
tgacgacctcccaaggtctctcaccctgggtacacaggtggggcggcagcctctaactttggctgtggcctctat

SEQ ID NO: 163016 - DNA, 75 bp, Artificial Sequence
  Synthetic
ctctaactttggctgtggcctctatttcctccctttcctagccagggccatgtgttcctgcatgtctacttgcct

SEQ ID NO: 163017 - DNA, 75 bp, Artificial Sequence
  Synthetic
ttcctccctttcctagccagggccatgtgttcctgcatgtctacttgcctcctgtggtggcagagcttggccctg

SEQ ID NO: 163018 - DNA, 75 bp, Artificial Sequence
  Synthetic
cttccttgtgctcctgccggcccctcgagattctgaccggggacctctggttgctctgttgcttcggggagctct

SEQ ID NO: 163019 - DNA, 75 bp, Artificial Sequence
  Synthetic
aatcactcatcattcgatgtttcagaagaggaaggggaagaaactgcaatgtcccccatccccaacatgttcctt

SEQ ID NO: 163020 - DNA, 75 bp, Artificial Sequence
  Synthetic
atagagcagcgagtagccgagcgactgcagatccaggcgaagggcccctcagtctccggactgcggaggaagcgg

SEQ ID NO: 163021 - DNA, 75 bp, Artificial Sequence
  Synthetic
aagaggaaggggaagaaactgcaatgtcccccatccccaacatgttcctttcctgtttatcagttcctccgcact

SEQ ID NO: 163022 - DNA, 75 bp, Artificial Sequence
  Synthetic
tttattaatagaatctcagccaggacctatacctgagacttcaaagtctggtcctgggttctgagacccccaaga

SEQ ID NO: 163023 - DNA, 75 bp, Artificial Sequence
  Synthetic
gagtgtgagggccccccctgcggcgtcttgcgctctggataggcctttttcttcacccgtttagacggcggaata

SEQ ID NO: 163024 - DNA, 75 bp, Artificial Sequence
  Synthetic
tcttgcgctctggataggcctttttcttcacccgtttagacggcggaatatcagtgggagacataggccccccta

SEQ ID NO: 163025 - DNA, 75 bp, Artificial Sequence
  Synthetic
tgtgaaagtttgtaaaaaaattcataaaatgtcactaattcctcttacctgtttagagtattgtgcaattcttca

SEQ ID NO: 163026 - DNA, 75 bp, Artificial Sequence
  Synthetic
gtttagagtattgtgcaattcttcagcctgcctattttcaatttgcctaaggtggcaatttaagatgtggttaat

SEQ ID NO: 163027 - DNA, 75 bp, Artificial Sequence
  Synthetic
gccacggcctttgaggaacccacttgccacataacttgtatgggctgtaggacgggtggatagaaaacaggtgcc

SEQ ID NO: 163028 - DNA, 75 bp, Artificial Sequence
  Synthetic
gccacataacttgtatgggctgtaggacgggtggatagaaaacaggtgcctgcacaatcttggcacccgttccag

SEQ ID NO: 163029 - DNA, 75 bp, Artificial Sequence
  Synthetic
caagacggctgagcaggagtatggggacaaagagataaaactgccacattggacacccaccctgcacacgtttca

SEQ ID NO: 163030 - DNA, 75 bp, Artificial Sequence
  Synthetic
tgcatgggcaaccgggttccatggcacatttacagataaacatagatgtcttgtcttgctcatgtgcagaggagg

SEQ ID NO: 163031 - DNA, 75 bp, Artificial Sequence
  Synthetic
acatttacagataaacatagatgtcttgtcttgctcatgtgcagaggagggggtgttggtgtgcaatatagtttc

SEQ ID NO: 163032 - DNA, 75 bp, Artificial Sequence
  Synthetic
ttaaacttaagtgatggtctcccattcttgacgccccccgttaacaactggcgcagaatgtgctttgctggcccc

SEQ ID NO: 163033 - DNA, 75 bp, Artificial Sequence
  Synthetic
ctgacattagacagtggacaccgggctatatgtggggatgtctgtggcttgtcatttcctcttagaaggtaatcc

SEQ ID NO: 163034 - DNA, 75 bp, Artificial Sequence
  Synthetic
ttctggccggtaagtgcccttggtgacagctgcatggcggtgggcggcccccgaggcggcggcatgggagtgggc

SEQ ID NO: 163035 - DNA, 75 bp, Artificial Sequence
  Synthetic
ggggaggatgaaacgctcttttccttcaccgctaccaccgcctcctcctcctcttccgtcgccagagggatctgc

SEQ ID NO: 163036 - DNA, 75 bp, Artificial Sequence
  Synthetic
gtcatttcctcttagaaggtaatcccccatcttaacttccctttaaattgtgatgcaagccctgggttatttata

SEQ ID NO: 163037 - DNA, 75 bp, Artificial Sequence
  Synthetic
gggcctcctgccgcggggcctcctgccgcggggcctcctgccgcggggcctcgcatactggcgcctctttccgct

SEQ ID NO: 163038 - DNA, 75 bp, Artificial Sequence
  Synthetic
ctcctgatatcccgggctgccattattcccttgagtgttatagcttcctcttaacttaagcaagagctccaggat

SEQ ID NO: 163039 - DNA, 75 bp, Artificial Sequence
  Synthetic
agacatgcaggaacacatggccctggctaggaaagggaggaaatagaggccacagccaaagttagaggctgccgc

SEQ ID NO: 163040 - DNA, 75 bp, Artificial Sequence
  Synthetic
cgtcttctgcaccctcggctcctgcgtccccggccttgccttccccctctaagttgagggggcgcagtccgaccg

SEQ ID NO: 163041 - DNA, 75 bp, Artificial Sequence
  Synthetic
cttcctaaaggcggggctcatggattagcaggggcttagtgtgtcatggtgaggcaggcaaggcgagcaacgggg

SEQ ID NO: 163042 - DNA, 75 bp, Artificial Sequence
  Synthetic
cagcttccgtccccgggacgtggtgcttcctaaaggcggggctcatggattagcaggggcttagtgtgtcatggt

SEQ ID NO: 163043 - DNA, 75 bp, Artificial Sequence
  Synthetic
cttttccgaagccactcgtccgcctactggttgtcggaggtggagaggcccgggggccttgtccgctggggcaga

SEQ ID NO: 163044 - DNA, 75 bp, Artificial Sequence
  Synthetic
atttattaggcacaaacttacatcgactttatgccccccgccccgtaaaactccacagagtacgcgactgagggg

SEQ ID NO: 163045 - DNA, 75 bp, Artificial Sequence
  Synthetic
ctgctcaaccagctccccaggctccataccagggataccaggagccgccggccccccaggctccataccagggat

SEQ ID NO: 163046 - DNA, 75 bp, Artificial Sequence
  Synthetic
acacccccagcgctggctccagggggtggcagcgttggatgcagtcctccgcatcggggcggacgcctcctccca

SEQ ID NO: 163047 - DNA, 75 bp, Artificial Sequence
  Synthetic
gcgtgaattgtgcccaccagagggtgagcccacctgtctgacttggcccccgtgtacataatactcggggtctcg

SEQ ID NO: 163048 - DNA, 75 bp, Artificial Sequence
  Synthetic
cggatgccaaagaagacgttgagatgcgtgtagcccagaagcgtgtagttctcggtggtggaggcgtagtccagg

SEQ ID NO: 163049 - DNA, 75 bp, Artificial Sequence
  Synthetic
cctgatggaagtggtattgttgccgttgaaagacgggtgtcctggctcaagttcgcacttcctatacagtgttaa

SEQ ID NO: 163050 - DNA, 75 bp, Artificial Sequence
  Synthetic
catgacccgctgcctcataaccctagcgactctgctggaaatgatggaggccctccaaatttgacggaagaggtt

SEQ ID NO: 163051 - DNA, 75 bp, Artificial Sequence
  Synthetic
gagggggccatggctgccattctaccagttaacgaggagagagagagtaggtccgcggaaattggtgcccctctc

SEQ ID NO: 163052 - DNA, 75 bp, Artificial Sequence
  Synthetic
gggtgtggctcaggctcaggttccggccctgggacggcagcagccgccgggacggtgaagtcgtggaaggtagag

SEQ ID NO: 163053 - DNA, 75 bp, Artificial Sequence
  Synthetic
gcagcccgagtatgtctacagcttcctggcccgactcatttacggcggcatctacgcttttagccacggaggaca

SEQ ID NO: 163054 - DNA, 75 bp, Artificial Sequence
  Synthetic
atttctagaagatctcctgatatcccgggctgccattattcccttgagtgttatagcttcctcttaacttaagca

SEQ ID NO: 163055 - DNA, 75 bp, Artificial Sequence
  Synthetic
accctgtgtttttcagatgccgttggacgtgtcactgagctgattttggacgcagctacttgacctttgcccccg

SEQ ID NO: 163056 - DNA, 75 bp, Artificial Sequence
  Synthetic
ccccagagtccagaggtcaggggcacctcagggtgcctccccgggtcccaggccagccggagggaccccggcagc

SEQ ID NO: 163057 - DNA, 75 bp, Artificial Sequence
  Synthetic
aaacctccagaatatcaagtggtggggccttggtgggctgcataaggcagtaggttttaggtgacctacttggac

SEQ ID NO: 163058 - DNA, 75 bp, Artificial Sequence
  Synthetic
ttccactttgtgttacaggtgggccaaacctccagaatatcaagtggtggggccttggtgggctgcataaggcag

SEQ ID NO: 163059 - DNA, 75 bp, Artificial Sequence
  Synthetic
ggaccttgactatgaaacaattcttaaaaaatgcatcatagtccagtgtccagggacagtgcactcggaagtctc

SEQ ID NO: 163060 - DNA, 75 bp, Artificial Sequence
  Synthetic
atcatctccgtttgtgtgtttagtgtggccagtacggccactcctgtgccacgccctggcatgctgctgacatct

SEQ ID NO: 163061 - DNA, 75 bp, Artificial Sequence
  Synthetic
cagccccttcttcccggccgccttcatcgagttccaaatctggcccgcccttcgccgggtcctctccaacgagct

SEQ ID NO: 163062 - DNA, 75 bp, Artificial Sequence
  Synthetic
ccatcagcacctgactggccggtgtaattagaggagagggcaacaacgcaaggctgttgttttatttgggttaca

SEQ ID NO: 163063 - DNA, 75 bp, Artificial Sequence
  Synthetic
gcggccagagagcgggttttgggcagctcgttggagaggacccggcgaagggcgggccagatttggaactcgatg

SEQ ID NO: 163064 - DNA, 75 bp, Artificial Sequence
  Synthetic
ctgattacggtttcctagattgtacagatgaactagaactgtcacaatctatggggtcgtagacagtgtgcttac

SEQ ID NO: 163065 - DNA, 75 bp, Artificial Sequence
  Synthetic
tgctgctagctatatgggtggtgctatgggctccctagggactcatgtagtggggctttgtgatagctaatgaat

SEQ ID NO: 163066 - DNA, 75 bp, Artificial Sequence
  Synthetic
atgggctccctagggactcatgtagtggggctttgtgatagctaatgaatgtggcagctgttgtttgtactggac

SEQ ID NO: 163067 - DNA, 75 bp, Artificial Sequence
  Synthetic
aatatgggaggaggggggctttgggttccattgtgtgccctttcctggccaacgtgagggtcctagtgttatagg

SEQ ID NO: 163068 - DNA, 75 bp, Artificial Sequence
  Synthetic
ggtgatgaagttgtggaagcggcggtcggccaccagccgcccaaagtccgggaccaggtcagccagggttgcggg

SEQ ID NO: 163069 - DNA, 75 bp, Artificial Sequence
  Synthetic
gggccaggtcagagtactcctccgcgctggccccgctggggacagggaccgagcgccgcctggaaaagttgtgcc

SEQ ID NO: 163070 - DNA, 75 bp, Artificial Sequence
  Synthetic
gggcacgagatggcccagttgacggacgtgcccagctccgtggtcctgaggggcggtgggcgcgtgcacatatac

SEQ ID NO: 163071 - DNA, 75 bp, Artificial Sequence
  Synthetic
gtgagcggcgtgaggccgcgcaggaaggggaaggcctcctccgccggcaggcgcagcgtcagaaccaggccgcag

SEQ ID NO: 163072 - DNA, 75 bp, Artificial Sequence
  Synthetic
gcgcagcctgtcattttcagatgatttggcagaagccacctgcggacaaaaatcaggcgtttagatggggcattt

SEQ ID NO: 163073 - DNA, 75 bp, Artificial Sequence
  Synthetic
gtgggctccccatgcaccaccttggcctccttggccgtgaggacccccttgtcgatggccaggctcctaaagttg

SEQ ID NO: 163074 - DNA, 75 bp, Artificial Sequence
  Synthetic
gccacctggcttctgttgggtcagacagtttggtgcgctagttgtgtgcttagcagcaacgcacaccaggctgac

SEQ ID NO: 163075 - DNA, 75 bp, Artificial Sequence
  Synthetic
tttggttctgtacatattttgttattgtacataaccatggagttggctgtggtgcactccatctggtaagggggg

SEQ ID NO: 163076 - DNA, 75 bp, Artificial Sequence
  Synthetic
attaggggtaaccctgtagtcacctgcacagatctgaccacggcccacgtctttaccacctcaaccgccgttagg

SEQ ID NO: 163077 - DNA, 75 bp, Artificial Sequence
  Synthetic
cccatagcgccacccatatagctagcagcaaattcacatcttccatggaagtctggtaagcacactgtctacgac

SEQ ID NO: 163078 - DNA, 75 bp, Artificial Sequence
  Synthetic
atcgctcctgtgccgctggatgagggagcgccaatttgtacatcctagctctggccatagagttagcccaccctt

SEQ ID NO: 163079 - DNA, 75 bp, Artificial Sequence
  Synthetic
tgcaggatctcaaaaagtcggaccgaggccggtgtggggtgcacaggaatggccgaggagccgagggcgccagag

SEQ ID NO: 163080 - DNA, 75 bp, Artificial Sequence
  Synthetic
gccctataacactagaaccctcacgttggacaggaaagggcacacaatgaaacccaaagccccccctcctcccat

SEQ ID NO: 163081 - DNA, 75 bp, Artificial Sequence
  Synthetic
cgcccgtttatccaatagcatgtaagagaggttgcctagatttggcaactttgagggaacgttccgtgtagctgg

SEQ ID NO: 163082 - DNA, 75 bp, Artificial Sequence
  Synthetic
attcaagatattcagcatagttgtcactacgggacccatgaagtgttacagaatccaagttactgtttccactag

SEQ ID NO: 163083 - DNA, 75 bp, Artificial Sequence
  Synthetic
cctgctgcccagggcaagtatgcgcctggtccgaggccttatccggcatgagcatcacgacctcttgaatctctt

SEQ ID NO: 163084 - DNA, 75 bp, Artificial Sequence
  Synthetic
agcgcaccaaactgtctgacccaacagaagccaggtggcagtaaaagccgagaatgatcagggctccaggtgtcc

SEQ ID NO: 163085 - DNA, 75 bp, Artificial Sequence
  Synthetic
gcccggatagacctggatgacctgtcagtggcggatgatttatcacgcatgcgtgtgatgatgacctacctacag

SEQ ID NO: 163086 - DNA, 75 bp, Artificial Sequence
  Synthetic
taaccggcccggtgcggctgccccgtgacccgtgggccttaccttcctggccatcgggggaccctggtgctaggg

SEQ ID NO: 163087 - DNA, 75 bp, Artificial Sequence
  Synthetic
ttaaaggtgtggtcgtttggaatagtaacccaaggcaggtaaacattggcatagactaaacacaggcgtccgcac

SEQ ID NO: 163088 - DNA, 75 bp, Artificial Sequence
  Synthetic
ccatcgggggaccctggtgctagggtcccttgtgttgctttctgccataggggggaaagcatcgccttcagaatt

SEQ ID NO: 163089 - DNA, 75 bp, Artificial Sequence
  Synthetic
gggggaaagcatcgccttcagaattggctgctccgttggaacatttgaggcctactgtatccgtgtcctgacaac

SEQ ID NO: 163090 - DNA, 75 bp, Artificial Sequence
  Synthetic
cctactgtatccgtgtcctgacaacattccccgcaaacatgacatgggttaatttaaacatgttttgtttgcttg

SEQ ID NO: 163091 - DNA, 75 bp, Artificial Sequence
  Synthetic
cactcacgtcctcctcctggatagactgggaggcctgagaccccagagtgtagctgctgctctgtgaagtctctt

SEQ ID NO: 163092 - DNA, 75 bp, Artificial Sequence
  Synthetic
taccattggcaccttttttccatgtaaacctccgtgatcctgggtcctttggagactcaagtgtgaatttgtttt

SEQ ID NO: 163093 - DNA, 75 bp, Artificial Sequence
  Synthetic
tggaaaactccactctggccagctgcatcctcaccacccccgacctcagctccgagtgggacgtgacccaggccc

SEQ ID NO: 163094 - DNA, 75 bp, Artificial Sequence
  Synthetic
ttctggacacaggactaaccatgccatctctgattatagctctggcactgctagcgtcactgattttgggcacac

SEQ ID NO: 163095 - DNA, 75 bp, Artificial Sequence
  Synthetic
cacctcgataaccggctcgtggctcgtacagacgattgtttggctctgtaacttgccagggacggctgacgatgt

SEQ ID NO: 163096 - DNA, 75 bp, Artificial Sequence
  Synthetic
ggcccgcgtctacgtggcggtgggaggcctctttgagcaggaggtctctgaggtgcagcgcctggagaatatttg

SEQ ID NO: 163097 - DNA, 75 bp, Artificial Sequence
  Synthetic
acttgccagggacggctgacgatgtgtttagtctgccacttgcatccggcgctttggttacacgggagactaatg

SEQ ID NO: 163098 - DNA, 75 bp, Artificial Sequence
  Synthetic
tccaacgtactcctgcgtaccccaaaaccacaccaaacaccacaggacaagttcagaatctgtccggtggtgatg

SEQ ID NO: 163099 - DNA, 75 bp, Artificial Sequence
  Synthetic
ggggatgagatgttcaggggtggccggtaccctacgctgccgatttacataatataaattgtaaatgctgcagta

SEQ ID NO: 163100 - DNA, 75 bp, Artificial Sequence
  Synthetic
aatataaattgtaaatgctgcagtagtagggatctggacgcgcgacctgctactcttcggaaacgccaacccagg

SEQ ID NO: 163101 - DNA, 75 bp, Artificial Sequence
  Synthetic
gttgaggctgggaactccttgaggggggccaccttggccaccttggcctggtcctgcaggctctgcttctccagc

SEQ ID NO: 163102 - DNA, 75 bp, Artificial Sequence
  Synthetic
gcatggcgggagtatggggccagaggcgacgctcctgggttggcgtttccgaagagtagcaggtcgcgcgtccag

SEQ ID NO: 163103 - DNA, 75 bp, Artificial Sequence
  Synthetic
cgccatgcgactgctcgccccctcccaggcctccctggtgagcccttgccgctccccgcattcctgctttcggcg

SEQ ID NO: 163104 - DNA, 75 bp, Artificial Sequence
  Synthetic
cccctgcggatcccgatgacagcaggcctttccttcccccgttaatgaaaagaatgacagtgaggttgtgacaga

SEQ ID NO: 163105 - DNA, 75 bp, Artificial Sequence
  Synthetic
cgttaaatgtcttgttgattctctcaaaggtggggagggaggagctctccacaacaatgttccctggcagcgtga

SEQ ID NO: 163106 - DNA, 75 bp, Artificial Sequence
  Synthetic
ttccggctttggcaggaacataccttcccggctatccctgaggcccttcttccttttaacgggaggaagaaaggt

SEQ ID NO: 163107 - DNA, 75 bp, Artificial Sequence
  Synthetic
acaacaatgttccctggcagcgtgagcgcgcagccctgccgttggatgtatcttctcatgatggtgctgatagag

SEQ ID NO: 163108 - DNA, 75 bp, Artificial Sequence
  Synthetic
ttccaacgtcaagatgccctggcgccgaacaccaaaacaaattcacacttgagtctccaaaggacccgggatcac

SEQ ID NO: 163109 - DNA, 75 bp, Artificial Sequence
  Synthetic
ggcccggcttccactcctgtgggtagacgtagaagaccgggttggaggagtgggacacgacaacggccgtaatct

SEQ ID NO: 163110 - DNA, 75 bp, Artificial Sequence
  Synthetic
gctggtggcatttggggttggggtagtcactgctgaggtgggtcttgtttttcccaaggtggggctggtggcatt

SEQ ID NO: 163111 - DNA, 75 bp, Artificial Sequence
  Synthetic
catgcctgctacaataggccctacgcctgtagttcaggaaacgatgaatccaatgacaagcttccgggccctaag

SEQ ID NO: 163112 - DNA, 75 bp, Artificial Sequence
  Synthetic
tggagctcaggggggcctcgtaggtgttgttgtattccagctccgtgatgaaattaggaggaataatcacagggg

SEQ ID NO: 163113 - DNA, 75 bp, Artificial Sequence
  Synthetic
gggggtgagtgccaattggcctttaataacaaagcccccaggcagcaccaaaaatgcctgcccgtccgatgtggt

SEQ ID NO: 163114 - DNA, 75 bp, Artificial Sequence
  Synthetic
attcagatgtcccgggacagggccccctttgtggaccagagccaatctcacagcctgtttttgcgtgaggaacac

SEQ ID NO: 163115 - DNA, 75 bp, Artificial Sequence
  Synthetic
agccaaagtagcggatgtctgtggattccccgtcccagcgccagtggctcttagggtaggggttgtaacggaagg

SEQ ID NO: 163116 - DNA, 75 bp, Artificial Sequence
  Synthetic
gacttttatgaggccaacggcagcggctttgacctggtggggcccgagcttgtgtccagtgatggggaggcggcg

SEQ ID NO: 163117 - DNA, 75 bp, Artificial Sequence
  Synthetic
ttagggtaggggttgtaacggaaggcaataatcacatcatccaatagggtcatgcccaccttgacgttcagcggg

SEQ ID NO: 163118 - DNA, 75 bp, Artificial Sequence
  Synthetic
acagtaggcctcaaatgttccaacggagcagccaattctgaaggcgatgctttcccccctatggcagaaagcaac

SEQ ID NO: 163119 - DNA, 75 bp, Artificial Sequence
  Synthetic
ccggacacgaggataggagtttccactgccttggacttggttgacagcaggcacgcgggaagcacgccgctcacg

SEQ ID NO: 163120 - DNA, 75 bp, Artificial Sequence
  Synthetic
ccacggagactcggacgtagcccttaccgcggcgtatggcgttgaccggacacaccttccccgggaatgtgtgaa

SEQ ID NO: 163121 - DNA, 75 bp, Artificial Sequence
  Synthetic
acaagggaccctagcaccagggtcccccgatggccaggaaggtaaggcccacgggtcacggggcagccgcaccag

SEQ ID NO: 163122 - DNA, 75 bp, Artificial Sequence
  Synthetic
atagctttcacccaacaactttcccaactaacccgtgtctggacagtgaagaacgcttccctgatcaggtctgaa

SEQ ID NO: 163123 - DNA, 75 bp, Artificial Sequence
  Synthetic
ccctctcgtttcaggtccggcgtgtccacggagactcggacgtagcccttaccgcggcgtatggcgttgaccgga

SEQ ID NO: 163124 - DNA, 75 bp, Artificial Sequence
  Synthetic
gggctcgctggtgtttagcttgtccccactctgggtgcaggagcgtgtcagctgaatgtcgctctgcccgggcag

SEQ ID NO: 163125 - DNA, 75 bp, Artificial Sequence
  Synthetic
gctgacggtccggaacatttccaacaaccccataacgatcgtgaccggccagagcatggcccaggcctttttcat

SEQ ID NO: 163126 - DNA, 75 bp, Artificial Sequence
  Synthetic
agagcatggcccaggcctttttcatctacgccggagacccctctatcagcaccatcatgagaagatacatccaac

SEQ ID NO: 163127 - DNA, 75 bp, Artificial Sequence
  Synthetic
ttgaccaatctgatgggcacaatgtaccaggtaaacttccctttctctatgaacaggctgcgcggattcaggacg

SEQ ID NO: 163128 - DNA, 75 bp, Artificial Sequence
  Synthetic
cgtcctggctggtgacgggagagccactgaggaagatctggggctcgctggtgtttagcttgtccccactctggg

SEQ ID NO: 163129 - DNA, 75 bp, Artificial Sequence
  Synthetic
gcataacgaagaagggcttgaggaatacctcgttgtcttccgctccaaagaacaagaacgcaaccgtaaagtagc

SEQ ID NO: 163130 - DNA, 75 bp, Artificial Sequence
  Synthetic
cctcggcggggaacgtgacaggcacaacggctgtgactacaccatcaccatcggcatcgggtcctagcacaaacc

SEQ ID NO: 163131 - DNA, 75 bp, Artificial Sequence
  Synthetic
atctctggatgggcggccaccgccagcatcgactgtaggaacgggtcttggatgggctctagggtcagagaggcc

SEQ ID NO: 163132 - DNA, 75 bp, Artificial Sequence
  Synthetic
gattctgtgtttgtgaggaccccggtcgaggcgtgggtcgcgccctcgccgccggacgacaaggtggctgagtcc

SEQ ID NO: 163133 - DNA, 75 bp, Artificial Sequence
  Synthetic
ggagaaagaaggtaacttgaagctgagtatctggcccaccgaggggcagggaggcagctcttggcactgcgcgtc

SEQ ID NO: 163134 - DNA, 75 bp, Artificial Sequence
  Synthetic
cagctgcaatacctgcttgttggtgacgcgaacgtatgaggggaagatctcgtacttccacacgcctctcatgaa

SEQ ID NO: 163135 - DNA, 75 bp, Artificial Sequence
  Synthetic
ttatggcctttctgcttgatgtgatatcacagtctggcactggaaatgcttggtcaataaagaatcttgataaaa

SEQ ID NO: 163136 - DNA, 75 bp, Artificial Sequence
  Synthetic
cgacgtgtctggtttttcagtgggccgcaggcggcggaggctgttcctgaacgacgagcgccgggacgctagtgc

SEQ ID NO: 163137 - DNA, 75 bp, Artificial Sequence
  Synthetic
cgcaggcggcggaggctgttcctgaacgacgagcgccgggacgctagtgctgcatgggctcctccggggtaagct

SEQ ID NO: 163138 - DNA, 75 bp, Artificial Sequence
  Synthetic
tgcatgggctcctccggggtaagcttcggccatggccggagctcgtcgacgggcaaggtgagagtcggggggcgg

SEQ ID NO: 163139 - DNA, 75 bp, Artificial Sequence
  Synthetic
ggggagctcttggagacctcggtgctctaggcaccctgggggcccttggggctctgggcgctcttgctcccgggg

SEQ ID NO: 163140 - DNA, 75 bp, Artificial Sequence
  Synthetic
cctggtgccccacggacacctccggcagcagggccgcagcaactatgcatcgcaatagggcgccggttggggagg

SEQ ID NO: 163141 - DNA, 75 bp, Artificial Sequence
  Synthetic
gggcaaggtgagagtcggggggcgggcgacggtgcggccccaatacaactctccgctcgttagctggtagaatat

SEQ ID NO: 163142 - DNA, 75 bp, Artificial Sequence
  Synthetic
cgctcggccggccagaagagcgcaagtccaagtctggtgctggggccgatgtgcagcggtttgtgcccgcagttg

SEQ ID NO: 163143 - DNA, 75 bp, Artificial Sequence
  Synthetic
catctactgaacaccatcggggtcgactgcgacctcccacctagccacccactcctgacagcccagagggggctg

SEQ ID NO: 163144 - DNA, 75 bp, Artificial Sequence
  Synthetic
gccccctccaaggactcgggcccagtttctaacttttccccttccctccctcgtcttgccctgcgcccggggcca

SEQ ID NO: 163145 - DNA, 75 bp, Artificial Sequence
  Synthetic
gggcggtccacacgcgcgggcgcagcacccattggtcgcacgccgcctcctggaatgtaaacccccagagagagg

SEQ ID NO: 163146 - DNA, 75 bp, Artificial Sequence
  Synthetic
cacccattggtcgcacgccgcctcctggaatgtaaacccccagagagagggcgtgccgccctggagatggccctg

SEQ ID NO: 163147 - DNA, 75 bp, Artificial Sequence
  Synthetic
tgccatcacatgtatttcctccttgggtggaacgacggcgtcgtgctccgggtggagggggaatagcgtccaggc

SEQ ID NO: 163148 - DNA, 75 bp, Artificial Sequence
  Synthetic
gtggcaccacatggttccaaacacatcttgaaagtagacatctacagattccaggcttacttgttgctcctctcc

SEQ ID NO: 163149 - DNA, 75 bp, Artificial Sequence
  Synthetic
gcgcggattcaggacgcttagcacgatgtcctggtcagagtgcataacgaagaagggcttggacgcttagcacga

SEQ ID NO: 163150 - DNA, 75 bp, Artificial Sequence
  Synthetic
tcttccgctccaaagaacaagaacgcaaccgtaaagtagcggctgccgtaggtggtcgtgttgaaggagaaagaa

SEQ ID NO: 163151 - DNA, 75 bp, Artificial Sequence
  Synthetic
gggcggtgggcggcccgggctccagcagaacgtcgcagacccagccctcctcggccctgtccacctgtatgtcca

SEQ ID NO: 163152 - DNA, 75 bp, Artificial Sequence
  Synthetic
atgtcggtaccacgccacggggggcgggcccgcatagggaaaagccagggagagcgatgtgggcgaggcagctcc

SEQ ID NO: 163153 - DNA, 75 bp, Artificial Sequence
  Synthetic
tggtcagccgcagaggaagcatgaccttggggtgggacggggcaggcgtgatcctgggcgcaatctttaccgatc

SEQ ID NO: 163154 - DNA, 75 bp, Artificial Sequence
  Synthetic
gccagggagagcgatatgggcgaggatgggctcaggcggccccagacacgcaatttgcccccctgggcggccgca

SEQ ID NO: 163155 - DNA, 75 bp, Artificial Sequence
  Synthetic
gggccatctccagggcggcacgccctctctctgggggtttacattccaggaggcggcgtgcgaccaatgggtgct

SEQ ID NO: 163156 - DNA, 75 bp, Artificial Sequence
  Synthetic
aggcggcgtgcgaccaatgggtgctgcgcccgcgcgtgtggaccgcccactcgcccataaaaatgacagtctaca

SEQ ID NO: 163157 - DNA, 75 bp, Artificial Sequence
  Synthetic
aggatgctttcattgtgaccagacaccctggcacccaggctggcggacggggagttgaacagcttttcgattgcg

SEQ ID NO: 163158 - DNA, 75 bp, Artificial Sequence
  Synthetic
gaggggtatatctaggatagccgcacctacacaaatgagacacagacacaggtcgtgaggatttaggcaacgcag

SEQ ID NO: 163159 - DNA, 75 bp, Artificial Sequence
  Synthetic
ggcccagcccgacccccgggcgcccccaaactttgtccagatgtccaggggtccccgagggtgaggcccagcccc

SEQ ID NO: 163160 - DNA, 75 bp, Artificial Sequence
  Synthetic
ggaggcgtggttaaataaaataacactaagatccaacggcaggtcccccgctgacgtcagcaggccggccaccac

SEQ ID NO: 163161 - DNA, 75 bp, Artificial Sequence
  Synthetic
gcgctcttctggccggccgagcgaagtgacaacctagacgccgggcggatattctaccagctaacgagcggagcg

SEQ ID NO: 163162 - DNA, 75 bp, Artificial Sequence
  Synthetic
cgtcagccgcttcagacagccgcggttgtcatcatcatcgggaaaggcggtgggatcatgaagcccccaggggag

SEQ ID NO: 163163 - DNA, 75 bp, Artificial Sequence
  Synthetic
gcctgcccctcggcggcccgtgccccagctccgtcacggggggcgcataggaggggtatatctaggatagccgca

SEQ ID NO: 163164 - DNA, 75 bp, Artificial Sequence
  Synthetic
ggtcgtgaggatttaggcaacgcaggcttgtctttatagttacaaacatgggagcgtgcacctggaagatgcagc

SEQ ID NO: 163165 - DNA, 75 bp, Artificial Sequence
  Synthetic
ggatgtgcaggcgaaagcaggggcatgagaccatgctgtcctgcatgtcaaaatcttgccgatgctcctgacaca

SEQ ID NO: 163166 - DNA, 75 bp, Artificial Sequence
  Synthetic
gtggacagggccgaggagggctgggtctgcgacgttctgctggagcccgggccgcccaccgcccgggagggctgt

SEQ ID NO: 163167 - DNA, 75 bp, Artificial Sequence
  Synthetic
cccagagggagcccaccagcccgtacctggccacggccagggcctcgtaggccgagacgggcagccggagcttgt

SEQ ID NO: 163168 - DNA, 75 bp, Artificial Sequence
  Synthetic
cgggtccgtgcacctggacatacaggtggacagggccgaggagggctgggtctgcgacgttctgctggagcccgg

SEQ ID NO: 163169 - DNA, 75 bp, Artificial Sequence
  Synthetic
attggcgagacctgggcggagttcctgagagcccaggggtctcgtgcaggtgtccccggggaattgttctccctg

SEQ ID NO: 163170 - DNA, 75 bp, Artificial Sequence
  Synthetic
agcatctttgcagagttttgcttacaggtccctaggaagcgacgcgggaccacgcggcagaactgctcgaagcag

SEQ ID NO: 163171 - DNA, 75 bp, Artificial Sequence
  Synthetic
cccctggtccctatctccacccgccaggcatgtgtgtcagtttgcagggccatcctcgcgctcaggtggactggc

SEQ ID NO: 163172 - DNA, 75 bp, Artificial Sequence
  Synthetic
catcctcgcgctcaggtggactggctaggcacccttctgaagtatctggcggtgactgtcacctggttcttgaga

SEQ ID NO: 163173 - DNA, 75 bp, Artificial Sequence
  Synthetic
gccgcctcgccagcccccgggccttcatgggcccgctttctacctctctccgccgccgaggggcaggctgcggcc

SEQ ID NO: 163174 - DNA, 75 bp, Artificial Sequence
  Synthetic
ggtgactgtcacctggttcttgagagagtccataaaatggctgaagctccaggcgtatagtataatgagcaacag

SEQ ID NO: 163175 - DNA, 75 bp, Artificial Sequence
  Synthetic
cccagccgccgtgcaggccttaaccacggcccacaacttatgtctgggtgttattccaggtgagacctcacacaa

SEQ ID NO: 163176 - DNA, 75 bp, Artificial Sequence
  Synthetic
tagtagcgggcaacgagagactctgtgcaatcaaaccccaggctcccggcctcacccaggaagagcagcggcagg

SEQ ID NO: 163177 - DNA, 75 bp, Artificial Sequence
  Synthetic
tgcaatcaaaccccaggctcccggcctcacccaggaagagcagcggcagggacagcataaaccaggagaaggcgc

SEQ ID NO: 163178 - DNA, 75 bp, Artificial Sequence
  Synthetic
taacgccgagtagaagacgacgcatagcccgacacgcgtaaaaggtggcctccctgcccagggccgtgtccaacc

SEQ ID NO: 163179 - DNA, 75 bp, Artificial Sequence
  Synthetic
aattttgtgcgcaaaagtttccagatgatgatgactgtgaggaggacgatcaggactgccgccagtaggtagcag

SEQ ID NO: 163180 - DNA, 75 bp, Artificial Sequence
  Synthetic
ttcctctgcggctgaccaggctggggggcccgtgccccagctccgtcacggggggcgcataggaggggtatatct

SEQ ID NO: 163181 - DNA, 75 bp, Artificial Sequence
  Synthetic
caggactgccgccagtaggtagcagccggctttcagtccttggacggccgtgtgcatgcctttggtggggccttc

SEQ ID NO: 163182 - DNA, 75 bp, Artificial Sequence
  Synthetic
cactaagcagtgtagtcctgtcaatctcctgaacatgttggtccacaagcttgtggctttacgtggtcatgtgca

SEQ ID NO: 163183 - DNA, 75 bp, Artificial Sequence
  Synthetic
tgatgatgactgtgaggaggacgatcaggactgccgccagtaggtagcagccggctttcagtccttggacggccg

SEQ ID NO: 163184 - DNA, 75 bp, Artificial Sequence
  Synthetic
ctggcttcagcggctgcggagggctgggctgcgcctccctggaagccacgtgtgtctcctggacaaggatggagc

SEQ ID NO: 163185 - DNA, 75 bp, Artificial Sequence
  Synthetic
tgaggaggatgataatcagcaggagtaccagacaaaacacgcccatcaggtacaggcacacatttctgtgggagg

SEQ ID NO: 163186 - DNA, 75 bp, Artificial Sequence
  Synthetic
atcctgggtattggtcttggtctctcctcccccattggcatggattggcataggtgggtgtggctcaggctcagg

SEQ ID NO: 163187 - DNA, 75 bp, Artificial Sequence
  Synthetic
gatctttacatctttacagggcgcagcagccgccagacactgaagggcagagttcacggcgggcacctcccagag

SEQ ID NO: 163188 - DNA, 75 bp, Artificial Sequence
  Synthetic
ttgccagactccgccaccaacgcccctgcgttgaacccacccctcctacacacatcagacctctgcacaacacaa

SEQ ID NO: 163189 - DNA, 75 bp, Artificial Sequence
  Synthetic
gcaaggtggatggcgtgttttctgaggttatccccgctacgtgcagtgctgggtgagagagaccctagaatgtgt

SEQ ID NO: 163190 - DNA, 75 bp, Artificial Sequence
  Synthetic
taccagacaaaacacgcccatcaggtacaggcacacatttctgtgggaggttcgcttgggcgttcggctgaacaa

SEQ ID NO: 163191 - DNA, 75 bp, Artificial Sequence
  Synthetic
gagaactcctgaatcatttttcccagcacccagagcagcagttctatgagaagagctatcagccagacatccatt

SEQ ID NO: 163192 - DNA, 75 bp, Artificial Sequence
  Synthetic
ctttgtgtgccgccagtcacgttcaggacgttatcacccgtggtgttggggcgggtgttcctcgtcctcggtttt

SEQ ID NO: 163193 - DNA, 75 bp, Artificial Sequence
  Synthetic
aagagctatcagccagacatccattcggtgaaccaattttcttacaaagatgataaacaagatgccagccagtgt

SEQ ID NO: 163194 - DNA, 75 bp, Artificial Sequence
  Synthetic
gttcccctcctccccaaccggcgccctattgcgatgcatagttgctgcggccctgctgccggaggtgtccgtggg

SEQ ID NO: 163195 - DNA, 75 bp, Artificial Sequence
  Synthetic
tgtaggaaaggacctggatgaagacctgtatggaccagagcttgaggatggccaaaaacagcacggttggggagc

SEQ ID NO: 163196 - DNA, 75 bp, Artificial Sequence
  Synthetic
tagcagaatcagcaggacgagcagcaggcttgtcatgccgctgaggaaggcgctgtaggatttagtgcacgcatc

SEQ ID NO: 163197 - DNA, 75 bp, Artificial Sequence
  Synthetic
cgcgtccctgagagctgtcgtggggtggtggaggcccaggtggccaagcttgaggccgtgcgctcagtcatctgg

SEQ ID NO: 163198 - DNA, 75 bp, Artificial Sequence
  Synthetic
catcatcacacgcatgcgtgataaatcatccgccactgacaggtcatccaggtctatccgggctatctcatccgg

SEQ ID NO: 163199 - DNA, 75 bp, Artificial Sequence
  Synthetic
tcaacagaggccccaacatgtgcagggaaggccccaccaaaggcatgcacacggccgtccaaggactgaaagccg

SEQ ID NO: 163200 - DNA, 75 bp, Artificial Sequence
  Synthetic
ggtgtctgcagcaaaagaggaacttgcccaggcagtcagttattttgcatgccacctccctgcctggtggacttc

SEQ ID NO: 163201 - DNA, 75 bp, Artificial Sequence
  Synthetic
cctcaggggccaagcaaaaccgcgggggcatgggatccttgaactcagcccagcctgaggggaccccccccgccg

SEQ ID NO: 163202 - DNA, 75 bp, Artificial Sequence
  Synthetic
ggcctcggaccaggcgcatacttgccctgcggccctgggacggcagcagccgccgggacggtgaagtcgtggaag

SEQ ID NO: 163203 - DNA, 75 bp, Artificial Sequence
  Synthetic
cagactattttctgcattcgcccttgcgtgtccattgttgcaaggagcgatttggagaaaataaactgtgagttt

SEQ ID NO: 163204 - DNA, 75 bp, Artificial Sequence
  Synthetic
caccgcggggtcactggatcctcacaggccgcacccagctcttcttccgttgccccagtagcatctctgtctggt

SEQ ID NO: 163205 - DNA, 75 bp, Artificial Sequence
  Synthetic
cccaaacatgtcctgttagctggtgcggttataactgccagagctgtgtttcccgacgccaatgctaactcccca

SEQ ID NO: 163206 - DNA, 75 bp, Artificial Sequence
  Synthetic
ttcccgatgatgatgacaaccgcggctgtctgaagcggctgacgaaatcggttgagattctgatgagaggcttgg

SEQ ID NO: 163207 - DNA, 75 bp, Artificial Sequence
  Synthetic
ccctgcactagcttcgctccactggggatctttgccagccttcatactagattcagcgatcccccggttgggaat

SEQ ID NO: 163208 - DNA, 75 bp, Artificial Sequence
  Synthetic
tgccccccctagccaaggcactgacgtggtccaacatcagctggatgctttggggtatgcactccatggtcttaa

SEQ ID NO: 163209 - DNA, 75 bp, Artificial Sequence
  Synthetic
cgctgaatctagtatgaaggctggcaaagatccccagcggagcgaagctagtgcagggggctcggcattcctaga

SEQ ID NO: 163210 - DNA, 75 bp, Artificial Sequence
  Synthetic
cccgctcgtcgccgcgcctcccatgctaagggcccccttcctttcccttgactttggggatattcggagtctgct

SEQ ID NO: 163211 - DNA, 75 bp, Artificial Sequence
  Synthetic
ttgggatggtgtggataacatctcccgctagatggcgcccttattattgatgtgacttgtgatgcaataaataaa

SEQ ID NO: 163212 - DNA, 75 bp, Artificial Sequence
  Synthetic
ccccccaagcctctcatcagaatctcaaccgatttcgtcagccgcttcagacagccgcggttgtcatcatcatcg

SEQ ID NO: 163213 - DNA, 75 bp, Artificial Sequence
  Synthetic
taataagtcacattgttaatgaccacggccgggataagggtgtaaaccttgcagaatggattggtcggacaccca

SEQ ID NO: 163214 - DNA, 75 bp, Artificial Sequence
  Synthetic
tctggaggacggagagggcggccccggagttgttatcaaagaggcactggaggatgttggccgctccttggagca

SEQ ID NO: 163215 - DNA, 75 bp, Artificial Sequence
  Synthetic
ggagttgttatcaaagaggcactggaggatgttggccgctccttggagcagcttgtcgaaataatgatccacggc

SEQ ID NO: 163216 - DNA, 75 bp, Artificial Sequence
  Synthetic
aggatgttggccgctccttggagcagcttgtcgaaataatgatccacggccacgggaacgccgtgccgctcggcg

SEQ ID NO: 163217 - DNA, 75 bp, Artificial Sequence
  Synthetic
cttgggctccacaaagacgtactggatgcggtcgtggatctggggcagttcctcgttgcgctcgacgaacttctg

SEQ ID NO: 163218 - DNA, 75 bp, Artificial Sequence
  Synthetic
gtgctcttgtaggctgagagcttgcggctgagctccgttgaaaagcagagctcccccatggggaccctgccttca

SEQ ID NO: 163219 - DNA, 75 bp, Artificial Sequence
  Synthetic
ggatgtcaatgacgggcaaaaagcccacaggtagcccttgtgtaaatgactcttggaagggccggtgggagagga

SEQ ID NO: 163220 - DNA, 75 bp, Artificial Sequence
  Synthetic
gatgggcagcagatccgcgtgttctcctgcctcctggcggccgcccaaaaggaaaactttatcctgcccatgccc

SEQ ID NO: 163221 - DNA, 75 bp, Artificial Sequence
  Synthetic
tggcataatttcctcttccaagctgctctccaccattaagaatggacccaccaaggtgtttgagccagctcccat

SEQ ID NO: 163222 - DNA, 75 bp, Artificial Sequence
  Synthetic
cctgcctcctggcggccgcccaaaaggaaaactttatcctgcccatgccctcggcctctgaccgggacggctacc

SEQ ID NO: 163223 - DNA, 75 bp, Artificial Sequence
  Synthetic
tgcaggccgtcttccggacgagctccacccccttcatcagggtcttgccgtccgtcagcacccccacatatctct

SEQ ID NO: 163224 - DNA, 75 bp, Artificial Sequence
  Synthetic
tccgtcagcacccccacatatctcttctttgtaatcagcatcaggcaggagaaggtcttctcggcctccagggag

SEQ ID NO: 163225 - DNA, 75 bp, Artificial Sequence
  Synthetic
atggctaggatcgtggactcaccggaaaaagccggaagcaccaagtctgacctgacggctgtggccgcaggggtt

SEQ ID NO: 163226 - DNA, 75 bp, Artificial Sequence
  Synthetic
aacccccggcactcgataaacagcgagtccgtgtccccgtagatgactcgaagctggccctcggggttgaggggc

SEQ ID NO: 163227 - DNA, 75 bp, Artificial Sequence
  Synthetic
ctggcagacgccctcctgggcctcgacgcgcggtcagggcaacgacgcggctcgctgctcctacaacaaatctgg

SEQ ID NO: 163228 - DNA, 75 bp, Artificial Sequence
  Synthetic
acgagtccttcttggctagtctgttgacctcctggctggccaagcgcaaggccatcaagaagctgctggcggcct

SEQ ID NO: 163229 - DNA, 75 bp, Artificial Sequence
  Synthetic
aagctggccctcggggttgaggggcgcccaggcgtctggggagggggccagggcctgcaggttggcggggctcag

SEQ ID NO: 163230 - DNA, 75 bp, Artificial Sequence
  Synthetic
aagtgcacgtgcaacgccgtctacggcttcaccggggtggccaacggcctctttccctgcctctccatcgccgag

SEQ ID NO: 163231 - DNA, 75 bp, Artificial Sequence
  Synthetic
tccaacatcgtgcggccctgcagcgtcaccgtctcggcgatggagaggcagggaaagaggccgttggccaccccg

SEQ ID NO: 163232 - DNA, 75 bp, Artificial Sequence
  Synthetic
tcaccgtctcggcgatggagaggcagggaaagaggccgttggccaccccggtgaagccgtagacggcgttgcacg

SEQ ID NO: 163233 - DNA, 75 bp, Artificial Sequence
  Synthetic
ggcctccacgaaggccttggcccgctccaacatcgtgcggccctgcagcgtcaccgtctcggcgatggagaggca

SEQ ID NO: 163234 - DNA, 75 bp, Artificial Sequence
  Synthetic
tcctcgcaggccgccagcagcttcttgatggccttgcgcttggccagccaggaggtcaacagactagccaagaag

SEQ ID NO: 163235 - DNA, 75 bp, Artificial Sequence
  Synthetic
tgatggccttgcgcttggccagccaggaggtcaacagactagccaagaaggactcgtgcacgtgcttcttcacaa

SEQ ID NO: 163236 - DNA, 75 bp, Artificial Sequence
  Synthetic
gccgcccgcctggctcgcctggagtctgagaataaggctctgaagcaacaggtcctcagagggggtgcctgtgcc

SEQ ID NO: 163237 - DNA, 75 bp, Artificial Sequence
  Synthetic
cgcaggccggctagcctgtgctcttctcccggcgttatcatggtagaataacagagattatgagcctgaatgatg

SEQ ID NO: 163238 - DNA, 75 bp, Artificial Sequence
  Synthetic
ctcccggcgttatcatggtagaataacagagattatgagcctgaatgatgctcgggtagaggctggcaaagtcca

SEQ ID NO: 163239 - DNA, 75 bp, Artificial Sequence
  Synthetic
gaatcttctgcagcacctcctctgctatgggcgtaggcagcaccatggggaaaacaatgtccacatcattggact

SEQ ID NO: 163240 - DNA, 75 bp, Artificial Sequence
  Synthetic
gtggccgtggatcattatttcgacaagctgctccaaggagcggccaacatcctccagtgcctctttgataacaac

SEQ ID NO: 163241 - DNA, 75 bp, Artificial Sequence
  Synthetic
gccccctggtagccgtcccggtcagaggccgagggcatgggcaggataaagttttccttttgggcggccgccagg

SEQ ID NO: 163242 - DNA, 75 bp, Artificial Sequence
  Synthetic
tcacgtagaaaggactaccgaggaaggaaattgggtcgccggtgtgttcgtatatggaggtagtaagacctccct

SEQ ID NO: 163243 - DNA, 75 bp, Artificial Sequence
  Synthetic
ccaattcttgcacccaccccacccttcgcccctatcttaacccaattcccgcctcccctcgttaccccgaaagaa

SEQ ID NO: 163244 - DNA, 75 bp, Artificial Sequence
  Synthetic
cttgctgttccacaatgtcgtattacaccattgagtcgtctcccctttggaatggcccctggacccggcccacaa

SEQ ID NO: 163245 - DNA, 75 bp, Artificial Sequence
  Synthetic
gccggcgactaccacaagatcaccctctcccatcccaacagtgtgtgtcacgtggccacgtggctgcaagacaag

SEQ ID NO: 163246 - DNA, 75 bp, Artificial Sequence
  Synthetic
ccgctgcaaagaggcgaggaatctccttgtaatgcacatcctccttcttggcccccagtaggtgcctggctactg

SEQ ID NO: 163247 - DNA, 75 bp, Artificial Sequence
  Synthetic
gcccccagtaggtgcctggctactgtgtccagcttgtagtctgagagactgagcttgtcccggcacacggcgtac

SEQ ID NO: 163248 - DNA, 75 bp, Artificial Sequence
  Synthetic
gacatagtcagtgccctggcgcatgcttttgaaaatccggcatatcctgatgagcatggccaccgagcacaggat

SEQ ID NO: 163249 - DNA, 75 bp, Artificial Sequence
  Synthetic
ccccccatcccctgaacgcccgccgccgtccaccgcccgcagcccccggagcccgcggaccccgaccccctcgcc

SEQ ID NO: 163250 - DNA, 75 bp, Artificial Sequence
  Synthetic
tgcggaccttggtgttggcccgcaagaagcccttgcccgcatcatggggtcgcctgacctcgcagacgcccccag

SEQ ID NO: 163251 - DNA, 75 bp, Artificial Sequence
  Synthetic
gcccgccccccgttgcgcctatctgtgcgggggggccggggaccgcgggggaaggccacgccccctccacttttt

SEQ ID NO: 163252 - DNA, 75 bp, Artificial Sequence
  Synthetic
gttgatgctgtagatgtgcctggctctgtccagaatgtagggccagtcaaagttggccacgttgtagccggtcac

SEQ ID NO: 163253 - DNA, 75 bp, Artificial Sequence
  Synthetic
ccacgcagcaagagcctggccccgccggcccactgagtgtccaggctcggctggagccatggcaacctttgcctg

SEQ ID NO: 163254 - DNA, 75 bp, Artificial Sequence
  Synthetic
ccagctccgatgggaactcgtagacctcaaccccctctatgtcttcgcaggtgcccagcgtcagcaggatgcgcc

SEQ ID NO: 163255 - DNA, 75 bp, Artificial Sequence
  Synthetic
ccccgggtcacgtttgccggggtcagccctggtcaccccggagccccgggtcacgtttgctggggtcagtcctgg

SEQ ID NO: 163256 - DNA, 75 bp, Artificial Sequence
  Synthetic
tttgggggggcgtgcctttggtgacattaacctcccccggttttgtggatgtggaactgtttccagggcctgacg

SEQ ID NO: 163257 - DNA, 75 bp, Artificial Sequence
  Synthetic
ccgtggggaagccctcctcccctagacactcgatatcgaaggccagggcctggtaggagggccaggagctgtctt

SEQ ID NO: 163258 - DNA, 75 bp, Artificial Sequence
  Synthetic
cacgccggaccgagaggtcgcccacctcacagtcgtactcgagctcggcgtacgagtcccggtgctggaggcggg

SEQ ID NO: 163259 - DNA, 75 bp, Artificial Sequence
  Synthetic
gcgtggtacacagtgtccactagatgtgggtggtgggtgaggttggtggcggctctcgtcctgatctcccggagt

SEQ ID NO: 163260 - DNA, 75 bp, Artificial Sequence
  Synthetic
tgggtgagcggaggttagtaaaggcatatgtgacgttgaattgtcactggtggaggggctgagtgtctctgggtt

SEQ ID NO: 163261 - DNA, 75 bp, Artificial Sequence
  Synthetic
ggatggcgcggcggcagctgtaccagccaaaggtgacaaagtcattgtccaggacaaagcggcgcgtggcatcca

SEQ ID NO: 163262 - DNA, 75 bp, Artificial Sequence
  Synthetic
gccggaggcagacacccacggaagccctctagacttccatgtctacgacatacttgagacggtgtacacgcacga

SEQ ID NO: 163263 - DNA, 75 bp, Artificial Sequence
  Synthetic
aggacaaagcggcgcgtggcatccacgttggcctcaaagatccgacacccgtgcttgtcttgcagccacgtggcc

SEQ ID NO: 163264 - DNA, 75 bp, Artificial Sequence
  Synthetic
gttggcctgtggtaacagcactggttgcattttttggttggctggtaactactggggtgggacttgttcctccta

SEQ ID NO: 163265 - DNA, 75 bp, Artificial Sequence
  Synthetic
ccccatcttccagcgcaagcttgctgccgttattgcctgtgtccgacgcctgcggactcaggccaccgtctaccc

SEQ ID NO: 163266 - DNA, 75 bp, Artificial Sequence
  Synthetic
agagggtgatcttgtggtagtcgccggcatggttgccgtagcccataatggaacggcgcgtgaccttctccaccg

SEQ ID NO: 163267 - DNA, 75 bp, Artificial Sequence
  Synthetic
cataaacccacttccctttacatgaatctgggcactgaattttggggtacctctaaagactaacgtgttcgattt

SEQ ID NO: 163268 - DNA, 75 bp, Artificial Sequence
  Synthetic
cacacgctggccccatcggccttgcgccggcccagtagcttgatgacgatgccacatggcaccacatacccctgt

SEQ ID NO: 163269 - DNA, 75 bp, Artificial Sequence
  Synthetic
gccacatggcaccacatacccctgtttatccgatggaatgacggcgcatttctcgtgcgtgtacaccgtctcgag

SEQ ID NO: 163270 - DNA, 75 bp, Artificial Sequence
  Synthetic
caaacaatgatggaaacacccgcggagagcgtcagggcccgggtcagctcggttaccttttataatgtcacccag

SEQ ID NO: 163271 - DNA, 75 bp, Artificial Sequence
  Synthetic
gccttgccgtgccctcttgggcacgctggcgccaccacatgccctttccatcctcgtcaccccccaccaccgtca

SEQ ID NO: 163272 - DNA, 75 bp, Artificial Sequence
  Synthetic
accgtccctggcccccttggagtccagagtctggagcatacagactgcgaaatatggtcctctgcccaccctgac

SEQ ID NO: 163273 - DNA, 75 bp, Artificial Sequence
  Synthetic
gggagtcttggtagaagcacagggggggctgaggcccccgcacatccaccacccctgcggcgcctggtgtctgga

SEQ ID NO: 163274 - DNA, 75 bp, Artificial Sequence
  Synthetic
ctccttgtcaggctttttcagaaggcctttattaggtcttaggaaagggttatagaagagtcccccagacatggt

SEQ ID NO: 163275 - DNA, 75 bp, Artificial Sequence
  Synthetic
cgctacggcgggcgggcggcggggggtcggggtccgcgggctcgggggctgcgggcggtggacggcggcgggcgt

SEQ ID NO: 163276 - DNA, 75 bp, Artificial Sequence
  Synthetic
cttactaatgggattaatgcctggaccctcaccagaggcatgttgctgagcgagctcgtcgatcccggggtagag

SEQ ID NO: 163277 - DNA, 75 bp, Artificial Sequence
  Synthetic
tgatgtaattgttggtcgttgatgacccctggaggtggctgtgctggtgctgctggtggtggcaattgtgagggg

SEQ ID NO: 163278 - DNA, 75 bp, Artificial Sequence
  Synthetic
cccctggaggtggctgtgctggtgctgctggtggtggcaattgtgaggggggtaatggcataggtggaatgttat

SEQ ID NO: 163279 - DNA, 75 bp, Artificial Sequence
  Synthetic
cgccgttggagggtggaatgacagggggggcggggacagagaggcggtcgcgccccccgccgcggcagccaagcc

SEQ ID NO: 163280 - DNA, 75 bp, Artificial Sequence
  Synthetic
tcgcaccgaacatgggtaatgattcatcagaagctacaaacacgggcctggggccatagtggcggcagtatgctc

SEQ ID NO: 163281 - DNA, 75 bp, Artificial Sequence
  Synthetic
tggcgcgtgcgcctcgtgagggaaataaccaggatcaccacccccgccaccaggaccagaatgagcatgccgccg

SEQ ID NO: 163282 - DNA, 75 bp, Artificial Sequence
  Synthetic
gaggccctcgcacatccaccacccctgcggcgcctggggtctggaaacacttgggaatgagacgcaggtactcct

SEQ ID NO: 163283 - DNA, 75 bp, Artificial Sequence
  Synthetic
ctttgatgagtaagagggtgcattgattggtctggcacatgcaagacagggagatgcatgctttgtggtgatggt

SEQ ID NO: 163284 - DNA, 75 bp, Artificial Sequence
  Synthetic
catttgaaggacagggggactctatacagtcacccgacaatgagcggggagatgatgtacagactaccggtgagc

SEQ ID NO: 163285 - DNA, 75 bp, Artificial Sequence
  Synthetic
accccccaccgtgctgactaggttggtgatggactgacccacgctacccagactgtccataagttcccccaggcc

SEQ ID NO: 163286 - DNA, 75 bp, Artificial Sequence
  Synthetic
gtccacgaattgatttcttccgtttgacactgcattgtccaaatccttccgcaggccggcgatgttttgcgcctg

SEQ ID NO: 163287 - DNA, 75 bp, Artificial Sequence
  Synthetic
agcgtcttctgcgtaggcctggaaaacggtccctggctgcctgcaatgctctgctggccactgagggtccggccg

SEQ ID NO: 163288 - DNA, 75 bp, Artificial Sequence
  Synthetic
tccaggtcaaagacgttggaggcacgctgttcgtcccgtgagtacagctccagggaggcaaagtcaatgttctcg

SEQ ID NO: 163289 - DNA, 75 bp, Artificial Sequence
  Synthetic
ctggttttgctcatgcagcgctaacatgatggcttgtaattctgtcttactaatgggattaatgcctggaccctc

SEQ ID NO: 163290 - DNA, 75 bp, Artificial Sequence
  Synthetic
atgagggaggtgtttagtgagatgaaggtctgcagggtggcaatgccgtccagctcgatggttttaaagtggtgg

SEQ ID NO: 163291 - DNA, 75 bp, Artificial Sequence
  Synthetic
agagcagggggaggggcaggggcaggggcaggggcaggggcaagggcaagtccagggacaagcaacgcaagcccg

SEQ ID NO: 163292 - DNA, 75 bp, Artificial Sequence
  Synthetic
aatgccggctttctccggggtcgtgcgtatgggctagacttgcttagaactgaaggggaacatgtcgaaggtgct

SEQ ID NO: 163293 - DNA, 75 bp, Artificial Sequence
  Synthetic
ggtcgcctggcacacctccgtcatcttttttgtgaggaagatctcgttgtcggtgcccagctgtccctcgtaggt

SEQ ID NO: 163294 - DNA, 75 bp, Artificial Sequence
  Synthetic
ttttttgtgaggaagatctcgttgtcggtgcccagctgtccctcgtaggtcttggtgtcgttgataaagctgaag

SEQ ID NO: 163295 - DNA, 75 bp, Artificial Sequence
  Synthetic
tggttaacgggcacgcactgggagactgagatgacatcccccaggcgcttggccgccaccgccttaccgtagatg

SEQ ID NO: 163296 - DNA, 75 bp, Artificial Sequence
  Synthetic
aggttacccaccattagccggtgcacggccctgtgcctggccctctccccggcatccctgccaatgtaaatatca

SEQ ID NO: 163297 - DNA, 75 bp, Artificial Sequence
  Synthetic
tcttggttagttctctcagcaccatgttctgcctcttctgctccaggcaccaggcccgcgcgaggtctcccagca

SEQ ID NO: 163298 - DNA, 75 bp, Artificial Sequence
  Synthetic
tacatttttgagacaacagaatctcctagctctgatgaagattatgtggggggacccagtaaaagacctcgcccc

SEQ ID NO: 163299 - DNA, 75 bp, Artificial Sequence
  Synthetic
gactgtggaaatgtcccctttctatgacgggaaaaatacggaaaccttccatgagcgggcagactccttccacgt

SEQ ID NO: 163300 - DNA, 75 bp, Artificial Sequence
  Synthetic
cccagagtgctccggctgccgcaccacgggaggcggtgcaaggacgggggtgggcacctcgggctcaaaggcgga

SEQ ID NO: 163301 - DNA, 75 bp, Artificial Sequence
  Synthetic
gacgggaaaaatacggaaaccttccatgagcgggcagactccttccacgtgagaactaactacaagatagtggac

SEQ ID NO: 163302 - DNA, 75 bp, Artificial Sequence
  Synthetic
caccggtgtggtggcattccccgcatcccgcctccggcgcctcagaacggcggcggaggtgctcccgcgggccgc

SEQ ID NO: 163303 - DNA, 75 bp, Artificial Sequence
  Synthetic
caagggcacttacacgctatcttggaagctcgagaacaggacagcctactgcccgcttcaacactggcaaacctt

SEQ ID NO: 163304 - DNA, 75 bp, Artificial Sequence
  Synthetic
caacaccttccatgtgtcaagggtctccgtgggctgaaggaccaagtggcccgagtaagtgtctcgcagcgcgga

SEQ ID NO: 163305 - DNA, 75 bp, Artificial Sequence
  Synthetic
gggcagtaagacgggccgagttgagctgcctaccatgctataagttgctggcaaagtgctgagagcaaggcccca

SEQ ID NO: 163306 - DNA, 75 bp, Artificial Sequence
  Synthetic
gcccgcttcaacactggcaaacctttgactcgaccatcgccacagaaacagggaagtcaatacattttgtgactg

SEQ ID NO: 163307 - DNA, 75 bp, Artificial Sequence
  Synthetic
ctgcctaccatgctataagttgctggcaaagtgctgagagcaaggccccaattttggcaagccttccttggggtc

SEQ ID NO: 163308 - DNA, 75 bp, Artificial Sequence
  Synthetic
ggccaacgagcgcggggtcagaggtagccaagctaataacaatcctccgctcgttataaaatatgtaatggcttc

SEQ ID NO: 163309 - DNA, 75 bp, Artificial Sequence
  Synthetic
ctggcccttcgtgtaacgatcctggacggcctcgtacttctcatgcatggtcttgttcacctgctcttcgatgca

SEQ ID NO: 163310 - DNA, 75 bp, Artificial Sequence
  Synthetic
ccatcccagcagtcacctccggatcccacgtacgcccgggcaggggcacagcaccaagctccgccacgtattccc

SEQ ID NO: 163311 - DNA, 75 bp, Artificial Sequence
  Synthetic
acaccaggcatacaaggactaggtaataaccttgtatgcctgcgtcctcttagggtgccacatcctgttcaacgt

SEQ ID NO: 163312 - DNA, 75 bp, Artificial Sequence
  Synthetic
aggccccttcctcatacagcgggtggctatctatccataggcaggcatccggcgtctttggtgcattggagatag

SEQ ID NO: 163313 - DNA, 75 bp, Artificial Sequence
  Synthetic
tagaggtgccctcgtcagtcacaaaatgtattgacttccctgtttctgtggcgatggtcgagtcaaaggtttgcc

SEQ ID NO: 163314 - DNA, 75 bp, Artificial Sequence
  Synthetic
gggtggcatcgaaggtggcttggggctccggaggtgggggctccggtgcctttttcaggatggacttggtgggag

SEQ ID NO: 163315 - DNA, 75 bp, Artificial Sequence
  Synthetic
gcgatggtcgagtcaaaggtttgccagtgttgaagcgggcagtaggctgtcctgttctcgagcttccaagatagg

SEQ ID NO: 163316 - DNA, 75 bp, Artificial Sequence
  Synthetic
gttattagcttggctacctctgaccccgcgctcgttggccaccgtcaagaacctgacggagcttaccactccgac

SEQ ID NO: 163317 - DNA, 75 bp, Artificial Sequence
  Synthetic
gcgaagaaaattggcacagtcacacaactgggcggtgccctctagcctctgtgccttgcgagtaacgctttgcgg

SEQ ID NO: 163318 - DNA, 75 bp, Artificial Sequence
  Synthetic
cctccgacgcctcagaacggcggcgggggtgctcccgcgggccgcggatggggctgggggcgatggactgctggg

SEQ ID NO: 163319 - DNA, 75 bp, Artificial Sequence
  Synthetic
ccctcggttgtcgtagtccactatcttgtagttagttctcacgtggaaggagtctgcccgctcatggaaggtttc

SEQ ID NO: 163320 - DNA, 75 bp, Artificial Sequence
  Synthetic
aaggatatgttttcccgagccgtcaccatgacagccgccagctacgctcgctacgttctggtccggcacggcacc

SEQ ID NO: 163321 - DNA, 75 bp, Artificial Sequence
  Synthetic
ttcccgggggccgtggggggcaccggtgtggtggcgttccccgcatcccgcctccgacgcctcagaacggcggcg

SEQ ID NO: 163322 - DNA, 75 bp, Artificial Sequence
  Synthetic
tggtcacaaagaagtcgaaggggctgttggacttggccatcatgtcagttatcaggcagttgacggtagttcttg

SEQ ID NO: 163323 - DNA, 75 bp, Artificial Sequence
  Synthetic
tggagcggactgacggcccctccgtgcccctacgccgaaagttcatgggcacaggcggccgtgcagacggccctc

SEQ ID NO: 163324 - DNA, 75 bp, Artificial Sequence
  Synthetic
gcactggtagatggtatccatctggtcagtttcgtagctgtcaacggagaacttctcctcgtgccggttggtcac

SEQ ID NO: 163325 - DNA, 75 bp, Artificial Sequence
  Synthetic
cgaagcggtcgacgtaggccaggatgtccggcgagagctcgaggccgtactcgagggtcttcatgaggtgtccaa

SEQ ID NO: 163326 - DNA, 75 bp, Artificial Sequence
  Synthetic
gggctcggagaaatggggccggccagggccacgggacctggaatgcagcagtttgtcagcagctacttcctcaac

SEQ ID NO: 163327 - DNA, 75 bp, Artificial Sequence
  Synthetic
cttgccctctccagcaaccaatgtatcccaaataaatgttacttcttttgctcttaaccattgacacgcctgtca

SEQ ID NO: 163328 - DNA, 75 bp, Artificial Sequence
  Synthetic
ggcctggtggacccggggaggccagaagctggggtctagggtggagcgaaggttggagaggagcagggggacaga

SEQ ID NO: 163329 - DNA, 75 bp, Artificial Sequence
  Synthetic
ggttggagaggagcagggggacagagagaagggccggtggggggatccgggccactcgggtctcggtggggctgg

SEQ ID NO: 163330 - DNA, 75 bp, Artificial Sequence
  Synthetic
cgctgggcctcctgccgcggggcctcacatactgacgcctccttccgcccggcctcgtataatggcgcctcccgt

SEQ ID NO: 163331 - DNA, 75 bp, Artificial Sequence
  Synthetic
tcccaaataaatgttacttcttttgctcttaaccattgacacgcctgtcattctatcaattaaacaagggaaaaa

SEQ ID NO: 163332 - DNA, 75 bp, Artificial Sequence
  Synthetic
ttctacagcgtacccgggggctcactggcatctagccagcaaattctgtgccgggcgctgcgcgaggccgtccta

SEQ ID NO: 163333 - DNA, 75 bp, Artificial Sequence
  Synthetic
gatgtccgaggagaagcggaacaggtcgccgtggctggagagctcgcagactcggaaaggaaagctggtttgctg

SEQ ID NO: 163334 - DNA, 75 bp, Artificial Sequence
  Synthetic
tttccaccgccgagatgatggatgatttctctcccttcttcaccgtggagtttcccccgattcaagaggagggcg

SEQ ID NO: 163335 - DNA, 75 bp, Artificial Sequence
  Synthetic
tttctctcccttcttcaccgtggagtttcccccgattcaagaggagggcgcaagttctccggtacccttagatgt

SEQ ID NO: 163336 - DNA, 75 bp, Artificial Sequence
  Synthetic
cgaccgcccggctgcccccggagcgccaggaaccccggctgcccctggacctggcggtagtgcagtgtccctgct

SEQ ID NO: 163337 - DNA, 75 bp, Artificial Sequence
  Synthetic
ctcatttggaggtgcaggtagagaagggcatatagatccttaaatacccaccccctgcccttatacagaagaatt

SEQ ID NO: 163338 - DNA, 75 bp, Artificial Sequence
  Synthetic
ccaggaaccccggctgcccctggacctggcggtagtgcagtgtccctgctgcccatggaatgctcagaccccggg

SEQ ID NO: 163339 - DNA, 75 bp, Artificial Sequence
  Synthetic
gggcatatagatccttaaatacccaccccctgcccttatacagaagaattaggggccggtcagagtcgtacgtga

SEQ ID NO: 163340 - DNA, 75 bp, Artificial Sequence
  Synthetic
ctggggtgcccgaggtccctggttcctctgaaggacagagagaggggcagaaccaaccccggcggctggccccga

SEQ ID NO: 163341 - DNA, 75 bp, Artificial Sequence
  Synthetic
ctccataccagggataccaggagccgccggccccccaggctccataccagggataccaggagccgccggcccccc

SEQ ID NO: 163342 - DNA, 75 bp, Artificial Sequence
  Synthetic
gaccttaaacgagtagggaataatgttgtctttaaacaccatcaacaggccctccgtgtgattctcccgcgtgcc

SEQ ID NO: 163343 - DNA, 75 bp, Artificial Sequence
  Synthetic
ggccctgttatttaaatccaccagaaacaagcgctatgatgctgtagccaaacgcatgagagagctatggatgtc

SEQ ID NO: 163344 - DNA, 75 bp, Artificial Sequence
  Synthetic
gtgagcccccgggtacgctgtagaagctgttgaaggaggtctctatccagtcgctcggctcgatgcctggccata

SEQ ID NO: 163345 - DNA, 75 bp, Artificial Sequence
  Synthetic
gccggcccttacaccaggttttggcaacgagagcaatacacaattaggctaaaagcagccatgtatcaataaact

SEQ ID NO: 163346 - DNA, 75 bp, Artificial Sequence
  Synthetic
tcagggaagtcaggaacgccttctggtgaggcagcgtacctgcggcgtcacagcagcgagccagggccacgttgc

SEQ ID NO: 163347 - DNA, 75 bp, Artificial Sequence
  Synthetic
gtgaggcagcgtacctgcggcgtcacagcagcgagccagggccacgttgctgggtgggggaaagagcccgctctc

SEQ ID NO: 163348 - DNA, 75 bp, Artificial Sequence
  Synthetic
ggggttcctggcgctccgggggcagccgggcggccgccggtgggtccgctgggccgctgccccgctccgggtggg

SEQ ID NO: 163349 - DNA, 75 bp, Artificial Sequence
  Synthetic
ctctgcaaagatgctggctcatctgaagcaggttaccaggatccccccctgtccgcccttcagcgggcgggaggc

SEQ ID NO: 163350 - DNA, 75 bp, Artificial Sequence
  Synthetic
gcctagccatcggggcacgtttaccagtgtgccagtgtactgcgaggagggccttccagagctctacaacccctt

SEQ ID NO: 163351 - DNA, 75 bp, Artificial Sequence
  Synthetic
cgccggcgcgcctgtcctcccagggacccgagacgaaggcccgtctgtagaggaagtggttgcgcatgcgggcca

SEQ ID NO: 163352 - DNA, 75 bp, Artificial Sequence
  Synthetic
cggtgccggtgaatccggagccggtctcgggactgtttgagaatgaagtccggcaggctgggctcgggcacctgt

SEQ ID NO: 163353 - DNA, 75 bp, Artificial Sequence
  Synthetic
gctcccagtagaccacgtccccccagacgcgcaggcacagggtctcggtcagggtctcgctctgttgcgccaggc

SEQ ID NO: 163354 - DNA, 75 bp, Artificial Sequence
  Synthetic
ccctattccaccactaggttaataacctataggttattctaccattaaaacggaaggaggaagggtggcgcacct

SEQ ID NO: 163355 - DNA, 75 bp, Artificial Sequence
  Synthetic
tcatgtcaacagccttaacagaaggcaatctgactttgcgtggagctgacatgctattggtttaacgagcagaga

SEQ ID NO: 163356 - DNA, 75 bp, Artificial Sequence
  Synthetic
gatgcctgcctatggatagatagccacccgctgtatgaggaaggggcctcggcctggggtaaggtgatcgactcc

SEQ ID NO: 163357 - DNA, 75 bp, Artificial Sequence
  Synthetic
gggcgccggacgggccgggctctcgtgccccagccggccggggcacctccgggctctcccgggacgcctcctcct

SEQ ID NO: 163358 - DNA, 75 bp, Artificial Sequence
  Synthetic
tgccccagccggccggggcacctccgggctctcccgggacgcctcctcctcgcctcggcccaaccgctgcatggc

SEQ ID NO: 163359 - DNA, 75 bp, Artificial Sequence
  Synthetic
aatggaaccctatggatacctacctctaggctccacccactaggtatatcggggcggagcccaatcctccccctc

SEQ ID NO: 163360 - DNA, 75 bp, Artificial Sequence
  Synthetic
cgcctcggcccaaccgctgcatggctcggttgagccgcgtgtagagctcgttcctcttttgcaggatggcccggt

SEQ ID NO: 163361 - DNA, 75 bp, Artificial Sequence
  Synthetic
ggcgcagtccgccttcagcgcctccaccgcgtcgcccgaggagctgtagaccccgccgcagaagagccgctccgt

SEQ ID NO: 163362 - DNA, 75 bp, Artificial Sequence
  Synthetic
tcccacctcagcagtgactaccccaaccccaaatgccaccagccctactgtgggagaaacaagtccacaggcaaa

SEQ ID NO: 163363 - DNA, 75 bp, Artificial Sequence
  Synthetic
tccccccccatgaagcgggtggcgcggggtccctgcctggcaccagggtccggcctgggagcgcacccccatccc

SEQ ID NO: 163364 - DNA, 75 bp, Artificial Sequence
  Synthetic
aacagggcagagaggcgggaatggccgccaccctccccctgccccgttgcaccgatagcatggccgccagagttc

SEQ ID NO: 163365 - DNA, 75 bp, Artificial Sequence
  Synthetic
ggggtccctgcctggcaccagggtccggcctgggagcgcacccccatccccgccggcccacccggttccctcccc

SEQ ID NO: 163366 - DNA, 75 bp, Artificial Sequence
  Synthetic
ccacctccgggggcactgtcgagaagacgttgtaggtgtccagcgctctggtcgccccctctgcctccggccgcc

SEQ ID NO: 163367 - DNA, 75 bp, Artificial Sequence
  Synthetic
ctacaagatctggcacaaatgtaattaagagggaactagaaaaccaaaaaattcaagttagcaccacgtgaacca

SEQ ID NO: 163368 - DNA, 75 bp, Artificial Sequence
  Synthetic
cagtcccgagaccggctccggattcaccggcaccgccaggtggttacaggagacgtgggtcccctctgccgtgga

SEQ ID NO: 163369 - DNA, 75 bp, Artificial Sequence
  Synthetic
accggcaccgccaggtggttacaggagacgtgggtcccctctgccgtggaagggttgccgtggttgggcagaacc

SEQ ID NO: 163370 - DNA, 75 bp, Artificial Sequence
  Synthetic
aacctagaggctatgctatcaggttaacaagggaagaaggcaagcgaaaattgagggtgggagcaattccaacac

SEQ ID NO: 163371 - DNA, 75 bp, Artificial Sequence
  Synthetic
cagcctacgatttgacctcacacgagaccacaagcacaaactgaaggtaggctagcgttcgggtgaacgcaagac

SEQ ID NO: 163372 - DNA, 75 bp, Artificial Sequence
  Synthetic
agggcacagaggtgatgtagaggcgcgggtctgggatgggacttacgccccgaaagcggcccagcagatccaggg

SEQ ID NO: 163373 - DNA, 75 bp, Artificial Sequence
  Synthetic
cgcaggccccccgcaccagggccaggcgacgctcccgggcaaacagggcagagaggcgggaatggccgccaccct

SEQ ID NO: 163374 - DNA, 75 bp, Artificial Sequence
  Synthetic
ggtgtccacaggccccagtacgtggggactggggaaataagctggcgaacactgaggggggaaataacccaccgc

SEQ ID NO: 163375 - DNA, 75 bp, Artificial Sequence
  Synthetic
cccgttccaggctctccagccccatggtgtgagacatgcaataaaacacgctattgattctcttcattaaaatct

SEQ ID NO: 163376 - DNA, 75 bp, Artificial Sequence
  Synthetic
tagcagctcagaagaggaagcagaagatgcccacctggagccatcccagaggggtaaaaagagaaaacgggtcga

SEQ ID NO: 163377 - DNA, 75 bp, Artificial Sequence
  Synthetic
tgaagtcatggagcagagggttatggcaaccctactgccaccagtaccacaacagccccgggctggcagaagagg

SEQ ID NO: 163378 - DNA, 75 bp, Artificial Sequence
  Synthetic
aactctatgagggtcgcatttgccacagccaggacaggggtgggaggaaagacaacacaacgtgacatctcgtac

SEQ ID NO: 163379 - DNA, 75 bp, Artificial Sequence
  Synthetic
aacaagggaagaaggcaagcgaaaattgagggtgggagcaattccaacacatgcccaccaacggccgctccctca

SEQ ID NO: 163380 - DNA, 75 bp, Artificial Sequence
  Synthetic
ggtgtgagacatgcaataaaacacgctattgattctcttcattaaaatctctatgtcatttattaggcacaaact

SEQ ID NO: 163381 - DNA, 75 bp, Artificial Sequence
  Synthetic
gcggcagaggcctctctcgagttctctagcaggtgcaccagctccagggacagggcgctgcatgcacggtcattc

SEQ ID NO: 163382 - DNA, 75 bp, Artificial Sequence
  Synthetic
cgcagttgcggcagaagccgcgtctgtagatatactgacgggcagcaccgcctccgcaatcgaaaagctgttcaa

SEQ ID NO: 163383 - DNA, 75 bp, Artificial Sequence
  Synthetic
cctccgcaatcgaaaagctgttcaactccccgtccgccagcctgggtgccagggtgtctggtcacaatgaaagca

SEQ ID NO: 163384 - DNA, 75 bp, Artificial Sequence
  Synthetic
ggcgtacacctggctgtacgccgccgccagcagccccgacatcgccgccccaggggtctctagacctcgagtccg

SEQ ID NO: 163385 - DNA, 75 bp, Artificial Sequence
  Synthetic
gtgggacccactccccatcagacacctcaagtggaaataacaccatataagcccacttgggctcagatagggcac

SEQ ID NO: 163386 - DNA, 75 bp, Artificial Sequence
  Synthetic
tgcgtctgcccccggagccctgccctcctccacccagcagcagcccggccgaggcctgcgacgcggtgctgaccg

SEQ ID NO: 163387 - DNA, 75 bp, Artificial Sequence
  Synthetic
gctcggccacgctgataaagttgtcctgggctgccccgggcccaccccacactccctccagaaagtcccgagcgg

SEQ ID NO: 163388 - DNA, 75 bp, Artificial Sequence
  Synthetic
caggggtgggagggggctgggcctcgccctcggggacccctggacatctggacaaagtttgggggcgcccgctcc

SEQ ID NO: 163389 - DNA, 75 bp, Artificial Sequence
  Synthetic
ctgggctgccccgggcccaccccacactccctccagaaagtcccgagcggcccccgccgtccactctatcccgct

SEQ ID NO: 163390 - DNA, 75 bp, Artificial Sequence
  Synthetic
tctctacaggtttccgctagatttaagaaggtttattcaagcaattggagccgcagctacggtgagcttccctat

SEQ ID NO: 163391 - DNA, 75 bp, Artificial Sequence
  Synthetic
tgagacggcagaatgaccgtgcatgcagcgccctgtccctggagctggtgcacctgctagagaactcgagagagg

SEQ ID NO: 163392 - DNA, 75 bp, Artificial Sequence
  Synthetic
aaaaagtaagcctgcgcgtgacccccagcccggggggacacggagcctgaccatgcaaaaagtaagcctgcgcgt

SEQ ID NO: 163393 - DNA, 75 bp, Artificial Sequence
  Synthetic
ccgacgggtgttctttcgcgaggttagggacaacacgttcctcgacaagtacgtgggtctggccatcggaggaga

SEQ ID NO: 163394 - DNA, 75 bp, Artificial Sequence
  Synthetic
tgtacctgtggcacaacttttccaggcggcgctcggtccctgtccccagcggggccagcgcggaggagtactctg

SEQ ID NO: 163395 - DNA, 75 bp, Artificial Sequence
  Synthetic
tccaggccagccctgatgttctcaatctcatatgtggtcgcggcttgggtccggcgcttcacggtcaaccctagg

SEQ ID NO: 163396 - DNA, 75 bp, Artificial Sequence
  Synthetic
tggccagacggcgcttgcgcctgcccccggagccctgccctcctccacccagcagcagcccggccgaggcctgcg

SEQ ID NO: 163397 - DNA, 75 bp, Artificial Sequence
  Synthetic
ggccgggtcaagtggctggggcaccggggctggcgttagggatccgaccggttcatggacaggtcctgtgggggt

SEQ ID NO: 163398 - DNA, 75 bp, Artificial Sequence
  Synthetic
aggactttgaggccatcttcacctccccgtctgataccatcagtgaggctgaaaccaaggcctttgagaagctgg

SEQ ID NO: 163399 - DNA, 75 bp, Artificial Sequence
  Synthetic
gccgtcacccgggttctcctgcacgcggccgctgacctaggactgacctgggcttatgcagacgagttcatcctg

SEQ ID NO: 163400 - DNA, 75 bp, Artificial Sequence
  Synthetic
tctgtggccgcgcagaccaccgtagtcgcagtaagggaggaggtggcctccgcgtaggccgctgccgactccacc

SEQ ID NO: 163401 - DNA, 75 bp, Artificial Sequence
  Synthetic
ccgccaggacggagaagcggcccaataagtactccgcgtcgtccctagtcagcgaggcgcatgcctcgcccatgg

SEQ ID NO: 163402 - DNA, 75 bp, Artificial Sequence
  Synthetic
taattgaagaggtggcgccggtacgaagaatattaaagtttggaaataaggtggttttttgataattgtcaataa

SEQ ID NO: 163403 - DNA, 75 bp, Artificial Sequence
  Synthetic
catgctaggactggaggtgtttggctctggtctccatggtccaccgggcttgcgttgcttgtccctggacttgcc

SEQ ID NO: 163404 - DNA, 75 bp, Artificial Sequence
  Synthetic
ggtgaggagcggggctgggtgggagagcgcggcccccggggtttgcccaactcttattcttcccgttaacaggaa

SEQ ID NO: 163405 - DNA, 75 bp, Artificial Sequence
  Synthetic
ctgatgtagaactgggtctggccgcacgccttcaggatggcgttgttgagcctctgcttggcgtaagtgaccagg

SEQ ID NO: 163406 - DNA, 75 bp, Artificial Sequence
  Synthetic
ggtaagagttatactctacttatcttttttgacactacagttaactgttatgtaacaatgtttgcttattttcat

SEQ ID NO: 163407 - DNA, 75 bp, Artificial Sequence
  Synthetic
agaattggctctaactatgcggtctaagaagcttccaattaacgtcaccactggagaggagcaacaagtaagcct

SEQ ID NO: 163408 - DNA, 75 bp, Artificial Sequence
  Synthetic
ccgacacgcgagccatagaccagtttttcggatcccagatttcaaataccgacctgtacgtaatgtatgccatgg

SEQ ID NO: 163409 - DNA, 75 bp, Artificial Sequence
  Synthetic
tgctctcttcgtgggcccgggagcccccgtccacaaagagggccaggtcagagtactcctccgcgctggccccgc

SEQ ID NO: 163410 - DNA, 75 bp, Artificial Sequence
  Synthetic
caccgtggcccgcagacacattcgggtgaaggctcgacgcgggcccgcgtgcctactgatggccatctttcaggg

SEQ ID NO: 163411 - DNA, 75 bp, Artificial Sequence
  Synthetic
ccagccccgggggcctgcagcaggttcctgtccacgccccggcccataaagtatcccaggttcccggcctggaat

SEQ ID NO: 163412 - DNA, 75 bp, Artificial Sequence
  Synthetic
cttgagagcttagtgtccgggaatagggtcttgtggtaggtgttgaggaatttcatgtagggcccgttgatgatg

SEQ ID NO: 163413 - DNA, 75 bp, Artificial Sequence
  Synthetic
ggcacgaagccttctcctggaccctggaccaactagcggcgagacccgaggcagacaaggccccgccatcccacg

SEQ ID NO: 163414 - DNA, 75 bp, Artificial Sequence
  Synthetic
attctcccccgtgaagaccaccctgttcttgatcttgatgttcctggggcacagcatcagcaccttggacatgcg

SEQ ID NO: 163415 - DNA, 75 bp, Artificial Sequence
  Synthetic
cctgacccggagactggcccctgggcggcgccgaaacaggttttgggctcttccgcgagcctggcttcagcggct

SEQ ID NO: 163416 - DNA, 75 bp, Artificial Sequence
  Synthetic
gctgccgactccaccgcccgcgtgcccagtacgtgggggtagtcacgggcgggcaccgactgcgtcctcggcacc

SEQ ID NO: 163417 - DNA, 75 bp, Artificial Sequence
  Synthetic
gaggtgggacttgtttttcccaaggtggttggggtagtcgctggggtggggctggtggcatttgggggtgcttgc

SEQ ID NO: 163418 - DNA, 75 bp, Artificial Sequence
  Synthetic
ctggcaggtcgcaggtgggctccccatgcaccaccttggcctccttggccgtgaggacccccttgtcgatggcca

SEQ ID NO: 163419 - DNA, 75 bp, Artificial Sequence
  Synthetic
ccagacggccactgagcatggtctcagccccaccgcctactttcgagagattatggcctttctgcttgatgtgat

SEQ ID NO: 163420 - DNA, 75 bp, Artificial Sequence
  Synthetic
ctggtagtgaccctttagccactctggggggctctggccaagcccggggttgtcattctcatagcacatacagat

SEQ ID NO: 163421 - DNA, 75 bp, Artificial Sequence
  Synthetic
tgtcattctcatagcacatacagatgggcagggagatgtcctgcaggatggtcagcagtgagcggtaaaacagct

SEQ ID NO: 163422 - DNA, 75 bp, Artificial Sequence
  Synthetic
gggcagggagatgtcctgcaggatggtcagcagtgagcggtaaaacagctgggtgaagatggggcaggcgggctg

SEQ ID NO: 163423 - DNA, 75 bp, Artificial Sequence
  Synthetic
accgtgtcactcccgaggcacttgcgtctcaaggtctggaggacagtctggcactggaaatgcttggtcaataaa

SEQ ID NO: 163424 - DNA, 75 bp, Artificial Sequence
  Synthetic
ggtccttgtaggtgatgttgttcttggccatgctgttcataaactggaccacttcggcgtccaccgccgcatcca

SEQ ID NO: 163425 - DNA, 75 bp, Artificial Sequence
  Synthetic
gaatcttgataaaacaggttaaatgtgaagcccgagttggcatcttcctccttgtttagatccgcgcagtaatcc

SEQ ID NO: 163426 - DNA, 75 bp, Artificial Sequence
  Synthetic
acagctccttccccccccccgccgtgtctggctcaccatcccccgcaaaactcggtttacataccctgatcccat

SEQ ID NO: 163427 - DNA, 75 bp, Artificial Sequence
  Synthetic
gagcacctggtctatgcggcctccttctcgcccaaccttcttgcccgctatgcctactacctgcagttttgccag

SEQ ID NO: 163428 - DNA, 75 bp, Artificial Sequence
  Synthetic
cggtgaccaggtaagcgtagagaaggctgggttgggaaagtccagcctttactgcactgggagagctgctgagca

SEQ ID NO: 163429 - DNA, 75 bp, Artificial Sequence
  Synthetic
cgtccttgaacatcttgacaaagtcacgcgggccatggggctccttctctagctttccctcagcgtctatgccca

SEQ ID NO: 163430 - DNA, 75 bp, Artificial Sequence
  Synthetic
gccgagacagccgctccagcaggttctggttcagctgccagtaggtgtagcggggctcgtcgtccggccgctgcc

SEQ ID NO: 163431 - DNA, 75 bp, Artificial Sequence
  Synthetic
ttgggtgacctggccaggcaccccatcttccccgaggtcaaaaagaggctctgcatgaggtcccgggcttcggat

SEQ ID NO: 163432 - DNA, 75 bp, Artificial Sequence
  Synthetic
ccacggcccgggggtggcagccccctcctccaggtcgtggtacttgaccagggtggacagcagcgtcctggcccc

SEQ ID NO: 163433 - DNA, 75 bp, Artificial Sequence
  Synthetic
ccctggccgctggttggcctatgggttaccaggcatacagtagctggatgtacagctacaccgatccccaggtga

SEQ ID NO: 163434 - DNA, 75 bp, Artificial Sequence
  Synthetic
gagaaagttgcccaaaaagtccgtctcgttgtaggagcccgaggcccccgagatcacataggggtccctccgctg

SEQ ID NO: 163435 - DNA, 75 bp, Artificial Sequence
  Synthetic
tgttgttacactctatttgtaacaaggggaaagagagtggacgccgacagcagcggactccactggttgtctcta

SEQ ID NO: 163436 - DNA, 75 bp, Artificial Sequence
  Synthetic
gcccctgcccctgcccctgcccctccccctgctctgtccccggctctggccttgagtcttagagggttgcggggg

SEQ ID NO: 163437 - DNA, 75 bp, Artificial Sequence
  Synthetic
ccccgccaatggggcccataaacaaagacaagtggccactcttttttttgaaattgtggagtgggggcacgcgtc

SEQ ID NO: 163438 - DNA, 75 bp, Artificial Sequence
  Synthetic
ttctcaatcatcgagagcagggcgcacatctccataaggttcacattgttgggtttgtacaggatcatcctctcg

SEQ ID NO: 163439 - DNA, 75 bp, Artificial Sequence
  Synthetic
ctcgcagagcgagcacatggggctggcggccgcccccgccacgtagctgcccgtctccggcaccggggtcagaga

SEQ ID NO: 163440 - DNA, 75 bp, Artificial Sequence
  Synthetic
ggccccgagggtagatgatgtaattgttggtcgttgatgacccctggaggtggctgtgctggtgctgctggtggt

SEQ ID NO: 163441 - DNA, 75 bp, Artificial Sequence
  Synthetic
ccgtctccggcaccggggtcagagagctcttctgtccctggcaaaactgcaggtagtaggcatagcgggcaagaa

SEQ ID NO: 163442 - DNA, 75 bp, Artificial Sequence
  Synthetic
ggtggtcgacctggtcctcggagtccagcagactcacgaggatgtagccgcaaaactgggacgagatcatccggg

SEQ ID NO: 163443 - DNA, 75 bp, Artificial Sequence
  Synthetic
ccattcttcccagctctgagcgagattttccacacctggacaccgacttcacgctatgtgccgaggcttttgagg

SEQ ID NO: 163444 - DNA, 75 bp, Artificial Sequence
  Synthetic
ggccaagataggggcgcgattgctgcgatctggaggacaagttacacacacttgcgcctgagcgccaagcacagg

SEQ ID NO: 163445 - DNA, 75 bp, Artificial Sequence
  Synthetic
cgatctggaggacaagttacacacacttgcgcctgagcgccaagcacagggttgttgtagattaggatagcatat

SEQ ID NO: 163446 - DNA, 75 bp, Artificial Sequence
  Synthetic
gttcggtaggcctttgtagtaccgtgagtagtggtgtgggtggcagagtggtaggacgggtaggccttggtggca

SEQ ID NO: 163447 - DNA, 75 bp, Artificial Sequence
  Synthetic
gggtcatgtagaaactgttaaagagactctccttgccctgaccggttgacttcgagacccccgagacgtagagga

SEQ ID NO: 163448 - DNA, 75 bp, Artificial Sequence
  Synthetic
actctccttgccctgaccggttgacttcgagacccccgagacgtagaggacggaattggtggcaaagatctgcgt

SEQ ID NO: 163449 - DNA, 75 bp, Artificial Sequence
  Synthetic
aaggccgggcccttccgaacaatcatcagtgaccgtggagcccgcccacccgaccccggtggagatgccaatggt

SEQ ID NO: 163450 - DNA, 75 bp, Artificial Sequence
  Synthetic
agaagcccttgccactcacggtggaacacctgccggatgctccggtcggctcagtctttggcctttaccagagcc

SEQ ID NO: 163451 - DNA, 75 bp, Artificial Sequence
  Synthetic
cctccagcatggcgggcgcgtagctcaccgccagctcgcaggccgcgctgtccacaatcattaaggctcccgagt

SEQ ID NO: 163452 - DNA, 75 bp, Artificial Sequence
  Synthetic
actttgcagtctgtggactgcaacacaacattgcctttatgtgtaactcttggctgaagctcttacaccaatgct

SEQ ID NO: 163453 - DNA, 75 bp, Artificial Sequence
  Synthetic
tccacaatcattaaggctcccgagtccgggtgactgatggttgaggctgggaactccttgaggggggccaccttg

SEQ ID NO: 163454 - DNA, 75 bp, Artificial Sequence
  Synthetic
tctgcttctccagcagctccaccagcttgcccacccgtcggacgcgcagcgcctgcgccagcccggtgtacagcg

SEQ ID NO: 163455 - DNA, 75 bp, Artificial Sequence
  Synthetic
tgtcgtagagcgggaccctaacgctcgcagactgccccaccgctacctcctgttttaacgatggaatggccacca

SEQ ID NO: 163456 - DNA, 75 bp, Artificial Sequence
  Synthetic
cgcagactgccccaccgctacctcctgttttaacgatggaatggccaccaggtttccgctgtagagtcgctcctt

SEQ ID NO: 163457 - DNA, 75 bp, Artificial Sequence
  Synthetic
catccgtcaagggtcctaactggtcaggggcagctggaggcatgaaacggaagcaatgtcgtgttgaccggctca

SEQ ID NO: 163458 - DNA, 75 bp, Artificial Sequence
  Synthetic
gcttttgtaggtccggggcgtcgctggcctttaaatacgactcggctgggatattggccacacccctgtcctgcc

SEQ ID NO: 163459 - DNA, 75 bp, Artificial Sequence
  Synthetic
tcctggggaatagagttgtcctgggccttgaccacccagaccggggagaagcgggtcacacatgcgcaggcgtgt

SEQ ID NO: 163460 - DNA, 75 bp, Artificial Sequence
  Synthetic
taggcgtcgtatccaaacacctccctggtctcgccacagagggcctcgagacccggcccctcaaagatgggggga

SEQ ID NO: 163461 - DNA, 75 bp, Artificial Sequence
  Synthetic
tccaccagcttgcccacccgtcggacgcgcagcgcctgcgccagcccggtgtacagcgcctcgtgcatgcagcgg

SEQ ID NO: 163462 - DNA, 75 bp, Artificial Sequence
  Synthetic
gcgtaggagcccgcagttggggtcgggcctcctgtgcagagccttgacattgatgctgaagcccggctccacggt

SEQ ID NO: 163463 - DNA, 75 bp, Artificial Sequence
  Synthetic
ggatggccaaaaacagcacggttggggagcccactgctgagacccaggccgagaggtctgtaagacccgagacct

SEQ ID NO: 163464 - DNA, 75 bp, Artificial Sequence
  Synthetic
gatgccacaaaggagcggcaccgtcaggcacctgtggcccgcgtagccggtccccagtgtggccacctccctaag

SEQ ID NO: 163465 - DNA, 75 bp, Artificial Sequence
  Synthetic
gtgccccctggctaatgggttgaattaaggggaggtcaaagtactgtggctgcatcgccggtaccccaggtgtgt

SEQ ID NO: 163466 - DNA, 75 bp, Artificial Sequence
  Synthetic
tagatgtagccgcacggacccggctggctctggctgcccagattatcctcgctagtctgtgcaccctgcatgatg

SEQ ID NO: 163467 - DNA, 75 bp, Artificial Sequence
  Synthetic
aggtggtgggccaggttgtaattggtcaggttaagtgccccgtaatcaaccagtgcgttaaagtagcaggggtac

SEQ ID NO: 163468 - DNA, 75 bp, Artificial Sequence
  Synthetic
tatcaaggaaacaaaaccactgacctggttaacagacttcaggtggtcatgtttccctccaagcggcacagatta

SEQ ID NO: 163469 - DNA, 75 bp, Artificial Sequence
  Synthetic
gctagtctgtgcaccctgcatgatgcccaaggtatcgccccggcctcccagtcccacattaaatgttacacttta

SEQ ID NO: 163470 - DNA, 75 bp, Artificial Sequence
  Synthetic
ttcatttacaaagatttcaggaagtcagtcaggctggccagggcccacgtcacggggaactgacgtctcagcgat

SEQ ID NO: 163471 - DNA, 75 bp, Artificial Sequence
  Synthetic
ttgatccacgttctatagacgaacgtgtcattcttggaggacttcatgattgcgatggtttcagttgagcattca

SEQ ID NO: 163472 - DNA, 75 bp, Artificial Sequence
  Synthetic
cataacaaagtacacaacaagcgttttgatccacgttctatagacgaacgtgtcattcttggaggacttcatgat

SEQ ID NO: 163473 - DNA, 75 bp, Artificial Sequence
  Synthetic
cgccacagagggcctcgagacccggcccctcaaagatggggggaaccatatgggcattgtggaacacgtagatgt

SEQ ID NO: 163474 - DNA, 75 bp, Artificial Sequence
  Synthetic
tgtcattcttggaggacttcatgattgcgatggtttcagttgagcattcaccttttaaataatttgcaaagggtg

SEQ ID NO: 163475 - DNA, 75 bp, Artificial Sequence
  Synthetic
aaggcggcgctcttgtggtcatccaggtagtttcgcaccgcaaacaccactgtgtagcacagcaccaccctgagc

SEQ ID NO: 163476 - DNA, 75 bp, Artificial Sequence
  Synthetic
gggtggggggtggccccgctgggcaccgctgcgccgccgccaggtcctggggcagccggggttcctggcgctccg

SEQ ID NO: 163477 - DNA, 75 bp, Artificial Sequence
  Synthetic
cgcgaccagtagtcgtagtggtcgttgtacactgcgcgcaggacgctgatgatgagccgtacgtgcgtgtctttg

SEQ ID NO: 163478 - DNA, 75 bp, Artificial Sequence
  Synthetic
cacagtcagatttgtcatcgagcccaaggccggccaggccctcctcaaagcctttctggtacatgaagctccggc

SEQ ID NO: 163479 - DNA, 75 bp, Artificial Sequence
  Synthetic
ctgccagccgccgcttggaggctccctggagccccccgcggtcaacgcgccctcgactaccgaactcaacttttt

SEQ ID NO: 163480 - DNA, 75 bp, Artificial Sequence
  Synthetic
cttcctcagggaggccttgatgagccggcagaggaccagggctggcaaaggcaggtctttctcatcccgggtgaa

SEQ ID NO: 163481 - DNA, 75 bp, Artificial Sequence
  Synthetic
cctcgactaccgaactcaactttttgcgatgggagcgggagctcaggcgcagcggggggctcattgctatgctcg

SEQ ID NO: 163482 - DNA, 75 bp, Artificial Sequence
  Synthetic
agcggggggctcattgctatgctcgccgatgccgccgagaaggacctatttgacctttcatttagaacccgagac

SEQ ID NO: 163483 - DNA, 75 bp, Artificial Sequence
  Synthetic
cgtccggcggcgagggcgcgacccacgcctcgaccggggtcctcacaaacacagaatctgtagacttggctggcc

SEQ ID NO: 163484 - DNA, 75 bp, Artificial Sequence
  Synthetic
aaagtgtaacatttaatgtgggactgggaggccggggcgataccttgggcatcatgcagggtgcacagactagcg

SEQ ID NO: 163485 - DNA, 75 bp, Artificial Sequence
  Synthetic
gtcgccggggttcctggcgctccactgcacctggaatgcagggtgggggcgtggtcccctggaccccagccccgc

SEQ ID NO: 163486 - DNA, 75 bp, Artificial Sequence
  Synthetic
cgcagactcttgtccgccgcccgggtggaggatgagcagggcctcatcttccagcctctctttccagcacaggtg

SEQ ID NO: 163487 - DNA, 75 bp, Artificial Sequence
  Synthetic
atcatgcagggtgcacagactagcgaggataatctgggcagccagagccagccgggtccgtgcggctacatctac

SEQ ID NO: 163488 - DNA, 75 bp, Artificial Sequence
  Synthetic
gccggctgggggctggggtcccgggacgccccctccctgctcccacccggttccctcccccagggcgtgccccgc

SEQ ID NO: 163489 - DNA, 75 bp, Artificial Sequence
  Synthetic
acagttggacgtatacatcaggacaccgcgtggggatgttttcacctattccaccgagactcccgacgacccctc

SEQ ID NO: 163490 - DNA, 75 bp, Artificial Sequence
  Synthetic
cttgggtgagcgagtcaccctgacctcctactggaggagggtgagcctcggtccagagattgaggtcagctggtt

SEQ ID NO: 163491 - DNA, 75 bp, Artificial Sequence
  Synthetic
ccaccgagactcccgacgacccctctcccgtcccctttagggacatcctgcgaccggtcacttatgaagtagatc

SEQ ID NO: 163492 - DNA, 75 bp, Artificial Sequence
  Synthetic
tcccgtcccctttagggacatcctgcgaccggtcacttatgaagtagatctggtgtcgtccgacggggccaccgg

SEQ ID NO: 163493 - DNA, 75 bp, Artificial Sequence
  Synthetic
taaactgggcccaggagaggagcaggtgcttattgggcgcatgcaccacgatgtcatctttatagagtggccttt

SEQ ID NO: 163494 - DNA, 75 bp, Artificial Sequence
  Synthetic
ccgtggtggggacgcccgacggcaccgcgtcagcctgaaaattctcgagccggctgggggattcgagtcctggct

SEQ ID NO: 163495 - DNA, 75 bp, Artificial Sequence
  Synthetic
gcacaggcttggaaacacccattccaggtgtgcttctttttggtgaaataaaaacagcatcctttatatgaaaat

SEQ ID NO: 163496 - DNA, 75 bp, Artificial Sequence
  Synthetic
agctcccaacccctctgcaccgtgaagctgcgccacggacagatttaccacctggagtttgtctacaagttcctg

SEQ ID NO: 163497 - DNA, 75 bp, Artificial Sequence
  Synthetic
aacgaccactacgactactggtcgcggctcagggtggtgctgtgctacacagtggtgtttgcggtgcgaaactac

SEQ ID NO: 163498 - DNA, 75 bp, Artificial Sequence
  Synthetic
tctaacgctgtctgtccactccgaaaggtctcagttcccagacttctctgtccttactgtgacatgcaccgtgaa

SEQ ID NO: 163499 - DNA, 75 bp, Artificial Sequence
  Synthetic
ccacagaggcaccaagcccatcttctacctcctggaccccgaactctgcccggggggctcagatttccagcccta

SEQ ID NO: 163500 - DNA, 75 bp, Artificial Sequence
  Synthetic
aggtctcagttcccagacttctctgtccttactgtgacatgcaccgtgaatgcatttccccatccccacgtccag

SEQ ID NO: 163501 - DNA, 75 bp, Artificial Sequence
  Synthetic
agatttggggtaggcggagcctcaggagggtcccctccatagggttgaaccaggagggggaggatcgggctccgc

SEQ ID NO: 163502 - DNA, 75 bp, Artificial Sequence
  Synthetic
atccattatgtgggacgggcgaggccggccttctggcaccgggcgccacacagcgagggtctcctgctactggac

SEQ ID NO: 163503 - DNA, 75 bp, Artificial Sequence
  Synthetic
tgttatgaaggaaaaggatgggagcctctctgttgctgttgacctgtcacttcccaagccctggcacctgccagt

SEQ ID NO: 163504 - DNA, 75 bp, Artificial Sequence
  Synthetic
tgcccagggacacaggccccgaactcatgtgggccccaagccttcgcaactcactgcgcgtgtcccccgaagcgc

SEQ ID NO: 163505 - DNA, 75 bp, Artificial Sequence
  Synthetic
ctcacctgcttaaatgaaaccatggcaaccacttcaaagagagccgacaggaagatatttattaatattccatta

SEQ ID NO: 163506 - DNA, 75 bp, Artificial Sequence
  Synthetic
gaggagcttcttaggcctgctgccactcgtggtttagcagctaggtggaggcccctactggttagaaagatgcac

SEQ ID NO: 163507 - DNA, 75 bp, Artificial Sequence
  Synthetic
tcgagctggcagagcgggaggccgaaagggccaggtcggagcggtgggacaggtgtgcccaggtgctcaaaaata

SEQ ID NO: 163508 - DNA, 75 bp, Artificial Sequence
  Synthetic
tccgccgggttctcgggggtgtagtgggtgggcattgcatatttttgccgcggtgctgttgggccttggactcgg

SEQ ID NO: 163509 - DNA, 75 bp, Artificial Sequence
  Synthetic
accaccggacaccgcggagggccaaactccgcggtccttatccgttttctgcccgtttactgatagaatgttagc

SEQ ID NO: 163510 - DNA, 75 bp, Artificial Sequence
  Synthetic
ggtggatagcctcgcgactcgtgggaaaatgggcggaagggcaccgtgggaaaatagttccaggtgacagcagca

SEQ ID NO: 163511 - DNA, 75 bp, Artificial Sequence
  Synthetic
gcagcactagcgtcccggcgctcgtcgttcaggaacagcctccgccgcctgcggcccactgaaaaaccagacacg

SEQ ID NO: 163512 - DNA, 75 bp, Artificial Sequence
  Synthetic
ggtttggagaaaacgggggtgggcggtgatcagggagaacaattccccggggacacctgcacgagacccctgcgc

SEQ ID NO: 163513 - DNA, 75 bp, Artificial Sequence
  Synthetic
ggagtgggccatcaaaaggccgactgcctcgaactggcttttcagattgtccacggtccagggcacaaagtcctc

SEQ ID NO: 163514 - DNA, 75 bp, Artificial Sequence
  Synthetic
gcatttcaggccggttttgcagtcgctgctgcagctatggggtccctagaaatggtgccaatgggcgcgggtccc

SEQ ID NO: 163515 - DNA, 75 bp, Artificial Sequence
  Synthetic
ccctgaaagatgcctggacgctattccccctccacccggagcacgacgccgtcgttccacccaaggaggaaatac

SEQ ID NO: 163516 - DNA, 75 bp, Artificial Sequence
  Synthetic
aactgagacctttcggagtggacagacagcgttagaggcttcaccacgctcaggtgttcctgcttggtgacctcg

SEQ ID NO: 163517 - DNA, 75 bp, Artificial Sequence
  Synthetic
tgatagaatgctggcccgggctcctaaccacggtccaccccgccctcaagcgtccgggagccgggcggctcggct

SEQ ID NO: 163518 - DNA, 75 bp, Artificial Sequence
  Synthetic
atatccatctgcttctggctcttctgggaacacccccaccccaccgaacgatgaggaacgtgaatctaatgaaga

SEQ ID NO: 163519 - DNA, 75 bp, Artificial Sequence
  Synthetic
tgtctgcgtacgctttccaggagccagccgcggtgctcaaggtcttacggatgacagagtccggcaggaccacgg

SEQ ID NO: 163520 - DNA, 75 bp, Artificial Sequence
  Synthetic
gtctcgcccagtttcatgcggcacaggtagttgccgtcatgggagatgttggcagcggtgactactaaaaagaag

SEQ ID NO: 163521 - DNA, 75 bp, Artificial Sequence
  Synthetic
tgatggatccagcgagtgcaccctgattgagacccatgagggagtggtgtgcgcccttacaggcaactacatggg

SEQ ID NO: 163522 - DNA, 75 bp, Artificial Sequence
  Synthetic
gttaacggatcgtcataaggaatggcgacaggatgcgctcttaaccatggcttggccgctttgggtctcccggtg

SEQ ID NO: 163523 - DNA, 75 bp, Artificial Sequence
  Synthetic
gggaacacccccaccccaccgaacgatgaggaacgtgaatctaatgaagagcccccaccgccttatgaggaccca

SEQ ID NO: 163524 - DNA, 75 bp, Artificial Sequence
  Synthetic
gctccttggagggacaaagactcgtggtcggaatccgaggcggcgccgtggaagaaggaactcgtgaggcacccc

SEQ ID NO: 163525 - DNA, 75 bp, Artificial Sequence
  Synthetic
cttctcccccggcttggttagtctgttgattctgggttatgtcggagactgggaacagctgaggtgctgcataag

SEQ ID NO: 163526 - DNA, 75 bp, Artificial Sequence
  Synthetic
agatcaaagtctgtacttgggattgcaacacgacgggaatgacgggctccctccccctccctactctccacggga

SEQ ID NO: 163527 - DNA, 75 bp, Artificial Sequence
  Synthetic
tattggggcaatggcgaccgtcactcggactatcaaccactaggaacccaagatcaaagtctgtacttgggattg

SEQ ID NO: 163528 - DNA, 75 bp, Artificial Sequence
  Synthetic
ctccccttaacagggggtctcgcggggtgccaattgtcgcctgccttcccctgcttccccttgttaacttatagc

SEQ ID NO: 163529 - DNA, 75 bp, Artificial Sequence
  Synthetic
gaagcgggcagaggaaggtaagagtgccatctatctgtacttttatttattgcatcacaagtcacatcaataata

SEQ ID NO: 163530 - DNA, 75 bp, Artificial Sequence
  Synthetic
tgcatcacaagtcacatcaataataagggcgccatctagcgggagatgttatccacaccatcccaattcacatct

SEQ ID NO: 163531 - DNA, 75 bp, Artificial Sequence
  Synthetic
acgggtggaacacgtgccccctgagaccccactgaatgggattcccacagggggtgtcggaggccttcttctgga

SEQ ID NO: 163532 - DNA, 75 bp, Artificial Sequence
  Synthetic
agggcgccatctagcgggagatgttatccacaccatcccaattcacatctcagggacaacaggtcaaagttcttt

SEQ ID NO: 163533 - DNA, 75 bp, Artificial Sequence
  Synthetic
gctggtgtaactctgtcgcgaatctcccggggatcgagctcgctggcgtgagactgggcccagcgggagaagctc

SEQ ID NO: 163534 - DNA, 75 bp, Artificial Sequence
  Synthetic
ctccgcatcggggcggacgcctcctcccaacgcgtttctgcggatcagtcgctggctggtgggcatcggagtcgg

SEQ ID NO: 163535 - DNA, 75 bp, Artificial Sequence
  Synthetic
ccgggacgtactccacggtaggacgagctatagaattgataaatctgataaatgacctcttgcatggcctcttgt

SEQ ID NO: 163536 - DNA, 75 bp, Artificial Sequence
  Synthetic
tgggcggtcctccacggggacacgctccttcttggccttgttctttgaccttttggacattcttctgaaggaacg

SEQ ID NO: 163537 - DNA, 75 bp, Artificial Sequence
  Synthetic
catagctactacgctcaaacacgaatgccaagaacctcttcacgaggcctcggtaacccctggccacggcccggg

SEQ ID NO: 163538 - DNA, 75 bp, Artificial Sequence
  Synthetic
ttttctcaggaggccctaatgtataattaatcatgcatttgattttaaaaaagtaggttacactcattttaggcc

SEQ ID NO: 163539 - DNA, 75 bp, Artificial Sequence
  Synthetic
gcggagagtagcgtagaatccagccagtggtctacccggtcgcatggtggcttcttagatgaggagcaggcataa

SEQ ID NO: 163540 - DNA, 75 bp, Artificial Sequence
  Synthetic
gttggatttcaagagggtcaggtcctggggcaggcagtagctgatcatgaaccggctctgtcgaagcgagctcat

SEQ ID NO: 163541 - DNA, 75 bp, Artificial Sequence
  Synthetic
gaaaacgcggggaaaacagaccgcacaaccaaaaaataagctaggaaaaaggcgttgcaaaaggccacggctcca

SEQ ID NO: 163542 - DNA, 75 bp, Artificial Sequence
  Synthetic
ttctttggaagtgggcccgatggggtagtaggttttgggagggtgccgtgttagatatttcaactgccacagacc

SEQ ID NO: 163543 - DNA, 75 bp, Artificial Sequence
  Synthetic
cgtctgggtcctcggggcaggggtggctaggcctggtctccgtagaagagccgggcaggccgcaggcagaggact

SEQ ID NO: 163544 - DNA, 75 bp, Artificial Sequence
  Synthetic
gagttctatgataacaagtatgcagcccccgtgacagatatagctctcaagtgcgggctgcccaccgaagacttc

SEQ ID NO: 163545 - DNA, 75 bp, Artificial Sequence
  Synthetic
gccctgggtcgtcggcgcggcaccacggcagtctacggtacagaccttgcgtgggtcctgaagcactttagtgac

SEQ ID NO: 163546 - DNA, 75 bp, Artificial Sequence
  Synthetic
tattacctgtctctcttcgagggggccaaaagggctctgaccgacgggcatctgatcagagaggcctctggggtc

SEQ ID NO: 163547 - DNA, 75 bp, Artificial Sequence
  Synthetic
cacagctgttttcgtggacttttatacagtaaggacaaggaaagaaggccagaggaatgtggaaagatgagcgag

SEQ ID NO: 163548 - DNA, 75 bp, Artificial Sequence
  Synthetic
ggggagagggccaggcacagggccgtgcaccggctaatggtgggtaacctgccgactcggtgagtccacgatcct

SEQ ID NO: 163549 - DNA, 75 bp, Artificial Sequence
  Synthetic
atctgctggcatgagttaggtgtggcttgggctgaatccaaatgtgtattggcacaagatggaaagcaaagttgc

SEQ ID NO: 163550 - DNA, 75 bp, Artificial Sequence
  Synthetic
ggaccaaccttaaagtaccaacaaggtcactgcttttagtgtaaatgatgctacctaggcctgcgtcccactaag

SEQ ID NO: 163551 - DNA, 75 bp, Artificial Sequence
  Synthetic
gcaggccagccccagatccaggagcctggagaactcccgctccccaagggccggcaacgtcaggtccacctcaga

SEQ ID NO: 163552 - DNA, 75 bp, Artificial Sequence
  Synthetic
cgtcccccgcaacacctttatgacactgcttcagaccaacctggacaacaaaccgccgaggcagaccccgctacc

SEQ ID NO: 163553 - DNA, 75 bp, Artificial Sequence
  Synthetic
tggcagcccaccgccgcagagccgcagttggagcagtacacacggccgctggcatggcaggtcagcacatgcttc

SEQ ID NO: 163554 - DNA, 75 bp, Artificial Sequence
  Synthetic
ggcctatgttttcacataacagtttcaagcaggtctctgggatgtgaagggaggtgccctggagcaggagatgca

SEQ ID NO: 163555 - DNA, 75 bp, Artificial Sequence
  Synthetic
ggcatggcaggtcagcacatgcttctccttctggtcacggggataaaactggagagtgggtctaaaggaattgag

SEQ ID NO: 163556 - DNA, 75 bp, Artificial Sequence
  Synthetic
gcttttcagcctagacagacagtgtggctaagggagtgtgtgccagttaaggtgattagctaaggcattcccagt

SEQ ID NO: 163557 - DNA, 75 bp, Artificial Sequence
  Synthetic
ccaaagttcaagcagtaaccgcagtccatgcaaaacacggccaagggagggtaatccgggccagacaccggtctg

SEQ ID NO: 163558 - DNA, 75 bp, Artificial Sequence
  Synthetic
agtaaagaaaggttagtcatagtagcttagctgaactgggccgtgggggtcgtcatcatctccaccggaaccaga

SEQ ID NO: 163559 - DNA, 75 bp, Artificial Sequence
  Synthetic
aaccacatacacgtaatgtaagtttagccagtttattgttacaccaatgccccgaaagtctcccctgtccctttg

SEQ ID NO: 163560 - DNA, 75 bp, Artificial Sequence
  Synthetic
aaatttggtgggcctccatcatttccagcagagtcgctagggttatgaggcagcgggtcatgtgggccattgtca

SEQ ID NO: 163561 - DNA, 75 bp, Artificial Sequence
  Synthetic
tccaagagtgtgaatgagttacagcacacgctacaggccctgcgccgggagacgctgtcctacggccacaccgga

SEQ ID NO: 163562 - DNA, 75 bp, Artificial Sequence
  Synthetic
tatggtgcgatgtcgtgtggaggcaaccatggcggcacattgtcttccgtgtctaacagatggccggacaaggca

SEQ ID NO: 163563 - DNA, 75 bp, Artificial Sequence
  Synthetic
cggctcggcatgtactgcgtgcaggactcggccctggtcatggatctgctaaaccatttcgtgatccacgtggag

SEQ ID NO: 163564 - DNA, 75 bp, Artificial Sequence
  Synthetic
tttccactgccttggacttggttgacagcaggcacgcgggaagcacgccgctcacgtagctcctctgtccggcgt

SEQ ID NO: 163565 - DNA, 75 bp, Artificial Sequence
  Synthetic
cagtgttgtcagggtcctgtgggccattgtcaggaccacctccaggtgcgcctaggttttgagagcagagtgggg

SEQ ID NO: 163566 - DNA, 75 bp, Artificial Sequence
  Synthetic
tctacgcggagctgcaccggagtctgccggagttttctcccccagatcacggctgtctagacgcgtgggcctccc

SEQ ID NO: 163567 - DNA, 75 bp, Artificial Sequence
  Synthetic
ccctatctgacggtggatgccgacctgctctcgaacctgcggcagtcagcggccgaggggttgtttcatagcttt

SEQ ID NO: 163568 - DNA, 75 bp, Artificial Sequence
  Synthetic
catgactatgaccgccgcctccgtctgtcatcaaaggcgggccctggtcacctcctttgttttcaacctcttccg

SEQ ID NO: 163569 - DNA, 75 bp, Artificial Sequence
  Synthetic
gagaggcgggcatcaagtttgaggtgctactcggggtctacacgaacgccatccaatatgttcgcttcctggaga

SEQ ID NO: 163570 - DNA, 75 bp, Artificial Sequence
  Synthetic
cgccgtcggctgcatctccgccgcgcgtgtctctccctgtcaggagcagacagcaacaatcccccgcaatcccat

SEQ ID NO: 163571 - DNA, 75 bp, Artificial Sequence
  Synthetic
gagactgcatctgaactgaggcataaacagggcgtggcaggacgtgcaggccgacaggtagtccaccagggcctt

SEQ ID NO: 163572 - DNA, 75 bp, Artificial Sequence
  Synthetic
aaggccaaaagctgccagatggtggcaccaagtcgccagagaatctccaataagtagatccagagacctaagact

SEQ ID NO: 163573 - DNA, 75 bp, Artificial Sequence
  Synthetic
gagtgttgtcagggtcctgtgggccattgtcatcagtgttgtcagggtcctgtgggccattgtcaggaccacctc

SEQ ID NO: 163574 - DNA, 75 bp, Artificial Sequence
  Synthetic
cccacgccagtggccaatgcccctgcgacctatccctatgcgccccttgcggatgcagccaatcccatttaatca

SEQ ID NO: 163575 - DNA, 75 bp, Artificial Sequence
  Synthetic
acaattccaaggtacaatgcctgtccgtgcaaattccagagagcgatgagcaggagggtgactggggaaagagga

SEQ ID NO: 163576 - DNA, 75 bp, Artificial Sequence
  Synthetic
gggtaagtctgggaggcagagggtcggcctaggcccggggaagtggagggggatcgcccgggtctctgttggcag

SEQ ID NO: 163577 - DNA, 75 bp, Artificial Sequence
  Synthetic
agctgctttttgatttcaggagttagcctcagaaagtcttccaagccatcctttttaggcctcatggctagtagt

SEQ ID NO: 163578 - DNA, 75 bp, Artificial Sequence
  Synthetic
atagattcttcggtaccgcctctgccatttaccacgaaggaagcgcacctcggcttcccgagcgtatctttcttg

SEQ ID NO: 163579 - DNA, 75 bp, Artificial Sequence
  Synthetic
gacctagtggtcccctccggatccccctcctctctatccaccgccgctccggaacaggacctgcgttatagcctc

SEQ ID NO: 163580 - DNA, 75 bp, Artificial Sequence
  Synthetic
caaggcctagggaagaggagagggggggtcctcgagggggccgtcgcgggcccggtgggcccctctcaaggtcgt

SEQ ID NO: 163581 - DNA, 75 bp, Artificial Sequence
  Synthetic
tcctactgatgagtaagtattacaccctttgccccccaccccctttcccttacgcttccttctctaacgcacttt

SEQ ID NO: 163582 - DNA, 75 bp, Artificial Sequence
  Synthetic
ctgtcagccccaaccctgttaggcacgggagttaatgtgcgtagtgttgctgtacgatatcccatgggccaggat

SEQ ID NO: 163583 - DNA, 75 bp, Artificial Sequence
  Synthetic
accctgcccaatatctccatccagcagtgcaaggccggggacagaccgggggacctggtgcaaggccggggacag

SEQ ID NO: 163584 - DNA, 75 bp, Artificial Sequence
  Synthetic
ttcgtgccctctactgtttcttacgtgccccgcgcggggcggtgtcttggggttgtcccccgccacctgacccgg

SEQ ID NO: 163585 - DNA, 75 bp, Artificial Sequence
  Synthetic
ggggcagagcagtgtgagaggcttatgtagggcggctacgtcagagtaacgcgtgtttcttgggatgtagggccg

SEQ ID NO: 163586 - DNA, 75 bp, Artificial Sequence
  Synthetic
tatcgacggctgcggcggcggaggcggcggcagtcgcccccgaagtcgcggcccggaggctgctaatagatgaag

SEQ ID NO: 163587 - DNA, 75 bp, Artificial Sequence
  Synthetic
agcggcggtgtgtgtgtgcatgtaagcgtaaaaaggggaagtagaaagcgtgtgttagtgttagaaaagcgggtc

SEQ ID NO: 163588 - DNA, 75 bp, Artificial Sequence
  Synthetic
cggcggcctgagcctgctggacgggggtggcggatgacccgccaaggtgtgcatgagcaccagccccagccaccc

SEQ ID NO: 163589 - DNA, 75 bp, Artificial Sequence
  Synthetic
ggtgggcaagtgcaacaggaaatggaaaggcagtgcggcaatcagaagggggagtgcgtagtgttgtgggaagcg

SEQ ID NO: 163590 - DNA, 75 bp, Artificial Sequence
  Synthetic
aacaggaaagggacatgttggggctgggggacattgcagtttcttccccttcctcttctgaaacatcgaacgatg

SEQ ID NO: 163591 - DNA, 75 bp, Artificial Sequence
  Synthetic
ctgtggggtaaccgtaggggaggcgggtgaggcggctaagagggctaagggtcggcgggtgacgaagcagcagac

SEQ ID NO: 163592 - DNA, 75 bp, Artificial Sequence
  Synthetic
ggtggcggattcaggcgaaaagggtgtgggctgtgcgagtgtcatgaggcaggcgcggaaagtcgctgcggcttg

SEQ ID NO: 163593 - DNA, 75 bp, Artificial Sequence
  Synthetic
cgtggccgcaaatcaggaggtcacggatgccattaccctgcctgactgcgctgaatacatagacctactaaagca

SEQ ID NO: 163594 - DNA, 75 bp, Artificial Sequence
  Synthetic
ctggggccatgggccgcgcattcctggaaaaagtggagggggcgtggcctgccccccgcggccccctagcccccc

SEQ ID NO: 163595 - DNA, 75 bp, Artificial Sequence
  Synthetic
cccaaagtcaagggaaaggaagggggcccttagcatgggaggcgcggcgacgagcaggatagcaggacggggggg

SEQ ID NO: 163596 - DNA, 75 bp, Artificial Sequence
  Synthetic
gggcggcggggggtcggggtccgcgggctccgggggctgcgggcggtggatggcggctggcgttcaggggaacgg

SEQ ID NO: 163597 - DNA, 75 bp, Artificial Sequence
  Synthetic
gtgctttgttaatctttagtgggaactagtgggagtgctgtgcctagggtacccctatcctagaggtcctaccgg

SEQ ID NO: 163598 - DNA, 75 bp, Artificial Sequence
  Synthetic
tagagtgtggagacaatgtgtaaacgatgggctttgaggggggctgttgtggtgctggttggggaaggagctcca

SEQ ID NO: 163599 - DNA, 75 bp, Artificial Sequence
  Synthetic
agggccccagggctgaccccggcaaacgtgacccggggctccggggtgacccagccaagcgtgaccaaggggccg

SEQ ID NO: 163600 - DNA, 75 bp, Artificial Sequence
  Synthetic
tgcctttgtgaacagcttttccatgatcaagttcatctgccgtcacctgggaaataacgccatctccaaggaggc

SEQ ID NO: 163601 - DNA, 75 bp, Artificial Sequence
  Synthetic
ggggcctgggagagtgatgggggcggccaatcccggggtaactgtcacgtcccggggggaggaggtaggagacag

SEQ ID NO: 163602 - DNA, 75 bp, Artificial Sequence
  Synthetic
ccagtgtcctgatcctggaccttgactatgaaacaattctaaaaaaatgcatcatagtccagtgtccagggacag

SEQ ID NO: 163603 - DNA, 75 bp, Artificial Sequence
  Synthetic
agggggcagggtcgcagggggtgtgtctggtgggggcgggagcggggggcggcgcgggagcctgcacgccgttgg

SEQ ID NO: 163604 - DNA, 75 bp, Artificial Sequence
  Synthetic
ttaactcccgtgcctaacagggttggggctgacagcatcatgttaactgccacatttggatgccaaaatgcggca

SEQ ID NO: 163605 - DNA, 75 bp, Artificial Sequence
  Synthetic
gtcattgctcggattgtggcagccgatagcaccctagatctagtgaatcatggcgagcccggaagagaggctcct

SEQ ID NO: 163606 - DNA, 75 bp, Artificial Sequence
  Synthetic
gtggcgcgccaagaataacgccatgctccccccgccaccgtctcccgggtctcagggggcacgtgttccacccgt

SEQ ID NO: 163607 - DNA, 75 bp, Artificial Sequence
  Synthetic
tcggtgcgagccccgcccttcacaccccagtccaggtccagatgtgcctactaccagagctacgcgacacgttac

SEQ ID NO: 163608 - DNA, 75 bp, Artificial Sequence
  Synthetic
gttccccgcgcggcgcgcccctgcccggcagtcttgagcgtggcgtggagggtggtgaggaaggtcttgacctcg

SEQ ID NO: 163609 - DNA, 75 bp, Artificial Sequence
  Synthetic
tcccagggcggagggactcgaggtcccccgcgaaaccccgtcttcctacggcaccgttaccggccgggccctgag

SEQ ID NO: 163610 - DNA, 75 bp, Artificial Sequence
  Synthetic
ccccgcgaaaccccgtcttcctacggcaccgttaccggccgggccctgagaaatcttatgccttatggcactccc

SEQ ID NO: 163611 - DNA, 75 bp, Artificial Sequence
  Synthetic
ttaccagatggagtgcaccacagccaactccatggttatgtacaataacaaaatatgtacagaaccaaagaggtg

SEQ ID NO: 163612 - DNA, 75 bp, Artificial Sequence
  Synthetic
attaccggtcctaagaggggctccggtgacaccatccccgtctccgtttttgaggcggccgtggcggcggccttc

SEQ ID NO: 163613 - DNA, 75 bp, Artificial Sequence
  Synthetic
ccagccaagcgtgaccaaggggcccctggtgactcaggcacagctgacaaagaaggccccccaggaaagaccccc

SEQ ID NO: 163614 - DNA, 75 bp, Artificial Sequence
  Synthetic
acaccaaaacaaattcacacttgagtctccaaaggacccgggatcacggaggtttacatggaaaaaaggtgccaa

SEQ ID NO: 163615 - DNA, 75 bp, Artificial Sequence
  Synthetic
gagggggcgtggccttcccccgcggccccccagcccccccgcacagagcggcgctacggcgggcgggcggcgggg

SEQ ID NO: 163616 - DNA, 75 bp, Artificial Sequence
  Synthetic
cggccccgaaatagggccttgccatcaatcgggggcctgggagagtgatgggggcggccaatcccggggtaactg

SEQ ID NO: 163617 - DNA, 75 bp, Artificial Sequence
  Synthetic
caaaggccccccaggaaagacccccggggggcatcggggggtgttggtggggccatggggggtcggatttcgccc

SEQ ID NO: 163618 - DNA, 75 bp, Artificial Sequence
  Synthetic
ggagctgtcgctccctcataaacatacgtacgacgggaggcgccattatacgaggccgggcggaaggaggcgtcg

SEQ ID NO: 163619 - DNA, 75 bp, Artificial Sequence
  Synthetic
tttaattctcttctgtttgcattgctggccgcagctggcggactacaaggcatttacggttagtgtgcctctgtt

SEQ ID NO: 163620 - DNA, 75 bp, Artificial Sequence
  Synthetic
ctgaccccggcaaacgtgacccggggctccggggtgacccagccaagcgtgaccaaggggcccgtgggtgacaca

SEQ ID NO: 163621 - DNA, 75 bp, Artificial Sequence
  Synthetic
gctcagcagcttgtctcgtgtgaggtcaaatcgtaggctgaggtagcacggtgagaagagcccgctctccgtccc

SEQ ID NO: 163622 - DNA, 75 bp, Artificial Sequence
  Synthetic
tctatcagaataacaggggaagcaaggccccctgcttcagcgggacacgtgtttctagaatctcggagccaataa

SEQ ID NO: 163623 - DNA, 75 bp, Artificial Sequence
  Synthetic
tgtgtacttgtcctcatcgtcgacgctgttttgcagctgagtcccctccttggagctgtaactgtggtttccatg

SEQ ID NO: 163624 - DNA, 75 bp, Artificial Sequence
  Synthetic
caagagaggaggagaagaaccctggccagtgtagcttccgcccgcctcagcgccgccgccgccgactcctactgg

SEQ ID NO: 163625 - DNA, 75 bp, Artificial Sequence
  Synthetic
gacacctggcccgacgtggagtccaacgccggggagctgcttcgggaatacgtctctgcgcccaaagccctgtgg

SEQ ID NO: 163626 - DNA, 75 bp, Artificial Sequence
  Synthetic
aggaggggcaggaggggcaggaggggcaggagcaggaggaggggcaggagcaggaggaggggcaggaggggcagg

SEQ ID NO: 163627 - DNA, 75 bp, Artificial Sequence
  Synthetic
gtctcagggcatgcttcacgcgaaaggcactccagaatccctccttaggatgccacaataaagggccacactgct

SEQ ID NO: 163628 - DNA, 75 bp, Artificial Sequence
  Synthetic
ggtaacattcatgtaggttttaggaggtccggctatctgaggcacgtacacagctgacacggcggttgtggccgt

SEQ ID NO: 163629 - DNA, 75 bp, Artificial Sequence
  Synthetic
gtgagtctggggatgtccctgggcgttgctgcagcccattcgccctctggggatgagatgttcaggggtggccgg

SEQ ID NO: 163630 - DNA, 75 bp, Artificial Sequence
  Synthetic
acggccccagggcaaacgtgacgcggggctccggggtgaccagggctgaccccggcaaacgtgacccggggctcc

SEQ ID NO: 163631 - DNA, 75 bp, Artificial Sequence
  Synthetic
cagggttgctgaggccggggtccagggggacccgagggccttagaggcccaggcgtctggcacatgtgtccagaa

SEQ ID NO: 163632 - DNA, 75 bp, Artificial Sequence
  Synthetic
ttttggttgtgcggtctgttttccccgcgttttccgatagaatagctgcctggatctgcgcccggtcccctttct

SEQ ID NO: 163633 - DNA, 75 bp, Artificial Sequence
  Synthetic
taggggccaacacccttggtttgtttgtgttcctgtttgctggcaacttactggcagccgagcagattctaatgg

SEQ ID NO: 163634 - DNA, 75 bp, Artificial Sequence
  Synthetic
tttcctgaccctcctgaggcacatccgccgacgtctgggcctgggccgtgcttccgtaaaacgagagattaccct

SEQ ID NO: 163635 - DNA, 75 bp, Artificial Sequence
  Synthetic
acatgccaaaaacatcatgccgccacaaacagtcaaacggcgccatctccttctgtatgctagtatcaggagcac

SEQ ID NO: 163636 - DNA, 75 bp, Artificial Sequence
  Synthetic
aagaattatatacataagattctttgaagttttcattggaattattttgagagaaatttcaattttaattttaaa

SEQ ID NO: 163637 - DNA, 75 bp, Artificial Sequence
  Synthetic
tcatcgctgggctggtactaccagaccgccaccggccccggagcagatgccagggcggcggcccggcgccaacag

SEQ ID NO: 163638 - DNA, 75 bp, Artificial Sequence
  Synthetic
ccagcaatgcaaacagaatagaattaaaaggtgggtcttcaatcctccatgttagccaaattgcaaagactgagg

SEQ ID NO: 163639 - DNA, 75 bp, Artificial Sequence
  Synthetic
gacggtcccgagcttctcccgctgggcccagtctcacgccagcgagctcgatccccgggagattcgcgacagagt

SEQ ID NO: 163640 - DNA, 75 bp, Artificial Sequence
  Synthetic
ccgctgggtgacacaggcaaccctgacaaaggccccccaggaaagacccccggggggcatcggggggtgttggag

SEQ ID NO: 163641 - DNA, 75 bp, Artificial Sequence
  Synthetic
acaaaggccccccaggaaagacccccggggggcatcggggggtgttggagagggcatgggggggtcggatttcgc

SEQ ID NO: 163642 - DNA, 75 bp, Artificial Sequence
  Synthetic
ccatcagcggggtcacggacgtggtggaggagttcataacggatgcctccaacaacctggtggaccgcaaccgtc

SEQ ID NO: 163643 - DNA, 75 bp, Artificial Sequence
  Synthetic
acacggaaaccacaacagccagaatcggtaacgaggggctcaaggaggggcggcagcggacggtggggctcaagg

SEQ ID NO: 163644 - DNA, 75 bp, Artificial Sequence
  Synthetic
gtggactttgccagcctctacccgagcatcattcaggctcataatctctgttattctaccatgataacgccggga

SEQ ID NO: 163645 - DNA, 75 bp, Artificial Sequence
  Synthetic
gggagcctggacaggggctttgggcggggaggggagcaggctccggagttcatcgtcgggggcttcgtcgcgtga

SEQ ID NO: 163646 - DNA, 75 bp, Artificial Sequence
  Synthetic
catatgccgctgcacaaaggaaactgctgacaccggtgacagttcttactgcggttgtcacttgtgagtacacac

SEQ ID NO: 163647 - DNA, 75 bp, Artificial Sequence
  Synthetic
gaatcacacggagggcctgttgatggtgtttaaagacaacattattccctactcgtttaaggtccgctcctacac

SEQ ID NO: 163648 - DNA, 75 bp, Artificial Sequence
  Synthetic
gaagagcacaggctagccggcctgcgcccgggagaagactatgagtccttcaggctcacggggggcgtctaccac

SEQ ID NO: 163649 - DNA, 75 bp, Artificial Sequence
  Synthetic
ccggcgctgccccggatgttgctggggttctcgagggctgggtggtgcttgggcacagaggtctcagcagccgcc

SEQ ID NO: 163650 - DNA, 75 bp, Artificial Sequence
  Synthetic
tttgcccccgaggacattgtgaaggtatgtgccggtctaacaacaatcacgacagtatgtcatcaaagccacacc

SEQ ID NO: 163651 - DNA, 75 bp, Artificial Sequence
  Synthetic
tcccttcctttaactcattacttgttcttttgtaatcgcagctctaacttggcatctcttttacagtggttctcc

SEQ ID NO: 163652 - DNA, 75 bp, Artificial Sequence
  Synthetic
acagtcttttgtgagtaaatagagatgatgacatggatgtagagactgaggaccacatccaccaccttctcggag

SEQ ID NO: 163653 - DNA, 75 bp, Artificial Sequence
  Synthetic
aatgcacccatctcctgcttccagggtatggaattatcacctggctttaattgtcatgtatgcttctatgtagtt

SEQ ID NO: 163654 - DNA, 75 bp, Artificial Sequence
  Synthetic
gttcctcggtggcgggcttaaagccttcggcctccaggcgccaggcctgcacctccttctgtctgagctgatcgt

SEQ ID NO: 163655 - DNA, 75 bp, Artificial Sequence
  Synthetic
tccacagctttactcttgttctcacacggcaggaacctgtggcacctgcgcaggcggagccgtagggtctttaga

SEQ ID NO: 163656 - DNA, 75 bp, Artificial Sequence
  Synthetic
ctttggcttcagggtcctggttttcagcctgtggcatgacttcctccaggtagaattggatcatttctgacaggg

SEQ ID NO: 163657 - DNA, 75 bp, Artificial Sequence
  Synthetic
ggcctagcaatgtcacagctaaatgcccaccggggcacacactcaagcggggtctcggagctcccaggtcagacc

SEQ ID NO: 163658 - DNA, 75 bp, Artificial Sequence
  Synthetic
cggacgggccgggctctcgtgccccagccggccggggcacctccgggctctcccggcagggctccgggggcaggc

SEQ ID NO: 163659 - DNA, 75 bp, Artificial Sequence
  Synthetic
tccaccccggccaggtccaggagggtgcaaatattctccaggcgctgcacctcagagacctcctgctcaaagagg

SEQ ID NO: 163660 - DNA, 75 bp, Artificial Sequence
  Synthetic
ctggggcggcgatgtcggggctgctggcggcggcgtacagccaggtgtacgccctggcggttgagctgagcgtgt

SEQ ID NO: 163661 - DNA, 75 bp, Artificial Sequence
  Synthetic
gccctggcggttgagctgagcgtgtgcgcccggctggaccccaggagtctggacgtggctgcggtggtgcgcaac

SEQ ID NO: 163662 - DNA, 75 bp, Artificial Sequence
  Synthetic
cagccctccgcagccgctgaagccaggctcgcggaagagcccaaaacctgtttcggcgccgcccgggggccagtc

SEQ ID NO: 163663 - DNA, 75 bp, Artificial Sequence
  Synthetic
cacgggccgccgaggggcaggctgcggccgccaaggggggcaaattgcgtgtctggggccgcctgagcccatcct

SEQ ID NO: 163664 - DNA, 75 bp, Artificial Sequence
  Synthetic
agccgggttccgcggcctccattctctccgccgcaccaccatcgtccacgagcagggatcgcagtctctccctcc

SEQ ID NO: 163665 - DNA, 75 bp, Artificial Sequence
  Synthetic
gcatgtatagagttacggttcactacatcaaacaggacagccgttgccctagtggtttcggacacaccgccaacg

SEQ ID NO: 163666 - DNA, 75 bp, Artificial Sequence
  Synthetic
cctgaccgacctgctctcgggcggagatcaggaggggggagaaggaggaggagaacccgaggataattccatcta

SEQ ID NO: 163667 - DNA, 75 bp, Artificial Sequence
  Synthetic
caggggcccgcacgtggacgtccccttggtcctggacgacgagagctggaagcgcctcctatccctggcggaggc

SEQ ID NO: 163668 - DNA, 75 bp, Artificial Sequence
  Synthetic
cgagcctctccctcgcggagaggggcctctttgggccctcaagtccagccccaccgagacccgagtggcccggat

SEQ ID NO: 163669 - DNA, 75 bp, Artificial Sequence
  Synthetic
aggtcagcggccgcgtgcaggagaacccgggtgacggcggtgtagaggcccccgagtgcccgtcgcgtgtctgag

SEQ ID NO: 163670 - DNA, 75 bp, Artificial Sequence
  Synthetic
tccgctttttggcgctgttgacagcgatagagtatggggcccctcccgccgcctcagtgcccccctttgtccaca

SEQ ID NO: 163671 - DNA, 75 bp, Artificial Sequence
  Synthetic
gactcacgacagggcggaccctaacagggtcatcgtcctgggcctggaacacttcttcctcaaggacctaacagg

SEQ ID NO: 163672 - DNA, 75 bp, Artificial Sequence
  Synthetic
gccagcaccccggcctctttcccttcgttagtgcaatagcatcatcgctgggctggtactaccagaccgccaccg

SEQ ID NO: 163673 - DNA, 75 bp, Artificial Sequence
  Synthetic
cggcggcctccgattatctctcctaccttgaggacccaagcctcccaacggtgatggattttgacgacctcctga

SEQ ID NO: 163674 - DNA, 75 bp, Artificial Sequence
  Synthetic
gtgatggattttgacgacctcctgacacacctgcggcacacatgccagatcatcgcctccctgcctctcctaaac

SEQ ID NO: 163675 - DNA, 75 bp, Artificial Sequence
  Synthetic
cacacctgtcccaccgctccgacctggccctttcggcctcccgctctgccagctcgagcgcttcgggggacacgc

SEQ ID NO: 163676 - DNA, 75 bp, Artificial Sequence
  Synthetic
ggtttcaggtgacgcccccagaataaaatttgaacggggggttcagtggtggcattgtgctatgacaccaatata

SEQ ID NO: 163677 - DNA, 75 bp, Artificial Sequence
  Synthetic
atgaggatagcatatactacccggatatagaataggatagcatatgctacccggatatagattaggatagcatat

SEQ ID NO: 163678 - DNA, 75 bp, Artificial Sequence
  Synthetic
gctacccagatatagattaggatagcatatgctacccacatagagattaggatagcatgtactacccggatatag

SEQ ID NO: 163679 - DNA, 75 bp, Artificial Sequence
  Synthetic
cccctgccatcagctaccccggctcctcctcctgctcagcagatcccaccatcagccacgacactcgaaccagaa

SEQ ID NO: 163680 - DNA, 75 bp, Artificial Sequence
  Synthetic
catatgctatccagatagagattaggatagcatatgctaccctaatctctatttgggtagcatatgctacccaga

SEQ ID NO: 163681 - DNA, 75 bp, Artificial Sequence
  Synthetic
tccgactctgaagaagcggagagcgacttagcctccgatatccccaccacagaggatgaagacatgttcgaagat

SEQ ID NO: 163682 - DNA, 75 bp, Artificial Sequence
  Synthetic
acccggatatagattaggatagcatatactacccagacagagattaggatagcatatgctacccacatagagatt

SEQ ID NO: 163683 - DNA, 75 bp, Artificial Sequence
  Synthetic
cgggatccagtgcccccacgtcccccatcacactggacaccgccaggagccaatactatcagaccacctttgaca

SEQ ID NO: 163684 - DNA, 75 bp, Artificial Sequence
  Synthetic
acaccagatctacttcataagtgaccggtcgcaggatgtccctaaaggggacgggagaggggtcgtcgggagtct

SEQ ID NO: 163685 - DNA, 75 bp, Artificial Sequence
  Synthetic
gctgggagaccttgcgcgggcctggtgcctggagcagaagaggcagaacatggtgctgagagaactaaccaagat

SEQ ID NO: 163686 - DNA, 75 bp, Artificial Sequence
  Synthetic
ccatagcggacggccacatccaggcattgcctgaaataggccctgaggtcattatatatgtttaacagggagcag

SEQ ID NO: 163687 - DNA, 75 bp, Artificial Sequence
  Synthetic
tattccaccgtgctctcagcgacctcgtgaatatgaggaccaacaaccctgtgcttggcgctcaggcgcaagtgt

SEQ ID NO: 163688 - DNA, 75 bp, Artificial Sequence
  Synthetic
cgtgaatatgaggaccaacaaccctgtgcttggcgctcaggcgcaagtgtgtgtaacttgtcctccagatcgcag

SEQ ID NO: 163689 - DNA, 75 bp, Artificial Sequence
  Synthetic
taaaggactggtcgggacatctgcaggtccccacgctggacctggagcaactgctcacttccgaacttaacatcc

SEQ ID NO: 163690 - DNA, 75 bp, Artificial Sequence
  Synthetic
gcggggtctttccgaaggagccctggccttagctgggggcgcaggtgcctggctgaacctagccgctgcgtctga

SEQ ID NO: 163691 - DNA, 75 bp, Artificial Sequence
  Synthetic
aaaacctcgcaaacatgctatcagaaaacaagggaagagcgggagagttccatgagcacctggccgcaaagctgg

SEQ ID NO: 163692 - DNA, 75 bp, Artificial Sequence
  Synthetic
ggtagggatggggattctcgggacccctcctcttcctcttcaaggtcaccagacagagatgctactggggcaacg

SEQ ID NO: 163693 - DNA, 75 bp, Artificial Sequence
  Synthetic
aaacaagggaagagcgggagagttccatgagcacctggccgcaaagctggaggcctgcctgccgtccctggccac

SEQ ID NO: 163694 - DNA, 75 bp, Artificial Sequence
  Synthetic
agacagagatgctactggggcaacggaagaagagctgggtgaggcctgtgaggatccagtgaccccgcggtgctt

SEQ ID NO: 163695 - DNA, 75 bp, Artificial Sequence
  Synthetic
gaccccaagcgggtcgcggggggcaaggagaccgtcgcagactggaaaaggcgcctctcccgactggaggccatc

SEQ ID NO: 163696 - DNA, 75 bp, Artificial Sequence
  Synthetic
tatcatggccaggacagcgcctgccttgtctctggcgtgtgccatcgcgtctggacgcagaaggcctcccggcct

SEQ ID NO: 163697 - DNA, 75 bp, Artificial Sequence
  Synthetic
agacaaccagtggagtccgctgctgtcggcgtccactctccttccccttgttacaaatagagtgtaacaacatgg

SEQ ID NO: 163698 - DNA, 75 bp, Artificial Sequence
  Synthetic
ccaaatctatatctgggtagcatatgctccccaaatctatatctgggtagcatatgctccccaaatctatatctg

SEQ ID NO: 163699 - DNA, 75 bp, Artificial Sequence
  Synthetic
cctatcgtccctgctcccccaggcaatgcagcggcgcaagcctgccgtggcgtcagctggcatgccgggcgccta

SEQ ID NO: 163700 - DNA, 75 bp, Artificial Sequence
  Synthetic
gctatcctaatctatatttgggtagcatatgctatccaaatctctatctaggtagcatatgctatcctaatctat

SEQ ID NO: 163701 - DNA, 75 bp, Artificial Sequence
  Synthetic
gatacccagtagtagagtgggagtgctatcctttgcatatgccgccacctcccaagggggcgtgaattttcgctg

SEQ ID NO: 163702 - DNA, 75 bp, Artificial Sequence
  Synthetic
tggggcaatggagccgcgacccggcgggcacaatttctggcggcggcagggccggcgaaatacgccggcaccctc

SEQ ID NO: 163703 - DNA, 75 bp, Artificial Sequence
  Synthetic
cgaaggagaatgaagaagcaggcgaagattcaggagagttcactgcccgctccttgatcttcagccactgccctt

SEQ ID NO: 163704 - DNA, 75 bp, Artificial Sequence
  Synthetic
ctccttcagtcactccatctcctcgcctccctttgcaaatacccatccctctgccacaggcagctccctcgaacc

SEQ ID NO: 163705 - DNA, 75 bp, Artificial Sequence
  Synthetic
taacaaggtccttaatcgcatccttcaaaacctcagcaaatatatgagtttgtagggcggagctgcttcgcttca

SEQ ID NO: 163706 - DNA, 75 bp, Artificial Sequence
  Synthetic
ctgccacaggcagctccctcgaacccaaaaatccctctgaccaccccatccccttccccgactgcagcagcagcc

SEQ ID NO: 163707 - DNA, 75 bp, Artificial Sequence
  Synthetic
ctccaactcagcagcagcccccgcaatcagccgccccggctccttctccacttcttcctcagcagcagcccacgc

SEQ ID NO: 163708 - DNA, 75 bp, Artificial Sequence
  Synthetic
ggctcccctcactgtcactggcctccctccacccagacataccccaaaccacctattcatccggcaccttgcgtg

SEQ ID NO: 163709 - DNA, 75 bp, Artificial Sequence
  Synthetic
aggctcagctagggtctctgcctctccatcatagacatcttccttgaatctcattctctcaccgcatacctcact

SEQ ID NO: 163710 - DNA, 75 bp, Artificial Sequence
  Synthetic
tcatcgcctctaggaatcaccccccttatccagccccggccacagacctggaagttattctattggaacaacggg

SEQ ID NO: 163711 - DNA, 75 bp, Artificial Sequence
  Synthetic
tacagctgccgccgcgccatcccccgcctccagcaccgggactcgtacgccgagctcgagtacgactgtgaggtg

SEQ ID NO: 163712 - DNA, 75 bp, Artificial Sequence
  Synthetic
ccaccctctgcccctcacgaagctcatagctaaggcaatcgatgctggatttctgagaattcacgggctcctcct

SEQ ID NO: 163713 - DNA, 75 bp, Artificial Sequence
  Synthetic
cttcatgcggcacaactttggcttctactgcggcatgttcatcgcctccatcatcctgatcctgcccttggtcag

SEQ ID NO: 163714 - DNA, 75 bp, Artificial Sequence
  Synthetic
ggttgatttctgagaaaccgcgtggagactctgaggcaggacaggggtgtggccaatatcccagccgagtcgtat

SEQ ID NO: 163715 - DNA, 75 bp, Artificial Sequence
  Synthetic
agctttcccagcctccgcttgttaggtcctagttatgggttttccatgggggacttagtatccgttctattagat

SEQ ID NO: 163716 - DNA, 75 bp, Artificial Sequence
  Synthetic
tctatctgtgccctgggtcgtcggcgcggcaccacggcagtctacggtacagaccttgcgtgggtcctgaagcac

SEQ ID NO: 163717 - DNA, 75 bp, Artificial Sequence
  Synthetic
gacagcgaggaggagatcttcccctaatgcaataaaaacttaaaacactgaggttactttcccgtcattctttcg

SEQ ID NO: 163718 - DNA, 75 bp, Artificial Sequence
  Synthetic
cgccaacctccgtaaccccggagtcttctcgaggcaggtgtttacccatttgtttaaacgagccatctctcattg

SEQ ID NO: 163719 - DNA, 75 bp, Artificial Sequence
  Synthetic
aataaggccccggtcaccccgtgattgtcttacaatataattagccatccaaagcattcgcatagcagatgctag

SEQ ID NO: 163720 - DNA, 75 bp, Artificial Sequence
  Synthetic
aggtccatgcccgacgtcatatcctagcggatccctatcaagaggtgatggctcttgtgtccaggcatccctgcg

SEQ ID NO: 163721 - DNA, 75 bp, Artificial Sequence
  Synthetic
ctcggagctgctgaccgaggccgaggcggccgaggtccgggcgctagaagagcaggtccgggagagccagaccct

SEQ ID NO: 163722 - DNA, 75 bp, Artificial Sequence
  Synthetic
cacagccgctccgtgctctcctatgagcgttatgtggactggatctgcgccaccggcatggtgcccgccgttaag

SEQ ID NO: 163723 - DNA, 75 bp, Artificial Sequence
  Synthetic
gtctcaaccttctgggctcgggccgcggtgtcgatatccgatggcctttccctctcttcctcgtatgctccttct

SEQ ID NO: 163724 - DNA, 75 bp, Artificial Sequence
  Synthetic
gagaggaccatcaggagtatcgggacggaattatatgaggcaacgagggaaataatagagtcgctcaactccacg

SEQ ID NO: 163725 - DNA, 75 bp, Artificial Sequence
  Synthetic
attggactctaacttcacggtggcatgctctcgtccaaacaccgggggcataacactgaggctcccggtcccatg

SEQ ID NO: 163726 - DNA, 75 bp, Artificial Sequence
  Synthetic
gaggaggaaaaggagaatggggaggagtccaaaacggcacccccccccgccattccgcatcctccccgccaaaaa

SEQ ID NO: 163727 - DNA, 75 bp, Artificial Sequence
  Synthetic
ttgatagaatgtcggtaccacgccacggggggcgggcccgcatagggaaaagccagggagagcgatgtgggcgag

SEQ ID NO: 163728 - DNA, 75 bp, Artificial Sequence
  Synthetic
actcgcggccattctcctgggtaacggcaggaacgcgagcaagcgccgggccagccgggacctgtcaccaccgcc

SEQ ID NO: 163729 - DNA, 75 bp, Artificial Sequence
  Synthetic
ccagccgggacctgtcaccaccgccccacggcaggtggcgtgccgttttggactcctccccattctccttttcct

SEQ ID NO: 163730 - DNA, 75 bp, Artificial Sequence
  Synthetic
tctattcgccactagagaccgccaaaatgcgaaactacaggcccgggcccaggccttgcagggcagacggttagg

SEQ ID NO: 163731 - DNA, 75 bp, Artificial Sequence
  Synthetic
aatgcgaaactacaggcccgggcccaggccttgcagggcagacggttaggctgacaagtggacaagtgtggcagg

SEQ ID NO: 163732 - DNA, 75 bp, Artificial Sequence
  Synthetic
gtcccgggcccggggcggccggaggcagagggggcgaccagagcgctggacacctacaacgtcttctcgacagtg

SEQ ID NO: 163733 - DNA, 75 bp, Artificial Sequence
  Synthetic
agctcctctattggaactctggcggccatgctatcggtgcaacggggcagggggagggtggcggacattcccgcc

SEQ ID NO: 163734 - DNA, 75 bp, Artificial Sequence
  Synthetic
aggcgttgggggccagaatcagaggtgatctctggacattaacttccacgccaggggcgggtggattatctgttg

SEQ ID NO: 163735 - DNA, 75 bp, Artificial Sequence
  Synthetic
cttcggtcaagtaccagctggtggtccgcatgttttgatccaaacttttgttttaggatttatgcatccattatc

SEQ ID NO: 163736 - DNA, 75 bp, Artificial Sequence
  Synthetic
gagcgggcgggagcacagcctccaagctgcccccgtcaagcgcgagatgtcctccgagagggtctcacccgagac

SEQ ID NO: 163737 - DNA, 75 bp, Artificial Sequence
  Synthetic
caccaattccaaccatttttaaacctcctggaattctatcattaaacggcatgcaggaaaaggacaagcagcgaa

SEQ ID NO: 163738 - DNA, 75 bp, Artificial Sequence
  Synthetic
gtggcgcaccttaaggtagggtaggggggtaccccagtaggaacctagctgaatcctacctagctccacccacct

SEQ ID NO: 163739 - DNA, 75 bp, Artificial Sequence
  Synthetic
ggatgctgcagaggttcagggacttgtcctctatagtctcataccccaacagtcttcaggtctgacaccatgtgt

SEQ ID NO: 163740 - DNA, 75 bp, Artificial Sequence
  Synthetic
atatgctatcctcatatatattaggatagcatatgctatcctcatatatattaggatagcatatgctatcctcat

SEQ ID NO: 163741 - DNA, 75 bp, Artificial Sequence
  Synthetic
ccggccccggctccggccctcccctgtaagccccccctactccccggcgagcaggggagaaggcagtggacggcg

SEQ ID NO: 163742 - DNA, 75 bp, Artificial Sequence
  Synthetic
gtggcctctggtgtaagaggagttgccagtctcctccttctcgtcctctggtgtaagaggagttgccagtctcct

SEQ ID NO: 163743 - DNA, 75 bp, Artificial Sequence
  Synthetic
atatattaggatagcatatgctatcctgatagagattaggatagcatatgctacccagatatagattaggatagc

SEQ ID NO: 163744 - DNA, 75 bp, Artificial Sequence
  Synthetic
ccgggcccgccgtcctctcgagctcatatacgccaccgtctgggagatctatgacggggcccctccgatgcctgg

SEQ ID NO: 163745 - DNA, 75 bp, Artificial Sequence
  Synthetic
gtgggccgtgaggcccggaagaccgaccagggtcttgtactgggccaggggatcgaggaagacctcgcactccac

SEQ ID NO: 163746 - DNA, 75 bp, Artificial Sequence
  Synthetic
gcagctgtgacaatcttcacacactgctgctgtcacctggaactattttcccacggtgcccttccgcccattttc

SEQ ID NO: 163747 - DNA, 75 bp, Artificial Sequence
  Synthetic
catcatggcgtagtcccccgccacggtctcgtggcggtagagatcctgggcgtgtacgcggaggccagcggggga

SEQ ID NO: 163748 - DNA, 75 bp, Artificial Sequence
  Synthetic
ctcggccccaggcgcccccatctctcccgcctctccctctgcgacacccgccaaccacgacaaccccgaagccac

SEQ ID NO: 163749 - DNA, 75 bp, Artificial Sequence
  Synthetic
gaaatatgagcaagaataaggacggctccttattaacctgatcagccccggagttgcctgtttcatcactaaccc

SEQ ID NO: 163750 - DNA, 75 bp, Artificial Sequence
  Synthetic
gctccggcttttggagccctcaggggccctcttttacgactatgtgtacgaggccctgctctgggaccagactta

SEQ ID NO: 163751 - DNA, 75 bp, Artificial Sequence
  Synthetic
tagccgtacaaggccacaaattgggcagccatctcatccatgtttccaaccctctcaataaactggggcgcggcc

SEQ ID NO: 163752 - DNA, 75 bp, Artificial Sequence
  Synthetic
gcttttctcctcagtctttgcaatttgcctaacatggaggattgaggacccaccttttaattctcttctgtttgc

SEQ ID NO: 163753 - DNA, 75 bp, Artificial Sequence
  Synthetic
gccatggccgtggagctggtggagcacagtgggggtggggccggcgggggagagggtgaagaaagcggcggtggt

SEQ ID NO: 163754 - DNA, 75 bp, Artificial Sequence
  Synthetic
caggcggggttgaggaagtagctgctgacaaactgctgcattccaggtcccgtggccctggccggccccatttct

SEQ ID NO: 163755 - DNA, 75 bp, Artificial Sequence
  Synthetic
acccccctttgggactagggaccccagatgctcgatcacagcactggggcccggggggcgcgcgtagcccgagat

SEQ ID NO: 163756 - DNA, 75 bp, Artificial Sequence
  Synthetic
ccgcctgtgcccatgaactttcggcgtaggggcacggaggggccgtcagtccgctccatggctggaatggcccca

SEQ ID NO: 163757 - DNA, 75 bp, Artificial Sequence
  Synthetic
ccaggtgctccaccgcgtagtttcccggaccgttggttccggtcacgtctggcccaccccagcccgagaagcagg

SEQ ID NO: 163758 - DNA, 75 bp, Artificial Sequence
  Synthetic
ttgccagccctggtcctctgccggctcatcaaggcctccctgaggaaggataggaagctgtacgcagagctggcc

SEQ ID NO: 163759 - DNA, 75 bp, Artificial Sequence
  Synthetic
cagacgctcggggggtgcacacctcccagccggcccggcgtccttgcggcggcctccccccccatgaagcgggtg

SEQ ID NO: 163760 - DNA, 75 bp, Artificial Sequence
  Synthetic
cgccggcctgctggccgagctggaggccatcctccttccccgtttgagacggcagaatgaccgtgcatgcagcgc

SEQ ID NO: 163761 - DNA, 75 bp, Artificial Sequence
  Synthetic
gtcctgtagaagccggccacgaccggcaccccgcttttggcatggcattcagccgccgccctggtctaaaaggcc

SEQ ID NO: 163762 - DNA, 75 bp, Artificial Sequence
  Synthetic
ggtccggcctgggagcgcacccccatccccgccgggggaggatcgggctccgccccgatatacctagtgggtgga

SEQ ID NO: 163763 - DNA, 75 bp, Artificial Sequence
  Synthetic
agccgccgccctggtctaaaaggcctgttggcgccgggccgccgccctggcatctgctccggggccggtggcggt

SEQ ID NO: 163764 - DNA, 75 bp, Artificial Sequence
  Synthetic
ggccggggatggggatgaagaggggagggctggaggccggggccgcggaggccggggccgcggaggccggggccg

SEQ ID NO: 163765 - DNA, 75 bp, Artificial Sequence
  Synthetic
ttagtgtgtcatggtgaggcaggcaaggcgagcaacgggggcttagtggctcaaagtgatgcatcccaaaggcag

SEQ ID NO: 163766 - DNA, 75 bp, Artificial Sequence
  Synthetic
gcggggctcatggattagcaggggcttagtgtgtcatggtgaggcaggcaaggcgagcaacgggggcttagtggc

SEQ ID NO: 163767 - DNA, 75 bp, Artificial Sequence
  Synthetic
gctattgcattaacgaagggaaagaggccggggtgctggcgtctcataaacagctgtgggcagttggcctggatg

SEQ ID NO: 163768 - DNA, 75 bp, Artificial Sequence
  Synthetic
acgggacaaggcacaggccaggtcatgacccaggaagtggcgagcatcggtcagctgaccaaatgtgcaaaggtg

SEQ ID NO: 163769 - DNA, 75 bp, Artificial Sequence
  Synthetic
gttttaccgaaagccagatactaaatcaaccaaaaaatgcagggccatagtgactgaccttagtataatcaaggt

SEQ ID NO: 163770 - DNA, 75 bp, Artificial Sequence
  Synthetic
ccaagtggcccgagtaagtgtctcgcagcgcggacacgatctttagctcgtcggccagctgtctgccaccagcag

SEQ ID NO: 163771 - DNA, 75 bp, Artificial Sequence
  Synthetic
atccacaaaggcctcctggggcaccgtcaccttgacggtgctgcgagggatggccttgctgaccacaggcccgtg

SEQ ID NO: 163772 - DNA, 75 bp, Artificial Sequence
  Synthetic
cacctggccggaatcgtacttgcgaagggcgttgtcaaacaggacaaggtgattgatggcctggaactgacggaa

SEQ ID NO: 163773 - DNA, 75 bp, Artificial Sequence
  Synthetic
gtcaccttgacggtgctgcgagggatggccttgctgaccacaggcccgtggaccaccgtggtgattttattcaga

SEQ ID NO: 163774 - DNA, 75 bp, Artificial Sequence
  Synthetic
cggcctcctcacccaggaaggtcaagagctggcgcagaacgttgtcggtgacaataaacaccccccccactggct

SEQ ID NO: 163775 - DNA, 75 bp, Artificial Sequence
  Synthetic
ggagggccggcttctatgcacctcgaagccaaactgcctgcccatctccacgcgaagcacgtacgtggcgcccag

SEQ ID NO: 163776 - DNA, 75 bp, Artificial Sequence
  Synthetic
cttagggctgttgagctcaagagccccacctgggtaaaatgtatgttctaaagagttacccaattataacaaaaa

SEQ ID NO: 163777 - DNA, 75 bp, Artificial Sequence
  Synthetic
atagttgttgcctgaggcctccagggcactctccgtgcccaagtgttcaccctgctcgccgtttcctagtagaat

SEQ ID NO: 163778 - DNA, 75 bp, Artificial Sequence
  Synthetic
gccgggggacttcttccccgaagggctagatccctctgcctacctgggggcggtggcaataaccgaggccttcaa

SEQ ID NO: 163779 - DNA, 75 bp, Artificial Sequence
  Synthetic
gcactctccgtgcccaagtgttcaccctgctcgccgtttcctagtagaatgccaacgagggccagttctctggcc

SEQ ID NO: 163780 - DNA, 75 bp, Artificial Sequence
  Synthetic
gaagcatacatgacaattaaagccaggtgataattccataccctggaagcaggagatgggtgcatttcaccccaa

SEQ ID NO: 163781 - DNA, 75 bp, Artificial Sequence
  Synthetic
tagcagcaggttctcagcaatcaggggccccgggtctaggccgagcgcagagcgtgggtcagagagtagctcata

SEQ ID NO: 163782 - DNA, 75 bp, Artificial Sequence
  Synthetic
ctcctacaacgagacggactttttgggcaactttctcaacttcatcgataaggaggacgacgggcagcggccgga

SEQ ID NO: 163783 - DNA, 75 bp, Artificial Sequence
  Synthetic
agcgtgggtcagagagtagctcatatagcctttgctcctgtatgtttgcctctccatcttgcccgaagagcctta

SEQ ID NO: 163784 - DNA, 75 bp, Artificial Sequence
  Synthetic
gcaactgcggcgggggctgacgccgctgggttgttgccgccgggacccagggaggcctgcagctgagactccatg

SEQ ID NO: 163785 - DNA, 75 bp, Artificial Sequence
  Synthetic
acacgaggcaagttttaagagttaaaagcaactactgtttattttccaaaatgagctgggtatagttgatgatct

SEQ ID NO: 163786 - DNA, 75 bp, Artificial Sequence
  Synthetic
cacagtggtccttcggcgaccacccacgcaaaaggtgactggccctgccggttcactgagtgtccaggctcagct

SEQ ID NO: 163787 - DNA, 75 bp, Artificial Sequence
  Synthetic
aagttacacgtgatagtgtctctaaaatttaataatacttacctttatacagtgttgcgatatggggtcggtggg

SEQ ID NO: 163788 - DNA, 75 bp, Artificial Sequence
  Synthetic
tggagacctttttctttaggccctgcgcagccgtctccccgggctggccaaatagacggttgcggtccaccaggt

SEQ ID NO: 163789 - DNA, 75 bp, Artificial Sequence
  Synthetic
cgccttaaggccgagtcagttacacacacagtagccgaatatctggaggtcttctctgacaaattctacgatgag

SEQ ID NO: 163790 - DNA, 75 bp, Artificial Sequence
  Synthetic
tctaatgaccccaaagagggcaaagcctacaaaagccaaacccatgtaagtcatgtgtcagaacagtgacataac

SEQ ID NO: 163791 - DNA, 75 bp, Artificial Sequence
  Synthetic
aagcgtgttagtcatcaccgtcagccacacagcgccggctaccatggtgagcaggccgccgagggacataaaaac

SEQ ID NO: 163792 - DNA, 75 bp, Artificial Sequence
  Synthetic
gcgggtccccggggggcaagctgtgggaatgcggtggccaagtgcaacaggaaatggaaaggcagtgcggcaatc

SEQ ID NO: 163793 - DNA, 75 bp, Artificial Sequence
  Synthetic
ccccccaccagtcacccggccgtgtccactcacatattccactcttatttttaaattaatgtgtcccaattagaa

SEQ ID NO: 163794 - DNA, 75 bp, Artificial Sequence
  Synthetic
ttaaatacgactcggctgggatattggccacacccctgtcctgccgtcctggggccggagcggtcgccccggccg

SEQ ID NO: 163795 - DNA, 75 bp, Artificial Sequence
  Synthetic
taaagagtatgccagcgacaatcagtaataacatgcagaacaaatctaaggaacaaagcgtaaaatgtgtgttac

SEQ ID NO: 163796 - DNA, 75 bp, Artificial Sequence
  Synthetic
taataacatgcagaacaaatctaaggaacaaagcgtaaaatgtgtgttacaatccaatagcttgttttcttcaac

SEQ ID NO: 163797 - DNA, 75 bp, Artificial Sequence
  Synthetic
ggtctcttttacgccctggcctgcaaccgcagcccacctgcacttcccgaggatgctacccttctaatcaaatgg

SEQ ID NO: 163798 - DNA, 75 bp, Artificial Sequence
  Synthetic
cgtgggaaaaaatttatggttcagtgcgtcgagtgctatctttggaacagtagaaaattgaaccttgttggcggg

SEQ ID NO: 163799 - DNA, 75 bp, Artificial Sequence
  Synthetic
caccaccccgtcccagtgggatgatctccgagggtgtgatatcttgcagttcttctactgttttaacggcggttg

SEQ ID NO: 163800 - DNA, 75 bp, Artificial Sequence
  Synthetic
taaacaggagtaacaaatagatactcacgaggtataaattcagtgctacttaaactcttgaagtttgtttgcaaa

SEQ ID NO: 163801 - DNA, 75 bp, Artificial Sequence
  Synthetic
gcgcaggcctcctcgctgagtgcggcggccgtctggcgcgcagggctgctggccccgcccggaccagaagggggg

SEQ ID NO: 163802 - DNA, 75 bp, Artificial Sequence
  Synthetic
tctcatataccgtgtctctggggctgacctttatacagaaggcgtcccctactaggtccacggccagctcgtagg

SEQ ID NO: 163803 - DNA, 75 bp, Artificial Sequence
  Synthetic
agtatagtggccccgtgggaccttagaggtggagcaacgtctaaagtggtaataacaccaggcggggctgggcaa

SEQ ID NO: 163804 - DNA, 75 bp, Artificial Sequence
  Synthetic
ggggacctttcatccgaactcctcaggtctctgctatgggtccgctacagccgcctgtggcaggcccctgccccg

SEQ ID NO: 163805 - DNA, 75 bp, Artificial Sequence
  Synthetic
tgtaaaagagatgccaagttagagctgcgattacaaaagaacaagtaatgagttaaaggaagggaaaacttacca

SEQ ID NO: 163806 - DNA, 75 bp, Artificial Sequence
  Synthetic
ggtctctgctatgggtccgctacagccgcctgtggcaggcccctgccccggctccggccctcccctgtaagcccc

SEQ ID NO: 163807 - DNA, 75 bp, Artificial Sequence
  Synthetic
cagtgttgtcctttatttttagatgttagctttgtgttgggttagtatgggctgggtattcactagtgaaggcaa

SEQ ID NO: 163808 - DNA, 75 bp, Artificial Sequence
  Synthetic
acattgtagtcaagttaagtgtgcccaaaatcagtgacgctagcagtgccagagctataatcagagatggcatgg

SEQ ID NO: 163809 - DNA, 75 bp, Artificial Sequence
  Synthetic
atcaacagccacgtggagtaccacaactacggctgcaagaggccggtcagtgtggcggcctacatggagccctgg

SEQ ID NO: 163810 - DNA, 75 bp, Artificial Sequence
  Synthetic
agagctataatcagagatggcatggttagtcctgtgtccagaaaacatgtggcaaaaaggcaagcaatgtcacac

SEQ ID NO: 163811 - DNA, 75 bp, Artificial Sequence
  Synthetic
actaggtccacggccagctcgtaggtggggcctatgttttcacataacagtttcaagcaggtctctgggatgtga

SEQ ID NO: 163812 - DNA, 75 bp, Artificial Sequence
  Synthetic
gacagtgtgcttaccagacttccatggaagatgtgaatttgctgctagctatatgggtggtgctatgggctccct

SEQ ID NO: 163813 - DNA, 75 bp, Artificial Sequence
  Synthetic
ggccccctggcgaagagagccagaggacgaaagccagtagcagcagcgtcatggaaaccacagttacagctccaa

SEQ ID NO: 163814 - DNA, 75 bp, Artificial Sequence
  Synthetic
atctccatccagcagtgcaaggccggggacagaccgggggacctggagatcattctacagagtaacggcggaggg

SEQ ID NO: 163815 - DNA, 75 bp, Artificial Sequence
  Synthetic
tatgaagtcaaacctgcattccagaacagaggcacactaaccgtaaatgccttgtagtccgccagctgcggccag

SEQ ID NO: 163816 - DNA, 75 bp, Artificial Sequence
  Synthetic
ggtgggtcttcaatcctccatgttaggcaaattgcaaagactgaggagaaaagcagaggaagtgaactgttagag

SEQ ID NO: 163817 - DNA, 75 bp, Artificial Sequence
  Synthetic
ggcaaattgcaaagactgaggagaaaagcagaggaagtgaactgttagagacagatcaatctcacgaacattatg

SEQ ID NO: 163818 - DNA, 75 bp, Artificial Sequence
  Synthetic
agctgtctccgctcaggtccagaagccagggaaggcagacggatgtcaggtcgggcccggacccggcacggaggc

SEQ ID NO: 163819 - DNA, 75 bp, Artificial Sequence
  Synthetic
ggagcacagcctccaagctgcccccgtcaagcgcgagatagaaggcagtggatggcggcggtcccgcggacagac

SEQ ID NO: 163820 - DNA, 75 bp, Artificial Sequence
  Synthetic
gtaaccggtgtcagcagtttcctttgtgcagcggcagatgagttggccactgctgccaagagtagaagtgagagg

SEQ ID NO: 163821 - DNA, 75 bp, Artificial Sequence
  Synthetic
gtgcagcggcagatgagttggccactgctgccaagagtagaagtgagagggccaagccggtggcgctgacaacgg

SEQ ID NO: 163822 - DNA, 75 bp, Artificial Sequence
  Synthetic
tgatgagcccgccacgtcagagccggttcttgatcagctactgcccgccccaggacttggacctcttgcaattca

SEQ ID NO: 163823 - DNA, 75 bp, Artificial Sequence
  Synthetic
ccagggggacccgagggccttagaggcccaggcggctcgctcctgttcctcccccggtccccagtagggccgccg

SEQ ID NO: 163824 - DNA, 75 bp, Artificial Sequence
  Synthetic
aggtagggcgcaacaattacaggcaggcatactggattcatactaagaaagagaacgggcaagaagaaaagttag

SEQ ID NO: 163825 - DNA, 75 bp, Artificial Sequence
  Synthetic
ggcatactggattcatactaagaaagagaacgggcaagaagaaaagttagggtgaatagagcaagacgaattcta

SEQ ID NO: 163826 - DNA, 75 bp, Artificial Sequence
  Synthetic
gccttggttgtaatttcaggagagagtcctcccttttcggccctgagaaatggatgctgaactcggtttctggta

SEQ ID NO: 163827 - DNA, 75 bp, Artificial Sequence
  Synthetic
ctccaagtggacagagaaggtctcttctgaagataaagatgatcaaaatgataatcacaagcatgagagcaaagg

SEQ ID NO: 163828 - DNA, 75 bp, Artificial Sequence
  Synthetic
tagggagcactcggggccctttttggtctggcacgaagccttctcctggaccctggaccaactagcggcgagggc

SEQ ID NO: 163829 - DNA, 75 bp, Artificial Sequence
  Synthetic
agggcaagacgagggagggaaggggaaaaagttagaaactgggcccgaggccttggagggggcggagggctaggg

SEQ ID NO: 163830 - DNA, 75 bp, Artificial Sequence
  Synthetic
aaaaagttagaaactgggcccgaggccttggagggggcggagggctagggagaggtagaagaccccctcttacat

SEQ ID NO: 163831 - DNA, 75 bp, Artificial Sequence
  Synthetic
ggagaaggagagcaaggcctatggaagaggagagggggggtcctcgagggggccgtcgcgggcccggtgggcccc

SEQ ID NO: 163832 - DNA, 75 bp, Artificial Sequence
  Synthetic
tctcaaggtccaggtccatgctcagggcagtgtgtcaggagccaggcagttgaggaaagaagggggcagagtagt

SEQ ID NO: 163833 - DNA, 75 bp, Artificial Sequence
  Synthetic
aggaccgatgagatcctctctgaaaacatattgtttagctccagggcctcaacatccatgttcattgggacccca

SEQ ID NO: 163834 - DNA, 75 bp, Artificial Sequence
  Synthetic
ccacccaagtcagactccaggtggcccaacgacacagtccctggcaccggaaacagaagccccgcgccagtggcc

SEQ ID NO: 163835 - DNA, 75 bp, Artificial Sequence
  Synthetic
gccatacgccgcggtaagggctacgtccgagtctccgtggacacgccggacctgaaacgagagggcccgctgaac

SEQ ID NO: 163836 - DNA, 75 bp, Artificial Sequence
  Synthetic
tccctttggcctctgcggtgccaatttccggtggtttcccttttccgcccgtttatccaatagcatgtaagagag

SEQ ID NO: 163837 - DNA, 75 bp, Artificial Sequence
  Synthetic
gtcaaggtgggcatgaccctattggatgatgtgattattgccttccgttacaacccctaccctaagagccactgg

SEQ ID NO: 163838 - DNA, 75 bp, Artificial Sequence
  Synthetic
tgacgcggtgccgtcgggcgtccccaccacggccggtggccccgtcggacgacagtcagcggccgcgtgcaggag

SEQ ID NO: 163839 - DNA, 75 bp, Artificial Sequence
  Synthetic
taagacccgcccatcaccaccggacagattctgaacttgtcctgtggtgtttggtgtggttttggggtacgcagg

SEQ ID NO: 163840 - DNA, 75 bp, Artificial Sequence
  Synthetic
ttgtgggaagcggcagtgtaatccgcacaaagaggcgcggggcgtgcaacgttgggaggtcgtcggcagcaggcg

SEQ ID NO: 163841 - DNA, 75 bp, Artificial Sequence
  Synthetic
gggggaagggaaggcctgctgtcatcggggtccgcaggggcgccgaaagcaggaatgcggggagcggcaagggct

SEQ ID NO: 163842 - DNA, 75 bp, Artificial Sequence
  Synthetic
cctcttccgtgcctcgggcctcaacgtccgtgagagcctacccatgaccaacatgagggcaccgatcatctcgct

SEQ ID NO: 163843 - DNA, 75 bp, Artificial Sequence
  Synthetic
gctcttagggcccggaagcttgtcattggattcatcgtttcctgaactacaggcgtagggcctattgtagcaggc

SEQ ID NO: 163844 - DNA, 75 bp, Artificial Sequence
  Synthetic
gcagggggcgtgtctggtgggggcgggagcggggggcggcgcgggagcctgcacgccgttggagggtagaatgac

SEQ ID NO: 163845 - DNA, 75 bp, Artificial Sequence
  Synthetic
tcaatctctggaccgaggctcaccctcctccagtaggaggtcagggtgactcgctcacccaagaaagcggtgaca

SEQ ID NO: 163846 - DNA, 75 bp, Artificial Sequence
  Synthetic
gaatcacggccggggtgtagccgcccgggtcgaggcaggtcagacctcctccaaccgtcagtagcactaaatgtc

SEQ ID NO: 163847 - DNA, 75 bp, Artificial Sequence
  Synthetic
ggagcctgcacgccgttggagggtagaatgacagggggcggggacagagaggcggtcgcgcccccggccgcgcca

SEQ ID NO: 163848 - DNA, 75 bp, Artificial Sequence
  Synthetic
aaacactattgctaatgccctcttgagggtccgcttatcggtagctacacaggcccctctgattgacgttggtgt

SEQ ID NO: 163849 - DNA, 75 bp, Artificial Sequence
  Synthetic
aagaagtcccgtagtgaaaaatgggatctgtctacaccatgtctggtgtgccgggaacatattgatcgggccaca

SEQ ID NO: 163850 - DNA, 75 bp, Artificial Sequence
  Synthetic
gcggcgcgggagcctgcacgccgttggagggtagaatgacaggggggcggggacagagaggcggtcgcgcccccg

SEQ ID NO: 163851 - DNA, 75 bp, Artificial Sequence
  Synthetic
ggaggaagtcatgccacaggctgaaaaccaggaccctgaagccaaagaccatgtcaattctttgggtgaaaatct

SEQ ID NO: 163852 - DNA, 75 bp, Artificial Sequence
  Synthetic
ccgtgtcatttagaaaccttgcctacgggcgcacctgtgtcctgggcaaggagctgtttggctcggctgtggagc

SEQ ID NO: 163853 - DNA, 75 bp, Artificial Sequence
  Synthetic
acctggaggaagatgaggacgtagaagagcggcggcggttgcgcccgggtgatggcgtgcgcgagggcctaggcc

SEQ ID NO: 163854 - DNA, 75 bp, Artificial Sequence
  Synthetic
cagcttgcctccccaccgggtccatcaggccggccggagggaccccggcggcccggtgtcagtcccccctgcagc

SEQ ID NO: 163855 - DNA, 75 bp, Artificial Sequence
  Synthetic
cacctgcgccctgatgccctatatgcccccggccagcgacaggctgaggaacgagcagatgattgggcaggtgct

SEQ ID NO: 163856 - DNA, 75 bp, Artificial Sequence
  Synthetic
gactctgctggaaatgatggaggccctccaaatttgacggaagaggttgaaaacaaaggaggtgaccggggcccg

SEQ ID NO: 163857 - DNA, 75 bp, Artificial Sequence
  Synthetic
cgagcctcggacctcacggtcactagagattatgaatgtcacgttgatgagcgggataatcatcagaactttgtc

SEQ ID NO: 163858 - DNA, 75 bp, Artificial Sequence
  Synthetic
cacacgccagtgctgggttactgcgggtggagggaaagggatacaggtggattaatcctagattgcgccacctgg

SEQ ID NO: 163859 - DNA, 75 bp, Artificial Sequence
  Synthetic
ccgagaacccggcggacccgatcagagcaccatgcttactcaatccattatcttggtaccccggcgtcggcaccg

SEQ ID NO: 163860 - DNA, 75 bp, Artificial Sequence
  Synthetic
cctcgcccacatcgctctccctggcttttccctatgcgggcccgccccccgtggcgtggtaccgacattctatca

SEQ ID NO: 163861 - DNA, 75 bp, Artificial Sequence
  Synthetic
cattcgtgagcagggcttcgtccaggggcttgttcttggtggacatcattagcccagctgcaaatatcagaatta

SEQ ID NO: 163862 - DNA, 75 bp, Artificial Sequence
  Synthetic
cccccgatgccccccgggggtctttcctggggggccttctttgtcagctgtgcctgagtcaccaggggccccttg

SEQ ID NO: 163863 - DNA, 75 bp, Artificial Sequence
  Synthetic
acagatgtcaggccatcagaaaaaaaccattaccaattgttaagcagaggcggtggaagctcctgtcatcttgca

SEQ ID NO: 163864 - DNA, 75 bp, Artificial Sequence
  Synthetic
aatgggggttggagaaagtaaccacatatactggagatgattcatgggctgggggttcccggacaatacacccat

SEQ ID NO: 163865 - DNA, 75 bp, Artificial Sequence
  Synthetic
gcgtagaggccacagccgcctcagaagctgggggcacacgtgccccccgagacccgggagacggtggtgggggga

SEQ ID NO: 163866 - DNA, 75 bp, Artificial Sequence
  Synthetic
cagatgaggccccttacttccacagggtactggcataccagcgggggaccacatacatccctgtctcccacccag

SEQ ID NO: 163867 - DNA, 75 bp, Artificial Sequence
  Synthetic
agatacttcagaagggtgcctagccagtccacctgagcgcgaggatggccctgcaaactgacacacaggcctggc

SEQ ID NO: 163868 - DNA, 75 bp, Artificial Sequence
  Synthetic
ttgtaagtggaggtatgagcagggggaatcaggttgattgaatagcaaatacaaggggagaaagttaacaccatt

SEQ ID NO: 163869 - DNA, 75 bp, Artificial Sequence
  Synthetic
agctcttggccaaccagcggaggtccacgcagccattgccagtctcacccacggcatgacccaccttaaagaagg

SEQ ID NO: 163870 - DNA, 75 bp, Artificial Sequence
  Synthetic
ctcgttagtccaagagaatgacagccaggacggtccctccctgaaatccatttactgggggctacaggaggccac

SEQ ID NO: 163871 - DNA, 75 bp, Artificial Sequence
  Synthetic
ttggagctgtaactgtggtttccatgacgctgctgctactggctttcgtcctctggctctcttcgccagggggcc

SEQ ID NO: 163872 - DNA, 75 bp, Artificial Sequence
  Synthetic
agggagagtcagtcaggcaagcctatgacatggtaatgcctagaagtaaagaaaggttagtcatagtagcttagt

SEQ ID NO: 163873 - DNA, 75 bp, Artificial Sequence
  Synthetic
ccacctccaccacctccaccacctccaccacctccaccacctccaccacccccaccacctcagcgcagggatgcc

SEQ ID NO: 163874 - DNA, 75 bp, Artificial Sequence
  Synthetic
ggcctggtcagccgagttcacagacgagatgaagataatcttggcatccttctgaagcataaagcccaggatcgc

SEQ ID NO: 163875 - DNA, 75 bp, Artificial Sequence
  Synthetic
cccacccccacaattaaagcggtgggtgccaggcccgtgccaaaggccacgggggcgctggcgaccggcgcccgt

SEQ ID NO: 163876 - DNA, 75 bp, Artificial Sequence
  Synthetic
agagccaaacacctccagtcctagcatgcctgaactaagtccagtcctcggtcttcatcagggacaaggggctgg

SEQ ID NO: 163877 - DNA, 75 bp, Artificial Sequence
  Synthetic
cggcagggcctccttcttgataaagttagcctcgtccacaaacaagaggtgaaatgtctgcccccggatgctctg

SEQ ID NO: 163878 - DNA, 75 bp, Artificial Sequence
  Synthetic
tctggatagcatatgctacccaatctatatgcgggtagtacatgctatcctaaatctatattcgggtagtatatg

SEQ ID NO: 163879 - DNA, 75 bp, Artificial Sequence
  Synthetic
ctatcctaatctctatgtgggtagtacatgctatcctaatctctatgtgggtagcatatgctatcctaatctata

SEQ ID NO: 163880 - DNA, 75 bp, Artificial Sequence
  Synthetic
aacgcaagcccggtggaccatggagaccagagccaaacacctccagtcctagcatgcctgaactaagtccagtcc

SEQ ID NO: 163881 - DNA, 75 bp, Artificial Sequence
  Synthetic
aactgaaggtaggctagcgttcgggtgaacgcaagacaaacttccaacaacaccgcgtcggctcggaaaggctgt

SEQ ID NO: 163882 - DNA, 75 bp, Artificial Sequence
  Synthetic
gtagtatatgctatcctaatctctatgtgggtagtacatgctatcctaatctctatgtgggtagcatatgctatc

SEQ ID NO: 163883 - DNA, 75 bp, Artificial Sequence
  Synthetic
gacgtgcaaggatggaggagaggggcagggaaacgcaaatgccggttgcccggtatgggggcccgtttattatgg

SEQ ID NO: 163884 - DNA, 75 bp, Artificial Sequence
  Synthetic
catggctgcttttagcctaattgtgtattgctctcgttgccaaaacctgttgtaagggccggcacccgcaacatg

SEQ ID NO: 163885 - DNA, 75 bp, Artificial Sequence
  Synthetic
tccaatgccgcccccgtttgtagaaattcacacacagcaacccctaacgtttcaccaatacatgaaccggagtcc

SEQ ID NO: 163886 - DNA, 75 bp, Artificial Sequence
  Synthetic
gcaggagcaaggcaactgaggaaagaagctgacagagcagtgacagaggcttatgtaggccgcctacgagagagt

SEQ ID NO: 163887 - DNA, 75 bp, Artificial Sequence
  Synthetic
cctaattctaacgggagaggcagaaagatatatggtggacgctgtgggaaattaccgggaagcctccactggaac

SEQ ID NO: 163888 - DNA, 75 bp, Artificial Sequence
  Synthetic
gggaaaacataaccgccgccatcccatggggagggtagaggcggttgacatgtaggtgagtagtgtaagaagcat

SEQ ID NO: 163889 - DNA, 75 bp, Artificial Sequence
  Synthetic
gccccactgtgcaatgcagcttttagccatgccatgctctataaatcacttccctatctcaggtaggcctgcaca

SEQ ID NO: 163890 - DNA, 75 bp, Artificial Sequence
  Synthetic
cttagccctcttatccgcctcacccgcctcccctacggttaccccacagccttgcctcacctgaacccccctaaa

SEQ ID NO: 163891 - DNA, 75 bp, Artificial Sequence
  Synthetic
agattatgtggagggacccagtaaaagacctcgcccctccacccagtaaaaacccttgccctctccagcaaccaa

SEQ ID NO: 163892 - DNA, 75 bp, Artificial Sequence
  Synthetic
attggcatagaaggggtagaaggcgtccgaacagcccgtcacctgggcacagcctgaggtgggcatcagggcgat

SEQ ID NO: 163893 - DNA, 75 bp, Artificial Sequence
  Synthetic
ccttgtgattgccgcactgcctttccatttcctgctacgctttaccaccgcattcccacagcttgcccctcgggg

SEQ ID NO: 163894 - DNA, 75 bp, Artificial Sequence
  Synthetic
ctggtgcagagggccgtaaagtacatatgttcgaatatttccttgtttaacgagcgagagggagggtcagtgtac

SEQ ID NO: 163895 - DNA, 75 bp, Artificial Sequence
  Synthetic
cccccggggggcatcgggggggatagatgggggcatgggggcgtggggcatgggccgcgcattcctggaaaaagt

SEQ ID NO: 163896 - DNA, 75 bp, Artificial Sequence
  Synthetic
aagatgcatgtgtacatcgagcatgtctgcgttcccgggagcctgcatgacaacccgggagtacacgttaaacag

SEQ ID NO: 163897 - DNA, 75 bp, Artificial Sequence
  Synthetic
ccaggtgtgtgtatgccctgtacttggacgtgcgtgactggaagggtgaggatatagctcctccctttgacgtta

SEQ ID NO: 163898 - DNA, 75 bp, Artificial Sequence
  Synthetic
cccccccatgcccccatctatcccccccgatgccccccggagtacctaggccccctggcgaagagagccagagga

SEQ ID NO: 163899 - DNA, 75 bp, Artificial Sequence
  Synthetic
gtcaccacgtatacttctggggaggcctgcctcaccctagactacaagcctctgagtgtggggccatacgaggcc

SEQ ID NO: 163900 - DNA, 75 bp, Artificial Sequence
  Synthetic
ctggtagagtccgtcatcatcttcctcacctgcccctgagtcactgccggttggggtaagaactgagggggcaaa

SEQ ID NO: 163901 - DNA, 75 bp, Artificial Sequence
  Synthetic
ggccccaatctctttgatcttgtgacgcatgcggcgcaggcaggccgttaggcccatgagcttctgcagcacaga

SEQ ID NO: 163902 - DNA, 75 bp, Artificial Sequence
  Synthetic
gcagtacctcacgccgcacggtccggcacaggtcatagatttcctccagcgaccagggggggcccttgatcttta

SEQ ID NO: 163903 - DNA, 75 bp, Artificial Sequence
  Synthetic
ctttagactatttttcgaagtcaccctgggtcggagaatcgcagattgcgttgtggtagctctgcagccttcccc

SEQ ID NO: 163904 - DNA, 75 bp, Artificial Sequence
  Synthetic
gaagctggtatccaaccggcagtggaggatcttcgtgctcgtagaaggaggggttgagtacatcggtcggccatc

SEQ ID NO: 163905 - DNA, 75 bp, Artificial Sequence
  Synthetic
tacatgatgtcgcccagagaacccagctgagatgcccagggattcacagtgctccggtactcataggcggcatcc

SEQ ID NO: 163906 - DNA, 75 bp, Artificial Sequence
  Synthetic
acgttaaggtttcaggtaccgtgattacattgggagaacaggggtacaaagtgtcgttggatctgagggagggaa

SEQ ID NO: 163907 - DNA, 75 bp, Artificial Sequence
  Synthetic
ttggtatttaaaaaccagcgatccctgagaacgctccaggtagagtttccagccctgggccaaaagaccctcccc

SEQ ID NO: 163908 - DNA, 75 bp, Artificial Sequence
  Synthetic
aaatataccgcaaacactgccgtacaatccaacagtatacggcaggcccgcggtgtttgaccgaaagtcagatgc

SEQ ID NO: 163909 - DNA, 75 bp, Artificial Sequence
  Synthetic
cgtccacactgagcccggcccaggcccgcatgagtccgtcatcggggtcggggtcccacgtgtatggggccgggg

SEQ ID NO: 163910 - DNA, 75 bp, Artificial Sequence
  Synthetic
tggccaacctgcctctcttatgcctgtggccccggctggccatcgagattgtttacatctgcccggctatacacc

SEQ ID NO: 163911 - DNA, 75 bp, Artificial Sequence
  Synthetic
cgggccaagatggggcgcgagggtcagggatgaggggctggtctgtgacctggcccagcggacaaggcccccggg

SEQ ID NO: 163912 - DNA, 75 bp, Artificial Sequence
  Synthetic
gcaggactcggcctggtctcggctctagcgagagatgggggtttgggagacctcctgtcggactcggtcctcacc

SEQ ID NO: 163913 - DNA, 75 bp, Artificial Sequence
  Synthetic
cccgagcaggtccgtcccctgccacgtacctaatagtagtccacagtagtcggccttggttgtaattttaggaga

SEQ ID NO: 163914 - DNA, 75 bp, Artificial Sequence
  Synthetic
tcaccgggaacgcccagtatgcagtctcaatctctcccacggacccccctctgatggtggccggcagcctggctc

SEQ ID NO: 163915 - DNA, 75 bp, Artificial Sequence
  Synthetic
atattaactgactttagtgtaatcaaggccattgaagaggaacacagaaagaagaaggcagccagaacagagcag

SEQ ID NO: 163916 - DNA, 75 bp, Artificial Sequence
  Synthetic
aggccccctccgtccccgtcctccagagacccgggcttcaggccctgcctctcctgttacccttttagaaccaca

SEQ ID NO: 163917 - DNA, 75 bp, Artificial Sequence
  Synthetic
gcctggacacatgtgccagacgcctgggcctctaaggccctcgggtccccctggaccccggcctcagcaaccctg

SEQ ID NO: 163918 - DNA, 75 bp, Artificial Sequence
  Synthetic
ttgtccctccaaggagcgtaactcgcctcgtcttcggtctcagcttctgaaaagttatccaagtcccaaccaccg

SEQ ID NO: 163919 - DNA, 75 bp, Artificial Sequence
  Synthetic
gggagccaaaggtgctaatgaaccacctggccgagatgttaacgcggtagatgcggcgcagacagcccacgatct

SEQ ID NO: 163920 - DNA, 75 bp, Artificial Sequence
  Synthetic
acggcggttgaggtggtaaagacgtgggccgtggtcagatctgtgcaggtgactacagggttacccctaatctcc

SEQ ID NO: 163921 - DNA, 75 bp, Artificial Sequence
  Synthetic
gaaacaccagaaactgcatcgtcgtccggtgttccgtgatgtaggcccggcagaccaccatagatttcatgagat

SEQ ID NO: 163922 - DNA, 75 bp, Artificial Sequence
  Synthetic
tataaaatatgtaatggcttcctggcccttcgtgtaacgatcctggacggcctcgtacttctcatgcatggtctt

SEQ ID NO: 163923 - DNA, 75 bp, Artificial Sequence
  Synthetic
gcccggggcggcgggtcgggaccgggacctggtgtaccggatcgccaaccagatctttggggaggatgtgccccc

SEQ ID NO: 163924 - DNA, 75 bp, Artificial Sequence
  Synthetic
tggcccagcataatgatggagttctttggtaggtcaacatccgttgagagacccaggcaagggccgctctggccc

SEQ ID NO: 163925 - DNA, 75 bp, Artificial Sequence
  Synthetic
gggacatcctgggaatctttgcaggttctgggtccagggagggtaagaaaagtgggggtggttctgggccacatg

SEQ ID NO: 163926 - DNA, 75 bp, Artificial Sequence
  Synthetic
attaagagtccctcctcaccactcgaaactatggcagacattctataagataacgaggagagatgaggtgagggc

SEQ ID NO: 163927 - DNA, 75 bp, Artificial Sequence
  Synthetic
ctcgccatgattcactagatctagggtgctatcggctgccacaatccgagcaatgacctgttttataatatccct

SEQ ID NO: 163928 - DNA, 75 bp, Artificial Sequence
  Synthetic
ctgctggacaaacaggctggcgacagcctggccctgatggagatggagaaggtggccacggcgctcaagatggac

SEQ ID NO: 163929 - DNA, 75 bp, Artificial Sequence
  Synthetic
gatgcagtgattcaggaggttcagcctcgcgtaggcagatggcgcaattatgggggcgagattggggtggatcat

SEQ ID NO: 163930 - DNA, 75 bp, Artificial Sequence
  Synthetic
aatgcagctggggccaggggagtcggcaggttacccaccattagccggtgcacggccctgtgcctggccctctcc

SEQ ID NO: 163931 - DNA, 75 bp, Artificial Sequence
  Synthetic
ccgaaggggtttttgaagaaggagatgaaacccgagaccaggctgctaaacaaaccccccaccgtgctgactagg

SEQ ID NO: 163932 - DNA, 75 bp, Artificial Sequence
  Synthetic
tgatagcatggtggctgggtctgtggaggccggtggtgggctctgaagtgccttgtccggcttttgtaggtccgg

SEQ ID NO: 163933 - DNA, 75 bp, Artificial Sequence
  Synthetic
cccgggtggtgaggacggtgtctgtggttgtcttcccagactctgctttctgccgtcttcggtcaagtaccagct

SEQ ID NO: 163934 - DNA, 75 bp, Artificial Sequence
  Synthetic
ggcccgcatgcgcaaccacttcctctacagacgggccttcgtctcgggtccctgggaggacaggcgcgccggcga

SEQ ID NO: 163935 - DNA, 75 bp, Artificial Sequence
  Synthetic
agaccctgagctcggagcacctgcacgcgctgacgcacagcctgtacaccttcatcacggggcccctggcggagg

SEQ ID NO: 163936 - DNA, 75 bp, Artificial Sequence
  Synthetic
tcttctgacatgattagaaatgccaacctcggctactacaaattggagtttctgaaatccatcctcactggccag

SEQ ID NO: 163937 - DNA, 75 bp, Artificial Sequence
  Synthetic
caacgtggccctggctcgctgctgtgacgccgcaggtacgctgccccaccagaaggcgttcctgacttccctgat

SEQ ID NO: 163938 - DNA, 75 bp, Artificial Sequence
  Synthetic
ccatgtggcccagaaccacccccacttttcttaccctccctggacccagaacctgcaaagattcccaggatgtcc

SEQ ID NO: 163939 - DNA, 75 bp, Artificial Sequence
  Synthetic
acctgcaaagattcccaggatgtcccaggggacgtcggcaggggccagtacaccgccctgtgctgccacctgcct

SEQ ID NO: 163940 - DNA, 75 bp, Artificial Sequence
  Synthetic
ttctcagggccgaaaagggaggactctctcctgaaattacaaccaaggccgactactgtggactactattaggta

SEQ ID NO: 163941 - DNA, 75 bp, Artificial Sequence
  Synthetic
gcgtatgtgtggacaggcctccatggtgatgatctaacagacagggacggcggcgctatatataagagcccaaga

SEQ ID NO: 163942 - DNA, 75 bp, Artificial Sequence
  Synthetic
caccagaccggaggctggcgaccattcgcagggcccttgcctcctggcccccatgtttggactaaggcacaagaa

SEQ ID NO: 163943 - DNA, 75 bp, Artificial Sequence
  Synthetic
gcagcgtgttttgggtcttgatgaggaacacgatcctgtctaggattttgatgttgttgccgaacgagtcaagaa

SEQ ID NO: 163944 - DNA, 75 bp, Artificial Sequence
  Synthetic
acgccaaggacacccttgaccgcttcaagagcctaattctggactcattcggcaacaacatcaaaatcctagaca

SEQ ID NO: 163945 - DNA, 75 bp, Artificial Sequence
  Synthetic
ggatcgtgttcctcatcaagacccaaaacacgctgctagatgtgccatgccccaggctaagggcctggctgcaga

SEQ ID NO: 163946 - DNA, 75 bp, Artificial Sequence
  Synthetic
tattttccaaaatgagctgggtatagttgatgatctgtaggcgcagctcatccccacattccaggtccttgatgg

SEQ ID NO: 163947 - DNA, 75 bp, Artificial Sequence
  Synthetic
cggagcggtcgccccggccggcggctactttacctccccaggaggttactacgccgggcccgcgggcggggaccc

SEQ ID NO: 163948 - DNA, 75 bp, Artificial Sequence
  Synthetic
gccatcaaccacagcatcacgaatccgagcgtgctgtttggtcagatttacccacccagcttccaggcctttaag

SEQ ID NO: 163949 - DNA, 75 bp, Artificial Sequence
  Synthetic
agctgtgcacaaactccatggccggtggttcagccaagtcagactccagatgacccaatgaaacagtcccggcca

SEQ ID NO: 163950 - DNA, 75 bp, Artificial Sequence
  Synthetic
aattacgcttgtgtacatatttaaatccacacaagtggccagagtgggcaaaacaatcctcgtggatgtcactaa

SEQ ID NO: 163951 - DNA, 75 bp, Artificial Sequence
  Synthetic
gggggtgcctgtgcctcgtctacctctgttccttctgctccagtgcctccgcctgagccgcttacagctcgacag

SEQ ID NO: 163952 - DNA, 75 bp, Artificial Sequence
  Synthetic
ccgtctccaggaagcgaacatattggatggcgttcgtgtagaccccgagtagcacctcaaacttgatgcccgcct

SEQ ID NO: 163953 - DNA, 75 bp, Artificial Sequence
  Synthetic
ggaactggacgtggtcctgcgcatccacggccttgacctggtacagtcctatcaaacttcccaggtctacgtgtg

SEQ ID NO: 163954 - DNA, 75 bp, Artificial Sequence
  Synthetic
acgctgtcctccaaagggacgtccaatgccacaaaaacaactgctgagcttcccaccgttccagatgagaggcag

SEQ ID NO: 163955 - DNA, 75 bp, Artificial Sequence
  Synthetic
atcaaacttcccaggtctacgtgtgaaaagtaaaaccgatggccccggtcaccccagaggccgtggatgcacgcc

SEQ ID NO: 163956 - DNA, 75 bp, Artificial Sequence
  Synthetic
attatgtgttgcccatagccataaattcgtgtgagatggacatccagtctttacggcttgtccccaccccatgga

SEQ ID NO: 163957 - DNA, 75 bp, Artificial Sequence
  Synthetic
cttgatggccctgatctgggagatgagatagaggaccggatcgaaggagagctggatggtgttggagacggtgac

SEQ ID NO: 163958 - DNA, 75 bp, Artificial Sequence
  Synthetic
ctgatccgtgaaatcacccccatcgtgacgcatcgagaggcaaaaatctcccggattaaaaaccggctctttacc

SEQ ID NO: 163959 - DNA, 75 bp, Artificial Sequence
  Synthetic
tttcggggcattggtgtaacaataaactggctaaacttacatcacgtgtatgtggtttttcatgcagcatacaga

SEQ ID NO: 163960 - DNA, 75 bp, Artificial Sequence
  Synthetic
ttagaggggcaggtagttattggctccgagattctagaaacacgtgtcccgctgacgcagggggccttgcttccc

SEQ ID NO: 163961 - DNA, 75 bp, Artificial Sequence
  Synthetic
aaggggaaaggaggacatgcgagaattggcagacacctttacccagcccttcacacaccacacaggtagcgaggc

SEQ ID NO: 163962 - DNA, 75 bp, Artificial Sequence
  Synthetic
accccatttctgacacgcagcggtgctctataccgcttcgtcacctgttgcaactgcaccctgcccaatatctcc

SEQ ID NO: 163963 - DNA, 75 bp, Artificial Sequence
  Synthetic
gttccttgggattccactggccccggcaggtggcctggccggccaagcatagaaacccttgaagcgtgggggggt

SEQ ID NO: 163964 - DNA, 75 bp, Artificial Sequence
  Synthetic
agggcagacggatgtcaggtcgggcccggacccggcccggaggctggtggccctcctgcgaagggaagatggggc

SEQ ID NO: 163965 - DNA, 75 bp, Artificial Sequence
  Synthetic
caggttcttcatcattaacatagcgtttattgaacatgaaaataagcaaacattgttacataacagttaactgta

SEQ ID NO: 163966 - DNA, 75 bp, Artificial Sequence
  Synthetic
cctgcgtcctcttagggtgccacatcctgttcaacgtggtggttggacatgcggaggtttatcaattgtgggata

SEQ ID NO: 163967 - DNA, 75 bp, Artificial Sequence
  Synthetic
cattgttacataacagttaactgtagtgtcaaaaaagataagtagagtataactcttaccatttcctcctccccc

SEQ ID NO: 163968 - DNA, 75 bp, Artificial Sequence
  Synthetic
gcggaggtttatcaattgtgggatatggatagagggtggtgatcttggtgtaattaaacaagagcacacacccac

SEQ ID NO: 163969 - DNA, 75 bp, Artificial Sequence
  Synthetic
gtgtcaaaaaagataagtagagtataactcttaccatttcctcctccccccgagtctgggctgcagtataggctc

SEQ ID NO: 163970 - DNA, 75 bp, Artificial Sequence
  Synthetic
acctgtggcgggaagccgtgataaatactggaaaccgcacgaatcgtgtgttggcacgcaaggtgccggatgaat

SEQ ID NO: 163971 - DNA, 75 bp, Artificial Sequence
  Synthetic
gttatttctttagtatcttgtccttgtgttattttaatgaagagcgtgaagcaccgcttgcaaattacgtgtgtg

SEQ ID NO: 163972 - DNA, 75 bp, Artificial Sequence
  Synthetic
cctgtttgatttctccaagagaagcatcgcccactccaaaaaccgacacgagtgcgcgcttctgggtcacagaca

SEQ ID NO: 163973 - DNA, 75 bp, Artificial Sequence
  Synthetic
ggcctctggggtgaccggggccatcgggtttacttttcacacgtagacctgggaagtttgataggactgtaccag

SEQ ID NO: 163974 - DNA, 75 bp, Artificial Sequence
  Synthetic
ccgggagacttacctggctgagcatgtgcgtgtccagcagctgaaaatccgcatggagcccccggccccatacac

SEQ ID NO: 163975 - DNA, 75 bp, Artificial Sequence
  Synthetic
cccaattgtagatatggccagcactttcaatttctgccgcaaaagataacattgggtatcagctatctgctgcaa

SEQ ID NO: 163976 - DNA, 75 bp, Artificial Sequence
  Synthetic
aaaaatgcctttaacaagctgcaggaaaaaggaatttacaaagccatgagtgaatttgacatttttattaactac

SEQ ID NO: 163977 - DNA, 75 bp, Artificial Sequence
  Synthetic
gagacggtggtggggggagcatggcgttattcttggcgcgccacaccttatctggcacgggtgctggctgtcacg

SEQ ID NO: 163978 - DNA, 75 bp, Artificial Sequence
  Synthetic
ttggcacgcaaggtgccggatgaatactggtacctgctttaccgggccctggcacgggtgggcttcccggcagag

SEQ ID NO: 163979 - DNA, 75 bp, Artificial Sequence
  Synthetic
ggccggggccgcggaggccggggccgcggaggccggggccgcggaggccggggccgcagaggccggggccgcaga

SEQ ID NO: 163980 - DNA, 75 bp, Artificial Sequence
  Synthetic
cattggcatgttattcttgtaagcccccatggccggcctaaaactcacgaccactgtttggttaaattataatgc

SEQ ID NO: 163981 - DNA, 75 bp, Artificial Sequence
  Synthetic
tcatggccaaacaatgccacactccgggagatcaggacgagggccgccaccaacctcacccaccacccacatcta

SEQ ID NO: 163982 - DNA, 75 bp, Artificial Sequence
  Synthetic
gtccccgggtcccgcctctccgcaccccctcagtcgcgtactctgtggagttttacggggggcataaagtcgatg

SEQ ID NO: 163983 - DNA, 75 bp, Artificial Sequence
  Synthetic
attgggtatcagctatctgctgcaacagaatttaaaagtgggggccgggtcattggcatgttattcttgtaagcc

SEQ ID NO: 163984 - DNA, 75 bp, Artificial Sequence
  Synthetic
aggcccaatgaccctgattcatataaagtgctgagaaaatgtatagattagtgtcttcctctggagataaataaa

SEQ ID NO: 163985 - DNA, 75 bp, Artificial Sequence
  Synthetic
ccagctaaaccttctggatccaggaatgttgtcttcaattaatgtagaccagccgccctgttgatgaatccaacc

SEQ ID NO: 163986 - DNA, 75 bp, Artificial Sequence
  Synthetic
atgttgtcttcaattaatgtagaccagccgccctgttgatgaatccaaccatccaggccttcgctggcttctaac

SEQ ID NO: 163987 - DNA, 75 bp, Artificial Sequence
  Synthetic
gccctgcgccccggtaaccgctcacggtctctttgtctgtttttgcatgaccggcctgatgtcacaggggccgtc

SEQ ID NO: 163988 - DNA, 75 bp, Artificial Sequence
  Synthetic
cgaaaggcggagaggtgtttctcttgctgctagctccaacacaggatgcagggtaccatttccatgcacacgact

SEQ ID NO: 163989 - DNA, 75 bp, Artificial Sequence
  Synthetic
cctcagccgctgcatgcacgaggcgctgtacaccgggctggcacaggcgctgcgcgtccggcgggtgggcaagct

SEQ ID NO: 163990 - DNA, 75 bp, Artificial Sequence
  Synthetic
atttgcatgaaggcaggaaacacagggcacattagcaatgttctaggcacgcaattgcctacattaggcctaaag

SEQ ID NO: 163991 - DNA, 75 bp, Artificial Sequence
  Synthetic
agggagaccatcacttaagttacaggccgcccttgagcgtcaagccgctgcgggctggcagccttcaacagggtc

SEQ ID NO: 163992 - DNA, 75 bp, Artificial Sequence
  Synthetic
tggaagagcccccgcaggggtctctagacctcgagtccggggagaacggtggccagacggcgcttgcgtctgcca

SEQ ID NO: 163993 - DNA, 75 bp, Artificial Sequence
  Synthetic
gcaattgcctacattaggcctaaagccacctgaggaacaactttggcctgagcaattccttatagctggtgtatt

SEQ ID NO: 163994 - DNA, 75 bp, Artificial Sequence
  Synthetic
agcaattccttatagctggtgtatttttggccctttctacgcactcgtgtcagctccttccccccacccgccgtg

SEQ ID NO: 163995 - DNA, 75 bp, Artificial Sequence
  Synthetic
gggggcgacaaggcgtcctccccgtcccaccgccgaagatgagtaacggcgactgggggcaaagccagcgccccc

SEQ ID NO: 163996 - DNA, 75 bp, Artificial Sequence
  Synthetic
ggggaaccggccccatgcgcggaatcaggaccatggatgtgaatgcccccgggggcgggagtggaggctcggccc

SEQ ID NO: 163997 - DNA, 75 bp, Artificial Sequence
  Synthetic
gtaaaacgagagattacccttctcctggcccacctgcgcaaaaagacagcccccatccactgccgtgatgctcaa

SEQ ID NO: 163998 - DNA, 75 bp, Artificial Sequence
  Synthetic
tccgcatcctaggcacggcctcgtgcaaccaggcccactgcaagtttggccgctttgccggcatccagtgtgtca

SEQ ID NO: 163999 - DNA, 75 bp, Artificial Sequence
  Synthetic
cgctttgccggcatccagtgtgtcagcaactgcgtcctctacctgggggtcttacgcggctggcggcggcagccg

SEQ ID NO: 164000 - DNA, 75 bp, Artificial Sequence
  Synthetic
aggcctgctgccactcgtggtttagcagcttgaaaaatggcaaccggcagctcctcttccgggtatggctgttgt

SEQ ID NO: 164001 - DNA, 75 bp, Artificial Sequence
  Synthetic
cctgggacccctgccgccgaccctgcttctcgggctggggtgggccagacgtgaccggaaccaacggtccgggaa

SEQ ID NO: 164002 - DNA, 75 bp, Artificial Sequence
  Synthetic
ggaggtcccaggcctagcgtcacgcactcggggtgtcttggggactcacacgttagggggcgcggtggttgggac

SEQ ID NO: 164003 - DNA, 75 bp, Artificial Sequence
  Synthetic
ctgtttgtgcatttttctcagatctggttaaatttgaaaatgtcaccgcccatgcaggtgctagagtgaatctca

SEQ ID NO: 164004 - DNA, 75 bp, Artificial Sequence
  Synthetic
agtgatgaaacaggcaactccggggctgatcaggttaataaggagccgtccttattcttgctcatatttccaccc

SEQ ID NO: 164005 - DNA, 75 bp, Artificial Sequence
  Synthetic
attcacggggccgtgcacctgccatcgggacagattgtcttccacaccatccacagccccactcttgcctcggcg

SEQ ID NO: 164006 - DNA, 75 bp, Artificial Sequence
  Synthetic
ggtaagtaatttgttgccgttggtttcagcgcatcgacacacgagccatagaccagtttttcggatcccagattt

SEQ ID NO: 164007 - DNA, 75 bp, Artificial Sequence
  Synthetic
ttaatcccgcccgtaggacccctttgcccagccccgcctggtgttattaccactttagacgttgctccacctcta

SEQ ID NO: 164008 - DNA, 75 bp, Artificial Sequence
  Synthetic
ccagatgcatcatccccaaaggagggctgctgcccgaagggaggtgatggggatatctccgttccagccctgtca

SEQ ID NO: 164009 - DNA, 75 bp, Artificial Sequence
  Synthetic
ccagacagtcccctgcttcctaaatttcaagagctgaaccagaataatctccccaatgatgtttttcgggaggct

SEQ ID NO: 164010 - DNA, 75 bp, Artificial Sequence
  Synthetic
agtggggcctatgcctcccaccgatattccgccgtctaaacgagcgaagatcgaggcctatacagagcccgagat

SEQ ID NO: 164011 - DNA, 75 bp, Artificial Sequence
  Synthetic
tcggaggacatctcgcgcttgacgggggcagcttggaggctgtgctcccgcccgctcctgtacgacgcagagacc

SEQ ID NO: 164012 - DNA, 75 bp, Artificial Sequence
  Synthetic
aatctgggaggaaattttaacacctgaccagcgtgtttcatttatggaattcctaggatttttgcagagaacaat

SEQ ID NO: 164013 - DNA, 75 bp, Artificial Sequence
  Synthetic
aagagagagctgctgagataggtggtgctggcctcgtatagcgccgagcctcggacctcacggtcactagagatt

SEQ ID NO: 164014 - DNA, 75 bp, Artificial Sequence
  Synthetic
tgggcaccactagtatccaaacaccgtggatcgatgacaatcctagcacggagacggcacaggcttggaatgccg

SEQ ID NO: 164015 - DNA, 75 bp, Artificial Sequence
  Synthetic
gaccagaaagcggcgggtggccaggcccaacgactccgccgtcgtgctgtatctcagggtgaagaggagtgaaaa

SEQ ID NO: 164016 - DNA, 75 bp, Artificial Sequence
  Synthetic
tgtattacccgccatccggtagcgcacgctatcccgcgccttttcaagcactttcgttttcgcaaagcgtggcct

SEQ ID NO: 164017 - DNA, 75 bp, Artificial Sequence
  Synthetic
tttgagccacccacagtaaccacccagcgccaatctgtctacatagaagaagaagaggatgaagactaagtcaca

SEQ ID NO: 164018 - DNA, 75 bp, Artificial Sequence
  Synthetic
cctcattcatgacctgccccactttcacccgcgccgtgcgcgtgtcggtggacaatgacgttacgcagcagctgc

SEQ ID NO: 164019 - DNA, 75 bp, Artificial Sequence
  Synthetic
cattaaggtgtgtaaccaggtgggtggtacctggaggtcattctattgggataacgagaggaggaggggctagag

SEQ ID NO: 164020 - DNA, 75 bp, Artificial Sequence
  Synthetic
cgagacagctaccagtcacgggtcggcgcaagtcccagaacccccaatcatccacctagcagctcagggagcata

SEQ ID NO: 164021 - DNA, 75 bp, Artificial Sequence
  Synthetic
cttcttccctgctcgccggggagtagggggggcttacaggggagggccggagccggggccggggcctgccacagg

SEQ ID NO: 164022 - DNA, 75 bp, Artificial Sequence
  Synthetic
cacctacgcccttgccccctgtatctccaggggaccaactcccaggtgtttctagcgacgggcgagtggcgtgtg

SEQ ID NO: 164023 - DNA, 75 bp, Artificial Sequence
  Synthetic
tgacccaccttaaagaaggccacagaaacctcaaacatggtagtcagcgtttccgtgtccagttctggctcccgg

SEQ ID NO: 164024 - DNA, 75 bp, Artificial Sequence
  Synthetic
taaagttttgcctgaacctgtggttgggcaggtacatgccaacaaccttctaagcacccgcgcttgtgttttgct

SEQ ID NO: 164025 - DNA, 75 bp, Artificial Sequence
  Synthetic
taagcacccgcgcttgtgttttgctttatctgccgccatcatgcctacattctatcttgcgttacatgggggaca

SEQ ID NO: 164026 - DNA, 75 bp, Artificial Sequence
  Synthetic
tcatcagtgttgtcagggtcctgaggcagcgggtcatgtgggccattgtcatcggggggcaggccacgccccctc

SEQ ID NO: 164027 - DNA, 75 bp, Artificial Sequence
  Synthetic
tgggggtgggcagggcagctgcatcttgggccctctgtgcttgcgttttttgggggcgcggtgccaatgcaccaa

SEQ ID NO: 164028 - DNA, 75 bp, Artificial Sequence
  Synthetic
gccaacgtcccagcccagattctcaaacctctccatgctagtactgcagtgggcctctctggcggtgctgaccct

SEQ ID NO: 164029 - DNA, 75 bp, Artificial Sequence
  Synthetic
gtgctggttggggaaggagctccagggaatctttgggccatggccttggggagcttcccggagaccggtctgggc

SEQ ID NO: 164030 - DNA, 75 bp, Artificial Sequence
  Synthetic
gggatgggaaagccggacggcgcttctcccgggtcgaacgctggagtagcggaggctgctgcgccggcggccacc

SEQ ID NO: 164031 - DNA, 75 bp, Artificial Sequence
  Synthetic
tatcccctcagcaaccaatggaggggccgttggtaccagagcagcagatgttccctggtgccccctttagcaagg

SEQ ID NO: 164032 - DNA, 75 bp, Artificial Sequence
  Synthetic
ccctcccctcttcatccccatccccggcctaggtcacacccccggggtccccgctccctccatgccaccaagggc

SEQ ID NO: 164033 - DNA, 75 bp, Artificial Sequence
  Synthetic
aagccggagccgggcggcgtcaaaggccaggacgggcacagccgcgacggggggcgtttgtcccccgctggcctc

SEQ ID NO: 164034 - DNA, 75 bp, Artificial Sequence
  Synthetic
ggcctaggtcacacccccggggtccccgctccctccatgccaccaagggcgtcgggcagcgcagcgcctcagact

SEQ ID NO: 164035 - DNA, 75 bp, Artificial Sequence
  Synthetic
ccgctccctccatgccaccaagggcgtcgggcagcgcagcgcctcagactcccaagaggaaaaagggattgggca

SEQ ID NO: 164036 - DNA, 75 bp, Artificial Sequence
  Synthetic
tcgtgcccagcccaatccatatagcatacagggtgtttccggaggatactaaatcaaagaacaaagtatatcttt

SEQ ID NO: 164037 - DNA, 75 bp, Artificial Sequence
  Synthetic
agccctcaacggggccgcgggtgccccctggctaatgggttgaattaaggggaggtcaaagtactgtggctgcat

SEQ ID NO: 164038 - DNA, 75 bp, Artificial Sequence
  Synthetic
gcttgcatcacaatttaaagggaagttaagatgggggattaccttctaagaggaaatgacaagccacagacatcc

SEQ ID NO: 164039 - DNA, 75 bp, Artificial Sequence
  Synthetic
actgcagcagcagcccccaccgccacgactctttctcctcctccaactcagcagcagcccccgcaatcagccgcc

SEQ ID NO: 164040 - DNA, 75 bp, Artificial Sequence
  Synthetic
cgactctttctcctcctccaactcagcagcagcccccgcaatcagccgccccggctcgttctcctcctccaactc

SEQ ID NO: 164041 - DNA, 75 bp, Artificial Sequence
  Synthetic
ctgccgaaagtgacctagcacgacgtgccatcaggaaggctgtttcgatcttttggttttggtctgatattcgtg

SEQ ID NO: 164042 - DNA, 75 bp, Artificial Sequence
  Synthetic
ggaggagcgctccttgtcctctattcctttgctctcatgcttattattatcattctcatcatctttatcttcaga

SEQ ID NO: 164043 - DNA, 75 bp, Artificial Sequence
  Synthetic
cagatagtccagaaccacggtccccgactgtattttataacattccacctatgccattacccccctcacaattgc

SEQ ID NO: 164044 - DNA, 75 bp, Artificial Sequence
  Synthetic
tgactcaaaactgtttactttgaggttatgcgtgcggtaacccatacgccaggatctgcaagatgacaggagctt

SEQ ID NO: 164045 - DNA, 75 bp, Artificial Sequence
  Synthetic
aaaatggttaattaaccacatcttaaattgccaccttaggcaaattgaaaataggcaggctgaagaattgcacaa

SEQ ID NO: 164046 - DNA, 75 bp, Artificial Sequence
  Synthetic
gtcatctttatagagtggcctttcaggggcttctttgatatccacagaagtgccaacaccttctttttagtagtc

SEQ ID NO: 164047 - DNA, 75 bp, Artificial Sequence
  Synthetic
ataggcaggctgaagaattgcacaataccctaaacaggtaagaggaattagtgacattttatgaatttttttaca

SEQ ID NO: 164048 - DNA, 75 bp, Artificial Sequence
  Synthetic
ccgctatggagagtgacagcggcggcggtagcggaggggcagacgcccagccgcccctggcagaggtggacgggg

SEQ ID NO: 164049 - DNA, 75 bp, Artificial Sequence
  Synthetic
gccgcatgaaactgggcgagaccgaggtcaccaagcaggaacacctgagcgtggtgaagcctctaacgctgtctg

SEQ ID NO: 164050 - DNA, 75 bp, Artificial Sequence
  Synthetic
ggctcgcccgcgtgacgcgtcagttgctgctgtctggggacgaccccgctgcccgcctgcgcgcgctgatgcatc

SEQ ID NO: 164051 - DNA, 75 bp, Artificial Sequence
  Synthetic
aagttggcataatgcacaaaggttgtaacaatcaccagggaatagtccccgctttgggcactggttaaggatggg

SEQ ID NO: 164052 - DNA, 75 bp, Artificial Sequence
  Synthetic
ggcgggcgcccattagaatctgctcggctgccagtaagttgccagcaaacaggaacacaaacaaaccaagggtgt

SEQ ID NO: 164053 - DNA, 75 bp, Artificial Sequence
  Synthetic
tattgctctctatctacaacaaaactggtggactctattggttgatctcctttggctcctcctgtttatggccat

SEQ ID NO: 164054 - DNA, 75 bp, Artificial Sequence
  Synthetic
gcaccaactgcggcaaatggcggtgttatgaaggaaaaggatgggagcctctctgttgctgttgacctgtcactt

SEQ ID NO: 164055 - DNA, 75 bp, Artificial Sequence
  Synthetic
cgtaggccggatgtgtgccgaccagcagcgccatcatctcccgttgttccaatagaataacttcccggtctgtgg

SEQ ID NO: 164056 - DNA, 75 bp, Artificial Sequence
  Synthetic
agttggatcactggagcctgcgttgggttcacatccacaaatctaggctggcgagtatggacatccaagggatcg

SEQ ID NO: 164057 - DNA, 75 bp, Artificial Sequence
  Synthetic
aacattgcgagaatagccggacatacctaccaggaacaggccatcgtctacgacccggcctctaaccgggaagtg

SEQ ID NO: 164058 - DNA, 75 bp, Artificial Sequence
  Synthetic
acctgtgtcacattaccttgatctccataatctggtgggtcctcggagccagatgcccccccggcatcggcttgc

SEQ ID NO: 164059 - DNA, 75 bp, Artificial Sequence
  Synthetic
agatgcccccccggcatcggcttgctgtgctctgctgagccacgctttcttcattattcaggtgtaactgtttta

SEQ ID NO: 164060 - DNA, 75 bp, Artificial Sequence
  Synthetic
cctcgagcaggggctaataaggagtagggaccgatctgctgtgctaaatctgctggaattcttaaaggactggtc

SEQ ID NO: 164061 - DNA, 75 bp, Artificial Sequence
  Synthetic
agataagatgtttcagtgacccttctgcaaatatgcgaggtctctctcatggaatatgaaataaaatcacaaaca

SEQ ID NO: 164062 - DNA, 75 bp, Artificial Sequence
  Synthetic
ccctgacaacactgatgacaatggcccacaggaccctgacaacacagcccccccgcacagagcggcgctacggcg

SEQ ID NO: 164063 - DNA, 75 bp, Artificial Sequence
  Synthetic
gggaaaaaggtttagctattccaccaacacgaccccaaggaaggcttgccaaaattggtgccttgctctcagcac

SEQ ID NO: 164064 - DNA, 75 bp, Artificial Sequence
  Synthetic
gcccactggtgtttatccggtcccaaatgtcaccacagaacacaggaggctggatttggcagcagcacttgtgct

SEQ ID NO: 164065 - DNA, 75 bp, Artificial Sequence
  Synthetic
cagtgggtggaatggagggggacacacttctacacctttgcttaggcctcatctggaggatcttgtagatccgga

SEQ ID NO: 164066 - DNA, 75 bp, Artificial Sequence
  Synthetic
atctggaggatcttgtagatccggaaactcgtcatcctgacacatgtgaacaacagctgacaccaccacccttct

SEQ ID NO: 164067 - DNA, 75 bp, Artificial Sequence
  Synthetic
gcgcctctgggctaaggcctgggacctttgccatcagttcggtccatgggatggtgtaatgcgaagcatgcccct

SEQ ID NO: 164068 - DNA, 75 bp, Artificial Sequence
  Synthetic
caccaggggcaccttccaaaaatagggaacaggcaggtttgattactggtacatgatttgtcaggtgggtcacaa

SEQ ID NO: 164069 - DNA, 75 bp, Artificial Sequence
  Synthetic
tggctgaaattccccagctggccgagagcgacgatggaaaatttgacctggaggcggcccgcagacgcctgaccg

SEQ ID NO: 164070 - DNA, 75 bp, Artificial Sequence
  Synthetic
cagaaattgtgcccgccgggtcggggctccattgccccatccagttggtggtgccgaaatcgtgatgaggagggg

SEQ ID NO: 164071 - DNA, 75 bp, Artificial Sequence
  Synthetic
ccaccttccccttgaacaggccactcgggggtccgagggcggggcctgccatggattgacaaatcaagaacctcg

SEQ ID NO: 164072 - DNA, 75 bp, Artificial Sequence
  Synthetic
tgggcgggcgccgcgcccccgacccccccgttcccctgaacgccagccgccatccaccgcccgcagcccccggag

SEQ ID NO: 164073 - DNA, 75 bp, Artificial Sequence
  Synthetic
cgggggtccgagggcggggcctgccatggattgacaaatcaagaacctcggtggcatcctggccaccctcctctt

SEQ ID NO: 164074 - DNA, 75 bp, Artificial Sequence
  Synthetic
tcaagagcttcacacggctcggaggtatcggacccctcgccactctcatcctcatcaataggtaacccaaaggca

SEQ ID NO: 164075 - DNA, 75 bp, Artificial Sequence
  Synthetic
tatcggacccctcgccactctcatcctcatcaataggtaacccaaaggcagcctggctgagatgatattggttaa

SEQ ID NO: 164076 - DNA, 75 bp, Artificial Sequence
  Synthetic
ggcgctacggcgggcgggcggcggggggtcggggtccgcgggctccgggggctgcgggcggtggatggcggcgga

SEQ ID NO: 164077 - DNA, 75 bp, Artificial Sequence
  Synthetic
agccaagggacgcgtgttatcccaggctgcccaccctgaggatttccccccaaaatcctcctaccctctctttat

SEQ ID NO: 164078 - DNA, 75 bp, Artificial Sequence
  Synthetic
gatccgtgttgaccaccgctgatttcatgtccggggactgcagggcctggcgcgtctgcgcgagggccgaacgga

SEQ ID NO: 164079 - DNA, 75 bp, Artificial Sequence
  Synthetic
cgataatgtcgactgctgcgaaggtttgggccgtcttccagtaggtgttgggggtccccaatcatgaggttaggc

SEQ ID NO: 164080 - DNA, 75 bp, Artificial Sequence
  Synthetic
caaaatcctcctaccctctctttatgccatgtgtgttgttggcttgtgttagtgctatgtaatgcgttgccgcca

SEQ ID NO: 164081 - DNA, 75 bp, Artificial Sequence
  Synthetic
ggtggcagcctgtttatagatgtgcagtaccccttaatgttaggtctgctttagggctgccaggtggcgcaatct

SEQ ID NO: 164082 - DNA, 75 bp, Artificial Sequence
  Synthetic
cccaaagcatccagctgatgttggaccacgtcagtgccttggctagggggggcaccttggaacatccactgctcg

SEQ ID NO: 164083 - DNA, 75 bp, Artificial Sequence
  Synthetic
gcgctacccctggcctaacactctggctcagggcggcacctgggaacatccaccgctcgggtaccaacggcccct

SEQ ID NO: 164084 - DNA, 75 bp, Artificial Sequence
  Synthetic
cctgggtagggtaaaggggcacgatgtgtgccggctacccggagagtttccagtattagatgtcacggcagcctg

SEQ ID NO: 164085 - DNA, 75 bp, Artificial Sequence
  Synthetic
ccatcggttgctgagggagaaaatgggccgcggatgccccctggttaatgggttcagttaaggggatgtcaaaat

SEQ ID NO: 164086 - DNA, 75 bp, Artificial Sequence
  Synthetic
gatgccccggatccacttggcggctgccagggatttccggtagggccatgagccgttcccggccgctgcccgggc

SEQ ID NO: 164087 - DNA, 75 bp, Artificial Sequence
  Synthetic
agtttgagacagtcgcgaaaaaacagaaggagctcgagaccaccagagaaaacgaaaagcgcctccgcaccatcc

SEQ ID NO: 164088 - DNA, 75 bp, Artificial Sequence
  Synthetic
gccgctcccgcctctccttgtcttcctgttctcggagcttctccttttccttgcgcccggtctccataagctgcc

SEQ ID NO: 164089 - DNA, 75 bp, Artificial Sequence
  Synthetic
aacgaaaagcgcctccgcaccatcctggacgacatcgaggcaatgttgggcctggccggtgtggcctcggcccca

SEQ ID NO: 164090 - DNA, 75 bp, Artificial Sequence
  Synthetic
atctaattgttgacacggatagtgttggaaacccgtcactctcagtaattccctcgaatccctaccaggaacaac

SEQ ID NO: 164091 - DNA, 75 bp, Artificial Sequence
  Synthetic
cctgacattttcgccagccgccgggcgggccggcctcctttcctggaaatccagccatggatcccacccgaggtc

SEQ ID NO: 164092 - DNA, 75 bp, Artificial Sequence
  Synthetic
ggcgcccccatctctcccgcctctccctctgcgacacccgccaaccacgacaaccccgaagccacgccaccgctg

SEQ ID NO: 164093 - DNA, 75 bp, Artificial Sequence
  Synthetic
tgtgtgccctctccacgcacgacctggcaaaatttcacagtctccccccggctagaaaggcggcaggtaagcgag

SEQ ID NO: 164094 - DNA, 75 bp, Artificial Sequence
  Synthetic
gccgacaccgcggccctcaccatccccgtcatagaaaagtacatcgcaaatgcagggtcgatagtcggggccgca

SEQ ID NO: 164095 - DNA, 75 bp, Artificial Sequence
  Synthetic
tgcagggtcgatagtcggggccgcaaagaaccccacgtacatccgcctacgtgacactatacagcagattgttcg

SEQ ID NO: 164096 - DNA, 75 bp, Artificial Sequence
  Synthetic
aatgctttggatggctaattatattgtaagacaatcacggggtgaccggggccttattttgccacaaggcccaca

SEQ ID NO: 164097 - DNA, 75 bp, Artificial Sequence
  Synthetic
gcccccggccgcgccagccaagcccccaaggggggcggggagcgggcaatggagcgtgacgaagggccccagggc

SEQ ID NO: 164098 - DNA, 75 bp, Artificial Sequence
  Synthetic
aacagcccctcaggccatgttggtacagccacatgtcccccctctacgcccgacagcacccaccattttgtcacc

SEQ ID NO: 164099 - DNA, 75 bp, Artificial Sequence
  Synthetic
ctgaaatccatcaccttctacaccatcgataactacattgcctccttcgaggagagcatagaccacctctatcgt

SEQ ID NO: 164100 - DNA, 75 bp, Artificial Sequence
  Synthetic
cgacagcacccaccattttgtcacctctgtcacaaccgaggcttacccctccacaaccactcatgatgccaccaa

SEQ ID NO: 164101 - DNA, 75 bp, Artificial Sequence
  Synthetic
ggcctacccctcctacccctctgccacctgcaacactaacggtgccaccaaggcctacccgtcctaccactctgc

SEQ ID NO: 164102 - DNA, 75 bp, Artificial Sequence
  Synthetic
tggttgatagtccgagtgacggtcgccattgccccaatatgggtcctcataaggcggtgggggctcttcattaga

SEQ ID NO: 164103 - DNA, 75 bp, Artificial Sequence
  Synthetic
agggggtcgcagggagactctgtttccagccagagggtgccggcgtatttcgccggccctgccgccgccagaaat

SEQ ID NO: 164104 - DNA, 75 bp, Artificial Sequence
  Synthetic
cggtgaatctgctcccaggtctactggcggtctatgatgcgacggtcacaggtcaggctccagaggatgccctga

SEQ ID NO: 164105 - DNA, 75 bp, Artificial Sequence
  Synthetic
tgccccatccagttggtggtgccgaaatcgtgatgaggaggggcaggttgttggtcaagggatgcttaacgaaaa

SEQ ID NO: 164106 - DNA, 75 bp, Artificial Sequence
  Synthetic
ggtcaggctccagaggatgccctgagactactctctgggctgcagaatcagctctcccaaacgctcatcccaggg

SEQ ID NO: 164107 - DNA, 75 bp, Artificial Sequence
  Synthetic
agcaccccaaatgatccagatagtccagaaccacggtccccgactgtattttataacattccacctatgccatta

SEQ ID NO: 164108 - DNA, 75 bp, Artificial Sequence
  Synthetic
ttataacattccacctatgccattacccccctcacaattgccaccaccagcagcaccagcacagccacctccagg

SEQ ID NO: 164109 - DNA, 75 bp, Artificial Sequence
  Synthetic
gccccacgcccatgccccctctataccccccccgatgcccccggggggtctttcctggggggccttatttgtcag

SEQ ID NO: 164110 - DNA, 75 bp, Artificial Sequence
  Synthetic
cagcaccagcacagccacctccaggggtcatcaacgaccaacaattacatcatctaccctcggggccaccatggt

SEQ ID NO: 164111 - DNA, 75 bp, Artificial Sequence
  Synthetic
ggtcatcaacgaccaacaattacatcatctaccctcggggccaccatggtggccacccatctgcgaccccccgca

SEQ ID NO: 164112 - DNA, 75 bp, Artificial Sequence
  Synthetic
ggccccaagcgccaggcccctggcagcctccaccacgatcttgagctggcgcgggtcggtgtggcccctggcctg

SEQ ID NO: 164113 - DNA, 75 bp, Artificial Sequence
  Synthetic
aaggctttaagcccgccaccgaggaacagctcgaggcctttctggacactgcccccaacaaagagctcaagcgac

SEQ ID NO: 164114 - DNA, 75 bp, Artificial Sequence
  Synthetic
accctctaagactcaaggccagagccggggacagagcagggggaggggcaggggcaggggcaggggcaggggcaa

SEQ ID NO: 164115 - DNA, 75 bp, Artificial Sequence
  Synthetic
catctaccctcggggccaccatggtggccacccatctgcgaccccccgcaaccctctaagactcaaggccagagc

SEQ ID NO: 164116 - DNA, 75 bp, Artificial Sequence
  Synthetic
ccgggtcacgtttgccggggtcagccctggggcccttcgtcacgctccgctgcccgcgccccgccccccgggggc

SEQ ID NO: 164117 - DNA, 75 bp, Artificial Sequence
  Synthetic
gagttgtgtttcaggtctgtgtcctgttttgcggtgggttatttcttccctcagtgtttgccagcttatttcccc

SEQ ID NO: 164118 - DNA, 75 bp, Artificial Sequence
  Synthetic
aggagaggcgggagcggcgagcgcgagaggcgaatgaggcctgggccagaattaggaaggcgctgggggcacgcc

SEQ ID NO: 164119 - DNA, 75 bp, Artificial Sequence
  Synthetic
tggggtccaacgtggccagagccaacctcagctcctccatgccatccatggagttctgggccatgccctcgactt

SEQ ID NO: 164120 - DNA, 75 bp, Artificial Sequence
  Synthetic
tgctttgtcggcccctgctgaccagcaggagcccttagtgccagctgcatgggagtgggcagcacctgaggaggt

SEQ ID NO: 164121 - DNA, 75 bp, Artificial Sequence
  Synthetic
gggagtgggcagcacctgaggaggtggcgtgggagtgggcgccccccgaggcctctgccggggaacgggcggcac

SEQ ID NO: 164122 - DNA, 75 bp, Artificial Sequence
  Synthetic
tgactggaacaccctgctggcctccctgctgccagacaatacggactcagccgcggcagcagcggcggcagtagc

SEQ ID NO: 164123 - DNA, 75 bp, Artificial Sequence
  Synthetic
atgaaccggagtcccataatagcccagaggctcccattctcttccccgatgattggtatcctccatctatagacc

SEQ ID NO: 164124 - DNA, 75 bp, Artificial Sequence
  Synthetic
ttcatggctagaatcgtcggtagcttgttgagggtgcgggagggagtcatcgtggtggtgttcatcagtgtgtcg

SEQ ID NO: 164125 - DNA, 75 bp, Artificial Sequence
  Synthetic
agaggctcccattctcttccccgatgattggtatcctccatctatagaccccgcagacttagacgaaagttggga

SEQ ID NO: 164126 - DNA, 75 bp, Artificial Sequence
  Synthetic
tattgggaataacgagggtgaggagggagagactgcgatccctgctcgtggacgatggtggtgcggcggagagaa

SEQ ID NO: 164127 - DNA, 75 bp, Artificial Sequence
  Synthetic
gacgatggtggtgcggcggagagaatggaggccgtggaacccggctggttcacggagatcgagaccggccctctg

SEQ ID NO: 164128 - DNA, 75 bp, Artificial Sequence
  Synthetic
ttccagctctcgtcgtccaggaccaaggggacgtccacgtgcgggcccctgtagatggaattatcctcgggttct

SEQ ID NO: 164129 - DNA, 75 bp, Artificial Sequence
  Synthetic
cccccgcggctaccgccaaagaaggaggaggagggcgaggagcggaggaagcggccggggccctctttcgtgcca

SEQ ID NO: 164130 - DNA, 75 bp, Artificial Sequence
  Synthetic
gacctgctcttccagcgcccggacctcggccgcctcggcctcggtcagcagctccgagaagaagtcccccgtgga

SEQ ID NO: 164131 - DNA, 75 bp, Artificial Sequence
  Synthetic
gacctgctcttccagcgcccggacctcggccgcctcggcctcggtcagcagctccgagaagaagtcccccgtggt

SEQ ID NO: 164132 - DNA, 75 bp, Artificial Sequence
  Synthetic
gacctgctcttccagcgcccggacctcggccgcctcggcctcggtcagcagctccgagaagaagtcccccgtggc

SEQ ID NO: 164133 - DNA, 75 bp, Artificial Sequence
  Synthetic
gacctgctcttccagcgcccggacctcggccgcctcggcctcggtcagcagctccgagaagaagtcccccgtggg

SEQ ID NO: 164134 - DNA, 75 bp, Artificial Sequence
  Synthetic
ccgcccaggctggcctcggactcggcgctctggcctaagaagccccagctgctgacaaggcgagagcgggacgat

SEQ ID NO: 164135 - DNA, 75 bp, Artificial Sequence
  Synthetic
cgttgccaaaacctggtgtaagggccggcacccgcaacatggggaaaacataaccgccgccatcccatggggagg

SEQ ID NO: 164136 - DNA, 75 bp, Artificial Sequence
  Synthetic
cgcaagctgaatgagtgggtgtttggtggcagggctgctggtggcagacagctggccgacgagctaaagatcgtg

SEQ ID NO: 164137 - DNA, 75 bp, Artificial Sequence
  Synthetic
acaacgtcaggcgcatcaccggtgacaccaagtccatctccacgggacaacggcacagaaagtaaggcccccgac

SEQ ID NO: 164138 - DNA, 75 bp, Artificial Sequence
  Synthetic
ccaacccggggtctgagcattccatgggcagcagggacactgcactaccgccaggtccaggggcagccggggttc

SEQ ID NO: 164139 - DNA, 75 bp, Artificial Sequence
  Synthetic
tgatggcgaaggcccacgagatggcggcaagcactcggcggggcttttacacggctctggaggccgtcctctcca

SEQ ID NO: 164140 - DNA, 75 bp, Artificial Sequence
  Synthetic
tccagtggggcttctgagggattggtaccagaagagtcagactcaagagatcagcaaccttgggggcaaagcagg

SEQ ID NO: 164141 - DNA, 75 bp, Artificial Sequence
  Synthetic
cctggcttagcagcctccaagttttacaagacgtcctggtccaagtctcgccggttttcagcagcctgttgtagc

SEQ ID NO: 164142 - DNA, 75 bp, Artificial Sequence
  Synthetic
ggtcacgcgacgaagcccccgacgatgaactccggagcttgctctcctccccgcccaaagcccctgtccaggctc

SEQ ID NO: 164143 - DNA, 75 bp, Artificial Sequence
  Synthetic
ggtgatgaaaacagaggctggatgcagcgcatcaggcgaaggcggagaagacgggctgccttgtccggccatctt

SEQ ID NO: 164144 - DNA, 75 bp, Artificial Sequence
  Synthetic
tggcctgacatctgtgacgcacggtcatgcacatccatataaattcttcgatgttcaggttttgctcaaggaata

SEQ ID NO: 164145 - DNA, 75 bp, Artificial Sequence
  Synthetic
tcccatttttagcgatctcttacctcacatgaagaggctagtgcctacgtgactccctgctcctgccagtttccc

SEQ ID NO: 164146 - DNA, 75 bp, Artificial Sequence
  Synthetic
ttagacacggaagacaatgtgccgccatggttgcctccacacgacatcacaccatatatcgcaaggaatatcagg

SEQ ID NO: 164147 - DNA, 75 bp, Artificial Sequence
  Synthetic
agagaactggccctcgttggcattctactaggaaacggcgagcagggtgaacacttgggcacggagagtgccctg

SEQ ID NO: 164148 - DNA, 75 bp, Artificial Sequence
  Synthetic
gctgatggtgggagctgctgagcaggaggaggagccggggtagctgatggcaggggctgctgctgaggaggaaga

SEQ ID NO: 164149 - DNA, 75 bp, Artificial Sequence
  Synthetic
aagggatcgtcaccaccattgtgctcctgctcatgaggttcctcttcctctcttgcagcggcatctaaattctct

SEQ ID NO: 164150 - DNA, 75 bp, Artificial Sequence
  Synthetic
attcgacgtggacccttggttgcggagggcggtgtgggttggcgacattggcttctgacatctcccagccaatcc

SEQ ID NO: 164151 - DNA, 75 bp, Artificial Sequence
  Synthetic
tcttgcagcggcatctaaattctcttccactggcccagattgaggatcatcctcactggccgcagagagttcaaa

SEQ ID NO: 164152 - DNA, 75 bp, Artificial Sequence
  Synthetic
ggagaaggagcccgggcggctgatggcgggggctgctgctgaggaagaagtggagaaggagccggggcggctgat

SEQ ID NO: 164153 - DNA, 75 bp, Artificial Sequence
  Synthetic
atgatttgatagaactgtgtggctctctgcaccacatctggcaaaacttgctccagaccgaggagaaccttttag

SEQ ID NO: 164154 - DNA, 75 bp, Artificial Sequence
  Synthetic
gctgagccttggccacagggccagtgaaggcctcgtatggccccacactcagaggcttgtagtctagggtgaggc

SEQ ID NO: 164155 - DNA, 75 bp, Artificial Sequence
  Synthetic
aagggaggggcgtggtcctgggaccccgcgccgactggcagggggtccccatggcacagggctaggggtccaggg

SEQ ID NO: 164156 - DNA, 75 bp, Artificial Sequence
  Synthetic
tcaaagtagttggagctcaagatggagttttggacttcctgggaggtgatgtaggttgtagtttccaggccttcc

SEQ ID NO: 164157 - DNA, 75 bp, Artificial Sequence
  Synthetic
ctccagaccgaggagaaccttttagatttcgtgcgtttcatgggtgtcatgtccagctgcaataatccagctgtg

SEQ ID NO: 164158 - DNA, 75 bp, Artificial Sequence
  Synthetic
cgcccgacgcccttggtggcgtggagggagcggggaccccgggggtgtgacctaggccggggatggggatgaaga

SEQ ID NO: 164159 - DNA, 75 bp, Artificial Sequence
  Synthetic
gtcaacgtggaggagaacatgcgccgcctgaagaagcgagggaggaaacatgagtcaggactggatgctggctac

SEQ ID NO: 164160 - DNA, 75 bp, Artificial Sequence
  Synthetic
attcgtgcggtttccagtatttatcacggcttcccgccacaggtaaaagttaacacttagggtcagcagcttggt

SEQ ID NO: 164161 - DNA, 75 bp, Artificial Sequence
  Synthetic
atgagctgccatatatcgatcccaatatggagccggttcagcagaggcccgtcatgtttgtgagccgtgtgcctg

SEQ ID NO: 164162 - DNA, 75 bp, Artificial Sequence
  Synthetic
tatggagccggttcagcagaggcccgtcatgtttgtgagccgtgtgcctgcaaaaaaaccgaggaaactgccttg

SEQ ID NO: 164163 - DNA, 75 bp, Artificial Sequence
  Synthetic
acggcttcccgccacaggtaaaagttaacacttagggtcagcagcttggtcagggataggtgcaaaaacctgagc

SEQ ID NO: 164164 - DNA, 75 bp, Artificial Sequence
  Synthetic
ggatgtttaggagaggcagggaggcgatgatctggcatgtgtgccgcaggtgtgtcaggaggtcgtcaaaatcca

SEQ ID NO: 164165 - DNA, 75 bp, Artificial Sequence
  Synthetic
gcccacgcccaagacgcacccagtgaagcgcacaaatgttaagacctctgatagatctgataaggcagaagcaca

SEQ ID NO: 164166 - DNA, 75 bp, Artificial Sequence
  Synthetic
aggaggagccggggtagctgatggcaggggctgctgctgaggaggaagaggagaaggagcccgggcggctgatgg

SEQ ID NO: 164167 - DNA, 75 bp, Artificial Sequence
  Synthetic
agtcatacagcctttccgagccgacgcggtgttgttggaagtttgtcttgcgttcacccgaacgctagcctacct

SEQ ID NO: 164168 - DNA, 75 bp, Artificial Sequence
  Synthetic
ggctgcgggtgccccatggttaatgggttgagttaaggggaggtcaaaatattgtgactgcgctacccctggcct

SEQ ID NO: 164169 - DNA, 75 bp, Artificial Sequence
  Synthetic
ccccacccaaggacgcctgccttcacctggatcccctcaccgtcaagagccagctccctctgaagaagcccttgc

SEQ ID NO: 164170 - DNA, 75 bp, Artificial Sequence
  Synthetic
ggagcgtgtcagctgaatgtcgctctgcccgggcagaatctgcaggtagaggtaggggttcttgaccaatctgat

SEQ ID NO: 164171 - DNA, 75 bp, Artificial Sequence
  Synthetic
atgtttccgatgtggcttatttggctgtgacactgacgatgaatcttcggtggtttcaacatcaatcacctctat

SEQ ID NO: 164172 - DNA, 75 bp, Artificial Sequence
  Synthetic
cggcctggcgtgcaaagatggacatctccggctcgaaagactcggagtagccgtccaggtcctgcagaaaattca

SEQ ID NO: 164173 - DNA, 75 bp, Artificial Sequence
  Synthetic
ggcctgaacgttgaaagccgtcttgatgtttccgatgtggcttatttggctgtgacactgacgatgaatcttcgg

SEQ ID NO: 164174 - DNA, 75 bp, Artificial Sequence
  Synthetic
tgtgacactgacgatgaatcttcggtggtttcaacatcaatcacctctatgacatcatcgtcgtacacaacacac

SEQ ID NO: 164175 - DNA, 75 bp, Artificial Sequence
  Synthetic
ggagctgacatgctattggtttaacgagcagagaagaagtacagacagccgagattgctgccccttttaaatatc

SEQ ID NO: 164176 - DNA, 75 bp, Artificial Sequence
  Synthetic
agctgggtatatacctataggtatatagaacctagaggaagggaaccctatagtgtaatccctcccccccctacc

SEQ ID NO: 164177 - DNA, 75 bp, Artificial Sequence
  Synthetic
gtcgttggatctgagggagggaaccaggctggcaatggctgaggcgctgctgaacgcagcatgtgccccaatctt

SEQ ID NO: 164178 - DNA, 75 bp, Artificial Sequence
  Synthetic
gtcgccgttactcatcttcggcggtggggcggggaggacgccttgtcgccccccttctggtccggggtcttacgc

SEQ ID NO: 164179 - DNA, 75 bp, Artificial Sequence
  Synthetic
ggcccggcgcttgctcgcgttcctgccgttacccaggagaatggccgcgagttttttggcggggaggatgcggaa

SEQ ID NO: 164180 - DNA, 75 bp, Artificial Sequence
  Synthetic
cgggggaggtggctgaattagggccttttccctcattcccccatgagacccacgtggcaggcctaggggctacat

SEQ ID NO: 164181 - DNA, 75 bp, Artificial Sequence
  Synthetic
tgggctgggccttaccagcatccatcaccgagagggcacagactgatggggcccatgatgggcgaggcgttgtag

SEQ ID NO: 164182 - DNA, 75 bp, Artificial Sequence
  Synthetic
aaacctgtctcagtgagcccatcgtctgctcatttcttagcaaatctcccacctgcacaccaggggggcccaggc

SEQ ID NO: 164183 - DNA, 75 bp, Artificial Sequence
  Synthetic
ctggggccgatgtgcagcggtttgtgcccgcagttgtagactgtcatttttatgggcgagtgggcggtccacacg

SEQ ID NO: 164184 - DNA, 75 bp, Artificial Sequence
  Synthetic
accgaggggcttctgggggtgactgtgatctgttccggatttaggtccatggcgggtgtgtatgttttaataggg

SEQ ID NO: 164185 - DNA, 75 bp, Artificial Sequence
  Synthetic
ggccccccaccgtggccatcctggccaacagaaaaaacatcatctggaagtgtttcacctatcggcacaatctgc

SEQ ID NO: 164186 - DNA, 75 bp, Artificial Sequence
  Synthetic
cctaccacccccacccacacccccctccggcctactttggcttgccgggcctctttggcccccctccacccgtgc

SEQ ID NO: 164187 - DNA, 75 bp, Artificial Sequence
  Synthetic
ggcacgactgttcctatatgctctcgcactcttgttgctagcctccgcgctaatcgctggtggcagtattttgca

SEQ ID NO: 164188 - DNA, 75 bp, Artificial Sequence
  Synthetic
cccgccctgcgtgacgctattctaaagttcctcaacaggccagatacgttctcggtggccttgggggagctgggg

SEQ ID NO: 164189 - DNA, 75 bp, Artificial Sequence
  Synthetic
gtataaaggtaagtattattaaattttagagacactatcacgtgtaacttgacgtgcaaggatggaagagagggg

SEQ ID NO: 164190 - DNA, 75 bp, Artificial Sequence
  Synthetic
attgtcccccgagccccgggcccagccctcctcagaaaactctgcatggagaagctggacgtgaacctccccccc

SEQ ID NO: 164191 - DNA, 75 bp, Artificial Sequence
  Synthetic
tgctgactctgacatgggcgggggtgcccggggccgcatccttctggcagtgggggtcaaacaagtagaaggagc

SEQ ID NO: 164192 - DNA, 75 bp, Artificial Sequence
  Synthetic
gggctccagccccaggacacacaagcctcctctcaggacccaccctatggccattctatcatgcaacgggagaag

SEQ ID NO: 164193 - DNA, 75 bp, Artificial Sequence
  Synthetic
cccactgtgctccaccagctccacggccatggccttgatgtccgcggccgtgggctgaccctgccctgcagccgc

SEQ ID NO: 164194 - DNA, 75 bp, Artificial Sequence
  Synthetic
cagccggagcttgtggtactgtccctccggcaggtggagtgggacacagttagagaacattagtcccctggtccc

SEQ ID NO: 164195 - DNA, 75 bp, Artificial Sequence
  Synthetic
tagagaacattagtcccctggtccctatctccacccgccaggcctgtgtgtcagtttgcagggccatcctcgcgc

SEQ ID NO: 164196 - DNA, 75 bp, Artificial Sequence
  Synthetic
gtgattaggagcagggcccagtgcacccaggtggtcttagggcgccagggatcgattggaaaagggcccagggtc

SEQ ID NO: 164197 - DNA, 75 bp, Artificial Sequence
  Synthetic
cgggtgccttcttggcgatggacgctcacacctaccacccccacccacacccccctccggcctactttggcttgc

SEQ ID NO: 164198 - DNA, 75 bp, Artificial Sequence
  Synthetic
agccccaccgtccgctgccgccctccttgagccccaccgtccgctgccgccctccttgatcccctccttaccgat

SEQ ID NO: 164199 - DNA, 75 bp, Artificial Sequence
  Synthetic
ttgtatggctactttgtgttcctaaaaaatgcaacaatagaagtggaaaccctcagtcacgggacattaacctca

SEQ ID NO: 164200 - DNA, 75 bp, Artificial Sequence
  Synthetic
aggaccttccccatttcgcagtaaagagagccgggtcttgggctcttatatatagcgccgccgtccctgtctgtt

SEQ ID NO: 164201 - DNA, 75 bp, Artificial Sequence
  Synthetic
gaggccgtgcctaggatgcggagggccgagcctccactcccgcccccgggggcattcacatccatggtcctgatt

SEQ ID NO: 164202 - DNA, 75 bp, Artificial Sequence
  Synthetic
taacgggaagtgtgtaagcacacacgtaatttgcaagcggtgcttcacgctcttcgttaaaataacacaaggaca

SEQ ID NO: 164203 - DNA, 75 bp, Artificial Sequence
  Synthetic
gtccgtgggagagattgagactgcatactgggcgttcccggtgagccgagtgaacggctgggctggggatgggga

SEQ ID NO: 164204 - DNA, 75 bp, Artificial Sequence
  Synthetic
cggcggcagccgccgagagataaggggggcacgtgtgtgcctccgcctctcctctgtctgggccgccgccgccgc

SEQ ID NO: 164205 - DNA, 75 bp, Artificial Sequence
  Synthetic
gaggaaatggtaagagttatactctacttatcttttttgacactacagttaactgttatgtaacaatgtttgctt

SEQ ID NO: 164206 - DNA, 75 bp, Artificial Sequence
  Synthetic
tccccagacagcagcaactgacgcgtcacgcgggcgagccccccgtccacctctgccaggggcggctgggcgtct

SEQ ID NO: 164207 - DNA, 75 bp, Artificial Sequence
  Synthetic
gtctaaaagatggccggacaaggcagcccgtcttctccgccttcgcctgatgcgctgcatccagcctctgttttc

SEQ ID NO: 164208 - DNA, 75 bp, Artificial Sequence
  Synthetic
gggcggggctggcgcagagcgccctcccgtggagggggacctgacctgcatgctctccaggccatcagagaaggc

SEQ ID NO: 164209 - DNA, 75 bp, Artificial Sequence
  Synthetic
cactctccatagcggacgccatgaaggtccaggggtccgtcgatcgccgccgtctgcaacgccgaatcgcggggc

SEQ ID NO: 164210 - DNA, 75 bp, Artificial Sequence
  Synthetic
ccatacggagcacatcaggcccaagaacatcatgttctgggtcaaaaggcagagaccggtagacgagaactcctg

SEQ ID NO: 164211 - DNA, 75 bp, Artificial Sequence
  Synthetic
tctgctgttgtttctgtctcacctaccggatgatgttaaggacgggctcggagaaatggggccggccagggccac

SEQ ID NO: 164212 - DNA, 75 bp, Artificial Sequence
  Synthetic
caccaccggcctgctaaacctcctctcccgctggcaggatggcgctctccgggcacgtcttgatagaccccgccc

SEQ ID NO: 164213 - DNA, 75 bp, Artificial Sequence
  Synthetic
attttcatgttcaataaatgctatgttaatgatgaagaacctgtgttgttctttggaagtgggcccgatggggta

SEQ ID NO: 164214 - DNA, 75 bp, Artificial Sequence
  Synthetic
ctaggtcctgcatccagtgggccaggtgtctcaccatggctctttctaggtggataccacagtccaggcccccaa

SEQ ID NO: 164215 - DNA, 75 bp, Artificial Sequence
  Synthetic
gccaggaagctcttgaccaggtagaggacgcagttgctgacgcactggatgccggcaaagcggccaaacttgcag

SEQ ID NO: 164216 - DNA, 75 bp, Artificial Sequence
  Synthetic
ccccggccccatcccgtgagccccagcagacatgctctcagttaacgagcagagggaatgaaagctcacggcgaa

SEQ ID NO: 164217 - DNA, 75 bp, Artificial Sequence
  Synthetic
acttggacgtttttggggtctccggacaccatctctatgtcttggccctgatcctgagccgcccggagctcctgg

SEQ ID NO: 164218 - DNA, 75 bp, Artificial Sequence
  Synthetic
atatctgggtagcatatgctacccaaatctatatctgggtagcatatgctatccatcgcaacattagcccaccgt

SEQ ID NO: 164219 - DNA, 75 bp, Artificial Sequence
  Synthetic
cttccccgtcctcgtccatggttatccccccctcttctttgaggtccactgccgccggagccttctggtccagat

SEQ ID NO: 164220 - DNA, 75 bp, Artificial Sequence
  Synthetic
tcagccaagttattacacccttagtttacagtccaaaaccgcagggcggcgtgtgggggctgacgcgtgccccca

SEQ ID NO: 164221 - DNA, 75 bp, Artificial Sequence
  Synthetic
gccgaggccgaagctgcgcctggaaaaggaggccgcccggagtaggtagtaggcgtggtggcggaggaccgccgc

SEQ ID NO: 164222 - DNA, 75 bp, Artificial Sequence
  Synthetic
acgctcagtgaatacagggagtgcagactcctgccccctccaacagcccccccaccctcatccccttcatggtcg

SEQ ID NO: 164223 - DNA, 75 bp, Artificial Sequence
  Synthetic
cccaccctcatccccttcatggtcgctgtcagacagatccaggtctgaaaattccccatcctccgaaccatcctc

SEQ ID NO: 164224 - DNA, 75 bp, Artificial Sequence
  Synthetic
accattggcatctccaccggggtcgggtgggcgggcgggcctcctgccgcggggcctcctgccgcggggcctcct

SEQ ID NO: 164225 - DNA, 75 bp, Artificial Sequence
  Synthetic
attccccatcctccgaaccatcctcgtcctcatcaccaattactcgcagcccggaaaactctcgctgaacatcct

SEQ ID NO: 164226 - DNA, 75 bp, Artificial Sequence
  Synthetic
aacatattgagcgggccacactgccaaccctttccattcttcccagctctgagcgagattttccacacctggaca

SEQ ID NO: 164227 - DNA, 75 bp, Artificial Sequence
  Synthetic
tactgctccaactgcggctctgcggcggtgggctgccagaggctggctgagccaccgagcgcccgctcgggctgg

SEQ ID NO: 164228 - DNA, 75 bp, Artificial Sequence
  Synthetic
ccggaaaactctcgctgaacatcctcaagatttgcatcctgagcctcaagccaggcctcaaattcctcggccccc

SEQ ID NO: 164229 - DNA, 75 bp, Artificial Sequence
  Synthetic
gctcgcggaagagcccaaaacctgtttcggcgccgcccgggggccagtctccgggtcaggtcgcggaccagggtc

SEQ ID NO: 164230 - DNA, 75 bp, Artificial Sequence
  Synthetic
gccgctggggaagcgatggggcatactggggagacggcgggggaggttccctcaggctgggctaagtgcaaggat

SEQ ID NO: 164231 - DNA, 75 bp, Artificial Sequence
  Synthetic
ccagagccgtttgctccatctgtcagcaacgccaagctccagaggacgcccgcgacgagcctcacctgttctcct

SEQ ID NO: 164232 - DNA, 75 bp, Artificial Sequence
  Synthetic
taaggaattgctcagaccaaagttgttcctcaggtggctttaggcctaatgtaggcaattgcgtgcctagaacat

SEQ ID NO: 164233 - DNA, 75 bp, Artificial Sequence
  Synthetic
ggtcgagcacgcgccggcagcgtgtctgcacaaacttgcaggccgtcttccggacgagctccacccccttcatca

SEQ ID NO: 164234 - DNA, 75 bp, Artificial Sequence
  Synthetic
ttcccccagtttgccccatcgtttccctgacggcctcaggggccaagcaaaaccgcgggggcatgggatccttgc

SEQ ID NO: 164235 - DNA, 75 bp, Artificial Sequence
  Synthetic
agagccagtgtggctggggctggtgctcatgcacaccttggcgggtcatccgccacccccgtccagcaggctcag

SEQ ID NO: 164236 - DNA, 75 bp, Artificial Sequence
  Synthetic
gtgggccccgaggctctcgcagagtgggcagatggtccgtgaggcattcttgtgccttagtccaaacatgggggc

SEQ ID NO: 164237 - DNA, 75 bp, Artificial Sequence
  Synthetic
cctgaagactatcatgtactattgtcgcattgagaaggccgccgatctgggggtgatggagtgtaaggccagcgc

SEQ ID NO: 164238 - DNA, 75 bp, Artificial Sequence
  Synthetic
cctcctgcacacgagcggccagggcctccatctctgccgccatcccggccaggaaggcctcgatgaccgagtctg

SEQ ID NO: 164239 - DNA, 75 bp, Artificial Sequence
  Synthetic
accaggaagatttttccgggtttcaaacagagcaagtatgctggggggtggtttcactggcacgattgggcagga

SEQ ID NO: 164240 - DNA, 75 bp, Artificial Sequence
  Synthetic
cgtcagctcttctcagaggatgatctgttggagactgacggttttactgaacgagcctgtgaatcttgccaataa

SEQ ID NO: 164241 - DNA, 75 bp, Artificial Sequence
  Synthetic
actgccacattggacacccaccctgcacacatttcaggtaccccaaaactataccaaagctaactgtacatactg

SEQ ID NO: 164242 - DNA, 75 bp, Artificial Sequence
  Synthetic
acgaaggcaaaggtggccgttgggccagagaccgcgagcacctccccgctgccctcttcgatgatgcgccggtac

SEQ ID NO: 164243 - DNA, 75 bp, Artificial Sequence
  Synthetic
acgagtggtgggtaggctatgccttcttccgcgttggctggaagataggagtggccatcaaaaggccgactgcct

SEQ ID NO: 164244 - DNA, 75 bp, Artificial Sequence
  Synthetic
actaagggagtccattgtctgttatttcatggtctttttacaaactcatatatttgctgaggttttgaaggatgc

SEQ ID NO: 164245 - DNA, 75 bp, Artificial Sequence
  Synthetic
gaaacataagtgtccagggggagcaccccgtggggtgcccaaaggcggggggaatgtgctcccattgccaaaagt

SEQ ID NO: 164246 - DNA, 75 bp, Artificial Sequence
  Synthetic
aggacaaggtgggctagcaagttctcgagtctatgaagactccgggggcagttttttgagtttctcgcctatgat

SEQ ID NO: 164247 - DNA, 75 bp, Artificial Sequence
  Synthetic
gcagcgaggccaccacgctggaaagtgactcggggcggtgaaagagaccaccaccgctttcttcaccctctcccc

SEQ ID NO: 164248 - DNA, 75 bp, Artificial Sequence
  Synthetic
gcctgccccctggtgtgcaggtgggagatttgctaagaaatgagcagacgatgggctcactgagacaggtttgct

SEQ ID NO: 164249 - DNA, 75 bp, Artificial Sequence
  Synthetic
agagccgtgtttcccgacgccaatgctaactcccccaaacacgtcctgtgagttttgcccataaatgaccccatc

SEQ ID NO: 164250 - DNA, 75 bp, Artificial Sequence
  Synthetic
ttgtgatatccaacaacggcctggccaccaccctgaggtgctttttgcacgagccctcgggtctcagatcgggcc

SEQ ID NO: 164251 - DNA, 75 bp, Artificial Sequence
  Synthetic
gcagggcctggccgatgtctttgcggacctgggctggcagtacactgaccctccctctcgctcgttaaacaagga

SEQ ID NO: 164252 - DNA, 75 bp, Artificial Sequence
  Synthetic
cgcagttccacctaaacggggcttaacgttgcatcccagaagatgcacgcttaaccccgcctacaaccgtgacgt

SEQ ID NO: 164253 - DNA, 75 bp, Artificial Sequence
  Synthetic
tgaatggggaggcgtaggtcttgtagtgttaagtgggcctacattctccttccctctaggactgaagaaacagcc

SEQ ID NO: 164254 - DNA, 75 bp, Artificial Sequence
  Synthetic
agggggcgtgtctggtgggggcgggagcggggggcggcgcgggagcctgcacgccgttggaggggagaatgacag

SEQ ID NO: 164255 - DNA, 75 bp, Artificial Sequence
  Synthetic
caccaccgtcagggagtcttggtagaaacacagggggggctgaggccctcgcacatccaccacccctgcggcgcc

SEQ ID NO: 164256 - DNA, 75 bp, Artificial Sequence
  Synthetic
caacgtcacatatgcctttactaacctccgctcacccaacaggtggtgaaaatataacacaggtgacaccagcct

SEQ ID NO: 164257 - DNA, 75 bp, Artificial Sequence
  Synthetic
gtagcatatgctacccaaatctatatctgggtagcatatgctatcctaatctatatcttggtagcatatgctatc

SEQ ID NO: 164258 - DNA, 75 bp, Artificial Sequence
  Synthetic
ccttggatagcagcggtccaccaagagagcgatgagagacccatattcccccacccctcaaagcccacctttctt

SEQ ID NO: 164259 - DNA, 75 bp, Artificial Sequence
  Synthetic
ctccgctcacccaacaggtggtgaaaatataacacaggtgacaccagcctctaccagcacacatcatgtgtccac

SEQ ID NO: 164260 - DNA, 75 bp, Artificial Sequence
  Synthetic
ggtggaaaggccaattctaccaccggtggaaagcacaccacaggacatggagcccggacaagtacagagcccacc

SEQ ID NO: 164261 - DNA, 75 bp, Artificial Sequence
  Synthetic
ccagatccaatttgcctacgattccctgcgccgccagatcaaccgcatgctgggagacctcgcgcgggcctggtg

SEQ ID NO: 164262 - DNA, 75 bp, Artificial Sequence
  Synthetic
acagcttttattccaacgtctctgactgggaggtgattctctagacttaacgggaggaaacaggaggaggagggg

SEQ ID NO: 164263 - DNA, 75 bp, Artificial Sequence
  Synthetic
tttagatatagaggctctcccaacacaatagaatttttgcagctaagttttctaagggcacgtgcctttccccca

SEQ ID NO: 164264 - DNA, 75 bp, Artificial Sequence
  Synthetic
cgccaagaacgagatacaatgcgaccacctatctacctcccagcacttctagcgaactgcggccccgctggactt

SEQ ID NO: 164265 - DNA, 75 bp, Artificial Sequence
  Synthetic
ccccctcccttacggttgcctgagcccatcccccaccccagcaccccggggtgacgtggcaccccgcgtgcctta

SEQ ID NO: 164266 - DNA, 75 bp, Artificial Sequence
  Synthetic
ttacgagcccaccggttaccacagcccaagccaccgtgccagtcccgccaacgtcccagcccagattctcaaacc

SEQ ID NO: 164267 - DNA, 75 bp, Artificial Sequence
  Synthetic
cccagtgcgtgcccgttaaccaggccaccgtcaccctgcgcaagagcatgagggtccctggctccgagaccatgt

SEQ ID NO: 164268 - DNA, 75 bp, Artificial Sequence
  Synthetic
ctctctggcggtgctgacccttctgctgctgctggtcatggcggactgcgccttcaggcgtaacttgtcgacatc

SEQ ID NO: 164269 - DNA, 75 bp, Artificial Sequence
  Synthetic
cagctttatcaacgacaccaagacctacgagggacagctgggcaccgacaacgagatcttccttacaaaaaagat

SEQ ID NO: 164270 - DNA, 75 bp, Artificial Sequence
  Synthetic
ccatacctacaccaccccaccatatgatgacgccgagacctatgtataaagtcaataaagatttattaatcagaa

SEQ ID NO: 164271 - DNA, 75 bp, Artificial Sequence
  Synthetic
cagaccagcccctcatccctgaccctcgcgccccatcttggcccgtccctcttgtccctttcagcgttcaccggt

SEQ ID NO: 164272 - DNA, 75 bp, Artificial Sequence
  Synthetic
agatccacgtctacaacgactaccaccactttaaaaccatcgagctggacggcattgccaccctgcagaccttca

SEQ ID NO: 164273 - DNA, 75 bp, Artificial Sequence
  Synthetic
gtcccaaatcacgaggttaggcaggtgcacttggctctttaggagggacccttaagccagacaatgtagtgcccc

SEQ ID NO: 164274 - DNA, 75 bp, Artificial Sequence
  Synthetic
cacacacccactctatctaaattccacacctgaaagcctggtaaacggaccctggcggctgacagaccttgcgtc

SEQ ID NO: 164275 - DNA, 75 bp, Artificial Sequence
  Synthetic
ctgtactcacgggacgaacagcgtgcctccaatgtctttgacctggagggcatcttccgggagtacaacttccag

SEQ ID NO: 164276 - DNA, 75 bp, Artificial Sequence
  Synthetic
cctccaatgtctttgacctggagggcatcttccgggagtacaacttccaggcgcaaaacatcgccggcctgcgga

SEQ ID NO: 164277 - DNA, 75 bp, Artificial Sequence
  Synthetic
ctgggggaacttatggacagtctgggtagcgtgggtcagtccatcaccaacctagtcagcacggtggggggtttg

SEQ ID NO: 164278 - DNA, 75 bp, Artificial Sequence
  Synthetic
tttagcagcctggtctcgggtttcatctccttcttcaaaaaccccttcggcggcatgctcattctggtcctggtg

SEQ ID NO: 164279 - DNA, 75 bp, Artificial Sequence
  Synthetic
tctccttcttcaaaaaccccttcggcggcatgctcattctggtcctggtggtgggggtggtgatcctggttattt

SEQ ID NO: 164280 - DNA, 75 bp, Artificial Sequence
  Synthetic
gtgggggtggtgatcctggttatttccctcacgaggcgcacgcgccagatgtcgcagcagccggtgcagatgctc

SEQ ID NO: 164281 - DNA, 75 bp, Artificial Sequence
  Synthetic
ctgggcataaattctcctgcctgcctctgctctggtacgttggcttctgctgctgcttgtgatcatggaaaccac

SEQ ID NO: 164282 - DNA, 75 bp, Artificial Sequence
  Synthetic
taccccgggatcgacgagctcgctcagcaacatgcctctggtgagggtccaggcattaatccaattagtaagaca

SEQ ID NO: 164283 - DNA, 75 bp, Artificial Sequence
  Synthetic
agcaacatgcctctggtgagggtccaggcattaatccaattagtaagacagaattacaagccatcatgttagcgc

SEQ ID NO: 164284 - DNA, 75 bp, Artificial Sequence
  Synthetic
atggaccttagatgcatccacttgcatggatccttcagagacagcagggatatcgacaggctcggccagcgcaat

SEQ ID NO: 164285 - DNA, 75 bp, Artificial Sequence
  Synthetic
tgaaactgtccggactccgagtggcgggcctcgggggggtggcgggcctcggtgtgagaggcacccccatcattc

SEQ ID NO: 164286 - DNA, 75 bp, Artificial Sequence
  Synthetic
aaaatggtcctaaggaacagcgatatctcccaccccatgagctgtcacggttttatttacatggggtcaggattc

SEQ ID NO: 164287 - DNA, 75 bp, Artificial Sequence
  Synthetic
gcgagtactatcggctggtgacagcgggcaagttttgtgggcgggtctccatcaagtccctgatgttctctatcg

SEQ ID NO: 164288 - DNA, 75 bp, Artificial Sequence
  Synthetic
ggaagccaccgagggtctggccaagctgcagtcctgcctggcgcaacagagcgagaccctgaccgagaccctgtg

SEQ ID NO: 164289 - DNA, 75 bp, Artificial Sequence
  Synthetic
ctgcagtcctgcctggcgcaacagagcgagaccctgaccgagaccctgtgcctgcgcgtctggggggacgtggtc

SEQ ID NO: 164290 - DNA, 75 bp, Artificial Sequence
  Synthetic
gcaggcctggtgacagggcgcgcatggcctgagcctctacttttgggggcttctggggggaccggggcagtggac

SEQ ID NO: 164291 - DNA, 75 bp, Artificial Sequence
  Synthetic
ccctcccgcgtgcaaacgtggcgagggttaatctcctttcgggtcgggggccagatttgttgtaggagcagcgag

SEQ ID NO: 164292 - DNA, 75 bp, Artificial Sequence
  Synthetic
tgttgctccagcaggctagtgtagggcggctcaccttggtcaacaagaccaccatcctgctgcgcccgatgaaga

SEQ ID NO: 164293 - DNA, 75 bp, Artificial Sequence
  Synthetic
gcctgtacaccttcatcacggggcccctggcggaggagagcgggctctttcccccacccagcaacgtggccctgg

SEQ ID NO: 164294 - DNA, 75 bp, Artificial Sequence
  Synthetic
ctttaacaatagaaatccatggggtggggacaagccgtaaagactggatgtccatctcacacgaatttattgcta

SEQ ID NO: 164295 - DNA, 75 bp, Artificial Sequence
  Synthetic
agaagcccggccagcccccgctcgtactccgcgtagggggcctccagatccgtgttgaccaccgctgatttcatg

SEQ ID NO: 164296 - DNA, 75 bp, Artificial Sequence
  Synthetic
gggggctcactggcatctagccagcaaattctgtgccgggcgctgcgcgaggccgtcctaaccgtgtccctctac

SEQ ID NO: 164297 - DNA, 75 bp, Artificial Sequence
  Synthetic
cagctctggcagttataaccgcaccagctaacaggacatgtttgggggagttggcattggcgtcaggagacacgg

SEQ ID NO: 164298 - DNA, 75 bp, Artificial Sequence
  Synthetic
aacaagacctgggggcggtccttgatcctgcgccgggcggacgcggtcagccccggccaggccctgcccccggat

SEQ ID NO: 164299 - DNA, 75 bp, Artificial Sequence
  Synthetic
ccccggccaggccctgcccccggatgggctttacctcacgtacgactctgaccgccccctaattcttctgtataa

SEQ ID NO: 164300 - DNA, 75 bp, Artificial Sequence
  Synthetic
tttgcccaacagctcgcgaagtgtctccagcggcttttccatcagcgccttggcgtcgggggtggtcacgtccag

SEQ ID NO: 164301 - DNA, 75 bp, Artificial Sequence
  Synthetic
tccagcggcttttccatcagcgccttggcgtcgggggtggtcacgtccagtccgccgctcattttgtggcgcgtg

SEQ ID NO: 164302 - DNA, 75 bp, Artificial Sequence
  Synthetic
ttcagcagatcggcctcgtcgctgagcgctttccgggccgcgtcggcctgctgatctagcagcgttttgaaaacg

SEQ ID NO: 164303 - DNA, 75 bp, Artificial Sequence
  Synthetic
gcgctttccgggccgcgtcggcctgctgatctagcagcgttttgaaaacgggccgctggaagtcggcgggcgggg

SEQ ID NO: 164304 - DNA, 75 bp, Artificial Sequence
  Synthetic
aacaacggccagaggaagctcgggggcgcaagggagggggggcaagacgcggaaaagaggaagtccctaggggac

SEQ ID NO: 164305 - DNA, 75 bp, Artificial Sequence
  Synthetic
cctggcgcagcgagcgatctagccgctcgctagtctcggtcatctgttgtctagtctcttgtaattgttcctcca

SEQ ID NO: 164306 - DNA, 75 bp, Artificial Sequence
  Synthetic
ctagtctcttgtaattgttcctccatcttctgttgactgctgcggtagcgtgcaaagtcgccctcgaactcgctg

SEQ ID NO: 164307 - DNA, 75 bp, Artificial Sequence
  Synthetic
ggccgaggggagggggggggggctcgcgggccccggggcacactgcttccatccacccgcgcacaccccgccaca

SEQ ID NO: 164308 - DNA, 75 bp, Artificial Sequence
  Synthetic
aacccgcgtcgaggacacacgcagacacggcccgccaacacaccccgacacacccctgacacaccccgccaacac

SEQ ID NO: 164309 - DNA, 75 bp, Artificial Sequence
  Synthetic
cacggcccgccaacacaccccgacacacccctgacacaccccgccaacacacccgccacacgcccgcgacacacc

SEQ ID NO: 164310 - DNA, 75 bp, Artificial Sequence
  Synthetic
gcctgctgcgtctcatggatcagaagttgcggacccaaaatttggtccaagtggtttagcgaggcttgggtttgc

SEQ ID NO: 164311 - DNA, 75 bp, Artificial Sequence
  Synthetic
gttgcggacccaaaatttggtccaagtggtttagcgaggcttgggtttgcatagccgcttctcggtgcgggtgac

SEQ ID NO: 164312 - DNA, 75 bp, Artificial Sequence
  Synthetic
cccgacacacgcccgcgacacacccgcggcacaccctgacacacccggcacacccggcacacacccacccagccg

SEQ ID NO: 164313 - DNA, 75 bp, Artificial Sequence
  Synthetic
gctgcagcgccgacagcaagtcctggttgaacttgtctagtagcggttgggcgcgttgatctaggcccaagagca

SEQ ID NO: 164314 - DNA, 75 bp, Artificial Sequence
  Synthetic
gttgaacttgtctagtagcggttgggcgcgttgatctaggcccaagagcagctcgagtgtggcctccagtggttg

SEQ ID NO: 164315 - DNA, 75 bp, Artificial Sequence
  Synthetic
agagcaacgcccgggggtgggggacgacggccagagacaagaggaagtccccggggacggtcgcgcgcggaaaag

SEQ ID NO: 164316 - DNA, 75 bp, Artificial Sequence
  Synthetic
cgagcgcgcacccacctaggtggacgcccggcatccattccgggccgtgtgctgggtccccgaggggcggggggg

SEQ ID NO: 164317 - DNA, 75 bp, Artificial Sequence
  Synthetic
gtagccgtccagtagctgccgttgctgttcttcctgtttacgtttctccttgtctaaaaagtcttgcatcttggt

SEQ ID NO: 164318 - DNA, 75 bp, Artificial Sequence
  Synthetic
gacgacgacgacgataaagaatacaaagccgcagtgtcgtccagaggattacgcgaccagattgcaagatctccg

SEQ ID NO: 164319 - DNA, 75 bp, Artificial Sequence
  Synthetic
tgttcttcctgtttacgtttctccttgtctaaaaagtcttgcatcttggtggttaacgtttgttgcatttgatgc

SEQ ID NO: 164320 - DNA, 75 bp, Artificial Sequence
  Synthetic
ggggacgggggttgcgccggggacggggggtgtgcggagacggggggtgtacaagcccgggggggttagcggcgg

SEQ ID NO: 164321 - DNA, 75 bp, Artificial Sequence
  Synthetic
tcttcttgccattcacgttccagccgttccaggtgctgttcttccatctcgtgttgatatcgctcgtagagttcc

SEQ ID NO: 164322 - DNA, 75 bp, Artificial Sequence
  Synthetic
gttccaggtgctgttcttccatctcgtgttgatatcgctcgtagagttccgttacctgaggtccgacgcccagtc

SEQ ID NO: 164323 - DNA, 75 bp, Artificial Sequence
  Synthetic
gtgacgtcgcggacgggggccttttgcggcagggacggggcgttgcggagacgggggcgtttgcggcggggacgg

SEQ ID NO: 164324 - DNA, 75 bp, Artificial Sequence
  Synthetic
gggcctttcgcggcggacacggggaacacagacggcacgcacacgcagctcgcctatttaacctccacccactac

SEQ ID NO: 164325 - DNA, 75 bp, Artificial Sequence
  Synthetic
tttcggatgcgccggtaccggctttctcgatctgctccagtttcttgaccatctgcgcgtacgtggcgttggcgg

SEQ ID NO: 164326 - DNA, 75 bp, Artificial Sequence
  Synthetic
ctcgatctgctccagtttcttgaccatctgcgcgtacgtggcgttggcggcacgcagatcctcacgttcatgcga

SEQ ID NO: 164327 - DNA, 75 bp, Artificial Sequence
  Synthetic
cgcctatttaacctccacccactacaacacacacatgccacacaatcatgccagccacagacacaaacagcaccc

SEQ ID NO: 164328 - DNA, 75 bp, Artificial Sequence
  Synthetic
tcgcatcactaatgtgtggaacatgctcagtacggcgttgatgagtcgcagacgcgtctgttcgtcgcgacgtaa

SEQ ID NO: 164329 - DNA, 75 bp, Artificial Sequence
  Synthetic
ctcagtacggcgttgatgagtcgcagacgcgtctgttcgtcgcgacgtaacatctcgcgtaattgtgggtgtcgc

SEQ ID NO: 164330 - DNA, 75 bp, Artificial Sequence
  Synthetic
tagaggcggcttagcgcgagttgcgcgttctgtaggcgctgctgcacttcgggtagctgcaggccgcctagcgct

SEQ ID NO: 164331 - DNA, 75 bp, Artificial Sequence
  Synthetic
cgttctgtaggcgctgctgcacttcgggtagctgcaggccgcctagcgcttccagctgagctagctgctcctgta

SEQ ID NO: 164332 - DNA, 75 bp, Artificial Sequence
  Synthetic
accccgtcccccgcgcggaaatccgccgcggcggtggcgactgggccgacagcgcaagcgacttcgacgccgact

SEQ ID NO: 164333 - DNA, 75 bp, Artificial Sequence
  Synthetic
accttactgttggcgcgccaacgcgacggcctcgctgactggaacgtcgtacgctgccgcggaacaggctttcgc

SEQ ID NO: 164334 - DNA, 75 bp, Artificial Sequence
  Synthetic
gaatctgcgtgaggcgaccctcgttttgctgcgtggcttgctggtacgcgtgtcgcagctgcaggatctcttgca

SEQ ID NO: 164335 - DNA, 75 bp, Artificial Sequence
  Synthetic
ttgctgcgtggcttgctggtacgcgtgtcgcagctgcaggatctcttgcagtagcggtacgttgtcgcgcacagt

SEQ ID NO: 164336 - DNA, 75 bp, Artificial Sequence
  Synthetic
gcacacgattccgaggacggcgtctctgtctggcgtcagcacctggtttttttactcggaggccacggccgccgt

SEQ ID NO: 164337 - DNA, 75 bp, Artificial Sequence
  Synthetic
gtcgcgcaggtcgtaaaagagtctcagtacctgctcgacgacgcgttccatctgcttcaggtcctctaccggcaa

SEQ ID NO: 164338 - DNA, 75 bp, Artificial Sequence
  Synthetic
agtacctgctcgacgacgcgttccatctgcttcaggtcctctaccggcaaaaagccgttgaggatgtgattgtgc

SEQ ID NO: 164339 - DNA, 75 bp, Artificial Sequence
  Synthetic
ggacgggggccttttgcggcagggacggggcgttgcggagacgggggcgtttgcggcggggacgggggcctttcg

SEQ ID NO: 164340 - DNA, 75 bp, Artificial Sequence
  Synthetic
cccccgtccccgctgctgagtccccccgtccccgcgacaccctgtcccgcaagtccctagcgcaaaagcccccgt

SEQ ID NO: 164341 - DNA, 75 bp, Artificial Sequence
  Synthetic
aagagttcctgcttggcgttgtcgtccaacggctgcagcgctttcagaatttcgcgtcggttcagatcgctggcg

SEQ ID NO: 164342 - DNA, 75 bp, Artificial Sequence
  Synthetic
ccaacggctgcagcgctttcagaatttcgcgtcggttcagatcgctggcgtctaggtcgtgaatgtcgatgctgg

SEQ ID NO: 164343 - DNA, 75 bp, Artificial Sequence
  Synthetic
gctgggcacgacgcggtgaacgtggcgcgtggatgccggccgagacatttacgtgtcccaaggataaacgtccct

SEQ ID NO: 164344 - DNA, 75 bp, Artificial Sequence
  Synthetic
ctacaccctcagccacggttcacaatccccgaaactacgccgtccaacttcacgccgaaacgacccgcacatggc

SEQ ID NO: 164345 - DNA, 75 bp, Artificial Sequence
  Synthetic
ccgtccccgcgacaccctgtcccgcaagtccctagcgcaaaagcccccgtccccgccgccaactgccgtcctcgc

SEQ ID NO: 164346 - DNA, 75 bp, Artificial Sequence
  Synthetic
cgcaacccccggccccccgtccccaacggcgggcaaaaacccccgtccccgcagcaccccgtacccagcgcacaa

SEQ ID NO: 164347 - DNA, 75 bp, Artificial Sequence
  Synthetic
cgatgacctgcgtcagacgctgaaagtctacgggtcgcaggcagacgaagctgtcgctaacgggcatcggtcgct

SEQ ID NO: 164348 - DNA, 75 bp, Artificial Sequence
  Synthetic
gcagcaccccgtacccagcgcacaaaaacacccgcagaaagatccctgagcaaacaaagaccgtgcgacgccacg

SEQ ID NO: 164349 - DNA, 75 bp, Artificial Sequence
  Synthetic
tccacgtagcgtagcatctcctccacccaggcgatgagcgccgggccgtgctgacgtccgtagggatcgaagacg

SEQ ID NO: 164350 - DNA, 75 bp, Artificial Sequence
  Synthetic
gcaccacaattacgtgccgtcgctggattctccaatcagacgcctttggaaaacaacacgcacctggccttggta

SEQ ID NO: 164351 - DNA, 75 bp, Artificial Sequence
  Synthetic
gggggtgaaggcaaagaaaaaaaaaaggaacaaaataatagattagcagaaggaataatccgtgcgaccgagctt

SEQ ID NO: 164352 - DNA, 75 bp, Artificial Sequence
  Synthetic
gatccagcgtcgagtacgtgcctttggtggtcttgtggctcaggtagtcgtgcatgcgccgcagatccaggccgt

SEQ ID NO: 164353 - DNA, 75 bp, Artificial Sequence
  Synthetic
aggaataatccgtgcgaccgagcttgtgcttcttttcttataaggaggcaaatatactagggaaaacataagaat

SEQ ID NO: 164354 - DNA, 75 bp, Artificial Sequence
  Synthetic
agggatacggacttggcagccaaggtcggtccggctccctgaagacacccgagacggccgcggcggccgtcaggg

SEQ ID NO: 164355 - DNA, 75 bp, Artificial Sequence
  Synthetic
ggtggtcttgtggctcaggtagtcgtgcatgcgccgcagatccaggccgtggtgcagccagttgagcagaaaggc

SEQ ID NO: 164356 - DNA, 75 bp, Artificial Sequence
  Synthetic
aagctgagataaaatagcgcattttccatacagaggttgttgtttttgtggatcctaagaggtttcaagtgcgaa

SEQ ID NO: 164357 - DNA, 75 bp, Artificial Sequence
  Synthetic
tcgggggtgcggctaggtgggtgtgtgccgggtgcggctgggtgtgccgggtgtgtcgcggtgccgggtgtgttg

SEQ ID NO: 164358 - DNA, 75 bp, Artificial Sequence
  Synthetic
cagacacgagcgctgattgacggcatggatgatgagctgctggagacgatcggtgaggaaagcttcgtcgaagga

SEQ ID NO: 164359 - DNA, 75 bp, Artificial Sequence
  Synthetic
aaatagaagtgactggacaacgttagaaaccagtgcattgctattgaaaaacacggagactgcagtgaacctcag

SEQ ID NO: 164360 - DNA, 75 bp, Artificial Sequence
  Synthetic
tggatgatgagctgctggagacgatcggtgaggaaagcttcgtcgaaggacggcgccgtggccgttgccgcgtta

SEQ ID NO: 164361 - DNA, 75 bp, Artificial Sequence
  Synthetic
tgccgggtgcggctgggtgtgccgggtgtgtcgcggtgccgggtgtgttggctgggtgtgtcgcgcggggtgtgg

SEQ ID NO: 164362 - DNA, 75 bp, Artificial Sequence
  Synthetic
gttctgcgagggacatcacgatggatcgttgcgatgaagtcacgcgtacgcctctggtgtgacgcggtgtcgtga

SEQ ID NO: 164363 - DNA, 75 bp, Artificial Sequence
  Synthetic
atggaagcagtgtgccccggggcccgcgactccccccccccgacccgacgcgggtctgcagcttcctcttttccg

SEQ ID NO: 164364 - DNA, 75 bp, Artificial Sequence
  Synthetic
ttcaactcctgctctacctcgtcgacgagctgttggtagcggcccagggccggcagggccccttcgccgcagctg

SEQ ID NO: 164365 - DNA, 75 bp, Artificial Sequence
  Synthetic
gcgactccccccccccgacccgacgcgggtctgcagcttcctcttttccgcctgcggccccgcggtcccctaggg

SEQ ID NO: 164366 - DNA, 75 bp, Artificial Sequence
  Synthetic
cggcagggccccttcgccgcagctgtaggacggtggtaccgcggacgaagaagaggccgccgctatcgctgagga

SEQ ID NO: 164367 - DNA, 75 bp, Artificial Sequence
  Synthetic
tcttctttggtgtaagtacatctaaaagctgcaaactatattctaagggctgtctctaggtgtactttgatgctg

SEQ ID NO: 164368 - DNA, 75 bp, Artificial Sequence
  Synthetic
aagctgcaaactatattctaagggctgtctctaggtgtactttgatgctggagtttttcgctgtgttgatgtgaa

SEQ ID NO: 164369 - DNA, 75 bp, Artificial Sequence
  Synthetic
tcccccgggagttgatgctcgcgtccccagggacttcttcttcctctgttccccggggattcgcaagatcaaaca

SEQ ID NO: 164370 - DNA, 75 bp, Artificial Sequence
  Synthetic
tgcctccgtgtttgctaccgctgaggtccttgcggcgtttctcgggtgtttttttgggtgaggacgagggatcgt

SEQ ID NO: 164371 - DNA, 75 bp, Artificial Sequence
  Synthetic
agaaagagtgattatgccgagacaagattgcattggctgaactgtttcaaaaacgcctacactctacttatccgt

SEQ ID NO: 164372 - DNA, 75 bp, Artificial Sequence
  Synthetic
tggacaacaacgttatttcgtatacaacagttccatcagtggtggaaactagatacgaccttatgcatccagaaa

SEQ ID NO: 164373 - DNA, 75 bp, Artificial Sequence
  Synthetic
gtccttgcggcgtttctcgggtgtttttttgggtgaggacgagggatcgtagacgggaatgctgggcgccacgcc

SEQ ID NO: 164374 - DNA, 75 bp, Artificial Sequence
  Synthetic
aacagttccatcagtggtggaaactagatacgaccttatgcatccagaaaacgggatataaaggtcaaaatatta

SEQ ID NO: 164375 - DNA, 75 bp, Artificial Sequence
  Synthetic
aaatggtgatacgtgcaattaaaactgtattccatgtttccatcctttcatttcaactttaaaggcggctttgag

SEQ ID NO: 164376 - DNA, 75 bp, Artificial Sequence
  Synthetic
cgtgtccgcgctttctcgaacgacgccggtgaggtcgatatcgcggtcgcgataggtggagaccaaacgtgcggc

SEQ ID NO: 164377 - DNA, 75 bp, Artificial Sequence
  Synthetic
acatgttatgttattataatgaaaaacatgaagaagtatacagcgagttaaacattatacgacaatgtctaggga

SEQ ID NO: 164378 - DNA, 75 bp, Artificial Sequence
  Synthetic
ccggtgaggtcgatatcgcggtcgcgataggtggagaccaaacgtgcggcgatctcagcctctggcacggtcgcc

SEQ ID NO: 164379 - DNA, 75 bp, Artificial Sequence
  Synthetic
acatgaagaagtatacagcgagttaaacattatacgacaatgtctagggaatcatacattgcttcttattaattt

SEQ ID NO: 164380 - DNA, 75 bp, Artificial Sequence
  Synthetic
atcagcacctgatggagaccctcgcagtgatacacggcggcgttgtgacattccgcggagctgtgcggatcaaag

SEQ ID NO: 164381 - DNA, 75 bp, Artificial Sequence
  Synthetic
atgttacaatgttaccgtgcactcgacatatcaaacatacacccacacaactatattatttcatccacttacatc

SEQ ID NO: 164382 - DNA, 75 bp, Artificial Sequence
  Synthetic
aacggcgacggagaggagcgtgtccgccgccgggaaggtggtctctttctcttttcttttttcaagaaatcttcc

SEQ ID NO: 164383 - DNA, 75 bp, Artificial Sequence
  Synthetic
atgtgtttatcgtagtgatcgaaatcgactgatctcgggttctttttgttggtttcttttcggttaatcatgtat

SEQ ID NO: 164384 - DNA, 75 bp, Artificial Sequence
  Synthetic
ctatattatttcatccacttacatccacacataattcattaacaatgttatcgtcactcacttcaaccaacctca

SEQ ID NO: 164385 - DNA, 75 bp, Artificial Sequence
  Synthetic
agtgatacacggcggcgttgtgacattccgcggagctgtgcggatcaaagaccaacatgtggtcctcggtgaaga

SEQ ID NO: 164386 - DNA, 75 bp, Artificial Sequence
  Synthetic
cttttttcatgagcaattcctcgcccggcgccggcatgccgaggtggggccactgcgatcagcggcatgccgacg

SEQ ID NO: 164387 - DNA, 75 bp, Artificial Sequence
  Synthetic
agtcgaagatgcccggacacatgtagccgtccaggtcgcacgtctcggtggtgccgttgaagggccgcgagagcg

SEQ ID NO: 164388 - DNA, 75 bp, Artificial Sequence
  Synthetic
gccgtccaggtcgcacgtctcggtggtgccgttgaagggccgcgagagcgcgtgcacggtccggccgaaccgcga

SEQ ID NO: 164389 - DNA, 75 bp, Artificial Sequence
  Synthetic
cagaccgggtggcaggagcggtaaggaatcatcgtcgtctttcattcttcgatgattatggtaatactaaatctt

SEQ ID NO: 164390 - DNA, 75 bp, Artificial Sequence
  Synthetic
gaatcatcgtcgtctttcattcttcgatgattatggtaatactaaatcttatctaggagcatatacatctaagat

SEQ ID NO: 164391 - DNA, 75 bp, Artificial Sequence
  Synthetic
ctcgcgctctagccgcgcgtccagacgcgcgccctcttccatgatggcgtccagcgcctcggtctgcaggacggc

SEQ ID NO: 164392 - DNA, 75 bp, Artificial Sequence
  Synthetic
tatgaaaccaaaacgcaaacataatagatacgcacgtttattttccagctcactgtttgaataccgtaagcaaaa

SEQ ID NO: 164393 - DNA, 75 bp, Artificial Sequence
  Synthetic
cgcgcgccctcttccatgatggcgtccagcgcctcggtctgcaggacggcgctcgttccacccaggtgcaaggcg

SEQ ID NO: 164394 - DNA, 75 bp, Artificial Sequence
  Synthetic
gataataatataataaaaactcatggacgtgaaatctggcttggttgtggtgatttcattctcattattgttgtt

SEQ ID NO: 164395 - DNA, 75 bp, Artificial Sequence
  Synthetic
cagctggcctgcgtgactttcatggcgaggccggcggcagggacaccgatgtcgagccggcgggcgggtcgatcg

SEQ ID NO: 164396 - DNA, 75 bp, Artificial Sequence
  Synthetic
cgaggccggcggcagggacaccgatgtcgagccggcgggcgggtcgatcgaagacaagatgtcctgctgcgcctg

SEQ ID NO: 164397 - DNA, 75 bp, Artificial Sequence
  Synthetic
tgctatacaccgagagagatgatctttttgttcttctggttcatttcctatgattgtttggctgctgaccgacgc

SEQ ID NO: 164398 - DNA, 75 bp, Artificial Sequence
  Synthetic
tgattgtttggctgctgaccgacgcgtcaggatgtgcggggcatgcggggaatcaggaccggacacgggataatt

SEQ ID NO: 164399 - DNA, 75 bp, Artificial Sequence
  Synthetic
aatcaggaccggacacgggataatttcatctacctatacggagatcgcggtcctcgccatgaggatcgcgacagg

SEQ ID NO: 164400 - DNA, 75 bp, Artificial Sequence
  Synthetic
ctccggtacggacgtcgcgcctgccgtcgattcttcgtgatcggtgtcgggcgtcatgcggagtcgcggcggttg

SEQ ID NO: 164401 - DNA, 75 bp, Artificial Sequence
  Synthetic
gtcgattcttcgtgatcggtgtcgggcgtcatgcggagtcgcggcggttggggcgccgattcccagggcgcctcc

SEQ ID NO: 164402 - DNA, 75 bp, Artificial Sequence
  Synthetic
gacgatgaggataaataaaaatgaccttgtttttgttctgttttctcttgttgggaatcgtcgactttgaattct

SEQ ID NO: 164403 - DNA, 75 bp, Artificial Sequence
  Synthetic
agcgcgcgatgtcggtgcagtaggctcgttgcttccgtcagacagagctgtgcgccgcggcgttccaagttctcg

SEQ ID NO: 164404 - DNA, 75 bp, Artificial Sequence
  Synthetic
tccgcagccgtacggcgcctccgccggcgggagcgcgatttgcgtgccaaacgcggacgcgcacgcggtggtcgg

SEQ ID NO: 164405 - DNA, 75 bp, Artificial Sequence
  Synthetic
tcgagttatcggaaagctgaggtacccaaatgtctgtagcttttttctttttaccctcttgtttatcatctgcga

SEQ ID NO: 164406 - DNA, 75 bp, Artificial Sequence
  Synthetic
tcgttgcttccgtcagacagagctgtgcgccgcggcgttccaagttctcgcgacttagtacgtcaaagacggcta

SEQ ID NO: 164407 - DNA, 75 bp, Artificial Sequence
  Synthetic
actatatccggccattgtttagtacaggaaatccaactaggtcaacgatattctcgcacatttgtcactttatgt

SEQ ID NO: 164408 - DNA, 75 bp, Artificial Sequence
  Synthetic
ccaacactttgattttggaggccgtctttttgagcgccttgctcatctgggccaccgtgcggtgacccttggcgt

SEQ ID NO: 164409 - DNA, 75 bp, Artificial Sequence
  Synthetic
taaaacagaagccgaccggccgccgacccgttccccaggaccagcctacgaggaacggataacgcggtggcgacg

SEQ ID NO: 164410 - DNA, 75 bp, Artificial Sequence
  Synthetic
gtcggcttacttcctctgtgtcgctgctgatctgacgtacgcgcacgcgaacactcagcaggcgctcgttcaagc

SEQ ID NO: 164411 - DNA, 75 bp, Artificial Sequence
  Synthetic
cgcgcagtccgtactgaccctgtacctccacgtacaccgtcacgccgtcctccgagaggcgcgcccggccacgcg

SEQ ID NO: 164412 - DNA, 75 bp, Artificial Sequence
  Synthetic
ctccacgtacaccgtcacgccgtcctccgagaggcgcgcccggccacgcgccagaccgaaacagagtcgcgtgtg

SEQ ID NO: 164413 - DNA, 75 bp, Artificial Sequence
  Synthetic
aggaccggggcttggcgacccttccacgactgctgttgtcatctcggctcctccgtcttctcccggccacgggcg

SEQ ID NO: 164414 - DNA, 75 bp, Artificial Sequence
  Synthetic
acgactgctgttgtcatctcggctcctccgtcttctcccggccacgggcggctaagtcaccgccgttctccccat

SEQ ID NO: 164415 - DNA, 75 bp, Artificial Sequence
  Synthetic
gcattctagtacctgctaaagtaggtactaacgtcacattaaacgcggtggatgtccagaacaacgattatgttt

SEQ ID NO: 164416 - DNA, 75 bp, Artificial Sequence
  Synthetic
gttatgcgctacggagcgcgccatgagctcggccagcaggtccacattgggcgtgacgggtacaccgctgaggtg

SEQ ID NO: 164417 - DNA, 75 bp, Artificial Sequence
  Synthetic
agctcggccagcaggtccacattgggcgtgacgggtacaccgctgaggtgctcgagggtcgtggcgatgtcgaag

SEQ ID NO: 164418 - DNA, 75 bp, Artificial Sequence
  Synthetic
tggggaagccgctaaacccctgcgtttttatatggtagctctgccgagcgcgggctgacgcgttgagtaagcgga

SEQ ID NO: 164419 - DNA, 75 bp, Artificial Sequence
  Synthetic
ttttatatggtagctctgccgagcgcgggctgacgcgttgagtaagcggaaagacgtgtgtgacgaaaaggggtc

SEQ ID NO: 164420 - DNA, 75 bp, Artificial Sequence
  Synthetic
acacaaatcgaagtttctcatgtcttaaaaatcacagtctcgttctcataaatgtaacagaagaatacaccgatt

SEQ ID NO: 164421 - DNA, 75 bp, Artificial Sequence
  Synthetic
atcgcgccgcagagtttgtggtgcacggcgttcaaggaagccctctgggatgtggctctgctggaagtgccgcgt

SEQ ID NO: 164422 - DNA, 75 bp, Artificial Sequence
  Synthetic
aggttctggtacagcgtcacctgctcgggcaacaatacacggcacagctgaatgagtgcgaaaagacgcggcgaa

SEQ ID NO: 164423 - DNA, 75 bp, Artificial Sequence
  Synthetic
cgggcaacaatacacggcacagctgaatgagtgcgaaaagacgcggcgaacccacggcttgaaacaggccctgcg

SEQ ID NO: 164424 - DNA, 75 bp, Artificial Sequence
  Synthetic
aagggctgagggacctctgtctccatgtgtgtataaaaagcaaggcacgttcataatgtaaaaaagaacacgttg

SEQ ID NO: 164425 - DNA, 75 bp, Artificial Sequence
  Synthetic
tgtgtgtataaaaagcaaggcacgttcataatgtaaaaaagaacacgttgtaaacaagctattgctgtatcattc

SEQ ID NO: 164426 - DNA, 75 bp, Artificial Sequence
  Synthetic
tgaaggctagcagggaggcgtagttgacgcggccttcgttcagattaacgagcgcgcattcgcgtaagatgtctg

SEQ ID NO: 164427 - DNA, 75 bp, Artificial Sequence
  Synthetic
gacgcggccttcgttcagattaacgagcgcgcattcgcgtaagatgtctgagcgtgtgacgccgtcgagcggagg

SEQ ID NO: 164428 - DNA, 75 bp, Artificial Sequence
  Synthetic
ttccccagagttatactatagtcatcatcctaaaattcagatataaatgaacacatgtcgttacgtacaaccata

SEQ ID NO: 164429 - DNA, 75 bp, Artificial Sequence
  Synthetic
gtcccgatacaggtactcgcgctccgcctccgtggcacccttcgtatgtgcctcaaagtcttcttccgtgtactg

SEQ ID NO: 164430 - DNA, 75 bp, Artificial Sequence
  Synthetic
gcctccgtggcacccttcgtatgtgcctcaaagtcttcttccgtgtactgaaccgcaaagtgcgtattgacgttc

SEQ ID NO: 164431 - DNA, 75 bp, Artificial Sequence
  Synthetic
aaatcatatgatccttcatgtttagttgacacgttacaaaatcccaaactgctgtgagtacagttacagatgcct

SEQ ID NO: 164432 - DNA, 75 bp, Artificial Sequence
  Synthetic
aaccgccgccggtggtcgaacaagaacgtggggctgtacacatagaggcacatgaaaaacgtgtaaaaattgtag

SEQ ID NO: 164433 - DNA, 75 bp, Artificial Sequence
  Synthetic
catgaaaaacgtgtaaaaattgtagacgatctgtatgagtttctcgcgaatctcgctgacaaagagcgagctctt

SEQ ID NO: 164434 - DNA, 75 bp, Artificial Sequence
  Synthetic
ctggaccggttccgagtagccctgggagccataactaaattggaccacagctacgacgaaaccaagtccagtgac

SEQ ID NO: 164435 - DNA, 75 bp, Artificial Sequence
  Synthetic
tcgcgttaccatctgcgtcagatccagtagccgctgcacgcgtcgcggcgtatgcaagtggtcttccagcacgcg

SEQ ID NO: 164436 - DNA, 75 bp, Artificial Sequence
  Synthetic
agtagccgctgcacgcgtcgcggcgtatgcaagtggtcttccagcacgcgatcgcacacgcgcgcgtaagcgtct

SEQ ID NO: 164437 - DNA, 75 bp, Artificial Sequence
  Synthetic
taggtcaacgatattctcgcacatttgtcactttatgtaatacatattttttaagattgtaaaacaacaggaaac

SEQ ID NO: 164438 - DNA, 75 bp, Artificial Sequence
  Synthetic
ttaagattgtaaaacaacaggaaacgattctcccggtccctcgtaaccaccatactctgtttcaacgctataaac

SEQ ID NO: 164439 - DNA, 75 bp, Artificial Sequence
  Synthetic
gacaggtaaaggtttacggtggagatacgcgtgctaatgatgggaaacatgaggccgctggcgtcacgcgcctgc

SEQ ID NO: 164440 - DNA, 75 bp, Artificial Sequence
  Synthetic
catactctgtttcaacgctataaacaccttcttgcgttgccgtcatattgcatatggttaacgatgtatgattgc

SEQ ID NO: 164441 - DNA, 75 bp, Artificial Sequence
  Synthetic
gctacctcggccttttcatacaaaccccgtgtccgcccctcttttccccgtgcccgatatacacgatattaaacc

SEQ ID NO: 164442 - DNA, 75 bp, Artificial Sequence
  Synthetic
tacgcgtgctaatgatgggaaacatgaggccgctggcgtcacgcgcctgcagattacccacgaacagcttgtagc

SEQ ID NO: 164443 - DNA, 75 bp, Artificial Sequence
  Synthetic
gcacgctgttcttgacgtagttttgaaactccacggccaaatcgccgttaaccgaacggtagtgtgtgtaaaaaa

SEQ ID NO: 164444 - DNA, 75 bp, Artificial Sequence
  Synthetic
aaactccacggccaaatcgccgttaaccgaacggtagtgtgtgtaaaaaaaatgcatcagaagcaccgtgtccag

SEQ ID NO: 164445 - DNA, 75 bp, Artificial Sequence
  Synthetic
cccgacttttttccaagtagaatgtacgtcagggctccacgttacagttccatttccattaacaggaattttaac

SEQ ID NO: 164446 - DNA, 75 bp, Artificial Sequence
  Synthetic
gtcgtccgtgtgccacggccgacacgcacctggcttttataggcagcgacgtgcacggcgcttgctggcgccgcc

SEQ ID NO: 164447 - DNA, 75 bp, Artificial Sequence
  Synthetic
gcacctggcttttataggcagcgacgtgcacggcgcttgctggcgccgccttggcgccgcgcagtctggaaggcc

SEQ ID NO: 164448 - DNA, 75 bp, Artificial Sequence
  Synthetic
caggtccaggagttcggccacggcgcgacaattgacgtagggccgcgcctccgtggcagccgtttccagctgcgt

SEQ ID NO: 164449 - DNA, 75 bp, Artificial Sequence
  Synthetic
cgacaattgacgtagggccgcgcctccgtggcagccgtttccagctgcgtgatcacccggcggaccagcggctgc

SEQ ID NO: 164450 - DNA, 75 bp, Artificial Sequence
  Synthetic
ccccccctcccctgggcgatcgcttctgcgtgtgtcctcgacgcgggttgtgccgtacttcgtctgtcgtttccc

SEQ ID NO: 164451 - DNA, 75 bp, Artificial Sequence
  Synthetic
gctaacgccgaacctagtgcagtaaaccgcgcttgcacccagaaccagcttatgtatcagccacaatcacatccg

SEQ ID NO: 164452 - DNA, 75 bp, Artificial Sequence
  Synthetic
gccgccgcggtgccgccgctctgttcggttattacggtctggatctcgcgcagggtctgcaacagcttctggaaa

SEQ ID NO: 164453 - DNA, 75 bp, Artificial Sequence
  Synthetic
cggttattacggtctggatctcgcgcagggtctgcaacagcttctggaaagccgtcagcgtggccccgttgtggt

SEQ ID NO: 164454 - DNA, 75 bp, Artificial Sequence
  Synthetic
gctcggcggcatacagcgggtcgcgcgccgtctgtaccgtggcgtggcttaggaggtaaaagaccacgttctgac

SEQ ID NO: 164455 - DNA, 75 bp, Artificial Sequence
  Synthetic
cgccgtctgtaccgtggcgtggcttaggaggtaaaagaccacgttctgacgcacgaagccaaagtggtagcccga

SEQ ID NO: 164456 - DNA, 75 bp, Artificial Sequence
  Synthetic
tcgcaacgaatcggggaacaggacgctgaacagctgcggacggacctggatacggaacctctgttgttgacggtg

SEQ ID NO: 164457 - DNA, 75 bp, Artificial Sequence
  Synthetic
tatagagaaataatgatagtttgacaacacatatggcagggatttcttcttcatcaataagatatgcaattcccc

SEQ ID NO: 164458 - DNA, 75 bp, Artificial Sequence
  Synthetic
ttggctcacggtatttaacgcctccgctttgtccgtggcccgtgcccgcagctgctctatcaactttttgaaatc

SEQ ID NO: 164459 - DNA, 75 bp, Artificial Sequence
  Synthetic
gctttgtccgtggcccgtgcccgcagctgctctatcaactttttgaaatctaccgtgcgcctcgccatcatggac

SEQ ID NO: 164460 - DNA, 75 bp, Artificial Sequence
  Synthetic
atattatatctggtgtatatactgaatgctgctggttcataaggtaacgatgctactttttttaattccaagatg

SEQ ID NO: 164461 - DNA, 75 bp, Artificial Sequence
  Synthetic
gtttttctttgttagtcttttgttgacttgctggttcctaaaagttcgcaaaaacgattgtgtgaagattttatg

SEQ ID NO: 164462 - DNA, 75 bp, Artificial Sequence
  Synthetic
cgcgaggtaaatactatatcggtgcgctacctctaccacgccgatcaccaggcgctcacggcgcgtttcttcgtg

SEQ ID NO: 164463 - DNA, 75 bp, Artificial Sequence
  Synthetic
gctacctctaccacgccgatcaccaggcgctcacggcgcgtttcttcgtgcccgagggcctggtagagttcgagg

SEQ ID NO: 164464 - DNA, 75 bp, Artificial Sequence
  Synthetic
acgttggttgactagttcatgagattctgctgtacgtgtgatggttattcgctggttcgttctaagatgagtatc

SEQ ID NO: 164465 - DNA, 75 bp, Artificial Sequence
  Synthetic
tctgctgtacgtgtgatggttattcgctggttcgttctaagatgagtatcgtactgtgtctgcgatggtcgtctc

SEQ ID NO: 164466 - DNA, 75 bp, Artificial Sequence
  Synthetic
tgttaggcattcgcgcctccaacatctcggctagcacgcgctgcctgctcgaaagcgtgtacacggcctcggccg

SEQ ID NO: 164467 - DNA, 75 bp, Artificial Sequence
  Synthetic
ctcggctagcacgcgctgcctgctcgaaagcgtgtacacggcctcggccgcgcgcgccgcgctgcagtggctgga

SEQ ID NO: 164468 - DNA, 75 bp, Artificial Sequence
  Synthetic
tttacttttcggttttctcgttggcgggtcagaggtagtcagatcatgagactgtcgtggtcgatgaaactgtgt

SEQ ID NO: 164469 - DNA, 75 bp, Artificial Sequence
  Synthetic
tacggagaaaaaagtcatcgggataaataaggctatacaaggcgttgtcaagcgtgcggctctaaacaaattaag

SEQ ID NO: 164470 - DNA, 75 bp, Artificial Sequence
  Synthetic
gttgctcacttgcgtcatgcgcggctacctttacaacacgctcaaaacggaggtgttcgcgttgatgataccgaa

SEQ ID NO: 164471 - DNA, 75 bp, Artificial Sequence
  Synthetic
tacctttacaacacgctcaaaacggaggtgttcgcgttgatgataccgaaagacatgtacctaacgtgggaagag

SEQ ID NO: 164472 - DNA, 75 bp, Artificial Sequence
  Synthetic
tacgtgctcacctccagcatcgcacactggcagaccctggtcgacgttgcacgcggaaagttcgcccgcgagcgc

SEQ ID NO: 164473 - DNA, 75 bp, Artificial Sequence
  Synthetic
actggcagaccctggtcgacgttgcacgcggaaagttcgcccgcgagcgctgtagctttgtcaaccgtcgcatca

SEQ ID NO: 164474 - DNA, 75 bp, Artificial Sequence
  Synthetic
acggcggccgcgcgcggaaaagaggaagcgcgcggcgcgactcgtccctggggaccgcggggggaatcacggcaa

SEQ ID NO: 164475 - DNA, 75 bp, Artificial Sequence
  Synthetic
gtcgacgtggttttctaacagtgtggttttatttattgaccagcggaatacacagtttacgagtaaaaaaaaaac

SEQ ID NO: 164476 - DNA, 75 bp, Artificial Sequence
  Synthetic
gaggagcggggcgtccgaaggcgaggatggcatggtctcgccggagcgcccggcttttatgggacactcgcgtcc

SEQ ID NO: 164477 - DNA, 75 bp, Artificial Sequence
  Synthetic
cctcgttcctggtacacaaagaactcaaactgtccgtcgtccgcttggacaactttagcgtcgaattgggagact

SEQ ID NO: 164478 - DNA, 75 bp, Artificial Sequence
  Synthetic
aactttagcgtcgaattgggagactttcgagaattcgtctgagcggcgctgacagcatacggggaggagacacag

SEQ ID NO: 164479 - DNA, 75 bp, Artificial Sequence
  Synthetic
ggttgggcattgcccacaggaagatgagtcacaacttccaaaccatcttgagacccgagtaacggtttacaggtc

SEQ ID NO: 164480 - DNA, 75 bp, Artificial Sequence
  Synthetic
gcacgccagtctcagctaaaaacagcggacagtcccacgctgtttctgttgtggctctctccagtttcctcatcg

SEQ ID NO: 164481 - DNA, 75 bp, Artificial Sequence
  Synthetic
aatctacctgatttctttgttcttttcctcgtaaacttatgaatccggctgacgcggacgaggaacagcgggtgt

SEQ ID NO: 164482 - DNA, 75 bp, Artificial Sequence
  Synthetic
acgcggcgacgcctctctacggccgactggttgtggtggtgaaagaagagcaccagcaatcccaggaggagcaac

SEQ ID NO: 164483 - DNA, 75 bp, Artificial Sequence
  Synthetic
gccaggtaggattccaagccgcggcgcggaaaccgagacggaggaatcgtcggcagaggccgccgctgatactac

SEQ ID NO: 164484 - DNA, 75 bp, Artificial Sequence
  Synthetic
cgggggagatgacagcgagctcgaggaggggccgctgcccgggggtgacaaggaagcgtccgctggaaataccaa

SEQ ID NO: 164485 - DNA, 75 bp, Artificial Sequence
  Synthetic
gaggggccgctgcccgggggtgacaaggaagcgtccgctggaaataccaacgtatcgagcggcgtagcgtgtgta

SEQ ID NO: 164486 - DNA, 75 bp, Artificial Sequence
  Synthetic
tagaaaaacagcacgtaggtcaggatccagatgctaatggcgatcatgatgacgatgatcatgcaggccaagacg

SEQ ID NO: 164487 - DNA, 75 bp, Artificial Sequence
  Synthetic
tccagatgctaatggcgatcatgatgacgatgatcatgcaggccaagacgcggcgcaccaatgccgaatccaaga

SEQ ID NO: 164488 - DNA, 75 bp, Artificial Sequence
  Synthetic
ctgtcgttgacgcgtgacggcggtcccgccgtgcccagtcgcggtggacgcgtgagtagcggtctgagcaccttc

SEQ ID NO: 164489 - DNA, 75 bp, Artificial Sequence
  Synthetic
ccgccgtgcccagtcgcggtggacgcgtgagtagcggtctgagcaccttcaatccggccggcgcgaccaggatgg

SEQ ID NO: 164490 - DNA, 75 bp, Artificial Sequence
  Synthetic
gtgttgaagggtaacgtgagggagatcatgtcatgggcgggctgaagaccgtgcggggaggatcgacgtgtgcgg

SEQ ID NO: 164491 - DNA, 75 bp, Artificial Sequence
  Synthetic
gcatgttgatgggcaaaaagtgtcattgtcacggctattggggcaagtttcgcttttgcggcgtacaggagccgg

SEQ ID NO: 164492 - DNA, 75 bp, Artificial Sequence
  Synthetic
ttgtcacggctattggggcaagtttcgcttttgcggcgtacaggagccggcgcgggagctgccgtccgacaggaa

SEQ ID NO: 164493 - DNA, 75 bp, Artificial Sequence
  Synthetic
catgcgccacggtccctgtctgattcgtcactcgccgcgttgcgatctgctgttgggtcgcttttatttcaaagc

SEQ ID NO: 164494 - DNA, 75 bp, Artificial Sequence
  Synthetic
cgtcactcgccgcgttgcgatctgctgttgggtcgcttttatttcaaagccaactgggcgcgcgaaagccgcacg

SEQ ID NO: 164495 - DNA, 75 bp, Artificial Sequence
  Synthetic
cgatgtgcaaatgccgggtcacagaacccattacaatgctaggcgcatactcggcctggggcgcgggctcgttcg

SEQ ID NO: 164496 - DNA, 75 bp, Artificial Sequence
  Synthetic
tggccacgctgatagtcctgctggtggtcttcttcgtaatttacgcgcgcgaggaggagaaaaacaacacgggca

SEQ ID NO: 164497 - DNA, 75 bp, Artificial Sequence
  Synthetic
aagctggccgaggagacggcgcgttttgtggaattggccggttgctggggtttgtacgcggccattttgtgtttg

SEQ ID NO: 164498 - DNA, 75 bp, Artificial Sequence
  Synthetic
ttgtggaattggccggttgctggggtttgtacgcggccattttgtgtttggataaggtgtgtcgccaactgcacg

SEQ ID NO: 164499 - DNA, 75 bp, Artificial Sequence
  Synthetic
actcgcgcatctatcgtttccatctggatgcgcgtttcgagggcgaggtgttggaatcggtgttgaagcgctgtc

SEQ ID NO: 164500 - DNA, 75 bp, Artificial Sequence
  Synthetic
ggatgcgcgtttcgagggcgaggtgttggaatcggtgttgaagcgctgtcgcgatgggcagctgtcgctgtccac

SEQ ID NO: 164501 - DNA, 75 bp, Artificial Sequence
  Synthetic
ccgttgatcgaaccgacgggcacagacgacgaagaggacgaggacgacgacgtctgataaggaaggcgagaacgt

SEQ ID NO: 164502 - DNA, 75 bp, Artificial Sequence
  Synthetic
tgacgccagttgggcggctatgtgcaaatggatgagcaccttgagttgcggcgtttctgtgtcggtgaacgtaac

SEQ ID NO: 164503 - DNA, 75 bp, Artificial Sequence
  Synthetic
aaatggatgagcaccttgagttgcggcgtttctgtgtcggtgaacgtaacgcgacttaacgccgatgtgaacagc

SEQ ID NO: 164504 - DNA, 75 bp, Artificial Sequence
  Synthetic
gtggacatgtgggacgtggccgctatccgcgtgatcaactttattctcaaagaaagcacgtcggagttgacgggg

SEQ ID NO: 164505 - DNA, 75 bp, Artificial Sequence
  Synthetic
tccgcgtgatcaactttattctcaaagaaagcacgtcggagttgacgggggtttgctacgctttcaacgtgccta

SEQ ID NO: 164506 - DNA, 75 bp, Artificial Sequence
  Synthetic
cggacctgggtcaggagtcggctttcgagaaagagtattcgcgctgcgagcaatcgtgccccaaggtggtcgtga

SEQ ID NO: 164507 - DNA, 75 bp, Artificial Sequence
  Synthetic
cgagaaagagtattcgcgctgcgagcaatcgtgccccaaggtggtcgtgaacacggacgattttctgaaaaagat

SEQ ID NO: 164508 - DNA, 75 bp, Artificial Sequence
  Synthetic
aagaggcagaccgagcaattatctcggatttaaaacgccagtggtccggcctctcactccattgcgcctgggttt

SEQ ID NO: 164509 - DNA, 75 bp, Artificial Sequence
  Synthetic
cagcgtgtgcctgccgccgtgcctgagtcccgatatggcgtcgtgccactttggcgagtgtgacatgccggtgca

SEQ ID NO: 164510 - DNA, 75 bp, Artificial Sequence
  Synthetic
agtcccgatatggcgtcgtgccactttggcgagtgtgacatgccggtgcagcggctgacggtgaacgtggctcgc

SEQ ID NO: 164511 - DNA, 75 bp, Artificial Sequence
  Synthetic
ggagatttagagtaaaatatgcgtactcaacatcgacggcgaagcaagtcatcatatacgcaaataatatgcatg

SEQ ID NO: 164512 - DNA, 75 bp, Artificial Sequence
  Synthetic
gatttgagcgtgctgcgcgagttggtgaccgaggcggtggtttggggtaacgcgcgcctggacgcgctaatgtcg

SEQ ID NO: 164513 - DNA, 75 bp, Artificial Sequence
  Synthetic
aaggcaagtgtaacaacacgactgctaatacttccatgtctacagcacttacaagcttgatacctactacacaac

SEQ ID NO: 164514 - DNA, 75 bp, Artificial Sequence
  Synthetic
taatacttccatgtctacagcacttacaagcttgatacctactacacaactgtcatctactttagaaaccaccgg

SEQ ID NO: 164515 - DNA, 75 bp, Artificial Sequence
  Synthetic
cgcgcgcctggacgcgctaatgtcggcgtccgaatggtgggtagagagcgcgctggaaaaactgcgtccgctgca

SEQ ID NO: 164516 - DNA, 75 bp, Artificial Sequence
  Synthetic
actttgcctcttgggacttgatcgagcgcatctttgagcacatgtactttgccgcggtgcgcgctagcgtcgatt

SEQ ID NO: 164517 - DNA, 75 bp, Artificial Sequence
  Synthetic
tgggagctctactatttctaccagacctattcaaacatctacaaccaacgcaactgtaatgacaacctcaccaaa

SEQ ID NO: 164518 - DNA, 75 bp, Artificial Sequence
  Synthetic
cctattcaaacatctacaaccaacgcaactgtaatgacaacctcaccaaacagcgacattaattcatcgacgcaa

SEQ ID NO: 164519 - DNA, 75 bp, Artificial Sequence
  Synthetic
gcgcatctttgagcacatgtactttgccgcggtgcgcgctagcgtcgatttgtgcaagtcgggtttgccgcgctg

SEQ ID NO: 164520 - DNA, 75 bp, Artificial Sequence
  Synthetic
cgccagcgcgcgctgggaagcgctgcgcgccgacatgctcgagttcggattgcgcaactgtcagtttctggcggt

SEQ ID NO: 164521 - DNA, 75 bp, Artificial Sequence
  Synthetic
gaaaacgtcagcacaccgcttccaatttgctcgtcatctaataacacattcaacgatacatcaaataaccatact

SEQ ID NO: 164522 - DNA, 75 bp, Artificial Sequence
  Synthetic
cgcgccgacatgctcgagttcggattgcgcaactgtcagtttctggcggtgggtcccgacgacgaggtggcgcat

SEQ ID NO: 164523 - DNA, 75 bp, Artificial Sequence
  Synthetic
ataacacacaatttaaccaccacatcgtgctacaaacaagcttggcttagacattttaatgtatctacacacgga

SEQ ID NO: 164524 - DNA, 75 bp, Artificial Sequence
  Synthetic
ccgcccaaccgtgagtgttacttccccaccgtggtgcggaggccgctgcgcgtgcccgtggtgaattacgcgtgg

SEQ ID NO: 164525 - DNA, 75 bp, Artificial Sequence
  Synthetic
ccaccgtggtgcggaggccgctgcgcgtgcccgtggtgaattacgcgtggttggagcagcaccaggaggagggca

SEQ ID NO: 164526 - DNA, 75 bp, Artificial Sequence
  Synthetic
tgtttgtggaccagtgcgtggccttggttttctactatgactctgggatgacgcccgacgtgcttctggccagga

SEQ ID NO: 164527 - DNA, 75 bp, Artificial Sequence
  Synthetic
agcatcactatgatttatgttttacatgcgatcagaatttatctttatctttgtacggtcttaactttactcatt

SEQ ID NO: 164528 - DNA, 75 bp, Artificial Sequence
  Synthetic
ggttttctactatgactctgggatgacgcccgacgtgcttctggccaggatgctcaagtggtaccactggcgctt

SEQ ID NO: 164529 - DNA, 75 bp, Artificial Sequence
  Synthetic
cgggcgtcttcgcagcgttcccggtcgtcgtgtgtgctctctataaaactttcgctcgctcgcgcccgctcctta

SEQ ID NO: 164530 - DNA, 75 bp, Artificial Sequence
  Synthetic
cgtcgtgtgtgctctctataaaactttcgctcgctcgcgcccgctccttagtcgagacttgcacgctgtccggga

SEQ ID NO: 164531 - DNA, 75 bp, Artificial Sequence
  Synthetic
cacatacatgtcaacagacttaccaagttctgacaggacatctttctcgggattatcattgcagtcttcggttac

SEQ ID NO: 164532 - DNA, 75 bp, Artificial Sequence
  Synthetic
acacatcacacggcagacgcactacgtggacgttagcattaatttgtgtagcctgcattctcctatttttcgtcc

SEQ ID NO: 164533 - DNA, 75 bp, Artificial Sequence
  Synthetic
atcgcgctcccgccggcggcgccgtacggctgcggagacacaggcacagcggaccccacggctcccgctatcgcg

SEQ ID NO: 164534 - DNA, 75 bp, Artificial Sequence
  Synthetic
agctgcgatctgtgatccgtgcgctcaaggagaacaccacggttaccttcttgcccacgccgtcgcttatcttgc

SEQ ID NO: 164535 - DNA, 75 bp, Artificial Sequence
  Synthetic
caaggagaacaccacggttaccttcttgcccacgccgtcgcttatcttgcaaacggtacgcagtcactgcgtgtc

SEQ ID NO: 164536 - DNA, 75 bp, Artificial Sequence
  Synthetic
ctgagcacgaggactaaacaacgtttccggataaatgtcttatgagaccacatcagaaaataaacgggcaagaaa

SEQ ID NO: 164537 - DNA, 75 bp, Artificial Sequence
  Synthetic
gccgctgctcggtaatttcatgtacctgacttccagcaaggacctgaccaagttctacgtgcaggacatctcgga

SEQ ID NO: 164538 - DNA, 75 bp, Artificial Sequence
  Synthetic
ctgacttccagcaaggacctgaccaagttctacgtgcaggacatctcggacctttcggccaagatctccatgtgc

SEQ ID NO: 164539 - DNA, 75 bp, Artificial Sequence
  Synthetic
acgttatggactggagatttacggttaagtggacgttactaatgattacgatatctgaaggttgcaatgacacgt

SEQ ID NO: 164540 - DNA, 75 bp, Artificial Sequence
  Synthetic
gccgtgcacgtggatttagatttcggcgtggtggccgacctgcttaagtggatcgggccgcatacccgcgtcaag

SEQ ID NO: 164541 - DNA, 75 bp, Artificial Sequence
  Synthetic
acagcacttcagctatcacaaatggaaccacgcacaaaccctctaccgcttcttcagtcacatcagcaaccactt

SEQ ID NO: 164542 - DNA, 75 bp, Artificial Sequence
  Synthetic
gatcgggccgcatacccgcgtcaagcgtaacgttaaaaaagcgccctgccctacgggcaccgtgcagattctggt

SEQ ID NO: 164543 - DNA, 75 bp, Artificial Sequence
  Synthetic
aaccacgcacaaaccctctaccgcttcttcagtcacatcagcaaccacttcaacgctttcaaaatcatcgtcaag

SEQ ID NO: 164544 - DNA, 75 bp, Artificial Sequence
  Synthetic
tcttcagtcacatcagcaaccacttcaacgctttcaaaatcatcgtcaagcgctacgccaacattaacgttttct

SEQ ID NO: 164545 - DNA, 75 bp, Artificial Sequence
  Synthetic
cagttttcacggcgtgaaaaacatgcgtatcaacgtgcagctgaagaacttctaccagacgctgctcaattgcgc

SEQ ID NO: 164546 - DNA, 75 bp, Artificial Sequence
  Synthetic
cactctaatttaaattacgaagtaattaatgtaacaggatatgtcggtggatacgtcactttgaaaaactgcagt

SEQ ID NO: 164547 - DNA, 75 bp, Artificial Sequence
  Synthetic
ttaatgtaacaggatatgtcggtggatacgtcactttgaaaaactgcagtagaacggatgtatggcacgatatag

SEQ ID NO: 164548 - DNA, 75 bp, Artificial Sequence
  Synthetic
cgtatcaacgtgcagctgaagaacttctaccagacgctgctcaattgcgccgtcaccaaactgccgtgcacgttg

SEQ ID NO: 164549 - DNA, 75 bp, Artificial Sequence
  Synthetic
accgaggaacctttccagcgtggcgatcccttcgataaaaattacgtcgggaacagcggcaagtcgcgtggcggc

SEQ ID NO: 164550 - DNA, 75 bp, Artificial Sequence
  Synthetic
gcatgtgtttagactgcaataagacctctctcactatatacaacgtaactacagaacacgctggaaaatacgttt

SEQ ID NO: 164551 - DNA, 75 bp, Artificial Sequence
  Synthetic
tgcaacgttacagtgacggtaaaaaggaaaactactatttaaccgtgttatcaggaactgcaacatcgtctccta

SEQ ID NO: 164552 - DNA, 75 bp, Artificial Sequence
  Synthetic
cgacgacggcccgggtctggataacgatctcatgaacgagcccatgggtctcggcggtctgggaggaggtggcgg

SEQ ID NO: 164553 - DNA, 75 bp, Artificial Sequence
  Synthetic
tcggcggtctgggaggaggtggcggcggtggcggcaagaagcacgaccgcggtggtggcggtggttccggtacgc

SEQ ID NO: 164554 - DNA, 75 bp, Artificial Sequence
  Synthetic
cggtggcggcaagaagcacgaccgcggtggtggcggtggttccggtacgcggaaaatgagcagcggtggcggcgg

SEQ ID NO: 164555 - DNA, 75 bp, Artificial Sequence
  Synthetic
taaaaaacactaacattcccctgggaattcatgctgtatgggcgggtatagtggtatctgtggcacttatagcct

SEQ ID NO: 164556 - DNA, 75 bp, Artificial Sequence
  Synthetic
aattcatgctgtatgggcgggtatagtggtatctgtggcacttatagccttatacatgggtagccgtcgcgtccc

SEQ ID NO: 164557 - DNA, 75 bp, Artificial Sequence
  Synthetic
aggtggatcgggcggcggcggaggaggaggaggcggcggtttggatcgcaactccggcaattacttcaacgacgc

SEQ ID NO: 164558 - DNA, 75 bp, Artificial Sequence
  Synthetic
ggaggaggcggcggtttggatcgcaactccggcaattacttcaacgacgcgaaagaggagagcgacagcgaggat

SEQ ID NO: 164559 - DNA, 75 bp, Artificial Sequence
  Synthetic
ataaacttttgtttttatttttagccaataatgtctccgtgtggtttttgtgggttaagcacttatggtgtgaag

SEQ ID NO: 164560 - DNA, 75 bp, Artificial Sequence
  Synthetic
caataatgtctccgtgtggtttttgtgggttaagcacttatggtgtgaagcagaatattcatagttattaaaaac

SEQ ID NO: 164561 - DNA, 75 bp, Artificial Sequence
  Synthetic
gcgcgcacggcgcggtcccgtgatggagaaaacgccggcggagacgacggcgatttcagctggcaacgtgccacg

SEQ ID NO: 164562 - DNA, 75 bp, Artificial Sequence
  Synthetic
gagaaaacgccggcggagacgacggcgatttcagctggcaacgtgccacgtgactcaattccgtgtataactaac

SEQ ID NO: 164563 - DNA, 75 bp, Artificial Sequence
  Synthetic
ttagttccggtacttttacatgaacaagaaaaaacattttaccggcgattttttacgcaaagtcaacatgtagaa

SEQ ID NO: 164564 - DNA, 75 bp, Artificial Sequence
  Synthetic
ttttacgcaaagtcaacatgtagaaagacccatcacggtaactcagggagatacagtttacctgaacggtagtaa

SEQ ID NO: 164565 - DNA, 75 bp, Artificial Sequence
  Synthetic
ggacactttaggcggcgcagcgccagccttagctttcttgactggccggacggcagcgtcacagagggcgttcgg

SEQ ID NO: 164566 - DNA, 75 bp, Artificial Sequence
  Synthetic
gccttagctttcttgactggccggacggcagcgtcacagagggcgttcggacgacctccgcgtcggtcgccgcct

SEQ ID NO: 164567 - DNA, 75 bp, Artificial Sequence
  Synthetic
catctttgtatctctccttaccgggcccaacggagttactcgcacagccatcgggggtctgtattcaaactacac

SEQ ID NO: 164568 - DNA, 75 bp, Artificial Sequence
  Synthetic
gtggatggaacggatacatacataaacagtaccacgaaaacaaatcatgctctccgcgatttacatgttttaacg

SEQ ID NO: 164569 - DNA, 75 bp, Artificial Sequence
  Synthetic
acgcgctggctgtcgagctggtcaacgagaccttccgctgctctgtcacctccgacgcccgcaaggacctgcaga

SEQ ID NO: 164570 - DNA, 75 bp, Artificial Sequence
  Synthetic
tacacggaatacgtgtatgaatgcgatttgccatgtaatacaagtgactatgatgaatatgacatactaaactat

SEQ ID NO: 164571 - DNA, 75 bp, Artificial Sequence
  Synthetic
cgagaccttccgctgctctgtcacctccgacgcccgcaaggacctgcagaagctggttcgtcgcgtcagcggcac

SEQ ID NO: 164572 - DNA, 75 bp, Artificial Sequence
  Synthetic
cttgacaattgtactactaccataaacagcaccaattatattattaccgtattgtctccacgtcattctaaacac

SEQ ID NO: 164573 - DNA, 75 bp, Artificial Sequence
  Synthetic
acagcaccaattatattattaccgtattgtctccacgtcattctaaacacaccaattcccacatatctattcacg

SEQ ID NO: 164574 - DNA, 75 bp, Artificial Sequence
  Synthetic
tctcaatattaaaggtttggagaagaccttcctgtgctgcgacaagttcctgctgccggtgggcactgtgagtcg

SEQ ID NO: 164575 - DNA, 75 bp, Artificial Sequence
  Synthetic
ggggagtcgcgggccccggggcacactgcacaacccgcgtcgaggacacacgcagacacggcccgccaacacacc

SEQ ID NO: 164576 - DNA, 75 bp, Artificial Sequence
  Synthetic
accttcctgtgctgcgacaagttcctgctgccggtgggcactgtgagtcgttgcgaagccatcggccgcccaccg

SEQ ID NO: 164577 - DNA, 75 bp, Artificial Sequence
  Synthetic
cggtccggtttccgcggcttcgtgcaggagggcctgcgcaactacgcgccgctgcgcgaagaactgggctatgtc

SEQ ID NO: 164578 - DNA, 75 bp, Artificial Sequence
  Synthetic
aggagggcctgcgcaactacgcgccgctgcgcgaagaactgggctatgtccgcttcgagaccggcggcgacgtgg

SEQ ID NO: 164579 - DNA, 75 bp, Artificial Sequence
  Synthetic
cgcacgacgcgatcacggtgacacccatgactagacccacgcagatagccagccccgctagcgtatccagcgcca

SEQ ID NO: 164580 - DNA, 75 bp, Artificial Sequence
  Synthetic
actttaaacgccgttgtattcctaccccatctccagacaaggcagatctgcgagtggaatttccttcgttatctc

SEQ ID NO: 164581 - DNA, 75 bp, Artificial Sequence
  Synthetic
gttggcgagacggtaatgaggcgctgacgacggtcgtcttgaacgggagccagacttacgaggatccggcccacg

SEQ ID NO: 164582 - DNA, 75 bp, Artificial Sequence
  Synthetic
gacgacggtcgtcttgaacgggagccagacttacgaggatccggcccacggcaactggttaaaagagacgtgctc

SEQ ID NO: 164583 - DNA, 75 bp, Artificial Sequence
  Synthetic
gaacataattcaaggaaagtgcaggttcctgttgctatgttaccacaggagatcacggaacataaatgttttctg

SEQ ID NO: 164584 - DNA, 75 bp, Artificial Sequence
  Synthetic
ggtgaacgagagcggcgccgtcttcggcgtgcatcccgagacgcggcaggcgcactttctggcgcgcggactcct

SEQ ID NO: 164585 - DNA, 75 bp, Artificial Sequence
  Synthetic
ggcgtgcatcccgagacgcggcaggcgcactttctggcgcgcggactcctgggcttctttcgcgtcgggttcttg

SEQ ID NO: 164586 - DNA, 75 bp, Artificial Sequence
  Synthetic
accggctgtcccagagaactgttttgccgtcgtttgcgcaaaaagaaggggctctttgctcgaaggtgagccgcg

SEQ ID NO: 164587 - DNA, 75 bp, Artificial Sequence
  Synthetic
gacgccgtcggtaccgtctccaccacagttaccaccgtcgccgtcactgccaccgacatggagcccacgccgatg

SEQ ID NO: 164588 - DNA, 75 bp, Artificial Sequence
  Synthetic
ccgtaagatgatcctcgtatcacatgaggtctggatatgtataaatgaggagtgaaataggcacagggaatcaga

SEQ ID NO: 164589 - DNA, 75 bp, Artificial Sequence
  Synthetic
acaccaccgccgccaccacccgactgcagcccaccgccctatcgacccccgtactgcctggttagttcgccgtcg

SEQ ID NO: 164590 - DNA, 75 bp, Artificial Sequence
  Synthetic
gcagcccaccgccctatcgacccccgtactgcctggttagttcgccgtcgccgcgacacacgttcgacatggata

SEQ ID NO: 164591 - DNA, 75 bp, Artificial Sequence
  Synthetic
taatcaacgtaactggacacgtcggtagcaacgtcactctgaaaaaatgtaatgatacagcatggtacaatgtgg

SEQ ID NO: 164592 - DNA, 75 bp, Artificial Sequence
  Synthetic
tcttagtggtcgctatattagggatcattttcttggccgtggtgttcaccgtggtgattaaccgggacaattcca

SEQ ID NO: 164593 - DNA, 75 bp, Artificial Sequence
  Synthetic
tgtttttgcgaattgttcaatcagcacgacgactgctcctgtggaatggaagtctcccaaccgtcagattcccaa

SEQ ID NO: 164594 - DNA, 75 bp, Artificial Sequence
  Synthetic
tgtaccatcattgctgctacggaataataactacgctacgacctggcctgtggtgtgtgttgttttttgtgcacg

SEQ ID NO: 164595 - DNA, 75 bp, Artificial Sequence
  Synthetic
gaatattacttgcgctaattactcagggaccgtcggcggtaacgttacttttcagggtctcaagaataaaacgga

SEQ ID NO: 164596 - DNA, 75 bp, Artificial Sequence
  Synthetic
tggtgtgtgttgttttttgtgcacgcacgacatgacactcttttgccgtaccgccaacagcaccgccggctacgt

SEQ ID NO: 164597 - DNA, 75 bp, Artificial Sequence
  Synthetic
cacgacatgacactcttttgccgtaccgccaacagcaccgccggctacgtcgacatgaacgtctgcatcggcatg

SEQ ID NO: 164598 - DNA, 75 bp, Artificial Sequence
  Synthetic
tccacaatcaccgtccccacacgatgggcccggcaggtcacccaacgttggttcaggcccagtcgggtttttccc

SEQ ID NO: 164599 - DNA, 75 bp, Artificial Sequence
  Synthetic
taatgagcagcattacagatatgaagtaaccaacctcacgtacaattgcacctatgaccgcctgacgttactgaa

SEQ ID NO: 164600 - DNA, 75 bp, Artificial Sequence
  Synthetic
caaaagacttaccacctcctgggtaccgagtcggacgacgaggagaccacggtttgggaaaagcgccggatggag

SEQ ID NO: 164601 - DNA, 75 bp, Artificial Sequence
  Synthetic
ccgagtcggacgacgaggagaccacggtttgggaaaagcgccggatggagtcggatacagacttttaaaagaagc

SEQ ID NO: 164602 - DNA, 75 bp, Artificial Sequence
  Synthetic
gtaaccaacctcacgtacaattgcacctatgaccgcctgacgttactgaatctgacaacggaaaacagcaggaat

SEQ ID NO: 164603 - DNA, 75 bp, Artificial Sequence
  Synthetic
cacgtgaagttccacagaaccgcgcagctgtagctattgtgtttacgttgcttttgaaatgttaagcgtccctac

SEQ ID NO: 164604 - DNA, 75 bp, Artificial Sequence
  Synthetic
cgtcattcgggccaggactttttaatggccaacagcctgtggcaccgcctccgaacgttcgtgagcaacagtcgg

SEQ ID NO: 164605 - DNA, 75 bp, Artificial Sequence
  Synthetic
cagaatgaacaaattcagcaacactcgtatcggcttcacttgcgcggttatgactccgcggactttaattctgac

SEQ ID NO: 164606 - DNA, 75 bp, Artificial Sequence
  Synthetic
ttgtgccacgttcgagtcctgctgttacgacatcaccgaggcggagagtaacaaggctatatcaagggacgaagc

SEQ ID NO: 164607 - DNA, 75 bp, Artificial Sequence
  Synthetic
gacgtccgctcacggtccgttatgtccgctcgtgttccagggttgggcgtacgccgtgtaccaccaaggcgacat

SEQ ID NO: 164608 - DNA, 75 bp, Artificial Sequence
  Synthetic
ggccctcatgacgctcgacgtgtactgttgccgccagacctccaacaacaccgccgtcgcgttctcgcgtcatct

SEQ ID NO: 164609 - DNA, 75 bp, Artificial Sequence
  Synthetic
ttttcgcgcgcaacaccaggattgcccggcccagacggtgcacgtgcgcggcgtaaacgaaagcgcttttgggct

SEQ ID NO: 164610 - DNA, 75 bp, Artificial Sequence
  Synthetic
ccggcccagacggtgcacgtgcgcggcgtaaacgaaagcgcttttgggctcacccacctgcagtcctgttgcctg

SEQ ID NO: 164611 - DNA, 75 bp, Artificial Sequence
  Synthetic
tgggccatgtacactgtgggcattctggccctgggctcgttctcctccttctattcccagatcgctaggagcctg

SEQ ID NO: 164612 - DNA, 75 bp, Artificial Sequence
  Synthetic
tggccctgggctcgttctcctccttctattcccagatcgctaggagcctgggggttctgcccaacgatcatcact

SEQ ID NO: 164613 - DNA, 75 bp, Artificial Sequence
  Synthetic
cgggtgggctggggtgtgcttggtaactcactgtttgaatacgcgctcacgcacatatgtagcactcaacatgtt

SEQ ID NO: 164614 - DNA, 75 bp, Artificial Sequence
  Synthetic
actcactgtttgaatacgcgctcacgcacatatgtagcactcaacatgttagcttttgctcgcacgccccggggc

SEQ ID NO: 164615 - DNA, 75 bp, Artificial Sequence
  Synthetic
aagaaaatcgatcagtgtcgtgacgtgtggtgtgtgtttttcactgttattgggtaccagggaggaggggttaag

SEQ ID NO: 164616 - DNA, 75 bp, Artificial Sequence
  Synthetic
tgtggtgtgtgtttttcactgttattgggtaccagggaggaggggttaagaggtcacaggtgcgatttaccgtaa

SEQ ID NO: 164617 - DNA, 75 bp, Artificial Sequence
  Synthetic
ccagcacgcccaaaagccccccgtccacgccccgaagacactcttagcccggttcggcgaacaaagaccgtggga

SEQ ID NO: 164618 - DNA, 75 bp, Artificial Sequence
  Synthetic
catcaggttgtaacataacccaatggggacgttaccagaatggaagtacgctggggccatggtgtaccctgtggg

SEQ ID NO: 164619 - DNA, 75 bp, Artificial Sequence
  Synthetic
cccctcacgtcagtgttgtcccctatccgcgtgagctgggtggctcaccgtcaggtgctccgagacgcgcgtact

SEQ ID NO: 164620 - DNA, 75 bp, Artificial Sequence
  Synthetic
tccgcgtgagctgggtggctcaccgtcaggtgctccgagacgcgcgtactcggaaagtgcgtcaatgcggtcggt

SEQ ID NO: 164621 - DNA, 75 bp, Artificial Sequence
  Synthetic
ccctgtcccgcaccggcgtcggtcggggtgtgcggggggtgcggctgggtgggtgtgtgccgggtgtgtcgcggg

SEQ ID NO: 164622 - DNA, 75 bp, Artificial Sequence
  Synthetic
cagccgaccctttgatgtagtacatcgcgtgcgaagatgaaaaacatcttaagaaaccgggtcgcctaaggggaa

SEQ ID NO: 164623 - DNA, 75 bp, Artificial Sequence
  Synthetic
tttctcaaaatcatagtggcacttattatcaaaaaggtgacaactgtaccgacaaacatataacactatcttgtt

SEQ ID NO: 164624 - DNA, 75 bp, Artificial Sequence
  Synthetic
gggtgtgcggggggtgcggctgggtgggtgtgtgccgggtgtgtcgcgggtgtgtcggcggggtgtggcgggtgt

SEQ ID NO: 164625 - DNA, 75 bp, Artificial Sequence
  Synthetic
aaccccacgtgtcttgggcgcgtcatgtccggcgtcttcatgtatataagacggtgtttcaagacgacgtgagac

SEQ ID NO: 164626 - DNA, 75 bp, Artificial Sequence
  Synthetic
tgtccggcgtcttcatgtatataagacggtgtttcaagacgacgtgagacccacacgcgggtttcacttctttct

SEQ ID NO: 164627 - DNA, 75 bp, Artificial Sequence
  Synthetic
agccggttacgagggatttgggtgggacggggaaactttaatggagctcaaggataacctgacactatggacggg

SEQ ID NO: 164628 - DNA, 75 bp, Artificial Sequence
  Synthetic
tggatccagcgaaaacgccttgaagatcctctcccgccttggttaagaaagaaaaaagcatgtgcgctcacccgg

SEQ ID NO: 164629 - DNA, 75 bp, Artificial Sequence
  Synthetic
gcgtgggtcgggtgtgtcgggggtgtgccttcggcgtgtgtcctcgacgcgggttgtgcgcctgccgctcccggc

SEQ ID NO: 164630 - DNA, 75 bp, Artificial Sequence
  Synthetic
atcctctcccgccttggttaagaaagaaaaaagcatgtgcgctcacccggcgttctcggcaccggttacgccgcc

SEQ ID NO: 164631 - DNA, 75 bp, Artificial Sequence
  Synthetic
ccggggaggagagcgtaacggaggacacagagcgggaggacacggaggaggaaagggaggatgaagaagaagaaa

SEQ ID NO: 164632 - DNA, 75 bp, Artificial Sequence
  Synthetic
tgacggttccacgattccgttggacagtgcatcatgtgtacaataaactattgattttagcgttgtttgcccccg

SEQ ID NO: 164633 - DNA, 75 bp, Artificial Sequence
  Synthetic
tccgggatagtataagaagggactttaccgctattgctgctattcatagagaaggatagaaaggatgactacgac

SEQ ID NO: 164634 - DNA, 75 bp, Artificial Sequence
  Synthetic
taccgctattgctgctattcatagagaaggatagaaaggatgactacgaccacgcatagcactgccgctatcatg

SEQ ID NO: 164635 - DNA, 75 bp, Artificial Sequence
  Synthetic
tttcaacgccttatgtgggtttaagtctaagttgtgcggctagccagatcaccatcttcaacctgacgttgaaca

SEQ ID NO: 164636 - DNA, 75 bp, Artificial Sequence
  Synthetic
tctaagttgtgcggctagccagatcaccatcttcaacctgacgttgaacaactcgggtcgttacggagcagaagg

SEQ ID NO: 164637 - DNA, 75 bp, Artificial Sequence
  Synthetic
aaggtggcgcttcgctacgcggtgaggaaactgatgaagcgcggagccaggctgcggcacgactcgggtctctac

SEQ ID NO: 164638 - DNA, 75 bp, Artificial Sequence
  Synthetic
ggaaactgatgaagcgcggagccaggctgcggcacgactcgggtctctacgtgtgcatctgcgacccttcgtacg

SEQ ID NO: 164639 - DNA, 75 bp, Artificial Sequence
  Synthetic
ctcagctaataacgtaacaaccatcgttacaacgacgccgacggtgactggcgcggagagtaacgggactagaaa

SEQ ID NO: 164640 - DNA, 75 bp, Artificial Sequence
  Synthetic
ctggccgtcccctgggaacttcctcttttccccggggaatcacacagacacagatcaactccacacagacacacg

SEQ ID NO: 164641 - DNA, 75 bp, Artificial Sequence
  Synthetic
tgttcggggtcatcgaggcctgggaggaagcttcggtgcggcccacgcgtcagctggtgttgttcatgacaccca

SEQ ID NO: 164642 - DNA, 75 bp, Artificial Sequence
  Synthetic
ggaagcttcggtgcggcccacgcgtcagctggtgttgttcatgacacccaagtgggacgtgttcgcctacgactc

SEQ ID NO: 164643 - DNA, 75 bp, Artificial Sequence
  Synthetic
ggccttggtaggtgttgtcgtgtttttgattctgatagttgtttgtattatggggtggtggaaattgttgtgtag

SEQ ID NO: 164644 - DNA, 75 bp, Artificial Sequence
  Synthetic
ttttatcagggagaaggttttgtgcccacaatgactagcccgggactatctacgtcggaaaattacaacggaaat

SEQ ID NO: 164645 - DNA, 75 bp, Artificial Sequence
  Synthetic
tttgttcccggtggaggtgcgttcccacgtccgtcagcacgcgcacactatggacgacctggtgatggtcttcca

SEQ ID NO: 164646 - DNA, 75 bp, Artificial Sequence
  Synthetic
cacgtccgtcagcacgcgcacactatggacgacctggtgatggtcttccaccagctggactacgaaaagcaagtg

SEQ ID NO: 164647 - DNA, 75 bp, Artificial Sequence
  Synthetic
ttgttgggaagcacggagactgcggtaaactttgacaacgcgactacgattatcccacaacgtgtggaacacccg

SEQ ID NO: 164648 - DNA, 75 bp, Artificial Sequence
  Synthetic
atcctggaatctgagcggcggatccgcgaagggaaaattcctatgaccttcgtggatcgcgactcgctgcgagcc

SEQ ID NO: 164649 - DNA, 75 bp, Artificial Sequence
  Synthetic
gcgaagggaaaattcctatgaccttcgtggatcgcgactcgctgcgagccaattcgttggcccacatccaagcca

SEQ ID NO: 164650 - DNA, 75 bp, Artificial Sequence
  Synthetic
ttcatgacggacacagaactatgatgttccggtacgcgttattacttcgatggataacaatcattctttgtacac

SEQ ID NO: 164651 - DNA, 75 bp, Artificial Sequence
  Synthetic
aagaagaccccgctgccgccgccacccctccgtcctccgccgccaccacccccccgtcctctgtcgtcccggcct

SEQ ID NO: 164652 - DNA, 75 bp, Artificial Sequence
  Synthetic
ccgtcgagagcgagttgtccttgtcgccgccgctgccgccggtcgtggtgaaggatgtgatgtacacggccgggg

SEQ ID NO: 164653 - DNA, 75 bp, Artificial Sequence
  Synthetic
tatctcccgttaacaaattgtcagtcaaagacgatgcttttcaatggtatatagacaaaccgagagttactaacg

SEQ ID NO: 164654 - DNA, 75 bp, Artificial Sequence
  Synthetic
cactatgtatttatcaaaataacgagtgcagtgtacaacccaatgagaacgctccgaacattaagtggcaatgtg

SEQ ID NO: 164655 - DNA, 75 bp, Artificial Sequence
  Synthetic
tttttttgtagtattttttcatagttgctatacctcagttatcccccctattagccccacatgctgcttaataaa

SEQ ID NO: 164656 - DNA, 75 bp, Artificial Sequence
  Synthetic
ttagccccacatgctgcttaataaacatacttgtttcattttctttctagtgccgcggttttttgtcgcgtccac

SEQ ID NO: 164657 - DNA, 75 bp, Artificial Sequence
  Synthetic
taatttaacaactacatatagtagaaattactattttaattcttttgaaacccttggagtaacaatagcaaaata

SEQ ID NO: 164658 - DNA, 75 bp, Artificial Sequence
  Synthetic
caataccctgtgttacaatgtcagtgtacattctgcctaccaaacacactgttgtacaaccacgttatccatgta

SEQ ID NO: 164659 - DNA, 75 bp, Artificial Sequence
  Synthetic
acgtgagtctccgtcaataaaaagtcccgtgtcgtctccacgtaggtttctgtgtggctgttgttgacgctgctt

SEQ ID NO: 164660 - DNA, 75 bp, Artificial Sequence
  Synthetic
gttgtacaaccacgttatccatgtattcacccacacccgtacacaggtcatacacattaacttcaaccaacttca

SEQ ID NO: 164661 - DNA, 75 bp, Artificial Sequence
  Synthetic
tgtgtggctgttgttgacgctgctttggagcacgggacacggtgtttcggtccgatgtacgtaccacggtacgga

SEQ ID NO: 164662 - DNA, 75 bp, Artificial Sequence
  Synthetic
tggagcacgggacacggtgtttcggtccgatgtacgtaccacggtacggacgttaatcgcacttccaacaccacg

SEQ ID NO: 164663 - DNA, 75 bp, Artificial Sequence
  Synthetic
agactgcccttgaatgtaacgtttaatcaatcacgacggaaatggcacagcgtcatgcttaaatttggttttcag

SEQ ID NO: 164664 - DNA, 75 bp, Artificial Sequence
  Synthetic
atcaatcacgacggaaatggcacagcgtcatgcttaaatttggttttcagtatcacctggaaggctggtttcccc

SEQ ID NO: 164665 - DNA, 75 bp, Artificial Sequence
  Synthetic
cgaacgtgaccgtgggacaactgacgctcaacttcaccggccacagctacgtgttgcgggcaatagcgcacacga

SEQ ID NO: 164666 - DNA, 75 bp, Artificial Sequence
  Synthetic
gctcaacttcaccggccacagctacgtgttgcgggcaatagcgcacacgagtccgttcgaatcatacgtacgttg

SEQ ID NO: 164667 - DNA, 75 bp, Artificial Sequence
  Synthetic
tttacaggtattccgaaacctgtatggaggtcactgtcagagtaggtgatccagttaccctcggtagtggacatg

SEQ ID NO: 164668 - DNA, 75 bp, Artificial Sequence
  Synthetic
cgcggaaagtgattatatctttctacaagacatgtgcccgcgatttctcaagaggaccgttaagctcacgagaaa

SEQ ID NO: 164669 - DNA, 75 bp, Artificial Sequence
  Synthetic
agaggaccgttaagctcacgagaaacaaaacaaaacataacgtgacagttacgggaaataacatgacaacgcttc

SEQ ID NO: 164670 - DNA, 75 bp, Artificial Sequence
  Synthetic
gatcccagaaactattgcaggcgaaaatgtccaccaaagggtaactgtgagtttcccacatgttttacattatcg

SEQ ID NO: 164671 - DNA, 75 bp, Artificial Sequence
  Synthetic
ctctcctccgagccaaaagtcgcgccttgggacactgggcgttgttgagcatatgtactgtggcggcgggcagca

SEQ ID NO: 164672 - DNA, 75 bp, Artificial Sequence
  Synthetic
cttgggacactgggcgttgttgagcatatgtactgtggcggcgggcagcatcgcgttgctcagcctcttttgcat

SEQ ID NO: 164673 - DNA, 75 bp, Artificial Sequence
  Synthetic
agggcaaagtcggcgatctgtcgtagtgcccactggggaatgagatgttgctgattctgtttagaaagtatgtag

SEQ ID NO: 164674 - DNA, 75 bp, Artificial Sequence
  Synthetic
aaaaaacgacgttcatcggatcgtctgacgtcaacgctgatagtgtctataaaggccgtgccgccgcgccgtagt

SEQ ID NO: 164675 - DNA, 75 bp, Artificial Sequence
  Synthetic
tgacgtcaacgctgatagtgtctataaaggccgtgccgccgcgccgtagttctccgaaggcggacggaggagtct

SEQ ID NO: 164676 - DNA, 75 bp, Artificial Sequence
  Synthetic
tttgcggactcgtttaccggtaacgtagaggcacatagagccaaagatgccgcacacagcgcatggattctcatt

SEQ ID NO: 164677 - DNA, 75 bp, Artificial Sequence
  Synthetic
aaagggcgagcgtccccggagagggtatattcgtttggcgagagcgggcggcggtggtgggtatgtccccttctg

SEQ ID NO: 164678 - DNA, 75 bp, Artificial Sequence
  Synthetic
ggacacgctgatggcctacggctgcatcgccatccgagccggggactttaacggtctcaacgactttctggagca

SEQ ID NO: 164679 - DNA, 75 bp, Artificial Sequence
  Synthetic
atcgccatccgagccggggactttaacggtctcaacgactttctggagcaggaatgcggcacccggctgcacgtg

SEQ ID NO: 164680 - DNA, 75 bp, Artificial Sequence
  Synthetic
catgtggaaatcacctgtggtagaatgctgctcaggtacattacctttcatcgcgaaaaggtactttacctaacg

SEQ ID NO: 164681 - DNA, 75 bp, Artificial Sequence
  Synthetic
tcgcgaaaaggtactttacctaacggctgcatgcatctttggtgtctacatcagcctctatgatgcctgcatacc

SEQ ID NO: 164682 - DNA, 75 bp, Artificial Sequence
  Synthetic
gtctgttcgcaaggtaagccccacgtcgttgaagacacctggaaagaggacgttcgctcgggcacgttctttcca

SEQ ID NO: 164683 - DNA, 75 bp, Artificial Sequence
  Synthetic
ttctctctaccaggtgcttacgtctgctgtcaggagtacctgcacccctttggcttcgtcgagggtccgggcttt

SEQ ID NO: 164684 - DNA, 75 bp, Artificial Sequence
  Synthetic
atgcgctaccaactcatcgtgctcatcgggcagcgcggcggcatctactgctacgatgacctgcgcgactgcgtc

SEQ ID NO: 164685 - DNA, 75 bp, Artificial Sequence
  Synthetic
tcgggcagcgcggcggcatctactgctacgatgacctgcgcgactgcgtctacgagctggcggccaccatgaagg

SEQ ID NO: 164686 - DNA, 75 bp, Artificial Sequence
  Synthetic
aattacagcctcctcctcattaacgttaccgcgcagtatagtactacctatcgtactatgacatcgctagacgat

SEQ ID NO: 164687 - DNA, 75 bp, Artificial Sequence
  Synthetic
acgacgactactggaacgccgtcatgctctaccgcggtgacgtggagagcctgtcggccgaggtgaccaagcggg

SEQ ID NO: 164688 - DNA, 75 bp, Artificial Sequence
  Synthetic
gctatgactatagagattcatcgagatatcaaacttcaaataggcggctatcattcatggttgtggtgactatat

SEQ ID NO: 164689 - DNA, 75 bp, Artificial Sequence
  Synthetic
gatttcgccaccgggactttccgcacggcggtttcgccaccgctgacgttctcatcgccgcccacgtcaacggtg

SEQ ID NO: 164690 - DNA, 75 bp, Artificial Sequence
  Synthetic
gctctaccgcggtgacgtggagagcctgtcggccgaggtgaccaagcggggctacgcttcctacagcatcgacga

SEQ ID NO: 164691 - DNA, 75 bp, Artificial Sequence
  Synthetic
atccttcagcgtcgtccgcgcgggcggcagcatccagaccatggagctcatgatccgtaccgtgccgcgcatcac

SEQ ID NO: 164692 - DNA, 75 bp, Artificial Sequence
  Synthetic
ggcagcatccagaccatggagctcatgatccgtaccgtgccgcgcatcacctgttaccaccagctgttaggcgcg

SEQ ID NO: 164693 - DNA, 75 bp, Artificial Sequence
  Synthetic
aaatccagcacccctaacagtcacgtagaacatcacgttggttttgaagccacagcagcggaaacaccgttacaa

SEQ ID NO: 164694 - DNA, 75 bp, Artificial Sequence
  Synthetic
atcattttctactttcgaataccgcaaaagctgtggttgctctggcagcatgacaagcacggcatcgtgctcatc

SEQ ID NO: 164695 - DNA, 75 bp, Artificial Sequence
  Synthetic
gggatgaaacatatctagatacgcagttttgttatccgaacaaagctcgtgtgatgcgaaaaacggtactgcagg

SEQ ID NO: 164696 - DNA, 75 bp, Artificial Sequence
  Synthetic
tacggctacgaccccgccatggacgccgtctaccgtctggccgaggacgtggttatgtttacctgcgtcatggga

SEQ ID NO: 164697 - DNA, 75 bp, Artificial Sequence
  Synthetic
cctcaaaccgatctgtgagcaagtcgcgtaggaaatgattgcatgaaatcactgtgaaacgccaactccgtgcca

SEQ ID NO: 164698 - DNA, 75 bp, Artificial Sequence
  Synthetic
ccgtctaccgtctggccgaggacgtggttatgtttacctgcgtcatgggaaagaagggacaccgaaaccaccgtt

SEQ ID NO: 164699 - DNA, 75 bp, Artificial Sequence
  Synthetic
cgtatttgaagccaggcgcgctctcgataccgaaaggatccgagggggctttccaaagccgacgtccctgattcc

SEQ ID NO: 164700 - DNA, 75 bp, Artificial Sequence
  Synthetic
ccatgatcatgtttgacgaggatgacgacgacgagctgtcgctgcctcgaaacgtgatgacgcacgaggaagccg

SEQ ID NO: 164701 - DNA, 75 bp, Artificial Sequence
  Synthetic
cgacgacgagctgtcgctgcctcgaaacgtgatgacgcacgaggaagccgagagtcgcctgtacgacgccatcac

SEQ ID NO: 164702 - DNA, 75 bp, Artificial Sequence
  Synthetic
cttcataaagctgttgaccggccctagaaagaccaagagcatgctgtgggcccactgcggtcgcttcttgcgtta

SEQ ID NO: 164703 - DNA, 75 bp, Artificial Sequence
  Synthetic
tcaggccctgtgtgacagcccagcactgtcgctgtgcaccgatgacgtagagggtgttcgccagaagctgcgagc

SEQ ID NO: 164704 - DNA, 75 bp, Artificial Sequence
  Synthetic
ggacattgtcgaggaggacgagtggctacgggagatacaaggagcgacgtaccagctgtccatagtgcgccaagc

SEQ ID NO: 164705 - DNA, 75 bp, Artificial Sequence
  Synthetic
ctgtcgctgtgcaccgatgacgtagagggtgttcgccagaagctgcgagctcggacgggctcgttgcaccacttt

SEQ ID NO: 164706 - DNA, 75 bp, Artificial Sequence
  Synthetic
cgctgcgtgcgccgacggcgtttcaaggtgtgcgacgtcggtcgacggcacattattcccggcgccgctaacggc

SEQ ID NO: 164707 - DNA, 75 bp, Artificial Sequence
  Synthetic
aggtgtgcgacgtcggtcgacggcacattattcccggcgccgctaacggcatgccgcccctcaccccgccacacg

SEQ ID NO: 164708 - DNA, 75 bp, Artificial Sequence
  Synthetic
gcagtgcggaaacggcacgaaagacggcgctataacgctctgacggtccgcagcagggactcgctgctcctgacg

SEQ ID NO: 164709 - DNA, 75 bp, Artificial Sequence
  Synthetic
tgccgtaggttttcggccagatcgtcccgcgggtcttcgacgtcgctgccgtagctagtgctcggcatgctgtcg

SEQ ID NO: 164710 - DNA, 75 bp, Artificial Sequence
  Synthetic
cccgcgggtcttcgacgtcgctgccgtagctagtgctcggcatgctgtcgggtccctggaagcgtgtgtgggccg

SEQ ID NO: 164711 - DNA, 75 bp, Artificial Sequence
  Synthetic
ggcggaccgcgacccggcggtgcgggactccgtcaactacgccaacaactgacggtccgctggcagctgttccgc

SEQ ID NO: 164712 - DNA, 75 bp, Artificial Sequence
  Synthetic
gactccgtcaactacgccaacaactgacggtccgctggcagctgttccgcctacggtgccacggttggacacagc

SEQ ID NO: 164713 - DNA, 75 bp, Artificial Sequence
  Synthetic
aaaagagggtcacgctgaccatgcggcgtcgttgccggggcggctgctccaggtccgcggagctaatgccgtgcg

SEQ ID NO: 164714 - DNA, 75 bp, Artificial Sequence
  Synthetic
taagagacccgtggtagaagaagtcccggccgaggtgtacgtggacgcgggcgtggtggttcgtgtggatgacga

SEQ ID NO: 164715 - DNA, 75 bp, Artificial Sequence
  Synthetic
cctggcggacggcagcgaaacagaattcggagatgctgaggacgacgacgaagacgcggacgacgaagaagctgc

SEQ ID NO: 164716 - DNA, 75 bp, Artificial Sequence
  Synthetic
ttcggagatgctgaggacgacgacgaagacgcggacgacgaagaagctgcgtcggtcacaggacggcgaaaaaca

SEQ ID NO: 164717 - DNA, 75 bp, Artificial Sequence
  Synthetic
cgtcaacagcttacgggagaggagacaagaaattcaacgcacactcaacgtgaagaagtggaggacgtttcgaga

SEQ ID NO: 164718 - DNA, 75 bp, Artificial Sequence
  Synthetic
caagaaattcaacgcacactcaacgtgaagaagtggaggacgtttcgagagagggcgcgagagaagggaatgatg

SEQ ID NO: 164719 - DNA, 75 bp, Artificial Sequence
  Synthetic
gagggcgcgagagaagggaatgatgggagccgagcaagtggaaacgacgagagaaggaataatgcgggaagatat

SEQ ID NO: 164720 - DNA, 75 bp, Artificial Sequence
  Synthetic
atgaagcgcttgggtgtcaggcccgtctgccgagaggcgccctcgatcatcatgctatagatgcgctggaggtga

SEQ ID NO: 164721 - DNA, 75 bp, Artificial Sequence
  Synthetic
gcattgttaaccattcgtctggcggtgcaagttgccgctgcgttttacgtgtattattacacggatcgcgtatcc

SEQ ID NO: 164722 - DNA, 75 bp, Artificial Sequence
  Synthetic
tctgccgagaggcgccctcgatcatcatgctatagatgcgctggaggtgatacgtctcggtggtgatcttgcctt

SEQ ID NO: 164723 - DNA, 75 bp, Artificial Sequence
  Synthetic
gaggagaacgaggaaggtggaccgtgtgaatcgccgccaatgacgacaaatacgctgaccgtggcctgtccgccc

SEQ ID NO: 164724 - DNA, 75 bp, Artificial Sequence
  Synthetic
gctcgggcacgcggaaaacctcgccgttgccgtacaggttcttggagaagaaaaagagctcgccctcgcgcgccg

SEQ ID NO: 164725 - DNA, 75 bp, Artificial Sequence
  Synthetic
cgagaacccccgcatcgtgccctgtttcgtctatgcttaggactgtgggtctcaagctacctggttcgacggccc

SEQ ID NO: 164726 - DNA, 75 bp, Artificial Sequence
  Synthetic
gttgccgtacaggttcttggagaagaaaaagagctcgccctcgcgcgccgtgggatcggcttcgagatcgagctg

SEQ ID NO: 164727 - DNA, 75 bp, Artificial Sequence
  Synthetic
gtcgcttatgcgtgtcaaacactaccaataaagataatctgccaatcgcaccttatatataatatgtggtcgcgt

SEQ ID NO: 164728 - DNA, 75 bp, Artificial Sequence
  Synthetic
atctgtgattctctatgagtgttatttttattatccttttggggactacgatttttcttcttgttctacatacca

SEQ ID NO: 164729 - DNA, 75 bp, Artificial Sequence
  Synthetic
caataaagataatctgccaatcgcaccttatatataatatgtggtcgcgtgtggtctttttaaggagctctgaaa

SEQ ID NO: 164730 - DNA, 75 bp, Artificial Sequence
  Synthetic
gaccgattggatctttttcagcagcttgtacgcgctgaaatgtaaatatcccgggcagaggtacacgttggcctc

SEQ ID NO: 164731 - DNA, 75 bp, Artificial Sequence
  Synthetic
ttgtacgcgctgaaatgtaaatatcccgggcagaggtacacgttggcctcgtgcagctgcgtcagtagttgcaac

SEQ ID NO: 164732 - DNA, 75 bp, Artificial Sequence
  Synthetic
acctccgcagccgtacggcgccgccggcgggagcgcgatttgcgtgccaaacgcggacgcgcacgcggtggtcgg

SEQ ID NO: 164733 - DNA, 75 bp, Artificial Sequence
  Synthetic
actgctgcctcgatgcgcctccggtggtgcgttcgccctgtctgcagccggtgcgcgaccgcaaccgcgagcgga

SEQ ID NO: 164734 - DNA, 75 bp, Artificial Sequence
  Synthetic
ggtgcgttcgccctgtctgcagccggtgcgcgaccgcaaccgcgagcggaacccgggctcaccgcagttgctgcc

SEQ ID NO: 164735 - DNA, 75 bp, Artificial Sequence
  Synthetic
aaagtctgccgtgtttcgggggcttgcgtgtaacaaaagtaaagcgcgtcgcaaagacggttgcagcgttccacc

SEQ ID NO: 164736 - DNA, 75 bp, Artificial Sequence
  Synthetic
gcgtgtaacaaaagtaaagcgcgtcgcaaagacggttgcagcgttccaccacccagtcctgcatcatttgtagct

SEQ ID NO: 164737 - DNA, 75 bp, Artificial Sequence
  Synthetic
ctgctactggcccgagatcgtgcgttcgctggtggtggacgcacgcagcggtcaggtgttacacaacgacgccag

SEQ ID NO: 164738 - DNA, 75 bp, Artificial Sequence
  Synthetic
gtgagcccgggcgtttgatggaggtgaggcagcgcaacggtcggttacgacgttgtgttacgtcggacaggttct

SEQ ID NO: 164739 - DNA, 75 bp, Artificial Sequence
  Synthetic
gaggcagcgcaacggtcggttacgacgttgtgttacgtcggacaggttctcggcgcacagatccaccgcctcgac

SEQ ID NO: 164740 - DNA, 75 bp, Artificial Sequence
  Synthetic
tatcaccgagaccgcgggcacctacacctgcgtgctgggcaacgagacccacagcctggcgaccgagaccacggc

SEQ ID NO: 164741 - DNA, 75 bp, Artificial Sequence
  Synthetic
caccgaaatttatcagttgttcgagtacactcggttcggggtatggttgatgtgcatcgtgggcacgtttctgaa

SEQ ID NO: 164742 - DNA, 75 bp, Artificial Sequence
  Synthetic
cgcgcgcagccccagcgcgtcgcgtacccggtgcaaccggaccagcgctcgttttagcacgccgaatgtcacatc

SEQ ID NO: 164743 - DNA, 75 bp, Artificial Sequence
  Synthetic
acccggtgcaaccggaccagcgctcgttttagcacgccgaatgtcacatcgtcggcgcccaggtgcacgctgatg

SEQ ID NO: 164744 - DNA, 75 bp, Artificial Sequence
  Synthetic
gcggtacctgtggacgcccgatccctccaggttgcgcagtataaactgtggttgggagggtgaacggcaccgcgt

SEQ ID NO: 164745 - DNA, 75 bp, Artificial Sequence
  Synthetic
ggtccactacatccccggcacctcgggtctgctgccctcgtgcgaggaggacgagcgcgaactgtgcgtgccctt

SEQ ID NO: 164746 - DNA, 75 bp, Artificial Sequence
  Synthetic
tccgagtacagcacgtcgagctgcgtgcgcaggtcccgcaacacatcgcggctgttgcggtagtgattagcgaga

SEQ ID NO: 164747 - DNA, 75 bp, Artificial Sequence
  Synthetic
gctgttgcggtagtgattagcgagaatgcagatacggataatctcctgggccacgggctttaccttcataaaagc

SEQ ID NO: 164748 - DNA, 75 bp, Artificial Sequence
  Synthetic
gcggagggattactggctgacggatccgaagatcgggctgctggccgcgggatcggtggccctgacctccctctg

SEQ ID NO: 164749 - DNA, 75 bp, Artificial Sequence
  Synthetic
gcacgccaaagttgagcagccccacaaagttggagcagccctgggtcaacatctcgagcagcaggcgccggtgct

SEQ ID NO: 164750 - DNA, 75 bp, Artificial Sequence
  Synthetic
cgtctccaaacaggtcaacccgaaagttgagccagtcgtccacggggagaacgggcagtggcgggcccgatgggg

SEQ ID NO: 164751 - DNA, 75 bp, Artificial Sequence
  Synthetic
gccccctttgaaaacgaaaccaaaaccagagcggaacttgagaaatcaacgctttattgttctccagtgacgtta

SEQ ID NO: 164752 - DNA, 75 bp, Artificial Sequence
  Synthetic
gagagccatgaagcggatgattcgcagtcacggcaggaaaacggaatgtcagatgacgggcgccggcgagcgacg

SEQ ID NO: 164753 - DNA, 75 bp, Artificial Sequence
  Synthetic
gtcgtccccgccgccgtccctgtcgccggccccgccgcgcagcccagccaccgcgacggcagcaccgcgcccagc

SEQ ID NO: 164754 - DNA, 75 bp, Artificial Sequence
  Synthetic
ccagagcggaacttgagaaatcaacgctttattgttctccagtgacgttaaatacacaacggggttatgggggac

SEQ ID NO: 164755 - DNA, 75 bp, Artificial Sequence
  Synthetic
cgacgtcggtcccatcgcccacagtagcggtaccagacgcggttcggcgaatgaaacgtccgcctgtacgcggac

SEQ ID NO: 164756 - DNA, 75 bp, Artificial Sequence
  Synthetic
agcggtaccagacgcggttcggcgaatgaaacgtccgcctgtacgcggaccgatcaccagaaggcggacattggg

SEQ ID NO: 164757 - DNA, 75 bp, Artificial Sequence
  Synthetic
ggtccgtcttcttcgtcggcgcgatgccgcagggcggtcgctagcgtgtcgcagcgttcgccaccgttgccgtcg

SEQ ID NO: 164758 - DNA, 75 bp, Artificial Sequence
  Synthetic
gccgcagggcggtcgctagcgtgtcgcagcgttcgccaccgttgccgtcgttgttggagacggagggttctgccc

SEQ ID NO: 164759 - DNA, 75 bp, Artificial Sequence
  Synthetic
cgatgtcaaggaacgcgtgttttgtattttattgggaatattggcggggataaaccggtttcggatgtttaccct

SEQ ID NO: 164760 - DNA, 75 bp, Artificial Sequence
  Synthetic
cgtgaggcggcacgcgtgtgcggggacgacgggcgttgcggggcttcttggaatcgtgaagcggcgccgggtcgc

SEQ ID NO: 164761 - DNA, 75 bp, Artificial Sequence
  Synthetic
acgacgggcgttgcggggcttcttggaatcgtgaagcggcgccgggtcgctgtgacggagctcgtcgtcgtcctc

SEQ ID NO: 164762 - DNA, 75 bp, Artificial Sequence
  Synthetic
gggctccatgctgacgtaggtaccgactggggtcaaaagcctgggtacttatgggaagcgcgcacaaaggaccgt

SEQ ID NO: 164763 - DNA, 75 bp, Artificial Sequence
  Synthetic
caccgagtccgtatgaccgatctggaagagcatgcggtaggcctcgctgtggtaacagccgtcgaagacttgtgc

SEQ ID NO: 164764 - DNA, 75 bp, Artificial Sequence
  Synthetic
aagagcatgcggtaggcctcgctgtggtaacagccgtcgaagacttgtgcgatatccaaacctgagttcatcaac

SEQ ID NO: 164765 - DNA, 75 bp, Artificial Sequence
  Synthetic
gtctggtgcaacaagccgatgaggacgtggcacagttcgcggtggcgctcgtgtggcagcaaggctaccagttga

SEQ ID NO: 164766 - DNA, 75 bp, Artificial Sequence
  Synthetic
cgtggcacagttcgcggtggcgctcgtgtggcagcaaggctaccagttgatgcacctctacgcccagcgccgatt

SEQ ID NO: 164767 - DNA, 75 bp, Artificial Sequence
  Synthetic
acgagatcatcggcgtggcttttacttggcagcataacgagtctgtggttgacctgtggttgtaccagaacgaca

SEQ ID NO: 164768 - DNA, 75 bp, Artificial Sequence
  Synthetic
caccactaacatcttgcaagacggactgaaaatgcgaaccgtccctgtgactaaactgtacaccagccgcatggt

SEQ ID NO: 164769 - DNA, 75 bp, Artificial Sequence
  Synthetic
gctgggccgtgaaaaccagctggttgaagagcgcgcacacgcgcgacacagccgtctgcagttcgtcggccggcg

SEQ ID NO: 164770 - DNA, 75 bp, Artificial Sequence
  Synthetic
gaagagcgcgcacacgcgcgacacagccgtctgcagttcgtcggccggcgtgggcggctcgcggagactgggctg

SEQ ID NO: 164771 - DNA, 75 bp, Artificial Sequence
  Synthetic
tgcgatgccctggtggaacttgcggtagtcgcgctcggtgcagaaaacgaagaggttgctgttgcggcgcgagca

SEQ ID NO: 164772 - DNA, 75 bp, Artificial Sequence
  Synthetic
tagtcgcgctcggtgcagaaaacgaagaggttgctgttgcggcgcgagcagccgccgggcggcacgggcaagtgc

SEQ ID NO: 164773 - DNA, 75 bp, Artificial Sequence
  Synthetic
acggatcccccagcgactgtgtcagcggctgcgcattcgcctgccgcatcgataccagcggttacgcaccgagga

SEQ ID NO: 164774 - DNA, 75 bp, Artificial Sequence
  Synthetic
cggctgcgcattcgcctgccgcatcgataccagcggttacgcaccgaggactgaacggataaccgcaaaggccac

SEQ ID NO: 164775 - DNA, 75 bp, Artificial Sequence
  Synthetic
tcacgcatctcggcggctcgcaggactgaatcgtcgttggagaagtctcgggtggtgatgatgaagttcatgacg

SEQ ID NO: 164776 - DNA, 75 bp, Artificial Sequence
  Synthetic
ctgaatcgtcgttggagaagtctcgggtggtgatgatgaagttcatgacgacgacggcggtggggcggtaatagt

SEQ ID NO: 164777 - DNA, 75 bp, Artificial Sequence
  Synthetic
aaaccacccggcagccgacgacgcactcgactgaaaaaggcaggcacccggaggaacacgcgcaacaggcccgcg

SEQ ID NO: 164778 - DNA, 75 bp, Artificial Sequence
  Synthetic
ttgccacgagcatggatcacgcgctcttcacacacttcgtcggccggccccgtcactgtcggttggaaatgttga

SEQ ID NO: 164779 - DNA, 75 bp, Artificial Sequence
  Synthetic
cgtcactgtcggttggaaatgttgattctggacgaacaggtgtctaagagatcctgggacaccacggtttaccac

SEQ ID NO: 164780 - DNA, 75 bp, Artificial Sequence
  Synthetic
gaaaacaacgtcgacgggggacgtcgtttttatcgtaccgtgccgagacagaagttgcgccggacggcgttgtgg

SEQ ID NO: 164781 - DNA, 75 bp, Artificial Sequence
  Synthetic
gtttttatcgtaccgtgccgagacagaagttgcgccggacggcgttgtggcgcgcaggggctccgacgtggcgtt

SEQ ID NO: 164782 - DNA, 75 bp, Artificial Sequence
  Synthetic
aaaaaggcggccgtccttctattttggcacgatttgtgctggctgtttcgacgacttttctttcctcgggaggac

SEQ ID NO: 164783 - DNA, 75 bp, Artificial Sequence
  Synthetic
cgtgatgacagatcagggggacgtgtaccgtatatgaggggaaatggcgacgggttctggtgctttctgaataaa

SEQ ID NO: 164784 - DNA, 75 bp, Artificial Sequence
  Synthetic
taccgtatatgaggggaaatggcgacgggttctggtgctttctgaataaagtaacaggaaagctcataccccgct

SEQ ID NO: 164785 - DNA, 75 bp, Artificial Sequence
  Synthetic
gcggcgacggcggtgtttccgggcgtgctgggcgccggcgccggtaacgggagttacgctggggttgacggggac

SEQ ID NO: 164786 - DNA, 75 bp, Artificial Sequence
  Synthetic
ggttagcagcggggacttgcgggcttttgcggatacggggacgggggtggggacggagacacggggtgacgtcgg

SEQ ID NO: 164787 - DNA, 75 bp, Artificial Sequence
  Synthetic
tttccacgtaccgctgggaaaattgaaagacacgctgcgtttggcgtgctgattgcagtttttgctattggggtc

SEQ ID NO: 164788 - DNA, 75 bp, Artificial Sequence
  Synthetic
cgatctcaggaaagcgcggcggtccagcaactgaccgcggaaacactgccgcatgcgttgcagaaagtcatgacc

SEQ ID NO: 164789 - DNA, 75 bp, Artificial Sequence
  Synthetic
agcaactgaccgcggaaacactgccgcatgcgttgcagaaagtcatgacccagcagcgcgtacaggatgggatta

SEQ ID NO: 164790 - DNA, 75 bp, Artificial Sequence
  Synthetic
aacgtctcggcggcctaccccacctacctagacggggaaagagccaaaggtgaccttatttttaaccaaaccgag

SEQ ID NO: 164791 - DNA, 75 bp, Artificial Sequence
  Synthetic
acctagacggggaaagagccaaaggtgaccttatttttaaccaaaccgagcaaaacctgttagagctggaaattg

SEQ ID NO: 164792 - DNA, 75 bp, Artificial Sequence
  Synthetic
atgggccaggcggttgtggcataactgttgaagatcatgagagagacgtagggagtctgtagcgccacgaaggag

SEQ ID NO: 164793 - DNA, 75 bp, Artificial Sequence
  Synthetic
tgttgaagatcatgagagagacgtagggagtctgtagcgccacgaaggagatgagtagcacgctaacaaaggtta

SEQ ID NO: 164794 - DNA, 75 bp, Artificial Sequence
  Synthetic
cggggaaactttaatggagctcaaggataacctgacactatggacgggccccaattacgaaattagttggttgaa

SEQ ID NO: 164795 - DNA, 75 bp, Artificial Sequence
  Synthetic
tcacgggtgcggcaccccataccagcgtcagcagcactttccacgaaagcagcactgtgtgcacttcttcagcta

SEQ ID NO: 164796 - DNA, 75 bp, Artificial Sequence
  Synthetic
cgtcagcagcactttccacgaaagcagcactgtgtgcacttcttcagctacgaagtacagtacacaggtggcgtg

SEQ ID NO: 164797 - DNA, 75 bp, Artificial Sequence
  Synthetic
aattagtccagcgagccatgtcaatagcaaaatcatataggttgaacggtatgattggcgtgcgtatgttcgttt

SEQ ID NO: 164798 - DNA, 75 bp, Artificial Sequence
  Synthetic
agcaaaatcatataggttgaacggtatgattggcgtgcgtatgttcgtttatgaaggacgcgataacgatcggcg

SEQ ID NO: 164799 - DNA, 75 bp, Artificial Sequence
  Synthetic
ggatgggactttccatcagggatgttacgtagccatcttttgcaatcaaaactacacctgccgcgttacacacgg

SEQ ID NO: 164800 - DNA, 75 bp, Artificial Sequence
  Synthetic
tacgtagccatcttttgcaatcaaaactacacctgccgcgttacacacggtaattggacggtggaaatccccatc

SEQ ID NO: 164801 - DNA, 75 bp, Artificial Sequence
  Synthetic
acgccggccggcaacagccactggttgctgagtacgataaagggtagcacagtaagcgtgagaaaattagtagag

SEQ ID NO: 164802 - DNA, 75 bp, Artificial Sequence
  Synthetic
cgacggccgttataaagccacccggacacgcgccgcggcacttgcctacggcgctgctccagggaaactcctctt

SEQ ID NO: 164803 - DNA, 75 bp, Artificial Sequence
  Synthetic
atgaccatcagcagtgtcctcctagccctgcttttgtgcgctttgctattcgcgttcctgcactactttaccacc

SEQ ID NO: 164804 - DNA, 75 bp, Artificial Sequence
  Synthetic
ccctgcttttgtgcgctttgctattcgcgttcctgcactactttaccaccttgaaacaatacctacgtaacctag

SEQ ID NO: 164805 - DNA, 75 bp, Artificial Sequence
  Synthetic
atggcgttaagtggaccgcccacgaagatgatgaatgtgttgagtacggcttcggtggttcgaatggcgaatagc

SEQ ID NO: 164806 - DNA, 75 bp, Artificial Sequence
  Synthetic
cctttgcgtggcgctatcgcaaggtccggtcgtcatgaccagcaacgccctgtatgagctgtttcgacgtcggtt

SEQ ID NO: 164807 - DNA, 75 bp, Artificial Sequence
  Synthetic
cgaaaaaacagaagaaacaagtcagcggcgcttaaaagaaaaccgcgtatccgcctccgctattaaactaccccc

SEQ ID NO: 164808 - DNA, 75 bp, Artificial Sequence
  Synthetic
cggcgcttaaaagaaaaccgcgtatccgcctccgctattaaactaccccccctccctctaggtggggcgctcacc

SEQ ID NO: 164809 - DNA, 75 bp, Artificial Sequence
  Synthetic
atgtttctcacgcgacgcactcgtgatgggttctgcggtcggttgacgtccatcgccacgaattcccactacact

SEQ ID NO: 164810 - DNA, 75 bp, Artificial Sequence
  Synthetic
ttctggagaaaagccagcatgagtttgcagtttatcggtctacagcggcgcgatgtggtggccctggtcaacttt

SEQ ID NO: 164811 - DNA, 75 bp, Artificial Sequence
  Synthetic
tgcagtttatcggtctacagcggcgcgatgtggtggccctggtcaactttctgcgccatctcacgcaaaagcccg

SEQ ID NO: 164812 - DNA, 75 bp, Artificial Sequence
  Synthetic
tcaacgagctcatgctttggttgggatactaccgcgagctgcgtttccacaaccccgacctttcctcggtgctcg

SEQ ID NO: 164813 - DNA, 75 bp, Artificial Sequence
  Synthetic
aggagttcgaggtgcgttgcgcggccgtggcgcgtcgcggctacacttacccgttcggtgatcgtggtaaggcgc

SEQ ID NO: 164814 - DNA, 75 bp, Artificial Sequence
  Synthetic
taccgaattcgatacggacgtgcgccacgatgctgagattgtggagcgcgcgctcgtaagcgcggtcattctggc

SEQ ID NO: 164815 - DNA, 75 bp, Artificial Sequence
  Synthetic
cacgatgctgagattgtggagcgcgcgctcgtaagcgcggtcattctggccaagatgtcggtgcgcgagacgctg

SEQ ID NO: 164816 - DNA, 75 bp, Artificial Sequence
  Synthetic
tcgacgactagtaccaaacccggttccaccactcacgaccccaacgtgatgagaccacatgctcacaatgatttt

SEQ ID NO: 164817 - DNA, 75 bp, Artificial Sequence
  Synthetic
tccttaccgggcccaacggagttactcgcacagccatcgggggtctgtattcaaactacaccaacttaactggag

SEQ ID NO: 164818 - DNA, 75 bp, Artificial Sequence
  Synthetic
aacctggagggtgtgcgccgtaacatgttctgtgtgaaaccgctcgaccttaacctggaccggcacgccaacacg

SEQ ID NO: 164819 - DNA, 75 bp, Artificial Sequence
  Synthetic
tgttctgtgtgaaaccgctcgaccttaacctggaccggcacgccaacacggcgctggtcaacgccgtcaacaagc

SEQ ID NO: 164820 - DNA, 75 bp, Artificial Sequence
  Synthetic
cggagagttgcatcaaccgcggtgagtcctatgtgactaccatctggcttctggactgcactaaaaacgatactt

SEQ ID NO: 164821 - DNA, 75 bp, Artificial Sequence
  Synthetic
attggtactatggaaatgcctacaatcatacatgtgaaggtacaatttcgggatatctcctgggcatgtgcaagc

SEQ ID NO: 164822 - DNA, 75 bp, Artificial Sequence
  Synthetic
ttcaagagcgctgcaagctgctggtcaaggagctgcgcatgtgcctttcctttgattccaactactgtcgcaata

SEQ ID NO: 164823 - DNA, 75 bp, Artificial Sequence
  Synthetic
caaggagctgcgcatgtgcctttcctttgattccaactactgtcgcaatatcctcaagcacgccgtggaaaacgg

SEQ ID NO: 164824 - DNA, 75 bp, Artificial Sequence
  Synthetic
aggtgtagtttcgttattatcggaagccgtttcgttttccacggacatggtttcgttgtaatataaggagctcat

SEQ ID NO: 164825 - DNA, 75 bp, Artificial Sequence
  Synthetic
gcacacctttttgggcgcgcgctcgccgtcgttggagtttgatgatgacgccaatctcctctcgctcggcggcgg

SEQ ID NO: 164826 - DNA, 75 bp, Artificial Sequence
  Synthetic
aacaaatctgaaggtgacgtaccagaagaatttatggactatgttatcctgacccccttggcagtgcttacatgc

SEQ ID NO: 164827 - DNA, 75 bp, Artificial Sequence
  Synthetic
ccgtcgttggagtttgatgatgacgccaatctcctctcgctcggcggcggttcagccttctcgtcggtacccaag

SEQ ID NO: 164828 - DNA, 75 bp, Artificial Sequence
  Synthetic
ttcgaggcccatggttctctggcaccggccgccgaagcccacgctgcccgttcggcggccgtcggctattacgac

SEQ ID NO: 164829 - DNA, 75 bp, Artificial Sequence
  Synthetic
gcagcgtgagaaacagcagctgaaggcttgggaggagaggcagcagaacctgcagcaacgtcagcagcaaccgcc

SEQ ID NO: 164830 - DNA, 75 bp, Artificial Sequence
  Synthetic
tgatgacgagaaaaacatctttacgcccatcaagaaaccgggaactagcggcaagggcgccgctagtggtggcgg

SEQ ID NO: 164831 - DNA, 75 bp, Artificial Sequence
  Synthetic
cccatcaagaaaccgggaactagcggcaagggcgccgctagtggtggcggtgtttccagcattttcagcggcctg

SEQ ID NO: 164832 - DNA, 75 bp, Artificial Sequence
  Synthetic
tccctgtgcagatgtaaataaaatgcttttatttaaaactggtcccaatgttcttcgggaatcatggggtgggga

SEQ ID NO: 164833 - DNA, 75 bp, Artificial Sequence
  Synthetic
agtctcgtttccccgcaggtgaccaaggccagcccgggaagggtccgtcgggacagcgcgtgggacgtgaggccg

SEQ ID NO: 164834 - DNA, 75 bp, Artificial Sequence
  Synthetic
aggccagcccgggaagggtccgtcgggacagcgcgtgggacgtgaggccgctcacggagaccagaggggatcttt

SEQ ID NO: 164835 - DNA, 75 bp, Artificial Sequence
  Synthetic
cagcagtagcaccagcggattgggcaggggctgttgcggaggtcggtcgatgacgatgtcgatctccatcggcag

SEQ ID NO: 164836 - DNA, 75 bp, Artificial Sequence
  Synthetic
tggtggacatcacggataccgagacgagcgccaaaccgcccgtcaccaccgcgtacaagttcgagcaaccgacgt

SEQ ID NO: 164837 - DNA, 75 bp, Artificial Sequence
  Synthetic
gagcgccaaaccgcccgtcaccaccgcgtacaagttcgagcaaccgacgttgacgttcggcgccggagttaacgt

SEQ ID NO: 164838 - DNA, 75 bp, Artificial Sequence
  Synthetic
ctggatgtatatgattctggaaaagcctccgacgagctcgcggcgcgtagaaagccaagcggcgcaagggccggc

SEQ ID NO: 164839 - DNA, 75 bp, Artificial Sequence
  Synthetic
tcccgccggtggaggcgccgtacggctgcggaggcacaggcacagcggaccccacggctcccgccatcgcgcacg

SEQ ID NO: 164840 - DNA, 75 bp, Artificial Sequence
  Synthetic
aaagccaagcggcgcaagggccggcgagcccgaaagtccatgcgcacagatggcatgagtccttgagtgacggtg

SEQ ID NO: 164841 - DNA, 75 bp, Artificial Sequence
  Synthetic
gcggttctgagagggcgaccgctgaagcgagttgcgtgtgcgtgcggtttgtggttccaagcgcaaaaggccccc

SEQ ID NO: 164842 - DNA, 75 bp, Artificial Sequence
  Synthetic
acctaccttcgcgggtacccaaaccccggtcaacggtaactcgccctgggctccgacggcgccgttgcccgggga

SEQ ID NO: 164843 - DNA, 75 bp, Artificial Sequence
  Synthetic
ccggtcaacggtaactcgccctgggctccgacggcgccgttgcccggggatatgaaccccgccaactggccgcgc

SEQ ID NO: 164844 - DNA, 75 bp, Artificial Sequence
  Synthetic
caaaacaccgtgtccaccacccctcggaggccgtcgactccacgcgccgcggtgacacaaacagcgtctcgggac

SEQ ID NO: 164845 - DNA, 75 bp, Artificial Sequence
  Synthetic
agaagcggccacatgacctcgagatgtcgtcacccaaggtatttaacggcacacagccagacgcgttcgtcatca

SEQ ID NO: 164846 - DNA, 75 bp, Artificial Sequence
  Synthetic
gccgctgatgaggtttgggctttaagggaccaaactgcagagtcaccggtcgaagacagcgaggaggaagacgac

SEQ ID NO: 164847 - DNA, 75 bp, Artificial Sequence
  Synthetic
acacagccagacgcgttcgtcatcagcgacgccgacaagacctcagcatggctcggaggctatggatcttgagct

SEQ ID NO: 164848 - DNA, 75 bp, Artificial Sequence
  Synthetic
cctttatcgtcggaggggaaagcgctaagataccccacctgagtgaaaggacctttgcagtttgtccgtgcataa

SEQ ID NO: 164849 - DNA, 75 bp, Artificial Sequence
  Synthetic
tcgcctcccagtcagacgcccgagcagtcgacgccgtccagaatacgtaaagctaagttatcgtctccaatgacg

SEQ ID NO: 164850 - DNA, 75 bp, Artificial Sequence
  Synthetic
agtcgacgccgtccagaatacgtaaagctaagttatcgtctccaatgacgacgacatccacgagccagaaaccgg

SEQ ID NO: 164851 - DNA, 75 bp, Artificial Sequence
  Synthetic
cctcaacactccctgagccccgtcccgcaccggcgtcggtcggggtgtgtcggggcgcggctgggtgggtgtgtg

SEQ ID NO: 164852 - DNA, 75 bp, Artificial Sequence
  Synthetic
ttattgggggtacttatcgacgtagtggatgtgacggtgatattaggggaagtgacggcacttgtagtgctactt

SEQ ID NO: 164853 - DNA, 75 bp, Artificial Sequence
  Synthetic
ggctagagaaacaggtgtcgggcacgccgtcgacggtacccgccacgctgttgcaacctcaaccggcttcgtcta

SEQ ID NO: 164854 - DNA, 75 bp, Artificial Sequence
  Synthetic
cccattcctgggtgcgtgttactcaagagcgcggctgcgagcgcaatcgccagtgcgggacacatgttgccgtgt

SEQ ID NO: 164855 - DNA, 75 bp, Artificial Sequence
  Synthetic
ttgcaacctcaaccggcttcgtctaaaacgacgtcatcaaggaacgtgacttctggcgcgggaacctcttccgct

SEQ ID NO: 164856 - DNA, 75 bp, Artificial Sequence
  Synthetic
cccgaaggcccgccggcaccgcggccgcgaccgaggggcggggggcgcggcgacatgccgttgcgctgggccatg

SEQ ID NO: 164857 - DNA, 75 bp, Artificial Sequence
  Synthetic
gcagcagatcccaagggttaaagaccatgttgactatcttgttttttattaaaaagctgtaaggttctgctctaa

SEQ ID NO: 164858 - DNA, 75 bp, Artificial Sequence
  Synthetic
catgttgactatcttgttttttattaaaaagctgtaaggttctgctctaaaaacaccccgcctccggtctttttt

SEQ ID NO: 164859 - DNA, 75 bp, Artificial Sequence
  Synthetic
tcgccgctgtccatgctttcgtcagcctctccgtccccggccaagagtgcccccccgtctccggtgaaaggccgg

SEQ ID NO: 164860 - DNA, 75 bp, Artificial Sequence
  Synthetic
ggtttcttcccatagcctgtctaactagccttcccgtgagagtttatgaacatgtatctcaccagaatgctagtt

SEQ ID NO: 164861 - DNA, 75 bp, Artificial Sequence
  Synthetic
tgaaacctactttgggcggcaaggcggtggtaggtcgaccgccctcggtccccgtgagcggtagcgcgccgggtc

SEQ ID NO: 164862 - DNA, 75 bp, Artificial Sequence
  Synthetic
attttactaagaaagttttggcaccaaaagtcccgttagagccccagcaggtaacgctgccgttcacataggctc

SEQ ID NO: 164863 - DNA, 75 bp, Artificial Sequence
  Synthetic
gcggcgcgaccttccctccccacccagccccgtcaaaacacacgcgactcgagcggttcgtatgaaaaataaaaa

SEQ ID NO: 164864 - DNA, 75 bp, Artificial Sequence
  Synthetic
gcctgtccggcagcagccgggccgcctcgaccacgccgacgtatcccgcggtaaccaccgtttacccaccgtcgt

SEQ ID NO: 164865 - DNA, 75 bp, Artificial Sequence
  Synthetic
ccggtgcccctgtcagcatgcgtttcagttcatgagtataatttttcctatcgttatacatatcatcactgtagt

SEQ ID NO: 164866 - DNA, 75 bp, Artificial Sequence
  Synthetic
agccccgtcaaaacacacgcgactcgagcggttcgtatgaaaaataaaaaacagctttttatttacaggaacggg

SEQ ID NO: 164867 - DNA, 75 bp, Artificial Sequence
  Synthetic
ctcgaccacgccgacgtatcccgcggtaaccaccgtttacccaccgtcgtctacggccaaaagcagcgtatcgaa

SEQ ID NO: 164868 - DNA, 75 bp, Artificial Sequence
  Synthetic
gggagacgcgggttcacgcgtcgtcaaaaagttggtggtccactccgtaaggacaggtaggctgatttagcttcc

SEQ ID NO: 164869 - DNA, 75 bp, Artificial Sequence
  Synthetic
gcagcgtccaaaacagcgacgcgactttggggatggcctcgtgctcaccgccgcggagagtgccgccggacctgc

SEQ ID NO: 164870 - DNA, 75 bp, Artificial Sequence
  Synthetic
ggggggggggctcgcgggccccggggcacacttgttgttccctccggccgccgacacgcaccccgaagccgcgca

SEQ ID NO: 164871 - DNA, 75 bp, Artificial Sequence
  Synthetic
aaaaagttggtggtccactccgtaaggacaggtaggctgatttagcttccgcatgctcctggttccgtaataaat

SEQ ID NO: 164872 - DNA, 75 bp, Artificial Sequence
  Synthetic
gaccgccgccgtaggttcccccgtcaagagcacgacgggcatgaaaacggtggctttcgacctatcgtcgcccca

SEQ ID NO: 164873 - DNA, 75 bp, Artificial Sequence
  Synthetic
aagagcacgacgggcatgaaaacggtggctttcgacctatcgtcgccccagaagagcggtacggggccgcaaccg

SEQ ID NO: 164874 - DNA, 75 bp, Artificial Sequence
  Synthetic
attgttggcagcaaagacgcgcatacagtcgtccacgaagaggttgatcacgtcgtaggggctcaccaaccagcc

SEQ ID NO: 164875 - DNA, 75 bp, Artificial Sequence
  Synthetic
cgtcgtaggggctcaccaaccagcctaaaggttccacgtggttactgccgaccatgaccctccagtcgttaatct

SEQ ID NO: 164876 - DNA, 75 bp, Artificial Sequence
  Synthetic
aagaacacggaggaatagttaagaaacacacacgcagacgtactttttaatgaaatcatcggatagtgacgtgtc

SEQ ID NO: 164877 - DNA, 75 bp, Artificial Sequence
  Synthetic
acacacacgcagacgtactttttaatgaaatcatcggatagtgacgtgtcgggaaaggaggacggacggagggtc

SEQ ID NO: 164878 - DNA, 75 bp, Artificial Sequence
  Synthetic
agcgcggctgcctttgtgcgcactaccggtgcgtgtcgtcccacggtatttgttcgcgggaccggactgcgggag

SEQ ID NO: 164879 - DNA, 75 bp, Artificial Sequence
  Synthetic
tgttcgcgggaccggactgcgggaggtttgcggggcgtcagcgcgctgagggatctctgtacgggtgtctccacg

SEQ ID NO: 164880 - DNA, 75 bp, Artificial Sequence
  Synthetic
acgtagcacgccactgcgcgaacgcgtggatgtgcatgcagccggccagcgctctaagcgaggcggtgtgcggca

SEQ ID NO: 164881 - DNA, 75 bp, Artificial Sequence
  Synthetic
gtggatgtgcatgcagccggccagcgctctaagcgaggcggtgtgcggcagctcctctgggacggtgatgaagtt

SEQ ID NO: 164882 - DNA, 75 bp, Artificial Sequence
  Synthetic
cgtgcatctgccgaaacaccgtgtggtgattgtacgagtacacgttaccgtcgccctcggtgatttgatacaacg

SEQ ID NO: 164883 - DNA, 75 bp, Artificial Sequence
  Synthetic
gtgattgtacgagtacacgttaccgtcgccctcggtgatttgatacaacgtggcgatgggggtgccctgcgggat

SEQ ID NO: 164884 - DNA, 75 bp, Artificial Sequence
  Synthetic
gggtacgggggttacgttggcgacgcgggtgttgcggggccggactgagggacgggggtggcgcgggtgtttgcg

SEQ ID NO: 164885 - DNA, 75 bp, Artificial Sequence
  Synthetic
gtcggtccacaggtacatggcgcccgaggcgcccaggtacagttcagacggcacgttgtgatcgcccttgtgttt

SEQ ID NO: 164886 - DNA, 75 bp, Artificial Sequence
  Synthetic
aaaggcgtcctcgtgtggcaagttggccaccaagaaacaccggtctgtgatctgcacgtagcgcaagtccaactc

SEQ ID NO: 164887 - DNA, 75 bp, Artificial Sequence
  Synthetic
gccaccaagaaacaccggtctgtgatctgcacgtagcgcaagtccaactccaccgtctgccgcggttgcactccg

SEQ ID NO: 164888 - DNA, 75 bp, Artificial Sequence
  Synthetic
gagaaagttgtaggtgcagatgctgccgacgaaacgcagcggctcggggcagcagaggtagctggccagacgctg

SEQ ID NO: 164889 - DNA, 75 bp, Artificial Sequence
  Synthetic
tcgccgctaaaaaagagtgacgggttgcggctaaatcgcaggtcgtacccgcgctgcgcgctcgtcagcaggtag

SEQ ID NO: 164890 - DNA, 75 bp, Artificial Sequence
  Synthetic
ggccacgcgttgcccgggtttccatggccgcgacgtcttaggaggcctccagcggtcgagcagattgagaaaaca

SEQ ID NO: 164891 - DNA, 75 bp, Artificial Sequence
  Synthetic
tgcggctaaatcgcaggtcgtacccgcgctgcgcgctcgtcagcaggtagaaggaaaaggcgcgcggcatgttgc

SEQ ID NO: 164892 - DNA, 75 bp, Artificial Sequence
  Synthetic
agcggtcgagcagattgagaaaacagtccttgattaccgacatcgcggtcgcgcgtcggtggacaaaaagaaatc

SEQ ID NO: 164893 - DNA, 75 bp, Artificial Sequence
  Synthetic
agtccccggggacagtctgccgggagcggcaggcgcacaacccgcgtcgaggacacacgccgaaggcacaccccc

SEQ ID NO: 164894 - DNA, 75 bp, Artificial Sequence
  Synthetic
ccacgcatagtgaatccacgttgacggtgaaaatgagacccatgaattcgtactgtacgtttttggacgcgatcc

SEQ ID NO: 164895 - DNA, 75 bp, Artificial Sequence
  Synthetic
ggtgaaaatgagacccatgaattcgtactgtacgtttttggacgcgatccacgcctcgtcctcgccgggtagcgc

SEQ ID NO: 164896 - DNA, 75 bp, Artificial Sequence
  Synthetic
gaggcggccttgacgacgttggcagcgaaaaaataggcacgcgagtcaaacgggaagtagcgtcggtgttttatg

SEQ ID NO: 164897 - DNA, 75 bp, Artificial Sequence
  Synthetic
cgaaaaaataggcacgcgagtcaaacgggaagtagcgtcggtgttttatgccccaagcagcgtcgtcgtcactcg

SEQ ID NO: 164898 - DNA, 75 bp, Artificial Sequence
  Synthetic
gggagggggggggctcgcgggccccggggcacactgcttccatccagccgcgcacacccctgacacaccccgcca

SEQ ID NO: 164899 - DNA, 75 bp, Artificial Sequence
  Synthetic
ggggcacactgcttccatccagccgcgcacacccctgacacaccccgccaccacacccgcgacacacccggccaa

SEQ ID NO: 164900 - DNA, 75 bp, Artificial Sequence
  Synthetic
gcgtttactgatccaggtcagatggtccacgcgacacagcagcgtcgcgccatgccgcgtgacgctgacccgtcc

SEQ ID NO: 164901 - DNA, 75 bp, Artificial Sequence
  Synthetic
tccacgcgacacagcagcgtcgcgccatgccgcgtgacgctgacccgtccaaagggcgccgtctcctccaacccc

SEQ ID NO: 164902 - DNA, 75 bp, Artificial Sequence
  Synthetic
aaacgtcggttttcaaacagcaggttaagtcccagacacatgaacgtgttcagattatctcccacccggatgtag

SEQ ID NO: 164903 - DNA, 75 bp, Artificial Sequence
  Synthetic
cagattatctcccacccggatgtagcggtcgtcgcgcacgtcgcaggcgtagacggccccggtataggcgacgac

SEQ ID NO: 164904 - DNA, 75 bp, Artificial Sequence
  Synthetic
tgcggcacgaagggcaccatgaccagttgtgtgtgcagaaaaccgatctgcaccgcctgcgactgccgcatggtt

SEQ ID NO: 164905 - DNA, 75 bp, Artificial Sequence
  Synthetic
gttgtgtgtgcagaaaaccgatctgcaccgcctgcgactgccgcatggtttcctcgtcgtaaaccgccatggacg

SEQ ID NO: 164906 - DNA, 75 bp, Artificial Sequence
  Synthetic
cgcccttgaggctgacggttcccaggccgagaacgcgcattccgaaagcggttttgatgttgcgcagcaagtgac

SEQ ID NO: 164907 - DNA, 75 bp, Artificial Sequence
  Synthetic
gccgagaacgcgcattccgaaagcggttttgatgttgcgcagcaagtgaccgccttccacgctgttttcgaaaca

SEQ ID NO: 164908 - DNA, 75 bp, Artificial Sequence
  Synthetic
gctcggcgtacgccgccttgggcgtcaccacgttggaccagtcgtacttgtagccgcagccctgcgtgttgttgt

SEQ ID NO: 164909 - DNA, 75 bp, Artificial Sequence
  Synthetic
taagtaagcgcggcggcgtcctcagcgcgtttgcggcgtgctgtgtccggcgctttgtgcgcactgccggtgcgt

SEQ ID NO: 164910 - DNA, 75 bp, Artificial Sequence
  Synthetic
gaatcgtgccatggtatccaaaccgaggctccaggcgcgcaacagcgggcgaaagtagcgcttaaccaacgacga

SEQ ID NO: 164911 - DNA, 75 bp, Artificial Sequence
  Synthetic
caccacgttggaccagtcgtacttgtagccgcagccctgcgtgttgttgtaaatgacgggaaacgagagaaagat

SEQ ID NO: 164912 - DNA, 75 bp, Artificial Sequence
  Synthetic
cgactcgtaggccgtcaggtgcgaggccgaacggtgaatcttggcgtggcgcacgcagcggccgtagttgtcgcg

SEQ ID NO: 164913 - DNA, 75 bp, Artificial Sequence
  Synthetic
caggtagtagacggcggtgtcctcgcgtacatagcaaaagacatagccctcgtccgagatgaggcacacggcggt

SEQ ID NO: 164914 - DNA, 75 bp, Artificial Sequence
  Synthetic
gatattgcgcaccttctcgttgtccaactcggagatgcgtttgctcttcttcttgcggggtccggtgctcgcccc

SEQ ID NO: 164915 - DNA, 75 bp, Artificial Sequence
  Synthetic
gccgaacggtgaatcttggcgtggcgcacgcagcggccgtagttgtcgcggtccgcgtcgcgtagcgcttcgatc

SEQ ID NO: 164916 - DNA, 75 bp, Artificial Sequence
  Synthetic
caggtagtgactccaagctttcacgtcctccggtttgaagtcctcgtccgtctcgatctcctgcagcactaggtt

SEQ ID NO: 164917 - DNA, 75 bp, Artificial Sequence
  Synthetic
tctgccagttggcgagggataccgtcgtgcgaccttttgaccgcggtggtgcccgtcgtcctcgtctcccctcct

SEQ ID NO: 164918 - DNA, 75 bp, Artificial Sequence
  Synthetic
tctcgatctcctgcagcactaggttccagcccggcggccagaccacgggcaacacctggcctgcgttgatgcgca

SEQ ID NO: 164919 - DNA, 75 bp, Artificial Sequence
  Synthetic
tcgtcctccctgttttctcttctctcattcccggtctccggacccgcagccgctacctcttgctccgcggttttc

SEQ ID NO: 164920 - DNA, 75 bp, Artificial Sequence
  Synthetic
cccccccgcccctcggggacccagcacacggcccggaatggatgtcgggcgtccacctaggtgggttctcgctcg

SEQ ID NO: 164921 - DNA, 75 bp, Artificial Sequence
  Synthetic
ccgccaccgcagcggcggcgacggacggcggcggtaacagcagctccgtgaagctgacgagcggcagcggcgacg

SEQ ID NO: 164922 - DNA, 75 bp, Artificial Sequence
  Synthetic
agtcggtgggcgagcccgggggcccgtcgcacaccacgctccgtcttcttgtcctcaccgcggccagcgtggcga

SEQ ID NO: 164923 - DNA, 75 bp, Artificial Sequence
  Synthetic
gtcgcacaccacgctccgtcttcttgtcctcaccgcggccagcgtggcgaggacactttccgcgcccgaggctgt

SEQ ID NO: 164924 - DNA, 75 bp, Artificial Sequence
  Synthetic
cggcggcggtaacagcagctccgtgaagctgacgagcggcagcggcgacgacggtggcggcgacgacacggcgac

SEQ ID NO: 164925 - DNA, 75 bp, Artificial Sequence
  Synthetic
ttcctccggcgccgcggtttccgccgtctccggatgagcggccgcggcgcgggctcggcgtcccgccgtccgaga

SEQ ID NO: 164926 - DNA, 75 bp, Artificial Sequence
  Synthetic
gcaactgagccgaacgcacctcagcagacgagaggatgtcgtcgcggcgtcgcagctcgtcacgtcgctctggcg

SEQ ID NO: 164927 - DNA, 75 bp, Artificial Sequence
  Synthetic
gtctccggatgagcggccgcggcgcgggctcggcgtcccgccgtccgagacggtgtatataaaccgcgtcggcct

SEQ ID NO: 164928 - DNA, 75 bp, Artificial Sequence
  Synthetic
gatgaggaggcggaggacagcgttttcacgagcacgcgggcgcgcagcgccacggaagatctggatcgcatggag

SEQ ID NO: 164929 - DNA, 75 bp, Artificial Sequence
  Synthetic
tgggtccgcttcatcagactgcgtacgctttggagcgtcagacccagggcgcatgtagccgacttggaggacttt

SEQ ID NO: 164930 - DNA, 75 bp, Artificial Sequence
  Synthetic
cgctttggagcgtcagacccagggcgcatgtagccgacttggaggactttgccgccttttatcgcaccctctcgg

SEQ ID NO: 164931 - DNA, 75 bp, Artificial Sequence
  Synthetic
cagggcgtgattttctcccccatccgacaaaaccgtgtcccttaaaattccccacctttctctgttcaaatggcc

SEQ ID NO: 164932 - DNA, 75 bp, Artificial Sequence
  Synthetic
ggcgccgccaagaaaccgagcgaaaagaaacgatcgtcgtcgcgtcggcaaccgcagatcgcagcgggcgcgcct

SEQ ID NO: 164933 - DNA, 75 bp, Artificial Sequence
  Synthetic
agaaacgatcgtcgtcgcgtcggcaaccgcagatcgcagcgggcgcgcctcggggctcgccggcgacacccaagg

SEQ ID NO: 164934 - DNA, 75 bp, Artificial Sequence
  Synthetic
cccggcgccagctcaagatggacctgatgtgtcacggcggttgaaaacgcgcatgatctcgcggagccatctacg

SEQ ID NO: 164935 - DNA, 75 bp, Artificial Sequence
  Synthetic
gatgtgtcacggcggttgaaaacgcgcatgatctcgcggagccatctacgcgcctgtcagggcgatgacgacatc

SEQ ID NO: 164936 - DNA, 75 bp, Artificial Sequence
  Synthetic
acgataacagcagcagcggcggtagcagcagtcgcaccaccagtaacagtagcagaagcaccagtcccgtggcgc

SEQ ID NO: 164937 - DNA, 75 bp, Artificial Sequence
  Synthetic
ctgctttgtgcacgatctccggggcatgatggactatcacgacgggctctcgcgccgtcaacagcgtgccttttg

SEQ ID NO: 164938 - DNA, 75 bp, Artificial Sequence
  Synthetic
atgatggactatcacgacgggctctcgcgccgtcaacagcgtgccttttgccgcgcgggtcgcgtgttgacggac

SEQ ID NO: 164939 - DNA, 75 bp, Artificial Sequence
  Synthetic
gacatcgaagactttgagcgcgaatgttaccgggtcagcgtggccgacaatctgggcttcgagcccagcgtggtc

SEQ ID NO: 164940 - DNA, 75 bp, Artificial Sequence
  Synthetic
tttattaaaagtgtctttgtatttccctgtcttgtgttgcccaactgctgtcaggtctccgtagatcgctcccgg

SEQ ID NO: 164941 - DNA, 75 bp, Artificial Sequence
  Synthetic
cctgtcttgtgttgcccaactgctgtcaggtctccgtagatcgctcccgggtgcccgagacggggggcagatggc

SEQ ID NO: 164942 - DNA, 75 bp, Artificial Sequence
  Synthetic
tgcatacccatgccggccttcgcgctcaccagcctcgtcaaccccgtcttaaacaacgtagcgcctggcgagcgc

SEQ ID NO: 164943 - DNA, 75 bp, Artificial Sequence
  Synthetic
tcaccagcctcgtcaaccccgtcttaaacaacgtagcgcctggcgagcgcgatctcacgcgtcggataatcacgc

SEQ ID NO: 164944 - DNA, 75 bp, Artificial Sequence
  Synthetic
gccgagactactactgcttctgcttttttgtctcctgtggatcgtcgcggactgccggcatgtccggccgtcgca

SEQ ID NO: 164945 - DNA, 75 bp, Artificial Sequence
  Synthetic
ttttgtctcctgtggatcgtcgcggactgccggcatgtccggccgtcgcaagggctgctcggcggccacggcgtc

SEQ ID NO: 164946 - DNA, 75 bp, Artificial Sequence
  Synthetic
cgctcggggcgtgcggcggcgctagcgcttcactttctcacgtcacgcaaaggagtaacggacggccagtacgcc

SEQ ID NO: 164947 - DNA, 75 bp, Artificial Sequence
  Synthetic
cttggtacccgaggtcttttgcacgcgcgacttggccgatctgtgcgtgcgacgcgactatgagggcctacggcg

SEQ ID NO: 164948 - DNA, 75 bp, Artificial Sequence
  Synthetic
agctacggcatcgcggcacgcccgaatcgccgcggctcaccgaggtctaccagacgctacgcgattacaacgtgc

SEQ ID NO: 164949 - DNA, 75 bp, Artificial Sequence
  Synthetic
atcgccgcggctcaccgaggtctaccagacgctacgcgattacaacgtgctcttctataccgcccactacacctc

SEQ ID NO: 164950 - DNA, 75 bp, Artificial Sequence
  Synthetic
ttatttgcggcgcttcgagggctcgtgcgtatcgctgggctggccctcgcagtgcatctacgtggtcgggggcga

SEQ ID NO: 164951 - DNA, 75 bp, Artificial Sequence
  Synthetic
atcgatctggagcactgccagaacgactttttcggcgaattccgagctctgcatctcattggcacggtctcgcac

SEQ ID NO: 164952 - DNA, 75 bp, Artificial Sequence
  Synthetic
ttcggtcgaagagatatgcgaagagcacacgctcaacgatctggcgttcctagtaggcgtcgagcttatgatcac

SEQ ID NO: 164953 - DNA, 75 bp, Artificial Sequence
  Synthetic
actttttcggcgaattccgagctctgcatctcattggcacggtctcgcacgccacctgccggtaccaggtgttcg

SEQ ID NO: 164954 - DNA, 75 bp, Artificial Sequence
  Synthetic
ctgcgctgctatctccagcaccagctgcagagcatctcggagctgtgttacctcatctatgtacaactgccgtcg

SEQ ID NO: 164955 - DNA, 75 bp, Artificial Sequence
  Synthetic
gattttttgccaagggcatgatccgctgcgacccggtgcacgaatccatctgcgcgcgtctgcaacccaacgtgc

SEQ ID NO: 164956 - DNA, 75 bp, Artificial Sequence
  Synthetic
ctgcgacccggtgcacgaatccatctgcgcgcgtctgcaacccaacgtgcccttggtgcatcccgatcatcgggc

SEQ ID NO: 164957 - DNA, 75 bp, Artificial Sequence
  Synthetic
atgcagctccttaatacaagccatccacatctcccgcttatcctcaggtacaatgtagttctcatacatgctctg

SEQ ID NO: 164958 - DNA, 75 bp, Artificial Sequence
  Synthetic
ggcctgcgaggacaccgccgctcgctgcgcctacgtagaggcgcaccgcgaggcgcagctgaccctcatctggcc

SEQ ID NO: 164959 - DNA, 75 bp, Artificial Sequence
  Synthetic
tactgcgccctgcgtctgctggcctgtcccgacagacctattatcggtgacaccggcggcagcagtagctcccaa

SEQ ID NO: 164960 - DNA, 75 bp, Artificial Sequence
  Synthetic
tgcgcctacgtagaggcgcaccgcgaggcgcagctgaccctcatctggcccgagaagcattccctggtgctgcgc

SEQ ID NO: 164961 - DNA, 75 bp, Artificial Sequence
  Synthetic
atcacccgcgacatatgcgtggcgcggttgcaagcgcagccctcgagtcgacacattccggtcgaacacacgggt

SEQ ID NO: 164962 - DNA, 75 bp, Artificial Sequence
  Synthetic
ggttgcaagcgcagccctcgagtcgacacattccggtcgaacacacgggtgtctcctccgtcaccctgctcaaaa

SEQ ID NO: 164963 - DNA, 75 bp, Artificial Sequence
  Synthetic
atgccgctgggcgagatcgagggcgccgaggacaagaccttctttcaccgcgtgcggattctctgcggcgacacg

SEQ ID NO: 164964 - DNA, 75 bp, Artificial Sequence
  Synthetic
ccgaggacaagaccttctttcaccgcgtgcggattctctgcggcgacacgggcaccgtgtacgcggcgctggtgg

SEQ ID NO: 164965 - DNA, 75 bp, Artificial Sequence
  Synthetic
ccattccgggccgcgtgctgggtccccgaggggcgggggggtgtttttagcgggggggtgaaatttggagcgtgt

SEQ ID NO: 164966 - DNA, 75 bp, Artificial Sequence
  Synthetic
cgaacggtaatcaccccgaacaaatctgccgatccccaccacccccgctgccgccgcgcgactatcctcaacgcg

SEQ ID NO: 164967 - DNA, 75 bp, Artificial Sequence
  Synthetic
actttcgctacgagagcatcggccccgtggaccgcagctcgctgtacgaggccaatcccgagctgagactgccgt

SEQ ID NO: 164968 - DNA, 75 bp, Artificial Sequence
  Synthetic
ccgccgcgcgactatcctcaacgcgacgagcgggaccgtcaccgtcgcgaccgccgcaacagcggggaatactgt

SEQ ID NO: 164969 - DNA, 75 bp, Artificial Sequence
  Synthetic
cgtggaccgcagctcgctgtacgaggccaatcccgagctgagactgccgttcaaaaagcgtaggtgagtcatcag

SEQ ID NO: 164970 - DNA, 75 bp, Artificial Sequence
  Synthetic
gttttttcaccgtcgtcgctctaggtttgattttcgcgctcttgtgtctcccgacaggctcgtcgtgggctactt

SEQ ID NO: 164971 - DNA, 75 bp, Artificial Sequence
  Synthetic
aatgtgtctacgaccaaagcggtgtgtggacgctcgtcctctctgtcttctccggttttttttttcacgtgtggt

SEQ ID NO: 164972 - DNA, 75 bp, Artificial Sequence
  Synthetic
tttgattttcgcgctcttgtgtctcccgacaggctcgtcgtgggctactttgactcgctctcgtcgctctatctg

SEQ ID NO: 164973 - DNA, 75 bp, Artificial Sequence
  Synthetic
ttttttccttcctattttgttacggcaacagcgctgatggcacgttgccggcttcgaacatcgcgtcggtgattt

SEQ ID NO: 164974 - DNA, 75 bp, Artificial Sequence
  Synthetic
caacagcgctgatggcacgttgccggcttcgaacatcgcgtcggtgatttcttgcttgcccggcgtcacacggtg

SEQ ID NO: 164975 - DNA, 75 bp, Artificial Sequence
  Synthetic
gagcgtgcgagcggggttcacctgcagcgctacgtgcgcgccacggcgggtcgttggctcccgctgtgctggccg

SEQ ID NO: 164976 - DNA, 75 bp, Artificial Sequence
  Synthetic
agcgctacgtgcgcgccacggcgggtcgttggctcccgctgtgctggccgccgctgcacggcatcatgctgggcg

SEQ ID NO: 164977 - DNA, 75 bp, Artificial Sequence
  Synthetic
gcggttgccgtgacgcagtctgccctgcgcagcgcgctccacgtcttcaaagtagctgtgtagcaggccgcgctc

SEQ ID NO: 164978 - DNA, 75 bp, Artificial Sequence
  Synthetic
tgcgcagcgcgctccacgtcttcaaagtagctgtgtagcaggccgcgctccagcaactgcggcagcgagtcggcg

SEQ ID NO: 164979 - DNA, 75 bp, Artificial Sequence
  Synthetic
gtaacgggcgttacgctggggacggggacgggggtttttgggcgtactggggacggggggtgtgcggggacgggg

SEQ ID NO: 164980 - DNA, 75 bp, Artificial Sequence
  Synthetic
tgtactttatcggcctcgtcagtgtgtacgaatgcgtgccggacgcaaacacggcgcccgagatctgggtctccg

SEQ ID NO: 164981 - DNA, 75 bp, Artificial Sequence
  Synthetic
gtacgaatgcgtgccggacgcaaacacggcgcccgagatctgggtctccgggcacgggcacgcctttgcgtacct

SEQ ID NO: 164982 - DNA, 75 bp, Artificial Sequence
  Synthetic
cggtcccaactgaaaaggttggcgagtccgatggtgccgatgacgcgcaactgaccctgggtcaccaccagcagc

SEQ ID NO: 164983 - DNA, 75 bp, Artificial Sequence
  Synthetic
tggcggtgcggcaaaagagtgtcatgtcgtgcgtgcacaaaaaacaacacacaccacaggccaggtcgtagcgta

SEQ ID NO: 164984 - DNA, 75 bp, Artificial Sequence
  Synthetic
gtccgatggtgccgatgacgcgcaactgaccctgggtcaccaccagcagcttccagtattctacgtcgcgcgggg

SEQ ID NO: 164985 - DNA, 75 bp, Artificial Sequence
  Synthetic
tagcttctttgagcgcgactacgtggatgaaatcgtagagggcgcgtggtttaagcacaccttcgcgggcatgta

SEQ ID NO: 164986 - DNA, 75 bp, Artificial Sequence
  Synthetic
gatgaaatcgtagagggcgcgtggtttaagcacaccttcgcgggcatgtacgaactctcccagatactgcacgac

SEQ ID NO: 164987 - DNA, 75 bp, Artificial Sequence
  Synthetic
gctggcggcgcataaaatcgtctaaattcaaaccgccgtcgggtgcgcgcctgctcgtcatcgccgcgcctcgtc

SEQ ID NO: 164988 - DNA, 75 bp, Artificial Sequence
  Synthetic
agtcgatgaccccacggtgcttataacgcgccgccgcggcttcatgtggcgtgacctccgacctcgtgaggccga

SEQ ID NO: 164989 - DNA, 75 bp, Artificial Sequence
  Synthetic
ttcactttcggctcgtggaacgtggccgaggccgacgaggccaacaattttgtgatcggcgtactagaacaggcc

SEQ ID NO: 164990 - DNA, 75 bp, Artificial Sequence
  Synthetic
tgtgatcggcgtactagaacaggcccactttgtagtcatcggatggatggaacccgtgaacaaagccgtatttat

SEQ ID NO: 164991 - DNA, 75 bp, Artificial Sequence
  Synthetic
acttttgaatgtgggcccggtagcgcaccgagggccccggggcggcgacgacggcgggtccgagttccagcgggg

SEQ ID NO: 164992 - DNA, 75 bp, Artificial Sequence
  Synthetic
agttggccgagacgctgcgcggttttatccgtcagggttccttctggtttcgttgcccacggcgtttttgcttct

SEQ ID NO: 164993 - DNA, 75 bp, Artificial Sequence
  Synthetic
gttgctcagctcggcgtccgagagcgccgagctgaactgcggcagccgcgtgcgatcctgcggcgcgtccccgtg

SEQ ID NO: 164994 - DNA, 75 bp, Artificial Sequence
  Synthetic
tatccgtcagggttccttctggtttcgttgcccacggcgtttttgcttctcgccgttggactcgagcgcaaccgt

SEQ ID NO: 164995 - DNA, 75 bp, Artificial Sequence
  Synthetic
cttgaaaacgtgcaggcacagcagctcgcgcttgatgcgcagcgacacgctgcggtagtcgggaatccgctgcac

SEQ ID NO: 164996 - DNA, 75 bp, Artificial Sequence
  Synthetic
tcgcgcttgatgcgcagcgacacgctgcggtagtcgggaatccgctgcaccagctcgagaaagtcgcagaaggtc

SEQ ID NO: 164997 - DNA, 75 bp, Artificial Sequence
  Synthetic
gctggatagcgtgagcggcacgggggcgtcgtgaaggaggagactgtgatgactagctatatagccgctgtctgg

SEQ ID NO: 164998 - DNA, 75 bp, Artificial Sequence
  Synthetic
ttaaccaataacatgtctctgtttttttttgttaacaacctatgatataaagcggtatattcaatcattactaaa

SEQ ID NO: 164999 - DNA, 75 bp, Artificial Sequence
  Synthetic
gcgtcgtgaaggaggagactgtgatgactagctatatagccgctgtctggctttaccgccgtcgctccgcgtcgc

SEQ ID NO: 165000 - DNA, 75 bp, Artificial Sequence
  Synthetic
cgttgcacggggttctgagcgagtcccttgcgcagcagcgcagcctcgcctttaaacagcctgatgagccgctgc

SEQ ID NO: 165001 - DNA, 75 bp, Artificial Sequence
  Synthetic
ccttgcgcagcagcgcagcctcgcctttaaacagcctgatgagccgctgcacgtccccgctcaacatacgtatac

SEQ ID NO: 165002 - DNA, 75 bp, Artificial Sequence
  Synthetic
ccggaggagcaggctaaagaagaccatgacgacggtgacgagcgcctatttcgcgatccgctcaccacgtacgag

SEQ ID NO: 165003 - DNA, 75 bp, Artificial Sequence
  Synthetic
atgacgacggtgacgagcgcctatttcgcgatccgctcaccacgtacgagtatctcgacgactgtcgtgatgatg

SEQ ID NO: 165004 - DNA, 75 bp, Artificial Sequence
  Synthetic
tacatgaacaaaaaaaggcgttttactggcgactttttctgcaaagtcaacatgtagaagcacccattacagtaa

SEQ ID NO: 165005 - DNA, 75 bp, Artificial Sequence
  Synthetic
ggtacatggcgtagccgcgacgcgggttggcacaggcccagcccgcggggagcagaaagtagtcgtcgaccagcg

SEQ ID NO: 165006 - DNA, 75 bp, Artificial Sequence
  Synthetic
ttttatcggtagcggcgagttccaacaatacgtcgactgctagcacaccgagtccctctagctctactcgcacct

SEQ ID NO: 165007 - DNA, 75 bp, Artificial Sequence
  Synthetic
tgttgtgtcgcacgcccgaggatctggcggccgccggcggtcagaaaaagaaaacgccggctcccaaacacccca

SEQ ID NO: 165008 - DNA, 75 bp, Artificial Sequence
  Synthetic
aaaacgccggctcccaaacaccccaagcacgccatggtgtacattcgccgcagctgtctggtccattcggcctgc

SEQ ID NO: 165009 - DNA, 75 bp, Artificial Sequence
  Synthetic
cctcgctgtctgggccgcgcttcgaggcgtgcccttgccgcccgatccgcagcattttcgctggctcaacgccgg

SEQ ID NO: 165010 - DNA, 75 bp, Artificial Sequence
  Synthetic
ggcgtgcccttgccgcccgatccgcagcattttcgctggctcaacgccggcgctttccgccgtctggtgcacgag

SEQ ID NO: 165011 - DNA, 75 bp, Artificial Sequence
  Synthetic
cgtcgtcgcgcccgtcgccgcactcgcaaaaggccgcgtagaggtccttcaacgccgcttcggctcgcgccataa

SEQ ID NO: 165012 - DNA, 75 bp, Artificial Sequence
  Synthetic
atctacgttttgatccactttaacgttccggcaactctgagacacaaactacgaactagaaacaacgtaaatcgc

SEQ ID NO: 165013 - DNA, 75 bp, Artificial Sequence
  Synthetic
aacgccgcttcggctcgcgccataaacgtggcgtggaaaaaaacggcggcgcggtgcgtccggtacttgacgggc

SEQ ID NO: 165014 - DNA, 75 bp, Artificial Sequence
  Synthetic
tgcacgttgctcgattacaagacctttgggacgcgcacccattacttgcggcagctatgctcgatgaccgaggag

SEQ ID NO: 165015 - DNA, 75 bp, Artificial Sequence
  Synthetic
ttgggacgcgcacccattacttgcggcagctatgctcgatgaccgaggagctgtacctgcgcctggacggcaccc

SEQ ID NO: 165016 - DNA, 75 bp, Artificial Sequence
  Synthetic
ctcgggctccagaaacaggcacagggtgccgtccaggcgcaggtacagctcctcggtcatcgagcatagctgccg

SEQ ID NO: 165017 - DNA, 75 bp, Artificial Sequence
  Synthetic
cacatcgtgctacaaaacagcctggcttagacattttaatatatccacacacggaaaatacacccatcccaacat

SEQ ID NO: 165018 - DNA, 75 bp, Artificial Sequence
  Synthetic
gtgccgtccaggcgcaggtacagctcctcggtcatcgagcatagctgccgcaagtaatgggtgcgcgtcccaaag

SEQ ID NO: 165019 - DNA, 75 bp, Artificial Sequence
  Synthetic
ccgtcaagtaccggacgcaccgcgccgccgtttttttccacgccacgtttatggcgcgggccgaagcggcgttga

SEQ ID NO: 165020 - DNA, 75 bp, Artificial Sequence
  Synthetic
aggacctctacgcagccttttgcgagtgcggcgacgggcgcgacgacggcggtaaccacgacggtaaccacggcg

SEQ ID NO: 165021 - DNA, 75 bp, Artificial Sequence
  Synthetic
ctgatctctggcaagtactgcgcctcgtgcaccagacggcggaaagcgccggcgttgagccagcgaaaatgctgc

SEQ ID NO: 165022 - DNA, 75 bp, Artificial Sequence
  Synthetic
cgactcgagcgtcagaccgcggatgtcgtacttgccgtgcgccgtagcgcaggctgaatggaccagacagctgcg

SEQ ID NO: 165023 - DNA, 75 bp, Artificial Sequence
  Synthetic
gggcttcgccgactggtcgcagacgctggtcgacgattactttctgctccccgcgggctgggcctgtgccaaccc

SEQ ID NO: 165024 - DNA, 75 bp, Artificial Sequence
  Synthetic
ctggtcgacgattactttctgctccccgcgggctgggcctgtgccaacccgcgtcgcggctacgccatgtacctg

SEQ ID NO: 165025 - DNA, 75 bp, Artificial Sequence
  Synthetic
atcctcgggcgtgcgacacaacaggccggcgcgcacagcctcctgtcgattacgaatcggcgtcaggtaggcgcg

SEQ ID NO: 165026 - DNA, 75 bp, Artificial Sequence
  Synthetic
tttaacttggtgccgttaatatacttgggaacgcggaatagatttcggctcatggcgttaaccaggtagaaactg

SEQ ID NO: 165027 - DNA, 75 bp, Artificial Sequence
  Synthetic
atacgtatgttgagcggggacgtgcagcggctcatcaggctgtttaaaggcgaggctgcgctgctgcgcaaggga

SEQ ID NO: 165028 - DNA, 75 bp, Artificial Sequence
  Synthetic
taggcgctcgtcaccgtcgtcatggtcttctttagcctgctcctccggctgctgggttggcggtggaggcggcgg

SEQ ID NO: 165029 - DNA, 75 bp, Artificial Sequence
  Synthetic
agcggctcatcaggctgtttaaaggcgaggctgcgctgctgcgcaagggactcgctcagaaccccgtgcaacgtc

SEQ ID NO: 165030 - DNA, 75 bp, Artificial Sequence
  Synthetic
ccttctgcgactttctcgagctggtgcagcggattcccgactaccgcagcgtgtcgctgcgcatcaagcgcgagc

SEQ ID NO: 165031 - DNA, 75 bp, Artificial Sequence
  Synthetic
agacaccggctatatagctagtcatcacagtctcctccttcacgacgcccccgtgccgctcacgttatccagcac

SEQ ID NO: 165032 - DNA, 75 bp, Artificial Sequence
  Synthetic
gcagcggattcccgactaccgcagcgtgtcgctgcgcatcaagcgcgagctgctgtgcctgcacgttttcaagct

SEQ ID NO: 165033 - DNA, 75 bp, Artificial Sequence
  Synthetic
ccgtgccgctcacgttatccagcacgctacggcccgaaaacacgtactcgctgacgtcgtacgcgggcgatgtat

SEQ ID NO: 165034 - DNA, 75 bp, Artificial Sequence
  Synthetic
aacgccgttatccgggacgttatttttatcctctttcccgtcttcgtcttcctctgtgtcgcgctcgtcccggta

SEQ ID NO: 165035 - DNA, 75 bp, Artificial Sequence
  Synthetic
cggggacgcgccgcaggatcgcacgcggctgccgcagttcagctcggcgctctcggacgccgagctgagcaacca

SEQ ID NO: 165036 - DNA, 75 bp, Artificial Sequence
  Synthetic
aagcaaaaacgccgtgggcaacgaaaccagaaggagccctgacggataaaaccgcgcagcgtctcggccaactta

SEQ ID NO: 165037 - DNA, 75 bp, Artificial Sequence
  Synthetic
cggctgccgcagttcagctcggcgctctcggacgccgagctgagcaaccacgccaaccgctgccgccgcaagacc

SEQ ID NO: 165038 - DNA, 75 bp, Artificial Sequence
  Synthetic
accgcgcagcgtctcggccaacttaaccagcatcgtaccgtacagcagtacgtgaatgccgccatgcgcgtccat

SEQ ID NO: 165039 - DNA, 75 bp, Artificial Sequence
  Synthetic
gagcgtcttcatgtacgccgttttcggcctcacgaggtcggaggtcacgccacatgaagccgcggcggcgcgtta

SEQ ID NO: 165040 - DNA, 75 bp, Artificial Sequence
  Synthetic
ggcctcacgaggtcggaggtcacgccacatgaagccgcggcggcgcgttataagcaccgtggggtcatcgaccga

SEQ ID NO: 165041 - DNA, 75 bp, Artificial Sequence
  Synthetic
attgttggcctcgtcggcctcggccacgttccacgagccgaaagtgaaagtacaagcgggcgagccgcccaggcg

SEQ ID NO: 165042 - DNA, 75 bp, Artificial Sequence
  Synthetic
tacaagcgggcgagccgcccaggcggatcttgctaccggcgtggagctgacatacgcgcagcagattggcgcggt

SEQ ID NO: 165043 - DNA, 75 bp, Artificial Sequence
  Synthetic
ggtcgccacctggatctgccctatccgcgcggctacacgctgtttgtctgcgacgtggaggagaccatcctcacc

SEQ ID NO: 165044 - DNA, 75 bp, Artificial Sequence
  Synthetic
cgacgtggaggagaccatcctcaccccgcgcgacgtagaatactggaagctgctggtggtgacccagggtcagtt

SEQ ID NO: 165045 - DNA, 75 bp, Artificial Sequence
  Synthetic
cgtagtcgcgctcaaagaagctgtacacggcaaagaggccgttctcaaaaaactcgccgaacgagagccccagca

SEQ ID NO: 165046 - DNA, 75 bp, Artificial Sequence
  Synthetic
aactcgccgaacgagagccccagcacgtacaccttgtcctcgccgggcaggtacgcaaaggcgtgcccgtgcccg

SEQ ID NO: 165047 - DNA, 75 bp, Artificial Sequence
  Synthetic
cagcgtgctgtgttacgagatcagccgtgagaactttgtggtgcgcgccgccgactcgctgccgcagctgctgga

SEQ ID NO: 165048 - DNA, 75 bp, Artificial Sequence
  Synthetic
cgtgagaactttgtggtgcgcgccgccgactcgctgccgcagctgctggagcgcggcctgctacacagctacttt

SEQ ID NO: 165049 - DNA, 75 bp, Artificial Sequence
  Synthetic
cggccagcctggcgcaggcacgagaagcgccggtaggtcttgtgatcgcgcaccaccccaaagtactgagtgtcg

SEQ ID NO: 165050 - DNA, 75 bp, Artificial Sequence
  Synthetic
agcgccggtaggtcttgtgatcgcgcaccaccccaaagtactgagtgtcgcccagcatgatgccgtgcagcggcg

SEQ ID NO: 165051 - DNA, 75 bp, Artificial Sequence
  Synthetic
caagtcatccgcgagtcggcctgctacgtgagccgcgcgctgctacgtcaccgtgtgacgccgggcaagcaagaa

SEQ ID NO: 165052 - DNA, 75 bp, Artificial Sequence
  Synthetic
acgtgagccgcgcgctgctacgtcaccgtgtgacgccgggcaagcaagaaatcaccgacgcgatgttcgaagccg

SEQ ID NO: 165053 - DNA, 75 bp, Artificial Sequence
  Synthetic
gcggcttcgggcgcttgtgggtccaggcatcacgcagaccgcgccagatgctgctgaacttgggctgcccgcgca

SEQ ID NO: 165054 - DNA, 75 bp, Artificial Sequence
  Synthetic
gtagcccacgacgagcctgtcgggagacacaagagcgcgaaaatcaaacctagagcgacgacggtgaaaaaaccg

SEQ ID NO: 165055 - DNA, 75 bp, Artificial Sequence
  Synthetic
cgtcccaccatcagcaacagtactccccgctgtcgcggcggtcgcgacggtgacggtcccgctcgtcgcgttgag

SEQ ID NO: 165056 - DNA, 75 bp, Artificial Sequence
  Synthetic
ctgatgactcacctacgctttttgaacggcagtctcagctcgggattggcctcgtacagcgagctgcggtccacg

SEQ ID NO: 165057 - DNA, 75 bp, Artificial Sequence
  Synthetic
acggcagtctcagctcgggattggcctcgtacagcgagctgcggtccacggggccgatgctctcgtagcgaaagt

SEQ ID NO: 165058 - DNA, 75 bp, Artificial Sequence
  Synthetic
cccgctgtcgcggcggtcgcgacggtgacggtcccgctcgtcgcgttgaggatagtcgcgcggtggcagcggggg

SEQ ID NO: 165059 - DNA, 75 bp, Artificial Sequence
  Synthetic
cgtgtcttcttcgcgttcgtcgggggggacctggctaaagattttgagcagggtgacggaggagacacccgtgtg

SEQ ID NO: 165060 - DNA, 75 bp, Artificial Sequence
  Synthetic
ccaccagcgccgcgtacacggtgcccgtgtcgccgcagagaatccgcacgcggtgaaagaaggtcttgtcctcgg

SEQ ID NO: 165061 - DNA, 75 bp, Artificial Sequence
  Synthetic
gggacctggctaaagattttgagcagggtgacggaggagacacccgtgtgttcgaccggaatgtgtcgactcgag

SEQ ID NO: 165062 - DNA, 75 bp, Artificial Sequence
  Synthetic
ttttttccgcggtttcccgctggcactgacccagcaccacggcgcacagacaaacagacagccacacccgacaca

SEQ ID NO: 165063 - DNA, 75 bp, Artificial Sequence
  Synthetic
agtgcgtcgttgttgggaagcacggagactgcggtaaactttgacaacgcgactacgattatcccacaacgtgtg

SEQ ID NO: 165064 - DNA, 75 bp, Artificial Sequence
  Synthetic
cgcaacagcggatcgcgcaccataaactcgcctacgaggcgttgggagctactgctgccgccggtgtcaccgata

SEQ ID NO: 165065 - DNA, 75 bp, Artificial Sequence
  Synthetic
actcgcctacgaggcgttgggagctactgctgccgccggtgtcaccgataataggtctgtcgggacaggccagca

SEQ ID NO: 165066 - DNA, 75 bp, Artificial Sequence
  Synthetic
agcaactcgcggaaagccagcagcgaacgtaggtagcggccgcgagcggaggcgcgcgagcggcggcacagctcg

SEQ ID NO: 165067 - DNA, 75 bp, Artificial Sequence
  Synthetic
aacgtaggtagcggccgcgagcggaggcgcgcgagcggcggcacagctcggcccgatggtcgggatgcaccaagg

SEQ ID NO: 165068 - DNA, 75 bp, Artificial Sequence
  Synthetic
acgccggcgtgctcgcgtagagcgcgtagtcgtagttttgactgacggcccagtagatcacgtcactaagctgcg

SEQ ID NO: 165069 - DNA, 75 bp, Artificial Sequence
  Synthetic
gtagtcgtagttttgactgacggcccagtagatcacgtcactaagctgcgcgtagtcttcgcgcaacgacggcag

SEQ ID NO: 165070 - DNA, 75 bp, Artificial Sequence
  Synthetic
cagaatcctctgacaccactactcgtacagattgttcagctacaaccgcacaaacaaccaccgtttctacagaac

SEQ ID NO: 165071 - DNA, 75 bp, Artificial Sequence
  Synthetic
cggccagatccgaggccaactcgtacaggcagtcctcttgcgcgtcgtaggcgaacacggcgccgtacgcgtcca

SEQ ID NO: 165072 - DNA, 75 bp, Artificial Sequence
  Synthetic
ggtgcgttgaaagtgcgtgatcataagctcgacgcctactaggaacgccagatcgttgagcgtgtgctcttcgca

SEQ ID NO: 165073 - DNA, 75 bp, Artificial Sequence
  Synthetic
agctcgacgcctactaggaacgccagatcgttgagcgtgtgctcttcgcatatctcttcgaccgaaagcagccgg

SEQ ID NO: 165074 - DNA, 75 bp, Artificial Sequence
  Synthetic
agagctcggaattcgccgaaaaagtcgttctggcagtgctccagatcgatctcggtcagcgagtgcggcgaatgc

SEQ ID NO: 165075 - DNA, 75 bp, Artificial Sequence
  Synthetic
tgggcggtatagaagagcacgttgtaatcgcgtagcgtctggtagacctcggtgagccgcggcgattcgggcgtg

SEQ ID NO: 165076 - DNA, 75 bp, Artificial Sequence
  Synthetic
aatcgcgtagcgtctggtagacctcggtgagccgcggcgattcgggcgtgccgcgatgccgcagctcttcgtcca

SEQ ID NO: 165077 - DNA, 75 bp, Artificial Sequence
  Synthetic
cgccgcaggccctcatagtcgcgtcgcacgcacaggtcggccaagtcgcgcgtgcaaaagacctcgggtaccaag

SEQ ID NO: 165078 - DNA, 75 bp, Artificial Sequence
  Synthetic
cgacggcggcgacgacgaggaggaagacgccgtggccgccgagcagcccttgcgacggccggacatgccggcagt

SEQ ID NO: 165079 - DNA, 75 bp, Artificial Sequence
  Synthetic
ccgcacgccccgaacggctctggttgttgacctgcgcggctacccggcgtaccgtgtcgccccgcacggtggtcc

SEQ ID NO: 165080 - DNA, 75 bp, Artificial Sequence
  Synthetic
accgtgtcgccccgcacggtggtccgtatggcctccaccatgtggcgcgctttcttttgcgccacgtagtaatag

SEQ ID NO: 165081 - DNA, 75 bp, Artificial Sequence
  Synthetic
gacccgctccaccccgtcctccacacgctcagccgcgactgagcgccggggcgcgccgctacttgggtttttata

SEQ ID NO: 165082 - DNA, 75 bp, Artificial Sequence
  Synthetic
aggcgctacgttgtttaagacggggtcgacgaggctggtgagcgcgaaggccggcatgggtatgcattcgttgag

SEQ ID NO: 165083 - DNA, 75 bp, Artificial Sequence
  Synthetic
tcgacgaggctggtgagcgcgaaggccggcatgggtatgcattcgttgaggcggcggaggtgctgcacgtcaaag

SEQ ID NO: 165084 - DNA, 75 bp, Artificial Sequence
  Synthetic
ccgggagcgatctacggagacctgacagcagttgggcaacacaagacagggaaatacaaagacacttttaataaa

SEQ ID NO: 165085 - DNA, 75 bp, Artificial Sequence
  Synthetic
acgctgacccggtaacattcgcgctcaaagtcttcgatgtcgctgtcgcagaaggaaaactcatcgccttcggca

SEQ ID NO: 165086 - DNA, 75 bp, Artificial Sequence
  Synthetic
gtccgtcaacacgcgacccgcgcggcaaaaggcacgctgttgacggcgcgagagcccgtcgtgatagtccatcat

SEQ ID NO: 165087 - DNA, 75 bp, Artificial Sequence
  Synthetic
caaaaggcacgctgttgacggcgcgagagcccgtcgtgatagtccatcatgccccggagatcgtgcacaaagcag

SEQ ID NO: 165088 - DNA, 75 bp, Artificial Sequence
  Synthetic
gactggtgcttctgctactgttactggtggtgcgactgctgctaccgccgctgctgctgttatcgtcgccaccgc

SEQ ID NO: 165089 - DNA, 75 bp, Artificial Sequence
  Synthetic
aaagttacggatctcatctagaaatagcagcgagtctagatagtcccacaggggatctataaacgttctctgaaa

SEQ ID NO: 165090 - DNA, 75 bp, Artificial Sequence
  Synthetic
cgccggcgccgttctcgggcagcgagggcacactaggcggtcgcgagactttaggcgacttgccggccttgggtg

SEQ ID NO: 165091 - DNA, 75 bp, Artificial Sequence
  Synthetic
gatgtcgtcatcgccctgacaggcgcgtagatggctccgcgagatcatgcgcgttttcaaccgccgtgacacatc

SEQ ID NO: 165092 - DNA, 75 bp, Artificial Sequence
  Synthetic
cgtagatggctccgcgagatcatgcgcgttttcaaccgccgtgacacatcaggtccatcttgagctggcgccggg

SEQ ID NO: 165093 - DNA, 75 bp, Artificial Sequence
  Synthetic
gggcacactaggcggtcgcgagactttaggcgacttgccggccttgggtgtcgccggcgagccccgaggcgcgcc

SEQ ID NO: 165094 - DNA, 75 bp, Artificial Sequence
  Synthetic
ggtctcgcgcacgagctcgaaggacgacggagcgtccgaggagacgctgtagggcgacaaaccggcctccatgcg

SEQ ID NO: 165095 - DNA, 75 bp, Artificial Sequence
  Synthetic
ccgagagggtgcgataaaaggcggcaaagtcctccaagtcggctacatgcgccctgggtctgacgctccaaagcg

SEQ ID NO: 165096 - DNA, 75 bp, Artificial Sequence
  Synthetic
aaagtcctccaagtcggctacatgcgccctgggtctgacgctccaaagcgtacgcagtctgatgaagcggaccca

SEQ ID NO: 165097 - DNA, 75 bp, Artificial Sequence
  Synthetic
gacggagcgtccgaggagacgctgtagggcgacaaaccggcctccatgcgatccagatcttccgtggcgctgcgc

SEQ ID NO: 165098 - DNA, 75 bp, Artificial Sequence
  Synthetic
atcaccgtcgagggttcgccagagcgacgtgacgagctgcgacgccgcgacgacatcctctcgtctgctgaggtg

SEQ ID NO: 165099 - DNA, 75 bp, Artificial Sequence
  Synthetic
aggccgacgcggtttatatacaccgtctcggacggcgggacgccgagcccgcgccgcggccgctcatccggagac

SEQ ID NO: 165100 - DNA, 75 bp, Artificial Sequence
  Synthetic
gacgtgacgagctgcgacgccgcgacgacatcctctcgtctgctgaggtgcgttcggctcagttgcttacctgca

SEQ ID NO: 165101 - DNA, 75 bp, Artificial Sequence
  Synthetic
gcggcgaccagattatgggggacaagcccacgcttgtgaccctgttgaccgtcgccgtgtcgtcgccgccaccgt

SEQ ID NO: 165102 - DNA, 75 bp, Artificial Sequence
  Synthetic
ggcgcggaaagtgtcctcgccacgctggccgcggtgaggacaagaagacggagcgtggtgtgcgacgggcccccg

SEQ ID NO: 165103 - DNA, 75 bp, Artificial Sequence
  Synthetic
tggccgcggtgaggacaagaagacggagcgtggtgtgcgacgggcccccgggctcgcccaccgactcggcgcgtc

SEQ ID NO: 165104 - DNA, 75 bp, Artificial Sequence
  Synthetic
cacggagctgctgttaccgccgccgtccgtcgccgccgctgcggtggcggcaacagcgacgagcgaggtgggcga

SEQ ID NO: 165105 - DNA, 75 bp, Artificial Sequence
  Synthetic
caacagcgacgagcgaggtgggcgagaaaaccgcggagcaagaggtagcggctgcgggtccggagaccgggaatg

SEQ ID NO: 165106 - DNA, 75 bp, Artificial Sequence
  Synthetic
acgcaggccaggtgttgcccgtggtctggccgccgggctggaacctagtgctgcaggagatcgagacggacgagg

SEQ ID NO: 165107 - DNA, 75 bp, Artificial Sequence
  Synthetic
ctgcaggagatcgagacggacgaggacttcaaaccggaggacgtgaaagcttggagtcactacctgtgctgcgag

SEQ ID NO: 165108 - DNA, 75 bp, Artificial Sequence
  Synthetic
accaccgcggtcaaaaggtcgcacgacggtatccctcgccaactggcagagcgcctgcggctgtgccgccacatg

SEQ ID NO: 165109 - DNA, 75 bp, Artificial Sequence
  Synthetic
acggtatccctcgccaactggcagagcgcctgcggctgtgccgccacatggaccccgagcaggactatcgtctgc

SEQ ID NO: 165110 - DNA, 75 bp, Artificial Sequence
  Synthetic
tgcctcatctcggacgagggctatgtcttttgctatgtacgcgaggacaccgccgtctactacctggcccgcaac

SEQ ID NO: 165111 - DNA, 75 bp, Artificial Sequence
  Synthetic
tcttttgctatgtacgcgaggacaccgccgtctactacctggcccgcaacctcatggaatttgcgcgcgttgggc

SEQ ID NO: 165112 - DNA, 75 bp, Artificial Sequence
  Synthetic
gccacgccaagattcaccgttcggcctcgcacctgacggcctacgagtcgtacttggtgtccatcaccgagcagt

SEQ ID NO: 165113 - DNA, 75 bp, Artificial Sequence
  Synthetic
ctcgcacctgacggcctacgagtcgtacttggtgtccatcaccgagcagtacaacacggcctcgaacgtgacgga

SEQ ID NO: 165114 - DNA, 75 bp, Artificial Sequence
  Synthetic
ggttccgactggcagggtattcaacagaatttggttgttgcaacgacagcgcttgtcgtaatcttccaattctaa

SEQ ID NO: 165115 - DNA, 75 bp, Artificial Sequence
  Synthetic
tgcgcgcctggaccctcggtttggataccatggcgcgattcatcatccgccaccacgggcagttcatgccgctga

SEQ ID NO: 165116 - DNA, 75 bp, Artificial Sequence
  Synthetic
taccatggcgcgattcatcatccgccaccacgggcagttcatgccgctgacgtacccgccgggaacggaactgcg

SEQ ID NO: 165117 - DNA, 75 bp, Artificial Sequence
  Synthetic
caagtacgactggtccaacgtggtgacgcccaaggcggcgtacgccgagctcttctttctgctctgctccaccag

SEQ ID NO: 165118 - DNA, 75 bp, Artificial Sequence
  Synthetic
acgcccaaggcggcgtacgccgagctcttctttctgctctgctccaccagcgagagctccgtggtgctgcaaccg

SEQ ID NO: 165119 - DNA, 75 bp, Artificial Sequence
  Synthetic
gatgtgcgaatttggaatcggatggtgtaaccatgtcaaaaccatgtcgaaaacacattgtactacctttttcgc

SEQ ID NO: 165120 - DNA, 75 bp, Artificial Sequence
  Synthetic
tgtaaccatgtcaaaaccatgtcgaaaacacattgtactacctttttcgctatatacgtgatattgccaacccgt

SEQ ID NO: 165121 - DNA, 75 bp, Artificial Sequence
  Synthetic
aatgcgcgttctcggcctgggaaccgtcagcctcaagggcgagaacgcgccctttcctcacttgcgctggcccgt

SEQ ID NO: 165122 - DNA, 75 bp, Artificial Sequence
  Synthetic
gtcagcctcaagggcgagaacgcgccctttcctcacttgcgctggcccgtcgaccttatccccatcgttgtcgcc

SEQ ID NO: 165123 - DNA, 75 bp, Artificial Sequence
  Synthetic
cagatcggttttctgcacacacaactggtcatggtgcccttcgtgccgcacgcctgcccgcattacgccgtgcct

SEQ ID NO: 165124 - DNA, 75 bp, Artificial Sequence
  Synthetic
gcagggtattcaacagaatttggttgttacaacgacaacgcctgtcgtaatcttccaattctaaaagatggaccg

SEQ ID NO: 165125 - DNA, 75 bp, Artificial Sequence
  Synthetic
attatcagtgtttttctttataaacactttatgccaccagttacttcgtttgccatcaacccatttcgatagata

SEQ ID NO: 165126 - DNA, 75 bp, Artificial Sequence
  Synthetic
atgtgtttgggacttaacctgctgtttgaaaaccgacgtttcagcggccacaacggcatctacgatcgcgtgccc

SEQ ID NO: 165127 - DNA, 75 bp, Artificial Sequence
  Synthetic
ttgaaaaccgacgtttcagcggccacaacggcatctacgatcgcgtgcccgactgccccaaaggacgtcagcacc

SEQ ID NO: 165128 - DNA, 75 bp, Artificial Sequence
  Synthetic
taatcgaatgatgtaaccatgttagcaccatatcaaaaacatattgcgttatcctttttcgtggaaaatttatca

SEQ ID NO: 165129 - DNA, 75 bp, Artificial Sequence
  Synthetic
gttgcgttttgtcgcatgtaggatctggaggtttatagccgacccaaaaaacgccgaatacgggatgatttgaac

SEQ ID NO: 165130 - DNA, 75 bp, Artificial Sequence
  Synthetic
caccatatcaaaaacatattgcgttatcctttttcgtggaaaatttatcagctatcgtatatatccatattaagc

SEQ ID NO: 165131 - DNA, 75 bp, Artificial Sequence
  Synthetic
gcgctacccggcgaggacgaggcgtggatcgcgtccaaaaacgtacagtacgaattcatgggtctcattttcacc

SEQ ID NO: 165132 - DNA, 75 bp, Artificial Sequence
  Synthetic
cgtgccaattttttcgctgccaacgccgtcaaggccgcctcttctggccctccgccacccttcgctcgagcacgg

SEQ ID NO: 165133 - DNA, 75 bp, Artificial Sequence
  Synthetic
gtcaccagcactctgtgccataaactactattttgaccattgagccatattgataaatgatgttgtggacctaag

SEQ ID NO: 165134 - DNA, 75 bp, Artificial Sequence
  Synthetic
gtcaacgtggattcactatgcgtggacgcggaacagcgccaactgctgggcaccgtggccacctccttctgtcac

SEQ ID NO: 165135 - DNA, 75 bp, Artificial Sequence
  Synthetic
tctggatcggcccgatttctttttgtccaccgacgcgcgaccgcgatgtcggtaatcaaggactgttttctcaat

SEQ ID NO: 165136 - DNA, 75 bp, Artificial Sequence
  Synthetic
gggtacgacctgcgatttagccgcaacccgtcactcttttttagcggcgacgcgctcaactgtccgcttctcaac

SEQ ID NO: 165137 - DNA, 75 bp, Artificial Sequence
  Synthetic
gcaacgcgtggccttggtttggcccaaagaccgctgcctcgttatccggcgtcgctggcgcttggtgcgcgacga

SEQ ID NO: 165138 - DNA, 75 bp, Artificial Sequence
  Synthetic
aaagaccgctgcctcgttatccggcgtcgctggcgcttggtgcgcgacgaaggacgggatgcacagcgtctggcc

SEQ ID NO: 165139 - DNA, 75 bp, Artificial Sequence
  Synthetic
gagttggacttgcgctacgtgcagatcacagaccggtgtttcttggtggccaacttgccacacgaggacgccttt

SEQ ID NO: 165140 - DNA, 75 bp, Artificial Sequence
  Synthetic
tcacagaccggtgtttcttggtggccaacttgccacacgaggacgccttttacacggggctcagcgtgtggcgcg

SEQ ID NO: 165141 - DNA, 75 bp, Artificial Sequence
  Synthetic
caacttgccacacgaggacgccttttacacggggctcagcgtgtggcgcggcggcgagccgctcaaagtcacgct

SEQ ID NO: 165142 - DNA, 75 bp, Artificial Sequence
  Synthetic
gatcacaacgtgccgtctgaactgtacctgggcgcctcgggcgccatgtacctgtggaccgaccacatctactct

SEQ ID NO: 165143 - DNA, 75 bp, Artificial Sequence
  Synthetic
acctgggcgcctcgggcgccatgtacctgtggaccgaccacatctactctgactcgttaacctttgtggccgaga

SEQ ID NO: 165144 - DNA, 75 bp, Artificial Sequence
  Synthetic
cggtaacgtgtactcgtacaatcaccacacggtgtttcggcagatgcacgccgccggagcaaccacgttctttct

SEQ ID NO: 165145 - DNA, 75 bp, Artificial Sequence
  Synthetic
cctcgcttagagcgctggccggctgcatgcacatccacgcgttcgcgcagtggcgtgctacgtatcgcggccgaa

SEQ ID NO: 165146 - DNA, 75 bp, Artificial Sequence
  Synthetic
catgcacatccacgcgttcgcgcagtggcgtgctacgtatcgcggccgaatcatggtcgtgggtgattacaccgt

SEQ ID NO: 165147 - DNA, 75 bp, Artificial Sequence
  Synthetic
gggcgacatgcaattgcccgcggacaactttctcacgtctccccatccctgaccctccgtccgtcctcctttccc

SEQ ID NO: 165148 - DNA, 75 bp, Artificial Sequence
  Synthetic
cgtggaacctttaggctggttggtgagcccctacgacgtgatcaacctcttcgtggacgactgtatgcgcgtctt

SEQ ID NO: 165149 - DNA, 75 bp, Artificial Sequence
  Synthetic
agcccctacgacgtgatcaacctcttcgtggacgactgtatgcgcgtctttgctgccaacaatcagcacgtttgc

SEQ ID NO: 165150 - DNA, 75 bp, Artificial Sequence
  Synthetic
aatcttctcgatcttttggaggatgttctgcacggcgtccgacggcgttttggcgccccccatgccggcagaacc

SEQ ID NO: 165151 - DNA, 75 bp, Artificial Sequence
  Synthetic
ttctgcacggcgtccgacggcgttttggcgccccccatgccggcagaacccggttgcggccccgtaccgctcttc

SEQ ID NO: 165152 - DNA, 75 bp, Artificial Sequence
  Synthetic
accaggagcatgcggaagctaaatcagcctacctgtccttacggagtggaccaccaactttttgacgacgcgtga

SEQ ID NO: 165153 - DNA, 75 bp, Artificial Sequence
  Synthetic
agcctacctgtccttacggagtggaccaccaactttttgacgacgcgtgaacccgcgtctcccacggaccgtgtg

SEQ ID NO: 165154 - DNA, 75 bp, Artificial Sequence
  Synthetic
cccgtcgagcggcgtgattgcaaagccgcgctcgcccccggtttcaggatggagggggaggccacaggcggcgca

SEQ ID NO: 165155 - DNA, 75 bp, Artificial Sequence
  Synthetic
tttgacggggctgggtggggagggaaggtcgcgccgccgcagcatcccgcatagcctctacaaactagcattctg

SEQ ID NO: 165156 - DNA, 75 bp, Artificial Sequence
  Synthetic
gcgacccggctggtgccggacaggcgacccggcgcgctaccgctcacggggaccgagggcggtcgacctaccacc

SEQ ID NO: 165157 - DNA, 75 bp, Artificial Sequence
  Synthetic
gacccggcgcgctaccgctcacggggaccgagggcggtcgacctaccaccgccttgccgcccaaagtaggtttca

SEQ ID NO: 165158 - DNA, 75 bp, Artificial Sequence
  Synthetic
cgaatacgaaagaaaaaagaccggaggcggggtgtttttagagcagaaccttacagctttttaataaaaaacaag

SEQ ID NO: 165159 - DNA, 75 bp, Artificial Sequence
  Synthetic
ggcggggtgtttttagagcagaaccttacagctttttaataaaaaacaagatagtcaacatggtctttaaccctt

SEQ ID NO: 165160 - DNA, 75 bp, Artificial Sequence
  Synthetic
ctgacgaaagcatggacagcggcgatgtggcgggggacacgacatcatcctccgtgggcgacaaaacggacgccg

SEQ ID NO: 165161 - DNA, 75 bp, Artificial Sequence
  Synthetic
acgttccttgatgacgtcgttttagacgaagccggttgaggttgcaacagcgtggcgggtaccgtcgacggcgtg

SEQ ID NO: 165162 - DNA, 75 bp, Artificial Sequence
  Synthetic
ggttgctgatggttacctccatctgtgtccgtaatcaaaacgtcatagtctcccccggagtaatcttcatctccg

SEQ ID NO: 165163 - DNA, 75 bp, Artificial Sequence
  Synthetic
aaacacataccactacatcgatttgtcgtgccgtacaaccgtcaagttttccgaacttttatacacgccaacggc

SEQ ID NO: 165164 - DNA, 75 bp, Artificial Sequence
  Synthetic
tcggtggtggaccccccctgactgagagttacgtctttgttgcgagtggtattaccatcggagttagtgctggta

SEQ ID NO: 165165 - DNA, 75 bp, Artificial Sequence
  Synthetic
cattggagacgataacttagctttacgtattctggacggcgtcgactgctcgggcgtctgactgggaggcgaaat

SEQ ID NO: 165166 - DNA, 75 bp, Artificial Sequence
  Synthetic
cctgtgttgagttccccagattccgtttacctgcgcttcgatttctgagaaggtgccgccaaagccaccgtcaag

SEQ ID NO: 165167 - DNA, 75 bp, Artificial Sequence
  Synthetic
tttacctgcgcttcgatttctgagaaggtgccgccaaagccaccgtcaaggtcacggctagtaagctcaggatcc

SEQ ID NO: 165168 - DNA, 75 bp, Artificial Sequence
  Synthetic
gtcttcctcctcgctgtcttcgaccggtgactctgcagtttggtcccttaaagcccaaacctcatcagcggcgtc

SEQ ID NO: 165169 - DNA, 75 bp, Artificial Sequence
  Synthetic
cttgggtgacgacatctcgaggtcatgtggccgcttctgaaaaacaacgtagtccggacgaaccgcagatacgcg

SEQ ID NO: 165170 - DNA, 75 bp, Artificial Sequence
  Synthetic
atgtgttgaatcagaatcatctttactgaccgcgccatacttcgtatacgaacctaaccggcgtaaagtgtttcc

SEQ ID NO: 165171 - DNA, 75 bp, Artificial Sequence
  Synthetic
tgtggccgcttctgaaaaacaacgtagtccggacgaaccgcagatacgcggtttttcaacctcgacggtttacgc

SEQ ID NO: 165172 - DNA, 75 bp, Artificial Sequence
  Synthetic
agccgtggaagtcgtaggcatcctgaagggattgtaagccaggtgaggattcttgagggcccacgcgcgttcgcg

SEQ ID NO: 165173 - DNA, 75 bp, Artificial Sequence
  Synthetic
aagggattgtaagccaggtgaggattcttgagggcccacgcgcgttcgcgcggccagttggcggggttcatatcc

SEQ ID NO: 165174 - DNA, 75 bp, Artificial Sequence
  Synthetic
gcgcctctctcatggatccactgtcaccgtcgcgatgggaggtagccctgttccccagctcaccaccgtcactca

SEQ ID NO: 165175 - DNA, 75 bp, Artificial Sequence
  Synthetic
ttccccagctcaccaccgtcactcaaggactcatgccatctgtgcgcatggactttcgggctcgccggcccttgc

SEQ ID NO: 165176 - DNA, 75 bp, Artificial Sequence
  Synthetic
tgctggtcggtgagggagacgaagagatgttgccggatctgccgatggagatcgacatcgtcatcgaccgacctc

SEQ ID NO: 165177 - DNA, 75 bp, Artificial Sequence
  Synthetic
tcggtatccgtgatgtccaccagcgtgtcggtgaaacgcggatcttgacggttggggggatagccatccgagctg

SEQ ID NO: 165178 - DNA, 75 bp, Artificial Sequence
  Synthetic
gttggggggatagccatccgagctgtcggaatcctcgtcgcccgagaaaagatcccctctggtctccgtgagcgg

SEQ ID NO: 165179 - DNA, 75 bp, Artificial Sequence
  Synthetic
ggtgctactgctggacgatgttcccccccatgtacccggttttgctccctaccgcgtcccccgtccccaccccat

SEQ ID NO: 165180 - DNA, 75 bp, Artificial Sequence
  Synthetic
gattcccgaagaacattgggaccagttttaaataaaagcattttatttacatctgtacagggattatataaaagt

SEQ ID NO: 165181 - DNA, 75 bp, Artificial Sequence
  Synthetic
aaatgtgatcgtggttgtacttttttgttttttgctcatatgctgtaaggtgttcgaggatcgtggggagtatat

SEQ ID NO: 165182 - DNA, 75 bp, Artificial Sequence
  Synthetic
tcacctgcggggagacgagactgaaagccgcgtgacgctgttgttgctgcgggatgttcaagggaccgctggtcg

SEQ ID NO: 165183 - DNA, 75 bp, Artificial Sequence
  Synthetic
ttttaaataaaagcattttatttacatctgtacagggattatataaaagtctgtatatccagtccattgtcagta

SEQ ID NO: 165184 - DNA, 75 bp, Artificial Sequence
  Synthetic
ctaccactagcggcgcccttgccgctagttcccggtttcttgatgggcgtaaagatgtttttctcgtcatcatca

SEQ ID NO: 165185 - DNA, 75 bp, Artificial Sequence
  Synthetic
cgtcatgctggcatgcagaccaccatgtgcatgggtccaggcgatggcggaggagacggcgggaattctattaag

SEQ ID NO: 165186 - DNA, 75 bp, Artificial Sequence
  Synthetic
ggttgctgctgacgttgctgcaggttctgctgcctctcctcccaagccttcagctgctgtttctcacgctgcacc

SEQ ID NO: 165187 - DNA, 75 bp, Artificial Sequence
  Synthetic
tctgctgcctctcctcccaagccttcagctgctgtttctcacgctgcaccacctcgtcgtccacccgtttctgcc

SEQ ID NO: 165188 - DNA, 75 bp, Artificial Sequence
  Synthetic
ttctttttcctcctcttcctcagtgaattctggcaagagttcaaagccgcgtgggcatatcagaagccggccaca

SEQ ID NO: 165189 - DNA, 75 bp, Artificial Sequence
  Synthetic
aattctggcaagagttcaaagccgcgtgggcatatcagaagccggccacagcgatagtaacagatgaggatgagc

SEQ ID NO: 165190 - DNA, 75 bp, Artificial Sequence
  Synthetic
ccagagaaccatgggcctcgaagcggaacggtttgtgtcccttccagggactggcgatccagctccagccgtcca

SEQ ID NO: 165191 - DNA, 75 bp, Artificial Sequence
  Synthetic
ctacgacccttgtcgactatataagcttcctgaagtccacatgtaagcactgccaagggggtcaggataacatag

SEQ ID NO: 165192 - DNA, 75 bp, Artificial Sequence
  Synthetic
tgccaagggggtcaggataacatagtccataaattcttttggtacgttaccttcagatttgttgtaccattctac

SEQ ID NO: 165193 - DNA, 75 bp, Artificial Sequence
  Synthetic
ttcccagcaactcgactttgatagtgttattaaaagtaatattgatccaatttttccatagctggcacatgccgg

SEQ ID NO: 165194 - DNA, 75 bp, Artificial Sequence
  Synthetic
cagcagcgtgtcggccgagtcgccgttttccacggcgtgtttgaggatattgcgacagtagttggaatcaaagga

SEQ ID NO: 165195 - DNA, 75 bp, Artificial Sequence
  Synthetic
gttattaaaagtaatattgatccaatttttccatagctggcacatgccggaaaagagatatttcgaaacttgatt

SEQ ID NO: 165196 - DNA, 75 bp, Artificial Sequence
  Synthetic
aaggcacatgcgcagctccttgaccagcagcttgcagcgctcctgaatgcgcgccagacatttgcgctccagctc

SEQ ID NO: 165197 - DNA, 75 bp, Artificial Sequence
  Synthetic
ccagagggtagtcagataggactcaccgcggttgatgcagctctctgtcagattagccacgctccaattaccctc

SEQ ID NO: 165198 - DNA, 75 bp, Artificial Sequence
  Synthetic
atgagacggcccgtgtacacgagcttgttgacggcgttgaccagcgccgtgttggcgtgccggtccaggttaagg

SEQ ID NO: 165199 - DNA, 75 bp, Artificial Sequence
  Synthetic
tgttgacggcgttgaccagcgccgtgttggcgtgccggtccaggttaaggtcgagcggtttcacacagaacatgt

SEQ ID NO: 165200 - DNA, 75 bp, Artificial Sequence
  Synthetic
caaacccccgatggccgtgcgggtaactccgttgggaccggtaaggagagacacaaagatggtatcggtattgtt

SEQ ID NO: 165201 - DNA, 75 bp, Artificial Sequence
  Synthetic
ccgtctggccaatggctgtgaccagcgtctcgcgcaccgacatcttggccagaatgaccgcgcttacgagcgcgc

SEQ ID NO: 165202 - DNA, 75 bp, Artificial Sequence
  Synthetic
tcaccagcatagcccgtatcccgagcatcttgccggacactgaacataacggcgtttgtatatataaagaccgtt

SEQ ID NO: 165203 - DNA, 75 bp, Artificial Sequence
  Synthetic
ggcgtttgtatatataaagaccgttccaacgcaacattgaggtgtcattgacgtctttattgacgtggttttacc

SEQ ID NO: 165204 - DNA, 75 bp, Artificial Sequence
  Synthetic
ccttaccacgatcaccgaacgggtaagtgtagccgcgacgcgccacggccgcgcaacgcacctcgaactcctcga

SEQ ID NO: 165205 - DNA, 75 bp, Artificial Sequence
  Synthetic
gcaccgaggaaaggtcggggttgtggaaacgcagctcgcggtagtatcccaaccaaagcatgagctcgttgaaca

SEQ ID NO: 165206 - DNA, 75 bp, Artificial Sequence
  Synthetic
gaaacgcagctcgcggtagtatcccaaccaaagcatgagctcgttgaacagcaccgtacgccggtgcaggcgttt

SEQ ID NO: 165207 - DNA, 75 bp, Artificial Sequence
  Synthetic
atgaggaaccagcgtggattccaacgctggtttcatcataaaccaccgtgaaaaccagacgcgggtttcgacacg

SEQ ID NO: 165208 - DNA, 75 bp, Artificial Sequence
  Synthetic
ttacgactcacatctagctcgtcttctgacgctacccacgaatttcgtaaccgaatccgcttcagcgtttccatt

SEQ ID NO: 165209 - DNA, 75 bp, Artificial Sequence
  Synthetic
gttgaccagggccaccacatcgcgccgctgtagaccgataaactgcaaactcatgctggcttttctccagaaccc

SEQ ID NO: 165210 - DNA, 75 bp, Artificial Sequence
  Synthetic
cgctgtagaccgataaactgcaaactcatgctggcttttctccagaacccggaagcgtcgtcgccccggactgcg

SEQ ID NO: 165211 - DNA, 75 bp, Artificial Sequence
  Synthetic
ctgacgctacccacgaatttcgtaaccgaatccgcttcagcgtttccattaaactggcgcaatccacttctgact

SEQ ID NO: 165212 - DNA, 75 bp, Artificial Sequence
  Synthetic
tcaaccgaccgcagaacccatcacgagtgcgtcgcgtgagaaacatgaccgtgttgacgggggcacgcggtaacc

SEQ ID NO: 165213 - DNA, 75 bp, Artificial Sequence
  Synthetic
gggggtagtttaatagcggaggcgggtacgcggttttcactctggcaccgctgacttgtttcttttgttttttgc

SEQ ID NO: 165214 - DNA, 75 bp, Artificial Sequence
  Synthetic
agtgcgtcgcgtgagaaacatgaccgtgttgacgggggcacgcggtaaccgacgtcgaaacagctcatacagggc

SEQ ID NO: 165215 - DNA, 75 bp, Artificial Sequence
  Synthetic
gtaaagtagtgcaggaacgcgaatagcaaagcgcataaaagcagggctaggaggacactgctgatggtcatggtg

SEQ ID NO: 165216 - DNA, 75 bp, Artificial Sequence
  Synthetic
gaggacactgctgatggtcatggtgttatagcgtttgttagctgtcggatgatcagggacctcccccgaggaact

SEQ ID NO: 165217 - DNA, 75 bp, Artificial Sequence
  Synthetic
aaccgtgtattgggctattcgacacccaccatctacatgaccaacctctattccactaactttctcacgctcacc

SEQ ID NO: 165218 - DNA, 75 bp, Artificial Sequence
  Synthetic
gtgtaacgcggcaggtgtagttttgattgcaaaagatggctacgtaacatccctgatggaaagtcccatcgaagg

SEQ ID NO: 165219 - DNA, 75 bp, Artificial Sequence
  Synthetic
atttactactcaagctgcacagtgggctttgccaccgtagccctgatcgccgccgaccgataccgcgttcttcat

SEQ ID NO: 165220 - DNA, 75 bp, Artificial Sequence
  Synthetic
tttcccctggaaagaacccgtaagatgtacagaacgcttcagctctgttgtcattgtggtttcggacaccgcctt

SEQ ID NO: 165221 - DNA, 75 bp, Artificial Sequence
  Synthetic
attgacttggtttgccgggctgatcttttccatgcccgcggccgtttacactacagtagtgatacataatggtac

SEQ ID NO: 165222 - DNA, 75 bp, Artificial Sequence
  Synthetic
acctgcgtactgtacttcatagccgacgaggtgtacacggtactactctcgtggaaagtgctgctgacgctagtg

SEQ ID NO: 165223 - DNA, 75 bp, Artificial Sequence
  Synthetic
acgaggtgtacacggtactactctcgtggaaagtgctgctgacgctagtgtggggcgccgcgcccgttatcatga

SEQ ID NO: 165224 - DNA, 75 bp, Artificial Sequence
  Synthetic
agttcctttgtattgcagtatccccctcgctgatgtttttaattttaccgtcgatgtacgttttgttttgcttca

SEQ ID NO: 165225 - DNA, 75 bp, Artificial Sequence
  Synthetic
ctcgctgatgtttttaattttaccgtcgatgtacgttttgttttgcttcaaccaactaatttcgtaattggggcc

SEQ ID NO: 165226 - DNA, 75 bp, Artificial Sequence
  Synthetic
tcgtcagcgtgttactcatctccttcgtggcgctacagacgccttacgtgtccatcatgattttcaacagttacg

SEQ ID NO: 165227 - DNA, 75 bp, Artificial Sequence
  Synthetic
aaaactaccgttttccgtggtattacactcgtgtgtccacgtcagcacgctctgtgaccggtaacccaacgcaat

SEQ ID NO: 165228 - DNA, 75 bp, Artificial Sequence
  Synthetic
cactcgtgtgtccacgtcagcacgctctgtgaccggtaacccaacgcaatttccagctctaacaggttttgctcg

SEQ ID NO: 165229 - DNA, 75 bp, Artificial Sequence
  Synthetic
atccaagaaatggtaccgttggcccgacttgacgttctatcgctggaattaacgtgataggtaaaaaagtgttgc

SEQ ID NO: 165230 - DNA, 75 bp, Artificial Sequence
  Synthetic
gactttctgcagcgcatgcggcagtgtttccgcggccagttgctggaccgccgcgctttcctgagatcgcagcag

SEQ ID NO: 165231 - DNA, 75 bp, Artificial Sequence
  Synthetic
gtttccgcggccagttgctggaccgccgcgctttcctgagatcgcagcagaatcagcgagctacagcggagacaa

SEQ ID NO: 165232 - DNA, 75 bp, Artificial Sequence
  Synthetic
gacttgacgttctatcgctggaattaacgtgataggtaaaaaagtgttgcccgtcaaaaatccccacgacggtca

SEQ ID NO: 165233 - DNA, 75 bp, Artificial Sequence
  Synthetic
acagcacaaataacgtcagacaccacgttgtcatcatggcgttttattaacagttcctcggacatgatcggcgtt

SEQ ID NO: 165234 - DNA, 75 bp, Artificial Sequence
  Synthetic
ccaaacgcagcgtgtctttcaattttcccagcggtacgtggaaaggcggccagaaaaccgcgtccaacgacacat

SEQ ID NO: 165235 - DNA, 75 bp, Artificial Sequence
  Synthetic
tcccagcggtacgtggaaaggcggccagaaaaccgcgtccaacgacacatccacaaaaatcccccatcgactctc

SEQ ID NO: 165236 - DNA, 75 bp, Artificial Sequence
  Synthetic
cgttgtcatcatggcgttttattaacagttcctcggacatgatcggcgttatatactttcagtccacgttttgac

SEQ ID NO: 165237 - DNA, 75 bp, Artificial Sequence
  Synthetic
atccgacatcagtggctccgagtcctcccgaggaaagaaaagtcgtcgaaacagccagcacaaatcgtgccaaaa

SEQ ID NO: 165238 - DNA, 75 bp, Artificial Sequence
  Synthetic
tttcccctcatatacggtacacgtccccctgatctgtcatcacggtacacagatttcgcccgactgcggacgccg

SEQ ID NO: 165239 - DNA, 75 bp, Artificial Sequence
  Synthetic
tcccgaggaaagaaaagtcgtcgaaacagccagcacaaatcgtgccaaaacagaaggacggccgccttttttctt

SEQ ID NO: 165240 - DNA, 75 bp, Artificial Sequence
  Synthetic
agatttcgcccgactgcggacgccgacggccaatcgcgtggcgtaggagtggcgccccggcttcattataacgcc

SEQ ID NO: 165241 - DNA, 75 bp, Artificial Sequence
  Synthetic
taaaccgtggtgtcccaggatctcttagacacctgttcgtccagaatcaacatttccaaccgacagtgacggggc

SEQ ID NO: 165242 - DNA, 75 bp, Artificial Sequence
  Synthetic
tagacacctgttcgtccagaatcaacatttccaaccgacagtgacggggccggccgacgaagtgtgtgaagagcg

SEQ ID NO: 165243 - DNA, 75 bp, Artificial Sequence
  Synthetic
ccccgtcgacgttgttttctccgagcggtgatcgttcccgtccctctcctccctccgcggcccccacggcggcgg

SEQ ID NO: 165244 - DNA, 75 bp, Artificial Sequence
  Synthetic
ccctccgcggcccccacggcggcggcctgctcgcacggacctatactattaccgccccaccgccgtcgtcgtcat

SEQ ID NO: 165245 - DNA, 75 bp, Artificial Sequence
  Synthetic
atagcagcgtgaacgttgcacgtggcctttgcggttatccgttcagtcctcggtgcgtaaccgctggtatcgatg

SEQ ID NO: 165246 - DNA, 75 bp, Artificial Sequence
  Synthetic
cctttgcggttatccgttcagtcctcggtgcgtaaccgctggtatcgatgcggcaggcgaatgcgcagccgctgc

SEQ ID NO: 165247 - DNA, 75 bp, Artificial Sequence
  Synthetic
gagccgccgagatgcgtgacaacgtggcaggctcgatttccaaagcgtacaagggcacggtacgcgccgaaggca

SEQ ID NO: 165248 - DNA, 75 bp, Artificial Sequence
  Synthetic
ggcaggctcgatttccaaagcgtacaagggcacggtacgcgccgaaggcaagaagaagctgctgctgaagcactt

SEQ ID NO: 165249 - DNA, 75 bp, Artificial Sequence
  Synthetic
gccaaggtcgcggacagttcctcgtcggcgcttacggaggggtgtttggcgagcccggatccgggcggtctcgga

SEQ ID NO: 165250 - DNA, 75 bp, Artificial Sequence
  Synthetic
cggcgcttacggaggggtgtttggcgagcccggatccgggcggtctcggatatagcgagcccaatcggacgtgga

SEQ ID NO: 165251 - DNA, 75 bp, Artificial Sequence
  Synthetic
gttccaccagggcatcgcacagctcaagcgcgcgccggccgaactggacccccacgagatccagcaagtcacggc

SEQ ID NO: 165252 - DNA, 75 bp, Artificial Sequence
  Synthetic
aagcgcgcgccggccgaactggacccccacgagatccagcaagtcacggccagtatccgctgccgcctgcagccc

SEQ ID NO: 165253 - DNA, 75 bp, Artificial Sequence
  Synthetic
tgcggctggtgtacagtttagtcacagggacggttcgcattttcagtccgtcttgcaagatgttggtggtgatgt

SEQ ID NO: 165254 - DNA, 75 bp, Artificial Sequence
  Synthetic
agggacggttcgcattttcagtccgtcttgcaagatgttggtggtgatgtcgctgaaattgcggatcaccgtatc

SEQ ID NO: 165255 - DNA, 75 bp, Artificial Sequence
  Synthetic
ctggttttcacggcccagctgcgccactactgcgagcaccaggacaaggtggtgagctacgcgcgcgacgagttg

SEQ ID NO: 165256 - DNA, 75 bp, Artificial Sequence
  Synthetic
actactgcgagcaccaggacaaggtggtgagctacgcgcgcgacgagttgaccaaacgctgcggcgaaaaatcgg

SEQ ID NO: 165257 - DNA, 75 bp, Artificial Sequence
  Synthetic
ggtcacattctcgtagtagcagatagagatacacatcccgtgtaacgtccacgtttccccaggacggatcgaggc

SEQ ID NO: 165258 - DNA, 75 bp, Artificial Sequence
  Synthetic
gagatacacatcccgtgtaacgtccacgtttccccaggacggatcgaggccaactccgtcacattcaagcggcag

SEQ ID NO: 165259 - DNA, 75 bp, Artificial Sequence
  Synthetic
tcggcttgttgcaccagacgccgcacatgtgggcgcgctccatccgtctcatcggacacctacgccactacctgc

SEQ ID NO: 165260 - DNA, 75 bp, Artificial Sequence
  Synthetic
gtcttcgacggctgttaccacagcgaggcctaccgcatgctcttccagatcggtcatacggactcggtgtcggcg

SEQ ID NO: 165261 - DNA, 75 bp, Artificial Sequence
  Synthetic
catcccagcggtaccgtacctcggcgacgctccatgccggcgcctgacggtcctttgtgcgcgctccccataagt

SEQ ID NO: 165262 - DNA, 75 bp, Artificial Sequence
  Synthetic
cggtcatacggactcggtgtcggcggccctggaactctcacacagcgcggcggccgggccgcccgaggccgatga

SEQ ID NO: 165263 - DNA, 75 bp, Artificial Sequence
  Synthetic
tcctttgtgcgcgctccccataagtacccaggcttttgaccccagtcggtacctacgtcagcatgaagcccggtg

SEQ ID NO: 165264 - DNA, 75 bp, Artificial Sequence
  Synthetic
cgccaatattcccaataaaatacaaaacacgcgttccttgatatggattcaaaatttattgtgcgcgataccgca

SEQ ID NO: 165265 - DNA, 75 bp, Artificial Sequence
  Synthetic
aacacgcgttccttgatatggattcaaaatttattgtgcgcgataccgcatcgccaaccacgaacacagtccaaa

SEQ ID NO: 165266 - DNA, 75 bp, Artificial Sequence
  Synthetic
cgaaccgcgtctggtaccgctactgtgggcgatgggaccgacgtcggagtcgcggcgttcgttggcgccgctgcc

SEQ ID NO: 165267 - DNA, 75 bp, Artificial Sequence
  Synthetic
tgggcgatgggaccgacgtcggagtcgcggcgttcgttggcgccgctgccgcgtcgggtaccgctgtcgcagatg

SEQ ID NO: 165268 - DNA, 75 bp, Artificial Sequence
  Synthetic
accccctcaccttcagtcaccccagcctttacccccgtcacgtcccccataaccccgttgtgtatttaacgtcac

SEQ ID NO: 165269 - DNA, 75 bp, Artificial Sequence
  Synthetic
cctttacccccgtcacgtcccccataaccccgttgtgtatttaacgtcactggagaacaataaagcgttgatttc

SEQ ID NO: 165270 - DNA, 75 bp, Artificial Sequence
  Synthetic
atcatccgcttcatggctttcctcgtttactcccgccgctgctcttcctcagagacggccgccgccgctaccgca

SEQ ID NO: 165271 - DNA, 75 bp, Artificial Sequence
  Synthetic
tttactcccgccgctgctcttcctcagagacggccgccgccgctaccgcagaggcttctcccgcggcagtttcct

SEQ ID NO: 165272 - DNA, 75 bp, Artificial Sequence
  Synthetic
gggaggtcagggccaccgatcccgcggccagcagcccgatcttcggatccgtcagccagtaatccctccgcagat

SEQ ID NO: 165273 - DNA, 75 bp, Artificial Sequence
  Synthetic
ccgacgtcaccccgtgtctccgtccccacccccgtccccgtatccgcaaaagcccgcaagtccccgccgctaacc

SEQ ID NO: 165274 - DNA, 75 bp, Artificial Sequence
  Synthetic
ggccagcagcccgatcttcggatccgtcagccagtaatccctccgcagatgatagcgccgcctagcgccgtctac

SEQ ID NO: 165275 - DNA, 75 bp, Artificial Sequence
  Synthetic
ccactaccgcaacagccgcgatgtgttgcgggacctgcgcacgcagctcgacgtgctgtactcggagccgcttaa

SEQ ID NO: 165276 - DNA, 75 bp, Artificial Sequence
  Synthetic
ctcgcacgagggcagcagacccgaggtgccggggatgtagtggactacgcggtgccgttcaccctcccaaccgca

SEQ ID NO: 165277 - DNA, 75 bp, Artificial Sequence
  Synthetic
gacgcgactgcttagagggctcatccgactctgccgcgctgcgcaaaccggcgtcaagcccgaggacatcagcgt

SEQ ID NO: 165278 - DNA, 75 bp, Artificial Sequence
  Synthetic
ggtgccgttcaccctcccaaccgcagtttatactgcgcaacctggagggatcgggcgtccacaggtaccgcgtct

SEQ ID NO: 165279 - DNA, 75 bp, Artificial Sequence
  Synthetic
tcgggcgtgctgggcgccggcgctggtaacgggagttacgctggggacggggacgggggttgcgccggggacggg

SEQ ID NO: 165280 - DNA, 75 bp, Artificial Sequence
  Synthetic
ttcggcgtgctaaaacgagcgctggtccggttgcaccgggtacgcgacgcgctggggctgcgcgcgtctcccgag

SEQ ID NO: 165281 - DNA, 75 bp, Artificial Sequence
  Synthetic
tccggttgcaccgggtacgcgacgcgctggggctgcgcgcgtctcccgaggccgaggcgcgctatccgcgcctca

SEQ ID NO: 165282 - DNA, 75 bp, Artificial Sequence
  Synthetic
tggtctcggtcgccaggctgtgggtctcgttgcccagcacgcaggtgtaggtgcccgcggtctcggtgatgagac

SEQ ID NO: 165283 - DNA, 75 bp, Artificial Sequence
  Synthetic
ctcgttgcccagcacgcaggtgtaggtgcccgcggtctcggtgatgagacgaaacgagaggctcagccgctgcgc

SEQ ID NO: 165284 - DNA, 75 bp, Artificial Sequence
  Synthetic
gggggttcgcggcggggacgggggggatggcggtgggggcctttcgcggcggggacggtggtggggacggcgaca

SEQ ID NO: 165285 - DNA, 75 bp, Artificial Sequence
  Synthetic
ccgacgtaacacaacgtcgtaaccgaccgttgcgctgcctcacctccatcaaacgcccgggctcacgcaccctgg

SEQ ID NO: 165286 - DNA, 75 bp, Artificial Sequence
  Synthetic
gcgtgcgtccaccaccagcgaacgcacgatctcgggccagtagcagaggtggactcggatagagacctctggcca

SEQ ID NO: 165287 - DNA, 75 bp, Artificial Sequence
  Synthetic
acgatctcgggccagtagcagaggtggactcggatagagacctctggccagtcgtgcgcggggaagatgcaggcc

SEQ ID NO: 165288 - DNA, 75 bp, Artificial Sequence
  Synthetic
tgatgcaggactgggtggtggaacgctgcaaccgtctttgcgacgcgctttacttttgttacacgcaagcccccg

SEQ ID NO: 165289 - DNA, 75 bp, Artificial Sequence
  Synthetic
aaacgcggcagactttcgtcacgctggtgcgtgggctggaacttgcgcggcaacacagcagtccggccttccagc

SEQ ID NO: 165290 - DNA, 75 bp, Artificial Sequence
  Synthetic
tgcagacagggcgaacgcaccaccggaggcgcatcgagacagcagttgccccactcgctccaggcgatcagcagc

SEQ ID NO: 165291 - DNA, 75 bp, Artificial Sequence
  Synthetic
gaggcgcatcgagacagcagttgccccactcgctccaggcgatcagcagcggcagccacagcggcggcagccggc

SEQ ID NO: 165292 - DNA, 75 bp, Artificial Sequence
  Synthetic
cgatgctgtacaatctgttgcaactactgacgcagctgcacgaggccaacgtgtacctctgcccgggatatttac

SEQ ID NO: 165293 - DNA, 75 bp, Artificial Sequence
  Synthetic
attggcagattatctttattggtagtgtttgacacgcataagcgaccggggatggagggaaataaaggaatggct

SEQ ID NO: 165294 - DNA, 75 bp, Artificial Sequence
  Synthetic
tgtttgacacgcataagcgaccggggatggagggaaataaaggaatggctcggtgtattctaaatcgtcatgggc

SEQ ID NO: 165295 - DNA, 75 bp, Artificial Sequence
  Synthetic
aggacgaagagcaggagaacgacggcgagccgcgcgaggcccagctcgatctcgaagccgatcccacggcgcgcg

SEQ ID NO: 165296 - DNA, 75 bp, Artificial Sequence
  Synthetic
cgagccgcgcgaggcccagctcgatctcgaagccgatcccacggcgcgcgagggcgagctctttttcttctccaa

SEQ ID NO: 165297 - DNA, 75 bp, Artificial Sequence
  Synthetic
ggacaggccacggtcagcgtatttgtcgtcattggcggcgattcacacggtccaccttcctcgttctcctcctgt

SEQ ID NO: 165298 - DNA, 75 bp, Artificial Sequence
  Synthetic
tcgtcattggcggcgattcacacggtccaccttcctcgttctcctcctgtgacctcctattcagttctccttgtc

SEQ ID NO: 165299 - DNA, 75 bp, Artificial Sequence
  Synthetic
ggaacggcccgaaaccctgcagatcttctataacttccacgaaggcaagatcaccaccgagacgtatcacctcca

SEQ ID NO: 165300 - DNA, 75 bp, Artificial Sequence
  Synthetic
ttctataacttccacgaaggcaagatcaccaccgagacgtatcacctccagcgcatctatagcatgatgatcgag

SEQ ID NO: 165301 - DNA, 75 bp, Artificial Sequence
  Synthetic
cgtttccacttgctcggctcccatcattcccttctctcgcgccctctctcgaaacgtcctccacttcttcacgtt

SEQ ID NO: 165302 - DNA, 75 bp, Artificial Sequence
  Synthetic
tcggaacccgagatcacagaacatcgcgatttatttgccgatgtttttcgccgtcctgtgaccgacgcggcttct

SEQ ID NO: 165303 - DNA, 75 bp, Artificial Sequence
  Synthetic
ctctcccgtaagctgttgacgtggttcctcgttctgccggagcaccgtgggtgccggcggtatgacggccagttc

SEQ ID NO: 165304 - DNA, 75 bp, Artificial Sequence
  Synthetic
gctgccgtctgccaggtcgtcatccacacgaaccaccacgcccgcgtccacgtacacctcggccgggacttcttc

SEQ ID NO: 165305 - DNA, 75 bp, Artificial Sequence
  Synthetic
acgtggttctttccacgaaccacgtacgtactcgcgtggccgtctggctcacgacgttgctttcctcccagcggg

SEQ ID NO: 165306 - DNA, 75 bp, Artificial Sequence
  Synthetic
acgacgttgctttcctcccagcgggttctgatttggctagagacctgctgtgtccaaccgtggcaccgtaggcgg

SEQ ID NO: 165307 - DNA, 75 bp, Artificial Sequence
  Synthetic
ccggcaacgacgccgcatggtcagcgtgaccctcttttcgccctactcggtagcctacagccaccaccgacgtca

SEQ ID NO: 165308 - DNA, 75 bp, Artificial Sequence
  Synthetic
accgccgggtcgcggttcgccggtgttgggaccgcttcccgcgggatgtctcagacgcccgcgtccgaaacaccg

SEQ ID NO: 165309 - DNA, 75 bp, Artificial Sequence
  Synthetic
ttgggaccgcttcccgcgggatgtctcagacgcccgcgtccgaaacaccgttggttggagaagcgtattcgcgtc

SEQ ID NO: 165310 - DNA, 75 bp, Artificial Sequence
  Synthetic
gcttccagggacccgacagcatgccgagcactagctacggcagcgacgtcgaagacccgcgggacgatctggccg

SEQ ID NO: 165311 - DNA, 75 bp, Artificial Sequence
  Synthetic
aaaacctacggcatctctgaaagcggtttttcctctttttctacgtgtctgtctcaagatgagacgtcgatatca

SEQ ID NO: 165312 - DNA, 75 bp, Artificial Sequence
  Synthetic
tcactcgcgtcgtgcctgacggtgctttctgcactatgtggtgattcggcacgttctgcgtccgcgtctcgtgca

SEQ ID NO: 165313 - DNA, 75 bp, Artificial Sequence
  Synthetic
tttctgcactatgtggtgattcggcacgttctgcgtccgcgtctcgtgcatcctctgccggctgtgatggtggat

SEQ ID NO: 165314 - DNA, 75 bp, Artificial Sequence
  Synthetic
gcagctcttggtactgccaacgtatcccgtctcgcgacggcagttcgggtgatacggcgtgatgctgtgatgacg

SEQ ID NO: 165315 - DNA, 75 bp, Artificial Sequence
  Synthetic
gttgttcatgtaaacgtgtggcggggtgaggggcggcatgccgttggcggcgccgggaataatgtgccgtcgacc

SEQ ID NO: 165316 - DNA, 75 bp, Artificial Sequence
  Synthetic
gatacggcgtgatgctgtgatgacggcggtctcaacggccgcggggaacgcacatcgtagacgggcaaatgcggg

SEQ ID NO: 165317 - DNA, 75 bp, Artificial Sequence
  Synthetic
taagcaattcagttccgactggcagagtattcaacagaatttggttgttacaacgacagcgtttgtcgtaatctt

SEQ ID NO: 165318 - DNA, 75 bp, Artificial Sequence
  Synthetic
cggtaggagagttcaaagtggtgcaacgagcccgtccgagctcgcagcttctggcgaacaccctccacgtcatcg

SEQ ID NO: 165319 - DNA, 75 bp, Artificial Sequence
  Synthetic
tggaatccggcgtgctgcatggcttggcgcactatggacagctggtacgtcgctccttgtatctcccgtagccac

SEQ ID NO: 165320 - DNA, 75 bp, Artificial Sequence
  Synthetic
ggcgcactatggacagctggtacgtcgctccttgtatctcccgtagccactcgtcctcctcgacaatgtctaagc

SEQ ID NO: 165321 - DNA, 75 bp, Artificial Sequence
  Synthetic
ccacaggtgcgtggccaggggcgagtccgtcgtcaccaatttgacgcagtgcatcaggttctcggtgatggcgtc

SEQ ID NO: 165322 - DNA, 75 bp, Artificial Sequence
  Synthetic
gcaagaagcgaccgcagtgggcccacagcatgctcttggtctttctagggccggtcaacagctttatgaaggaaa

SEQ ID NO: 165323 - DNA, 75 bp, Artificial Sequence
  Synthetic
cagcatgctcttggtctttctagggccggtcaacagctttatgaaggaaatcagggacgtcggctttggaaagcc

SEQ ID NO: 165324 - DNA, 75 bp, Artificial Sequence
  Synthetic
aaacatgatcatggggtcaggggtttttttgggatgttgacaggtgggtgtcttttccagacgcacgatggcctc

SEQ ID NO: 165325 - DNA, 75 bp, Artificial Sequence
  Synthetic
tttttgggatgttgacaggtgggtgtcttttccagacgcacgatggcctcacgccggccgctgaaacggtggttt

SEQ ID NO: 165326 - DNA, 75 bp, Artificial Sequence
  Synthetic
acggagttggcgtttcacagtgatttcatgcaatcatttcctacgcgacttgctcacagatcggtttgggggatg

SEQ ID NO: 165327 - DNA, 75 bp, Artificial Sequence
  Synthetic
tcatgcaatcatttcctacgcgacttgctcacagatcggtttgggggatgagcacgatgccgtgcttgtcatgct

SEQ ID NO: 165328 - DNA, 75 bp, Artificial Sequence
  Synthetic
gggtcgtagccgtagacgacgccgaaagtgtccaccaagacgtactggcgtacgaggaactctttgcgttctggc

SEQ ID NO: 165329 - DNA, 75 bp, Artificial Sequence
  Synthetic
aagtgtccaccaagacgtactggcgtacgaggaactctttgcgttctggcacctcgtggcccagcgcgcccaaca

SEQ ID NO: 165330 - DNA, 75 bp, Artificial Sequence
  Synthetic
gcgcccatcggccgcggcgatctcctagtaacactcgtccgacacttccaccatctccagctcggccggcggttc

SEQ ID NO: 165331 - DNA, 75 bp, Artificial Sequence
  Synthetic
aaacccagagggcgtgtgtagccacgtgttggtgctgtgggcttggttgtaacggtgtttccgctactgtggctt

SEQ ID NO: 165332 - DNA, 75 bp, Artificial Sequence
  Synthetic
aacggtgtttccgctactgtggcttcaaaaccaacgtgatgttctacgtgactgttaggggtggtggattttttg

SEQ ID NO: 165333 - DNA, 75 bp, Artificial Sequence
  Synthetic
ctttgtgttgtggtagttgtcgttctcgcagtcgtagtgggctttttggtggtggtagtggggaatgtaccgttt

SEQ ID NO: 165334 - DNA, 75 bp, Artificial Sequence
  Synthetic
caccgcggtagagcatgacggcgttccagtagtcgtcgtactgcaccatgggccgctggtagtcgcgcatagtgt

SEQ ID NO: 165335 - DNA, 75 bp, Artificial Sequence
  Synthetic
ccagtagtcgtcgtactgcaccatgggccgctggtagtcgcgcatagtgtggaagtggtcgcagtgacgaaagcc

SEQ ID NO: 165336 - DNA, 75 bp, Artificial Sequence
  Synthetic
tgtctaaagtccatcgagaaccatggttatgtcgttggtgaagccaatggtctagtgatgtcatagtacgatagg

SEQ ID NO: 165337 - DNA, 75 bp, Artificial Sequence
  Synthetic
gccgcgctgcccgatgagcacgatgagttggtagcgcataaagcccggaccctcgacgaagccaaaggggtgcag

SEQ ID NO: 165338 - DNA, 75 bp, Artificial Sequence
  Synthetic
tgttaaatgttgttgttgatgtgccagtgaaaatgcataacatgtagccttgcccacctggaccgtatgaccaac

SEQ ID NO: 165339 - DNA, 75 bp, Artificial Sequence
  Synthetic
tgcccacctggaccgtatgaccaacgaacttgatcgcgagggggaagaacatctaccgcgtttaacgtaacgttg

SEQ ID NO: 165340 - DNA, 75 bp, Artificial Sequence
  Synthetic
cgcacgttgaaaacacctggaaagaacgtgcccgagcgaacgtcctctttccaggtgtcttcaacgacgtggggc

SEQ ID NO: 165341 - DNA, 75 bp, Artificial Sequence
  Synthetic
ccaggtgtcttcaacgacgtggggcttaccttgcgaacagacggtgcccatcttgcccacgaagggccccagggc

SEQ ID NO: 165342 - DNA, 75 bp, Artificial Sequence
  Synthetic
aggtaaagtaccttttcgcgatgaaaggtaatgtacctgaacagcattctaccacaggtgatttccacatgttct

SEQ ID NO: 165343 - DNA, 75 bp, Artificial Sequence
  Synthetic
gctgcgcgaacggagctggatgaagcagcgttcgggccaggccacgtgcagccgggtgccgcattcctgctccag

SEQ ID NO: 165344 - DNA, 75 bp, Artificial Sequence
  Synthetic
tatccactcacgttggttggacagctgccgtggttacggttattataatctgcgttctgatttactttaacgttc

SEQ ID NO: 165345 - DNA, 75 bp, Artificial Sequence
  Synthetic
ttttttttaatgtaccaagaataaaaagtgcgtctacgaccaaagcggtgtgtggacgctcgtcctctctgtctt

SEQ ID NO: 165346 - DNA, 75 bp, Artificial Sequence
  Synthetic
aggtaatgtacctgaacagcattctaccacaggtgatttccacatgttctcaggttccgtagggactgtccctat

SEQ ID NO: 165347 - DNA, 75 bp, Artificial Sequence
  Synthetic
acatatccgtccgctcacgataattagtccgtagtgggcaggccatcggttcctttgtaaaggtatcccttggtg

SEQ ID NO: 165348 - DNA, 75 bp, Artificial Sequence
  Synthetic
gaagtcggcgccgccgccgcttggaccttcgtgcgttgtctcgcctatcagcgctccttccccgtgcttacagcc

SEQ ID NO: 165349 - DNA, 75 bp, Artificial Sequence
  Synthetic
gtccatgacggactcctctactttcgctcgccgacgctgcgcttctccagccaccgctgcggtcgacagactcct

SEQ ID NO: 165350 - DNA, 75 bp, Artificial Sequence
  Synthetic
gcgctccttccccgtgcttacagccttcccctgaaacccacgttaaccgaccgtcccgaaaacgccggtgttaac

SEQ ID NO: 165351 - DNA, 75 bp, Artificial Sequence
  Synthetic
ccaccgctgcggtcgacagactcctccgtccgccttcggagaactacggcgcggcggcacggcctttatagacac

SEQ ID NO: 165352 - DNA, 75 bp, Artificial Sequence
  Synthetic
agaatccatgcgctgtgtgcggcatctttggttcgatgtgcctctacgttaccggtaaacgagtccgcaaagcct

SEQ ID NO: 165353 - DNA, 75 bp, Artificial Sequence
  Synthetic
aaccgcgcaggaaccacgcggaacatgggacactatctggaaatcctgttcaacgtcatcgtcttcactctgctg

SEQ ID NO: 165354 - DNA, 75 bp, Artificial Sequence
  Synthetic
caacgtcatcgtcttcactctgctgctcggcgtcatggtcagtatcgtcgcctggtacttcacgtgaaccaccgt

SEQ ID NO: 165355 - DNA, 75 bp, Artificial Sequence
  Synthetic
cggaaatcttcaagcaaatcgcgacgaagtccgataaggaggatgcaaaagaggctgagcaacgcgatgctgccc

SEQ ID NO: 165356 - DNA, 75 bp, Artificial Sequence
  Synthetic
ctttaggtgacgttctccgcgtggatcttttgtgctgcgtatgtttatttggcgtggtttttaatcgcaacaacg

SEQ ID NO: 165357 - DNA, 75 bp, Artificial Sequence
  Synthetic
gcaacagcccgccatcccgcgacgcccccgtggccgcaacccccgtccccgtccccaccaccgtccccggccccg

SEQ ID NO: 165358 - DNA, 75 bp, Artificial Sequence
  Synthetic
gaagtccgataaggaggatgcaaaagaggctgagcaacgcgatgctgcccgccgctacagtacatatgctcaaca

SEQ ID NO: 165359 - DNA, 75 bp, Artificial Sequence
  Synthetic
gtaaaacatgtgggaaactcacagttaccctttggtggacattttcgcctgcaatagtttctgggatctgagacg

SEQ ID NO: 165360 - DNA, 75 bp, Artificial Sequence
  Synthetic
tgcaaaagccctccgtccccgccgcaggagtcccccgccgcaaaagacccccctgcccgcgccgcaaactctccc

SEQ ID NO: 165361 - DNA, 75 bp, Artificial Sequence
  Synthetic
cggtttctccacatgacagataacgtggtccagtacgtccatcctttgcattccggcgtccagacgggaagcgtt

SEQ ID NO: 165362 - DNA, 75 bp, Artificial Sequence
  Synthetic
taccctttggtggacattttcgcctgcaatagtttctgggatctgagacgtttacatgaagaatgcttaatgtgg

SEQ ID NO: 165363 - DNA, 75 bp, Artificial Sequence
  Synthetic
cgcgggcacatgtcttgtagaaagatgtaatcactttccgcgtatgtcgctagggttgacatcacagtggtagtg

SEQ ID NO: 165364 - DNA, 75 bp, Artificial Sequence
  Synthetic
ggtcgtaggtgcagataggatgcgtattttcgccgttgccgatgccgacgcatgactggttataccagtgtactt

SEQ ID NO: 165365 - DNA, 75 bp, Artificial Sequence
  Synthetic
tgtaatcactttccgcgtatgtcgctagggttgacatcacagtggtagtgttttccgaagaagtgacgttgtcag

SEQ ID NO: 165366 - DNA, 75 bp, Artificial Sequence
  Synthetic
attttcgccgttgccgatgccgacgcatgactggttataccagtgtactttttgtcctggatgataaccatgtcc

SEQ ID NO: 165367 - DNA, 75 bp, Artificial Sequence
  Synthetic
acacgtaactacggccggtgaggttaagtgttagttgtcccacggtcacattggtgtcatttgtaaaacacgcga

SEQ ID NO: 165368 - DNA, 75 bp, Artificial Sequence
  Synthetic
tgcggtcacgacggaccatcggaaaagatcatggttcacgatatggttaatcagttgccgcataacacaaacacc

SEQ ID NO: 165369 - DNA, 75 bp, Artificial Sequence
  Synthetic
aagtgttagttgtcccacggtcacattggtgtcatttgtaaaacacgcgatttctccgcgaacttccgtgacgtt

SEQ ID NO: 165370 - DNA, 75 bp, Artificial Sequence
  Synthetic
tgttgtataaccacgtatatgtacgtcattatgtttacggtattcaaacagtgagctgaaaaataaacgtacata

SEQ ID NO: 165371 - DNA, 75 bp, Artificial Sequence
  Synthetic
acgccgccgcgcgtgcttgtgtcccgcaacactccctcagccctgtcccgtgccggaccggcggaacgaaaaata

SEQ ID NO: 165372 - DNA, 75 bp, Artificial Sequence
  Synthetic
tctattctttttacgttttgatttccttggcgttgattctttaagcggcggcgagcataccgctgtatcggtatt

SEQ ID NO: 165373 - DNA, 75 bp, Artificial Sequence
  Synthetic
gacgctatgccattgtctccgtggttgccgaaacgttacgttcagaggcagtttggcttcggctcctgcgcaagg

SEQ ID NO: 165374 - DNA, 75 bp, Artificial Sequence
  Synthetic
tgccgaaacgttacgttcagaggcagtttggcttcggctcctgcgcaaggcccgttatagatttgcgtgtcattg

SEQ ID NO: 165375 - DNA, 75 bp, Artificial Sequence
  Synthetic
ggggaacttgaaacaaattaaaacgatgattgttataacgataactaggggtatgatccacattgtatgtgaagt

SEQ ID NO: 165376 - DNA, 75 bp, Artificial Sequence
  Synthetic
tgactgtgatatttataatgaatcgtgtacagatgtaggtggatacagggatgatgtagttgtatggcaatgtgt

SEQ ID NO: 165377 - DNA, 75 bp, Artificial Sequence
  Synthetic
tgtacagatgtaggtggatacagggatgatgtagttgtatggcaatgtgtttggtgggtaaagtgtacactaacg

SEQ ID NO: 165378 - DNA, 75 bp, Artificial Sequence
  Synthetic
cagcccgtggacgcgacaaaaaaccgcggcactagaaagaaaatgaaacaagtatgtttattaaacagcatgtgg

SEQ ID NO: 165379 - DNA, 75 bp, Artificial Sequence
  Synthetic
tatgttgtggttaagttcatgagaattagtgtacgattatctgtgcactgccacataatatttggagagtctaga

SEQ ID NO: 165380 - DNA, 75 bp, Artificial Sequence
  Synthetic
aaaaaaaaagctgaacatggtcatctagcagcaaagttctccttctagaccacgaccaccatctgtaccacgtcg

SEQ ID NO: 165381 - DNA, 75 bp, Artificial Sequence
  Synthetic
cacgaccaccatctgtaccacgtcgccctccccggccgtgtacatcacatccttcaccacgaccggcggcaacgg

SEQ ID NO: 165382 - DNA, 75 bp, Artificial Sequence
  Synthetic
cattggtttgtctatgtaccattcaaaaacatcgtcttgaaataatgagttattaagcggatgcaagctaatatt

SEQ ID NO: 165383 - DNA, 75 bp, Artificial Sequence
  Synthetic
tattaagcggatgcaagctaatattatgactgccgtatccaactgtaggggtacatggtattgtcatatagttcc

SEQ ID NO: 165384 - DNA, 75 bp, Artificial Sequence
  Synthetic
atgactgccgtatccaactgtaggggtacatggtattgtcatatagttccaatactgggattttgatgtgtaaaa

SEQ ID NO: 165385 - DNA, 75 bp, Artificial Sequence
  Synthetic
ggagagtgccgccggacctgctcgtcagcagcgagctacgcagacggaatatctggaggagagttacgtgtgtca

SEQ ID NO: 165386 - DNA, 75 bp, Artificial Sequence
  Synthetic
tcttccgacacgggcgacggcaggctcggcggcgcggacagcacccgttgcgccggggcgtgagaaggctgagcc

SEQ ID NO: 165387 - DNA, 75 bp, Artificial Sequence
  Synthetic
tgtccgtactgtttactgtctttccagtgatggtagatttttcgaggtgctcgtagacagatgataataaaaatg

SEQ ID NO: 165388 - DNA, 75 bp, Artificial Sequence
  Synthetic
ccggtggcctggatgtgggccaacgaattggctcgcagcgagtcgcgatccacgaaggtcataggaattttccct

SEQ ID NO: 165389 - DNA, 75 bp, Artificial Sequence
  Synthetic
ttgatattgtacttccccagccgggtattctacaggttgtgggatgaccgtagtcgcgttgctgaggttgactgc

SEQ ID NO: 165390 - DNA, 75 bp, Artificial Sequence
  Synthetic
tccgtattcttgtcgcgacgcgcttccagcacctgcttttcgtagtccagctggtggaagaccatcaccaggtcg

SEQ ID NO: 165391 - DNA, 75 bp, Artificial Sequence
  Synthetic
gcactgcttcctaacgttatccagtcactggtatttgtacgcgttgtattggcagtttccgtgagttcataattt

SEQ ID NO: 165392 - DNA, 75 bp, Artificial Sequence
  Synthetic
caaagcgttccaatactccagcacgatggcaccgtgccagaactgcgccatgctgggcgccaggaaaaacaggat

SEQ ID NO: 165393 - DNA, 75 bp, Artificial Sequence
  Synthetic
tgctgggcgccaggaaaaacaggataccggagtcgtaggcgaacacgtcccacttgggtgtcatgaacaacacca

SEQ ID NO: 165394 - DNA, 75 bp, Artificial Sequence
  Synthetic
cattactataactctgatttactacacaacaacttccaccaccccataatacaaacaactatcagaattaaaaac

SEQ ID NO: 165395 - DNA, 75 bp, Artificial Sequence
  Synthetic
acaacaacttccaccaccccataatacaaacaactatcagaattaaaaacacgacaacacctaccaaggccaggt

SEQ ID NO: 165396 - DNA, 75 bp, Artificial Sequence
  Synthetic
ttcctcccaggcctcgatgaccccgaacatgatgagctcctggtccaacggggggcagtgtcgctccagccaact

SEQ ID NO: 165397 - DNA, 75 bp, Artificial Sequence
  Synthetic
acgacaacacctaccaaggccaggtgcgtgttgttttccaaaggtgtctgattggagaatccagcgacggcacgt

SEQ ID NO: 165398 - DNA, 75 bp, Artificial Sequence
  Synthetic
acacgtagagacccgagtcgtgccgcagcctggctccgcgcttcatcagtttcctcaccgcgtagcgaagcgcca

SEQ ID NO: 165399 - DNA, 75 bp, Artificial Sequence
  Synthetic
cagcctggctccgcgcttcatcagtttcctcaccgcgtagcgaagcgccaccttgcccaacgccgacgcctggat

SEQ ID NO: 165400 - DNA, 75 bp, Artificial Sequence
  Synthetic
gttgttacgttactaactggggtagtttccaaagggttgggtttcacggttaagttataccacaggaacgtttca

SEQ ID NO: 165401 - DNA, 75 bp, Artificial Sequence
  Synthetic
cgtggtcgtagtcatcctttctatccttctctatgaatagcagcaatagcggtaaagtcccttcttatactatcc

SEQ ID NO: 165402 - DNA, 75 bp, Artificial Sequence
  Synthetic
tggctagccgcacaacttaggcttaaacccacatagggcgtagagagaccctctccacgtttgtagaagcaaatg

SEQ ID NO: 165403 - DNA, 75 bp, Artificial Sequence
  Synthetic
agtgaagttagacaccagggtaacgttccctccctctggtgcatacacgtagatgacggattccaaaatcacggg

SEQ ID NO: 165404 - DNA, 75 bp, Artificial Sequence
  Synthetic
ctcgttgccgccgttgccacaggaaccggtgcctccgcagggcctttttgagggcctcgcaggcttctcgcgcaa

SEQ ID NO: 165405 - DNA, 75 bp, Artificial Sequence
  Synthetic
ccggtgcctccgcagggcctttttgagggcctcgcaggcttctcgcgcaagtcctgagaggccctcggcgtcgat

SEQ ID NO: 165406 - DNA, 75 bp, Artificial Sequence
  Synthetic
agatgacggattccaaaatcacgggggcaaacaacgtcaaaatcaatagtttattgtacatatgatgcactgtcc

SEQ ID NO: 165407 - DNA, 75 bp, Artificial Sequence
  Synthetic
tttcctcctccgtgtcctcccgctctgtgtcctccgttacgctctcctccccggcctcggccaagagcgcggcca

SEQ ID NO: 165408 - DNA, 75 bp, Artificial Sequence
  Synthetic
ccaggtccacggaccgctcggtctccgagttctcaccgtcaattacgccatgttggcggcgtaaccggtgccgag

SEQ ID NO: 165409 - DNA, 75 bp, Artificial Sequence
  Synthetic
cgagttctcaccgtcaattacgccatgttggcggcgtaaccggtgccgagaacgccgggtgagcgcacatgcttt

SEQ ID NO: 165410 - DNA, 75 bp, Artificial Sequence
  Synthetic
gttcttcatcgtccacgtggcttcgccagcgtcgccaagccgattgaggcaaacccaaatcaacgagcaccatca

SEQ ID NO: 165411 - DNA, 75 bp, Artificial Sequence
  Synthetic
ggccagcaggcccacgctacctaacagattcacgtagactggagacataattaaagaaagaagtgaaacccgcgt

SEQ ID NO: 165412 - DNA, 75 bp, Artificial Sequence
  Synthetic
atgatttttacaaggcgcattgcacatcgcatatgtatgagctctcactgtccagctttgcagcctggtggacta

SEQ ID NO: 165413 - DNA, 75 bp, Artificial Sequence
  Synthetic
agattcacgtagactggagacataattaaagaaagaagtgaaacccgcgtgtgggtctcacgtcgtcttgaaaca

SEQ ID NO: 165414 - DNA, 75 bp, Artificial Sequence
  Synthetic
ttgataactaacgtgttcaaacgcgttcgaatttaccgttagagtcgacgtaatgggtgatacatttgccgtggc

SEQ ID NO: 165415 - DNA, 75 bp, Artificial Sequence
  Synthetic
gcgccgcgcaaaagctgcggagagacgccgcacaaacaccgtagaaacacccgccgccaacccccgagcgcccgc

SEQ ID NO: 165416 - DNA, 75 bp, Artificial Sequence
  Synthetic
agatagtgttatatgtttgtcggtacagttgtcaccttttcgataataagtgccgctatgattttgggaaacgtt

SEQ ID NO: 165417 - DNA, 75 bp, Artificial Sequence
  Synthetic
cagttgtcaccttttcgataataagtgccgctatgattttgggaaacgttgtatataaaaaacgttgtcaaagaa

SEQ ID NO: 165418 - DNA, 75 bp, Artificial Sequence
  Synthetic
tttccgagtacgcgcgtctcggagcacctgacggtgagccacccagctcacgcggataggggacaacactgacgt

SEQ ID NO: 165419 - DNA, 75 bp, Artificial Sequence
  Synthetic
gtgcgtgcgtggggtgggtgtcgggtgtgtcgcgggcgtgtgtcgggtgtgtcgggggtgtgttggcagggtgtg

SEQ ID NO: 165420 - DNA, 75 bp, Artificial Sequence
  Synthetic
tgtgtcgcgggcgtgtgtcgggtgtgtcgggggtgtgttggcagggtgtgtcagggtgtgtcagggtgtgtcgcg

SEQ ID NO: 165421 - DNA, 75 bp, Artificial Sequence
  Synthetic
ctcccattttcgtaacgtccccactgggtcacgttacaacctggtgacaatgtgccgcacaactcagcgttttgt

SEQ ID NO: 165422 - DNA, 75 bp, Artificial Sequence
  Synthetic
cctgctgttctagtcaccgtgctgcagttgagtggcctgtgaattatcacagagctcgtggagcctttaaaagca

SEQ ID NO: 165423 - DNA, 75 bp, Artificial Sequence
  Synthetic
ggcccgcgagccccccccccctcccctcggccggacgcttcttctgcgtctgtcctcgacgcgggttgtgccgta

SEQ ID NO: 165424 - DNA, 75 bp, Artificial Sequence
  Synthetic
ggcgttcgggcaaaagctaacatgttgagtgctacatatgtgcgtgagcgcgtattcaaacagtgagttactaag

SEQ ID NO: 165425 - DNA, 75 bp, Artificial Sequence
  Synthetic
tttaatttgttttaaattcccccagaaagcttggaataaattcacacaataccgatacaacggtatgctcgccgc

SEQ ID NO: 165426 - DNA, 75 bp, Artificial Sequence
  Synthetic
aaagcttggaataaattcacacaataccgatacaacggtatgctcgccgccgcttaaagaatcaacgtcgaggaa

SEQ ID NO: 165427 - DNA, 75 bp, Artificial Sequence
  Synthetic
ccccagggccagaatgcccacagtgtacatggcccaggtctccagaccgaacgtggcgggtcgcagcttcagatg

SEQ ID NO: 165428 - DNA, 75 bp, Artificial Sequence
  Synthetic
cataccccagcccgcccgttcatcttagcatgcattacccgaaaaggtccctcccaccccgtttcagactctccg

SEQ ID NO: 165429 - DNA, 75 bp, Artificial Sequence
  Synthetic
gttgatagcggtatttcagaggacgggcgatgtcccgtagacggtctatgcagaaacgacagatggattgcggca

SEQ ID NO: 165430 - DNA, 75 bp, Artificial Sequence
  Synthetic
gcgccgcacgtcgcttttattcgccgtcgccggcttccgcgaccgccgtccctaccgcaccacaccgcaccgcag

SEQ ID NO: 165431 - DNA, 75 bp, Artificial Sequence
  Synthetic
ttcgtttacgccgcgcacgtgcaccgtctgggccgggcaatcctggtgttgcgcgcgaaaatggtccaggcagga

SEQ ID NO: 165432 - DNA, 75 bp, Artificial Sequence
  Synthetic
gtgacccaggtggtgtggaaaatcaggcctccgtagaactgcttagtgatgatgagacgactccacggaacgagc

SEQ ID NO: 165433 - DNA, 75 bp, Artificial Sequence
  Synthetic
tgttaacggcaagatgatgcgagaacgcgacggcggtgttgttggaggtctggcggcaacagtacacgtcgagcg

SEQ ID NO: 165434 - DNA, 75 bp, Artificial Sequence
  Synthetic
tggcggcaacagtacacgtcgagcgtcatgagggccatgtcgccttggtggtacacggcgtacgcccaaccctgg

SEQ ID NO: 165435 - DNA, 75 bp, Artificial Sequence
  Synthetic
ccggaggtgaatgctgcttcgtcccttgatatagccttgttactctccgcctcggtgatgtcgtaacagcaggac

SEQ ID NO: 165436 - DNA, 75 bp, Artificial Sequence
  Synthetic
ttgatatagccttgttactctccgcctcggtgatgtcgtaacagcaggactcgaacgtggcacaatcatggagac

SEQ ID NO: 165437 - DNA, 75 bp, Artificial Sequence
  Synthetic
tgttcattctgccgactgttgctcacgagcgttcggaggcggtgccacaggctgttggccattaaaaagtcctgg

SEQ ID NO: 165438 - DNA, 75 bp, Artificial Sequence
  Synthetic
ctacacagtcagagtagcctagaaacatgttagcgccgtaaggacgcttaacatttcaaaagcaacgtaaacaca

SEQ ID NO: 165439 - DNA, 75 bp, Artificial Sequence
  Synthetic
cgtagctgtagctggcttcgcaattcacagtatacaggtgcccctctttctgcgtcgtggctgccacggaggtag

SEQ ID NO: 165440 - DNA, 75 bp, Artificial Sequence
  Synthetic
gaaataatactttccgctgttttccgtcgtcagattcagcaacgtcaggcggtcataggtacagttatacgtgag

SEQ ID NO: 165441 - DNA, 75 bp, Artificial Sequence
  Synthetic
gtccgactcggtacccaggaggtggtaagtcttttgccgcacgtagaaagctttcaacgtggagcaaaaaatgag

SEQ ID NO: 165442 - DNA, 75 bp, Artificial Sequence
  Synthetic
aaatcttccgttttgttctgaagacctcgaaatgtaacgttgccgttgacggtccctgagtaattagcgcaagta

SEQ ID NO: 165443 - DNA, 75 bp, Artificial Sequence
  Synthetic
ggtccctgagtaattagcgcaagtaatattcataggaatctgacggtcgggagacttccattccacgggagcagt

SEQ ID NO: 165444 - DNA, 75 bp, Artificial Sequence
  Synthetic
gcagtaccatcggtaataatatccacgttctaagcatcataacgatactctttcagtctcacaatcaaaatattg

SEQ ID NO: 165445 - DNA, 75 bp, Artificial Sequence
  Synthetic
gtggaattgtcccggttaatcaccacggtgaacaccacggccaagaaaatgatccctaatatagcgaccactaag

SEQ ID NO: 165446 - DNA, 75 bp, Artificial Sequence
  Synthetic
gatccctaatatagcgaccactaagagagcaaaagtccatttccagccgttgtcaaagtacgcccccgtggtggg

SEQ ID NO: 165447 - DNA, 75 bp, Artificial Sequence
  Synthetic
tccggacaacggtgttttatggacttatcgcttaaggcgggatgtatttgcaaatcagtagagacgacagtttct

SEQ ID NO: 165448 - DNA, 75 bp, Artificial Sequence
  Synthetic
gcgatattcattaaatgcattacgtgcctgtattggtacatttgcaaacgtccgggtgcagtggtataacttggc

SEQ ID NO: 165449 - DNA, 75 bp, Artificial Sequence
  Synthetic
gcgacggcgaactaaccaggcagtacgggggtcgatagggcggtgggctgcagtcgggtggtggcggcggtggcg

SEQ ID NO: 165450 - DNA, 75 bp, Artificial Sequence
  Synthetic
gtactgcatgttccacatgtacgcgctagacgtgtaatctactcgcaattcggggacgcaacgcagccagatcac

SEQ ID NO: 165451 - DNA, 75 bp, Artificial Sequence
  Synthetic
gagacatacacgagttgctaggcacggatgcatgtgtatgttggccaagggatatgcgtacaacgacgaaaaagt

SEQ ID NO: 165452 - DNA, 75 bp, Artificial Sequence
  Synthetic
attgtcccttgagaattcctcactatcccccgagccggaacagaacaattccaaaccggatacgctacataccag

SEQ ID NO: 165453 - DNA, 75 bp, Artificial Sequence
  Synthetic
ccgcggctcaccttcgagcaaagagccccttctttttgcgcaaacgacggcaaaacagttctctgggacagccgg

SEQ ID NO: 165454 - DNA, 75 bp, Artificial Sequence
  Synthetic
ccccttctttttgcgcaaacgacggcaaaacagttctctgggacagccggtggcgcggtaagcgggtgccacgct

SEQ ID NO: 165455 - DNA, 75 bp, Artificial Sequence
  Synthetic
tcgttcggcagcctacccgcctcgcacgctcagtacggctttcgactgctacgcggcatatttttgatcatgctt

SEQ ID NO: 165456 - DNA, 75 bp, Artificial Sequence
  Synthetic
caggagtccgcgcgccagaaagtgcgcctgccgcgtctcgggatgcacgccgaagacggcgccgctctcgttcac

SEQ ID NO: 165457 - DNA, 75 bp, Artificial Sequence
  Synthetic
gcctgccgcgtctcgggatgcacgccgaagacggcgccgctctcgttcaccagtatggagatgtccaggcgctgc

SEQ ID NO: 165458 - DNA, 75 bp, Artificial Sequence
  Synthetic
tatgataacatgtcactaagaacctgtactttatttcaattacgttatcatagactgtaccgtcctggggtacgg

SEQ ID NO: 165459 - DNA, 75 bp, Artificial Sequence
  Synthetic
gtactttatttcaattacgttatcatagactgtaccgtcctggggtacggtatgtgtcacgcgtctttctatgca

SEQ ID NO: 165460 - DNA, 75 bp, Artificial Sequence
  Synthetic
ccgtgggccggatcctcgtaagtctggctcccgttcaagacgaccgtcgtcagcgcctcattaccgtctcgccag

SEQ ID NO: 165461 - DNA, 75 bp, Artificial Sequence
  Synthetic
ggctcccgttcaagacgaccgtcgtcagcgcctcattaccgtctcgccagctgaagatggaaccctcgcgcttca

SEQ ID NO: 165462 - DNA, 75 bp, Artificial Sequence
  Synthetic
ggacatagcccagttcttcgcgcagcggcgcgtagttgcgcaggccctcctgcacgaagccgcggaaaccggacc

SEQ ID NO: 165463 - DNA, 75 bp, Artificial Sequence
  Synthetic
ccctaaataaattagcgttggtactttgtgatcacattgtgtggttgacgttgtttctagttcgtagtctgtgct

SEQ ID NO: 165464 - DNA, 75 bp, Artificial Sequence
  Synthetic
ttgtgatcacattgtgtggttgacgttgtttctagttcgtagtctgtgcttcagggttgttgtaacgttaacgta

SEQ ID NO: 165465 - DNA, 75 bp, Artificial Sequence
  Synthetic
gcggtgggcggccgatggcttcgcaacgactcacagtgcccaccggcagcaggaacttgtcgcagcacaggaagg

SEQ ID NO: 165466 - DNA, 75 bp, Artificial Sequence
  Synthetic
aggaacttgtcgcagcacaggaaggtcttctccaaacctttaatattgagatgtccaaagtagccgacgcgtaac

SEQ ID NO: 165467 - DNA, 75 bp, Artificial Sequence
  Synthetic
tcttctccaaacctttaatattgagatgtccaaagtagccgacgcgtaacaggtcgcagtaggtgaagaaccaac

SEQ ID NO: 165468 - DNA, 75 bp, Artificial Sequence
  Synthetic
agaataacgtgaagacgagacagtaataatatagtgagttctatttatagtggtgttacagttgtcaaagtcctc

SEQ ID NO: 165469 - DNA, 75 bp, Artificial Sequence
  Synthetic
ataatatagtgagttctatttatagtggtgttacagttgtcaaagtcctctacgttatgtttatgatcatcgctg

SEQ ID NO: 165470 - DNA, 75 bp, Artificial Sequence
  Synthetic
aggtgacagagcagcggaaggtctcgttgaccagctcgacagccagcgcgtcctccagcgtgcgttccttcatct

SEQ ID NO: 165471 - DNA, 75 bp, Artificial Sequence
  Synthetic
ttcagacctttagtatcgtgaagacaggtaaatcgtgggtgacacgacttgttttcggaatattcagcatattcc

SEQ ID NO: 165472 - DNA, 75 bp, Artificial Sequence
  Synthetic
aggtaaatcgtgggtgacacgacttgttttcggaatattcagcatattccgagtaaaatggtgtccaaccgcaaa

SEQ ID NO: 165473 - DNA, 75 bp, Artificial Sequence
  Synthetic
ccggatttcgtcgaaacgggccgcggaggcggcgaccgacgcggaggtcgtctgaacgccctctgtgacgctgtc

SEQ ID NO: 165474 - DNA, 75 bp, Artificial Sequence
  Synthetic
cttcggctactgtgatgggtatttgtacatgtccactttgcagcaagagctgctggtaggatgttttttgtttat

SEQ ID NO: 165475 - DNA, 75 bp, Artificial Sequence
  Synthetic
tacatgtccactttgcagcaagagctgctggtaggatgttttttgtttatgtggaattgcctgtaccagaatgct

SEQ ID NO: 165476 - DNA, 75 bp, Artificial Sequence
  Synthetic
gacggtggctggtctgctggggcgggtacggccgcgggtgtccgcggacacgttagttatacacggaattgagtc

SEQ ID NO: 165477 - DNA, 75 bp, Artificial Sequence
  Synthetic
ctatggatatcccgacttataagtggttaactcagaataaacacacccaaacattaatgactaaagataaaaaag

SEQ ID NO: 165478 - DNA, 75 bp, Artificial Sequence
  Synthetic
gttaactcagaataaacacacccaaacattaatgactaaagataaaaaagtttattgatgtgcatattaggtttt

SEQ ID NO: 165479 - DNA, 75 bp, Artificial Sequence
  Synthetic
ttagggacgaactcgaacgttacagaatcctcgctgtcgctctcctctttcgcgtcgttgaagtaattgccggag

SEQ ID NO: 165480 - DNA, 75 bp, Artificial Sequence
  Synthetic
cgcgtcgttgaagtaattgccggagttgcgatccaaaccgccgcctcctcctcctccgccgccgcccgatccacc

SEQ ID NO: 165481 - DNA, 75 bp, Artificial Sequence
  Synthetic
atatagcgctatgagtgccaccgatactactatacccgcccatacagcgtgaattcccagaggaatgttggcttt

SEQ ID NO: 165482 - DNA, 75 bp, Artificial Sequence
  Synthetic
actactatacccgcccatacagcgtgaattcccagaggaatgttggctttcttaatagtttcaataatatgtttc

SEQ ID NO: 165483 - DNA, 75 bp, Artificial Sequence
  Synthetic
gccgccaccgctgctcattttccgcgtaccggaaccaccgccgccaccgcggtcgtgcttcttgccgccaccgcc

SEQ ID NO: 165484 - DNA, 75 bp, Artificial Sequence
  Synthetic
gtacatatgctcaacaacgcccagtgtcccaacgcgcgacttttggctcggaggagagccgaacggcggtttttc

SEQ ID NO: 165485 - DNA, 75 bp, Artificial Sequence
  Synthetic
gccacctcctcccagaccgccgagacccatgggctcgttcatgagatcgttatccagacccgggccgtcgtcgtg

SEQ ID NO: 165486 - DNA, 75 bp, Artificial Sequence
  Synthetic
gtgttggcaaaaatcaccgtgaggctgtagcatgcttcttcgtattgtcatggcgcgttctcttgacaacgtact

SEQ ID NO: 165487 - DNA, 75 bp, Artificial Sequence
  Synthetic
tgtagcatgcttcttcgtattgtcatggcgcgttctcttgacaacgtactttccagaatcgtttaacgtcagatc

SEQ ID NO: 165488 - DNA, 75 bp, Artificial Sequence
  Synthetic
gacgtaatttttatcgaagggatcgccacgctggaaaggttcctcggtgagaaaattctccacggcgaacagacc

SEQ ID NO: 165489 - DNA, 75 bp, Artificial Sequence
  Synthetic
aacggtgcatattggttccgaggaataaagccagcctggagaaccgtaccggaaccattgaatgtaattccatga

SEQ ID NO: 165490 - DNA, 75 bp, Artificial Sequence
  Synthetic
taaagccagcctggagaaccgtaccggaaccattgaatgtaattccatgatccagtgaagtttagagtcacttct

SEQ ID NO: 165491 - DNA, 75 bp, Artificial Sequence
  Synthetic
acgtgcacggcagtttggtgacggcgcaattgagcagcgtctggtagaagttcttcagctgcacgttgatacgca

SEQ ID NO: 165492 - DNA, 75 bp, Artificial Sequence
  Synthetic
ttggtttgagatattatggttgacgacgctgcagtagaaacgactttgccagtcgttactaacgagggtgtagtg

SEQ ID NO: 165493 - DNA, 75 bp, Artificial Sequence
  Synthetic
acgctgcagtagaaacgactttgccagtcgttactaacgagggtgtagtggtagcaatacttgacgttgtttttt

SEQ ID NO: 165494 - DNA, 75 bp, Artificial Sequence
  Synthetic
tgatggccggcggaccggcgtgcaccagaatctgcacggtgcccgtagggcagggcgcttttttaacgttacgct

SEQ ID NO: 165495 - DNA, 75 bp, Artificial Sequence
  Synthetic
cagaatctgcacggtgcccgtagggcagggcgcttttttaacgttacgcttgacgcgggtatgcggcccgatcca

SEQ ID NO: 165496 - DNA, 75 bp, Artificial Sequence
  Synthetic
tgacacaaatgcaggggcacggacaagtttggttgtaacattccgaaaacgttaatatgattaccgtccatgtaa

SEQ ID NO: 165497 - DNA, 75 bp, Artificial Sequence
  Synthetic
agtttggttgtaacattccgaaaacgttaatatgattaccgtccatgtaatcgcaagatgccagtgcatggtacc

SEQ ID NO: 165498 - DNA, 75 bp, Artificial Sequence
  Synthetic
ttggccgtgcacgcaggccgagctgaactccatattgaaatcgggcgcgcacatggagatcttggccgaaaggtc

SEQ ID NO: 165499 - DNA, 75 bp, Artificial Sequence
  Synthetic
aactccatattgaaatcgggcgcgcacatggagatcttggccgaaaggtccgagatgtcctgcacgtagaacttg

SEQ ID NO: 165500 - DNA, 75 bp, Artificial Sequence
  Synthetic
gtgtccggaaacgtcagtcttcatgttcaggatgatatcgtacaacaaagctagattcactaatatcgtcccgta

SEQ ID NO: 165501 - DNA, 75 bp, Artificial Sequence
  Synthetic
ttcaggatgatatcgtacaacaaagctagattcactaatatcgtcccgtaatggacggtatcttttattgagggc

SEQ ID NO: 165502 - DNA, 75 bp, Artificial Sequence
  Synthetic
aacgacttgtcagtgatgtagaggcatgagctgttaaaagtgatttttgacacgcagtgactgcgtaccgtttgc

SEQ ID NO: 165503 - DNA, 75 bp, Artificial Sequence
  Synthetic
atgagctgttaaaagtgatttttgacacgcagtgactgcgtaccgtttgcaagataagcgacggcgtgggcaaga

SEQ ID NO: 165504 - DNA, 75 bp, Artificial Sequence
  Synthetic
gatgtcacggtgacttgttttgcgcatgttattatttgtgatagtgcttagtgtataatcgtcgtcttcgtcttc

SEQ ID NO: 165505 - DNA, 75 bp, Artificial Sequence
  Synthetic
atgttattatttgtgatagtgcttagtgtataatcgtcgtcttcgtcttcttctgattgtgttcctacgtatctg

SEQ ID NO: 165506 - DNA, 75 bp, Artificial Sequence
  Synthetic
gccgcagcgccagcgtcggcggctccgagaggcgcgtcttgcgatccatcccggacagcgtgcaagtctcgacta

SEQ ID NO: 165507 - DNA, 75 bp, Artificial Sequence
  Synthetic
cgagaggcgcgtcttgcgatccatcccggacagcgtgcaagtctcgactaaggagcgggcgcgagcgagcgaaag

SEQ ID NO: 165508 - DNA, 75 bp, Artificial Sequence
  Synthetic
ggtccatcgtggttgtactctttgtaacaccgtcgactatatctgcctgaatttgtagtgtttaaatcgtatata

SEQ ID NO: 165509 - DNA, 75 bp, Artificial Sequence
  Synthetic
aacaccgtcgactatatctgcctgaatttgtagtgtttaaatcgtatatacgtagttctgtcttattacacgaac

SEQ ID NO: 165510 - DNA, 75 bp, Artificial Sequence
  Synthetic
cagcgggcccccgactaagaggcacagtacttatatactccgaccttaaagcgccagtggtaccacttgagcatc

SEQ ID NO: 165511 - DNA, 75 bp, Artificial Sequence
  Synthetic
gatacgttggcgtttggtaacgtctattgggataaatgtggtgtccatgtgtagaccaattgtaatgtcggtacc

SEQ ID NO: 165512 - DNA, 75 bp, Artificial Sequence
  Synthetic
ggccacgcactggtccacaaacacgctcaggttcacagccgccatttccacgtcgttttggatcgccggcgccgc

SEQ ID NO: 165513 - DNA, 75 bp, Artificial Sequence
  Synthetic
attgggataaatgtggtgtccatgtgtagaccaattgtaatgtcggtaccaaactacattggggcagttccatgt

SEQ ID NO: 165514 - DNA, 75 bp, Artificial Sequence
  Synthetic
caacggcctccgcaccacggtggggaagtaacactcacggttgggcgggcacaatgaccacaccgtctcctcctc

SEQ ID NO: 165515 - DNA, 75 bp, Artificial Sequence
  Synthetic
atcttgttggcaattttttgaacttgaattgtttgtttcattagctgcgacagtacaattaacagcaatcgatgt

SEQ ID NO: 165516 - DNA, 75 bp, Artificial Sequence
  Synthetic
gaattgtttgtttcattagctgcgacagtacaattaacagcaatcgatgttacaggactgtacgtagtgttatga

SEQ ID NO: 165517 - DNA, 75 bp, Artificial Sequence
  Synthetic
acacaccctgacacaccctgccaacacacccccgacacacccgacacacgcccgcgacacacccggcacacaccc

SEQ ID NO: 165518 - DNA, 75 bp, Artificial Sequence
  Synthetic
actgacggcgtcacgccccacagatgcgccacctcgtcgtcgggacccaccgccagaaactgacagttgcgcaat

SEQ ID NO: 165519 - DNA, 75 bp, Artificial Sequence
  Synthetic
ccgaactcgagcatgtcggcgcgcagcgcttcccagcgcgcgctggcgatggagagccgcggcaaccgatacaat

SEQ ID NO: 165520 - DNA, 75 bp, Artificial Sequence
  Synthetic
cgcacgtcgcaaagaagacgcgtgtctgtgtctgtgtgattccccggggaaaagaggaagttcccaggggacggc

SEQ ID NO: 165521 - DNA, 75 bp, Artificial Sequence
  Synthetic
gttgcgttgttggagagtattggggaatttgtgtgggtactggagagagcagtaagagttgaagctgtataagac

SEQ ID NO: 165522 - DNA, 75 bp, Artificial Sequence
  Synthetic
aatttgtgtgggtactggagagagcagtaagagttgaagctgtataagacgtagtgttagtcgaggtgtttaacg

SEQ ID NO: 165523 - DNA, 75 bp, Artificial Sequence
  Synthetic
gcgtggcaaacccgacttgcacaaatcgacgctagcgcgcaccgcggcaaagtacatgtgctcaaagatgcgctc

SEQ ID NO: 165524 - DNA, 75 bp, Artificial Sequence
  Synthetic
tagatgtatcaagagttgtaaaaaatgtactgggaagatttggagtagagtacacactagtatcagagacggtgc

SEQ ID NO: 165525 - DNA, 75 bp, Artificial Sequence
  Synthetic
tatctgaagtagacgtagaattattggtatcagtgctgttacatttgcccctatatacaatgtagaaggtcagga

SEQ ID NO: 165526 - DNA, 75 bp, Artificial Sequence
  Synthetic
cagcggacgcagtttttccagcgcgctctctacccaccattcggacgccgacattagcgcgtccaagcgcgcgtt

SEQ ID NO: 165527 - DNA, 75 bp, Artificial Sequence
  Synthetic
ctctctacccaccattcggacgccgacattagcgcgtccaagcgcgcgttgccccaaaccaccgcctcggtcacc

SEQ ID NO: 165528 - DNA, 75 bp, Artificial Sequence
  Synthetic
cgtccaccgtcaacaacagaggttccgtatccaggtccgtccgcagctgttcagcgtcctgttccccgattcgtt

SEQ ID NO: 165529 - DNA, 75 bp, Artificial Sequence
  Synthetic
tcgtcgctacgcgcaaacacgcagcgagccacgttcaccgtcagccgctgcaccggcatgtcacactcgccaaag

SEQ ID NO: 165530 - DNA, 75 bp, Artificial Sequence
  Synthetic
tggcacgacgccatatcgggactcaagcacggcggcaggcacacgctgtcggccataatcgagtacttgactacg

SEQ ID NO: 165531 - DNA, 75 bp, Artificial Sequence
  Synthetic
tgcggcgtgtttcgtccggcgctttgtgcgtttcggcagtgcggcacgcggtctccgtcgtttcgccagtacgac

SEQ ID NO: 165532 - DNA, 75 bp, Artificial Sequence
  Synthetic
ctggtcccggataaaagcatcgacgcgtttccaaagctcggcagaagctgcgtgggtggatgatgaggtagaaag

SEQ ID NO: 165533 - DNA, 75 bp, Artificial Sequence
  Synthetic
acgaccaccttggggcacgattgctcgcagcgcgaatactctttctcgaaagccgactcctgacccaggtccgag

SEQ ID NO: 165534 - DNA, 75 bp, Artificial Sequence
  Synthetic
cgcagcgcgaatactctttctcgaaagccgactcctgacccaggtccgagagccgccgggagacaggccgcccga

SEQ ID NO: 165535 - DNA, 75 bp, Artificial Sequence
  Synthetic
ccgtcaactccgacgtgctttctttgagaataaagttgatcacgcggatagcggccacgtcccacatgtccacaa

SEQ ID NO: 165536 - DNA, 75 bp, Artificial Sequence
  Synthetic
gctgtagatatcataacgttgccagactacgctgtgatggctagtgttaagcctggtaaccagagtacgtgtacg

SEQ ID NO: 165537 - DNA, 75 bp, Artificial Sequence
  Synthetic
tatccccccagacaacgaatcacgctgttcacatcggcgttaagtcgcgttacgttcaccgacacagaaacgccg

SEQ ID NO: 165538 - DNA, 75 bp, Artificial Sequence
  Synthetic
cgaaaaagggtcggccgagatcagaaagtcgtactgcggcacgcgatcgaaacccacggtagacatggtgaaggt

SEQ ID NO: 165539 - DNA, 75 bp, Artificial Sequence
  Synthetic
cagcgcttcaacaccgattccaacacctcgccctcgaaacgcgcatccagatggaaacgatagatgcgtgagtgc

SEQ ID NO: 165540 - DNA, 75 bp, Artificial Sequence
  Synthetic
tgcagttggcgacacaccttatccaaacacaaaatggccgcgtacaagccccagcaaccggccaattccacaaaa

SEQ ID NO: 165541 - DNA, 75 bp, Artificial Sequence
  Synthetic
ccagcaaccggccaattccacaaaacgcgccgtctcttcggccagcttgggtagatcctccatgtgacgcagcac

SEQ ID NO: 165542 - DNA, 75 bp, Artificial Sequence
  Synthetic
tgcggctttcgcgcgcccagttggctttgaaataaaagcgacccaacagcagatcgcaacgcggcgagtgacgaa

SEQ ID NO: 165543 - DNA, 75 bp, Artificial Sequence
  Synthetic
ggctcctgtacgccacaaaagcgaaacttgccccaatagccgtgacaatgacactttttgcccatcaacatgcgc

SEQ ID NO: 165544 - DNA, 75 bp, Artificial Sequence
  Synthetic
gtagcctgtatcggcggcgacactttgcagagcgaagccccgaaatcgtcctcctcctcgacactgtccagctcc

SEQ ID NO: 165545 - DNA, 75 bp, Artificial Sequence
  Synthetic
gtccccaggaggacggccgcgcgcggcgccactcgtccctggggaccgcgggagaaataacggccgcgaggtacg

SEQ ID NO: 165546 - DNA, 75 bp, Artificial Sequence
  Synthetic
ggggggggggggctcgcgggcccccggggcacacactcgttcctgcgaagccgcacaccccgaagccgcgcacac

SEQ ID NO: 165547 - DNA, 75 bp, Artificial Sequence
  Synthetic
ccgctatcacgcgtcaacgacagcacagacggcgtgccgtcgggagacggcgactcgggacgccaactgacgacg

SEQ ID NO: 165548 - DNA, 75 bp, Artificial Sequence
  Synthetic
ccattccgggccgtgtgttgggtccccgaggggcgggggggtgtttttcgcgggggggtgaaatttggagccgcg

SEQ ID NO: 165549 - DNA, 75 bp, Artificial Sequence
  Synthetic
tattcttccgatgacgacggagaccgggacggcgatgaggaaactggagagagccacaacagaaacagcgtggga

SEQ ID NO: 165550 - DNA, 75 bp, Artificial Sequence
  Synthetic
ggcgtgcgacctgtaaaccgttactcgggtctcaagatggtttggaagttgtgactcatcttcctgtgggtgata

SEQ ID NO: 165551 - DNA, 75 bp, Artificial Sequence
  Synthetic
gccgctcagacgaattctcgaaagtctcccaattcgacgctaaagttgtccaaacggacgacggacagtttgagt

SEQ ID NO: 165552 - DNA, 75 bp, Artificial Sequence
  Synthetic
ctcccaattcgacgctaaagttgtccaaacggacgacggacagtttgagttctttgtgtaccaggaacgaggtgt

SEQ ID NO: 165553 - DNA, 75 bp, Artificial Sequence
  Synthetic
tgcgacggttgacaaagctacagcgctcgcgggcgaactttccgcgtgcaacgtcgaccagggtctgccaatgtg

SEQ ID NO: 165554 - DNA, 75 bp, Artificial Sequence
  Synthetic
acgtcgaccagggtctgccaatgtgcgatgctggaggtgagcacgtagatgccgggacgtgtttcgggcccgtca

SEQ ID NO: 165555 - DNA, 75 bp, Artificial Sequence
  Synthetic
ttcccacgtcaggtacatgtctttcggtatcatcaacgcgaacacctccgttttgagcgtgttgtaaaggtagcc

SEQ ID NO: 165556 - DNA, 75 bp, Artificial Sequence
  Synthetic
ggtatcatcaacgcgaacacctccgttttgagcgtgttgtaaaggtagccgcgcatgacgcaggtgagcaacgag

SEQ ID NO: 165557 - DNA, 75 bp, Artificial Sequence
  Synthetic
tttgttcgcggcacggcgctggggaatttgtgcgcgctgagggatctctctacgggtgtgtccacgggatttgtt

SEQ ID NO: 165558 - DNA, 75 bp, Artificial Sequence
  Synthetic
tatcggagaagttgccgcgcacaagccaggcggccacgagtaccccgtgctggacgtaacattcggacacggaac

SEQ ID NO: 165559 - DNA, 75 bp, Artificial Sequence
  Synthetic
agccactgcagcgcggcgcgcgcggccgaggccgtgtacacgctttcgagcaggcagcgcgtgctggccgagacg

SEQ ID NO: 165560 - DNA, 75 bp, Artificial Sequence
  Synthetic
ccgaggccgtgtacacgctttcgagcaggcagcgcgtgctggccgagacgttggaggcgcgaatgcctaacaggt

SEQ ID NO: 165561 - DNA, 75 bp, Artificial Sequence
  Synthetic
acggggtgttgcggggacggggattacgttgggaacggcggtggcgggggtgtttgcggcaaggacggggtgttt

SEQ ID NO: 165562 - DNA, 75 bp, Artificial Sequence
  Synthetic
cgaactctaccaggccctcgggcacgaagaaacgcgccgtgagcgcctggtgatcggcgtggtagaggtagcgca

SEQ ID NO: 165563 - DNA, 75 bp, Artificial Sequence
  Synthetic
gaagaaacgcgccgtgagcgcctggtgatcggcgtggtagaggtagcgcaccgatatagtatttacctcgcgttt

SEQ ID NO: 165564 - DNA, 75 bp, Artificial Sequence
  Synthetic
catgatggcaaggcgcacggtagatttcaaaaagttgatagagcagctgcgggcacgggccacggacaaagcgga

SEQ ID NO: 165565 - DNA, 75 bp, Artificial Sequence
  Synthetic
ttcaaaaagttgatagagcagctgcgggcacgggccacggacaaagcggaggcgttaaataccgtgagccaattg

SEQ ID NO: 165566 - DNA, 75 bp, Artificial Sequence
  Synthetic
cagaggcggtaacggctccgtctccaccaagggcggaggttcatcgaaaagagtcaaggataattcaggcatact

SEQ ID NO: 165567 - DNA, 75 bp, Artificial Sequence
  Synthetic
ggttaccactttggcttcgtgcgtcagaacgtggtcttttacctcctaagccacgccacggtacagacggcgcgc

SEQ ID NO: 165568 - DNA, 75 bp, Artificial Sequence
  Synthetic
agaacgtggtcttttacctcctaagccacgccacggtacagacggcgcgcgacccgctgtacgccgccgagcagt

SEQ ID NO: 165569 - DNA, 75 bp, Artificial Sequence
  Synthetic
acccgggtgggttgttcggaaacggcgggatgggaaacggttgtaaacagcgtcgcagtatacgtgacttttgat

SEQ ID NO: 165570 - DNA, 75 bp, Artificial Sequence
  Synthetic
acaacggggccacgctgacggctttccagaagctgttgcagaccttgcgcgagatccagaccgtaatagccgaac

SEQ ID NO: 165571 - DNA, 75 bp, Artificial Sequence
  Synthetic
ccagaagctgttgcagaccttgcgcgagatccagaccgtaatagccgaacagagcggcggcaccgcggcggcggc

SEQ ID NO: 165572 - DNA, 75 bp, Artificial Sequence
  Synthetic
tataacgggaaagaaccagtttggcagcattccattgtggggggggggtacttatagcgtgtataattttgacgt

SEQ ID NO: 165573 - DNA, 75 bp, Artificial Sequence
  Synthetic
gccgctggttcgccgggtgatcacgcagctggaaacggctgccacggaggcgcggccctacgtcaattgtcgcgc

SEQ ID NO: 165574 - DNA, 75 bp, Artificial Sequence
  Synthetic
cagctggaaacggctgccacggaggcgcggccctacgtcaattgtcgcgccgtggccgaactcctggacctgacc

SEQ ID NO: 165575 - DNA, 75 bp, Artificial Sequence
  Synthetic
aaacggtttggtcgttttttgatggtaaaaatgataccgacgtgtgtagtgtggaggggacgaagaattacacgc

SEQ ID NO: 165576 - DNA, 75 bp, Artificial Sequence
  Synthetic
taaaaatgataccgacgtgtgtagtgtggaggggacgaagaattacacgctagcaacgccgccgattcacggtgt

SEQ ID NO: 165577 - DNA, 75 bp, Artificial Sequence
  Synthetic
gacacggtgcttctgatgcattttttttacacacactaccgttcggttaacggcgatttggccgtggagtttcaa

SEQ ID NO: 165578 - DNA, 75 bp, Artificial Sequence
  Synthetic
tttacacacactaccgttcggttaacggcgatttggccgtggagtttcaaaactacgtcaagaacagcgtgcggc

SEQ ID NO: 165579 - DNA, 75 bp, Artificial Sequence
  Synthetic
gagagttgataacggtcctgaacaagtggatacttggtttcttattgtaactaagtaacgttgataattcaataa

SEQ ID NO: 165580 - DNA, 75 bp, Artificial Sequence
  Synthetic
gtggatacttggtttcttattgtaactaagtaacgttgataattcaataaataaacgtcagtgcttttgtgttgc

SEQ ID NO: 165581 - DNA, 75 bp, Artificial Sequence
  Synthetic
acaagctgttcgtgggtaatctgcaggcgcgtgacgccagcggcctcatgtttcccatcattagcacgcgcatct

SEQ ID NO: 165582 - DNA, 75 bp, Artificial Sequence
  Synthetic
ggcgcgtgacgccagcggcctcatgtttcccatcattagcacgcgcatctccaccgtgaacctttacctgtcgcc

SEQ ID NO: 165583 - DNA, 75 bp, Artificial Sequence
  Synthetic
acctggactggtacatacgcagggttgcacgtggttatcggtcactggactcggttttgctgtagctgtggttca

SEQ ID NO: 165584 - DNA, 75 bp, Artificial Sequence
  Synthetic
cgcttacgcgcgcgtgtgcgatcgcgtgctggaagaccacttgcatacgccgcgacgcgtgcagcgactactgga

SEQ ID NO: 165585 - DNA, 75 bp, Artificial Sequence
  Synthetic
gtggaactgggtttcaatcacgatacctgcgcggcctacgcacaaatggcgctgatccagccggccagtcagaag

SEQ ID NO: 165586 - DNA, 75 bp, Artificial Sequence
  Synthetic
tgcttaatattggggtttaatgatggaatccagggtatggatatgaagaaactgaataccacgcagggtggaaat

SEQ ID NO: 165587 - DNA, 75 bp, Artificial Sequence
  Synthetic
gaatccagggtatggatatgaagaaactgaataccacgcagggtggaaatcttactatagttgatgatagcggcc

SEQ ID NO: 165588 - DNA, 75 bp, Artificial Sequence
  Synthetic
gcgagaaactcatacagatcatctacaatttttacacgtttttcatgtgcctctatgtgtacagccccacgttcc

SEQ ID NO: 165589 - DNA, 75 bp, Artificial Sequence
  Synthetic
caatttttacacgtttttcatgtgcctctatgtgtacagccccacgttcctgttcgaccaccggcggcggttgat

SEQ ID NO: 165590 - DNA, 75 bp, Artificial Sequence
  Synthetic
cgtcaatacgcactttgcggttcagtacacggaagaagactttgaggcacatacgaagggtgccacggaggcaga

SEQ ID NO: 165591 - DNA, 75 bp, Artificial Sequence
  Synthetic
taatctgaacgaaggccgcgtcaactacgcctccctgctagccttcagccatcatcccgagttccccagcatctt

SEQ ID NO: 165592 - DNA, 75 bp, Artificial Sequence
  Synthetic
ttttcggagatctttggtatcccgcagggcctgtttcaagccgtgggttcgccgcgtcttttcgcgctcattcag

SEQ ID NO: 165593 - DNA, 75 bp, Artificial Sequence
  Synthetic
aggtgacgctgtaccagaacctggtctccatttacaacctgaccacctttgtcaagcacatcgacgccgcggttt

SEQ ID NO: 165594 - DNA, 75 bp, Artificial Sequence
  Synthetic
ctccatttacaacctgaccacctttgtcaagcacatcgacgccgcggtttttaagacggtacgcgattgcgtctt

SEQ ID NO: 165595 - DNA, 75 bp, Artificial Sequence
  Synthetic
gcgcggcggcgtcctcagcgcctttgcggcgtgctgtgtccggcgccttgtgcgcactgccggtgcgcggcgtcc

SEQ ID NO: 165596 - DNA, 75 bp, Artificial Sequence
  Synthetic
ggcgcgctccgtagcgcataacctgtacaccaccgtcaacccgctgatcgaggacgtgatgcgcagcagcgccgg

SEQ ID NO: 165597 - DNA, 75 bp, Artificial Sequence
  Synthetic
tacggtgtttgtgaacgccggcgccggtaacgggagttacgctggggttgacggcggggtgtgcggagccggggg

SEQ ID NO: 165598 - DNA, 75 bp, Artificial Sequence
  Synthetic
cataaaggctcggtgattgctgcgcctaaagtacgcgggattctccaccagttcattctgttgaacaaagtggat

SEQ ID NO: 165599 - DNA, 75 bp, Artificial Sequence
  Synthetic
ctaccacgcgtttcgtagaacagttgcgcgaactggttcgccgcgatcggctgttggccgagaatctgcgcggct

SEQ ID NO: 165600 - DNA, 75 bp, Artificial Sequence
  Synthetic
cgtgcgcgtacgtcagatcagcagcgacacagaggaagtaagccgacacgccaagggtcaccacacggtggccca

SEQ ID NO: 165601 - DNA, 75 bp, Artificial Sequence
  Synthetic
gacacagaggaagtaagccgacacgccaagggtcaccacacggtggcccagatgagcaaggcgctcaaaaagacg

SEQ ID NO: 165602 - DNA, 75 bp, Artificial Sequence
  Synthetic
gttaccgcggtgcaacgcgcgctagccgtctttgacgtactaagtcgcgagaacttggaacgccgcggcgcacag

SEQ ID NO: 165603 - DNA, 75 bp, Artificial Sequence
  Synthetic
ccgtctttgacgtactaagtcgcgagaacttggaacgccgcggcgcacagctctgtctgacggaagcgacgagcc

SEQ ID NO: 165604 - DNA, 75 bp, Artificial Sequence
  Synthetic
atcgcgccttacgcgagttcttggaggcgccctgggaatcggcgccccaaccgccgcgactccgcatgacgcccg

SEQ ID NO: 165605 - DNA, 75 bp, Artificial Sequence
  Synthetic
ggcgccctgggaatcggcgccccaaccgccgcgactccgcatgacgcccgacaccgatcacgaagaatcgacggc

SEQ ID NO: 165606 - DNA, 75 bp, Artificial Sequence
  Synthetic
ctggtacatcgtccccgtaagccaggcgcagcaggacatcttgtcttcgatcgacccgcccgccggctcgacatc

SEQ ID NO: 165607 - DNA, 75 bp, Artificial Sequence
  Synthetic
gcgcagcaggacatcttgtcttcgatcgacccgcccgccggctcgacatcggtgtccctgccgccggcctcgcca

SEQ ID NO: 165608 - DNA, 75 bp, Artificial Sequence
  Synthetic
ttctacattgtatataggggcaaatgtaacagcactgataccaataattctacgtctacttcagatagcaccgtc

SEQ ID NO: 165609 - DNA, 75 bp, Artificial Sequence
  Synthetic
gcaacggcatcatgttcctacacgccttgcacctgggtggaacgagcgccgtcctgcagaccgaggcgctggacg

SEQ ID NO: 165610 - DNA, 75 bp, Artificial Sequence
  Synthetic
cttgcacctgggtggaacgagcgccgtcctgcagaccgaggcgctggacgccatcatggaagagggcgcgcgtct

SEQ ID NO: 165611 - DNA, 75 bp, Artificial Sequence
  Synthetic
cgaagtgccgcgccgcctggagtcgcggttcggccggaccgtgcacgcgctctcgcggcccttcaacggcaccac

SEQ ID NO: 165612 - DNA, 75 bp, Artificial Sequence
  Synthetic
cggttcggccggaccgtgcacgcgctctcgcggcccttcaacggcaccaccgagacgtgcgacctggacggctac

SEQ ID NO: 165613 - DNA, 75 bp, Artificial Sequence
  Synthetic
agtcaaataccataattcaccgctgtactcgtctttattctctccgaaccaacgaccaaggtcgacaacgccgtc

SEQ ID NO: 165614 - DNA, 75 bp, Artificial Sequence
  Synthetic
aactcgttggcgcgcgccgtggtcttcaccgaggaccacatgttggtctttgatccgcacagctccgcggaatgt

SEQ ID NO: 165615 - DNA, 75 bp, Artificial Sequence
  Synthetic
gcgacaacgaccaccgccgcaccttccttacctccgctgcccgaccccatcgtcgacccgggctgccctcctggc

SEQ ID NO: 165616 - DNA, 75 bp, Artificial Sequence
  Synthetic
atccctcgtcctcacccaaaaaaacacccgagaaacgccgcaaggacctcagcggtagcaaacacggaggcaaaa

SEQ ID NO: 165617 - DNA, 75 bp, Artificial Sequence
  Synthetic
tcagcgatagcggcggcctcttcttcgtccgcggtaccaccgtcctacagctgcggcgaaggggccctgccggcc

SEQ ID NO: 165618 - DNA, 75 bp, Artificial Sequence
  Synthetic
cgtccgcggtaccaccgtcctacagctgcggcgaaggggccctgccggccctgggccgctaccaacagctggtcg

SEQ ID NO: 165619 - DNA, 75 bp, Artificial Sequence
  Synthetic
cggcgggtaccgaaagcggcgctaacgcggcaacggccacggcgccgtccttcgacgaagctttcctcaccgatc

SEQ ID NO: 165620 - DNA, 75 bp, Artificial Sequence
  Synthetic
ttcgacgaagctttcctcaccgatcgtctccagcagctcatcatccatgccgtcaatcagcgctcgtgtctgcgt

SEQ ID NO: 165621 - DNA, 75 bp, Artificial Sequence
  Synthetic
tttctgctcaactggctgcaccacggcctggatctgcggcgcatgcacgactacctgagccacaagaccaccaaa

SEQ ID NO: 165622 - DNA, 75 bp, Artificial Sequence
  Synthetic
attatcatcattatgatacggtcgcggtcttcttctccgatgacgaaacctgcgcacatcgaagaaaagacgagc

SEQ ID NO: 165623 - DNA, 75 bp, Artificial Sequence
  Synthetic
caagcccactaacgaactgtctcaacgactgcaacgtttcgtaaccaagcgaccgatgcccgttagcgacagctt

SEQ ID NO: 165624 - DNA, 75 bp, Artificial Sequence
  Synthetic
gaccgatgcccgttagcgacagcttcgtctgcctgcgacccgtagactttcagcgtctgacgcaggtcatcgaac

SEQ ID NO: 165625 - DNA, 75 bp, Artificial Sequence
  Synthetic
gcatcgacattcacgacctagacgccagcgatctgaaccgacgcgaaattctgaaagcgctgcagccgttggacg

SEQ ID NO: 165626 - DNA, 75 bp, Artificial Sequence
  Synthetic
cagcgatctgaaccgacgcgaaattctgaaagcgctgcagccgttggacgacaacgccaagcaggaactctttcg

SEQ ID NO: 165627 - DNA, 75 bp, Artificial Sequence
  Synthetic
caatcacatcctcaacggctttttgccggtagaggacctgaagcagatggaacgcgtcgtcgagcaggtactgag

SEQ ID NO: 165628 - DNA, 75 bp, Artificial Sequence
  Synthetic
ccggtagaggacctgaagcagatggaacgcgtcgtcgagcaggtactgagactcttttacgacctgcgcgacctg

SEQ ID NO: 165629 - DNA, 75 bp, Artificial Sequence
  Synthetic
cttttttttttagagaggaggaatttcgtcttgatctccagccggagacaacggcggcggtggtggtggtggcgg

SEQ ID NO: 165630 - DNA, 75 bp, Artificial Sequence
  Synthetic
gtgcgcgacaacgtaccgctactgcaagagatcctgcagctgcgacacgcgtaccagcaagccacgcagcaaaac

SEQ ID NO: 165631 - DNA, 75 bp, Artificial Sequence
  Synthetic
cccagtcgccaccgccgcggcggatttctgcgcgggggacggggtagccgagcgctgcgccctcgcctatgttgt

SEQ ID NO: 165632 - DNA, 75 bp, Artificial Sequence
  Synthetic
gctaggcggcttgcagctacccgaagtgcagcagcgcctacagaacgcgcaactcgcgctaagccgcctctacga

SEQ ID NO: 165633 - DNA, 75 bp, Artificial Sequence
  Synthetic
gtgcagcagcgcctacagaacgcgcaactcgcgctaagccgcctctacgaagaggaagaggaaacgcagcgtttc

SEQ ID NO: 165634 - DNA, 75 bp, Artificial Sequence
  Synthetic
cgtgtagttggggttgtgtttgagcgtagaggtgttggcgggcctgtgcgcaagcagcgtagtccgcggcgtcga

SEQ ID NO: 165635 - DNA, 75 bp, Artificial Sequence
  Synthetic
cgtcgtgacgaacagacgcgtctgcgactcatcaacgccgtactgagcatgttccacacattagtgatgcgattg

SEQ ID NO: 165636 - DNA, 75 bp, Artificial Sequence
  Synthetic
tgggtgaagcggcgtggtgtgggtgctgtttgtgtctgtggctggcatgattgtgcggcatgtgtgtgttgtagt

SEQ ID NO: 165637 - DNA, 75 bp, Artificial Sequence
  Synthetic
cacgaacgtgaggatctgcgtgccgccaacgccacgtacgcgcagatggtcaagaaactggagcagatcgagaaa

SEQ ID NO: 165638 - DNA, 75 bp, Artificial Sequence
  Synthetic
ccaacgccacgtacgcgcagatggtcaagaaactggagcagatcgagaaagccggtaccggcgcatccgaaaaac

SEQ ID NO: 165639 - DNA, 75 bp, Artificial Sequence
  Synthetic
cggaaactaacgttggctctacggaaataaacgttacttccatgaatacttcagcaacaagcaacgtcacgtcaa

SEQ ID NO: 165640 - DNA, 75 bp, Artificial Sequence
  Synthetic
gccggtaccggcgcatccgaaaaacgcttccaagcgttacgggagttggtttactttttccgtaatcatgaatat

SEQ ID NO: 165641 - DNA, 75 bp, Artificial Sequence
  Synthetic
actctacgagcgatatcaacacgagatggaagaacagcacctggaacggctagaacgtgaatggcaagaagaggc

SEQ ID NO: 165642 - DNA, 75 bp, Artificial Sequence
  Synthetic
agcgtatccccggacggcacactttatgagaacgcaatttaaggaaagtacaagttcctatcgacatgttatcac

SEQ ID NO: 165643 - DNA, 75 bp, Artificial Sequence
  Synthetic
tagaacgtgaatggcaagaagaggccggcaagctcacggtaacttctgtggaggacgtgcagcgtgtcttggccc

SEQ ID NO: 165644 - DNA, 75 bp, Artificial Sequence
  Synthetic
cacaaggtggtttggatgcgacaatataatctaaccacacatggagattatttcccaatacgatataaacgtcct

SEQ ID NO: 165645 - DNA, 75 bp, Artificial Sequence
  Synthetic
cgtccccggcgcaacccccgtccccgtccccagcgtaactcccgttaccggcgccggcgcccagcacgcccgaaa

SEQ ID NO: 165646 - DNA, 75 bp, Artificial Sequence
  Synthetic
aagatgcaagactttttagacaaggagaaacgtaaacaggaagaacagcaacggcagctactggacggttaccaa

SEQ ID NO: 165647 - DNA, 75 bp, Artificial Sequence
  Synthetic
acggcagctactggacggttaccaaaaaaaggtgcagcaggatttgcaacgcgtggtggacgccgttaagggcga

SEQ ID NO: 165648 - DNA, 75 bp, Artificial Sequence
  Synthetic
acgtattacttacctttatcgttggagggaaaggcgctaagataccccacctgagtgaagggacccttgcagtct

SEQ ID NO: 165649 - DNA, 75 bp, Artificial Sequence
  Synthetic
accgctactggacaagttcaaccaggacttgctgtcggcgctgcagcagctgagcaaaaaactagacgggcgaat

SEQ ID NO: 165650 - DNA, 75 bp, Artificial Sequence
  Synthetic
caacgagtgtctgcacggcgtgctgacgggtgatgtagagcggcgctgtcacccgcaccgagaagcggctatgca

SEQ ID NO: 165651 - DNA, 75 bp, Artificial Sequence
  Synthetic
tgatccatgagacgcaacaggccctgcaacacgccgtccatcaagcgcagttcatcgagaagtgtcaacagggcg

SEQ ID NO: 165652 - DNA, 75 bp, Artificial Sequence
  Synthetic
gcaacacgccgtccatcaagcgcagttcatcgagaagtgtcaacagggcgatccaactacagccatcacgggcag

SEQ ID NO: 165653 - DNA, 75 bp, Artificial Sequence
  Synthetic
tttcaaaacgctgctagatcagcaggccgacgcggcccggaaagcgctcagcgacgaggccgatctgctgaatca

SEQ ID NO: 165654 - DNA, 75 bp, Artificial Sequence
  Synthetic
gccgacgcggcccggaaagcgctcagcgacgaggccgatctgctgaatcagaaagtacagacgcagttgcgacaa

SEQ ID NO: 165655 - DNA, 75 bp, Artificial Sequence
  Synthetic
ataactgcacctataaccgcttgacgttgctgaatctgacgacggaaaacagcggaaagtactatttcaaaaggg

SEQ ID NO: 165656 - DNA, 75 bp, Artificial Sequence
  Synthetic
gacgtgaccacccccgacgccaaggcgctgatggaaaagccgctggagacacttcgcgagctgttgggcaaagcc

SEQ ID NO: 165657 - DNA, 75 bp, Artificial Sequence
  Synthetic
cgctgatggaaaagccgctggagacacttcgcgagctgttgggcaaagccacgcaacaactgccgtacctgtcgg

SEQ ID NO: 165658 - DNA, 75 bp, Artificial Sequence
  Synthetic
cgcatcacggaagcaggacccactaccggaacctacaacagcaagccgtcgagagcgccgtgacgctagcgcatc

SEQ ID NO: 165659 - DNA, 75 bp, Artificial Sequence
  Synthetic
gagagcgccgtgacgctagcgcatcaaatcgaacaaaacgcggcctgtgaaaattttattgcacagcatcaagag

SEQ ID NO: 165660 - DNA, 75 bp, Artificial Sequence
  Synthetic
acagggtttcgctcaggtttgcctgtgtcatggatgcagcctccagaatacttactggaaactattgtaacccgc

SEQ ID NO: 165661 - DNA, 75 bp, Artificial Sequence
  Synthetic
cccggacgcgtagccggcggcgccgcgcgtcatcaaaaagtgcaggaactgttgcagcgcttgggtcagacgcta

SEQ ID NO: 165662 - DNA, 75 bp, Artificial Sequence
  Synthetic
ggcgacgacttcgctgggcgcctttacacgcgggttgaacgcactggaacgacacgtccagctgggtcaccagta

SEQ ID NO: 165663 - DNA, 75 bp, Artificial Sequence
  Synthetic
agtttacgtgcatggatctgcaacatgtcccaggtgacgatgtatttttcgctcatgtgaagtgtcccagcctgt

SEQ ID NO: 165664 - DNA, 75 bp, Artificial Sequence
  Synthetic
tcgcgcgtcaccacgacacctttcttgaagtggtagacgtcttcggcatgcggcaaatcgtcacgcaggccggcg

SEQ ID NO: 165665 - DNA, 75 bp, Artificial Sequence
  Synthetic
gcgctgcgagacgatggccgacccctggcatggcggcgccgctgtagcggcggaggactcaagaacgtcgtcacc

SEQ ID NO: 165666 - DNA, 75 bp, Artificial Sequence
  Synthetic
cggaggactcaagaacgtcgtcaccacacgttataaagccatcacggtagccgtggccgtctgtcagacattgcg

SEQ ID NO: 165667 - DNA, 75 bp, Artificial Sequence
  Synthetic
gggccacggggatgaagcagctgcgccactccctgaagctcctgcagaagcttcgaattcgagctcccgggtacc

SEQ ID NO: 165668 - DNA, 75 bp, Artificial Sequence
  Synthetic
ccactccctgaagctcctgcagaagcttcgaattcgagctcccgggtaccatggcatgcatcgatagatcgcagc

SEQ ID NO: 165669 - DNA, 75 bp, Artificial Sequence
  Synthetic
ggagactcacacgttacataaccttaagctcttttgttatctggtgagcaccgcctggcaccagcgcatcgacac

SEQ ID NO: 165670 - DNA, 75 bp, Artificial Sequence
  Synthetic
aagctcttttgttatctggtgagcaccgcctggcaccagcgcatcgacacgcagcaggagctgacggccgccgat

SEQ ID NO: 165671 - DNA, 75 bp, Artificial Sequence
  Synthetic
caagagttttgtgtactcatagcagctctgtaccccgagtacatctacaccgtcctcaagtacccggtgcagatg

SEQ ID NO: 165672 - DNA, 75 bp, Artificial Sequence
  Synthetic
ctctgtaccccgagtacatctacaccgtcctcaagtacccggtgcagatgtcgctaccctccctcacagctcacc

SEQ ID NO: 165673 - DNA, 75 bp, Artificial Sequence
  Synthetic
ccaccaccaccgccgggcggacgtcggggtcgggcccggaacaatacccgaggaggcggcggtggtggcggtggt

SEQ ID NO: 165674 - DNA, 75 bp, Artificial Sequence
  Synthetic
ggacacacgcagaagcggtcgcccaggggagggggggggggactcgcggaccccggggcacactgcttccagcca

SEQ ID NO: 165675 - DNA, 75 bp, Artificial Sequence
  Synthetic
aggctttctgtatcacccccacccaatggcccgccatgcagctcaataaactgttttgggaaaataaactggtgc

SEQ ID NO: 165676 - DNA, 75 bp, Artificial Sequence
  Synthetic
ggggagggggggggggactcgcggaccccggggcacactgcttccagccagccgcgcacaccgcacccctgacac

SEQ ID NO: 165677 - DNA, 75 bp, Artificial Sequence
  Synthetic
tggtctttccacaagacatgctgcagtgtctgtggctagaactgaaaccccagtacgccgagacctacgcctcgg

SEQ ID NO: 165678 - DNA, 75 bp, Artificial Sequence
  Synthetic
gtgtctgtggctagaactgaaaccccagtacgccgagacctacgcctcggtgtccgaattggtacagacgttgtt

SEQ ID NO: 165679 - DNA, 75 bp, Artificial Sequence
  Synthetic
aatgagcgccatctggtgtcggcataagaacaggcatcaaccccgtggccggcgaggcggtgagcacttttgttg

SEQ ID NO: 165680 - DNA, 75 bp, Artificial Sequence
  Synthetic
cacacacccacccagccgcgcccccgacacaccccgaccgccgccggtgcgggacagggctgagggagtgttgag

SEQ ID NO: 165681 - DNA, 75 bp, Artificial Sequence
  Synthetic
tcagattttcacgcaacaatgcgagatggtgaccgaggggtacacgcaaccgcagctccccaccggagagccggt

SEQ ID NO: 165682 - DNA, 75 bp, Artificial Sequence
  Synthetic
acgggctgtccgcgcgttcagggatgtttccacgggtgtgcggagccgcagttttgtttacggcgtgccgtggcc

SEQ ID NO: 165683 - DNA, 75 bp, Artificial Sequence
  Synthetic
acacgaccacagagccaggacttttagatgtttttattcaaacagaaaccgccctagactacgcgctgggctcct

SEQ ID NO: 165684 - DNA, 75 bp, Artificial Sequence
  Synthetic
agatgtttttattcaaacagaaaccgccctagactacgcgctgggctcctggcttttcggcatacccgtgtgtct

SEQ ID NO: 165685 - DNA, 75 bp, Artificial Sequence
  Synthetic
ccgcgacttcctccgcatccaacgctcccgggacctcaatctcagtcaactgctccaggacacgtggaccgaaac

SEQ ID NO: 165686 - DNA, 75 bp, Artificial Sequence
  Synthetic
ttttgcgcggcgcttcgcttttcggggcggcgacggcggtgttttcgggcgtgctgggcgccggcgccggtaacg

SEQ ID NO: 165687 - DNA, 75 bp, Artificial Sequence
  Synthetic
tcccgggacctcaatctcagtcaactgctccaggacacgtggaccgaaacgccgctggagcactgctggctacaa

SEQ ID NO: 165688 - DNA, 75 bp, Artificial Sequence
  Synthetic
gcacaggaccacaccgttgtacgcgtgctgcgaccgccctccacgttcgaacaggaccacagtcggctggtgttg

SEQ ID NO: 165689 - DNA, 75 bp, Artificial Sequence
  Synthetic
cggcagggacggggcgttgcggggccgggggcgtttgcggcggggacgggggccttctgcggcggggacagtggt

SEQ ID NO: 165690 - DNA, 75 bp, Artificial Sequence
  Synthetic
gccgctccaacaccgccggtacctttcaaccgcgtaccagtcaatattcagtttctgcgtgaaaacccgccaccc

SEQ ID NO: 165691 - DNA, 75 bp, Artificial Sequence
  Synthetic
gtgtttatgacggacacggaactgtaatatactataatgtctaagaagtgtttgcggttatttccatggatgaca

SEQ ID NO: 165692 - DNA, 75 bp, Artificial Sequence
  Synthetic
ttggacctgcgacaactggcgcaatccgtacaggacactattcaacacatgcggtttctctatcttttgtaaccg

SEQ ID NO: 165693 - DNA, 75 bp, Artificial Sequence
  Synthetic
tccccatgggctgtcagcgtcgggtgcgcgacacggctaccatgcgcaacaggtccagcttaaaggcgcacttgt

SEQ ID NO: 165694 - DNA, 75 bp, Artificial Sequence
  Synthetic
acaatccaatgaagacatttcaaacatcaaatggcaatgtacaaaaaaccatacgttaattcttattaacctaac

SEQ ID NO: 165695 - DNA, 75 bp, Artificial Sequence
  Synthetic
cggtcggcaactccaaaacgacgttgacgacgtgacggtgtttttcgtcccgcttgttggccaccgtgggtcccg

SEQ ID NO: 165696 - DNA, 75 bp, Artificial Sequence
  Synthetic
cgtggggggaggacgaggaggaaatcgctgctaaaccgccgcgcgcctgctgcacaatgtggccgccgacgtggc

SEQ ID NO: 165697 - DNA, 75 bp, Artificial Sequence
  Synthetic
aggcggtctgtttaaccagcgcgcagccccgacacagcggggcgccgtcttcgctttccaaacagctgtcgcggt

SEQ ID NO: 165698 - DNA, 75 bp, Artificial Sequence
  Synthetic
gccccgacacagcggggcgccgtcttcgctttccaaacagctgtcgcggtactcgcccgtctgacagcgcgcgca

SEQ ID NO: 165699 - DNA, 75 bp, Artificial Sequence
  Synthetic
gcaggtgcgtgccgcgcagggcagaatgacgtcgaaagccagccggtgatcgtacacggcacaagccgcgttgag

SEQ ID NO: 165700 - DNA, 75 bp, Artificial Sequence
  Synthetic
atgacgtcgaaagccagccggtgatcgtacacggcacaagccgcgttgaggcccagcacggctttccagcccacg

SEQ ID NO: 165701 - DNA, 75 bp, Artificial Sequence
  Synthetic
tggtggctgtcgtggcaccgcacagacgaagcaacatgtcgctgtgaagagatagagtgtgagcattgtgtgcag

SEQ ID NO: 165702 - DNA, 75 bp, Artificial Sequence
  Synthetic
cagagcgagcagtgtacgagctcggcgtgcgtgttgaagatgacgctcttttcttgacggtcccgataatagaac

SEQ ID NO: 165703 - DNA, 75 bp, Artificial Sequence
  Synthetic
cgtgcgtgttgaagatgacgctcttttcttgacggtcccgataatagaacatcgagttgagcggaaaattttgct

SEQ ID NO: 165704 - DNA, 75 bp, Artificial Sequence
  Synthetic
gaggtgcgtgtgcgtgtggtttgtggtcgccgcgaacagccttgccgtcgccgcaaaagccctcctgtccccgtc

SEQ ID NO: 165705 - DNA, 75 bp, Artificial Sequence
  Synthetic
ccacccccgtccctcagcccggtcccgcgattccccgtcgccaacgtaacccccgtacccgcaacgcccaggcca

SEQ ID NO: 165706 - DNA, 75 bp, Artificial Sequence
  Synthetic
cgtccagatggcgctcgcacttgagtcgacacagacaccagagcggcaggtcgatgacgctgccgatgaggccgc

SEQ ID NO: 165707 - DNA, 75 bp, Artificial Sequence
  Synthetic
tcgatgacgctgccgatgaggccgccgcgcagcgcggcgctgagtgcaaagaggacgatcttggtgggctctacg

SEQ ID NO: 165708 - DNA, 75 bp, Artificial Sequence
  Synthetic
tcgtgcagacccagtgcccgcaacggcaccaggtatcgcggacacgtgtcgcaaaacgtctgcaccgcttgtcgg

SEQ ID NO: 165709 - DNA, 75 bp, Artificial Sequence
  Synthetic
aagctgaaaatggaggtgcctgtcacgatgtagaagaggatagccagcactttcatgatttcgtcattgcgcgcg

SEQ ID NO: 165710 - DNA, 75 bp, Artificial Sequence
  Synthetic
cgccgcgctgacggcccgcaaacctcccgcagtccggtcccgcgaacaaatagcgtgggacgccacgcaccggta

SEQ ID NO: 165711 - DNA, 75 bp, Artificial Sequence
  Synthetic
gccagtacgtagagcgggtttccgcagggtaccttcccggcgtgccggcgcaaggctgcgatgaggccccgcagc

SEQ ID NO: 165712 - DNA, 75 bp, Artificial Sequence
  Synthetic
caaaaacctacaccgccgcaactaagaaccacgccaaagaaacatacgcagcacaaaagatccacgggaataacg

SEQ ID NO: 165713 - DNA, 75 bp, Artificial Sequence
  Synthetic
cgcttggcgcgtagtagtgctaggcacggcgagctggtggggtgaagcacgggcagccgaaggtccaccccgaaa

SEQ ID NO: 165714 - DNA, 75 bp, Artificial Sequence
  Synthetic
acggcgagctggtggggtgaagcacgggcagccgaaggtccaccccgaaaaggaaacggtgaaggtcacctagca

SEQ ID NO: 165715 - DNA, 75 bp, Artificial Sequence
  Synthetic
ccactacggactacttatcgtgagcggacggatatctccgatttcaaactcactgtttgaatatagggacagtcc

SEQ ID NO: 165716 - DNA, 75 bp, Artificial Sequence
  Synthetic
cggtgttgtagcgttcgaaacgcagaaaggccatcgtgcggacggccacggtgtgcagacagtccatgctgtaga

SEQ ID NO: 165717 - DNA, 75 bp, Artificial Sequence
  Synthetic
aaaggccatcgtgcggacggccacggtgtgcagacagtccatgctgtagacgtaagcgagaaacacaaagtaggg

SEQ ID NO: 165718 - DNA, 75 bp, Artificial Sequence
  Synthetic
aatcacacagacacagacacacgtcggggaatcaactccacacagacacacgtcttcttttcgccgtgcgcggcg

SEQ ID NO: 165719 - DNA, 75 bp, Artificial Sequence
  Synthetic
caggaagcgttggtagagacggtcgcccagctcgcgattcagaaagcgcttatccgtcacgaagagatgaaggac

SEQ ID NO: 165720 - DNA, 75 bp, Artificial Sequence
  Synthetic
cccagctcgcgattcagaaagcgcttatccgtcacgaagagatgaaggacgcaagaacgtggcacgtgatgcacc

SEQ ID NO: 165721 - DNA, 75 bp, Artificial Sequence
  Synthetic
tccggctgcagcgcaccgcggccgatcaccagctgcacatggaaatggtcctcgtgaacgcagaggggcgcgaag

SEQ ID NO: 165722 - DNA, 75 bp, Artificial Sequence
  Synthetic
tcaccagctgcacatggaaatggtcctcgtgaacgcagaggggcgcgaagagacggcacagagcctggtggaact

SEQ ID NO: 165723 - DNA, 75 bp, Artificial Sequence
  Synthetic
gcttaccaaacaacagtcttcttttgattaacgtaaccgtaaattataccaacacttaccgtaccatgacatcgt

SEQ ID NO: 165724 - DNA, 75 bp, Artificial Sequence
  Synthetic
gagaaaaaaacaccaagctcaggcacgcgtacatcattatcatcatcggatatctcaccacgggtcatagtagta

SEQ ID NO: 165725 - DNA, 75 bp, Artificial Sequence
  Synthetic
agaagagccagcaccagcgggcccagagtcgcaaagcgcgcgggcagccacggcccagactgcggtcgcgatggc

SEQ ID NO: 165726 - DNA, 75 bp, Artificial Sequence
  Synthetic
gagtcgcaaagcgcgcgggcagccacggcccagactgcggtcgcgatggcccggagcgcgctcgccaccacgatg

SEQ ID NO: 165727 - DNA, 75 bp, Artificial Sequence
  Synthetic
tgaacgaaaacggtacattccccattaccaccaccaaaaagcccactacgaccacaagaacgacaactaccacca

SEQ ID NO: 165728 - DNA, 75 bp, Artificial Sequence
  Synthetic
acacccctcgccgacgactcacgtgctcctccagaggccgacgcgcggaccctccgacgtcctggcccgccgctg

SEQ ID NO: 165729 - DNA, 75 bp, Artificial Sequence
  Synthetic
ccgctgccgccttcccttctcccgccagagccagcaactcctcctcctcttcatcagcgtctccctcgcttgcgc

SEQ ID NO: 165730 - DNA, 75 bp, Artificial Sequence
  Synthetic
gaggcccggcagcggcgccgccagcggcgaccatggtgggagagcaactcggatgacgaggaggaggaggaggag

SEQ ID NO: 165731 - DNA, 75 bp, Artificial Sequence
  Synthetic
gagggggagatgcggtccgagaggaccgctttcccgccgttcgcgtgagcgcggccgacatgcgggcgcgccaca

SEQ ID NO: 165732 - DNA, 75 bp, Artificial Sequence
  Synthetic
gcttacggtgacgtggttccggaccgccaacgacgtcgacgcggctttcttggcgtacagctcgcgcagcagatt

SEQ ID NO: 165733 - DNA, 75 bp, Artificial Sequence
  Synthetic
gccaacgacgtcgacgcggctttcttggcgtacagctcgcgcagcagattctcgtactcgccctcgttttcgggt

SEQ ID NO: 165734 - DNA, 75 bp, Artificial Sequence
  Synthetic
taggccgagggcttgatctcctcgatgtccttgagcgtgacgatgagcgactcgttcaccttaagcacattgaac

SEQ ID NO: 165735 - DNA, 75 bp, Artificial Sequence
  Synthetic
tgtccttgagcgtgacgatgagcgactcgttcaccttaagcacattgaactcacctacgtggcgcgccggcgaaa

SEQ ID NO: 165736 - DNA, 75 bp, Artificial Sequence
  Synthetic
cgtggtctgtgcggctctcccagtagctgagcagatactcgacacaatagaccgtgtctgtcttgagcatggcgt

SEQ ID NO: 165737 - DNA, 75 bp, Artificial Sequence
  Synthetic
gctgagcagatactcgacacaatagaccgtgtctgtcttgagcatggcgtcgcacaccgagtaattggggttttt

SEQ ID NO: 165738 - DNA, 75 bp, Artificial Sequence
  Synthetic
atcctgatggagaaccttgttcatctccatcgcaccgacgccaccgccgatttatttacccggcgccggctcgtc

SEQ ID NO: 165739 - DNA, 75 bp, Artificial Sequence
  Synthetic
tccatcgcaccgacgccaccgccgatttatttacccggcgccggctcgtcttttccctccaggattccgttaatg

SEQ ID NO: 165740 - DNA, 75 bp, Artificial Sequence
  Synthetic
cagtcgccgtgcacgtacttgaggaaggcggcgtacttctgacccgcgttcacgaaatttaagcgcgcgtccaga

SEQ ID NO: 165741 - DNA, 75 bp, Artificial Sequence
  Synthetic
cacgaaatttaagcgcgcgtccagagagggcagcaacagatcgtagacgcgcggcagcatcggctcgaactgtaa

SEQ ID NO: 165742 - DNA, 75 bp, Artificial Sequence
  Synthetic
cccaccgctcgtaccagccgcgggctccgcgtcctcgtcgatcaccagcggtcgcgtcggcaccggagaatccac

SEQ ID NO: 165743 - DNA, 75 bp, Artificial Sequence
  Synthetic
tccgcgtcctcgtcgatcaccagcggtcgcgtcggcaccggagaatccacgtcatcctgcacgtcgttttcctcc

SEQ ID NO: 165744 - DNA, 75 bp, Artificial Sequence
  Synthetic
gcgccgatcgccatgaatccgagtacccacgtgagcagtaacggcccaacgactccccctcacgggccccacacc

SEQ ID NO: 165745 - DNA, 75 bp, Artificial Sequence
  Synthetic
ccccgtccaccagctccgtcgccgccgctaccttgtgcagtccgcaacgacaggccgtttcgcgttacagcggct

SEQ ID NO: 165746 - DNA, 75 bp, Artificial Sequence
  Synthetic
ggagcaccgagtacacccagtggcactcggacttgacaactgagctgctatggcacgcgcacccgcgtcaagtac

SEQ ID NO: 165747 - DNA, 75 bp, Artificial Sequence
  Synthetic
ctcggacttgacaactgagctgctatggcacgcgcacccgcgtcaagtacctatggacgaagcgctggccgccgc

SEQ ID NO: 165748 - DNA, 75 bp, Artificial Sequence
  Synthetic
cctcggcacctcggaggtagacgaactgctcaactgctgtgcggaagaaaccacgtgcggcggcacgcaatccac

SEQ ID NO: 165749 - DNA, 75 bp, Artificial Sequence
  Synthetic
ctgctcaactgctgtgcggaagaaaccacgtgcggcggcacgcaatccaccgtactcaccaatgcgaccaacacc

SEQ ID NO: 165750 - DNA, 75 bp, Artificial Sequence
  Synthetic
gcagaactggccggcctcgaaacctcggcggccgactttgaacaactgcggcgactgtgcgcgccgctggccatc

SEQ ID NO: 165751 - DNA, 75 bp, Artificial Sequence
  Synthetic
cggcggccgactttgaacaactgcggcgactgtgcgcgccgctggccatcgacacgcgctgtaacctatgcgcca

SEQ ID NO: 165752 - DNA, 75 bp, Artificial Sequence
  Synthetic
tttcatgtctgagtaattacagcctcctcctcattaacgttaccgcgcagtatagtactactatcgtactatgac

SEQ ID NO: 165753 - DNA, 75 bp, Artificial Sequence
  Synthetic
gttacgcgccccgtgcggcgctcagcacgctcatcatcatgtccgagtttacgcatctgctgcagcagcactttt

SEQ ID NO: 165754 - DNA, 75 bp, Artificial Sequence
  Synthetic
cacgctcatcatcatgtccgagtttacgcatctgctgcagcagcacttttccgatctgcgcatcgacgacctgtt

SEQ ID NO: 165755 - DNA, 75 bp, Artificial Sequence
  Synthetic
cgacgcggttgataacgagaatgtcaccctaaaccatctggccgtggtgcgggccatggtcatgggcgaagacac

SEQ ID NO: 165756 - DNA, 75 bp, Artificial Sequence
  Synthetic
accctaaaccatctggccgtggtgcgggccatggtcatgggcgaagacacggtgccttacaacaagcctcggcgc

SEQ ID NO: 165757 - DNA, 75 bp, Artificial Sequence
  Synthetic
aggtgacgatccgggccgtcacaacggcggtggcaccagcggggggttcagcgagagcacgctaaaaaagaacgt

SEQ ID NO: 165758 - DNA, 75 bp, Artificial Sequence
  Synthetic
gcgagagcacgctaaaaaagaacgtgggtcccatttacctatgtcccgtacccgccttttttaccaagaaccaaa

SEQ ID NO: 165759 - DNA, 75 bp, Artificial Sequence
  Synthetic
gccgcgtcgtctcgtactgtcagaacaatgtgaagatggtggaccgcattcagctggtattggccgacctgttgc

SEQ ID NO: 165760 - DNA, 75 bp, Artificial Sequence
  Synthetic
caatgtgaagatggtggaccgcattcagctggtattggccgacctgttgcgcgaatgcacgtcgccgctcggcgc

SEQ ID NO: 165761 - DNA, 75 bp, Artificial Sequence
  Synthetic
tagactgcaataaaaacggtacctatcagcattctggaaatgcttacaaccatacaaataccagctgtggaagta

SEQ ID NO: 165762 - DNA, 75 bp, Artificial Sequence
  Synthetic
gtgccgcttatggaaagattgggtcaataatgatacttcttacaacactgtaagagtccagtcactgggaaatga

SEQ ID NO: 165763 - DNA, 75 bp, Artificial Sequence
  Synthetic
gagcggcgtcgacggcgcactggcgcgacccgacccggtattttgccacgtcctgcgtcaggcgggcgtcacggg

SEQ ID NO: 165764 - DNA, 75 bp, Artificial Sequence
  Synthetic
aacgtacatcgacggtaaaattaaaaacatcagcgagggggatactacaatacaaaggaactatcttatgggcaa

SEQ ID NO: 165765 - DNA, 75 bp, Artificial Sequence
  Synthetic
cgacccgacccggtattttgccacgtcctgcgtcaggcgggcgtcacgggcatctacaagcactttttctgtgac

SEQ ID NO: 165766 - DNA, 75 bp, Artificial Sequence
  Synthetic
gaggtgaaactggccatctgtcacgacaattactatataagtcgacttccgcgacgtgtgtggctctgcatcaca

SEQ ID NO: 165767 - DNA, 75 bp, Artificial Sequence
  Synthetic
acaattactatataagtcgacttccgcgacgtgtgtggctctgcatcacactcttcaaggcctttcagattacaa

SEQ ID NO: 165768 - DNA, 75 bp, Artificial Sequence
  Synthetic
tcaagctggtggaccccacgtacgtgatagacaagtatgtctagcgtgagcggcgtgcgcacgccgcgcgaacga

SEQ ID NO: 165769 - DNA, 75 bp, Artificial Sequence
  Synthetic
gggtgtgtcacaggcatggtgtgctccatgaggaagggagtggagagggccaggttgcacatggtgcccaggcga

SEQ ID NO: 165770 - DNA, 75 bp, Artificial Sequence
  Synthetic
gcaaacgccgccaacgcgagctggccagcaaagtggcgtcaacggtgaacggcgctacgtcggccaacaaccacg

SEQ ID NO: 165771 - DNA, 75 bp, Artificial Sequence
  Synthetic
gcgaaccgccgtcgccggccgacgcgcgcccgcgcctcacgctgcacgacctgcacgacatcttccgcgagcacc

SEQ ID NO: 165772 - DNA, 75 bp, Artificial Sequence
  Synthetic
gcgcccgcgcctcacgctgcacgacctgcacgacatcttccgcgagcaccccgaactagagctcaagtacctcaa

SEQ ID NO: 165773 - DNA, 75 bp, Artificial Sequence
  Synthetic
cactgaacttgagcacaaaaatactgacaatggactggatatacagacttttatatgatccctgtacagatgtaa

SEQ ID NO: 165774 - DNA, 75 bp, Artificial Sequence
  Synthetic
ctgcctcgacatctcgccgtacggcaacgagcaggtctcgcgcatcgcctgcacctcgtgcgaggacaaccgcat

SEQ ID NO: 165775 - DNA, 75 bp, Artificial Sequence
  Synthetic
aacgagcaggtctcgcgcatcgcctgcacctcgtgcgaggacaaccgcatcctgcccaccgcctccgacgccatg

SEQ ID NO: 165776 - DNA, 75 bp, Artificial Sequence
  Synthetic
ctactcaagctctccaccaaccagccgcccatcttccaaatttattacctgctgcacgccgctaaccacgacatc

SEQ ID NO: 165777 - DNA, 75 bp, Artificial Sequence
  Synthetic
cgcccatcttccaaatttattacctgctgcacgccgctaaccacgacatcgtgccctttatgcacgccgaggacg

SEQ ID NO: 165778 - DNA, 75 bp, Artificial Sequence
  Synthetic
cggcggcgcgcgaagactacagcgtcacgctcaacatcgtgcgcgaccacgtcgttatcagcgtgctgtgtcacg

SEQ ID NO: 165779 - DNA, 75 bp, Artificial Sequence
  Synthetic
gtcgttatcagcgtgctgtgtcacgccgtctcggccagcagcgtcaagatcgacgtgactattttgcaacgcaag

SEQ ID NO: 165780 - DNA, 75 bp, Artificial Sequence
  Synthetic
caaagagctcattcaggagctgtgtcagtccagcggcaacaacctatacgaggaggccacgtcgtcctacgcaat

SEQ ID NO: 165781 - DNA, 75 bp, Artificial Sequence
  Synthetic
gcggcccctcctcctcgtcccagtccacgccgcctcatctccacccgccgtcgcaggcgacgcagccccaccact

SEQ ID NO: 165782 - DNA, 75 bp, Artificial Sequence
  Synthetic
ccaccgccgccgctgtttctcaacagcattcgtgcgccttgacactgtacggcagaaaagccggctccaagtgca

SEQ ID NO: 165783 - DNA, 75 bp, Artificial Sequence
  Synthetic
gcattcgtgcgccttgacactgtacggcagaaaagccggctccaagtgcaagcgccgcggcagcaccatgtgcaa

SEQ ID NO: 165784 - DNA, 75 bp, Artificial Sequence
  Synthetic
ctcaaagtacttgtcggcgtgaatgggcacgccgtgctcgcgcacgtagctcggatcttcggctacctcgtagtt

SEQ ID NO: 165785 - DNA, 75 bp, Artificial Sequence
  Synthetic
ggcacgccgtgctcgcgcacgtagctcggatcttcggctacctcgtagttgcacacggccgacggtggtttccgc

SEQ ID NO: 165786 - DNA, 75 bp, Artificial Sequence
  Synthetic
tgttccccgtgtccgccgcgaaaggcccccgtccccgccgcaaacgcccccgtctccgcaacgccccgtccctgc

SEQ ID NO: 165787 - DNA, 75 bp, Artificial Sequence
  Synthetic
ccatcaatcgcgtccgaccgggaaaccacgccggtggttacagaatcaccgttgtcggaggaaccctgcggcgcc

SEQ ID NO: 165788 - DNA, 75 bp, Artificial Sequence
  Synthetic
ccgcgtgtgcgtgtggtttgtggagtccccgtccccaacgtaatccccgtccccgccggcgccacccctgtcccc

SEQ ID NO: 165789 - DNA, 75 bp, Artificial Sequence
  Synthetic
gttgtcggaggaaccctgcggcgccgtccggacaccgggcgccgtcaggacgtaaaagacccgatccccgaccga

SEQ ID NO: 165790 - DNA, 75 bp, Artificial Sequence
  Synthetic
gatgtccttagaaagcaccgacgaaagcaccaggtcctcgacacgcacacggtgcaggtacagatcgtcgcgagc

SEQ ID NO: 165791 - DNA, 75 bp, Artificial Sequence
  Synthetic
cagaaaccgcgtggcacgccgtatttcttgacttcatcgagtgagaggcgcgacaggcgcacggctgcttccgag

SEQ ID NO: 165792 - DNA, 75 bp, Artificial Sequence
  Synthetic
acctcgcgatcctcaaagagcagcgagaggacgtcacgcgtgacgcccttgacgaactcgcaagccgtcttgcgc

SEQ ID NO: 165793 - DNA, 75 bp, Artificial Sequence
  Synthetic
agaggacgtcacgcgtgacgcccttgacgaactcgcaagccgtcttgcgcaccaaatccacgcccttcatgctca

SEQ ID NO: 165794 - DNA, 75 bp, Artificial Sequence
  Synthetic
gtcgcgggcgcggctgggtgggtgggtgtgtgccgggtgtgtcgcgggcgtgtgcccgcgagtccccccccccct

SEQ ID NO: 165795 - DNA, 75 bp, Artificial Sequence
  Synthetic
ctcagccctgtcccgcaccggcggcggtcggggtgtgtcgggggcgcggctgggtgggtgtgtgccgggtgtgtc

SEQ ID NO: 165796 - DNA, 75 bp, Artificial Sequence
  Synthetic
actccagcttgacgggctccacaaaaagacaggccgtcacgtagtgcgccaggctgggcccacgcgccaccagag

SEQ ID NO: 165797 - DNA, 75 bp, Artificial Sequence
  Synthetic
agggtgtgccgcgggtgtgtcgcgggcgtgtgtcgggtgtgtcggggtgtgtcgcgggcgtgtgccgggtgtgtc

SEQ ID NO: 165798 - DNA, 75 bp, Artificial Sequence
  Synthetic
cctgcggcgtcaggccacgaaagcggacaaacacgctgtccgtgtccccgtagatgacccgcgcctccacccgcc

SEQ ID NO: 165799 - DNA, 75 bp, Artificial Sequence
  Synthetic
ttcccactacatagtcttcctgattaaaaaaattgtgcaaaaaacacggctctgaaaagttgtctttgatgaacc

SEQ ID NO: 165800 - DNA, 75 bp, Artificial Sequence
  Synthetic
catgcattcgcgcacggcacggcgctgcgaaacccacttgttgagcagttccgaaagcaccgagacgcgcaccga

SEQ ID NO: 165801 - DNA, 75 bp, Artificial Sequence
  Synthetic
aacggcgtggtcgctgacgcgggttgtgttgctatatagtggacgtcggctcgacgtcggaggtgtccggcggcc

SEQ ID NO: 165802 - DNA, 75 bp, Artificial Sequence
  Synthetic
tcgacggcgcagattgcaagggcggcgacatctgaaacatagccgccacagaacccgcgtcgccgggcacggcgg

SEQ ID NO: 165803 - DNA, 75 bp, Artificial Sequence
  Synthetic
caacgagtactgctcagactacactgccctccaccgttaacagcaccgcaacgggagttacctctgactctcaac

SEQ ID NO: 165804 - DNA, 75 bp, Artificial Sequence
  Synthetic
cgacatctgaaacatagccgccacagaacccgcgtcgccgggcacggcggcggtagagatgatagcggcgttagg

SEQ ID NO: 165805 - DNA, 75 bp, Artificial Sequence
  Synthetic
ggcgcactcgtccagcagcgaggtgtagatacggatctgctgtccgtcaaagatgacacgccgcaacggaatttt

SEQ ID NO: 165806 - DNA, 75 bp, Artificial Sequence
  Synthetic
agatgacacgccgcaacggaattttagccagccgcgcgatggccccggcctcgtagtgaaaattaatggtgttga

SEQ ID NO: 165807 - DNA, 75 bp, Artificial Sequence
  Synthetic
gcgcggccctcggcattagccacgaaacaacgcgggatgtccttgtaggacaggtcatccttgcgttgccgcagg

SEQ ID NO: 165808 - DNA, 75 bp, Artificial Sequence
  Synthetic
aacaacgcgggatgtccttgtaggacaggtcatccttgcgttgccgcaggtaaagctcggccatagtgttgagct

SEQ ID NO: 165809 - DNA, 75 bp, Artificial Sequence
  Synthetic
cggaatcaccgccgtcgctttctccctcggagccggcagaggcggcgtccatgtcgcaccctctgagtgctgcgg

SEQ ID NO: 165810 - DNA, 75 bp, Artificial Sequence
  Synthetic
tggtggcggccgtgctggccggattgttgtgagaagccgagggaaaggcggcggcgtactgccgcttaaaaccca

SEQ ID NO: 165811 - DNA, 75 bp, Artificial Sequence
  Synthetic
gttgtgagaagccgagggaaaggcggcggcgtactgccgcttaaaacccacggcggggctgtgtaaaaagaaacg

SEQ ID NO: 165812 - DNA, 75 bp, Artificial Sequence
  Synthetic
gtacttcaagtcaaaagagttgatgttgtaaccggtcacaaaggccggcgcgtaccgttgaaagaaaagcataaa

SEQ ID NO: 165813 - DNA, 75 bp, Artificial Sequence
  Synthetic
gcccagcagcagctcgtattcggaagggaactcgtagacgtccacgtctgggcccacctgcccgcaggtgccgat

SEQ ID NO: 165814 - DNA, 75 bp, Artificial Sequence
  Synthetic
ttggcatatagccaataaagatagttgtggcaaagagccatgttatggattagtaatggaaagtatcgtcaccaa

SEQ ID NO: 165815 - DNA, 75 bp, Artificial Sequence
  Synthetic
agcattgtaatggtagtgtgtggctacattagaaaacgtgacgcgtcgcatgtcgcggcacaatctggcagcggg

SEQ ID NO: 165816 - DNA, 75 bp, Artificial Sequence
  Synthetic
gatcccctgatccacggcggtgtttccccccgtctcgtagcacacgcacgagatctgaatgacaatgtcatcgga

SEQ ID NO: 165817 - DNA, 75 bp, Artificial Sequence
  Synthetic
ccccccgtctcgtagcacacgcacgagatctgaatgacaatgtcatcggacttctcggcgcagggaaaaccaccc

SEQ ID NO: 165818 - DNA, 75 bp, Artificial Sequence
  Synthetic
aggtcagagacatcgcagtcgacctcgatatcacaagtcgacgcgcgaccctgctgccgccagtcgtaacgattc

SEQ ID NO: 165819 - DNA, 75 bp, Artificial Sequence
  Synthetic
cgatatcacaagtcgacgcgcgaccctgctgccgccagtcgtaacgattcacggagcaccagccgaacgtggtga

SEQ ID NO: 165820 - DNA, 75 bp, Artificial Sequence
  Synthetic
actcgccgatttttctggccatggtccagttgctgatagacacacactgcaaatcgggcacgggtcgcgtcccgt

SEQ ID NO: 165821 - DNA, 75 bp, Artificial Sequence
  Synthetic
ccagttgctgatagacacacactgcaaatcgggcacgggtcgcgtcccgtacccgtagatcgaggttttggtggc

SEQ ID NO: 165822 - DNA, 75 bp, Artificial Sequence
  Synthetic
cctatcggtgtcgctgtactcacagtaaaagtagctgcgctgcccgaaaacgttgacgcagatactgtagccgtg

SEQ ID NO: 165823 - DNA, 75 bp, Artificial Sequence
  Synthetic
cgttgacgcagatactgtagccgtgttctgtggccccgaagaaacgcaacacgttccccgaaggcaccagatgct

SEQ ID NO: 165824 - DNA, 75 bp, Artificial Sequence
  Synthetic
gaataggtcccaccacgcgacccaccagggtctcgcgccaaggacacggccaaaccatgtcatgactcaacaaat

SEQ ID NO: 165825 - DNA, 75 bp, Artificial Sequence
  Synthetic
cagggtctcgcgccaaggacacggccaaaccatgtcatgactcaacaaatgtttaatctctcgatagaacatgag

SEQ ID NO: 165826 - DNA, 75 bp, Artificial Sequence
  Synthetic
aaactgtttctgtggcggccgcttgcccgagccctgcgcggagccgggctgcgaacgctgacgccggccacccgc

SEQ ID NO: 165827 - DNA, 75 bp, Artificial Sequence
  Synthetic
cagtcggtctagtaggttgggcttctgtcccttgtcctgcgtgccagtctgtccgtccaaagaatctgtaccgtt

SEQ ID NO: 165828 - DNA, 75 bp, Artificial Sequence
  Synthetic
tgtcccttgtcctgcgtgccagtctgtccgtccaaagaatctgtaccgttctgctgcgctcgctgctctgcgtcc

SEQ ID NO: 165829 - DNA, 75 bp, Artificial Sequence
  Synthetic
gacggtggtcccggtcctttgcgaccagaattataaacactttcctcgtaggaaggcggagcctgtaacgacgtg

SEQ ID NO: 165830 - DNA, 75 bp, Artificial Sequence
  Synthetic
cagaattataaacactttcctcgtaggaaggcggagcctgtaacgacgtgtctttggtgctgcccgacgtcacgg

SEQ ID NO: 165831 - DNA, 75 bp, Artificial Sequence
  Synthetic
atggctacgccaacggcctttcccgcggcgcccaggccgctcatgaggtcgtccagacccttgaggtagggcggt

SEQ ID NO: 165832 - DNA, 75 bp, Artificial Sequence
  Synthetic
cggcgcccaggccgctcatgaggtcgtccagacccttgaggtagggcggtagcgggtcgactaccttgtcctcca

SEQ ID NO: 165833 - DNA, 75 bp, Artificial Sequence
  Synthetic
cggcgatgaagatcttgaggctgggaagctgacattcctcagtgcggtggttgcccaacaggatttcgttgtcct

SEQ ID NO: 165834 - DNA, 75 bp, Artificial Sequence
  Synthetic
aagctgacattcctcagtgcggtggttgcccaacaggatttcgttgtcctcgcccagttgaccgtactgcacgta

SEQ ID NO: 165835 - DNA, 75 bp, Artificial Sequence
  Synthetic
tggacaaatgagttgtattattgtcactcgtacttcttctggtcctatgagtgatattcagactggatcgattgg

SEQ ID NO: 165836 - DNA, 75 bp, Artificial Sequence
  Synthetic
gctggcaggtgacattcttctcgtcctgtatatcccaagagatcaccgagtcggcacgttcgagaaaagccacca

SEQ ID NO: 165837 - DNA, 75 bp, Artificial Sequence
  Synthetic
ccattccggcccccgtgctgggtccccgaggggcgggggggtgttttcggcgggggggtgcaatttggagttgcg

SEQ ID NO: 165838 - DNA, 75 bp, Artificial Sequence
  Synthetic
accgtcacgtaacgggtactgtgggtgttggaataatcgtcgggcattaattgcatggttttgttttcatagctg

SEQ ID NO: 165839 - DNA, 75 bp, Artificial Sequence
  Synthetic
tttgctgctggtgctagtagggacttttgtgctgctggtcatattcgtagcgtcgctgaggtctatctgaaacag

SEQ ID NO: 165840 - DNA, 75 bp, Artificial Sequence
  Synthetic
ccttttggtagacccgtaccttaaaggtgtgcgcgacgatgttgcgtttgtagaccaccatgatgccctcgtcca

SEQ ID NO: 165841 - DNA, 75 bp, Artificial Sequence
  Synthetic
ggtgtgcgcgacgatgttgcgtttgtagaccaccatgatgccctcgtccaggtcttcattgatgggcttcatcgg

SEQ ID NO: 165842 - DNA, 75 bp, Artificial Sequence
  Synthetic
cgaataagatccgtaccctgggccatagaacacacgcgataggggtacttggtggtgttgacccccaccacatct

SEQ ID NO: 165843 - DNA, 75 bp, Artificial Sequence
  Synthetic
cacccagacagacgatacacaagttaacgcagactaccaggcaccagatcctggattccatgttcgtcgcgggcc

SEQ ID NO: 165844 - DNA, 75 bp, Artificial Sequence
  Synthetic
ggcgctcgggggttggcggcggggccgggcacgggggccttttgcggcgtttccacgcagcttttgcgcggcgct

SEQ ID NO: 165845 - DNA, 75 bp, Artificial Sequence
  Synthetic
agggtggagggcttggccacgggagctgttggcacgtcgccactctcatccggtctggacagatgcctgtagagg

SEQ ID NO: 165846 - DNA, 75 bp, Artificial Sequence
  Synthetic
ctgttggcacgtcgccactctcatccggtctggacagatgcctgtagaggaggagatatagatctttggacttat

SEQ ID NO: 165847 - DNA, 75 bp, Artificial Sequence
  Synthetic
gacagggggtgacgttggggacggggagctttggcgctggggacggggagctgtcgcgctggcgacagggagctt

SEQ ID NO: 165848 - DNA, 75 bp, Artificial Sequence
  Synthetic
gttcgtcgcgcaggcacgcgatcgagagttgtttcccgaaagtttcattatatagtgcgacggagagcacgagct

SEQ ID NO: 165849 - DNA, 75 bp, Artificial Sequence
  Synthetic
gagttgtttcccgaaagtttcattatatagtgcgacggagagcacgagctcccgcacgtgcatccacatctcctt

SEQ ID NO: 165850 - DNA, 75 bp, Artificial Sequence
  Synthetic
atacacggtaccttccgcgcatttgaccaaatcgtccttgacatggggtagtacgcccgcgttgtcgcaggcata

SEQ ID NO: 165851 - DNA, 75 bp, Artificial Sequence
  Synthetic
accaaatcgtccttgacatggggtagtacgcccgcgttgtcgcaggcataggccatgtccacattgtgagagagg

SEQ ID NO: 165852 - DNA, 75 bp, Artificial Sequence
  Synthetic
gattccacaggcagactcttgtggatcaggttattgaccacatacaggtgctcatcgtacgtgaactgatccccc

SEQ ID NO: 165853 - DNA, 75 bp, Artificial Sequence
  Synthetic
acgtccaccacgtcttggtcctggtggtattggctgcggtatagaaacccattcatgagcttagagataaagtcc

SEQ ID NO: 165854 - DNA, 75 bp, Artificial Sequence
  Synthetic
actttgccatagcccacctccgagaccttctgcaggtaggcgcgtttgcgcacgttcacctcgcgggtgacgttg

SEQ ID NO: 165855 - DNA, 75 bp, Artificial Sequence
  Synthetic
ttccccggggaacgacggcagcgcgggtccctggggacacacgaagcacgacgcggaaaagaggaagtcccaggg

SEQ ID NO: 165856 - DNA, 75 bp, Artificial Sequence
  Synthetic
catcaaagtcgtacccgtccccgacatcgcctcccgtccacgcaggtgaatagcctcgccctcggggccgtcgcc

SEQ ID NO: 165857 - DNA, 75 bp, Artificial Sequence
  Synthetic
atcgcctcccgtccacgcaggtgaatagcctcgccctcggggccgtcgccccccgtgccatctggcagcggacgt

SEQ ID NO: 165858 - DNA, 75 bp, Artificial Sequence
  Synthetic
tcctcgaaagcttgaatgctgagggatgtgatgaggtcgatgatcctgttgggggcggcaaagaccgaccccacg

SEQ ID NO: 165859 - DNA, 75 bp, Artificial Sequence
  Synthetic
atgtgatgaggtcgatgatcctgttgggggcggcaaagaccgaccccacgaacatgcgctcctccccgtccaacg

SEQ ID NO: 165860 - DNA, 75 bp, Artificial Sequence
  Synthetic
ttagcgatgtccgcggggacgctacgtttcaccgtgacggtgagaatttgaccgtcgttttgtacttcatgaggc

SEQ ID NO: 165861 - DNA, 75 bp, Artificial Sequence
  Synthetic
gacacagctggtgatacacatttagctgctggatggtgatgcccacccgcttgacgataacctccgaggtacggg

SEQ ID NO: 165862 - DNA, 75 bp, Artificial Sequence
  Synthetic
ctgctggatggtgatgcccacccgcttgacgataacctccgaggtacgggaccagtaggtaaaatccgacaagga

SEQ ID NO: 165863 - DNA, 75 bp, Artificial Sequence
  Synthetic
gtaggccgatgaagaagagaataggcttttgagggccgaaaggactccagccaagtgggggatgcgcgttgtcag

SEQ ID NO: 165864 - DNA, 75 bp, Artificial Sequence
  Synthetic
cttttgagggccgaaaggactccagccaagtgggggatgcgcgttgtcaggtccagcagatcctgctccaccgtc

SEQ ID NO: 165865 - DNA, 75 bp, Artificial Sequence
  Synthetic
aatccgacgacgagtcgtcggcgtcttcctcgggcgaagcgccagagcaacaggtccccgcttggaagaccgtgc

SEQ ID NO: 165866 - DNA, 75 bp, Artificial Sequence
  Synthetic
ttcagcgagcggccctgattcgggatgatggtcagctcctcgtagcactgggcgcatgtcgtcccttcgacgtac

SEQ ID NO: 165867 - DNA, 75 bp, Artificial Sequence
  Synthetic
tgatggtcagctcctcgtagcactgggcgcatgtcgtcccttcgacgtacacttcctgacgcgccaccggcgaga

SEQ ID NO: 165868 - DNA, 75 bp, Artificial Sequence
  Synthetic
ctggagaccgggctgcgggacggggggtgtgcgggacggcgctggtgccggggcgttgcgggtacgggggttacg

SEQ ID NO: 165869 - DNA, 75 bp, Artificial Sequence
  Synthetic
acacgtagttcattttgcacaggaagcgctcgatgtcgttgagtgtggccagactgacgctgaaacggacgttgt

SEQ ID NO: 165870 - DNA, 75 bp, Artificial Sequence
  Synthetic
agactgacgctgaaacggacgttgtccgtaaactggagctccacggtgtgatggcgatcgcagcgatccaaacgg

SEQ ID NO: 165871 - DNA, 75 bp, Artificial Sequence
  Synthetic
tcctcgtgcagcgccttcagcagcatctccagatagagcgtcagcagcgaactctgcgtacgattctgcgccacc

SEQ ID NO: 165872 - DNA, 75 bp, Artificial Sequence
  Synthetic
tctccagatagagcgtcagcagcgaactctgcgtacgattctgcgccaccacctccgggtagatcttccggtaca

SEQ ID NO: 165873 - DNA, 75 bp, Artificial Sequence
  Synthetic
gacactccagctccatggcgtattcgttgcatttcgaacacactacgcatagtttctgtaacaaattcatctcca

SEQ ID NO: 165874 - DNA, 75 bp, Artificial Sequence
  Synthetic
cataaaatatgccatataaaggatcgtgtaaaccattagtgcatgggcaacgtagttccgtactttgtacttcat

SEQ ID NO: 165875 - DNA, 75 bp, Artificial Sequence
  Synthetic
tgactcgactcgctcacgtacgagacgctgtcgtccggtctggcgccggccagagacatggagtcggtgcacaaa

SEQ ID NO: 165876 - DNA, 75 bp, Artificial Sequence
  Synthetic
gctcccgaagctgttgccgccgcttgcggcgcaacctcctccaccaccgccgccgccggctcctccacctcgggc

SEQ ID NO: 165877 - DNA, 75 bp, Artificial Sequence
  Synthetic
gacgggggctcggagatgaccggctgtgtctgacactcctccccttcctcaggcggcccgggcgccgacgcgaat

SEQ ID NO: 165878 - DNA, 75 bp, Artificial Sequence
  Synthetic
atgtgaacaacttgaaacacagactgtgttattaatgaccgttgtaccattactagtcacattgcataaagatcc

SEQ ID NO: 165879 - DNA, 75 bp, Artificial Sequence
  Synthetic
tgatgatgcgacgccgtctgtcgccgctgttgcggcggtagctgatacggtgtcgcctggtgctgctgtgtcggt

SEQ ID NO: 165880 - DNA, 75 bp, Artificial Sequence
  Synthetic
agaagaggtgttcctcctcttgaaccgctgccatgggccactgtcaacgccgaaaaacgcttgtctggctgaggt

SEQ ID NO: 165881 - DNA, 75 bp, Artificial Sequence
  Synthetic
gctcgtggctgcggcggccgttgtcgcggcgtttgctggcggttacaaccggctgcgtttggccggcaataaccc

SEQ ID NO: 165882 - DNA, 75 bp, Artificial Sequence
  Synthetic
gcggcgtttgctggcggttacaaccggctgcgtttggccggcaataacccgctgcccccgccgcccccgctgctc

SEQ ID NO: 165883 - DNA, 75 bp, Artificial Sequence
  Synthetic
ccgccgacgccgccagcctcgtcttcgccggcgttcacgagaaagcagccacctcccgtctcgccgggcacgccg

SEQ ID NO: 165884 - DNA, 75 bp, Artificial Sequence
  Synthetic
gtgctaatgcgtaggcgaaggccatttctaccgtgcggcggtccagcatctgacatcgaccgcttttgagtacat

SEQ ID NO: 165885 - DNA, 75 bp, Artificial Sequence
  Synthetic
ccactgggcgcgaagagcgccgacaggtcgtgcacctcccccccggcggcgtccgttaatcgctgggcgtcggcg

SEQ ID NO: 165886 - DNA, 75 bp, Artificial Sequence
  Synthetic
gtccgttaatcgctgggcgtcggcgtccagcacgcgtcgcaagttctccagcgaaaagtcctccacgccctgctc

SEQ ID NO: 165887 - DNA, 75 bp, Artificial Sequence
  Synthetic
tttactgaccgcgccatacttcgtatacgaacctaaccggcgtaaagtgttttccgatatataaactggcgccta

SEQ ID NO: 165888 - DNA, 75 bp, Artificial Sequence
  Synthetic
ggacgcggggatctcctcgcgcacgctcagaatctcgtacacggccatcacttcggggtcgcaatccaagttctc

SEQ ID NO: 165889 - DNA, 75 bp, Artificial Sequence
  Synthetic
ctcagaatctcgtacacggccatcacttcggggtcgcaatccaagttctcggcgtccagcgccagcatgacgcgg

SEQ ID NO: 165890 - DNA, 75 bp, Artificial Sequence
  Synthetic
gccaagaggtagcgctggcgcatgaaacgataatcttggccgctcatagagctcacgttaaggctgcgttctaca

SEQ ID NO: 165891 - DNA, 75 bp, Artificial Sequence
  Synthetic
ccgttgcccgaaaagtagccgatctgcccaaactgatagatctccttgctgttgttgatacccgcatatttttcc

SEQ ID NO: 165892 - DNA, 75 bp, Artificial Sequence
  Synthetic
cagggtagagtcccgttttttttcctgtccatattgtttagcaattcgtaaactgtcagtctagccgcgtccgtt

SEQ ID NO: 165893 - DNA, 75 bp, Artificial Sequence
  Synthetic
aacgatgctcaaaaacgctccgtaccaacgattcacgcgccacagtggcggccatgggcgccggcacgcctgcgg

SEQ ID NO: 165894 - DNA, 75 bp, Artificial Sequence
  Synthetic
gccatgggcgccggcacgcctgcggtcttcaagcccttgacatgcaacgcaaattcggcgggcgacgagaaacgc

SEQ ID NO: 165895 - DNA, 75 bp, Artificial Sequence
  Synthetic
cataaaaggcatatacacgaattactagttacacgtttatctatgtgcgagtttaaggacacttgtataatgcgt

SEQ ID NO: 165896 - DNA, 75 bp, Artificial Sequence
  Synthetic
tagttacacgtttatctatgtgcgagtttaaggacacttgtataatgcgtatgacggcaaacggccgcggaaacg

SEQ ID NO: 165897 - DNA, 75 bp, Artificial Sequence
  Synthetic
ccgatgtagtctttgaagccgtagtagcagaggaatttgttatggaaacggctttccacgtaactcagcacacag

SEQ ID NO: 165898 - DNA, 75 bp, Artificial Sequence
  Synthetic
agcagaggaatttgttatggaaacggctttccacgtaactcagcacacagtctggcgccacatccagcagatcgt

SEQ ID NO: 165899 - DNA, 75 bp, Artificial Sequence
  Synthetic
tccaacaccgccggtacctttcaaccgcgtgccagtcaatattcagtttcttcgtgaaaacccgccacccatcgc

SEQ ID NO: 165900 - DNA, 75 bp, Artificial Sequence
  Synthetic
cattcttgggcaacgcgttggaacagaccttctgccaaaactgtaagcaggggagaccacattcaggaaagagtc

SEQ ID NO: 165901 - DNA, 75 bp, Artificial Sequence
  Synthetic
gggagaccacattcaggaaagagtcgctcgtgatgtcgatacagcagaaatcccaagcagcccttagccggatta

SEQ ID NO: 165902 - DNA, 75 bp, Artificial Sequence
  Synthetic
gctagagacgggtttgtttctgtgctagcccaacggcacttgtacaatccatgcaaccagaaaaaggatgcgaaa

SEQ ID NO: 165903 - DNA, 75 bp, Artificial Sequence
  Synthetic
gcccgcgcggtagatgggtcggtttttcacccgcaccatgatcaacgtgggtaccgacagccgcgagagcttgat

SEQ ID NO: 165904 - DNA, 75 bp, Artificial Sequence
  Synthetic
gtaccgacagccgcgagagcttgatctccatgggcaccacggcgtacgtgccctgcgcgtacagcctaaagtcca

SEQ ID NO: 165905 - DNA, 75 bp, Artificial Sequence
  Synthetic
tggagaacgcgccgtgaatggattgaaaatgctgcgtcatccatttggataccaagttggtggtcaacggattgt

SEQ ID NO: 165906 - DNA, 75 bp, Artificial Sequence
  Synthetic
aaaatgctgcgtcatccatttggataccaagttggtggtcaacggattgtccacaatgtatgaggtagcggtaat

SEQ ID NO: 165907 - DNA, 75 bp, Artificial Sequence
  Synthetic
gtagggattcagatccaggttgaaggcctgcgtggcgcccgccacctcgtcgcggctgctcttgaggcgcacctc

SEQ ID NO: 165908 - DNA, 75 bp, Artificial Sequence
  Synthetic
gcctgcgtggcgcccgccacctcgtcgcggctgctcttgaggcgcacctccgaaacgaaacccagggcctcgtcg

SEQ ID NO: 165909 - DNA, 75 bp, Artificial Sequence
  Synthetic
gtcacggggtcgatgagccgcatcttgcggcagtaatccaaaatgcgattgagccgataggtacggtccacgcta

SEQ ID NO: 165910 - DNA, 75 bp, Artificial Sequence
  Synthetic
gagccgataggtacggtccacgctagcgcccagcatgcgaccgccgcgccccatcattcccccggaatccccgcc

SEQ ID NO: 165911 - DNA, 75 bp, Artificial Sequence
  Synthetic
cgtcccgtccaccacccccgccagcaccgccgcccggaaccccgtcgtcacctttgccgtccaaacccccgtcct

SEQ ID NO: 165912 - DNA, 75 bp, Artificial Sequence
  Synthetic
cctttgccgtccaaacccccgtccttggcgtcgacgttgtaacgccgaccgaagctgcccaaaatatccacgtcg

SEQ ID NO: 165913 - DNA, 75 bp, Artificial Sequence
  Synthetic
cttgggcaccacgggcaagcgggtgcgcacccgcacgaaggccgtctgataacacgtgtggcaacaagtaccccc

SEQ ID NO: 165914 - DNA, 75 bp, Artificial Sequence
  Synthetic
cgcacccgcacgaaggccgtctgataacacgtgtggcaacaagtacccccacaggcctcgcacagccccgcggcg

SEQ ID NO: 165915 - DNA, 75 bp, Artificial Sequence
  Synthetic
cagacgaagcccgaaactagctgcggacacgtgccacacaccaacgccaaatgctgcggcccatagcgttcgtcc

SEQ ID NO: 165916 - DNA, 75 bp, Artificial Sequence
  Synthetic
gacacgtgccacacaccaacgccaaatgctgcggcccatagcgttcgtccttaagcggcgcgccttgaaacttga

SEQ ID NO: 165917 - DNA, 75 bp, Artificial Sequence
  Synthetic
ccaccaccagcatggcgcgcggcacggtccccgacgccgccggacccaccatcaccgtcggcgccgccgctgctg

SEQ ID NO: 165918 - DNA, 75 bp, Artificial Sequence
  Synthetic
acgtctcctgactggccgtaccgccggcgctgggatgccgcgccgacgactggagatacaccagcctgtgctggt

SEQ ID NO: 165919 - DNA, 75 bp, Artificial Sequence
  Synthetic
ggcgctgggatgccgcgccgacgactggagatacaccagcctgtgctggtagagcaccgaattagcgctgaagac

SEQ ID NO: 165920 - DNA, 75 bp, Artificial Sequence
  Synthetic
gttggtcactaaaggccactcggaaaagagcatagactcggcaggttggtaggccgaatcgaaaaataccgaggc

SEQ ID NO: 165921 - DNA, 75 bp, Artificial Sequence
  Synthetic
aagagcatagactcggcaggttggtaggccgaatcgaaaaataccgaggcaaaactgaaggccaactcgcaaacc

SEQ ID NO: 165922 - DNA, 75 bp, Artificial Sequence
  Synthetic
cagaaaatacccacctgacatgtaagtgcagtccgaataccacatctaataccaacaatggcagcaagtgccacg

SEQ ID NO: 165923 - DNA, 75 bp, Artificial Sequence
  Synthetic
tgtggcgccagcttcaccgactgctgactgtcgtgcacaaactgccgcaacgccgcctcgatcagcacacgcggc

SEQ ID NO: 165924 - DNA, 75 bp, Artificial Sequence
  Synthetic
gactgtcgtgcacaaactgccgcaacgccgcctcgatcagcacacgcggctccgagaagcgcagcgattgacacc

SEQ ID NO: 165925 - DNA, 75 bp, Artificial Sequence
  Synthetic
tgcgcgcatccagcgagacctcgtcggcttcggcgtcaaactgcagcgaattaaagagcgtaggcgggtacaacg

SEQ ID NO: 165926 - DNA, 75 bp, Artificial Sequence
  Synthetic
ttaaagagcgtaggcgggtacaacggcacgcgcaccgcctcgccgccgtgcagtcgcaccgtggtcgcctcctcc

SEQ ID NO: 165927 - DNA, 75 bp, Artificial Sequence
  Synthetic
gacgcctgacagcccaccgccgcgcacaacgccgccagatcggtaggcacgcgatccgcctcgggcgtgtaggcc

SEQ ID NO: 165928 - DNA, 75 bp, Artificial Sequence
  Synthetic
cctcgcacagccgatgcacgtctccgtgatcctcggtaaaagccacgatgccttgcgtatgatgaaagtagagcg

SEQ ID NO: 165929 - DNA, 75 bp, Artificial Sequence
  Synthetic
cgaaatccgcctccaccgtgagccccgccaacagaggagcgatcaccacgctcgaggaacggtcgcatagcgaga

SEQ ID NO: 165930 - DNA, 75 bp, Artificial Sequence
  Synthetic
cgccaacagaggagcgatcaccacgctcgaggaacggtcgcatagcgagagagtggccagaatctcctgcgtttc

SEQ ID NO: 165931 - DNA, 75 bp, Artificial Sequence
  Synthetic
ggtggatgaacggaagacaatggctacgccgccactgagtgaattttataccaaggaaaagttcagcacgtcatg

SEQ ID NO: 165932 - DNA, 75 bp, Artificial Sequence
  Synthetic
acgccgccactgagtgaattttataccaaggaaaagttcagcacgtcatgtttgacgcacgacgtctgatacacc

SEQ ID NO: 165933 - DNA, 75 bp, Artificial Sequence
  Synthetic
taagaaaagctaaccgttacggtcgggcagcctctcgcagccagaccgctagccgacgcacccgcccgcgaaaat

SEQ ID NO: 165934 - DNA, 75 bp, Artificial Sequence
  Synthetic
ggcagcctctcgcagccagaccgctagccgacgcacccgcccgcgaaaatagcgtgatgttcgggacggcttcgc

SEQ ID NO: 165935 - DNA, 75 bp, Artificial Sequence
  Synthetic
cactcagtcgcacaagcagcacataaaaaccccacacagggcacgtgaaaacaacgtccctagaaaacggtgttt

SEQ ID NO: 165936 - DNA, 75 bp, Artificial Sequence
  Synthetic
cacctgacggtttacaagcagaaacaccgcaccacggtggtacaagcgcggtggatctggtctcgcaacctcaat

SEQ ID NO: 165937 - DNA, 75 bp, Artificial Sequence
  Synthetic
caaaccgcgtaacgtggtttcccgaacacgtacgcggcacagacccccgacacgtactcgaagaccttacagttt

SEQ ID NO: 165938 - DNA, 75 bp, Artificial Sequence
  Synthetic
acacgtacgcggcacagacccccgacacgtactcgaagaccttacagtttacgagtcaataaaacaggaaaagat

SEQ ID NO: 165939 - DNA, 75 bp, Artificial Sequence
  Synthetic
gggggggggtcgaggaccccggggcacactgcttccatccagccgcgcacaccgcacccctgacacaccccgcca

SEQ ID NO: 165940 - DNA, 75 bp, Artificial Sequence
  Synthetic
aaagtaactttcgcccattgccatgaaacaccgtgatggggaacggtgttgtgtgtcgactgacgtcactacggc

SEQ ID NO: 165941 - DNA, 75 bp, Artificial Sequence
  Synthetic
aaacaccgtgatggggaacggtgttgtgtgtcgactgacgtcactacggcgatcagtatcgacgtcgtgtataca

SEQ ID NO: 165942 - DNA, 75 bp, Artificial Sequence
  Synthetic
aatgcggaagccagcgtgtaatcataacggggttttgggtacaatctgacgacatctggcggcgagcgtacacca

SEQ ID NO: 165943 - DNA, 75 bp, Artificial Sequence
  Synthetic
ggaagcgagacccgtagaaccgcccaagaggcggtgccagatgccaacgtcataatcacaaggtgatttgttacg

SEQ ID NO: 165944 - DNA, 75 bp, Artificial Sequence
  Synthetic
ttgtacggaaatttcagataggtggaacccgttagggttccaccgtcctcggtgtacgtacaggcttctccgtct

SEQ ID NO: 165945 - DNA, 75 bp, Artificial Sequence
  Synthetic
ccttacttagggtatccgcccctttcctctgttttggcctagtaaacttaacgccgccgcttctcacgtgacccc

SEQ ID NO: 165946 - DNA, 75 bp, Artificial Sequence
  Synthetic
acgccgccgcttctcacgtgacccctgacaagcctacgtcacactcgcgtgaccacacccactccggatatacgt

SEQ ID NO: 165947 - DNA, 75 bp, Artificial Sequence
  Synthetic
acggccgcgaggtacggcacaacccgcgtcgaggacagacgcagaagaagcgtccggccgaggggaggggggggg

SEQ ID NO: 165948 - DNA, 75 bp, Artificial Sequence
  Synthetic
ggcggaaatcatctctgatgacgtagcgagcgaagcgagctacgtcatcagtccgttttacgtataccggatgct

SEQ ID NO: 165949 - DNA, 75 bp, Artificial Sequence
  Synthetic
ccgagcgcgcacccacctaggtggacgcccgacatccattccgggccgtgtggtgggtccccgaggggcgggggg

SEQ ID NO: 165950 - DNA, 75 bp, Artificial Sequence
  Synthetic
aggcgacgccccgtaggggcggagcctagcttccacccctaggatgcataccctatatagcataattcttctaac

SEQ ID NO: 165951 - DNA, 75 bp, Artificial Sequence
  Synthetic
cggcgaaaagaagacgcgtgtctgtgtctgtctgtgattccccggggaaaagaggaagtccccaggggacggcag

SEQ ID NO: 165952 - DNA, 75 bp, Artificial Sequence
  Synthetic
cacgaattactagttacacgtttgtctatgtgcgagtttaaggacacttgtataatgcgtatgacggcaaaaggc

SEQ ID NO: 165953 - DNA, 75 bp, Artificial Sequence
  Synthetic
cggaaccggggggggcaaatttttaccaaatttgggcaaccatgatttccaatgggacggcgtttccgtgcgcat

SEQ ID NO: 165954 - DNA, 75 bp, Artificial Sequence
  Synthetic
gcggtctccgtcgtttcgccagtacgacgctgtggacggggtttcgccgcgctccgggatctctgtactggtgtc

SEQ ID NO: 165955 - DNA, 75 bp, Artificial Sequence
  Synthetic
gccccggtgcgcatgcgcgggccagggcccgcgggagggtcgccctgcgcatgcgccggtaaaattccactgtgt

SEQ ID NO: 165956 - DNA, 75 bp, Artificial Sequence
  Synthetic
gcgtgctggggacgtgttgcgggaccggactgagggacggggggtgtgcgctggggccgggggttgcgggaacgg

SEQ ID NO: 165957 - DNA, 75 bp, Artificial Sequence
  Synthetic
tgcgccgtgcgcatgcgccggtatttttccactgggcggccgcacctagggagcgcgagccccgtgccgggcatg

SEQ ID NO: 165958 - DNA, 75 bp, Artificial Sequence
  Synthetic
cacagatggagctcgacgccgcagactacgctgcttgcgcacaggcccgccaacacctctacgctcaaacacaac

SEQ ID NO: 165959 - DNA, 75 bp, Artificial Sequence
  Synthetic
atctctctcatgatcttcaacagttacgccacaacggcctggtccacggaatgtaaacacctcacactgcgacgc

SEQ ID NO: 165960 - DNA, 75 bp, Artificial Sequence
  Synthetic
ggggggacccgagcgggggcttcccacccccaccccgctcctccccgggctccggcccgggatccctcgctgctc

SEQ ID NO: 165961 - DNA, 75 bp, Artificial Sequence
  Synthetic
tccggcccgggatccctcgctgctcccggcgacctccgccggcttcccggtccacccgccgcggaacggacggga

SEQ ID NO: 165962 - DNA, 75 bp, Artificial Sequence
  Synthetic
ccggcgacctccgccggcttcccggtccacccgccgcggaacggacgggacccggggtccgcgcccttcccctcc

SEQ ID NO: 165963 - DNA, 75 bp, Artificial Sequence
  Synthetic
tgatattcataggtaggtatattgtttgtgaggttacaggtgtgattttcttgtaaactcgtttttacccacctt

SEQ ID NO: 165964 - DNA, 75 bp, Artificial Sequence
  Synthetic
ccggaaggttgggggctgggggcccggtcaggagctccgggagcggggtcgaccgcgacggcttccgggtctcgc

SEQ ID NO: 165965 - DNA, 75 bp, Artificial Sequence
  Synthetic
cccatcggccgcccagccggggtcggcgcctcggaccccaccaggctgtggcgtgtgtgctggccgatgcggcgg

SEQ ID NO: 165966 - DNA, 75 bp, Artificial Sequence
  Synthetic
agcgattacccaggtggagcacaatcacatagctgatggacgttggttgatccgttgattcccatggacatttta

SEQ ID NO: 165967 - DNA, 75 bp, Artificial Sequence
  Synthetic
cccggcacgaacgcacgtccccgtgggctccacgcgttttccaccctttcctggaggggtccggaacaccgtgaa

SEQ ID NO: 165968 - DNA, 75 bp, Artificial Sequence
  Synthetic
caatacgacggcagggcgtgattttctcccccatccgacaaaaccgtgtcccttaaaattccccacctttctctg

SEQ ID NO: 165969 - DNA, 75 bp, Artificial Sequence
  Synthetic
gttctctcgctcgtcatgccgttctgagctccgacatggcggacgagagaaaatggcgtcgagagcctaggagcg

SEQ ID NO: 165970 - DNA, 75 bp, Artificial Sequence
  Synthetic
aaatggcgtcgagagcctaggagcgttttcgctccaggtgggtaaaaaaatagcacgataacttttctgtgcttt

SEQ ID NO: 165971 - DNA, 75 bp, Artificial Sequence
  Synthetic
taccccctggccgaggcgagtccgcggtcgccgcctgttccgtgatgctacctagagggcgctgtcgaggcgact

SEQ ID NO: 165972 - DNA, 75 bp, Artificial Sequence
  Synthetic
acggtcgctgacgtcaaaccatctcgtgctcgctgagtcacatccggttgttgacaagcgatggaggaccgcacc

SEQ ID NO: 165973 - DNA, 75 bp, Artificial Sequence
  Synthetic
aatacagaatgatgacaagttcatccaacacaaccgctcaacaacgccatatctatcagtgtccaaaaactatct

SEQ ID NO: 165974 - DNA, 75 bp, Artificial Sequence
  Synthetic
caacacaaccgctcaacaacgccatatctatcagtgtccaaaaactatcttctatcctttgaaactataaatgct

SEQ ID NO: 165975 - DNA, 75 bp, Artificial Sequence
  Synthetic
ttttgtttccttctccgcgaccaaatgctaacgcccgcggtctttccggccgtgctctacctcctggcgcttgtc

SEQ ID NO: 165976 - DNA, 75 bp, Artificial Sequence
  Synthetic
tcgtctatatcgtgctagatatattcagataagacgcgcaaaccatagatttctcatcagtatcatgaaagacct

SEQ ID NO: 165977 - DNA, 75 bp, Artificial Sequence
  Synthetic
ggcgaaaagcagccgcgcgcctgtcctgcgtgtctttgatgttgcgtgtctttgaatccccggggaaaagaggag

SEQ ID NO: 165978 - DNA, 75 bp, Artificial Sequence
  Synthetic
ttttaggacagccgccggagaagccgacgagggatcgggcgggtgcagccagaacctcacgcccgatcccgcctc

SEQ ID NO: 165979 - DNA, 75 bp, Artificial Sequence
  Synthetic
gaagtccccgaggacagtccgcaaaagaggaagctgcagacccgcgtcgaggacacacgcagaagaggcgacggc

SEQ ID NO: 165980 - DNA, 75 bp, Artificial Sequence
  Synthetic
tacaccgaactgtcgctgttgtataagaagaaaaaactctccatatttatatcgtctgaatttttgcttgataga

SEQ ID NO: 165981 - DNA, 75 bp, Artificial Sequence
  Synthetic
tatgtgtttctcaaaagatcttgaggtgtttgaaaacgggggaaacctgcgtttgggtgcgctaaggcccggact

SEQ ID NO: 165982 - DNA, 75 bp, Artificial Sequence
  Synthetic
tatatgatgaaccaagaataaaactctagctctcgtctatttttaatatgctctacttagaacctttttaatgac

SEQ ID NO: 165983 - DNA, 75 bp, Artificial Sequence
  Synthetic
cggcgccggtgcgggacagggctcggggaggtttcagggacgtaagcgccagcgcgccgaccgggctgagggagt

SEQ ID NO: 165984 - DNA, 75 bp, Artificial Sequence
  Synthetic
tttgcgctgaggcagctagggccgggggttgcgctggggacggggtgttgattgcggcggggacttgcgaggacg

SEQ ID NO: 165985 - DNA, 75 bp, Artificial Sequence
  Synthetic
tttatatagtttctctgcactaacctttaaaaccgtatccttccctgttgtacaaatcatcttttgatacacaat

SEQ ID NO: 165986 - DNA, 75 bp, Artificial Sequence
  Synthetic
atggtggatcagcgttgccatcgtcatcttcatcggagtctgtctggtggccctgatgtactttacgcagcagca

SEQ ID NO: 165987 - DNA, 75 bp, Artificial Sequence
  Synthetic
tcccgtatctggagatatatgttgaccaccaccgccatgaccaccaaaaagctagccgtcacgactagaaatgtg

SEQ ID NO: 165988 - DNA, 75 bp, Artificial Sequence
  Synthetic
taggattcggactttccgttcgagaagagaccgcgtctctggacgctctttttgtcggtctgaatcgacccggga

SEQ ID NO: 165989 - DNA, 75 bp, Artificial Sequence
  Synthetic
actgccgcgacaggcacaagtggacaccgccatctgccaccacacatggcccatgtgctccgacgtcccgcatcc

SEQ ID NO: 165990 - DNA, 75 bp, Artificial Sequence
  Synthetic
aaaacgcaccatcgacaccacaccctcatgagcaccacctgtcggtgttggtcgtcctccatcgttctctacgaa

SEQ ID NO: 165991 - DNA, 75 bp, Artificial Sequence
  Synthetic
tcatgagcaccacctgtcggtgttggtcgtcctccatcgttctctacgaacatctcgacgcccgggtgacggacg

SEQ ID NO: 165992 - DNA, 75 bp, Artificial Sequence
  Synthetic
caggccagaggctaagccgaaaccgtccggggaagcgggcgcgagttttccgacttagtctctggtgctcgttga

SEQ ID NO: 165993 - DNA, 75 bp, Artificial Sequence
  Synthetic
gaagaatcaccgtcacagccctatgacgcgaaatcaattgctagaacataaacgttctcaacaggtatgaaatga

SEQ ID NO: 165994 - DNA, 75 bp, Artificial Sequence
  Synthetic
gaaatttgtaggataaaaagtgtcgttgtatgatgcacaacgatcgtgaaactggagactgtagctctctaccga

SEQ ID NO: 165995 - DNA, 75 bp, Artificial Sequence
  Synthetic
ttgtatgatgcacaacgatcgtgaaactggagactgtagctctctaccgaatgcaaatacacaaatgacatcgat

SEQ ID NO: 165996 - DNA, 75 bp, Artificial Sequence
  Synthetic
gtattcagtttcctcatatccataacctggattttatcattaaaccccaatattaaacacttttttagtaccccc

SEQ ID NO: 165997 - DNA, 75 bp, Artificial Sequence
  Synthetic
ctcgctcgtcgtgcctcttcccccctccgggagaggggacgtcggggccctccgtcgcaccgggccgaagccagt

SEQ ID NO: 165998 - DNA, 75 bp, Artificial Sequence
  Synthetic
gaaatgtttactacactgtcatcagaatatatgatgtatattatttcctccaaactcctcaccatagccaccaat

SEQ ID NO: 165999 - DNA, 75 bp, Artificial Sequence
  Synthetic
tgtacatgtgcagaaaaatgtgtaaatacgtgttatttatcccatgcgtcttgtacatagatatatgtttttata

SEQ ID NO: 166000 - DNA, 75 bp, Artificial Sequence
  Synthetic
ttttgcataaccatagacagtcaaggattttaatgatttgctcatccgcctttgagccatcgcttaggagttagt

SEQ ID NO: 166001 - DNA, 75 bp, Artificial Sequence
  Synthetic
tcctctatgttctcggcccaccttttcgactacagtagcaaacccttgtactaccaccccgataaaaaccacatc

SEQ ID NO: 166002 - DNA, 75 bp, Artificial Sequence
  Synthetic
ttaagacgttaataaagaatagcggcggttctgatagggcgaccgctgaagcgagctgcgtgtgcgtgcggtttg

SEQ ID NO: 166003 - DNA, 75 bp, Artificial Sequence
  Synthetic
gcgagctgcgtgtgcgtgcggtttgtcgtccccgctgcagaagcccccccgtccccgcaacaccctgtctgcagc

SEQ ID NO: 166004 - DNA, 75 bp, Artificial Sequence
  Synthetic
gggaaaagaagggggccgtcattaacggaaaccgtgtatggggtccggacacgaacagtacacagcttatgggga

SEQ ID NO: 166005 - DNA, 75 bp, Artificial Sequence
  Synthetic
cggaaaccgtgtatggggtccggacacgaacagtacacagcttatggggaaaaaagctcacagagagaaaaaaac

SEQ ID NO: 166006 - DNA, 75 bp, Artificial Sequence
  Synthetic
aaattaaagatgaccacgggtcgtgagtagcagcgtcctggcgattccttcacgttcatatcacgcagcaccttg

SEQ ID NO: 166007 - DNA, 75 bp, Artificial Sequence
  Synthetic
aaaagccctccgtccccgccgcaggagtcccccgccgcaaaagacccccctgcccgcgccgcaaactctcccccg

SEQ ID NO: 166008 - DNA, 75 bp, Artificial Sequence
  Synthetic
agcactacccatcatcgacactccaatcccaaagaatccaccacccctaaaacccacgtagaacttcacgtcggt

SEQ ID NO: 166009 - DNA, 75 bp, Artificial Sequence
  Synthetic
gagctgcgtgtgcgtgccgtctgtgttccccgccgcgaaaggcccccgtccccggcgccacccccgtccccgtgt

SEQ ID NO: 166010 - DNA, 75 bp, Artificial Sequence
  Synthetic
ttccccgccgcgaaaggcccccgtccccggcgccacccccgtccccgtgtccgccgcgaaaggcccccgtccccg

SEQ ID NO: 166011 - DNA, 75 bp, Artificial Sequence
  Synthetic
taacgggataagggacagcaatcatcacgcacaacacccttcactctctttttagtcatccatatcatcgctgta

SEQ ID NO: 166012 - DNA, 75 bp, Artificial Sequence
  Synthetic
tttagtcatccatatcatcgctgtaacacagcatgtcctcgtaatcgggcgtctggcagcgcattaccaccgagt

SEQ ID NO: 166013 - DNA, 75 bp, Artificial Sequence
  Synthetic
tcttcgtcattcaaccgatgacccactccgtacaacgaatcagtctgctgtgtcacattgcaaactactagcgac

SEQ ID NO: 166014 - DNA, 75 bp, Artificial Sequence
  Synthetic
cccccgagaagcgcagcgccgaaacgacacagacaagtacagtggaacgcaccggcagtgcccgcaacaccccgt

SEQ ID NO: 166015 - DNA, 75 bp, Artificial Sequence
  Synthetic
accaccgtccccgccgcaaaaggcccccgtgcccggccccgcacacccacgcacaccccccgttcccggcgcaac

SEQ ID NO: 166016 - DNA, 75 bp, Artificial Sequence
  Synthetic
gttgccgtcgtactgtgattaccgttggcggactgcaccgggatgatgggctgcttgtggggaacctggggtgga

SEQ ID NO: 166017 - DNA, 75 bp, Artificial Sequence
  Synthetic
ctgcttgtggggaacctggggtggactgccgccgtgagaaggcgacggcgtcatcaagttaagctcaccacggtg

SEQ ID NO: 166018 - DNA, 75 bp, Artificial Sequence
  Synthetic
ctgccgccgtgagaaggcgacggcgtcatcaagttaagctcaccacggtgactccggacaccggcgaggggcgcc

SEQ ID NO: 166019 - DNA, 75 bp, Artificial Sequence
  Synthetic
tgactgctagcgtcgtcactgtcttcgtcctcttccagctcgccctcagagtagtgctgctgtggttgcgacggt

SEQ ID NO: 166020 - DNA, 75 bp, Artificial Sequence
  Synthetic
gccaagaagtcgctcagccctgtcccgcactggcggcggtcggggtgtgccgggctggcggctgtcggggtgtgt

SEQ ID NO: 166021 - DNA, 75 bp, Artificial Sequence
  Synthetic
cctggagagagcaggcggaccgagccagagggaccttcgctcggcgttcaggccttaatactagccacatcttac

SEQ ID NO: 166022 - DNA, 75 bp, Artificial Sequence
  Synthetic
tttctcccgcggtccccagggacgagtggcgccgcgcgcggccgtcctcctggggacttcctcttttccgcgtct

SEQ ID NO: 166023 - DNA, 75 bp, Artificial Sequence
  Synthetic
cgtaccggcaaagacggtgagatccaatagcgactgctcgtcgaagggacagtacgctatcatgaaacgataggg

SEQ ID NO: 166024 - DNA, 75 bp, Artificial Sequence
  Synthetic
aatagcgactgctcgtcgaagggacagtacgctatcatgaaacgatagggtgccaacgcgcgttggatgcgcagt

SEQ ID NO: 166025 - DNA, 75 bp, Artificial Sequence
  Synthetic
agacgccgctgtcgagtatagatcaaataagtgataatgactacggctatggccacgaggatgatggtgaaggct

SEQ ID NO: 166026 - DNA, 75 bp, Artificial Sequence
  Synthetic
gtacccatggcgttgttagtatcgaactggtcaaaaaattggggcgtaccggtgacttgcaacgcgcgacggcgt

SEQ ID NO: 166027 - DNA, 75 bp, Artificial Sequence
  Synthetic
agcgagacggccacgcgcgagaaagagcacacgtaggccatggcgcggtgcatgggttgcgagaaggtctcgggc

SEQ ID NO: 166028 - DNA, 75 bp, Artificial Sequence
  Synthetic
gaatcagacagacacagacacgcgtcttctttgcgacgtgcgccgcgcacgtcgcttttattcgccgtcgccgtc

SEQ ID NO: 166029 - DNA, 75 bp, Artificial Sequence
  Synthetic
cgacgacagctgcgatttatcggccgacatgccgatggtatgggcggcggcggcagtggccgcggcagcggggag

SEQ ID NO: 166030 - DNA, 75 bp, Artificial Sequence
  Synthetic
gcacacgcagacacggcccgccaacacaccccgacacacccctgacacaccccgccaacacacccgccacacgcc

SEQ ID NO: 166031 - DNA, 75 bp, Artificial Sequence
  Synthetic
accgggcttcttgactagccgtttgagcgtggtgcaatggtcgccccagccgtcctggtggtccaggatgcagcc

SEQ ID NO: 166032 - DNA, 75 bp, Artificial Sequence
  Synthetic
agcgtggtgcaatggtcgccccagccgtcctggtggtccaggatgcagcccaggtccaggttgttgagtttgttg

SEQ ID NO: 166033 - DNA, 75 bp, Artificial Sequence
  Synthetic
gtggttttccacgacctccccgactgcgcggcgccaaggcggcgccagcaagcgccgcgctcgtcgctgcctata

SEQ ID NO: 166034 - DNA, 75 bp, Artificial Sequence
  Synthetic
ccccgacacacccggcacacgcccgcgacacaccccgacacacccgacacacgcccgcgacacacccgcggcaca

SEQ ID NO: 166035 - DNA, 75 bp, Artificial Sequence
  Synthetic
tggtacttcatgtagctgagcgtttcgtcgatgatggccagcaacgtgtgcaagttgggagcgttgtacacggcg

SEQ ID NO: 166036 - DNA, 75 bp, Artificial Sequence
  Synthetic
cgtcgatgatggccagcaacgtgtgcaagttgggagcgttgtacacggcgaagatcttttccaccaccagcttgc

SEQ ID NO: 166037 - DNA, 75 bp, Artificial Sequence
  Synthetic
gtgacagcaggatgcgaccgcgcggctgatgatcttgcgggaaggcggtggggaccttgagatcggtggggtagg

SEQ ID NO: 166038 - DNA, 75 bp, Artificial Sequence
  Synthetic
ctgatgatcttgcgggaaggcggtggggaccttgagatcggtggggtagggtgccagacgtagactctcggccgt

SEQ ID NO: 166039 - DNA, 75 bp, Artificial Sequence
  Synthetic
cgctctttttttcttttcgatcaaacggctgagttgctgtagttcgtcctcgtccatggcgtccagttcgtcgtc

SEQ ID NO: 166040 - DNA, 75 bp, Artificial Sequence
  Synthetic
cggctgagttgctgtagttcgtcctcgtccatggcgtccagttcgtcgtcaataagcgccagcatctgttgttgt

SEQ ID NO: 166041 - DNA, 75 bp, Artificial Sequence
  Synthetic
ggaactcggcgacgaagatgcgtcgaatcgccgccgtgatggtgcggttcgccgtcatcgttgtcgtaagactta

SEQ ID NO: 166042 - DNA, 75 bp, Artificial Sequence
  Synthetic
aatcgccgccgtgatggtgcggttcgccgtcatcgttgtcgtaagacttaccgtagtgggggttaaggggcaccg

SEQ ID NO: 166043 - DNA, 75 bp, Artificial Sequence
  Synthetic
cactacaacacacacatgccgcacaatcatgccagccacagacacaaacagcacccacaccacgccgcttcaccc

SEQ ID NO: 166044 - DNA, 75 bp, Artificial Sequence
  Synthetic
tgatgtgtccgccggtgcccccgagtgcgtggcgggaggagggtggaaggggaggaggatagtggtccggatcgc

SEQ ID NO: 166045 - DNA, 75 bp, Artificial Sequence
  Synthetic
tgcgtggcgggaggagggtggaaggggaggaggatagtggtccggatcgccttcggtatcatcgtctttgctgta

SEQ ID NO: 166046 - DNA, 75 bp, Artificial Sequence
  Synthetic
cctcgtccccgccgcaagagtcccccgtccccgacgtcaccccgtgtcgccgtccccaccaccgtccccgccgcg

SEQ ID NO: 166047 - DNA, 75 bp, Artificial Sequence
  Synthetic
ttcgcgggcccgggctgagggagctttctgcggcgccgtcagcgcaatggcactgcgtgccttcgtgcgcgctgc

SEQ ID NO: 166048 - DNA, 75 bp, Artificial Sequence
  Synthetic
ttcgctggcggctgctccgttccgtgtcgacggcgaggttggacttcgctcgcgtcggaacttccgtggcacggg

SEQ ID NO: 166049 - DNA, 75 bp, Artificial Sequence
  Synthetic
gtcgacggcgaggttggacttcgctcgcgtcggaacttccgtggcacgggttcgtaatccagacagaagcgccgt

SEQ ID NO: 166050 - DNA, 75 bp, Artificial Sequence
  Synthetic
cactttgtgcgcgctgccggtgcgtgtcgtgccacggtacttgtcgtttcggcaatacggcgcgggatctttctg

SEQ ID NO: 166051 - DNA, 75 bp, Artificial Sequence
  Synthetic
gggttcttgggcgtgctaaacgccggaggcgaccacggggcttgcgactcgcaggaccgggctgagggacgggga

SEQ ID NO: 166052 - DNA, 75 bp, Artificial Sequence
  Synthetic
tccatggccgccgtcgctaggaaggtcacgttcgggcacgctgatgtatatatagatgagaccgctgccgggggg

SEQ ID NO: 166053 - DNA, 75 bp, Artificial Sequence
  Synthetic
tcacgttcgggcacgctgatgtatatatagatgagaccgctgccggggggcgggtcaccggcgccgtggaaagtg

SEQ ID NO: 166054 - DNA, 75 bp, Artificial Sequence
  Synthetic
cgttggagtgacactttttggtgaaacagcggctccagaggctggcccagagcgcgtagctgtgctcggtgcgca

SEQ ID NO: 166055 - DNA, 75 bp, Artificial Sequence
  Synthetic
acagcggctccagaggctggcccagagcgcgtagctgtgctcggtgcgcaggtcgatgaacacctgcacggtctc

SEQ ID NO: 166056 - DNA, 75 bp, Artificial Sequence
  Synthetic
gcagcaggcgccgtggggctgaaagaggaggacgtggggcgcggtaaactgctcgctgacgtgcggctcgtagtg

SEQ ID NO: 166057 - DNA, 75 bp, Artificial Sequence
  Synthetic
ggccacacgcgggtgacgacgagccgctgcaagtccgtgtcggaaatcgcagcggcagtggcgccgtcgccaccg

SEQ ID NO: 166058 - DNA, 75 bp, Artificial Sequence
  Synthetic
tgcgtgcggtttgtgtttccctgccgcaaaagccacccccgtccccggccccgcaacgcgccgtccccggcccct

SEQ ID NO: 166059 - DNA, 75 bp, Artificial Sequence
  Synthetic
tacaggtgataggcgagcacctcggtgagaccgcggcgtcgataacgcgtcacgttaagcgagcgcgtctcgata

SEQ ID NO: 166060 - DNA, 75 bp, Artificial Sequence
  Synthetic
tgagaccgcggcgtcgataacgcgtcacgttaagcgagcgcgtctcgataaagttggcttcggtcgaggggcaga

SEQ ID NO: 166061 - DNA, 75 bp, Artificial Sequence
  Synthetic
cacccccgtccccagcgcaacccccgtccctggtgccactaccgttcccagcgcaaaagccccccgtccccggcg

SEQ ID NO: 166062 - DNA, 75 bp, Artificial Sequence
  Synthetic
ggtgaagcaggttacgcagatccagttgggcgcgcacaaagcctagcgggtgttcgcggtaggcgtcgggcacga

SEQ ID NO: 166063 - DNA, 75 bp, Artificial Sequence
  Synthetic
ttgggcgcgcacaaagcctagcgggtgttcgcggtaggcgtcgggcacgatgaacagcggcaacagacggcgatg

SEQ ID NO: 166064 - DNA, 75 bp, Artificial Sequence
  Synthetic
aacatctgcggacggacctggatacggaacctttgttgttaacagtggacggggatttggaataaaagatgcgta

SEQ ID NO: 166065 - DNA, 75 bp, Artificial Sequence
  Synthetic
agcgccgtggaaactcccgcagaaagatcccgcgccgtactgccgaaacgacaagtaccgtggcacgacacgcac

SEQ ID NO: 166066 - DNA, 75 bp, Artificial Sequence
  Synthetic
gatcccgcgccgtactgccgaaacgacaagtaccgtggcacgacacgcaccggcagcgcgcacaaagcgccggcc

SEQ ID NO: 166067 - DNA, 75 bp, Artificial Sequence
  Synthetic
tgtgtctaggctgctctcgggatgcgagatggggtccagcagcgtgtgcagttcggcgtcgagacagacggcgtg

SEQ ID NO: 166068 - DNA, 75 bp, Artificial Sequence
  Synthetic
attgagcacctgcgccacggcgcgtaaaacgctggggtgtacggctacggtgcaggcggggaacggcgtgatgat

SEQ ID NO: 166069 - DNA, 75 bp, Artificial Sequence
  Synthetic
gtgagaacactactaatgcttcatccaacgctgaatctacaagcgttatcactacactaactgcagatacctcat

SEQ ID NO: 166070 - DNA, 75 bp, Artificial Sequence
  Synthetic
ctcggagacagccgacccgacgatataaagcaacgcagactgctgaaggccactcaacgacgaggcgccgaaatc

SEQ ID NO: 166071 - DNA, 75 bp, Artificial Sequence
  Synthetic
ccagtccaaatacatcgtatgtttccacctcttacgataacacatcgacgtcagtgatgattacaagcacatcca

SEQ ID NO: 166072 - DNA, 75 bp, Artificial Sequence
  Synthetic
cacctcttacgataacacatcgacgtcagtgatgattacaagcacatccacggaaactaacgttagttctacgga

SEQ ID NO: 166073 - DNA, 75 bp, Artificial Sequence
  Synthetic
ccggccgcatccacgggcacgctgttgggtgggcacgcgcttttgaagaaatagaccgggtgccggtcggggtgc

SEQ ID NO: 166074 - DNA, 75 bp, Artificial Sequence
  Synthetic
tgggtgggcacgcgcttttgaagaaatagaccgggtgccggtcggggtgcgtgtagccaaagaggctcgcccata

SEQ ID NO: 166075 - DNA, 75 bp, Artificial Sequence
  Synthetic
tattacatctccagccgcaacaacaaacgcaaccattagtaacacatcattcgtaaattgcgaaatgtggaacac

SEQ ID NO: 166076 - DNA, 75 bp, Artificial Sequence
  Synthetic
aacgcaaccattagtaacacatcattcgtaaattgcgaaatgtggaacactacgcttaaaaataatacaaaagac

SEQ ID NO: 166077 - DNA, 75 bp, Artificial Sequence
  Synthetic
gcagccgtaaatcaaagtcggccacaaaattgaagacgggcagacgttcgttgaagacttcgtgtcgcgtgtagt

SEQ ID NO: 166078 - DNA, 75 bp, Artificial Sequence
  Synthetic
agcaatttcacgataccgcactgtaacaaggtaatttggatacgacactataatcgaaccacacacggaaactac

SEQ ID NO: 166079 - DNA, 75 bp, Artificial Sequence
  Synthetic
acggtctcggtcagggcctcgtccgagaaacggctgtcgggtacgtgacggagcaggtcgcgcggaaagaggctg

SEQ ID NO: 166080 - DNA, 75 bp, Artificial Sequence
  Synthetic
acaaggtaatttggatacgacactataatcgaaccacacacggaaactacttcccaatacaatatagacgtcctt

SEQ ID NO: 166081 - DNA, 75 bp, Artificial Sequence
  Synthetic
caggtgtacgcggtagacgggcagcggtcgctccagcagcggtgccagcgcgggctcgggtagcaggtagcgacg

SEQ ID NO: 166082 - DNA, 75 bp, Artificial Sequence
  Synthetic
ggtcgctccagcagcggtgccagcgcgggctcgggtagcaggtagcgacgttgcgagtaacgcgttagcgtgccg

SEQ ID NO: 166083 - DNA, 75 bp, Artificial Sequence
  Synthetic
cgccgcaaaaggcccccgtccccgcacaccccccgtccccagtacgcccaaaaaaccccgtccccgtccccagcg

SEQ ID NO: 166084 - DNA, 75 bp, Artificial Sequence
  Synthetic
actacatctttacggtgtaaacacaactcattcaggtagatatactgcacgttgccatacttatgaatatcatag

SEQ ID NO: 166085 - DNA, 75 bp, Artificial Sequence
  Synthetic
aagacagactcggaaagcgtgttgatgcgttcgagctggcgcgccagttgcgtggaggtgccgaagaagcccgcc

SEQ ID NO: 166086 - DNA, 75 bp, Artificial Sequence
  Synthetic
catctggatatgtccacaacctacgaaagacgaaacccaagcagacaaccaaagtaaagaaaaacacttaacaac

SEQ ID NO: 166087 - DNA, 75 bp, Artificial Sequence
  Synthetic
gaacaccgcgggacgacacgcaccggcagcgcgcagaaagcggcggccacaggacgtcaggaaaggcaggacccg

SEQ ID NO: 166088 - DNA, 75 bp, Artificial Sequence
  Synthetic
cgggctggtcgccgagtggggggattcgtcgagacgcagtaggtgcgtctccacgtaatcgtgtagaaagttgtc

SEQ ID NO: 166089 - DNA, 75 bp, Artificial Sequence
  Synthetic
ccaaaccattactcaagaacctcacaccgcagtgcctggactgtcgcgttgctttgtattgcctgtatactccta

SEQ ID NO: 166090 - DNA, 75 bp, Artificial Sequence
  Synthetic
tgttttttgcacgacgagcctttaacaaaaaataccatatgttacaagacaccgttagtgaatcagaattcattg

SEQ ID NO: 166091 - DNA, 75 bp, Artificial Sequence
  Synthetic
cgacacacccggcacacacccacccacccagccgcgcccccgacacaccccgaacggcgccggtgcgggacaggg

SEQ ID NO: 166092 - DNA, 75 bp, Artificial Sequence
  Synthetic
ctcagccctgtcccgcaccggcggcggtcggggtgtgtggggggtgcggctgggtgggtgtgtgccgggtgtgtc

SEQ ID NO: 166093 - DNA, 75 bp, Artificial Sequence
  Synthetic
ggtcggggtgtgtggggggtgcggctgggtgggtgtgtgccgggtgtgtcgcgggtgtgtcgggggtgtgctggc

SEQ ID NO: 166094 - DNA, 75 bp, Artificial Sequence
  Synthetic
acactgcgcttcgggcgccgcgtcagcgtcgtaagccaccacgcgccggtactcgagcaaccgcgcgcgtgccag

SEQ ID NO: 166095 - DNA, 75 bp, Artificial Sequence
  Synthetic
gatctacgtttccgagaagcttatgaacctgaacaaaaaagtaaagtaccctaaagaactcatagcattcaaagg

SEQ ID NO: 166096 - DNA, 75 bp, Artificial Sequence
  Synthetic
actcgagcaaccgcgcgcgtgccagcgccgtgcggtaggccaagtagacgtagtgcacgcagaccgtgtcgggca

SEQ ID NO: 166097 - DNA, 75 bp, Artificial Sequence
  Synthetic
acatacacagaccaccgggagttcagttaaagatttcatcaggtttattttggctgctgctagtcttttgcttct

SEQ ID NO: 166098 - DNA, 75 bp, Artificial Sequence
  Synthetic
caacgtgtccttgtcaatgtctctgtaatgacaccaccacaaattacttcgtaaatactactagcacaacagtta

SEQ ID NO: 166099 - DNA, 75 bp, Artificial Sequence
  Synthetic
ccacggcgtacgccacgaaagcggacacgcgctgacggaagggcgagcccagtagcagacgcgcgaattcgccca

SEQ ID NO: 166100 - DNA, 75 bp, Artificial Sequence
  Synthetic
tctgcgtgtgtcctcgacgcgggttgtgccgtacttcgtctgtcgtttcccccgcggtcccctagggacgagtcg

SEQ ID NO: 166101 - DNA, 75 bp, Artificial Sequence
  Synthetic
gcccaggtcgcgcgtgcagaagctgcgcacgtactcctccaccgtggagatggtgctgtactggccctcgaatag

SEQ ID NO: 166102 - DNA, 75 bp, Artificial Sequence
  Synthetic
ccaccgtttcaacaaaaccgttgatagcaaccacacagatatcaacgacattaagcacaaaaatcgaaactacga

SEQ ID NO: 166103 - DNA, 75 bp, Artificial Sequence
  Synthetic
gtagtaggccatggtcagcagcacctggccctcggtgtgcccgaagacgctgatgaaccacgagggcgaggtggg

SEQ ID NO: 166104 - DNA, 75 bp, Artificial Sequence
  Synthetic
agcaaccacacagatatcaacgacattaagcacaaaaatcgaaactacgacgtgtataaataccaccacaatcgt

SEQ ID NO: 166105 - DNA, 75 bp, Artificial Sequence
  Synthetic
ctgcctcagccggcgctccgacagacgttgctgcgcgccgaggaggcgacggcgctcggacgggagctgcgccgg

SEQ ID NO: 166106 - DNA, 75 bp, Artificial Sequence
  Synthetic
gcagaggaagacctggttgagatgacgtagcacggccgcgtggtgaaagtacaccaggtgcttgaattcgcgcac

SEQ ID NO: 166107 - DNA, 75 bp, Artificial Sequence
  Synthetic
ccggcggtcgcgggggtgtgcggggacggggggcttttgcagcgacgagggttgcgcggccaggagtgtgcggag

SEQ ID NO: 166108 - DNA, 75 bp, Artificial Sequence
  Synthetic
cgtcggtagcaacgtcactctgaaaaaatgtaatgatacagcatggtacaatgtggactggattaaatacgaaga

SEQ ID NO: 166109 - DNA, 75 bp, Artificial Sequence
  Synthetic
cagactggcgatgagcgccgagagggggatgggttggcgcgcggccaggtagcgcgagagctgcagcgtttcgtt

SEQ ID NO: 166110 - DNA, 75 bp, Artificial Sequence
  Synthetic
gggatgggttggcgcgcggccaggtagcgcgagagctgcagcgtttcgttgttcacggcgaagacgggcgccact

SEQ ID NO: 166111 - DNA, 75 bp, Artificial Sequence
  Synthetic
ctcttcacagcgacatgttgcttcgtctatgcactgccgcagcagacaccagcggacaccgccatctgccaccac

SEQ ID NO: 166112 - DNA, 75 bp, Artificial Sequence
  Synthetic
gggaagacgcagtggtccgtcggtgtctgcgagagtacgttggcgactatatgagcagaatcatactctgttgcg

SEQ ID NO: 166113 - DNA, 75 bp, Artificial Sequence
  Synthetic
tctgcgagagtacgttggcgactatatgagcagaatcatactctgttgcgaacagaacgagcgtcatcgtcgcgc

SEQ ID NO: 166114 - DNA, 75 bp, Artificial Sequence
  Synthetic
tgtgaaatatagagtaaaatccagtgaatctagggacactgaaggtaccatcggaagtaacattatacaagccat

SEQ ID NO: 166115 - DNA, 75 bp, Artificial Sequence
  Synthetic
gaatctagggacactgaaggtaccatcggaagtaacattatacaagccattcagaaagctaacatccctctggga

SEQ ID NO: 166116 - DNA, 75 bp, Artificial Sequence
  Synthetic
cgtgctgctgcagcctagcgaggacgtggagctgcgcgagctgcaggcgtttctggacgagaactttaagcagct

SEQ ID NO: 166117 - DNA, 75 bp, Artificial Sequence
  Synthetic
gtggagctgcgcgagctgcaggcgtttctggacgagaactttaagcagctggagatcaccccggccgacctgcga

SEQ ID NO: 166118 - DNA, 75 bp, Artificial Sequence
  Synthetic
aaaaagccgcgttacaccagacttcccaaatatgatccagatgagttttggactaaaacctaacatgcacatcaa

SEQ ID NO: 166119 - DNA, 75 bp, Artificial Sequence
  Synthetic
ttccgggccgtgtgctgggtccccgaggggcgggggggtgttttttgcgggggggtgaaaattggagttgcgtgc

SEQ ID NO: 166120 - DNA, 75 bp, Artificial Sequence
  Synthetic
tgcgcgttcctcaagggctatctctcggagggctgtttgcctcacacgcggccggcggccgaggtggagtgcaag

SEQ ID NO: 166121 - DNA, 75 bp, Artificial Sequence
  Synthetic
attcacaattatcgctaaacaacaaaacatgagcgtgcaatgtaacactgaattgctattactaattgcattaat

SEQ ID NO: 166122 - DNA, 75 bp, Artificial Sequence
  Synthetic
cggagggctgtttgcctcacacgcggccggcggccgaggtggagtgcaagaaatcgcagcgtatcctagaggccc

SEQ ID NO: 166123 - DNA, 75 bp, Artificial Sequence
  Synthetic
aattgctattactaattgcattaatgctgattgcaattatcctaactggaactctagtgccggtaattttacatg

SEQ ID NO: 166124 - DNA, 75 bp, Artificial Sequence
  Synthetic
acaagttctccacggatcaggcctcgctggtggaggtgcagcgcgttatgggcctggtggatatggactgcgaga

SEQ ID NO: 166125 - DNA, 75 bp, Artificial Sequence
  Synthetic
gctggtggaggtgcagcgcgttatgggcctggtggatatggactgcgagaaaagcgcgtacatgctcgaggccgg

SEQ ID NO: 166126 - DNA, 75 bp, Artificial Sequence
  Synthetic
caacgctagtaacaatccctgcaattattccagctttcggtaccacggtaattgcgaactttgtggatggaacgg

SEQ ID NO: 166127 - DNA, 75 bp, Artificial Sequence
  Synthetic
ccagacagaaagataactccccgttgatcgaaccgacgggcacagacgacgaagaggacgaggacgacgacgtct

SEQ ID NO: 166128 - DNA, 75 bp, Artificial Sequence
  Synthetic
aacggtcgccgccgtgtcggcctttgcctgtccctcggtttcggactcgctgatccccgaggaaacgggggtcac

SEQ ID NO: 166129 - DNA, 75 bp, Artificial Sequence
  Synthetic
gcctgtccctcggtttcggactcgctgatccccgaggaaacgggggtcacgcgtcctatgatgagtttggctcac

SEQ ID NO: 166130 - DNA, 75 bp, Artificial Sequence
  Synthetic
agggctgcaattacataatgtaacattgaacgattcaggaacatatactgaggacgtttacgagtgcgacctttt

SEQ ID NO: 166131 - DNA, 75 bp, Artificial Sequence
  Synthetic
aatatgaaatactcaattattttgataactgtaactacaccataaatagcaccaagcatattatcaccgtggtgt

SEQ ID NO: 166132 - DNA, 75 bp, Artificial Sequence
  Synthetic
gtgaccgtgatgtcgccgtcacccgagcccgtgcaacagcagccgccggtcgagcccgtgcagcagcagccccag

SEQ ID NO: 166133 - DNA, 75 bp, Artificial Sequence
  Synthetic
agcccgtgcaacagcagccgccggtcgagcccgtgcagcagcagccccagggacgcgggtctcaccgtcggcgct

SEQ ID NO: 166134 - DNA, 75 bp, Artificial Sequence
  Synthetic
tcaccgtgttctccccacatcattctgaacatacctattcccacgtatccactcacgttggttggacagctgccg

SEQ ID NO: 166135 - DNA, 75 bp, Artificial Sequence
  Synthetic
gaaacaacgtaaatcgaataacgtgatcacaaagtatcgacgctaatttacccaagatacattttaactactctg

SEQ ID NO: 166136 - DNA, 75 bp, Artificial Sequence
  Synthetic
ccgacgtgcctcgggaggcggtgatgtcaccgaccatggtcaccatacctcctccccagataccctttgtgggtt

SEQ ID NO: 166137 - DNA, 75 bp, Artificial Sequence
  Synthetic
aaactgtaaggccccgcttttccactccgtcatgaaggatcgcaatagaatactgctatgtatcatctttatttg

SEQ ID NO: 166138 - DNA, 75 bp, Artificial Sequence
  Synthetic
ccgcgcgtgaactcaggggcgtgaagaaaaagaaacccacggcggcggccttgctgtcctccgcgtgaacagcct

SEQ ID NO: 166139 - DNA, 75 bp, Artificial Sequence
  Synthetic
catgttcatttgcattatgtgcctcatttgtctttactttaaacgccgttgtattcctattccgtctccagacaa

SEQ ID NO: 166140 - DNA, 75 bp, Artificial Sequence
  Synthetic
agggatgacggggaggtttcgggccgacgtcaaaaataacgtcactcgtgttgacagggctttctgcgtcggagc

SEQ ID NO: 166141 - DNA, 75 bp, Artificial Sequence
  Synthetic
gacgtcatcgtctaccggcgagggtgtccgttgcagcaacgcgtgctcgggcgtgtgggtgaaaccgatgtcggg

SEQ ID NO: 166142 - DNA, 75 bp, Artificial Sequence
  Synthetic
cccggcacacacccacccagccgcaccccccgcacaccccgaccgacgccggtgcgggacagggctgaggttttc

SEQ ID NO: 166143 - DNA, 75 bp, Artificial Sequence
  Synthetic
agggggtgactgcccaccggcagataggtaaagcgatgggtggtaaaaaccgctttggctacggtggtgtgtggg

SEQ ID NO: 166144 - DNA, 75 bp, Artificial Sequence
  Synthetic
cacactacggtccagatgacgagcgtgatcaaaaatatgccgcgcagtagtcgaaagccgtactgagcgtgcgag

SEQ ID NO: 166145 - DNA, 75 bp, Artificial Sequence
  Synthetic
cgctttggctacggtggtgtgtggggagatgcagacggtggtgtgcgaagtgttgaccaccgtcacgccggccgc

SEQ ID NO: 166146 - DNA, 75 bp, Artificial Sequence
  Synthetic
ccggggtgtttcggggacagggatgtttcaccgggtgtgtgcacggtgtctgtgcgcagcttctgcgcggcgctc

SEQ ID NO: 166147 - DNA, 75 bp, Artificial Sequence
  Synthetic
cgcttttcgggccgtcgcgggggtttgtgggcgtgcgggatgcccgcgggacggcagcggggacgggtgtggcgg

SEQ ID NO: 166148 - DNA, 75 bp, Artificial Sequence
  Synthetic
actggcgcacgcccactatgagggcgcagataccgggcgcgtgcacgtaggccgcgtcaaaatagacggtttgcg

SEQ ID NO: 166149 - DNA, 75 bp, Artificial Sequence
  Synthetic
gcagataccgggcgcgtgcacgtaggccgcgtcaaaatagacggtttgcgtgtgacccggaccgatcaccagcgt

SEQ ID NO: 166150 - DNA, 75 bp, Artificial Sequence
  Synthetic
gacggggggcttttgcgctgggaacggtggtggcaccggggacgggggttgcgctggggacgggggtgttgcttg

SEQ ID NO: 166151 - DNA, 75 bp, Artificial Sequence
  Synthetic
aaaacaggggaaaacgccgatatcgccttcgatggtgcccggaaagatggactgaaaagtgtcgttgaggttgac

SEQ ID NO: 166152 - DNA, 75 bp, Artificial Sequence
  Synthetic
gggttgcgctcagggacggggacgcggcgttgcggggacggggggctttagcgccgagaactcgcgggaccgggc

SEQ ID NO: 166153 - DNA, 75 bp, Artificial Sequence
  Synthetic
aacatccaactgcgggacttgcagcccgggttccagcagctcgggcatgcaaacgaattgcgcgtccaggcattt

SEQ ID NO: 166154 - DNA, 75 bp, Artificial Sequence
  Synthetic
tcagggacggggacgagcgctgcgcgggaccgggaggcttttgcgctgcgaagacgcgggtgttgattgcggcgg

SEQ ID NO: 166155 - DNA, 75 bp, Artificial Sequence
  Synthetic
tcggggatatagaggctgacgcccagcgaggtgggcactttgcgctcgcgtgacagccaaatgatgtgtttattg

SEQ ID NO: 166156 - DNA, 75 bp, Artificial Sequence
  Synthetic
ggacggtggtggggacgggggccgcgcgggaccgcactgagggacggcggtgctttcgcgctgcgcacgcgggtg

SEQ ID NO: 166157 - DNA, 75 bp, Artificial Sequence
  Synthetic
cctctcccggatgctgctctttgtcgtatttctcctcggtcgattggggcagcgtaaatgtggtttgaaaatcgc

SEQ ID NO: 166158 - DNA, 75 bp, Artificial Sequence
  Synthetic
agcgtaaatgtggtttgaaaatcgctatcgctagcgaaacgcacgcagtaacgcatgttgacggatttctcggct

SEQ ID NO: 166159 - DNA, 75 bp, Artificial Sequence
  Synthetic
cggcaacgttacatttcgaggtcttcagaacagaacggaagactttttgtactggttgttagggtggggtcataa

SEQ ID NO: 166160 - DNA, 75 bp, Artificial Sequence
  Synthetic
aggggtctcccagaatcgctgaaaacgggagcgcggcagccgcgacaataccagttgagagtcgattcggtcggt

SEQ ID NO: 166161 - DNA, 75 bp, Artificial Sequence
  Synthetic
atcaaagtcttctactagcgtatcaactaccaaactaacaacagttgcaacaacttctgcaacaactacgacgac

SEQ ID NO: 166162 - DNA, 75 bp, Artificial Sequence
  Synthetic
ggctcatggcgttaaccaggtagaaactgtgtgtacagttgcgttgtgcgtaacgtaaaagcagggcggttaaac

SEQ ID NO: 166163 - DNA, 75 bp, Artificial Sequence
  Synthetic
acggatcaacataaggacttttcacacttttggggtacacaggcgtgccaccgcagatagtaagcgctggataca

SEQ ID NO: 166164 - DNA, 75 bp, Artificial Sequence
  Synthetic
cattgaaaaacatggggttgaacgtggtgaaattaccgcaaccttgttcgccagtatcattacgtttggaaacgt

SEQ ID NO: 166165 - DNA, 75 bp, Artificial Sequence
  Synthetic
ggtgaaattaccgcaaccttgttcgccagtatcattacgtttggaaacgtttagcatttcggaaagacaagtcat

SEQ ID NO: 166166 - DNA, 75 bp, Artificial Sequence
  Synthetic
aacttggcatttacctacggcagctggggcattgcgatgctgctgttcgccgctgtgatggtgctcgttgatttg

SEQ ID NO: 166167 - DNA, 75 bp, Artificial Sequence
  Synthetic
taaagaatcaacgtcgaggaaaccaaaacgcaaacataatggatatgtacgtgtattttttagctcactgtttga

SEQ ID NO: 166168 - DNA, 75 bp, Artificial Sequence
  Synthetic
ttttgcgggttttctaagctgggtactataaaaatcaaaccacagataggttatactataattctgaatggggcc

SEQ ID NO: 166169 - DNA, 75 bp, Artificial Sequence
  Synthetic
ttttgtagaaattgtcgtttctagttgtctcaaaatttctaacttaagctgatctaatttatatttgcctatctt

SEQ ID NO: 166170 - DNA, 75 bp, Artificial Sequence
  Synthetic
gttatcatcctggtcaaagagtacactggtataatcattcatgtgtcggtatcggtaacggcgaaaatgcacatc

SEQ ID NO: 166171 - DNA, 75 bp, Artificial Sequence
  Synthetic
cgattataaagcgcttttgacataactttacagtttatgagagaaacaagcaagaaagatatagatattagaaac

SEQ ID NO: 166172 - DNA, 75 bp, Artificial Sequence
  Synthetic
gccttgtggtttggcttgcctgcgtgtactcactgctgattctggtcgttttgctgctcatctaccgttgttgca

SEQ ID NO: 166173 - DNA, 75 bp, Artificial Sequence
  Synthetic
ttactcctttccaaaacaactactagaaaacccggacagaaacctacatcgccacaactaagaactacgccaaag

SEQ ID NO: 166174 - DNA, 75 bp, Artificial Sequence
  Synthetic
actttattacaacgagcaagagtgcccctaagtgttggggcccgtaccgttttagaaggttttgtgtgaatgtct

SEQ ID NO: 166175 - DNA, 75 bp, Artificial Sequence
  Synthetic
tcgtggagatgagaccaccacttcgttgtagggatccagggcaaaaaggacgtcgtccgagtcgtgcatgtacat

SEQ ID NO: 166176 - DNA, 75 bp, Artificial Sequence
  Synthetic
gttacgttaaacgcggtggatgttcttcccaatgatcacgttcgttggtcatacggtcccggtggggcaggccat

SEQ ID NO: 166177 - DNA, 75 bp, Artificial Sequence
  Synthetic
cgcatttactttgactgtccgtctgggtgatgatgaggctctggcctacgacggtggtggagacagggtaggaga

SEQ ID NO: 166178 - DNA, 75 bp, Artificial Sequence
  Synthetic
ggtgatgatgaggctctggcctacgacggtggtggagacagggtaggagatacctttgatcaggtattggtttgt

SEQ ID NO: 166179 - DNA, 75 bp, Artificial Sequence
  Synthetic
gaaggtttccagcgtgcttggttgcatggtagataggatggaaagggcggcgggaacggtagcggggacggtggc

SEQ ID NO: 166180 - DNA, 75 bp, Artificial Sequence
  Synthetic
caatcttatagtgaacgagaacggcacattccccattaccactaccaaaaaacctactacgaccacgagaacaac

SEQ ID NO: 166181 - DNA, 75 bp, Artificial Sequence
  Synthetic
tcgagcgagtgatcgcgtcgcccgctactggaacagggtgtgtacaggtcgctgaggtattcgtggtgcggatga

SEQ ID NO: 166182 - DNA, 75 bp, Artificial Sequence
  Synthetic
gctagcaactgcgtaaagtgtgatagctcggccaatgaacagaggcccgtttctacgatgaagatttcgcgtctc

SEQ ID NO: 166183 - DNA, 75 bp, Artificial Sequence
  Synthetic
caggtgatcataaattcttgtatttgtaagagtgcggcctggcggtctagggcccgtgggatggagatttcggtg

SEQ ID NO: 166184 - DNA, 75 bp, Artificial Sequence
  Synthetic
ttttccccatgggctgtcagcgtcgggtgcgcgacacggctatcatgcgcaacaggtccagcttaaaggcgcact

SEQ ID NO: 166185 - DNA, 75 bp, Artificial Sequence
  Synthetic
ttcttaactagtaccaggagctcgtgtttttcagtttgtcgtagtataaagttgtcgcgttgatagggcgctttg

SEQ ID NO: 166186 - DNA, 75 bp, Artificial Sequence
  Synthetic
aagtcctcggtcagtgtgattttaacgtaacgtagttcgtccatgaggtaaaagccctggtgcagacagggcgta

SEQ ID NO: 166187 - DNA, 75 bp, Artificial Sequence
  Synthetic
aatatccacgttgtcagaaagctgtaaaccaacgtgtccttgtcaatgtctctgtaatgacaccaccacaaatta

SEQ ID NO: 166188 - DNA, 75 bp, Artificial Sequence
  Synthetic
gcagttgagttccgactggcagggtattcaacagaatttggttgttacaacgacagcgcctgtcgtaatcttcca

SEQ ID NO: 166189 - DNA, 75 bp, Artificial Sequence
  Synthetic
gtggtgtgcgatcccttccagtcgtgtggagtggtttggggtggcatccagacgtgaggtattgacagatcaatg

SEQ ID NO: 166190 - DNA, 75 bp, Artificial Sequence
  Synthetic
ccctccccccacggggggctgggtcgcggaccccggttcctaggctcgttccgcggtgggcgaccggggatcccc

SEQ ID NO: 166191 - DNA, 75 bp, Artificial Sequence
  Synthetic
ttctagggtttcggtcagatctacctggttcagaaactgctccgccagaggacccgcaaaaagacatcgaggcat

SEQ ID NO: 166192 - DNA, 75 bp, Artificial Sequence
  Synthetic
tggttcagaaactgctccgccagaggacccgcaaaaagacatcgaggcatatggaatacatagtattgattatag

SEQ ID NO: 166193 - DNA, 75 bp, Artificial Sequence
  Synthetic
tagcgcggccgcgccgctgggttcagcggcgtgatccaggtggtggttggcgttacacccgagagaaggagaaaa

SEQ ID NO: 166194 - DNA, 75 bp, Artificial Sequence
  Synthetic
gtccgggcgtggggacgacgctgatttgacggggaacgctctgcggagattgcctcacgtgcgtaagcggatcgg

SEQ ID NO: 166195 - DNA, 75 bp, Artificial Sequence
  Synthetic
tgcctcacgtgcgtaagcggatcggtaagcgcaagcacctggacatctaccgtcgcctgctgcgggtctttccct

SEQ ID NO: 166196 - DNA, 75 bp, Artificial Sequence
  Synthetic
ggtttaggagccacagcagcggaaacaccgttacaaccaagcccacagcaccaacacgtggctacacacgccctc

SEQ ID NO: 166197 - DNA, 75 bp, Artificial Sequence
  Synthetic
cgtcgcctgctgcgggtctttccctcgtttgtggcgctcaaccgcctgttgggaggccttttcccacccgagttg

SEQ ID NO: 166198 - DNA, 75 bp, Artificial Sequence
  Synthetic
tcccgactgcgtgttggtgtttttaccgccggactctgggtcgcgcggcatcgtgtattgctacgtgattgagtt

SEQ ID NO: 166199 - DNA, 75 bp, Artificial Sequence
  Synthetic
acacaaatacatcgtgttccccgaaattcatctgcataaacgaaactaaaggactgcagttacataatgtaacat

SEQ ID NO: 166200 - DNA, 75 bp, Artificial Sequence
  Synthetic
ctggactatctagggaggcgtcaggatgagtctgttgcacaccttttggcggctacccgtcgccgtcttcttcga

SEQ ID NO: 166201 - DNA, 75 bp, Artificial Sequence
  Synthetic
atgagtctgttgcacaccttttggcggctacccgtcgccgtcttcttcgagccgcacgaggaaaacgtgctgcgc

SEQ ID NO: 166202 - DNA, 75 bp, Artificial Sequence
  Synthetic
ggctacccgtcgccgtcttcttcgagccgcacgaggaaaacgtgctgcgctgccccgagcgcgtgcttcggcggt

SEQ ID NO: 166203 - DNA, 75 bp, Artificial Sequence
  Synthetic
ggtatctgcgtcaggagctcagggatctgggtcacagggtgcagacttactgcgaggatctcgaagggcgcgtgt

SEQ ID NO: 166204 - DNA, 75 bp, Artificial Sequence
  Synthetic
tctgggtcacagggtgcagacttactgcgaggatctcgaagggcgcgtgtccgaggcggaggcgctgttgaacca

SEQ ID NO: 166205 - DNA, 75 bp, Artificial Sequence
  Synthetic
agggaccggcgtggcaggagcttccgccgtcccacacggtctttatagtcggcacgatgccatcacgggacccgc

SEQ ID NO: 166206 - DNA, 75 bp, Artificial Sequence
  Synthetic
tactttggaatcacgcagaacgatccctttatccgctttcacaccgattttcgcggcgaggtggtcaacaccatg

SEQ ID NO: 166207 - DNA, 75 bp, Artificial Sequence
  Synthetic
ttcgagaacgcctctacttggactttctcctttggtatctggtactatcggctcaagcgggggttgtacacgcaa

SEQ ID NO: 166208 - DNA, 75 bp, Artificial Sequence
  Synthetic
tttgggagggccgcgatccgccggactccgtgacggcggtgttgggtgagctccctcagctgttgccgcgtctgg

SEQ ID NO: 166209 - DNA, 75 bp, Artificial Sequence
  Synthetic
actcgcccgatctacgctactacatgcccctaagcggtggtcgccactatcacccgggcacttttgatcgtcacg

SEQ ID NO: 166210 - DNA, 75 bp, Artificial Sequence
  Synthetic
gcccctaagcggtggtcgccactatcacccgggcacttttgatcgtcacgtgctggtgcggcttttccacaaacg

SEQ ID NO: 166211 - DNA, 75 bp, Artificial Sequence
  Synthetic
cagcctccatgatgcctgcataccggtggttggcaagataggtaccaacgttacgttgaacgcggtagatgttct

SEQ ID NO: 166212 - DNA, 75 bp, Artificial Sequence
  Synthetic
ggcgaagaggagggctatgggggacggcacgggcgggtacgtaactttgagtttctggtgcagtactacatcggg

SEQ ID NO: 166213 - DNA, 75 bp, Artificial Sequence
  Synthetic
ggcacgggcgggtacgtaactttgagtttctggtgcagtactacatcgggccgtggtacgcgcgcgaccccgcgg

SEQ ID NO: 166214 - DNA, 75 bp, Artificial Sequence
  Synthetic
cacgtcgcgaggacagcgccggaggtggcgacggcggcggcgccgtgctcatgcagctcagcaagagcaaccccg

SEQ ID NO: 166215 - DNA, 75 bp, Artificial Sequence
  Synthetic
atgcagctcagcaagagcaaccccgtggccgactacatgtttgcgcagagctccaaacagtacggcgatttacgt

SEQ ID NO: 166216 - DNA, 75 bp, Artificial Sequence
  Synthetic
gcggctgttgtcagtgaccctgccgcgtcatcgtgtgtccactctgggctcgtccctctttaacgtcaacgatat

SEQ ID NO: 166217 - DNA, 75 bp, Artificial Sequence
  Synthetic
cgtcatcgtgtgtccactctgggctcgtccctctttaacgtcaacgatatttacgaactgttgtactttttagtg

SEQ ID NO: 166218 - DNA, 75 bp, Artificial Sequence
  Synthetic
ccccttctgcggagaagactacctcagtcaccgattccatcatgctcgctatcgtgaatttcagatacatgggcc

SEQ ID NO: 166219 - DNA, 75 bp, Artificial Sequence
  Synthetic
agtgcggcaacggcacgaaagacggcgctataacgctctgacggtccgcagccgggactcgctgctcctgacgcg

SEQ ID NO: 166220 - DNA, 75 bp, Artificial Sequence
  Synthetic
atcggcatgttcggctccgttagcctggtcaacctgctgaccatcatcggttgcctctgggtgttgcgtgttacg

SEQ ID NO: 166221 - DNA, 75 bp, Artificial Sequence
  Synthetic
tggtcaacctgctgaccatcatcggttgcctctgggtgttgcgtgttacgcggccgcccgtgtccgtgatgattt

SEQ ID NO: 166222 - DNA, 75 bp, Artificial Sequence
  Synthetic
gcgctctaaatctcagcctctgtcgcttagtgctctttgtcgacgacgtgggcctatattcgacggcgttgtttt

SEQ ID NO: 166223 - DNA, 75 bp, Artificial Sequence
  Synthetic
cttagtgctctttgtcgacgacgtgggcctatattcgacggcgttgtttttcctctttctgatactggatcgtct

SEQ ID NO: 166224 - DNA, 75 bp, Artificial Sequence
  Synthetic
ccaatgacgtaaaaatttccactacacaataaaattacggactcatgtgaaaagtgtgctttttattaacagagc

SEQ ID NO: 166225 - DNA, 75 bp, Artificial Sequence
  Synthetic
gaagcacacccgtattatggtgcaccttatggggatcgcgcacacgagtctcattaggacaccgtgtagcgtttg

SEQ ID NO: 166226 - DNA, 75 bp, Artificial Sequence
  Synthetic
cgcctttgcctgggttctttccatcgtagccgctgtgcccaccgccgctacgggttcactggactaccgttggct

SEQ ID NO: 166227 - DNA, 75 bp, Artificial Sequence
  Synthetic
gtagccgctgtgcccaccgccgctacgggttcactggactaccgttggctaggctgtcagatccctatacagtat

SEQ ID NO: 166228 - DNA, 75 bp, Artificial Sequence
  Synthetic
gagttggcctacagcgatcggcgcgaccacgtctggtcctacgtgggtcgtgtctgcaccttctacgtgacgtgt

SEQ ID NO: 166229 - DNA, 75 bp, Artificial Sequence
  Synthetic
accacgtctggtcctacgtgggtcgtgtctgcaccttctacgtgacgtgtctcatgctttttgtaccctactact

SEQ ID NO: 166230 - DNA, 75 bp, Artificial Sequence
  Synthetic
aattggctacgcgtacccttctcaccatgcgtcttggcattctgccgctctttatcattgcgttcttctcccgcg

SEQ ID NO: 166231 - DNA, 75 bp, Artificial Sequence
  Synthetic
gccgcgtgttacttttctacgtccgtccgagacgtcgccgaggcggtgaaaaagtcctccagccgttgttacgcc

SEQ ID NO: 166232 - DNA, 75 bp, Artificial Sequence
  Synthetic
gacaacagagctgaagcgttctgtacatcttacgggttctttccaggggaaattaatattacttttatccattac

SEQ ID NO: 166233 - DNA, 75 bp, Artificial Sequence
  Synthetic
ctacgatcgatgtttcggccgaaagttcctccgtcctctgcaccgacggcgaaaacaccgtcgcgtcggacgcga

SEQ ID NO: 166234 - DNA, 75 bp, Artificial Sequence
  Synthetic
ggcagataaatcacgttaggtttacacgtcgttagccagcgtcggcatatgaagggcgcgggcggccagtacggc

SEQ ID NO: 166235 - DNA, 75 bp, Artificial Sequence
  Synthetic
acgtcgttagccagcgtcggcatatgaagggcgcgggcggccagtacggcctctgggctgagacaggacgaggca

SEQ ID NO: 166236 - DNA, 75 bp, Artificial Sequence
  Synthetic
cgggacagcgtgccggcgaacgttctgtaatcttccataataaaggtaaaaatgcccgtctcgtgtcgactccgc

SEQ ID NO: 166237 - DNA, 75 bp, Artificial Sequence
  Synthetic
aatgcccgtctcgtgtcgactccgctggatctcgaaggcatcgggggtaatgcgcatcttgccggtgccgatgag

SEQ ID NO: 166238 - DNA, 75 bp, Artificial Sequence
  Synthetic
gaaggccgccagacgaaacaagcggtgtccgtagagcgtgcctagggagaagaggatgttgccgttgcgcgccag

SEQ ID NO: 166239 - DNA, 75 bp, Artificial Sequence
  Synthetic
agaggatgttgccgttgcgcgccaggtcttcggggaaaacgaccggcaggccggtgtggcgctgcacaaagcgcg

SEQ ID NO: 166240 - DNA, 75 bp, Artificial Sequence
  Synthetic
caggattaacgtaggttttcgaaataatctacgtacgtgagtgacgcgatttcgtgtcgaaacccgcgtctggtt

SEQ ID NO: 166241 - DNA, 75 bp, Artificial Sequence
  Synthetic
ccgcttcaaagtccagccccgggaaggcctggcgcagttcgcggtacagatgaggccagtagggttgcggcgtct

SEQ ID NO: 166242 - DNA, 75 bp, Artificial Sequence
  Synthetic
ggcctggcgcagttcgcggtacagatgaggccagtagggttgcggcgtcttgcgactaagcacggcgtggtccga

SEQ ID NO: 166243 - DNA, 75 bp, Artificial Sequence
  Synthetic
gcgtacgattttgagttcttccaaacgcagcgagctcagcggctgtccgcgcgacatcttctcgctaatctgtaa

SEQ ID NO: 166244 - DNA, 75 bp, Artificial Sequence
  Synthetic
gagaatttgcccgtgcggacccgcgggacggcggggttctcttcgtcgcgggccatcatcgttcgctcggtgagc

SEQ ID NO: 166245 - DNA, 75 bp, Artificial Sequence
  Synthetic
ttctcgcccgctatgaccagtctccggacgaggccgaattgctgttgccgcgggacgtagtggagcactggttgc

SEQ ID NO: 166246 - DNA, 75 bp, Artificial Sequence
  Synthetic
gttgtcggtcgcgctcccgctcaacatcaaccacgacgacacggccgttgtaggacacgttgcggcgatgcagag

SEQ ID NO: 166247 - DNA, 75 bp, Artificial Sequence
  Synthetic
ctacgccggcctctcgctctccagccggcgctgcgacgacgtggaggccgcgacgtcgctttcgggctcggaaac

SEQ ID NO: 166248 - DNA, 75 bp, Artificial Sequence
  Synthetic
cggcgctgcgacgacgtggaggccgcgacgtcgctttcgggctcggaaaccacgccgttcaaacacgtggctttg

SEQ ID NO: 166249 - DNA, 75 bp, Artificial Sequence
  Synthetic
gacctcacggcggccgaccgtgacgggctacgtgcacagtggcagcgctgcggcagcactgctgtcgacgcgtcg

SEQ ID NO: 166250 - DNA, 75 bp, Artificial Sequence
  Synthetic
ggctacgtgcacagtggcagcgctgcggcagcactgctgtcgacgcgtcgggcgatccctttcgctcagacagct

SEQ ID NO: 166251 - DNA, 75 bp, Artificial Sequence
  Synthetic
tagtcggcgtgacggagcgcgagtcgtacgtcaaggcgagcgtttcgcctgaggcggcgtgcgatattaaagcgg

SEQ ID NO: 166252 - DNA, 75 bp, Artificial Sequence
  Synthetic
acgtagaacttcacgtcggtttagaagccacagcagcggaaacaccgttacaaccaagcccacagtaccaacacg

SEQ ID NO: 166253 - DNA, 75 bp, Artificial Sequence
  Synthetic
caccgaacagagactcacgcgtacgagaccccgaggtacgccacgcggtgcctaacgcggtataccacacccgta

SEQ ID NO: 166254 - DNA, 75 bp, Artificial Sequence
  Synthetic
tgctaccgtggcaggtgcgtcgccggctgtgccgtctctagcgtggcctcacgacggagtttatttacccaaaga

SEQ ID NO: 166255 - DNA, 75 bp, Artificial Sequence
  Synthetic
gttggcggcacgtcactttgcggaatacgtggatccccattatcccgggtggggtcggcgttacgagcccgcgcc

SEQ ID NO: 166256 - DNA, 75 bp, Artificial Sequence
  Synthetic
accgtcggcgtgattctccgggcggtatggatgaaccaccgtccggatgggagcgttacgacggtggtcaccgtg

SEQ ID NO: 166257 - DNA, 75 bp, Artificial Sequence
  Synthetic
gagcgttacgacggtggtcaccgtggtcagtcgcagaagcagcaccgtcacgggggcagcggtggacacaacaaa

SEQ ID NO: 166258 - DNA, 75 bp, Artificial Sequence
  Synthetic
cgtcgtcgtcctcggacgaagacttgagtttccccggcgaggccgagcacggccgggcgcgaaagcgtctaaaaa

SEQ ID NO: 166259 - DNA, 75 bp, Artificial Sequence
  Synthetic
ccgaggataagcgggagatgtggatggcttgtattaaggaactctataatgtgaccaagggtgcagctaacaagc

SEQ ID NO: 166260 - DNA, 75 bp, Artificial Sequence
  Synthetic
cagcagcaacaacgttacgatgaactgcgggatgccattcacgagctgaaacgcgatctgtttgccgcgcggcag

SEQ ID NO: 166261 - DNA, 75 bp, Artificial Sequence
  Synthetic
tgcgggatgccattcacgagctgaaacgcgatctgtttgccgcgcggcagagttctacgttactttcggcggctc

SEQ ID NO: 166262 - DNA, 75 bp, Artificial Sequence
  Synthetic
tgatcatatatttatggatatcctcactacatgtgtggagaccatgtgcagtgagtacaaggtcaccagtgacgc

SEQ ID NO: 166263 - DNA, 75 bp, Artificial Sequence
  Synthetic
tcgacggcaggttcttcttcctgcccggctagtgtcgtgttagccgccgctgctgcccaagccgccgcagcttcc

SEQ ID NO: 166264 - DNA, 75 bp, Artificial Sequence
  Synthetic
agacgctatatttagggcttccctctctttttttttctacaccgtgataccctaataaagcacaccgcggttatt

SEQ ID NO: 166265 - DNA, 75 bp, Artificial Sequence
  Synthetic
agtctctctctagatgcggggtcgactgcgtggggtgctggaagtggaagcggtgctgatgggtgagggtcgtgg

SEQ ID NO: 166266 - DNA, 75 bp, Artificial Sequence
  Synthetic
cgcgggcacggaccgcaacgtgctgctgatgtctgccgcggtacgcacgtcgccgtccatgtcgctgcgcagata

SEQ ID NO: 166267 - DNA, 75 bp, Artificial Sequence
  Synthetic
ggacagtccggcttgggtgtccgagtcctcgtcgccgctggcctcctcgaagccggcaaacatggcttcggacag

SEQ ID NO: 166268 - DNA, 75 bp, Artificial Sequence
  Synthetic
tcctcgtcgccgctggcctcctcgaagccggcaaacatggcttcggacaggggggtcggcgtcggtgtggatgag

SEQ ID NO: 166269 - DNA, 75 bp, Artificial Sequence
  Synthetic
ggcggttctgatagggcgatcgctgaagcgagctgcgtgtgcgtgccgtctgtgttccccggccccgcaaacgcc

SEQ ID NO: 166270 - DNA, 75 bp, Artificial Sequence
  Synthetic
aactcggagacggcgccgcgcatgacgttgctccgtggaaagagaccggcgcgcagctgcacctggggacgcttg

SEQ ID NO: 166271 - DNA, 75 bp, Artificial Sequence
  Synthetic
cgtccctaccaccgtccccggccctgcaacgtgccgtcgtcgccgcaaaaggccgcaagtccccgccgcaaaagc

SEQ ID NO: 166272 - DNA, 75 bp, Artificial Sequence
  Synthetic
attttgtccggtttaccgggtgtgagagtccaaaacccacggcggaaaaagtggatgcggcctagcggctgtcgg

SEQ ID NO: 166273 - DNA, 75 bp, Artificial Sequence
  Synthetic
acaccccgccgtcaaccccagcgtaactcccgttaccggcgccggcgttcacaaacaccgtagaaacacccgccg

SEQ ID NO: 166274 - DNA, 75 bp, Artificial Sequence
  Synthetic
tcgcacacgatcgggtagcgggccggcttctatggagacgcccgggatgttttccgggaaaaagatggtgtcgtg

SEQ ID NO: 166275 - DNA, 75 bp, Artificial Sequence
  Synthetic
gcttctatggagacgcccgggatgttttccgggaaaaagatggtgtcgtgagtctgattggtctcgaaagcattc

SEQ ID NO: 166276 - DNA, 75 bp, Artificial Sequence
  Synthetic
tccggcaagcgtcgtaggtgcgggtacggattgtgtcgcgccaccacctcggcgcgatgcgtgtaaaccgaaaag

SEQ ID NO: 166277 - DNA, 75 bp, Artificial Sequence
  Synthetic
acggattgtgtcgcgccaccacctcggcgcgatgcgtgtaaaccgaaaagtgcaaaaacacgctggtcggcgggt

SEQ ID NO: 166278 - DNA, 75 bp, Artificial Sequence
  Synthetic
cagttcggcgttacggtcagtcgcacggcccagtggtgagccgtgcggcggatgatggcgcgcgcttccattcgc

SEQ ID NO: 166279 - DNA, 75 bp, Artificial Sequence
  Synthetic
agtgcaaaggccagtaccgagaccgtgttgttttctgagcctggcgtcaggcgtcgtgggccaaagttgttgagg

SEQ ID NO: 166280 - DNA, 75 bp, Artificial Sequence
  Synthetic
tgttgttttctgagcctggcgtcaggcgtcgtgggccaaagttgttgaggtccaccagcagtcggtcctgttcgc

SEQ ID NO: 166281 - DNA, 75 bp, Artificial Sequence
  Synthetic
tcagacaagcgcgaacgtaggccaaaaactgaccgacgtatagacagaagataataacgttttgaagtgtgtcat

SEQ ID NO: 166282 - DNA, 75 bp, Artificial Sequence
  Synthetic
agcagagaaccgagggccggctcacctctatgttggtacgcaggtccaggagtcgcagacgaccggcttccagcg

SEQ ID NO: 166283 - DNA, 75 bp, Artificial Sequence
  Synthetic
ccaaagcttccgctggcggcttcggcctcgctgatcgcggccgcttccgacgagggtccctcaccgggcgaggac

SEQ ID NO: 166284 - DNA, 75 bp, Artificial Sequence
  Synthetic
cccgcccctcggggacccaccacacggcccggaatggatgtcgggcgtccacttaggtgggtgcgcgctcgggcg

SEQ ID NO: 166285 - DNA, 75 bp, Artificial Sequence
  Synthetic
atgttaactttggtgttcaaaaacacggggaaccaacccgacgtctcgttagcgaattcaccaacacactcgttg

SEQ ID NO: 166286 - DNA, 75 bp, Artificial Sequence
  Synthetic
cggggaaccaacccgacgtctcgttagcgaattcaccaacacactcgttgttggtatggctgtacatcaggtaat

SEQ ID NO: 166287 - DNA, 75 bp, Artificial Sequence
  Synthetic
aggtcgggaagggttccggcaactgtcgcaaatatagcagcggcgacaggtgtggcggccaaaagttgcgtgtct

SEQ ID NO: 166288 - DNA, 75 bp, Artificial Sequence
  Synthetic
tcgcaaatatagcagcggcgacaggtgtggcggccaaaagttgcgtgtctgagtggacgtgggtttttatagagt

SEQ ID NO: 166289 - DNA, 75 bp, Artificial Sequence
  Synthetic
aggcgtcttgccggtggcggcgacgtttgggttgcgcagcgggctgccatacgccttccaattcggcgaagatgc

SEQ ID NO: 166290 - DNA, 75 bp, Artificial Sequence
  Synthetic
tttgggttgcgcagcgggctgccatacgccttccaattcggcgaagatgcggtagatgtcgttggcgtcccagaa

SEQ ID NO: 166291 - DNA, 75 bp, Artificial Sequence
  Synthetic
ctgccagggcggccaggtgaacacggccggattgtggatttcgttgtcggaatcctcgtcggtgtcctcttcggg

SEQ ID NO: 166292 - DNA, 75 bp, Artificial Sequence
  Synthetic
ttcagaaacgtgcccacgatgcacatcaaccatacccccaaccgagtgtactcgaacaactgataaatttcggtg

SEQ ID NO: 166293 - DNA, 75 bp, Artificial Sequence
  Synthetic
aatcctcgtcggtgtcctcttcgggcgcgacggtggactcggccttaaggcggccgcgtgtcataacgcccgacg

SEQ ID NO: 166294 - DNA, 75 bp, Artificial Sequence
  Synthetic
caggtactatcacctgtcgaacagtcctgtaaaaagcattacacgttagtcgtctaagcacccagattcctcaca

SEQ ID NO: 166295 - DNA, 75 bp, Artificial Sequence
  Synthetic
cggtgacgcggggcgtcttgcgctcggtggttacgagttcttcgtcggagtccgatccgctggtccagacgtcgt

SEQ ID NO: 166296 - DNA, 75 bp, Artificial Sequence
  Synthetic
cgtcgccctgggcggcaccctcgtcgtgccggtcccaggtgtgtcggtactcaagcttgccctggatgcgatact

SEQ ID NO: 166297 - DNA, 75 bp, Artificial Sequence
  Synthetic
cagccacgggatcgtactgacgcagttccacggtctcgcgtatcgcttgtacctccaggaagatctgctgcccgt

SEQ ID NO: 166298 - DNA, 75 bp, Artificial Sequence
  Synthetic
tcatcaacaggttacctgagatgctcaggcccgggatgctcttgggacacagcagcccaaaatgctcgtgtgagg

SEQ ID NO: 166299 - DNA, 75 bp, Artificial Sequence
  Synthetic
gggtaactatgtaccgtgcgggggtgacgttgttagtggtggcggtgataagtgtcgggagatgggacgtggtgg

SEQ ID NO: 166300 - DNA, 75 bp, Artificial Sequence
  Synthetic
cgagatcttgcccggtttgattatcatatttttgggacacaacaccgtaaagccgttgcgctcgtgggggcgcat

SEQ ID NO: 166301 - DNA, 75 bp, Artificial Sequence
  Synthetic
atatttttgggacacaacaccgtaaagccgttgcgctcgtgggggcgcatgaagggttgcgggttgcgggtcatc

SEQ ID NO: 166302 - DNA, 75 bp, Artificial Sequence
  Synthetic
ttttctgtaacactacagcttgcgattcgccctttttggcctcggggatgatgattagtattccacagaacacac

SEQ ID NO: 166303 - DNA, 75 bp, Artificial Sequence
  Synthetic
ttcgccctttttggcctcggggatgatgattagtattccacagaacacacagtttctcaccagcaaagtcaacta

SEQ ID NO: 166304 - DNA, 75 bp, Artificial Sequence
  Synthetic
gactccaggtacaccttgacgtactggtcacctatcacctgcatcttggttgcgcgcgtgttctccatggagcaa

SEQ ID NO: 166305 - DNA, 75 bp, Artificial Sequence
  Synthetic
ggtcacctatcacctgcatcttggttgcgcgcgtgttctccatggagcaaaccagctcgtgcgcgcacaccacgt

SEQ ID NO: 166306 - DNA, 75 bp, Artificial Sequence
  Synthetic
ctatgtgaacggcagcgttacctgctggggctctaacgggacttttggtgccaaaactttcttagtaaaatccat

SEQ ID NO: 166307 - DNA, 75 bp, Artificial Sequence
  Synthetic
tggggctctaacgggacttttggtgccaaaactttcttagtaaaatccatgatcaatacgacggccggtaacacc

SEQ ID NO: 166308 - DNA, 75 bp, Artificial Sequence
  Synthetic
gctgacgcgtccaggccagtcccgagaccgtgagacgcgcctgccacatctgcttgcccgacgcgtgaatcacag

SEQ ID NO: 166309 - DNA, 75 bp, Artificial Sequence
  Synthetic
cgtcagctacgggcaggtgtcggtgtttgcgctcggccgccgacgggtagtggtgcacgttgatgctggggatgt

SEQ ID NO: 166310 - DNA, 75 bp, Artificial Sequence
  Synthetic
cacatagatcgacatgggctcctggctggggcagatgcttcggcccgtggggttgtgcacgttgaccgacacgtt

SEQ ID NO: 166311 - DNA, 75 bp, Artificial Sequence
  Synthetic
ctggggcagatgcttcggcccgtggggttgtgcacgttgaccgacacgttctccacctcgctgcccgtaaagtac

SEQ ID NO: 166312 - DNA, 75 bp, Artificial Sequence
  Synthetic
ggcaacatgtgtcccgcactggcgattgcgctcgcagccgcgctcttgagtaacacgcacccgggaatgggaagt

SEQ ID NO: 166313 - DNA, 75 bp, Artificial Sequence
  Synthetic
ctaatatcaccgtcacattcactacgtcgataaatacccccaataacgttacttccaccgtcaccaccacggtac

SEQ ID NO: 166314 - DNA, 75 bp, Artificial Sequence
  Synthetic
agcgagggctggctcacgcgtacgtggatacccgtctgcaggagtcgcgtctcgtgcggcagcaccggcgtatcg

SEQ ID NO: 166315 - DNA, 75 bp, Artificial Sequence
  Synthetic
ggatacccgtctgcaggagtcgcgtctcgtgcggcagcaccggcgtatcgccgcgactaaacacggctttcagca

SEQ ID NO: 166316 - DNA, 75 bp, Artificial Sequence
  Synthetic
ataggcaggcgaccaaacgcggaacccgaaataaaaacgttctacacagagacaaccgcggattattgagtgtct

SEQ ID NO: 166317 - DNA, 75 bp, Artificial Sequence
  Synthetic
tttcccctccgacgataaaggtaagtagcacctacctttccgtctattccccttcctcccccgctaacctgacat

SEQ ID NO: 166318 - DNA, 75 bp, Artificial Sequence
  Synthetic
cggggacgccagtcgcatgggcagcaggtcctccagcgcgatggaagcgcccagcaccgagagctgctgttgcga

SEQ ID NO: 166319 - DNA, 75 bp, Artificial Sequence
  Synthetic
ccagcaccgagagctgctgttgcgacggcgaatgggatgtggaccgcgagtgtagcgtggatttgacttggtgcg

SEQ ID NO: 166320 - DNA, 75 bp, Artificial Sequence
  Synthetic
gtgggaacgtggcgccgttctcgtcgctcaccagtacggttaattccaaccaggagcgcggtagccagaccgtaa

SEQ ID NO: 166321 - DNA, 75 bp, Artificial Sequence
  Synthetic
gctcaccagtacggttaattccaaccaggagcgcggtagccagaccgtaacgggcattttgagtccctgacggtt

SEQ ID NO: 166322 - DNA, 75 bp, Artificial Sequence
  Synthetic
gtcttcccactcgtcgtcatcgctctcgtggccggcggccatacgcgcggcaaccgcgtcttcccctcctcttct

SEQ ID NO: 166323 - DNA, 75 bp, Artificial Sequence
  Synthetic
caattcgtaagggacgcgcacctccagtccctcgtccgccgcgccggagcgtggcggtacaaagtaaggcagtgg

SEQ ID NO: 166324 - DNA, 75 bp, Artificial Sequence
  Synthetic
gtggcggtacaaagtaaggcagtggcgcgtccgaaaagaagggtcgtcgcaccgtttcgcgtcgcagccgcaggc

SEQ ID NO: 166325 - DNA, 75 bp, Artificial Sequence
  Synthetic
gcgtgagtgacgacagcgtcaggtccggcggtgattcgttcgggtctagctccaatcgtccaaagacggagggtc

SEQ ID NO: 166326 - DNA, 75 bp, Artificial Sequence
  Synthetic
cggcggtgattcgttcgggtctagctccaatcgtccaaagacggagggtcccaatgtcttggccgtggtttccga

SEQ ID NO: 166327 - DNA, 75 bp, Artificial Sequence
  Synthetic
taacgccgtgtgatgcgcggctttacgtcgtagcggtagccgtttcagcagcggcgtgatgatacggagcgcgaa

SEQ ID NO: 166328 - DNA, 75 bp, Artificial Sequence
  Synthetic
cgtcgtagcggtagccgtttcagcagcggcgtgatgatacggagcgcgaagagattgagtgataagcgcacgatg

SEQ ID NO: 166329 - DNA, 75 bp, Artificial Sequence
  Synthetic
cggcgtagagagcagaatctggaagggatctcgcaattcttcgggtcggaggtcgaggtgcaactggatcagatg

SEQ ID NO: 166330 - DNA, 75 bp, Artificial Sequence
  Synthetic
ggtcgaggtgcaactggatcagatggtaggtgccgcggtgcacccgaggctgacggatgtcgtgtttatccgtca

SEQ ID NO: 166331 - DNA, 75 bp, Artificial Sequence
  Synthetic
tccacgcacaccccccgtccccgcacaccccccgtccccggcgcaacccccgtccccgtccccagcgtaactccc

SEQ ID NO: 166332 - DNA, 75 bp, Artificial Sequence
  Synthetic
cggtactggcgacgcccatcatggtcgtggtggtagtggtggcgaggaaagtgagcggcggcgccgacagagctc

SEQ ID NO: 166333 - DNA, 75 bp, Artificial Sequence
  Synthetic
cgtggtggtagtggtggcgaggaaagtgagcggcggcgccgacagagctcggcgttggcggcggcatttgccgct

SEQ ID NO: 166334 - DNA, 75 bp, Artificial Sequence
  Synthetic
cccgaaaacaccgccgtcgccgccccgaaaagcgaagcgccgcgcaaaagctgcgtagaaactccgtgcaaagac

SEQ ID NO: 166335 - DNA, 75 bp, Artificial Sequence
  Synthetic
gttggggtcgacgcgtggcatgcttggtgtctgcgggcgcgagagggccggctcagcctttaaatatgcaggtcg

SEQ ID NO: 166336 - DNA, 75 bp, Artificial Sequence
  Synthetic
ggtgtctgcgggcgcgagagggccggctcagcctttaaatatgcaggtcgcggatttgttatcgggtgaaacgtc

SEQ ID NO: 166337 - DNA, 75 bp, Artificial Sequence
  Synthetic
tccctgaacgcgcggacagcccgttaccggcgcgctgcgctcacggcccgcaaaactccctcagccctgtcccgc

SEQ ID NO: 166338 - DNA, 75 bp, Artificial Sequence
  Synthetic
cgcgatctcgtcgtcgggcgacacgtgctgcggccgcgcgggcgtgcgcggctcgccgacgctgcgctcgcggtc

SEQ ID NO: 166339 - DNA, 75 bp, Artificial Sequence
  Synthetic
tgctgcggccgcgcgggcgtgcgcggctcgccgacgctgcgctcgcggtccagccgcatcagcagctcctggcac

SEQ ID NO: 166340 - DNA, 75 bp, Artificial Sequence
  Synthetic
gccaccatggacatggagaggcaggcggtcttcatgtcgatcagcaggtgctggtcgatgaccggatcggggatg

SEQ ID NO: 166341 - DNA, 75 bp, Artificial Sequence
  Synthetic
cggtcttcatgtcgatcagcaggtgctggtcgatgaccggatcggggatggtgaaggtggcgtcgcgaaaagtaa

SEQ ID NO: 166342 - DNA, 75 bp, Artificial Sequence
  Synthetic
caccaccggtaccactactacctcccccaacgtcacttcaaccacgtccagcgccacgtcgaattcaatctccac

SEQ ID NO: 166343 - DNA, 75 bp, Artificial Sequence
  Synthetic
gtgtcaggggactgtcggcggggtgtgtcaggggtgcggtgtgcgcggctggctggaagcagtgtgccccggggt

SEQ ID NO: 166344 - DNA, 75 bp, Artificial Sequence
  Synthetic
ccgccgcgaaaggcccccgtccccgccgcaaacgcccccgtctccgcaacgccccgtccctgccgcaaaaggccc

SEQ ID NO: 166345 - DNA, 75 bp, Artificial Sequence
  Synthetic
gtcgctggttgatttccagcgccagtggcatgggtacgatccagggcagcaccagctcccactggcccagcgtca

SEQ ID NO: 166346 - DNA, 75 bp, Artificial Sequence
  Synthetic
tggcatgggtacgatccagggcagcaccagctcccactggcccagcgtcagcaggttctcgcgcgccagcggtcc

SEQ ID NO: 166347 - DNA, 75 bp, Artificial Sequence
  Synthetic
acccccccgggcttgtacaccccccgtctccgcacaccccccgtccccggcgcaacccccgtccccgtccccagc

SEQ ID NO: 166348 - DNA, 75 bp, Artificial Sequence
  Synthetic
gagcagtccgtgcgtcggtacgtgtaggaggatctggttgccttctacgcgccgcatcaacgtcagcgtcatatt

SEQ ID NO: 166349 - DNA, 75 bp, Artificial Sequence
  Synthetic
aggaggatctggttgccttctacgcgccgcatcaacgtcagcgtcatattgcgcagcaggccgcgcagtcgtacg

SEQ ID NO: 166350 - DNA, 75 bp, Artificial Sequence
  Synthetic
ggcacaacggccgctactagcttggtcagtttgcctacgtcggcgatgctgagcttgtggtcgaaagtgcagaag

SEQ ID NO: 166351 - DNA, 75 bp, Artificial Sequence
  Synthetic
tcagtttgcctacgtcggcgatgctgagcttgtggtcgaaagtgcagaagatgttggcctccatggccgccatag

SEQ ID NO: 166352 - DNA, 75 bp, Artificial Sequence
  Synthetic
agcgtggcgcgtccgggcccgcgtttgcgtctaggtgactcgccgctaacctgcggtcgtcgccgtcctccttac

SEQ ID NO: 166353 - DNA, 75 bp, Artificial Sequence
  Synthetic
gtgtgtcgcgggcgtgtgccgggtgtgtcgggggtgtgctggcggggtgtgtcaggggtgcggtgtgcgcggctg

SEQ ID NO: 166354 - DNA, 75 bp, Artificial Sequence
  Synthetic
gatggaagcagtgtgccccggggtcctcgacccccccccctcccctgggcgatcgcctctgcgggttgtgccgta

SEQ ID NO: 166355 - DNA, 75 bp, Artificial Sequence
  Synthetic
atggattgctgcagcgggatgatttcgcctacgacgtagttaccaaagtgcgtttcggacgtagcaaaagccccg

SEQ ID NO: 166356 - DNA, 75 bp, Artificial Sequence
  Synthetic
ggtgggctgctgacccaggctgtcttgtgccttcagctgctgcgaaaaagatcggtagctggccaggtctttgga

SEQ ID NO: 166357 - DNA, 75 bp, Artificial Sequence
  Synthetic
cggcacgggttttcgatgagttgttccgtgccttcgacgcagacgtactgcgtgtcagtgtcgccgcggatgcag

SEQ ID NO: 166358 - DNA, 75 bp, Artificial Sequence
  Synthetic
tccttggcgcgtagcaggtactcgtcgatggttttgaagagcgttttgttggccgcgataatctcttctgtgtta

SEQ ID NO: 166359 - DNA, 75 bp, Artificial Sequence
  Synthetic
ccaccgcaccgcgccgcagcacacgcaactccaaatttcacccccccgcaaaaaaacccccccgcccctcggaga

SEQ ID NO: 166360 - DNA, 75 bp, Artificial Sequence
  Synthetic
gcgatgtcgggtgttgtagagtacgtcgctcagacagccggcttgcgaggcccaggggttgtgtgtggccgcgaa

SEQ ID NO: 166361 - DNA, 75 bp, Artificial Sequence
  Synthetic
ccgtgtcgtacggatcgacggccagcatgcaggaggcacgcccgcgcgggttgttggggatcttaaagtaattaa

SEQ ID NO: 166362 - DNA, 75 bp, Artificial Sequence
  Synthetic
cgccgaggcggcgccagcaagcgccgtgcacgtcgctgcctataaaagccaggtgcgtgtcggccgtggcacacg

SEQ ID NO: 166363 - DNA, 75 bp, Artificial Sequence
  Synthetic
cggacatgctgccgaacgtcagcatggagatggtctccgtgtctaacagttgcggccgttctacgccggccgcgt

SEQ ID NO: 166364 - DNA, 75 bp, Artificial Sequence
  Synthetic
ggagatggtctccgtgtctaacagttgcggccgttctacgccggccgcgtgccggatccagcggtccacctcgtc

SEQ ID NO: 166365 - DNA, 75 bp, Artificial Sequence
  Synthetic
tacgtaggctacgcaggtatttgacgtgtaacccagacccatgtctacggtgttaatgttctgcgtgacgtggta

SEQ ID NO: 166366 - DNA, 75 bp, Artificial Sequence
  Synthetic
gtgtaacccagacccatgtctacggtgttaatgttctgcgtgacgtggtacgtggtgctgatgtcgcgttcctcc

SEQ ID NO: 166367 - DNA, 75 bp, Artificial Sequence
  Synthetic
gtgtcggtgcgtacggccgtgagtgcgaatcccgggtggatgtgcgccttggtctgcagcaccagtgaaactggt

SEQ ID NO: 166368 - DNA, 75 bp, Artificial Sequence
  Synthetic
cgaatcccgggtggatgtgcgccttggtctgcagcaccagtgaaactggtgagattttgtataacatggcggcca

SEQ ID NO: 166369 - DNA, 75 bp, Artificial Sequence
  Synthetic
actcgtgcgcgaaggctgtgggtagcgggaaaccaccgtcgtgacggtgatagtgcgggaactcggtcacgtagc

SEQ ID NO: 166370 - DNA, 75 bp, Artificial Sequence
  Synthetic
tagtgcgggaactcggtcacgtagcgtttaatgtcgtcgctcaacgccgcgcagatggtggggtttgagtagaaa

SEQ ID NO: 166371 - DNA, 75 bp, Artificial Sequence
  Synthetic
acgtgctgacgtgagataaagtccggcaggccctgacgctgcgcgtggtccagaggcgcgcgcacttcgagcacc

SEQ ID NO: 166372 - DNA, 75 bp, Artificial Sequence
  Synthetic
gtggcgacgtcctccaccagctcggtcagcatctcgcctacggcttgacgttgcgccgctatcgagtcttcgggg

SEQ ID NO: 166373 - DNA, 75 bp, Artificial Sequence
  Synthetic
tcagcatctcgcctacggcttgacgttgcgccgctatcgagtcttcgggggtgacaccgcttgtgctctctttcg

SEQ ID NO: 166374 - DNA, 75 bp, Artificial Sequence
  Synthetic
acgtcgtacctgacgtggagaccgcggtggcggccggcatcaggagaaacgccggtcggtaaaagaggtctacta

SEQ ID NO: 166375 - DNA, 75 bp, Artificial Sequence
  Synthetic
gccgcaggcccggttgttggtcatggcgggcatgaggcagagataaaagaccttttgtaacgtccattcgtcgtc

SEQ ID NO: 166376 - DNA, 75 bp, Artificial Sequence
  Synthetic
gcgggcatgaggcagagataaaagaccttttgtaacgtccattcgtcgtcggtggcacggtaatcgtccacaaac

SEQ ID NO: 166377 - DNA, 75 bp, Artificial Sequence
  Synthetic
gggttcaacggttgccggtcggccactacctgtacgccttccatgttacgcggcaggtgcgtaacgaaggggggc

SEQ ID NO: 166378 - DNA, 75 bp, Artificial Sequence
  Synthetic
ggcagcgctgagatgcgcgttaccagacgcagcacggcgaccagattgcggtagtgaaagagcaactgcggtggt

SEQ ID NO: 166379 - DNA, 75 bp, Artificial Sequence
  Synthetic
gacgcagcacggcgaccagattgcggtagtgaaagagcaactgcggtggtagggcgccatcagccaggtgttcgg

SEQ ID NO: 166380 - DNA, 75 bp, Artificial Sequence
  Synthetic
gtgtgaaacatgttgacgatacaacgtgctacgaaagtgcggattagcaaaaaagcgtcgacgttgccgtgtacc

SEQ ID NO: 166381 - DNA, 75 bp, Artificial Sequence
  Synthetic
ggttttgaaaagtcgcaacgtctcttcgtagtcgggtggtggccgcagtcgcatgtgttccatgatctcccaggt

SEQ ID NO: 166382 - DNA, 75 bp, Artificial Sequence
  Synthetic
gcaccgcccatgggttcctgctgaaaacgacactcgagcagtcgttgcatggcgggttccgagggcggtccgcgt

SEQ ID NO: 166383 - DNA, 75 bp, Artificial Sequence
  Synthetic
cagccctacggggaagaaaaacgtcaggtccacgttacgttctagcggatctttggtatcggtgtttttgtagac

SEQ ID NO: 166384 - DNA, 75 bp, Artificial Sequence
  Synthetic
cggcgccgagaccgtttctttggtgatgtggcttgagagcagcgacatgatgatctgcataacgttggccgtgct

SEQ ID NO: 166385 - DNA, 75 bp, Artificial Sequence
  Synthetic
atgtggcttgagagcagcgacatgatgatctgcataacgttggccgtgcttaccatcacgccgctgatcttggcc

SEQ ID NO: 166386 - DNA, 75 bp, Artificial Sequence
  Synthetic
ttgagcacatagtcgcgatcgcgcgtgcgattcagcaaaaagagcgtggccagcattttggccttgaagctctgc

SEQ ID NO: 166387 - DNA, 75 bp, Artificial Sequence
  Synthetic
ggtatggttgatgtgcatcgtgggcacgtttctgaacgtgctggtgattaccaccatcctgtactaccgtcgtaa

SEQ ID NO: 166388 - DNA, 75 bp, Artificial Sequence
  Synthetic
tcgcgcagatacgtgaggcaggctgcgctgagctcaaaggggatggtgatgggggatttttcactgtatttggtg

SEQ ID NO: 166389 - DNA, 75 bp, Artificial Sequence
  Synthetic
cgctgagctcaaaggggatggtgatgggggatttttcactgtatttggtgaccataatggtggtctgacgactgg

SEQ ID NO: 166390 - DNA, 75 bp, Artificial Sequence
  Synthetic
ggtcgtggaacttgatggcgtgcgccgccgcggccaagccgctggtcaaaaaataaacccattccaggcgattgc

SEQ ID NO: 166391 - DNA, 75 bp, Artificial Sequence
  Synthetic
cgccgcggccaagccgctggtcaaaaaataaacccattccaggcgattgcagaaggtgccgaagatggcttcgaa

SEQ ID NO: 166392 - DNA, 75 bp, Artificial Sequence
  Synthetic
cttgacgtgcgtcagaaagtcagtgggaatgcctactttaggcaggagctcgagcgccgaccagttctccatcgc

SEQ ID NO: 166393 - DNA, 75 bp, Artificial Sequence
  Synthetic
ggaatgcctactttaggcaggagctcgagcgccgaccagttctccatcgcggcggcggcgtgagcgcgaggcgtc

SEQ ID NO: 166394 - DNA, 75 bp, Artificial Sequence
  Synthetic
agtcgtcggcggctccgctatgccgcgccgggttttacacgtccccgtgcacgttcgcgcctgcaacctcaccca

SEQ ID NO: 166395 - DNA, 75 bp, Artificial Sequence
  Synthetic
acgttcgcgcctgcaacctcacccaagagctatcgacgggcgaggacgcccgcttctgtcgtccgcgacccgtta

SEQ ID NO: 166396 - DNA, 75 bp, Artificial Sequence
  Synthetic
gtgtcaagctggtactgggtcgtctgttactgggacccgtggccgtaccctgtttttgcgacggtgaagtggagg

SEQ ID NO: 166397 - DNA, 75 bp, Artificial Sequence
  Synthetic
cctttggacgggtcagcgtcacgcggcatggcgcgacgctgctgtgtcgcgtggaccatctgacctggatcagta

SEQ ID NO: 166398 - DNA, 75 bp, Artificial Sequence
  Synthetic
gacgcagttttgtcgcgggccgctgctctacgtgcaccgacgttgttgttgcggatccgtgaccgccgggcgcgc

SEQ ID NO: 166399 - DNA, 75 bp, Artificial Sequence
  Synthetic
gacggcgtgacggtgtacgtggaggtacaaggtcagtacggactgcgcgtacctaccacgcgtttcgtagaacag

SEQ ID NO: 166400 - DNA, 75 bp, Artificial Sequence
  Synthetic
ggcctgcctgccgcgcgacctcagcctgcacctggacgactatccttacctgatggtggaaatcggacgcgtact

SEQ ID NO: 166401 - DNA, 75 bp, Artificial Sequence
  Synthetic
ctgcacctggacgactatccttacctgatggtggaaatcggacgcgtactcagtgtcagcgaggtagacgactac

SEQ ID NO: 166402 - DNA, 75 bp, Artificial Sequence
  Synthetic
ctcaacgtgcgtccgcaagcgccgtgcgcgttggacgctacacgcgacttttttctgctggagctgcaaaagctt

SEQ ID NO: 166403 - DNA, 75 bp, Artificial Sequence
  Synthetic
aagtgacgtcggagtttttcggtcgcgtgctggctcagctgcatcgcgaccgcgcccgcgtcatgatggcgcttc

SEQ ID NO: 166404 - DNA, 75 bp, Artificial Sequence
  Synthetic
cttgagcaccttcgttctcagtcgcttcaagcgacaggtactgtacttcaagttacaggtgagctacggcaagtg

SEQ ID NO: 166405 - DNA, 75 bp, Artificial Sequence
  Synthetic
tcgacgccttagcgtcacgtttgccgacacggacacggtgtggagaaaccttttctacgtttattatgaactagc

SEQ ID NO: 166406 - DNA, 75 bp, Artificial Sequence
  Synthetic
tttctgggcgacatgcaattgcccgcggacaactttctcacgtctccccatccctgaccctccgtccgtcctcct

SEQ ID NO: 166407 - DNA, 75 bp, Artificial Sequence
  Synthetic
ggaggaggaagagacgctggaatcgggggagactgacgccacgccgccatttgactttacggggcagcagctgcg

SEQ ID NO: 166408 - DNA, 75 bp, Artificial Sequence
  Synthetic
ggggagactgacgccacgccgccatttgactttacggggcagcagctgcgccgggcctatcaggaacaccgacgt

SEQ ID NO: 166409 - DNA, 75 bp, Artificial Sequence
  Synthetic
acgggcgtgagtctggaccgcatcgccgtcaacgctttcaacaccaaccgcgttatcaatatgaaggccgcgctc

SEQ ID NO: 166410 - DNA, 75 bp, Artificial Sequence
  Synthetic
ccgtcaacgctttcaacaccaaccgcgttatcaatatgaaggccgcgctctcgtccatcgccgcgtcgggtctcg

SEQ ID NO: 166411 - DNA, 75 bp, Artificial Sequence
  Synthetic
cttgcaccgtcagcacctttgtttccaacgacgccgtctacattaactcgctcaacgtcaatattcgcggttcct

SEQ ID NO: 166412 - DNA, 75 bp, Artificial Sequence
  Synthetic
caacgacgccgtctacattaactcgctcaacgtcaatattcgcggttcctaccccgagtttctgtactcgctggg

SEQ ID NO: 166413 - DNA, 75 bp, Artificial Sequence
  Synthetic
cgtgcatgggctggaggaccaggcggtgatccgctcggagcgcagcaaggtgtactggaccaccaactttccgtg

SEQ ID NO: 166414 - DNA, 75 bp, Artificial Sequence
  Synthetic
gtgatccgctcggagcgcagcaaggtgtactggaccaccaactttccgtgcatgatctcgcatactaacaacgtc

SEQ ID NO: 166415 - DNA, 75 bp, Artificial Sequence
  Synthetic
aaagaactctcgtgcatcaagaacatgcgcgacgtgtgcatcgattacggtctgcaccgcgttttcacgcaacta

SEQ ID NO: 166416 - DNA, 75 bp, Artificial Sequence
  Synthetic
tgcgcgacgtgtgcatcgattacggtctgcaccgcgttttcacgcaactagagctgcgcaattcgtaccagatcc

SEQ ID NO: 166417 - DNA, 75 bp, Artificial Sequence
  Synthetic
agttggaccgcctagtatttgaggcggcacagcggggtctctttgactacagcaagaacctcacggcgcacacca

SEQ ID NO: 166418 - DNA, 75 bp, Artificial Sequence
  Synthetic
ggcacagcggggtctctttgactacagcaagaacctcacggcgcacaccaagatcaagcacacttgtgcgctcat

SEQ ID NO: 166419 - DNA, 75 bp, Artificial Sequence
  Synthetic
tttagcagcgtccagaacagcgacgcgactttggggatggcctcgtgctcacctccgcggagagcgccgccggac

SEQ ID NO: 166420 - DNA, 75 bp, Artificial Sequence
  Synthetic
gaacgccaacgtgctgacggtgtgtcagcacgtggaagcccacaagatccctcgcacgcgcctcaaagtgttagt

SEQ ID NO: 166421 - DNA, 75 bp, Artificial Sequence
  Synthetic
cgaggtgctgggcgtgttgcagagtatcagcggtacgccgcacacgcgcgaagtgatccaccagacgttgtttcg

SEQ ID NO: 166422 - DNA, 75 bp, Artificial Sequence
  Synthetic
atgctagccttacatataggtaccgtcatgggtgaagcaggcattaagcacagaaaacaccgtagggggggggga

SEQ ID NO: 166423 - DNA, 75 bp, Artificial Sequence
  Synthetic
cgtcccttctgtcccaacctccgtcagcgttgacggcagttctgaacccacgtcgccgcgagcgcggtttgcatc

SEQ ID NO: 166424 - DNA, 75 bp, Artificial Sequence
  Synthetic
agcgttgacggcagttctgaacccacgtcgccgcgagcgcggtttgcatcacgatgatggaagccgcggccgctg

SEQ ID NO: 166425 - DNA, 75 bp, Artificial Sequence
  Synthetic
cggtgcgcgagcacgcgtttcgcaacggaccgctgtcgcaactgattcgccgtgtgttaccgccgccgcccgacg

SEQ ID NO: 166426 - DNA, 75 bp, Artificial Sequence
  Synthetic
ccgaagacgacgtggtttttgcttccgagctgtgtttttattgcagcggtcgttttaaccgcaggtcgtccgtct

SEQ ID NO: 166427 - DNA, 75 bp, Artificial Sequence
  Synthetic
attacccattgcgccaagttggtggtggaatgcggtcagttggggagtagtaggctacggtggcgcgacggtgat

SEQ ID NO: 166428 - DNA, 75 bp, Artificial Sequence
  Synthetic
taggctacggtggcgcgacggtgatgcgagtggtgaggagcgccggggagacgacgacagcagggacgagctgta

SEQ ID NO: 166429 - DNA, 75 bp, Artificial Sequence
  Synthetic
gccccagacacgttatttggccgggtaccagcgtgctttgggcgccggacgttgtgatcactacggtgcagcgac

SEQ ID NO: 166430 - DNA, 75 bp, Artificial Sequence
  Synthetic
caccttcttgctctgtctgggcctggtgctggcttttccgcatcttaaaggcaccgtctttctctgttgcaccgg

SEQ ID NO: 166431 - DNA, 75 bp, Artificial Sequence
  Synthetic
gttgtgatcactacggtgcagcgacgaatctcggcggcgcgcgccctggtgaacacgttccgccaatattttttt

SEQ ID NO: 166432 - DNA, 75 bp, Artificial Sequence
  Synthetic
gtgctggcttttccgcatcttaaaggcaccgtctttctctgttgcaccggctttatgccgcccttaagtttgatg

SEQ ID NO: 166433 - DNA, 75 bp, Artificial Sequence
  Synthetic
cagagtgccacgcgcggtgattcggacatgtttgatggtgtggtggccagcgcttatcaccgtttgcgaatgagt

SEQ ID NO: 166434 - DNA, 75 bp, Artificial Sequence
  Synthetic
acatgtttgatggtgtggtggccagcgcttatcaccgtttgcgaatgagtaatattccgcgttcatccgcccgtc

SEQ ID NO: 166435 - DNA, 75 bp, Artificial Sequence
  Synthetic
cacatccctgtccccaacgtaacccccgtccccgccggcgccaccccctgtccccagcgcaatgaacccccgcgc

SEQ ID NO: 166436 - DNA, 75 bp, Artificial Sequence
  Synthetic
tccccagcgcaatgaacccccgcgctcgccgcaaaaggcccccggccccgcaacaccccgggccagcgcaacccc

SEQ ID NO: 166437 - DNA, 75 bp, Artificial Sequence
  Synthetic
ttctttgtcaagtctgtctttacgagctggacgaggacgagatgggcgaggagatgctgggcatgttggccggaa

SEQ ID NO: 166438 - DNA, 75 bp, Artificial Sequence
  Synthetic
gctggacgaggacgagatgggcgaggagatgctgggcatgttggccggaaagcccgaggatgccgccgtctcggg

SEQ ID NO: 166439 - DNA, 75 bp, Artificial Sequence
  Synthetic
aaaaacccgcggaaggcgaagcgccgcgcagaagcgccgtggaaacacccgtagagagatccctcagcgcggtga

SEQ ID NO: 166440 - DNA, 75 bp, Artificial Sequence
  Synthetic
gcatttgcaccaggaggcgctggaggccttggatcctccgccgccgcgcgtcgaggagaacgaccttgtcaacgt

SEQ ID NO: 166441 - DNA, 75 bp, Artificial Sequence
  Synthetic
gccttggatcctccgccgccgcgcgtcgaggagaacgaccttgtcaacgtggtgctgcgccgttattatcgcagt

SEQ ID NO: 166442 - DNA, 75 bp, Artificial Sequence
  Synthetic
ttggggagttttacgcgcctgggttacgatcgtctcgtttctgccgatgccggcgtcagtcgccggcacctggtg

SEQ ID NO: 166443 - DNA, 75 bp, Artificial Sequence
  Synthetic
acgatcgtctcgtttctgccgatgccggcgtcagtcgccggcacctggtggctctgctgcgtgcctagctgaccc

SEQ ID NO: 166444 - DNA, 75 bp, Artificial Sequence
  Synthetic
gattctggcgcttggccgagtagcgtgccgtcgtgccttcggccagcgtgacgcggtgcaggttctgaatctgct

SEQ ID NO: 166445 - DNA, 75 bp, Artificial Sequence
  Synthetic
tgccgtcgtgccttcggccagcgtgacgcggtgcaggttctgaatctgctccagaagatactcgatggggtcgtg

SEQ ID NO: 166446 - DNA, 75 bp, Artificial Sequence
  Synthetic
ttccacggccagcgccttgtcgcggcccatgaggtagaagggctgttcgatgtggttctggtcgggcgtgtggta

SEQ ID NO: 166447 - DNA, 75 bp, Artificial Sequence
  Synthetic
tgtggttctggtcgggcgtgtggtagaagagcacgcggatgagcgtgctgctctgcacgctctgtcggatgaggc

SEQ ID NO: 166448 - DNA, 75 bp, Artificial Sequence
  Synthetic
ggctcagcaccgagatgatcatgtgcgccgcgcactcggcgatggctacctcagaactctcggagaggtcgcgca

SEQ ID NO: 166449 - DNA, 75 bp, Artificial Sequence
  Synthetic
cgccgcgcactcggcgatggctacctcagaactctcggagaggtcgcgcaaaaagaaatgctctaggccgtaaat

SEQ ID NO: 166450 - DNA, 75 bp, Artificial Sequence
  Synthetic
gtccagatacacgtaaagcgtcttgccgaaataatcgtaggcgttggtgttgagcgtgctgtaacgcaaaatatc

SEQ ID NO: 166451 - DNA, 75 bp, Artificial Sequence
  Synthetic
ccgaaataatcgtaggcgttggtgttgagcgtgctgtaacgcaaaatatcgaactcttcgcggctctggtccgtg

SEQ ID NO: 166452 - DNA, 75 bp, Artificial Sequence
  Synthetic
gctcaccaatcgcgtgcttggctattcgacgcccaccatctacatgaccaacctctattccactaactttctcac

SEQ ID NO: 166453 - DNA, 75 bp, Artificial Sequence
  Synthetic
ttggccgtcttgcgcacctgcgagttgaggctgatgaaggtgggcttgtgcagtcggtagcaaggacacgctgtg

SEQ ID NO: 166454 - DNA, 75 bp, Artificial Sequence
  Synthetic
gtcggtgatctactactcaagttgcacagtgggctttgccaccgtagccttgatcgccgccgaccgctatcgcgt

SEQ ID NO: 166455 - DNA, 75 bp, Artificial Sequence
  Synthetic
cagtcggtagcaaggacacgctgtggcgtcgcccttctccgtgaagctgtgcaggtgctcttcgcacacgtaaga

SEQ ID NO: 166456 - DNA, 75 bp, Artificial Sequence
  Synthetic
acgtggcgtcactggtagtgttggtggacgatatgaagatgatcttggtggtattctgggccaggaaccccagaa

SEQ ID NO: 166457 - DNA, 75 bp, Artificial Sequence
  Synthetic
gaagtgcgcctcgtccaccagcagcaaatggaagttttgtcctcggatgctctgtgtagagaggagacagaaaag

SEQ ID NO: 166458 - DNA, 75 bp, Artificial Sequence
  Synthetic
gtcccagccccagagcgatgtgtttcaataaaaattatgtagtatcatattatgcgtgtcctggtttttcatttt

SEQ ID NO: 166459 - DNA, 75 bp, Artificial Sequence
  Synthetic
ccgccaggtgaggcgggatcgccgtgtgccaaccgggctgcgacctgaaaaccggaaccaatccgccgacaccgg

SEQ ID NO: 166460 - DNA, 75 bp, Artificial Sequence
  Synthetic
gtgccaaccgggctgcgacctgaaaaccggaaccaatccgccgacaccggcgccgcgtgacgcgcgcccataaaa

SEQ ID NO: 166461 - DNA, 75 bp, Artificial Sequence
  Synthetic
tttttgttttaatcccgtatggcgcggacgcctagtgtccgtttcccattatcagggtcctctgtttagagatcg

SEQ ID NO: 166462 - DNA, 75 bp, Artificial Sequence
  Synthetic
tccagatacgcagttttgttatcctaacaaaacccgtgtcatgctaaaaacggtaatgcaggatgaaagtcccgt

SEQ ID NO: 166463 - DNA, 75 bp, Artificial Sequence
  Synthetic
gcacgcctggttccccatttgcactgcctcattaatcccatcctgtacgcactgctgggtcatgactttctgcag

SEQ ID NO: 166464 - DNA, 75 bp, Artificial Sequence
  Synthetic
gcgcacgccactacggaggatgtttttatctttgtcgaccgcctctttcaacacttttccttccttttccaggcc

SEQ ID NO: 166465 - DNA, 75 bp, Artificial Sequence
  Synthetic
aactggtcgcgtccgtgttcgagcacctgacggtggagtgcgtcaacgacatcctggacgcctgcagccacccgg

SEQ ID NO: 166466 - DNA, 75 bp, Artificial Sequence
  Synthetic
gcgacgctcagacgtcatgtgcgacgcctcgggcgcctgtgacatgaggcacgtccagaacgcgtttaccgagga

SEQ ID NO: 166467 - DNA, 75 bp, Artificial Sequence
  Synthetic
gcctcgggcgcctgtgacatgaggcacgtccagaacgcgtttaccgaggagatccagttacactccctctacgcg

SEQ ID NO: 166468 - DNA, 75 bp, Artificial Sequence
  Synthetic
gcttggtggcggtgttcattaaatgcattccgtgtatttattggtacatttgcaaatcgccgagtataccggtat

SEQ ID NO: 166469 - DNA, 75 bp, Artificial Sequence
  Synthetic
atcagtgtaacgtgaagcaagtgtgggaacaatgccagtgaagaatatataaaagccagaaacatacataaatga

SEQ ID NO: 166470 - DNA, 75 bp, Artificial Sequence
  Synthetic
cacaccctgacacacccggcacacgcccgcgacacacccgcggcacaccctgacacacccgccacacccggcaca

SEQ ID NO: 166471 - DNA, 75 bp, Artificial Sequence
  Synthetic
tggtgttgtgtatgttacgatgcggtgtgcctgtcggtgtaattggatgtatgttacttatccgtggcgttgtga

SEQ ID NO: 166472 - DNA, 75 bp, Artificial Sequence
  Synthetic
ggtcgttacgccgacgtgatccaagaggtggtcgagcgcgaccgcctcaaaaagcaggtggaggacagtatttac

SEQ ID NO: 166473 - DNA, 75 bp, Artificial Sequence
  Synthetic
aaagcaggtggaggacagtatttacttcacctttaataaggttttccgttctatgcataacgtcaaccgtatttc

SEQ ID NO: 166474 - DNA, 75 bp, Artificial Sequence
  Synthetic
gtatcgggacctgcacagcaagtggggcgtgcacctgtttaccttgcgtccgtcccgcggcgcgaccggcgcggc

SEQ ID NO: 166475 - DNA, 75 bp, Artificial Sequence
  Synthetic
tgtcatcaaggttagtcgtaagaagcgtgaggacgcgcttctgaaacagatgcgttccgaatatggaaacgcacc

SEQ ID NO: 166476 - DNA, 75 bp, Artificial Sequence
  Synthetic
cgtgaggacgcgcttctgaaacagatgcgttccgaatatggaaacgcacctgtattcggatctggcgtttgaggc

SEQ ID NO: 166477 - DNA, 75 bp, Artificial Sequence
  Synthetic
gacgctgcgctacgtctactatcgtaatgtagacagcgctggccgatccgcgggccgcgctccgggcggagatga

SEQ ID NO: 166478 - DNA, 75 bp, Artificial Sequence
  Synthetic
gccgaggacgccgtgggcggcgatcgcgcttttgaccgcgagcggcggacttggcagcgggcctgttttcgtgta

SEQ ID NO: 166479 - DNA, 75 bp, Artificial Sequence
  Synthetic
ctaccgcgcccactggagttgctcgattacctacgtcaaagcggtctcactgtgacgttagagaaagagcagcgc

SEQ ID NO: 166480 - DNA, 75 bp, Artificial Sequence
  Synthetic
attacctacgtcaaagcggtctcactgtgacgttagagaaagagcagcgcgtgcgcatgttctatgccgtcttca

SEQ ID NO: 166481 - DNA, 75 bp, Artificial Sequence
  Synthetic
agaggcatcgctagacacaggttgatcgttgtgctagccccacctgagcagcgtcatgggtaaagcggtgattaa

SEQ ID NO: 166482 - DNA, 75 bp, Artificial Sequence
  Synthetic
ggcttctctggagacggccgtcagtactccattttttgaaattccgaacggagcaggaacctcctccgcgaacgg

SEQ ID NO: 166483 - DNA, 75 bp, Artificial Sequence
  Synthetic
cggcggcagattcagtaacctggagcagcgggtagcgcgtttgttgcgcggcgacgaggaattcatctatcacgc

SEQ ID NO: 166484 - DNA, 75 bp, Artificial Sequence
  Synthetic
catgtacgccaccgatccgcacgaccgcgacgaggtcgcgcgtacggacgagtggaagggtgccggtgtctcgcg

SEQ ID NO: 166485 - DNA, 75 bp, Artificial Sequence
  Synthetic
tctccgcgaggtctgggatgtgcagcatcgcgtgcgcctccgtgtgctgtggtacgtcaattccttttggcgcag

SEQ ID NO: 166486 - DNA, 75 bp, Artificial Sequence
  Synthetic
gaagtcgaactataccgggcgttggacgcttatcgggcgcgcatcgccgtcgagtacgtgctgattcgcgccgtg

SEQ ID NO: 166487 - DNA, 75 bp, Artificial Sequence
  Synthetic
acgcttatcgggcgcgcatcgccgtcgagtacgtgctgattcgcgccgtgcgcgacgagatctacgctgtactac

SEQ ID NO: 166488 - DNA, 75 bp, Artificial Sequence
  Synthetic
tcgcgagccccatcgggcccgccactgcccgttctccccgtggacgactggctcaactttcgggttgacctgttt

SEQ ID NO: 166489 - DNA, 75 bp, Artificial Sequence
  Synthetic
accacaactagaatgcagtgaaaaaaatgctttatttgtgaaatttgtgatgctattgctttatttgtaaccatt

SEQ ID NO: 166490 - DNA, 75 bp, Artificial Sequence
  Synthetic
aactttgccgtcatgccttggcgctctggatggatcgggcggacgtgcgtagctgtattattaaggcgctaacgc

SEQ ID NO: 166491 - DNA, 75 bp, Artificial Sequence
  Synthetic
ctggatggatcgggcggacgtgcgtagctgtattattaaggcgctaacgcctcgtctgagccggggtgccgccgc

SEQ ID NO: 166492 - DNA, 75 bp, Artificial Sequence
  Synthetic
aatgctttatttgtgaaatttgtgatgctattgctttatttgtaaccattataagctgcaataaacaagttaacg

SEQ ID NO: 166493 - DNA, 75 bp, Artificial Sequence
  Synthetic
attttatcgatgcatggggtcgtgcgctcctttcggtcgggcgctgcgggtcgtggggcgggcgtcaggcaccgg

SEQ ID NO: 166494 - DNA, 75 bp, Artificial Sequence
  Synthetic
gctcctttcggtcgggcgctgcgggtcgtggggcgggcgtcaggcaccgggcttgcgggtcatgcaccaggtgcg

SEQ ID NO: 166495 - DNA, 75 bp, Artificial Sequence
  Synthetic
cgagagcggtccgcccgccgaacggacttggtacgctgacgtggtgcgctgcgttcgcgcgcaagtggatttggg

SEQ ID NO: 166496 - DNA, 75 bp, Artificial Sequence
  Synthetic
cctcgcaccgggctttggatcgtccgtgatcgccgcggacgcctgcgacgttggctctcgcagcccgaggtgtgc

SEQ ID NO: 166497 - DNA, 75 bp, Artificial Sequence
  Synthetic
ggaggtctccaggaaggcgggcaccccggcgcgctcggccgcctccactccggggagcacgacggcgctgcccag

SEQ ID NO: 166498 - DNA, 75 bp, Artificial Sequence
  Synthetic
ccggcgcgctcggccgcctccactccggggagcacgacggcgctgcccagacccttgccctggtggtcgggcgag

SEQ ID NO: 166499 - DNA, 75 bp, Artificial Sequence
  Synthetic
cttcatggcttggcgcagcgggctttgcgagaccgattccagaactttgaagcagttcttgcaagaggaatgcat

SEQ ID NO: 166500 - DNA, 75 bp, Artificial Sequence
  Synthetic
gcggccagccgggaaccgctcaactcggccatgcgcgggccgatctcggcgaacaccgcccccgcttcgacgctc

SEQ ID NO: 166501 - DNA, 75 bp, Artificial Sequence
  Synthetic
cggccatgcgcgggccgatctcggcgaacaccgcccccgcttcgacgctctccggcgtggtccagaccgccaccg

SEQ ID NO: 166502 - DNA, 75 bp, Artificial Sequence
  Synthetic
cttccaacgtcgttgatacacgtcgtttttacggttactccccagaacccagaaagtctcgtccaagtcgtacca

SEQ ID NO: 166503 - DNA, 75 bp, Artificial Sequence
  Synthetic
tgacccgctcgatgtggcggtccggatcgacggtgtggcgcgtggcggggtagtcggcgaacgcggcggcgaggg

SEQ ID NO: 166504 - DNA, 75 bp, Artificial Sequence
  Synthetic
atcgacggtgtggcgcgtggcggggtagtcggcgaacgcggcggcgagggtgcgtacggccctggggacgtcgtc

SEQ ID NO: 166505 - DNA, 75 bp, Artificial Sequence
  Synthetic
gtcgtcgacgcatctgtcatttacctaccttgtaccaactgagcttcggaggtcctttgggtccagccagcattg

SEQ ID NO: 166506 - DNA, 75 bp, Artificial Sequence
  Synthetic
ggtcctttgggtccagccagcattgatttcttgccaagctttagccaggtgaccagcagtatgacgtgcgatggt

SEQ ID NO: 166507 - DNA, 75 bp, Artificial Sequence
  Synthetic
atttcttgccaagctttagccaggtgaccagcagtatgacgtgcgatggtattacgcccgacgtgatttacgagg

SEQ ID NO: 166508 - DNA, 75 bp, Artificial Sequence
  Synthetic
tcatccatgctctgcgtctggtgtacgggcctagcctggctcatggcctggaacatgcaacgacggttagccatc

SEQ ID NO: 166509 - DNA, 75 bp, Artificial Sequence
  Synthetic
cgggttgtggcaagcttatcatcgtgtttttcaaaggaaaaccacgtccccgtggttcggggggcctagacgttt

SEQ ID NO: 166510 - DNA, 75 bp, Artificial Sequence
  Synthetic
gtttttcaaaggaaaaccacgtccccgtggttcggggggcctagacgtttttttaacctcgactaaacacatgta

SEQ ID NO: 166511 - DNA, 75 bp, Artificial Sequence
  Synthetic
agaaggcagtgacgctaggcggcgccggcgcctggttgctgccgcgtcccgaaggctacacgcttttcttttaca

SEQ ID NO: 166512 - DNA, 75 bp, Artificial Sequence
  Synthetic
cggcgcctggttgctgccgcgtcccgaaggctacacgcttttcttttacattctgtgctacgacctgtttacctc

SEQ ID NO: 166513 - DNA, 75 bp, Artificial Sequence
  Synthetic
agaatacagcgatccctagtgaagccacacccattacgtgtagccatatccgcttacgtatacagccacacccct

SEQ ID NO: 166514 - DNA, 75 bp, Artificial Sequence
  Synthetic
aatacgcttgaggagagccatttgactctttccacaactatccaactcacaacgtggcactggggttgtgccgcc

SEQ ID NO: 166515 - DNA, 75 bp, Artificial Sequence
  Synthetic
ctctttccacaactatccaactcacaacgtggcactggggttgtgccgcctttgcaggtgtatcttatacacgtg

SEQ ID NO: 166516 - DNA, 75 bp, Artificial Sequence
  Synthetic
cagcttttgcacggatcacgagggacatgtagatcccactggcaattacgtgggttgcacccccgatatgggccg

SEQ ID NO: 166517 - DNA, 75 bp, Artificial Sequence
  Synthetic
catgtagatcccactggcaattacgtgggttgcacccccgatatgggccgctgtctttgttacgtgccctgtggg

SEQ ID NO: 166518 - DNA, 75 bp, Artificial Sequence
  Synthetic
gaggtgcatgtctccctgttacattacataaccatccttgattcagatggctccatttcgtagtcatcgggtcgt

SEQ ID NO: 166519 - DNA, 75 bp, Artificial Sequence
  Synthetic
gtcttcaagaagcttccagaggaactgcttccttcacgacattcaacagaccttgcattcctttggcgagagggg

SEQ ID NO: 166520 - DNA, 75 bp, Artificial Sequence
  Synthetic
tgtgccgtaggttctaagaccgcggcgcaggtcacactgggagacggcctggattatcacatcggtgtcaaggat

SEQ ID NO: 166521 - DNA, 75 bp, Artificial Sequence
  Synthetic
tggtggaaaataacatatagacaaacgcacaccggccttattccaagcggcttcggccagtaacgttaggggggg

SEQ ID NO: 166522 - DNA, 75 bp, Artificial Sequence
  Synthetic
agaccgatgtgtgggacctggttaaggtagaggaacctgtgtcacgtatgatagtgtgttcctgtccggtgctta

SEQ ID NO: 166523 - DNA, 75 bp, Artificial Sequence
  Synthetic
acttgtacagctcgtccatgccgagagtgatcccggcggcggtcacgaactccagcaggaccatgtgatcgcgct

SEQ ID NO: 166524 - DNA, 75 bp, Artificial Sequence
  Synthetic
agtgatcccggcggcggtcacgaactccagcaggaccatgtgatcgcgcttctcgttggggtctttgctcagggc

SEQ ID NO: 166525 - DNA, 75 bp, Artificial Sequence
  Synthetic
ggactcgccacggtttgtggcaaggcgtatgttatcatcatggagctactcacgttggtgttgtagcaactggca

SEQ ID NO: 166526 - DNA, 75 bp, Artificial Sequence
  Synthetic
cgtatgttatcatcatggagctactcacgttggtgttgtagcaactggcaaaaagcgccgtgctcttggcgccgc

SEQ ID NO: 166527 - DNA, 75 bp, Artificial Sequence
  Synthetic
tccagcaggaccatgtgatcgcgcttctcgttggggtctttgctcagggcggactgggtgctcaggtagtggttg

SEQ ID NO: 166528 - DNA, 75 bp, Artificial Sequence
  Synthetic
cccccgacacacccgcgacacacccggcacacacccacccagccgcaccccccacacaccccgaccgccgccggt

SEQ ID NO: 166529 - DNA, 75 bp, Artificial Sequence
  Synthetic
ggcccccgccatcgcgtccgcgcccccgcagctggcctccgtctccgtgccgctcgcccccgccggcaacggcgt

SEQ ID NO: 166530 - DNA, 75 bp, Artificial Sequence
  Synthetic
cgggggggtgcaatttggagttgcgtgtgcggaggatggcgaataaaagcgacgtgcggcgcgcacggcgaaaag

SEQ ID NO: 166531 - DNA, 75 bp, Artificial Sequence
  Synthetic
tcgatgttgtggcggatcttgaagttcaccttgatgccgttcttctgcttgtcggccatgatatagacgttgtgg

SEQ ID NO: 166532 - DNA, 75 bp, Artificial Sequence
  Synthetic
cgacctctttgagcacaaactgcgacacgtgcttttggtgcgccacgtagccgatgctgatgccgatcatgtgct

SEQ ID NO: 166533 - DNA, 75 bp, Artificial Sequence
  Synthetic
gaccccccatccgacggcccggccgggctgggacccccgcaccggggtcccggttcccgtccgcggcccgggggg

SEQ ID NO: 166534 - DNA, 75 bp, Artificial Sequence
  Synthetic
cacgtgcttttggtgcgccacgtagccgatgctgatgccgatcatgtgcttaagcagaaacgagataatggggat

SEQ ID NO: 166535 - DNA, 75 bp, Artificial Sequence
  Synthetic
tcaccttgatgccgttcttctgcttgtcggccatgatatagacgttgtggctgttgtagttgtactccagcttgt

SEQ ID NO: 166536 - DNA, 75 bp, Artificial Sequence
  Synthetic
tgtgcggaggatggcgaataaaagcgacgtgcggcgcgcacggcgaaaagcagccgcgcgcctgatcttgcgtgt

SEQ ID NO: 166537 - DNA, 75 bp, Artificial Sequence
  Synthetic
cggccagacgcggaaaaagaggaagttcccggggacagtgggggggggggcgcgcgggccccgggcacagcttcc

SEQ ID NO: 166538 - DNA, 75 bp, Artificial Sequence
  Synthetic
acttcacctcggcgcgggtcttgtagttgccgtcgtccttgaagaagatggtgcgctcctggacgtagccttcgg

SEQ ID NO: 166539 - DNA, 75 bp, Artificial Sequence
  Synthetic
ctgcgagaggaagtcgatctggaaggcgtggatgaggtactgcagcacgcgattggccagcacggggatcttggt

SEQ ID NO: 166540 - DNA, 75 bp, Artificial Sequence
  Synthetic
atccagccgcgcacacccccgacacacccggcacacgcccgcggcacacccgcgacacacccgacacacccaccc

SEQ ID NO: 166541 - DNA, 75 bp, Artificial Sequence
  Synthetic
tggttttctttattgaccagcggagtacacagtttacgagtaaaaaagacagggaaaggttatataaaatgctgt

SEQ ID NO: 166542 - DNA, 75 bp, Artificial Sequence
  Synthetic
gcgtggatgaggtactgcagcacgcgattggccagcacggggatcttggtcacggctataaaaaagatgacgtgt

SEQ ID NO: 166543 - DNA, 75 bp, Artificial Sequence
  Synthetic
gttgccgtcgtccttgaagaagatggtgcgctcctggacgtagccttcgggcatggcggacttgaagaagtcgtg

SEQ ID NO: 166544 - DNA, 75 bp, Artificial Sequence
  Synthetic
agcgcgccgccgcttctgcggcgtgttgtccacggcgctttctgcgcgccagtccggcacgggacagggctgagg

SEQ ID NO: 166545 - DNA, 75 bp, Artificial Sequence
  Synthetic
cacgggcagcttgccggtggtgcagatgaacttcagggtcagcttgccgtaggtggcatcgccctcgccctcgcc

SEQ ID NO: 166546 - DNA, 75 bp, Artificial Sequence
  Synthetic
tcgagccactttttaaagtcggtcatgaagttgttgatctgctgaaactgcggatcgcggtagagctcggtcaac

SEQ ID NO: 166547 - DNA, 75 bp, Artificial Sequence
  Synthetic
aggtggcatcgccctcgccctcgccggacacgctgaacttgtggccgtttacgtcgccgtccagctcgaccagga

SEQ ID NO: 166548 - DNA, 75 bp, Artificial Sequence
  Synthetic
cggatcgcggtagagctcggtcaacgcgtccagcttctggtaggaggcgcgctgctcctcggagcacgggcgaaa

SEQ ID NO: 166549 - DNA, 75 bp, Artificial Sequence
  Synthetic
aagcctcctcactacttctggaatagctcagaggccgaggcggcctcggcctctgcataaataaaaaaaattagt

SEQ ID NO: 166550 - DNA, 75 bp, Artificial Sequence
  Synthetic
gtcgcggtggcggccgcagaaggccatgagcggcaggaaggcctcgttgcacgagtgggccagcccgagttcggg

SEQ ID NO: 166551 - DNA, 75 bp, Artificial Sequence
  Synthetic
gctcttgcgcttctgcagctccgcgtagcgctcctggatcttggcggccgaatctccgcgcaacatgatggcggc

SEQ ID NO: 166552 - DNA, 75 bp, Artificial Sequence
  Synthetic
ggatccacccgaaaaccacgttgtcgcggacgtggcttgtgggacgggcgccgtcactcgttcgtcttcgtcgtc

SEQ ID NO: 166553 - DNA, 75 bp, Artificial Sequence
  Synthetic
gcggacgtggcttgtgggacgggcgccgtcactcgttcgtcttcgtcgtccctagtggtgtcgtctttctcggcg

SEQ ID NO: 166554 - DNA, 75 bp, Artificial Sequence
  Synthetic
gcggggacttgcgggcttttgcggcggggacagtggtggggacggagacacggggtgacgtcgcggacgggggcc

SEQ ID NO: 166555 - DNA, 75 bp, Artificial Sequence
  Synthetic
ccggggtccgccggggtttcaacgtccctgtgctcggtggaacggatggtcgagctgtcggcgcagtctccggcc

SEQ ID NO: 166556 - DNA, 75 bp, Artificial Sequence
  Synthetic
gccgatttctcggtctccgaggcttggcgcttcgaggaggccgtaaatatggcgctggtggcctgcgaggccgtg

SEQ ID NO: 166557 - DNA, 75 bp, Artificial Sequence
  Synthetic
gagtcggccgaggtgccggtgttggatagcagtagcagcggtggcgatagcgggccggaggacaaaaagaaaaac

SEQ ID NO: 166558 - DNA, 75 bp, Artificial Sequence
  Synthetic
atagcagtagcagcggtggcgatagcgggccggaggacaaaaagaaaaacgtcgggaataaaaccgcgggggaaa

SEQ ID NO: 166559 - DNA, 75 bp, Artificial Sequence
  Synthetic
ttctacgtcgacacgacgtgctggagcgtttcgcggccgcggctgagcctttgccgtcgctttgtgtgcgtgatt

SEQ ID NO: 166560 - DNA, 75 bp, Artificial Sequence
  Synthetic
gcgtttcgcggccgcggctgagcctttgccgtcgctttgtgtgcgtgattatgcgttacgcaatgctgaccgtgt

SEQ ID NO: 166561 - DNA, 75 bp, Artificial Sequence
  Synthetic
ccattccggggcgtgtggtgggtccccgaggggcgggggggtgtttttggcgggggggtgcaaattggagttgcg

SEQ ID NO: 166562 - DNA, 75 bp, Artificial Sequence
  Synthetic
caacaaggtgcaacacgtggaagccgtgctgcgacaggtgtacacgccgggcttgttagatcatcacaacgtgtg

SEQ ID NO: 166563 - DNA, 75 bp, Artificial Sequence
  Synthetic
gtgctgcgacaggtgtacacgccgggcttgttagatcatcacaacgtgtgcgacgtggaagccctgctgtggctg

SEQ ID NO: 166564 - DNA, 75 bp, Artificial Sequence
  Synthetic
tgtggtgcggtgggcacggcggtcgcggaggacggcgacggcgaataaaagcgccgtgcggcgcgcacggcgaaa

SEQ ID NO: 166565 - DNA, 75 bp, Artificial Sequence
  Synthetic
cggaggacggcgacggcgaataaaagcgccgtgcggcgcgcacggcgaaaagcagccgcgcgcgtgtcttgcgtg

SEQ ID NO: 166566 - DNA, 75 bp, Artificial Sequence
  Synthetic
gcgttgttgcccaaactcttttacgaacccgtgcgggactatatgacctacatgaatctggctgagctgtacgtc

SEQ ID NO: 166567 - DNA, 75 bp, Artificial Sequence
  Synthetic
tccctggggacgcgaagatcgactctcggggggtgagggacggcggccagacgcggaaaaagaggaagtacccgc

SEQ ID NO: 166568 - DNA, 75 bp, Artificial Sequence
  Synthetic
tcgccacgacgtctccgcgtatctttgtagcctcaggaatccgtccccacgtccacccatcccgagcactccaca

SEQ ID NO: 166569 - DNA, 75 bp, Artificial Sequence
  Synthetic
tcgagacgagcgcgtcagcaggccgggtcgatgacgccggcgacgaggtgcatttgcctttaaagcccgtctcgc

SEQ ID NO: 166570 - DNA, 75 bp, Artificial Sequence
  Synthetic
ggtcgatgacgccggcgacgaggtgcatttgcctttaaagcccgtctcgctggaccgtctcagagaggtgttgca

SEQ ID NO: 166571 - DNA, 75 bp, Artificial Sequence
  Synthetic
ccgcgtcggggggggggggagtcgcgggccccggggcacactgcttccatccgacacacccctgccacacccgcc

SEQ ID NO: 166572 - DNA, 75 bp, Artificial Sequence
  Synthetic
ggcacacgcccgcgacacacccggccaacacacccccgacacacccgcccaacacacccccgacacacccggcac

SEQ ID NO: 166573 - DNA, 75 bp, Artificial Sequence
  Synthetic
gctctacagtcagaaccgtctctgtttagatctcgcgcgtgacgaggcgcggaccgtgagttatagccccatcgt

SEQ ID NO: 166574 - DNA, 75 bp, Artificial Sequence
  Synthetic
ttagatctcgcgcgtgacgaggcgcggaccgtgagttatagccccatcgttatccaagactgcgccgcggctgtc

SEQ ID NO: 166575 - DNA, 75 bp, Artificial Sequence
  Synthetic
cgccgtcccacggtatctgttggcgggaccagcgggagttttgagggacggaccgggctgcgggtgtttgcggcg

SEQ ID NO: 166576 - DNA, 75 bp, Artificial Sequence
  Synthetic
ttgctggacgctctctcgctgaacgacgcgggtctcatcacgttgaatctatgacgtcggtcaacaaacagctct

SEQ ID NO: 166577 - DNA, 75 bp, Artificial Sequence
  Synthetic
acgcgggtctcatcacgttgaatctatgacgtcggtcaacaaacagctcttaaaggacgtgatgcgcgtcgacct

SEQ ID NO: 166578 - DNA, 75 bp, Artificial Sequence
  Synthetic
ggaccagcgggagttttgagggacggaccgggctgcgggtgtttgcggcgtgctgtaggcgggacggtgcggaac

SEQ ID NO: 166579 - DNA, 75 bp, Artificial Sequence
  Synthetic
tgcgggatgtttctgcgggggttttcacggcgcttctgcgcgccccacggtctctgtcgtttcgggggtttctgc

SEQ ID NO: 166580 - DNA, 75 bp, Artificial Sequence
  Synthetic
ggtgatgcgtgtggccgctcgggaacagacccgatacagtcagcgaacgacgcagtgcgtggccgcacacctgtt

SEQ ID NO: 166581 - DNA, 75 bp, Artificial Sequence
  Synthetic
cagacccgatacagtcagcgaacgacgcagtgcgtggccgcacacctgttggagcaacgggcggccgtgcagcaa

SEQ ID NO: 166582 - DNA, 75 bp, Artificial Sequence
  Synthetic
ggggacggggggcttttgcgctgcggggcctcgcgggaccgggctgagggacggggacggggcgttgcgggaccg

SEQ ID NO: 166583 - DNA, 75 bp, Artificial Sequence
  Synthetic
tctgcagcgcaacacccgttgccgtccctcagcgcggtccccggcaccgccggtcccgcgagtccccgtccccaa

SEQ ID NO: 166584 - DNA, 75 bp, Artificial Sequence
  Synthetic
acggtagacgacgtgagagccaccttggtggactcggtttcggcgacgtgcgatttggacctggaggtcgacgac

SEQ ID NO: 166585 - DNA, 75 bp, Artificial Sequence
  Synthetic
tggtggactcggtttcggcgacgtgcgatttggacctggaggtcgacgacgccgtctaacaggtatagcaatccc

SEQ ID NO: 166586 - DNA, 75 bp, Artificial Sequence
  Synthetic
ggccgttgtagatttgcgtattattgcacgtgcagtttaactgacagttcatactcgtagtgttggaagtgatgt

SEQ ID NO: 166587 - DNA, 75 bp, Artificial Sequence
  Synthetic
cccgccacacccggcacacacccacccagccgcgcccccgacacaccccgaccgccgccggtgcgggacagggct

SEQ ID NO: 166588 - DNA, 75 bp, Artificial Sequence
  Synthetic
acccactccggatatacgtcatcctgtggaattccggacatacggtgacgtagcgagcgtagcgagctacgtcac

SEQ ID NO: 166589 - DNA, 75 bp, Artificial Sequence
  Synthetic
ccctaggaacagggaagactgtcgccactatgtcctccgcacttcggtctcgggctcgctcggcctcgctcggaa

SEQ ID NO: 166590 - DNA, 75 bp, Artificial Sequence
  Synthetic
cactatgtcctccgcacttcggtctcgggctcgctcggcctcgctcggaacgacgactcagggctgggatccgcc

SEQ ID NO: 166591 - DNA, 75 bp, Artificial Sequence
  Synthetic
ctgtccccgcaacccccggccccagcgcaacccccgtccccgcaacaccccgccccaaacctccctcagccccgt

SEQ ID NO: 166592 - DNA, 75 bp, Artificial Sequence
  Synthetic
cgccccaaacctccctcagccccgtcccgcgagcaaatactgtgggaggaaacgcaccggcagtgcgcagagagg

SEQ ID NO: 166593 - DNA, 75 bp, Artificial Sequence
  Synthetic
ggtgcaggccgcgcaggccgccgccgctcaggttgcccaggctcacgtcgatgaagacgaggtcgtggatctgat

SEQ ID NO: 166594 - DNA, 75 bp, Artificial Sequence
  Synthetic
ggccgacgaggccggcggcggcgtcaccactttgaccaccctgagttccgtcagcacaaccaccgtgcttggaca

SEQ ID NO: 166595 - DNA, 75 bp, Artificial Sequence
  Synthetic
gaacctgcgtcggcccgtggtgccgtccacgtcgtctcgcggcagcgccgccagcggcgacggttaccacggctt

SEQ ID NO: 166596 - DNA, 75 bp, Artificial Sequence
  Synthetic
gagtcgcgccgcgcgcttcctcttttccgcgcgcggccgccgtccccctggggacttcctcttttccgcgtcgtt

SEQ ID NO: 166597 - DNA, 75 bp, Artificial Sequence
  Synthetic
gcgctgccgcgaaacctcggccatgtggtcgttcgagtacgatcgcgacggcgacgtgaccagcgtacgccgcgc

SEQ ID NO: 166598 - DNA, 75 bp, Artificial Sequence
  Synthetic
gccgttggtgtcgctggcccgcaccccgctgtgccgacgtcgtgtgggcggcgtggacgcggtgctcgaagaaaa

SEQ ID NO: 166599 - DNA, 75 bp, Artificial Sequence
  Synthetic
ggacggggaccttttgcggcggggacaggggggtgtgcggggccggtgctggggttggcggcggggacttgcggg

SEQ ID NO: 166600 - DNA, 75 bp, Artificial Sequence
  Synthetic
gcgtggacgcggtgctcgaagaaaacgacgtggagctgcgcgcggaaagtcaggacagcgccgtggcatcgggcc

SEQ ID NO: 166601 - DNA, 75 bp, Artificial Sequence
  Synthetic
cacacgacgacgtgcattgcacctgttccaacgaccagatcatcaccacgtccatccgcggccttacgtgcgacc

SEQ ID NO: 166602 - DNA, 75 bp, Artificial Sequence
  Synthetic
ttccaacgaccagatcatcaccacgtccatccgcggccttacgtgcgacccgcgtatgttcttgcgccttacgca

SEQ ID NO: 166603 - DNA, 75 bp, Artificial Sequence
  Synthetic
gtcgctgcctataaaagccaggtgcgtgtcggccgtggcacacgggcgacggaggcgtccgcgtgtgtaaacggc

SEQ ID NO: 166604 - DNA, 75 bp, Artificial Sequence
  Synthetic
ctgttatgccgtggacatgagcgacgagagctaccgcctgggccagggctccttcggcgaggtctggccgctcga

SEQ ID NO: 166605 - DNA, 75 bp, Artificial Sequence
  Synthetic
gagagctaccgcctgggccagggctccttcggcgaggtctggccgctcgatcgctatcgcgtggtcaaggtggcg

SEQ ID NO: 166606 - DNA, 75 bp, Artificial Sequence
  Synthetic
cagccgccgtcgctggtgggcacgggcgtgcaccgcggtctgctcacggccacgggctgctgtctgctgcacaac

SEQ ID NO: 166607 - DNA, 75 bp, Artificial Sequence
  Synthetic
cacgggctgctgtctgctgcacaacgtcacggtacatcgacgtttccacacagacatgtttcatcacgaccagtg

SEQ ID NO: 166608 - DNA, 75 bp, Artificial Sequence
  Synthetic
gtgtcgtgtatgccactttgacattacacccatgaacgtgctcatcgacgtgaacccgcacaaccccagcgagat

SEQ ID NO: 166609 - DNA, 75 bp, Artificial Sequence
  Synthetic
acacccatgaacgtgctcatcgacgtgaacccgcacaaccccagcgagatcgtgcgcgccgcgctgtgcgattac

SEQ ID NO: 166610 - DNA, 75 bp, Artificial Sequence
  Synthetic
atccccaactgctcgcaccgtctgcgcgaatgttaccaccctgctttccgacccatgccgctgcagaagctgctc

SEQ ID NO: 166611 - DNA, 75 bp, Artificial Sequence
  Synthetic
gcgaatgttaccaccctgctttccgacccatgccgctgcagaagctgctcatctgcgacccgcacgcgcgtttcc

SEQ ID NO: 166612 - DNA, 75 bp, Artificial Sequence
  Synthetic
ggctgttggaccggcgcggtctggacgaggtgcgcatgggcacggaggcgttgctctttaagcacgccggcgcgg

SEQ ID NO: 166613 - DNA, 75 bp, Artificial Sequence
  Synthetic
cgaggtgcgcatgggcacggaggcgttgctctttaagcacgccggcgcggcctgccgcgcgttggagaacggcaa

SEQ ID NO: 166614 - DNA, 75 bp, Artificial Sequence
  Synthetic
gcatggcgccgcgctggtgtcgcacacgctgcgctttgtggaggccaagatgtcctcgtgtcgcgtacgcgcctt

SEQ ID NO: 166615 - DNA, 75 bp, Artificial Sequence
  Synthetic
acgctgcgctttgtggaggccaagatgtcctcgtgtcgcgtacgcgcctttcgccgcttctaccacgaatgctcg

SEQ ID NO: 166616 - DNA, 75 bp, Artificial Sequence
  Synthetic
aacgcctttcggcgcaccaccagcataatctgcgaggaggaccttgacggtgactgccgtcaactgttccccgag

SEQ ID NO: 166617 - DNA, 75 bp, Artificial Sequence
  Synthetic
taatctgcgaggaggaccttgacggtgactgccgtcaactgttccccgagtaaccgggacgcggaacgtgacggt

SEQ ID NO: 166618 - DNA, 75 bp, Artificial Sequence
  Synthetic
ggggcgtctcgagtttggactacgacgacgatgaggagctcacccggctgctggcggtttgggacgatgagcccc

SEQ ID NO: 166619 - DNA, 75 bp, Artificial Sequence
  Synthetic
cgacgatgaggagctcacccggctgctggcggtttgggacgatgagcccctcagtctctttctcatgaacacctt

SEQ ID NO: 166620 - DNA, 75 bp, Artificial Sequence
  Synthetic
caagatgctgcgggcccacggtacgccagtagccgaggactttatgacgcgcgtggccgcgctggctcgcgacga

SEQ ID NO: 166621 - DNA, 75 bp, Artificial Sequence
  Synthetic
ccagtagccgaggactttatgacgcgcgtggccgcgctggctcgcgacgagggtctgcgcgacattttgggtcag

SEQ ID NO: 166622 - DNA, 75 bp, Artificial Sequence
  Synthetic
gcctgaccattttcaacgtgagcatggtcacgcagtaccgcagctacaaacgctcgctctttttcttctcgcgtc

SEQ ID NO: 166623 - DNA, 75 bp, Artificial Sequence
  Synthetic
cacggcggctcggacgactacgtgtggctcagccggttgctggatttggcgcccaactatcggcaggtcgagctc

SEQ ID NO: 166624 - DNA, 75 bp, Artificial Sequence
  Synthetic
ggctcagccggttgctggatttggcgcccaactatcggcaggtcgagctcttccagttgctggaaaaggaatcgc

SEQ ID NO: 166625 - DNA, 75 bp, Artificial Sequence
  Synthetic
tcgtcagcggctgtctgcccggcgccgcggcggcggacggttcgggtggcggcggctcgcactacacgggctcgc

SEQ ID NO: 166626 - DNA, 75 bp, Artificial Sequence
  Synthetic
cgcggcggcggacggttcgggtggcggcggctcgcactacacgggctcgcgcgccggcgtctcgccgggcatcca

SEQ ID NO: 166627 - DNA, 75 bp, Artificial Sequence
  Synthetic
cgacggcctcggtctgctcatcgaccccacgtcggggctgctgggcgcttccatggacctgtgcttcggcgtgct

SEQ ID NO: 166628 - DNA, 75 bp, Artificial Sequence
  Synthetic
cccacgtcggggctgctgggcgcttccatggacctgtgcttcggcgtgctcaagcagggcagcggtcgcaccttg

SEQ ID NO: 166629 - DNA, 75 bp, Artificial Sequence
  Synthetic
gtgcagaacgtgctgcggaggcacgacgcggcggccgtggcctcgctgttgcagtcacacccggtgccgggcgtg

SEQ ID NO: 166630 - DNA, 75 bp, Artificial Sequence
  Synthetic
acgcggcggccgtggcctcgctgttgcagtcacacccggtgccgggcgtggagtttcgcggtgaacgcgagaccc

SEQ ID NO: 166631 - DNA, 75 bp, Artificial Sequence
  Synthetic
cgtgcggcgcgcctgtcttgcgtgtctgtctttgctgttgcgtgtctttgaatccccggggaaaagaggaagaag

SEQ ID NO: 166632 - DNA, 75 bp, Artificial Sequence
  Synthetic
aatccccggggaaaagaggaagaagaaggggagtccctggggacggcagcgcgagtccctggggacgcgcagagc

SEQ ID NO: 166633 - DNA, 75 bp, Artificial Sequence
  Synthetic
agccgcccgaaccgctgcgtgagtacctggccgatctgctgtatctcaataaggccgagtgttcggaagtgatcg

SEQ ID NO: 166634 - DNA, 75 bp, Artificial Sequence
  Synthetic
cctggccgatctgctgtatctcaataaggccgagtgttcggaagtgatcgtgtttgacgccaagcacctgaatga

SEQ ID NO: 166635 - DNA, 75 bp, Artificial Sequence
  Synthetic
cggcgctgatcactacctgcggggcagcccgggcgattcgccgccgccgatacctttcgaggacgaaaacacgcc

SEQ ID NO: 166636 - DNA, 75 bp, Artificial Sequence
  Synthetic
agcccgggcgattcgccgccgccgatacctttcgaggacgaaaacacgcccgagctgctgggccggctcaacgtg

SEQ ID NO: 166637 - DNA, 75 bp, Artificial Sequence
  Synthetic
cagtacgtgctcagccaatactatataaagaagcatccggacccggagcggatcgatttccgcgacctgcctacc

SEQ ID NO: 166638 - DNA, 75 bp, Artificial Sequence
  Synthetic
taaagaagcatccggacccggagcggatcgatttccgcgacctgcctaccgtctacctggtctcggccatcttcc

SEQ ID NO: 166639 - DNA, 75 bp, Artificial Sequence
  Synthetic
ccccgtgtgctgttgacctgggtagcaagtcctccaactcgacctgccgcttgaatgtgacggagttggcctcga

SEQ ID NO: 166640 - DNA, 75 bp, Artificial Sequence
  Synthetic
gacacgtcgtaaacatggcccatatgaaaaagagcatgccgaacgaccagctgatgccggtgcggtattcgttgc

SEQ ID NO: 166641 - DNA, 75 bp, Artificial Sequence
  Synthetic
tcctgctcatcgtcacgcccgtggtctttgaccctcagtttacgcgccatgccgtctctaccgtgttagaccgtt

SEQ ID NO: 166642 - DNA, 75 bp, Artificial Sequence
  Synthetic
ctttgaccctcagtttacgcgccatgccgtctctaccgtgttagaccgttggagtcgcgacctgtcccgcaagac

SEQ ID NO: 166643 - DNA, 75 bp, Artificial Sequence
  Synthetic
ggaggtttgcggggcgtcagcgcgcggccgaccgggccgcgggtgtttgcacggagcttttgcgctgcgctttgt

SEQ ID NO: 166644 - DNA, 75 bp, Artificial Sequence
  Synthetic
ggccgaccgggccgcgggtgtttgcacggagcttttgcgctgcgctttgtgcacgctgccggtgcgtggggtctc

SEQ ID NO: 166645 - DNA, 75 bp, Artificial Sequence
  Synthetic
ccacgggggtttttgccgtgctaaacgccggcggcggccacgggggttgcgctagggacgggggcttttgcgctg

SEQ ID NO: 166646 - DNA, 75 bp, Artificial Sequence
  Synthetic
aaagatgctctgggtcgccaggtgtctctacgctcctacgacaacatccctccgacttcctcctcggacgaaggg

SEQ ID NO: 166647 - DNA, 75 bp, Artificial Sequence
  Synthetic
tccgacttcctcctcggacgaaggggaggacgatgacgacggggaggatgacgataacgaggagcggcaacagaa

SEQ ID NO: 166648 - DNA, 75 bp, Artificial Sequence
  Synthetic
cgggacggtgctgttgattgcggcgcggaggcttttgcgctggactgctggtggggacgggggtgttgattgcag

SEQ ID NO: 166649 - DNA, 75 bp, Artificial Sequence
  Synthetic
ccccaagaaaaacgcggtgcgctcgacgtttcgcgaggacaaggctccgaaaccgagcaagcagtcaaaaaagaa

SEQ ID NO: 166650 - DNA, 75 bp, Artificial Sequence
  Synthetic
aaagaaaccctcaaaacatcaccaccatcagcaaagctccattatgcaggagacggacgacctagacgaagagga

SEQ ID NO: 166651 - DNA, 75 bp, Artificial Sequence
  Synthetic
tacgcctgaataagtgataataagcggatgaatggcagaaattcgatgataagctgtcaaacatgagaattggtc

SEQ ID NO: 166652 - DNA, 75 bp, Artificial Sequence
  Synthetic
ctaagcgactgccgcggcccgacacacccaggactccgcgccaaaagaagatttcacaacgtccacccacccccg

SEQ ID NO: 166653 - DNA, 75 bp, Artificial Sequence
  Synthetic
tgttctacacaggaaatctaactaggtcaacgcaattttattccaccgttacgcagaatactaacaaaaaaacac

SEQ ID NO: 166654 - DNA, 75 bp, Artificial Sequence
  Synthetic
gtctcgcgtacgattcgcgagtcgggaatgggacacccatgggtgtttctccgtgtgtatattattttttttttt

SEQ ID NO: 166655 - DNA, 75 bp, Artificial Sequence
  Synthetic
ctcacgcatctacttcacaacattggcgagggcgcagcgctcggctaccccgtcccccgcgcggaaatccgccgc

SEQ ID NO: 166656 - DNA, 75 bp, Artificial Sequence
  Synthetic
gtgtgtgtttgcgcccccgtgtgtctaatgtgctgtttgaaacacgtaaagtagctggtggaagaacagataaac

SEQ ID NO: 166657 - DNA, 75 bp, Artificial Sequence
  Synthetic
caccactgtattcatccatgttttcaccgaaccaacgagacagatcgaagaagccagaatctcccgactttaaat

SEQ ID NO: 166658 - DNA, 75 bp, Artificial Sequence
  Synthetic
accgaaccaacgagacagatcgaagaagccagaatctcccgactttaaattacataaatccaacgtattatgacc

SEQ ID NO: 166659 - DNA, 75 bp, Artificial Sequence
  Synthetic
tcgtcctcttcttcgcggaggcgacggctttccaagctgtcgtggtgactgagcgcagcgacttcttcgccggag

SEQ ID NO: 166660 - DNA, 75 bp, Artificial Sequence
  Synthetic
ggctttccaagctgtcgtggtgactgagcgcagcgacttcttcgccggaggctgtggccagcgcctggtacttga

SEQ ID NO: 166661 - DNA, 75 bp, Artificial Sequence
  Synthetic
atagccatagcgttcccaggcaaaagcaaacgccaaacctaatgcagtgaaaagcgcttgcagccagaaccagct

SEQ ID NO: 166662 - DNA, 75 bp, Artificial Sequence
  Synthetic
gtgttgaaaccaagtgccatctccaccaggttgacgatgagcgtgcgaaactgcaccgtacctttgagcttgggg

SEQ ID NO: 166663 - DNA, 75 bp, Artificial Sequence
  Synthetic
aagcagaaaaagtgcacggcggccatgaaggcgatcatgctgggcagccgaaatgacatggtcagtgtgaatagt

SEQ ID NO: 166664 - DNA, 75 bp, Artificial Sequence
  Synthetic
tgaaggcgatcatgctgggcagccgaaatgacatggtcagtgtgaatagttggaacgtgtccatgctgaggatga

SEQ ID NO: 166665 - DNA, 75 bp, Artificial Sequence
  Synthetic
taaggagctcatgtcgagagtaccgtaaatagtgtacggtgtttcgttacggatcagtacatgcgtgtttttcat

SEQ ID NO: 166666 - DNA, 75 bp, Artificial Sequence
  Synthetic
tgcgcatgctgatcttgatccagcataccaggtagtagatggtcacggctaaaaagacgagctgcatgaacacgg

SEQ ID NO: 166667 - DNA, 75 bp, Artificial Sequence
  Synthetic
taccaggtagtagatggtcacggctaaaaagacgagctgcatgaacacggcgtagcacaccagctgcaccgagtc

SEQ ID NO: 166668 - DNA, 75 bp, Artificial Sequence
  Synthetic
atagtagacgcaggggtagcccaggtgcggaaaattgctcagcaccagatgcacgctgacgttgacaaaagtcag

SEQ ID NO: 166669 - DNA, 75 bp, Artificial Sequence
  Synthetic
gcacgctgacgttgacaaaagtcagcaccatgaaaacgatagaagcgctccatgtccgtgtattcaccttatcca

SEQ ID NO: 166670 - DNA, 75 bp, Artificial Sequence
  Synthetic
tgggggcgcgccgatgacgacaggctcgcgggtcgttaaatactacgatgggagccgccgcggctcacgacgcgg

SEQ ID NO: 166671 - DNA, 75 bp, Artificial Sequence
  Synthetic
tcgcgggtcgttaaatactacgatgggagccgccgcggctcacgacgcggtttgagcacgtccgggcggtcggcg

SEQ ID NO: 166672 - DNA, 75 bp, Artificial Sequence
  Synthetic
ccacccgtacaccctgttcgggaccagctgtcatctcagctggtacggccttctggaggcctcggtgcctatcgt

SEQ ID NO: 166673 - DNA, 75 bp, Artificial Sequence
  Synthetic
ttctggaggcctcggtgcctatcgtacaatgtctgtttttggatctgggtggcggccgtgccgagccgcggcttc

SEQ ID NO: 166674 - DNA, 75 bp, Artificial Sequence
  Synthetic
tggcctcggccgtgactacggacgccgacgagcgccggcgcggcctagagcagcgtagcgccgtgttggcgcgcg

SEQ ID NO: 166675 - DNA, 75 bp, Artificial Sequence
  Synthetic
cgacgagcgccggcgcggcctagagcagcgtagcgccgtgttggcgcgcgtgttgctagaaggcagcgcgttaat

SEQ ID NO: 166676 - DNA, 75 bp, Artificial Sequence
  Synthetic
accggcactgggcgtggaaaccgcagcgctgtcgaacgcgcttagtcttttccacgtagccaagctagtggtcat

SEQ ID NO: 166677 - DNA, 75 bp, Artificial Sequence
  Synthetic
gcgctgtcgaacgcgcttagtcttttccacgtagccaagctagtggtcatcggctcgtatcccgaagtgcacgag

SEQ ID NO: 166678 - DNA, 75 bp, Artificial Sequence
  Synthetic
aatcaccagcacgttcagaaacgtgcccacgatgcacatcaaccataccccgaaccgagtgtactcgaacaactg

SEQ ID NO: 166679 - DNA, 75 bp, Artificial Sequence
  Synthetic
cacgctataagtaccccccccccacaatggaatgctgccaaactggttctttcccgttatagccatagcgttccc

SEQ ID NO: 166680 - DNA, 75 bp, Artificial Sequence
  Synthetic
cgaaccgagtgtactcgaacaactgataaatttcggtgctattcagggtgtgattcgttacgttgctcacctgta

SEQ ID NO: 166681 - DNA, 75 bp, Artificial Sequence
  Synthetic
ggttactacgcctacgatttggccatgtcgtttcgcgtcggcactcacaagtacgtgctggagcgcgacgacgag

SEQ ID NO: 166682 - DNA, 75 bp, Artificial Sequence
  Synthetic
gtacgtgctggagcgcgacgacgaggccgtcctggcacgcctctttgaggtgcgcgaggtgtgttttttgcgcac

SEQ ID NO: 166683 - DNA, 75 bp, Artificial Sequence
  Synthetic
ccgaagaagaggtgttcctcctcttgaaccgctgccatgggccactgtcaacgccgaaaaacgcttgtctggctg

SEQ ID NO: 166684 - DNA, 75 bp, Artificial Sequence
  Synthetic
acgagcagtgttgtttattgctgcagtcggcctggactcacctttacgacgtgcttttccgtggtttcgctgggc

SEQ ID NO: 166685 - DNA, 75 bp, Artificial Sequence
  Synthetic
gtcggcctggactcacctttacgacgtgcttttccgtggtttcgctgggcagccgccgctacgcgactacctggg

SEQ ID NO: 166686 - DNA, 75 bp, Artificial Sequence
  Synthetic
ccacggtctgcacacgttaatgcgcgagacggcgttggacgcggcggctgaggtgctctcgtggtgcggcttgcc

SEQ ID NO: 166687 - DNA, 75 bp, Artificial Sequence
  Synthetic
cgacatcgtgggctcggccggcaagctggaggtggaaccctgcgcgctctcgctcggcgtgcccgaggatgagtg

SEQ ID NO: 166688 - DNA, 75 bp, Artificial Sequence
  Synthetic
ggcggcgccgtgcgtctcaatgccacggcttttcgcgagcgaccggccggcggcgatcgtcgctggctgttgccg

SEQ ID NO: 166689 - DNA, 75 bp, Artificial Sequence
  Synthetic
cggcttttcgcgagcgaccggccggcggcgatcgtcgctggctgttgccgccgctgccgcgtgacgacggcgacg

SEQ ID NO: 166690 - DNA, 75 bp, Artificial Sequence
  Synthetic
ggccgcgtggtgggtcctcgagggagtgttgagggccgtaagcgtgttgtgtccgacgctgcctgcgcactgccg

SEQ ID NO: 166691 - DNA, 75 bp, Artificial Sequence
  Synthetic
aaaggcgatagaatgtggggacgaaacatatccagatacgcagttttgttattcgaacaaaacccgtgtgatgca

SEQ ID NO: 166692 - DNA, 75 bp, Artificial Sequence
  Synthetic
acatatccagatacgcagttttgttattcgaacaaaacccgtgtgatgcaaaaaacagtactgcaggatgaaagt

SEQ ID NO: 166693 - DNA, 75 bp, Artificial Sequence
  Synthetic
tgcacgttcgcgacgccacgctacatcgagtgctcatcgtggatttggtcgagcgcgtgctggccaagtgtgtac

SEQ ID NO: 166694 - DNA, 75 bp, Artificial Sequence
  Synthetic
tcgagtgctcatcgtggatttggtcgagcgcgtgctggccaagtgtgtacgcgcgcgcgacttcaatccctacgt

SEQ ID NO: 166695 - DNA, 75 bp, Artificial Sequence
  Synthetic
cgccttctggcagatccagagtctgctgggctacatctccgagcacgttacgtcagcctgcgcttcggccggcct

SEQ ID NO: 166696 - DNA, 75 bp, Artificial Sequence
  Synthetic
agtggccgttagatacactacgtgtctgtattggtacatttgcaaactgccgggtgtgtcggtatagtttagcga

SEQ ID NO: 166697 - DNA, 75 bp, Artificial Sequence
  Synthetic
tttgtgggttttgtcgcgtggccaccgcgagttttatgtctacgacggctattcgggtcacggacccgtctcggc

SEQ ID NO: 166698 - DNA, 75 bp, Artificial Sequence
  Synthetic
gactgttattggcgcaaactttttggcggcgacgatccgggtcccacctgtcgtgttcaagagagcgcgcccggc

SEQ ID NO: 166699 - DNA, 75 bp, Artificial Sequence
  Synthetic
gcggcgacgatccgggtcccacctgtcgtgttcaagagagcgcgcccggcgtgctgttggtctggggcgacgagc

SEQ ID NO: 166700 - DNA, 75 bp, Artificial Sequence
  Synthetic
gtttcgcggcgggacattgcggtggcgcttgttgcgcgggctgcgtcgtcactcaccgccattctagcggcggcg

SEQ ID NO: 166701 - DNA, 75 bp, Artificial Sequence
  Synthetic
gggcgacgcggaccacgcgagtggtggcggtctagatgccgctgccgggagtggtcataacggcggtagtgatcg

SEQ ID NO: 166702 - DNA, 75 bp, Artificial Sequence
  Synthetic
gcgttaggtggctgttgctgcgcggccggtggcgactggctttcggccgtgggtcatgtcctgggccggctgccg

SEQ ID NO: 166703 - DNA, 75 bp, Artificial Sequence
  Synthetic
ccggtggcgactggctttcggccgtgggtcatgtcctgggccggctgccggcgctgttacgggagcgcgtgagcg

SEQ ID NO: 166704 - DNA, 75 bp, Artificial Sequence
  Synthetic
tactgcgcttccagcccggtgaaaacgaagtaaggccgcacgctggggtgattgattgcgcgcccttccacggcg

SEQ ID NO: 166705 - DNA, 75 bp, Artificial Sequence
  Synthetic
attgattgcgcgcccttccacggcgtgtgggccgagcagggccagatcatcgtacagtcacgcgatacggcgttg

SEQ ID NO: 166706 - DNA, 75 bp, Artificial Sequence
  Synthetic
cacggcttgcgtggaggtctgggcgcgagagttattgtcgtcctccaccgcttccaccaccacttgttcttcttc

SEQ ID NO: 166707 - DNA, 75 bp, Artificial Sequence
  Synthetic
gaggagcgcgacgagtgggtgcgctcgctggcggttgacgcgcaacacgctgctaagcgggtggcttccgagggc

SEQ ID NO: 166708 - DNA, 75 bp, Artificial Sequence
  Synthetic
aaaaaagtgcgtcaaagttctcagcgtgtgacgtggatactagtaaaagggacgtcaaagctcactacgtgttgc

SEQ ID NO: 166709 - DNA, 75 bp, Artificial Sequence
  Synthetic
tgtctagttcgcttctcactcttcctctccccgttcccagcgcggtggcagcttggggggtgagggcaaattggg

SEQ ID NO: 166710 - DNA, 75 bp, Artificial Sequence
  Synthetic
tctccccgttcccagcgcggtggcagcttggggggtgagggcaaattggggtagttggcgttgagcacgtctagc

SEQ ID NO: 166711 - DNA, 75 bp, Artificial Sequence
  Synthetic
ctcacagacgtcaaccattggcaacatgaccaacgttacctctggcttaagtactgctacaactgtatattctac

SEQ ID NO: 166712 - DNA, 75 bp, Artificial Sequence
  Synthetic
atgaccaacgttacctctggcttaagtactgctacaactgtatattctacattcaatacatcatataacaatgca

SEQ ID NO: 166713 - DNA, 75 bp, Artificial Sequence
  Synthetic
tgaccggtaaggcggaaaaagaagcgtgctaccagctgcaggcaggtatgccgcgtctgctggaaaagcacgaag

SEQ ID NO: 166714 - DNA, 75 bp, Artificial Sequence
  Synthetic
gtagagcgcgctgcagatcagccgccgggcgctgtggtgcagcagccggccgaagctttcgcgcacgttcaccgc

SEQ ID NO: 166715 - DNA, 75 bp, Artificial Sequence
  Synthetic
ccaaatgctacatcttataacacaactattactgcgtcatacaacgtatctactaacagcaccgtgtttactatg

SEQ ID NO: 166716 - DNA, 75 bp, Artificial Sequence
  Synthetic
ctattactgcgtcatacaacgtatctactaacagcaccgtgtttactatgagcatgcctctagtcacaaactgca

SEQ ID NO: 166717 - DNA, 75 bp, Artificial Sequence
  Synthetic
aggcacttgcgcgttaagttgcaattttccacgcatgaaataacggtacagagcgcgaagtgcagcaggttgtcg

SEQ ID NO: 166718 - DNA, 75 bp, Artificial Sequence
  Synthetic
aacagaaaatacagacactactaaccatgaaatcgggaaacatattattgaaactattaagaaagccaacattcc

SEQ ID NO: 166719 - DNA, 75 bp, Artificial Sequence
  Synthetic
gccttgacgatgccgcagcggtgtttgagccgcagatccgagagcctcacctgcgtgacggcgtcttcggtctcg

SEQ ID NO: 166720 - DNA, 75 bp, Artificial Sequence
  Synthetic
aagaaaccaacgcaacaggaatagaaggaggcaatgttactataaaaggcaattatacatggaattgcagttcag

SEQ ID NO: 166721 - DNA, 75 bp, Artificial Sequence
  Synthetic
aggaggcaatgttactataaaaggcaattatacatggaattgcagttcagtctcctgggtacgacattacaatct

SEQ ID NO: 166722 - DNA, 75 bp, Artificial Sequence
  Synthetic
gctgcggtactcggccatggaaaccagcagcccgtgctccgtgtgcagccacagcttgtcgccgcgcaccgtaaa

SEQ ID NO: 166723 - DNA, 75 bp, Artificial Sequence
  Synthetic
agcagcccgtgctccgtgtgcagccacagcttgtcgccgcgcaccgtaaagtcgagcacttgcggctccatgatc

SEQ ID NO: 166724 - DNA, 75 bp, Artificial Sequence
  Synthetic
tacctcgcatactatatgccattcccctcatcaaaaccctacatcatatcacgacttatgtcgttcatgcaataa

SEQ ID NO: 166725 - DNA, 75 bp, Artificial Sequence
  Synthetic
cctcatcaaaaccctacatcatatcacgacttatgtcgttcatgcaataacacagaactgtatctatacgatctg

SEQ ID NO: 166726 - DNA, 75 bp, Artificial Sequence
  Synthetic
gccgacacgctctgggccgcgccgctcctcgtctgccgtgatcaagcggcgcggcgcggacctttcaagcgttcc

SEQ ID NO: 166727 - DNA, 75 bp, Artificial Sequence
  Synthetic
tcctcgtctgccgtgatcaagcggcgcggcgcggacctttcaagcgttcctgggccgccgctcgaggcagttccc

SEQ ID NO: 166728 - DNA, 75 bp, Artificial Sequence
  Synthetic
aatttctacttattcgtgacaccccgaaatggaactaatcatactgaaatcattaacactaccttcgtttgtcct

SEQ ID NO: 166729 - DNA, 75 bp, Artificial Sequence
  Synthetic
gaaatggaactaatcatactgaaatcattaacactaccttcgtttgtcctagaaccaacactaacaccaaaaata

SEQ ID NO: 166730 - DNA, 75 bp, Artificial Sequence
  Synthetic
acgtatcggcaaaacttgctgtcgtcgtaggcggcggctacgatctcgccgaaggagagctgcaggtaggcctcg

SEQ ID NO: 166731 - DNA, 75 bp, Artificial Sequence
  Synthetic
gccgcaccgtatggacaattatgttaatttgtgtagcctgtctgcttctattttttggacgacgagcttttagta

SEQ ID NO: 166732 - DNA, 75 bp, Artificial Sequence
  Synthetic
ggtacggggtccagcgtgcccagcgccaggatgtgacacagatagggcagggtcacgcgctctaccgtgtaattg

SEQ ID NO: 166733 - DNA, 75 bp, Artificial Sequence
  Synthetic
aatttgtgtagcctgtctgcttctattttttggacgacgagcttttagtaaaaagtaccaaatgttacatgacac

SEQ ID NO: 166734 - DNA, 75 bp, Artificial Sequence
  Synthetic
gcgaaaggtgcggaaatactcgttttcccacagctgcgtgaggaagcgttccagcgactcggtgccgggcacgaa

SEQ ID NO: 166735 - DNA, 75 bp, Artificial Sequence
  Synthetic
catgaagctacacaataaagtataacacactgaaaaacggtgttcataaatataccaatgcctactgaataaaaa

SEQ ID NO: 166736 - DNA, 75 bp, Artificial Sequence
  Synthetic
cacactgaaaaacggtgttcataaatataccaatgcctactgaataaaaagtagtattgcaatgaactggcggat

SEQ ID NO: 166737 - DNA, 75 bp, Artificial Sequence
  Synthetic
gacggaagggcgccgcgtcgcgcgccttgcgcacggcctccaacacgggcaggtggtacagttcggcgtcgcgcg

SEQ ID NO: 166738 - DNA, 75 bp, Artificial Sequence
  Synthetic
tactgcttcaaattattctaccaatggcactactactatctcaacctctgatactaccaatacaacagtcaacag

SEQ ID NO: 166739 - DNA, 75 bp, Artificial Sequence
  Synthetic
ggcactactactatctcaacctctgatactaccaatacaacagtcaacagtaaaggtacctccggaccctctaca

SEQ ID NO: 166740 - DNA, 75 bp, Artificial Sequence
  Synthetic
cccaggtctggttgagcgtgcgcaggtcctggatctcgtccacctgcgactggatctgctcctccaggcacttga

SEQ ID NO: 166741 - DNA, 75 bp, Artificial Sequence
  Synthetic
gtcctggatctcgtccacctgcgactggatctgctcctccaggcacttgatgacctgcttcttaaacaggtcgcg

SEQ ID NO: 166742 - DNA, 75 bp, Artificial Sequence
  Synthetic
aaaacaacgtcagtcacaaatattcagaccacaacatgtaccaacactagcacgaacgtcgtttgtgatagtttg

SEQ ID NO: 166743 - DNA, 75 bp, Artificial Sequence
  Synthetic
gctaagatgaacgggtgggctggggtgtgcttggtaactcactgtttgaatacgcgctcacgcacatatgtagca

SEQ ID NO: 166744 - DNA, 75 bp, Artificial Sequence
  Synthetic
agaccacaacatgtaccaacactagcacgaacgtcgtttgtgatagtttgaattatacggtccataaaacatgcg

SEQ ID NO: 166745 - DNA, 75 bp, Artificial Sequence
  Synthetic
ggcgccgccgggtcccaccacgccgggtccacccggaccacgcgcgggtagtagacggttttggtccaccagcga

SEQ ID NO: 166746 - DNA, 75 bp, Artificial Sequence
  Synthetic
gggggtcaggtcctgcagaaaggactcgacgctgtcctcgatgccgatgcgcgatttgctgtccgagacgttaag

SEQ ID NO: 166747 - DNA, 75 bp, Artificial Sequence
  Synthetic
gatggcacaatgtggactggatccactatggacattacacacataaaatgtgtgaactaggggactaccatagaa

SEQ ID NO: 166748 - DNA, 75 bp, Artificial Sequence
  Synthetic
gatggcacaatgtggactggatccactatggacattacacacataaaatgtgtgatctaggggactaccatagaa

SEQ ID NO: 166749 - DNA, 75 bp, Artificial Sequence
  Synthetic
gatggcacaatgtggactggatccactatggacattacacacataaaatgtgtgacctaggggactaccatagaa

SEQ ID NO: 166750 - DNA, 75 bp, Artificial Sequence
  Synthetic
gatggcacaatgtggactggatccactatggacattacacacataaaatgtgtgagctaggggactaccatagaa

SEQ ID NO: 166751 - DNA, 75 bp, Artificial Sequence
  Synthetic
ctatggacattacacacataaaatgtgtgaactaggggactaccatagaactactctacaaagtggcatatgttt

SEQ ID NO: 166752 - DNA, 75 bp, Artificial Sequence
  Synthetic
ctatggacattacacacataaaatgtgtgatctaggggactaccatagaactactctacaaagtggcatatgttt

SEQ ID NO: 166753 - DNA, 75 bp, Artificial Sequence
  Synthetic
ctatggacattacacacataaaatgtgtgacctaggggactaccatagaactactctacaaagtggcatatgttt

SEQ ID NO: 166754 - DNA, 75 bp, Artificial Sequence
  Synthetic
ctatggacattacacacataaaatgtgtgagctaggggactaccatagaactactctacaaagtggcatatgttt

SEQ ID NO: 166755 - DNA, 75 bp, Artificial Sequence
  Synthetic
gcatcgctgccccggtcgtgctgctccatcatctccaccagcttcttgcagttgagctcgtggcggctggcggtc

SEQ ID NO: 166756 - DNA, 75 bp, Artificial Sequence
  Synthetic
ccatcatctccaccagcttcttgcagttgagctcgtggcggctggcggtcaccactttcacaggaaaggtattga

SEQ ID NO: 166757 - DNA, 75 bp, Artificial Sequence
  Synthetic
tgataatagtgatgaagaaaactattacgtgacagtgttaaccagagacacgacgacttcaacttctggtacatg

SEQ ID NO: 166758 - DNA, 75 bp, Artificial Sequence
  Synthetic
tacgtgacagtgttaaccagagacacgacgacttcaacttctggtacatgccctgtgaaatacaacgccgaaccc

SEQ ID NO: 166759 - DNA, 75 bp, Artificial Sequence
  Synthetic
tggtgaacagcagcttgtcgcgctcataagccagcggttcggccgccacgtacaagcggatgtgcttgccgcgca

SEQ ID NO: 166760 - DNA, 75 bp, Artificial Sequence
  Synthetic
ataagccagcggttcggccgccacgtacaagcggatgtgcttgccgcgcagctgcgcctccagccgctccgagcg

SEQ ID NO: 166761 - DNA, 75 bp, Artificial Sequence
  Synthetic
gctatatgggcgggcatagtggtatcagtggcacttatagcgctttacatgggtagccatcgcacgcccaagaaa

SEQ ID NO: 166762 - DNA, 75 bp, Artificial Sequence
  Synthetic
cagtggcacttatagcgctttacatgggtagccatcgcacgcccaagaaaccgcgttataccaaacttcccaaat

SEQ ID NO: 166763 - DNA, 75 bp, Artificial Sequence
  Synthetic
cagcgccaggttagcctgcagcaggtcctgcgccagcgggtgtgtctcggtggcccgctgcacggccgcgcgtac

SEQ ID NO: 166764 - DNA, 75 bp, Artificial Sequence
  Synthetic
tcctgcgccagcgggtgtgtctcggtggcccgctgcacggccgcgcgtacaaattgcgcccgctcggccgcctcg

SEQ ID NO: 166765 - DNA, 75 bp, Artificial Sequence
  Synthetic
ctgcgtgtgtttattctaaattaaccacttatagtataaatcggggtattcatagacattaaaaacatgggtgta

SEQ ID NO: 166766 - DNA, 75 bp, Artificial Sequence
  Synthetic
cacttatagtataaatcggggtattcatagacattaaaaacatgggtgtacaatgtaacaataaactgctattac

SEQ ID NO: 166767 - DNA, 75 bp, Artificial Sequence
  Synthetic
tcgttatcggcgtactgatataaaatgtcgcggagcgcgcccagcacgcccgtttgcacgctctggcgcaacgaa

SEQ ID NO: 166768 - DNA, 75 bp, Artificial Sequence
  Synthetic
tgtcgcggagcgcgcccagcacgcccgtttgcacgctctggcgcaacgaagcgctccacaccaacagatactgct

SEQ ID NO: 166769 - DNA, 75 bp, Artificial Sequence
  Synthetic
ttactacaaactgaatatatacaaatacccatcacagtagctgagggaaacacaatttactttaatgctagcgat

SEQ ID NO: 166770 - DNA, 75 bp, Artificial Sequence
  Synthetic
tacccatcacagtagctgagggaaacacaatttactttaatgctagcgataactcctgtaatgtcatgccatcca

SEQ ID NO: 166771 - DNA, 75 bp, Artificial Sequence
  Synthetic
ccgtgatggtgtcaaagagcgtcttgcacactccgtagagcagctgcttgcgcagcacgcacgggtcgcgcagca

SEQ ID NO: 166772 - DNA, 75 bp, Artificial Sequence
  Synthetic
atgtacgtttatttttcagctcactgtttgaataccgtaaacataatgacgtacatatacgtggttatacaacag

SEQ ID NO: 166773 - DNA, 75 bp, Artificial Sequence
  Synthetic
gcacactccgtagagcagctgcttgcgcagcacgcacgggtcgcgcagcacctggtgcatgctctggccgcgaca

SEQ ID NO: 166774 - DNA, 75 bp, Artificial Sequence
  Synthetic
gacattccatgtaatatcaacgatgaacgtaaacaacgtagactactttgacaactgtaacaactataaatagag

SEQ ID NO: 166775 - DNA, 75 bp, Artificial Sequence
  Synthetic
gtcatccacgccgcggcccacgcccaagtacgacgacgccttgatcctcaacctctcgtcggccgccaagatcga

SEQ ID NO: 166776 - DNA, 75 bp, Artificial Sequence
  Synthetic
acggatcgtcgacaaggtcaagtccctctcgcgcgagcgctttgcgcccgaggatttttcgttccagtggtttcg

SEQ ID NO: 166777 - DNA, 75 bp, Artificial Sequence
  Synthetic
ggacaattgccgcggcaacgatgataattatctgcatcctaacatacgtcaatgtttcaccaaacagaagacgca

SEQ ID NO: 166778 - DNA, 75 bp, Artificial Sequence
  Synthetic
aattatctgcatcctaacatacgtcaatgtttcaccaaacagaagacgcagactacaaactagaaataacgtcaa

SEQ ID NO: 166779 - DNA, 75 bp, Artificial Sequence
  Synthetic
tcactcctccgcctcctcttctgccgccgctgccgcttcgtccgaggccggcggcacgcgcgtgccctgcgtcga

SEQ ID NO: 166780 - DNA, 75 bp, Artificial Sequence
  Synthetic
gccgctgccgcttcgtccgaggccggcggcacgcgcgtgccctgcgtcgaccgttggcccttctttcccttccgc

SEQ ID NO: 166781 - DNA, 75 bp, Artificial Sequence
  Synthetic
ctacgttggtaaatggcacatgcagacgctccacgttcttttggttgtggttgtgtcttttgccagcttttggtt

SEQ ID NO: 166782 - DNA, 75 bp, Artificial Sequence
  Synthetic
gtgatcaccggtaccacggtgatcgccgcgcagaacctcagcgcgatcctcaaccgcactcgttcggcgcaggtc

SEQ ID NO: 166783 - DNA, 75 bp, Artificial Sequence
  Synthetic
tcgtcagcaagcacgtgccgctggctgacagcgccgttagccacgagacgctggaacgctaccgcgtgtgcgagc

SEQ ID NO: 166784 - DNA, 75 bp, Artificial Sequence
  Synthetic
cgcacgaggagaccaccatccagcgcctgcagatcaacgatctgctcgcctactggccggtcatcgccgacatcg

SEQ ID NO: 166785 - DNA, 75 bp, Artificial Sequence
  Synthetic
tactggccggtcatcgccgacatcgtggacaaatgcttaaatatgtgggagcgcaaggccgcttcggcctccgcc

SEQ ID NO: 166786 - DNA, 75 bp, Artificial Sequence
  Synthetic
cttatgctgcgctacatgctacaggtggtggtgtttttttactacttttacaacgccctgggcgacacgcgactt

SEQ ID NO: 166787 - DNA, 75 bp, Artificial Sequence
  Synthetic
tggtggtgtttttttactacttttacaacgccctgggcgacacgcgactttaccgcgaacgccgcgtgccctgca

SEQ ID NO: 166788 - DNA, 75 bp, Artificial Sequence
  Synthetic
agctgtcgcccgctttctactatgaggccctttttctctacatgctggatgtggcgaccgtaccagaggctgaga

SEQ ID NO: 166789 - DNA, 75 bp, Artificial Sequence
  Synthetic
tgcgcaagggcgttgacgtgctctcggcgctgattcagaacgaggtgctcatcaactactgcgacatcgccgaca

SEQ ID NO: 166790 - DNA, 75 bp, Artificial Sequence
  Synthetic
ggcgctgattcagaacgaggtgctcatcaactactgcgacatcgccgacaactgggtcatgtttattcacaacaa

SEQ ID NO: 166791 - DNA, 75 bp, Artificial Sequence
  Synthetic
catcccaccttaagcgatgagtccataaagcaccgttgtccgggtacggtaaaagtgacccggattgtagcacgt

SEQ ID NO: 166792 - DNA, 75 bp, Artificial Sequence
  Synthetic
ggcctacgtggaccgcttcgtgcggccgcccagctccatccgcaacccctcgtacgccgccgagatgacgcggct

SEQ ID NO: 166793 - DNA, 75 bp, Artificial Sequence
  Synthetic
gcttacttcaagcggctgcacgagcagatccgcctgagcgagcgccaccgtctctttgatctgcccgtctactgc

SEQ ID NO: 166794 - DNA, 75 bp, Artificial Sequence
  Synthetic
tcttttttttttctacaccgtgataccctaataaagcacaccgcggttattatcaacgtctctgtgtttttatta

SEQ ID NO: 166795 - DNA, 75 bp, Artificial Sequence
  Synthetic
tccttgattcagatggctccatttcgtagtcatcgggtcgtttttgtgttcaatggttacattgtcaccactttt

SEQ ID NO: 166796 - DNA, 75 bp, Artificial Sequence
  Synthetic
ctctggttccgccagaacttggcgcgcatcattaactactcgcagtttgtcgaccacaacctctccagcgagatc

SEQ ID NO: 166797 - DNA, 75 bp, Artificial Sequence
  Synthetic
gcatcattaactactcgcagtttgtcgaccacaacctctccagcgagatcaccaaggaggcgctgcgccccgcgg

SEQ ID NO: 166798 - DNA, 75 bp, Artificial Sequence
  Synthetic
ttcctgctccgttcggaatttcgaaaaatggagtactgacggccgtctccaaagaagccatagccgtttcgggca

SEQ ID NO: 166799 - DNA, 75 bp, Artificial Sequence
  Synthetic
gcaacgacgagacggcgtttttccaggacgatgataccaccaccgcgcccgatagccgtgagacgctgctcacct

SEQ ID NO: 166800 - DNA, 75 bp, Artificial Sequence
  Synthetic
ggacgatgataccaccaccgcgcccgatagccgtgagacgctgctcaccttgcgcattacctacatcaagggcag

SEQ ID NO: 166801 - DNA, 75 bp, Artificial Sequence
  Synthetic
cttgcaaaaggacacgtttattgaacgcacgccctgcgagcaggcggcctacgcctactcgttagtttcgggcct

SEQ ID NO: 166802 - DNA, 75 bp, Artificial Sequence
  Synthetic
gctcttctcggccatgtactacttctacgtgtcgccctacacgaccgaggagatgttgcgtgagctggcgcgcgt

SEQ ID NO: 166803 - DNA, 75 bp, Artificial Sequence
  Synthetic
ccgctcccgcttggagcgggggagagaatccgataaataatcacgtcgacgcggattcttctcagggcggccaga

SEQ ID NO: 166804 - DNA, 75 bp, Artificial Sequence
  Synthetic
gaatccgataaataatcacgtcgacgcggattcttctcagggcggccagagcgtgccggtatctcaacggatgga

SEQ ID NO: 166805 - DNA, 75 bp, Artificial Sequence
  Synthetic
cgaactcatggatcacaccagtctgtacgcggatcccttttttctcaaatacgtcaagccacctagcctggcgct

SEQ ID NO: 166806 - DNA, 75 bp, Artificial Sequence
  Synthetic
tacgcggatcccttttttctcaaatacgtcaagccacctagcctggcgctgctttctttcgaggagacggtgcac

SEQ ID NO: 166807 - DNA, 75 bp, Artificial Sequence
  Synthetic
atgttgctgtgtgacgagacggcgtgtggacgagctatatgtggcaggaggtcgcgtcacctcttgtgacgccta

SEQ ID NO: 166808 - DNA, 75 bp, Artificial Sequence
  Synthetic
acgttgccgctcgttacctacaatcgccgtaacgtggtgttcaaggccaactgtcagatcagctcgcagaccggc

SEQ ID NO: 166809 - DNA, 75 bp, Artificial Sequence
  Synthetic
tccttcgtgggcatgctttcgcatgtgtcgccggcgcagacgtacacgctcgagggctacaccagcgacaacgtg

SEQ ID NO: 166810 - DNA, 75 bp, Artificial Sequence
  Synthetic
gatgcgctcgggttcctctttgtgctcgacgttaacgtttcgcgcttcgtcgagtcggcgcagggcaagagtctg

SEQ ID NO: 166811 - DNA, 75 bp, Artificial Sequence
  Synthetic
tcgacgttaacgtttcgcgcttcgtcgagtcggcgcagggcaagagtctgcacgtgtgcaccaccgtggactacg

SEQ ID NO: 166812 - DNA, 75 bp, Artificial Sequence
  Synthetic
gggaccatcccaagaacctcaagatgagccacatctacgtggccatgtcgcgagtcacggaccccgagcacctca

SEQ ID NO: 166813 - DNA, 75 bp, Artificial Sequence
  Synthetic
aagacaaacgcaccacgcttattttttgacacaacaccgtgtaaggaaaacgtgactttattgagcagggtaaaa

SEQ ID NO: 166814 - DNA, 75 bp, Artificial Sequence
  Synthetic
gggaacacatcgcctatagatagcggcactttacataaaaccaccgtacctgcatcacggtggctcgatacactg

SEQ ID NO: 166815 - DNA, 75 bp, Artificial Sequence
  Synthetic
taatatgtgcagtcgtgtgtcgatgttcctattgggaagggtgtgaatgtaggaggtataaagaatggtgggacg

SEQ ID NO: 166816 - DNA, 75 bp, Artificial Sequence
  Synthetic
ccgtcgtcgcaagccgggttcgaccaagagaaaaaacccgggtgcggggggagacgggtcgtcctttggttgttc

SEQ ID NO: 166817 - DNA, 75 bp, Artificial Sequence
  Synthetic
gagacgggtcgtcctttggttgttcgcggacggcgtacatgccgcgtgggtcagtcgacggcgtcgctccgtgcg

SEQ ID NO: 166818 - DNA, 75 bp, Artificial Sequence
  Synthetic
gcggacggcgtacatgccgcgtgggtcagtcgacggcgtcgctccgtgcggtcggtcatcattctgcttcacata

SEQ ID NO: 166819 - DNA, 75 bp, Artificial Sequence
  Synthetic
caggatgctcggtggcgacgttcattaaatgcattacgtgcctgtattggtatatttgcaagcgtccgggtgccg

SEQ ID NO: 166820 - DNA, 75 bp, Artificial Sequence
  Synthetic
gactgtgagtacgacgaaccacatcatcttttttttatgttgcttctttagaaaatgacttatgtcgacgacact

SEQ ID NO: 166821 - DNA, 75 bp, Artificial Sequence
  Synthetic
gccttataacatgtattttgaaaaattgccaacagctataatttctctcatgtagcagaatagagaccttttgtc

SEQ ID NO: 166822 - DNA, 75 bp, Artificial Sequence
  Synthetic
cgcgcctccggcggcggtgcccgcggaccccggccccttctcgcgtgcgcggtgtgactggttgagcgaatgagc

SEQ ID NO: 166823 - DNA, 75 bp, Artificial Sequence
  Synthetic
ggtgtgactggttgagcgaatgagcagctaggcttggtggtgctccgcgtgcgggggagaagacgattaacaaca

SEQ ID NO: 166824 - DNA, 75 bp, Artificial Sequence
  Synthetic
aaaaataagtggaagtggccggtgggtctttgtccgcgtgcgcgcccatccgtcgccgggaccgagcagaaagtg

SEQ ID NO: 166825 - DNA, 75 bp, Artificial Sequence
  Synthetic
ttgttttcctatgtgagaggagaaaggtatgtgaggagatgttcgatgatcgtatgttacagttatgctgtaagg

SEQ ID NO: 166826 - DNA, 75 bp, Artificial Sequence
  Synthetic
ggtatgtgaggagatgttcgatgatcgtatgttacagttatgctgtaaggaagcttttatcgtgcgtcctgtttt

SEQ ID NO: 166827 - DNA, 75 bp, Artificial Sequence
  Synthetic
gtctttttggctaattggactttgcccatgttggttgtcattcgtggcctgaggtcatcgtcgtccacgacgacg

SEQ ID NO: 166828 - DNA, 75 bp, Artificial Sequence
  Synthetic
ccatgttggttgtcattcgtggcctgaggtcatcgtcgtccacgacgacgtgtctatagcgtgcggtgtgatcat

SEQ ID NO: 166829 - DNA, 75 bp, Artificial Sequence
  Synthetic
ataatcagctggtcgtctttctttgatgtgttgttgtcgtcgaggtcttgcttcgttttcttttttctttttagt

SEQ ID NO: 166830 - DNA, 75 bp, Artificial Sequence
  Synthetic
atgtgttgttgtcgtcgaggtcttgcttcgttttcttttttctttttagtcgatggaacttttcttcggtacggg

SEQ ID NO: 166831 - DNA, 75 bp, Artificial Sequence
  Synthetic
gacagatatcaatcttcttaacttatatcatggtaaattcagaatcctatggtgtcttattatctctaaagtagt

SEQ ID NO: 166832 - DNA, 75 bp, Artificial Sequence
  Synthetic
tatcatggtaaattcagaatcctatggtgtcttattatctctaaagtagtcaacattatggtctaacttgtattt

SEQ ID NO: 166833 - DNA, 75 bp, Artificial Sequence
  Synthetic
cgtgagttaatgaagtataatatcggtcatctatcaacttatctgctatgtaacgtacccttttaggtattttgc

SEQ ID NO: 166834 - DNA, 75 bp, Artificial Sequence
  Synthetic
taacgtacccttttaggtattttgcgtttcttaacgagtgtacccgcctgtgtgaggcgaaactctgagaagtct

SEQ ID NO: 166835 - DNA, 75 bp, Artificial Sequence
  Synthetic
ctgcatggctaaataccgtgaatcccctgacgtcgtctttcgtcccgaacgcgtcatgttgggggcgaggcgtaa

SEQ ID NO: 166836 - DNA, 75 bp, Artificial Sequence
  Synthetic
tacctaattattatcctacatgacgaagctacctcccaacgtaaggtagggggagaggagacagaacaataaaaa

SEQ ID NO: 166837 - DNA, 75 bp, Artificial Sequence
  Synthetic
gggagaggagacagaacaataaaaagtaactaatgtttcttagaacttacccgctaaggacttaccaaactatat

SEQ ID NO: 166838 - DNA, 75 bp, Artificial Sequence
  Synthetic
aaaaaaaaagatgattagctatccagaacctacttacttcttaatgttttaactaaggatgcctatgggattgga

SEQ ID NO: 166839 - DNA, 75 bp, Artificial Sequence
  Synthetic
tgtcatcatcattatcatagtcgtcattctatttttcttcaagattcctcaaagactccgagagaaatgggacac

SEQ ID NO: 166840 - DNA, 75 bp, Artificial Sequence
  Synthetic
aaaaaaatcacagcaacttgctactaatcagttgacagcgaagagactcataacaaagatttctgggtaatacgg

SEQ ID NO: 166841 - DNA, 75 bp, Artificial Sequence
  Synthetic
gacgatataagtgaatcagaattcatagttcgatacaatcctgagcacgaggactaagcaacgtttccggataaa

SEQ ID NO: 166842 - DNA, 75 bp, Artificial Sequence
  Synthetic
gatacttggaaaaaaagaacgggctatgactatagagattcatcgagatatcaaacttcaaataggcggctatca

SEQ ID NO: 166843 - DNA, 75 bp, Artificial Sequence
  Synthetic
tgatagtacgtctatggtggtgatcgattttggttagcaatttgttcgtttaaaggcttaatgtacttatgctac

SEQ ID NO: 166844 - DNA, 75 bp, Artificial Sequence
  Synthetic
gattttggttagcaatttgttcgtttaaaggcttaatgtacttatgctacatgatgtattattctttgattcatc

SEQ ID NO: 166845 - DNA, 75 bp, Artificial Sequence
  Synthetic
ctgctcaccatgatttccgagaacggtaatttgcaagtgacttacgtgcggcattacctgaaaaaccacggcgaa

SEQ ID NO: 166846 - DNA, 75 bp, Artificial Sequence
  Synthetic
gcttcatctatcgtgtctaaagttcacttattctactattactatatatatgcactactatgtaactaggatatg

SEQ ID NO: 166847 - DNA, 75 bp, Artificial Sequence
  Synthetic
gtcctataaggtgtcttctatcacggtggcttgtttattgcttggcggttacgagcaagagttcatcacggacca

SEQ ID NO: 166848 - DNA, 75 bp, Artificial Sequence
  Synthetic
ctgacgagctgcaactacaatccgtaagtctcttcctcgagggccttacagcctatgggaaagtaagacagaggg

SEQ ID NO: 166849 - DNA, 75 bp, Artificial Sequence
  Synthetic
gccgccggccgcggccacggacgcgtagcggttacacaatgtttggttgagcgttttgtttcatcgtcgtggtgg

SEQ ID NO: 166850 - DNA, 75 bp, Artificial Sequence
  Synthetic
tccctggggacacacgaagcacgcctcccaggggccagcgacgcggaaacgacgcggaaaagaggaagtccccag

SEQ ID NO: 166851 - DNA, 75 bp, Artificial Sequence
  Synthetic
tattatcatcattcttgtttccatcatcacgatgagttttctccgttttcctctcctccagtggtagtcgtgtat

SEQ ID NO: 166852 - DNA, 75 bp, Artificial Sequence
  Synthetic
gttgctgctgctgctcttgccttcatggcggtatttctcttcctcccccctaaccccatattaactcgtgagtgt

SEQ ID NO: 166853 - DNA, 75 bp, Artificial Sequence
  Synthetic
tgacgaaacctgcgcacatcgaagaaaagacgagcgcgcgaaccgatagccgtccgtctgggacgaaggagaaga

SEQ ID NO: 166854 - DNA, 75 bp, Artificial Sequence
  Synthetic
aaagacgagcgcgcgaaccgatagccgtccgtctgggacgaaggagaagatgatggggagaggaggagagcccca

SEQ ID NO: 166855 - DNA, 75 bp, Artificial Sequence
  Synthetic
ttgtttggatgcttgattatatcctgttctatggggtagattattatcaataggcttggttttcgaaggtcagcc
